United States Patent 9,328,346 (POLYCOMB-ASSOCIATED NON-CODING RNAS) - sequence listing, part 115

SEQ ID NO: 112357 - RNA, 46 nt, Mus musculus
gauccuguuagagaugguugugagccaccauguaguuguugggaau

SEQ ID NO: 112358 - RNA, 39 nt, Mus musculus
ugccuggauugugcuuauuccauccacaccaggugagag

SEQ ID NO: 112359 - RNA, 45 nt, Mus musculus
acacccucuucuagccucugcugggagcaaaacacacacacacac

SEQ ID NO: 112360 - RNA, 46 nt, Mus musculus
uuugauaauuuuccucauucauagggaaaaacaaaaaacaggaaag

SEQ ID NO: 112361 - RNA, 42 nt, Mus musculus
gguuguggacaaucugaaguggucccauaucccacaccuggg

SEQ ID NO: 112362 - RNA, 46 nt, Mus musculus
ucuuuggagaucucucacugaauuggagaugagauuuggcuguuug

SEQ ID NO: 112363 - RNA, 46 nt, Mus musculus
accagauguuauuuauauuuuauuaaaaaaauuaaguguuuaaaag

SEQ ID NO: 112364 - RNA, 45 nt, Mus musculus
augacaccaauggacugagaaaagcacagaacuauaggcaacuaa

SEQ ID NO: 112365 - RNA, 46 nt, Mus musculus
auugccaauuagacaauaaccaaccagguuaucuccauggugccau

SEQ ID NO: 112366 - RNA, 41 nt, Mus musculus
cguugggggaaagaccaauauuaaaaguaguuacagaugag

SEQ ID NO: 112367 - RNA, 46 nt, Mus musculus
ugaggcaacacaugccugugacaugugugauaaacucugccugccu

SEQ ID NO: 112368 - RNA, 46 nt, Mus musculus
acacuauguccuguguugauguaaaacacaguuuacaccucaaaag

SEQ ID NO: 112369 - RNA, 46 nt, Mus musculus
auaacugacaguagggagagggaacuuacagagcccaccuccagua

SEQ ID NO: 112370 - RNA, 46 nt, Mus musculus
ccacuuacuagugaguauauaccaugcauguccuuuugggucagag

SEQ ID NO: 112371 - RNA, 45 nt, Mus musculus
aucuagguuguuuccagcuucuggcuaucauaaauaaggccgcua

SEQ ID NO: 112372 - RNA, 45 nt, Mus musculus
gcucacaaccaucuguaaugggauucaaugcccucuucugauaug

SEQ ID NO: 112373 - RNA, 46 nt, Mus musculus
auaucaaauauagacaguugaaaaucagaucuggggcuggagagau

SEQ ID NO: 112374 - RNA, 46 nt, Mus musculus
uguuuaggauaaguaaaaagucauaacaaaaaagaugauuaugaaa

SEQ ID NO: 112375 - RNA, 45 nt, Mus musculus
augguuguuagccaccauguagauucugguauuugaacucaugac

SEQ ID NO: 112376 - RNA, 46 nt, Mus musculus
aauaauccucauagaugaugaagaguugucuucagugagaugccau

SEQ ID NO: 112377 - RNA, 46 nt, Mus musculus
ugacuaucuccaagauguuuggagacaguccuaguucucucagcag

SEQ ID NO: 112378 - RNA, 42 nt, Mus musculus
ggaugcagucccaagcuaucugcaucaaccugucagccccag

SEQ ID NO: 112379 - RNA, 46 nt, Mus musculus
auuaaaccaagaaucuguauuguccuuuagaaucucaggguuagga

SEQ ID NO: 112380 - RNA, 45 nt, Mus musculus
cacauucugcaaguguggugugaaguaggugaaagguaaccaucu

SEQ ID NO: 112381 - RNA, 42 nt, Mus musculus
gauuggauugaucaguuugauuuguucuguauuuggccaaac

SEQ ID NO: 112382 - RNA, 46 nt, Mus musculus
cacacaaaaauaauuggagaaugugagagugcuggagagggaccag

SEQ ID NO: 112383 - RNA, 44 nt, Mus musculus
gauaaaaauagauguuuaaaagcaaaugccaaaucuugcggaga

SEQ ID NO: 112384 - RNA, 44 nt, Mus musculus
gcuggggcaguaguuaaaagcuuacauccugauugacacuauga

SEQ ID NO: 112385 - RNA, 46 nt, Mus musculus
ccuggggaaagauaggacuuuuucaguugguuuuacuuguuuuugu

SEQ ID NO: 112386 - RNA, 51 nt, Mus musculus
cacgaugugaugauuuagaagcuuugaaaaagaaggguugccagccaagug

SEQ ID NO: 112387 - RNA, 49 nt, Mus musculus
agaagacauuacucagauccaaccacaacagcugcuucuaaaauugaga

SEQ ID NO: 112388 - RNA, 46 nt, Mus musculus
cacaauuuuuguaagacauauuacuuuuaauaauuuaaugauagag

SEQ ID NO: 112389 - RNA, 42 nt, Mus musculus
aagucagcuacaguguacucauauacauuaaauaaauaagua

SEQ ID NO: 112390 - RNA, 44 nt, Mus musculus
uaggagaaccacagaaguuuacauuaaaauucaagagggcugaa

SEQ ID NO: 112391 - RNA, 50 nt, Mus musculus
gaucuggagaaugugaaaagucuuggaacggauuugaugaaugaaaugag

SEQ ID NO: 112392 - RNA, 46 nt, Mus musculus
auuucauucaucaaauccguuccaagacuuuucacauucuccagau

SEQ ID NO: 112393 - RNA, 46 nt, Mus musculus
cuucacccaaauaaauaaguaaauaucaauuuaaaagugauguaag

SEQ ID NO: 112394 - RNA, 45 nt, Mus musculus
caguuuuguucacuuguacaaggauuucuuagcuuugcugggguu

SEQ ID NO: 112395 - RNA, 50 nt, Mus musculus
aaacugcaccagcccauuuagcuacaaaaaugugcuuagucuuacugaca

SEQ ID NO: 112396 - RNA, 46 nt, Mus musculus
caguuuucuauuuuaauaauaaaaggaaagaacuuucaaagcccug

SEQ ID NO: 112397 - RNA, 46 nt, Mus musculus
gaaauggucuugcuguguggcccagccuauccuugaacuuguagag

SEQ ID NO: 112398 - RNA, 45 nt, Mus musculus
aagcagaggcagccuagaaaauguucuccacacagugacuggggu

SEQ ID NO: 112399 - RNA, 74 nt, Mus musculus
ggguaaaacaauaccaccaaguuucccaucuccagcaaagugaaacccagcauccguggaaaacaccagcaguc

SEQ ID NO: 112400 - RNA, 46 nt, Mus musculus
cugcugguguuuuccacggaugcuggguuucacuuugcuggagaug

SEQ ID NO: 112401 - RNA, 49 nt, Mus musculus
acacacucuggcuuucauugaaagcaaauauaggcaaaucacucagguu

SEQ ID NO: 112402 - RNA, 91 nt, Mus musculus
aucuaguuccaggguuucagauacucucacacagauauacaugcagacaaaauaccaaugaauauaaaaauaaauuauuaaaaaaugccuu

SEQ ID NO: 112403 - RNA, 52 nt, Mus musculus
ugcucaccuuguucagaaacuaagugaaaauaauauucagacgauuuuugca

SEQ ID NO: 112404 - RNA, 46 nt, Mus musculus
ugucuggaaacucuaguaaugugauccagcuaaucaucgaugccua

SEQ ID NO: 112405 - RNA, 46 nt, Mus musculus
ucuuggaauucacuauguagaccaagcuggcuuugaaugcacagag

SEQ ID NO: 112406 - RNA, 84 nt, Mus musculus
agucucuuucuucagaagucauucuggaaaauagcaaauugccagacggaguaacaauaaauuacaaauccuauugcaagaaug

SEQ ID NO: 112407 - RNA, 46 nt, Mus musculus
caauagaaauguuggaacacuuucguccauuuucuccugucccauu

SEQ ID NO: 112408 - RNA, 55 nt, Mus musculus
gggugaaugggacaggagaaaauggacgaaaguguuccaacauuucuauuggaga

SEQ ID NO: 112409 - RNA, 98 nt, Mus musculus
caauuugaaauuagcauaacugcuaauaaauguccaaauaaggagucugaaaccauuaaaauuaaaccucugggcuucacugaagaaguagaggucgu

SEQ ID NO: 112410 - RNA, 100 nt, Mus musculus
ucuucaguucaucuguaagugcaauugucaaagccauggcaucccagccagucccaagugccaugagggaaaugggacauuugaguguggagccugcagg

SEQ ID NO: 112411 - RNA, 45 nt, Mus musculus
gcauaugcaaaaucaguuuauccaguguccaagaacaugcuccaa

SEQ ID NO: 112412 - RNA, 46 nt, Mus musculus
cuccauuguuacugcagauuuccgaacuguucucuuuccugcagua

SEQ ID NO: 112413 - RNA, 74 nt, Mus musculus
gagaacaguucggaaaucugcaguaacaauggagaaugugucuguggacaguguguguguaggaagagagauaa

SEQ ID NO: 112414 - RNA, 79 nt, Mus musculus
uacaaaugaaauuuacucuggaaaauucugcgagugugauaacuucaacugugauaggucuaauggcuuaauuugugga

SEQ ID NO: 112415 - RNA, 59 nt, Mus musculus
ugacuguucuuuggacacugguccaugucuagcgucaaauggucagaucugcaauggcc

SEQ ID NO: 112416 - RNA, 59 nt, Mus musculus
gggguauuugugaauguggugcuuguaagugcacagaucccaaguuucaagggccaacu

SEQ ID NO: 112417 - RNA, 74 nt, Mus musculus
cgugugcacaggagugcucccacuucaaucucaccaaaguagaaagcagggagaaguugccccagccggugcag

SEQ ID NO: 112418 - RNA, 96 nt, Mus musculus
gucgauccugugacccauugcaaggagaaggacauugaugacugcugguucuauuucaccuauucagugaauggcaacaaugaagcuaucgugcau

SEQ ID NO: 112419 - RNA, 49 nt, Mus musculus
ggcaaggccaauaagaacaauuccagcaaccacgccugcuacaauuggg

SEQ ID NO: 112420 - RNA, 67 nt, Mus musculus
ugcugcugauuuggaaacuuuuaaugauaauucaugacagaagggaauuugcuaaauuugaaaagga

SEQ ID NO: 112421 - RNA, 45 nt, Mus musculus
uauucuuguuuuauagaagagaagacugaggcagaaaaacagcua

SEQ ID NO: 112422 - RNA, 45 nt, Mus musculus
agcuguuugcaugaagcaggaaauagaagguaggauauuugggag

SEQ ID NO: 112423 - RNA, 45 nt, Mus musculus
ucuuaugaauauuauaguagaaaugaacaauacaaaugaaugaga

SEQ ID NO: 112424 - RNA, 45 nt, Mus musculus
ccucacauauauaaguacacauacauaaguaauuuacagccacca

SEQ ID NO: 112425 - RNA, 46 nt, Mus musculus
gguuuacagcauccuucauucagcauucauucauacagcauucauu

SEQ ID NO: 112426 - RNA, 46 nt, Mus musculus
augacagaaacuaaccagcauuccaccacagacccuuugugcgcag

SEQ ID NO: 112427 - RNA, 46 nt, Mus musculus
ugaaauugaaaaauauauucugagguacugggaauggagcagagac

SEQ ID NO: 112428 - RNA, 75 nt, Mus musculus
uuagggugaaaauccuauuuacaagagugccgugacaacuguggucaauccgaaguaugagggaaaaugaauccu

SEQ ID NO: 112429 - RNA, 99 nt, Mus musculus
acucaggcggauuuugcaacaccaagcucacagcagcagcaucuuagucacaguaggguaguuuuggggcucuguggccaggguuuuauucacaugcag

SEQ ID NO: 112430 - RNA, 42 nt, Mus musculus
cauuuuccaaaccugcaugugaauaaaacccuggccacagag

SEQ ID NO: 112431 - RNA, 44 nt, Mus musculus
auuuuuuauuauuuugaaaauaauguuauaauccaugccaggga

SEQ ID NO: 112432 - RNA, 68 nt, Mus musculus
cccuuccuucuggaccauuggaaucaagcucucacuagauugaaugacacugcuagugccaaugcagg

SEQ ID NO: 112433 - RNA, 47 nt, Mus musculus
uguuuagccugcuggcugcccucugggaauucccagugauguaugug

SEQ ID NO: 112434 - RNA, 51 nt, Mus musculus
aauaaaauugacacaguugauguucaaguccauuggaaaaauucugagagg

SEQ ID NO: 112435 - RNA, 44 nt, Mus musculus
ugcuaaaaagucccugacuuagcacuauucacauaaaggccaua

SEQ ID NO: 112436 - RNA, 62 nt, Mus musculus
uucucuaaucuuuuaaugugucuguuugcaauauggggguuagacuuuuuaucauuaccuuu

SEQ ID NO: 112437 - RNA, 48 nt, Mus musculus
agugcaccugcacaugccuuuccuacaugcuugcucugucucgaacua

SEQ ID NO: 112438 - RNA, 46 nt, Mus musculus
gacagugcuauuaacugaaguuauuuauuaaaauaaaaaggccuaa

SEQ ID NO: 112439 - RNA, 46 nt, Mus musculus
gcauuuugugaguuauaauaagccuauguagucuuuggaagcagaa

SEQ ID NO: 112440 - RNA, 45 nt, Mus musculus
cauaacaaggccacuuccaugaccagaaggcucuuuccuguaugu

SEQ ID NO: 112441 - RNA, 46 nt, Mus musculus
ggcuggcgauugacaaagcagcugggaggugaacauuucuggugag

SEQ ID NO: 112442 - RNA, 48 nt, Mus musculus
gggauacucacucgguggguguuacggaaaucgcugaagauggcugcc

SEQ ID NO: 112443 - RNA, 46 nt, Mus musculus
ggcuucccccauugaucgcuagguuuggaaaugccuuagagcugga

SEQ ID NO: 112444 - RNA, 46 nt, Mus musculus
aagaucaaagagagcaucaagugcuguggagcuguaguuauggaug

SEQ ID NO: 112445 - RNA, 26 nt, Mus musculus
cuugugucucagcucccccaggccag

SEQ ID NO: 112446 - RNA, 44 nt, Mus musculus
gaaacccugucucaaaaaaaccaaaagaaaagaaaagaagagaa

SEQ ID NO: 112447 - RNA, 45 nt, Mus musculus
aaaaaaaaaaaaaaaacaaaacaaaacaaaaaaaaaaaacaaaaa

SEQ ID NO: 112448 - RNA, 45 nt, Mus musculus
uuaacuaacauuuacuuaacaguuaauauccauuuaugaugggua

SEQ ID NO: 112449 - RNA, 48 nt, Mus musculus
cauauugcccuggcuguuacuaauuguguucuuaaucugguggcaucu

SEQ ID NO: 112450 - RNA, 52 nt, Mus musculus
cuguuguugcucuagaguugacccugagaauuugauuggagaagcagaguac

SEQ ID NO: 112451 - RNA, 44 nt, Mus musculus
ugaagguugcuguuggcauuacugauugauuguguauguguaag

SEQ ID NO: 112452 - RNA, 46 nt, Mus musculus
ggagagacaagcuagguuucuuauacaaauguuucuuuguugggga

SEQ ID NO: 112453 - RNA, 47 nt, Mus musculus
uaguagaguuccugaaagcuuugccaagugguuccauaguggcagau

SEQ ID NO: 112454 - RNA, 46 nt, Mus musculus
auauagagauauaaucgggguacuguaggcaaaaucuugcuagcau

SEQ ID NO: 112455 - RNA, 46 nt, Mus musculus
uauucuuuugugauuggguuaccuuacucaggaugauauucuccag

SEQ ID NO: 112456 - RNA, 46 nt, Mus musculus
uccaucucuuguauucuguugcugaugcucgcaucuauggguccug

SEQ ID NO: 112457 - RNA, 42 nt, Mus musculus
caacauaaacacaucacauguacacacauaacacauacacaa

SEQ ID NO: 112458 - RNA, 46 nt, Mus musculus
auaaaacaaaaaacaacaaacaacacaaaaacgugauuugaacuau

SEQ ID NO: 112459 - RNA, 46 nt, Mus musculus
uuuugguaagaaaaucugaauucuuuauuuuuagcagaacugcaag

SEQ ID NO: 112460 - RNA, 45 nt, Mus musculus
aauuguuaguucaguacuuuguuguuuguaaggcuaggcuguggg

SEQ ID NO: 112461 - RNA, 45 nt, Mus musculus
ccucauuuaugucugggcaauggaacaagaguauaaaaaucagaa

SEQ ID NO: 112462 - RNA, 45 nt, Mus musculus
augaagacccagcauugucugucaacuccaguaguaucaccaagg

SEQ ID NO: 112463 - RNA, 46 nt, Mus musculus
auuuuucucuauucccguugucugacuucauaaacguagguuccuc

SEQ ID NO: 112464 - RNA, 54 nt, Mus musculus
ugaagauaaacuuuuguguuaaaaucuuuuuauaacuccaacuuuuguaggguc

SEQ ID NO: 112465 - RNA, 46 nt, Mus musculus
gccaggacuacacagagaaacccugucucuaaaaaaccaaaccaaa

SEQ ID NO: 112466 - RNA, 42 nt, Mus musculus
cgacugcaguugcaggugggugagcugugcgguuugagggag

SEQ ID NO: 112467 - RNA, 44 nt, Mus musculus
uuauccuggauaaggaguagaaaauuacaguggugccuagggga

SEQ ID NO: 112468 - RNA, 87 nt, Mus musculus
ucaauuccaagcaaccacaugacggcuuacaaccaucuacccugggaucugaugaugcccucuucuggcaugcagguguacauacag

SEQ ID NO: 112469 - RNA, 53 nt, Mus musculus
cucuaaauguuccaacaaauaaccuucuuucaacuuaugucacuuaugagcua

SEQ ID NO: 112470 - RNA, 46 nt, Mus musculus
cuucuguggacaguaauggcuaccucuaacuuuuuaaaaccaaaag

SEQ ID NO: 112471 - RNA, 75 nt, Mus musculus
gaccuugugcaaaguacuuauuuccccaucuauaaaauagagauaauaauaguuuuugauuuguauaaguagcua

SEQ ID NO: 112472 - RNA, 44 nt, Mus musculus
gaaguagcagcacuagauaauaaacacaaaaagaaagaaaauau

SEQ ID NO: 112473 - RNA, 41 nt, Mus musculus
uaaagggagacuagccaaagauaagagaauagagagaguga

SEQ ID NO: 112474 - RNA, 42 nt, Mus musculus
cgaugucaaacaucagaugacuccaaccacagcugccugcaa

SEQ ID NO: 112475 - RNA, 45 nt, Mus musculus
caaguagacaaggugcuggcacaggagccagauuucuaaacccag

SEQ ID NO: 112476 - RNA, 23 nt, Mus musculus
auucauuaugggggauugugaca

SEQ ID NO: 112477 - RNA, 46 nt, Mus musculus
augaaagaagaaauaaucccaugucaucguuguguguuggcugcau

SEQ ID NO: 112478 - RNA, 46 nt, Mus musculus
uguuauaucuugguccucagguaauaauaugcccaauuuucugaag

SEQ ID NO: 112479 - RNA, 45 nt, Mus musculus
gaugagguaccagugcccaacuggcucagacuggaaagaacccaa

SEQ ID NO: 112480 - RNA, 42 nt, Mus musculus
cuaugauccugggaauguuagagcaccuaggacuaaagcauc

SEQ ID NO: 112481 - RNA, 46 nt, Mus musculus
agaaacugucuaauuaggcuuacagucucagaagguuagaaaucag

SEQ ID NO: 112482 - RNA, 44 nt, Mus musculus
gagauuacagaugaagugcaggucuaccacaguaguaggucaga

SEQ ID NO: 112483 - RNA, 48 nt, Mus musculus
gaaccuacugaaggugguacagagcugugggaagucaaugaaaaugaa

SEQ ID NO: 112484 - RNA, 48 nt, Mus musculus
gaaauaccuagaaaacuacuauggccuugcaaaagaugugaagcaauu

SEQ ID NO: 112485 - RNA, 48 nt, Mus musculus
ggaagcuggacuccaacacuauggagcugaugcauaagcccaggugug

SEQ ID NO: 112486 - RNA, 42 nt, Mus musculus
auccaggauugugaauuauacaccggauuugccaagacagag

SEQ ID NO: 112487 - RNA, 65 nt, Mus musculus
gaccccacucacuuucuccaggaucucugaaggagaggcugacauaaugaucuccuuugcaguug

SEQ ID NO: 112488 - RNA, 80 nt, Mus musculus
uggaacagucuuggcucaugccuaugcaccuggaccagggauuaauggagaugcucacuuugacgaugaugaacgaugga

SEQ ID NO: 112489 - RNA, 54 nt, Mus musculus
guccuccacagacuugucccguuuccaucucucucaagaugauguagaugguau

SEQ ID NO: 112490 - RNA, 50 nt, Mus musculus
accaaugugcagcucuacuuuguucuuugaugcagucagcacccuccggg

SEQ ID NO: 112491 - RNA, 69 nt, Mus musculus
ccugagccugaauuuuauuugaucucuucauuuuggccaucucuuccauccaacauggaugcugcauau

SEQ ID NO: 112492 - RNA, 105 nt, Mus musculus
uaaaagcauucacacccugggucucccugcaaccgugaagaagaucgaugcugccauuucuaauaaagagaaaaggaagaccuacuucuuuguagaggacaaaua

SEQ ID NO: 112493 - RNA, 48 nt, Mus musculus
gaugagaagaaacaauccauggagccaggauuucccaggaagauagcu

SEQ ID NO: 112494 - RNA, 84 nt, Mus musculus
ucuucgcaguuggaauuugacccaaaugccaaaaaagugacccacauauugaagagcaauagcugguuuaauuguuaaaaagag

SEQ ID NO: 112495 - RNA, 77 nt, Mus musculus
ccuguguuuuaacugaugcuuauaguucuucaucugagucuuugugaaaggaagugcuuuguucagcaugugcuaug

SEQ ID NO: 112496 - RNA, 48 nt, Mus musculus
agggaaggcacuccugggccacaaacaagugucugaacuguguagaug

SEQ ID NO: 112497 - RNA, 41 nt, Mus musculus
uaccaaucugcucagcguauccucugcauggggcagugaca

SEQ ID NO: 112498 - RNA, 62 nt, Mus musculus
aagaaaggacaguaguccuguugucaaaaaaauucaagaaaugcagaaguuccucggguugg

SEQ ID NO: 112499 - RNA, 56 nt, Mus musculus
agaugacagggaagcuggacuccaacacuauggagcugaugcacaagcccaggugu

SEQ ID NO: 112500 - RNA, 42 nt, Mus musculus
auccaggauugugaauuauacaccagauuugccaagacagag

SEQ ID NO: 112501 - RNA, 65 nt, Mus musculus; identical to SEQ ID NO: 112487

SEQ ID NO: 112502 - RNA, 70 nt, Mus musculus
cugggucucuuucauuccgacaagaaagaaucucugauguacccagucuacagguucuccacaagcccag

SEQ ID NO: 112503 - RNA, 47 nt, Mus musculus
gcucucgugugcacuugugugugugugugugugugugugugugagag

SEQ ID NO: 112504 - RNA, 46 nt, Mus musculus
ccacagugguuccuguguugucugucucuccaagaccugagacccc

SEQ ID NO: 112505 - RNA, 46 nt, Mus musculus
aaucccgagccugaauuucauuugauaucagcauuuuggcccacuc

SEQ ID NO: 112506 - RNA, 47 nt, Mus musculus
gaaaaggagaagaagaaaacguacuucuuuguaggggacaaauacug

SEQ ID NO: 112507 - RNA, 80 nt, Mus musculus
agauuugaugagacaagacauguuauggauaaaggcuucccaagacagauaacagaugauuuuccaggaauugagccaca

SEQ ID NO: 112508 - RNA, 46 nt, Mus musculus
uccgaggaucaucacaguucgaguuugaccccaaugccaggacggu

SEQ ID NO: 112509 - RNA, 47 nt, Mus musculus
ugauuaguugcuccugcauguucuguggcuccggaugagcgcagcag

SEQ ID NO: 112510 - RNA, 25 nt, Mus musculus
cuuugccgaccacgcccuggccccg

SEQ ID NO: 112511 - RNA, 23 nt, Mus musculus
guaccagaauagcuggggcugua

SEQ ID NO: 112512 - RNA, 53 nt, Mus musculus
auucacauaaacuaaaugggucucucauuuacuucaagcucacaguuccuucu

SEQ ID NO: 112513 - RNA, 46 nt, Mus musculus
cuggugacucugccacaugggccugaacucuuccucagggccccca

SEQ ID NO: 112514 - RNA, 46 nt, Mus musculus
gaagguuagagggcuccugcuauguuccaaguuaaaucuucaguau

SEQ ID NO: 112515 - RNA, 93 nt, Mus musculus
agcugauauaacaaccucagccucagcugagguucccuccucccagaugacugaagcuugugucaaauugacagaaaacaguaaccaggacag

SEQ ID NO: 112516 - RNA, 46 nt, Mus musculus
cucugcaccauccuggcuguuucuaaaugcaucucucucucaucag

SEQ ID NO: 112517 - RNA, 41 nt, Mus musculus
uucuuaucagcagauaacgugagcucaguucccagccccca

SEQ ID NO: 112518 - RNA, 45 nt, Mus musculus
auauacuggcaucugaagauugcugguaaugugugauguccauag

SEQ ID NO: 112519 - RNA, 45 nt, Mus musculus
auacaacaucucaucacaggcuccccaccucuaacucucaccaga

SEQ ID NO: 112520 - RNA, 46 nt, Mus musculus
ugcagucucucugagucuuuccucucagcugggcagcacaggguag

SEQ ID NO: 112521 - RNA, 33 nt, Mus musculus
gcucuaaggcaauccauccuucaccuuuccagc

SEQ ID NO: 112522 - RNA, 45 nt, Mus musculus
agggacaugccuagccucagccauuuuccuuacucacaucaggag

SEQ ID NO: 112523 - RNA, 46 nt, Mus musculus
uaaaggcacagagacguaauuggacauagauaaaaacugcuaggau

SEQ ID NO: 112524 - RNA, 46 nt, Mus musculus
ggugugaccaaguaggaguccccucucgggugacugacauggccag

SEQ ID NO: 112525 - RNA, 41 nt, Mus musculus
gacuucgaagcucugcuccuggggcagaacuaaucggguag

SEQ ID NO: 112526 - RNA, 49 nt, Mus musculus
caagugcuucuccaaacucuacccacacgucagcauccaugacaacccc

SEQ ID NO: 112527 - RNA, 46 nt, Mus musculus
acuuucuuuuuuccuauacugugaauuagcuguuaaaugccacgug

SEQ ID NO: 112528 - RNA, 46 nt, Mus musculus
uguaaguugggccauuuugcauacuuuaucaugaccaauaccauag

SEQ ID NO: 112529 - RNA, 46 nt, Mus musculus
aauuuuuuaauugaaucagaaaugccauuuuuaaaaagcuccguga

SEQ ID NO: 112530 - RNA, 52 nt, Mus musculus
cacaacagaguuacacaggugauucccuugcugagccagcagagcaaacgca

SEQ ID NO: 112531 - RNA, 45 nt, Mus musculus
gcaugucccaggugcucugguauuccaugauacuaauaugugaga

SEQ ID NO: 112532 - RNA, 46 nt, Mus musculus
aaaaucaagauuuugaaaagcacuaagaguuacugggcacaucuuu

SEQ ID NO: 112533 - RNA, 46 nt, Mus musculus
gggauugaacuuggguugucaggccuguguauguuuagcccccuga

SEQ ID NO: 112534 - RNA, 46 nt, Mus musculus
gcuaucucuuuaucgggcuaugguagggugcuuuucaacaguuaaa

SEQ ID NO: 112535 - RNA, 46 nt, Mus musculus
caaacauuuaaaacacauauuacauguuuaauuuaaccuggaaguc

SEQ ID NO: 112536 - RNA, 55 nt, Mus musculus
ucauguuaucugcuucucugcccauuuuagucuuccauuucacccacagccggcc

SEQ ID NO: 112537 - RNA, 45 nt, Mus musculus
gacuucucauuagacaauucacuagucuuauauuuaagugcagau

SEQ ID NO: 112538 - RNA, 45 nt, Mus musculus
uucuguauaauaaaagggggaaaaaucaaauugugagcuugggag

SEQ ID NO: 112539 - RNA, 46 nt, Mus musculus
aguauguugauggaguucccuuguaauguaaucuaugcccccacca

SEQ ID NO: 112540 - RNA, 42 nt, Mus musculus
guggaaucagacuagugaguagcuggaauuccaacgccagag

SEQ ID NO: 112541 - RNA, 42 nt, Mus musculus
cagccugcgaggccaucacuuccuggugucucuuugggccag

SEQ ID NO: 112542 - RNA, 46 nt, Mus musculus
gagggguaaguauguagagguggcugugugugugugugugugugug

SEQ ID NO: 112543 - RNA, 45 nt, Mus musculus
gagcggaggaaggggaggcugugguagggauguaguguaugagag

SEQ ID NO: 112544 - RNA, 42 nt, Mus musculus
cucuuuucugaagggaaauggaggagcaguggaucugggagg

SEQ ID NO: 112545 - RNA, 45 nt, Mus musculus
ugacugaucacugaugaccucaaacugcacagggcggucacccau

SEQ ID NO: 112546 - RNA, 44 nt, Mus musculus
caacacuggggaaagggaacuggaagaguccaccuccaguagau

SEQ ID NO: 112547 - RNA, 46 nt, Mus musculus
ccuaagccguacagagcgaguuuugugcuuccuuucugcagcagaa

SEQ ID NO: 112548 - RNA, 46 nt, Mus musculus
uacuuuuuuauucacaaacauccgauagagccuuucaucuggaaug

SEQ ID NO: 112549 - RNA, 45 nt, Mus musculus
auaauacacacacacacacacacacacacagagagagagagagag

SEQ ID NO: 112550 - RNA, 28 nt, Mus musculus
gagaagggagagaaauuaaucugucugu

SEQ ID NO: 112551 - RNA, 45 nt, Mus musculus
gccuacuuaagccauuuaaaaaaaagaaagaaagaaagaaagaaa

SEQ ID NO: 112552 - RNA, 41 nt, Mus musculus
ucaacucuuugauaacacugugggugccuaccggagccugu

SEQ ID NO: 112553 - RNA, 46 nt, Mus musculus
ugggcuaaaggacauuuucuuaguuacugguagggauggcccagcc

SEQ ID NO: 112554 - RNA, 50 nt, Mus musculus
aaaaccugucuuaaaaaagagagagagagagaaagagagagagagaagag

SEQ ID NO: 112555 - RNA, 42 nt, Mus musculus
uguuaaagccagaggcuuagaaugaaaagauggcuaagagac

SEQ ID NO: 112556 - RNA, 41 nt, Mus musculus
acagacuccugugugugagugccugaaccacacggagcggc

SEQ ID NO: 112557 - RNA, 45 nt, Mus musculus
agaaucacaggguuccagaaagaacaagugacaggcagggggaga

SEQ ID NO: 112558 - RNA, 88 nt, Mus musculus
acagcagacauaaggcaaguuauaaagcggucugauagcaggagaccagggacuccucaagcucuaacaggaccacuggcaucaagag

SEQ ID NO: 112559 - RNA, 44 nt, Mus musculus
uaauucuuaggggcuacauuucuagaaggcuguugucggguaga

SEQ ID NO: 112560 - RNA, 40 nt, Mus musculus
cccuugauggguaugugcuauguuuucaccuacuaaacug

SEQ ID NO: 112561 - RNA, 46 nt, Mus musculus
augucguaauaguugauguagacccgguccgggcugaugugcaggc

SEQ ID NO: 112562 - RNA, 52 nt, Mus musculus
gugcacugcgauguacugugcgggcuugccgguggccugcgccagcugcugg

SEQ ID NO: 112563 - RNA, 41 nt, Mus musculus
aagucagcugcuccugcuguuucuuuaaaaaucacccaaga

SEQ ID NO: 112564 - RNA, 46 nt, Mus musculus
gaguacuuuggaaugaaaaauguauguacaguuauaguaugcagua

SEQ ID NO: 112565 - RNA, 45 nt, Mus musculus
ugguuuccuccauaguucguaacggaccugagaguggcagcaaga

SEQ ID NO: 112566 - RNA, 46 nt, Mus musculus
guuuucagugugcaguuuuagcgaggaaaugaacauaagaucagau

SEQ ID NO: 112567 - RNA, 46 nt, Mus musculus
gggugugcuaggacacaccacuaaucucagagcuuaggagguggag

SEQ ID NO: 112568 - RNA, 45 nt, Mus musculus
ugcaaccauugacagcuuggcaagucgcauugaggacccccagau

SEQ ID NO: 112569 - RNA, 45 nt, Mus musculus
gccuucccaggagugaucugcccuauuugaccuuucagggaagag

SEQ ID NO: 112570 - RNA, 46 nt, Mus musculus
aaggcucuugccagcacccuggagggguagggggaggcagaagaaa

SEQ ID NO: 112571 - RNA, 45 nt, Mus musculus
guccucaagcuuuugauaaaaaugaaauuaauucaauacagucca

SEQ ID NO: 112572 - RNA, 46 nt, Mus musculus
uuuaagauucuguguuuguaaaacccauugagcgcuguccccaguc

SEQ ID NO: 112573 - RNA, 46 nt, Mus musculus
uacuguccucuggauguccaaauuccuagugauuuagaggggucug

SEQ ID NO: 112574 - RNA, 46 nt, Mus musculus
aauuaagggcaagugcuuaauuguucuuuggguugauccuuugaga

SEQ ID NO: 112575 - RNA, 70 nt, Mus musculus
uuccuugucaggcuguuacuaaaacacaaucuggggucagugucccagcacugauaugagucccacuaca

SEQ ID NO: 112576 - RNA, 45 nt, Mus musculus
accucggccucucccaacagcgacccggagccucgugcggccugc

SEQ ID NO: 112577 - RNA, 45 nt, Mus musculus
cccccccaaaaaagaaaugaauagaauacugucaauggacuaaga

SEQ ID NO: 112578 - RNA, 46 nt, Mus musculus
ugucaauggccgggcgugguggcgcacgccuuuaaucccagcacuc

SEQ ID NO: 112579 - RNA, 46 nt, Mus musculus
uauaggugaaggagcacacugaguuuuaaauaagcugccaucagag

SEQ ID NO: 112580 - RNA, 46 nt, Mus musculus
cccuuccugggacuucuaaaagugggccuuaaaugguaccauaccu

SEQ ID NO: 112581 - RNA, 46 nt, Mus musculus
agaggcuaaauaaacaauggcuugccguucaucaaaaggaccagau

SEQ ID NO: 112582 - RNA, 46 nt, Mus musculus; identical to SEQ ID NO: 67509

SEQ ID NO: 112583 - RNA, 46 nt, Mus musculus
cuugcucugcagaugagcaaaagggcgaggcuggggucuugaaucu

SEQ ID NO: 112584 - RNA, 46 nt, Mus musculus
uucaaaucaucucuuccuccucauagucauaguggcugcgacagac

SEQ ID NO: 112585 - RNA, 42 nt, Mus musculus
agagaucaagcuagacacaggugaauacagaaugagccaaga

SEQ ID NO: 112586 - RNA, 42 nt, Mus musculus
auagcaaauguuuuucugagaacuuacaugcgaccuggagau

SEQ ID NO: 112587 - RNA, 56 nt, Mus musculus
accuuucauucaaaguacaaauugaaauaaaacacuagaaacuccagacccaaaau

SEQ ID NO: 112588 - RNA, 42 nt, Mus musculus
cuucagggcacuaauuauuuugcuaauauuaccagccuaauu

SEQ ID NO: 112589 - RNA, 72 nt, Mus musculus
auagcuacaucagguaguuuacaagaagcauuuaugacaagacagacacuuacagaacgaucuuaccagagg

SEQ ID NO: 112590 - RNA, 42 nt, Mus musculus
gcuugagaacauuaucaacucauguugggaugaaagccacgc

SEQ ID NO: 112591 - RNA, 48 nt, Mus musculus
gccagacuuuaaauuuuaaaaguaauaaaaauaaacaugagacuggga

SEQ ID NO: 112592 - RNA, 54 nt, Mus musculus
caucagcaucacugaaacagaucuugcaaacuuaacccuugaagacagagaaga

SEQ ID NO: 112593 - RNA, 46 nt, Mus musculus
gcuucugccucccgagugcugggaucaaaggcgugcgccaccaugc

SEQ ID NO: 112594 - RNA, 46 nt, Mus musculus
ucaaaaacacuuuugggucaauaauaaguucauuugaguuguaggu

SEQ ID NO: 112595 - RNA, 46 nt, Mus musculus
aauuguaaauagaaaccgaccugaaaccuccagucugaacucagau

SEQ ID NO: 112596 - RNA, 120 nt, Mus musculus
cuaugauuuuacauucuaaaaguagaauguaaaaauagcaauuagaauggggacuagaaauguuaauacauuaauaaaaugcaucugaacuucugggaacaagcuuuuaagucuuacaca

SEQ ID NO: 112597 - RNA, 47 nt, Mus musculus
gucaucucuccagcccuuaugaaaaguuuuauagcaucugcagaugg

SEQ ID NO: 112598 - RNA, 46 nt, Mus musculus
ccgaucucauuauggaugguugugagccaccauguuguuucuggga

SEQ ID NO: 112599 - RNA, 45 nt, Mus musculus
aauaauggcuauuguuauuucuuacgagauuguuuggacuauaau

SEQ ID NO: 112600 - RNA, 45 nt, Mus musculus
uauggcucaggcugguguaauaagucauauguguucuuggguggc

SEQ ID NO: 112601 - RNA, 42 nt, Mus musculus
aaagccuagaagagggggaugccucuccuagggauagcagaa

SEQ ID NO: 112602 - RNA, 41 nt, Mus musculus
gggaaaauaaaguuguguuugaaguuuaugugguggguaau

SEQ ID NO: 112603 - RNA, 45 nt, Mus musculus
augaauugcaaauuugaaguuguagagaaauuacuaaggcuucuc

SEQ ID NO: 112604 - RNA, 49 nt, Mus musculus
agaguucauccuguuccugcuccuacuaacgaugcugggaaaagaagga

SEQ ID NO: 112605 - RNA, 46 nt, Mus musculus
guaaggagaaaauugucagaucuacugcuguucuugcaugggcuaa

SEQ ID NO: 112606 - RNA, 47 nt, Mus musculus
uuugauauugaguuauagugguggcuuuauauuaauaauggcaguaa

SEQ ID NO: 112607 - RNA, 47 nt, Mus musculus
acucauuuucuaucaaauuuuguucagagguuuaggaggcuguacag

SEQ ID NO: 112608 - RNA, 46 nt, Mus musculus
aauuagcuccucucuauuuucaucccagguagcacugcccauugcc

SEQ ID NO: 112609 - RNA, 46 nt, Mus musculus
ucuacugagaaagcccaagaaggguugguguuucccagaccauguc

SEQ ID NO: 112610 - RNA, 46 nt, Mus musculus
gccaucauccacucuagacaagaagcucaugaagaaacacuaagag

SEQ ID NO: 112611 - RNA, 46 nt, Mus musculus
aagugauaggacagaccccuuaaggcauuuuaagauuccagcguuu

SEQ ID NO: 112612 - RNA, 118 nt, Mus musculus
uauccacuuuaaagugauagucuuugucagccuuuaguucacagccaaaaagguaguucugaggccuaagaggacucauguccacauccaucgagucuuccaugagguggaggcgcgc

SEQ ID NO: 112613 - RNA, 44 nt, Mus musculus
uagcuacuagaugcuguccacuaaugugcacaggcccugaacca

SEQ ID NO: 112614 - RNA, 45 nt, Mus musculus
uuuuacuuuuuucuguggaaccuuguuaccaccuccaggagcaga

SEQ ID NO: 112615 - RNA, 42 nt, Mus musculus
ccauuuugguuugauuuuugugcauuuuuggcugggguaucu

SEQ ID NO: 112616 - RNA, 46 nt, Mus musculus
cuguuuaaauccuuuucuuaaagagacuuccuccacugccagagau

SEQ ID NO: 112617 - RNA, 46 nt, Mus musculus
uauaaagaggugcacacuauuagacuucuuguugcguuugaguacu

SEQ ID NO: 112618 - RNA, 66 nt, Mus musculus
ugggugaaaccagaggugugaaugaaucucauuauugaguggaguauuuaugcagauaacugggcu

SEQ ID NO: 112619 - RNA, 47 nt, Mus musculus
auacucauuauauaacugaaccacacugaaguauuucaucacagacu

SEQ ID NO: 112620 - RNA, 49 nt, Mus musculus
ucuugguacacaaguaaacugguagcuucuuucaaaaugagacugggac

SEQ ID NO: 112621 - RNA, 46 nt, Mus musculus
cauauucuacuucaguacugaauacauugaugcauuguagccugag

SEQ ID NO: 112622 - RNA, 51 nt, Mus musculus
gacagucaucaauuuggggcacauacaucaagggaacaccagucagccgac

SEQ ID NO: 112623 - RNA, 45 nt, Mus musculus
gccaaguaaauugguugaaugaguggcaguugauaacacuggauu

SEQ ID NO: 112624 - RNA, 46 nt, Mus musculus
uucaaggaguacagugauagauguuucacuuguaagaagcugccag

SEQ ID NO: 112625 - RNA, 46 nt, Mus musculus
uauaagaacaaaauaaauuaaaacuuuuauucuguaaugaggagag

SEQ ID NO: 112626 - RNA, 42 nt, Mus musculus
uucccagcaaccacauggugggucacaaccauccguaacgag

SEQ ID NO: 112627 - RNA, 41 nt, Mus musculus
cauccuuccaaaacucuccuucuucaaagucuucuugguga

SEQ ID NO: 112628 - RNA, 52 nt, Mus musculus
aucauuucaguguuuuagaugagaaaaauaaauuuucauaaauuauuugggu

SEQ ID NO: 112629 - RNA, 46 nt, Mus musculus
uaacuuugaauuccugaucuuccugccuucaaauacaagugguaag

SEQ ID NO: 112630 - RNA, 57 nt, Mus musculus
ggaacuaucugaauuaaaacccaaauuucaggagcacaucauucaagccccuaagcc

SEQ ID NO: 112631 - RNA, 42 nt, Mus musculus
agaaccacuauauuauuaauggguuuacuccuguaaggcaag

SEQ ID NO: 112632 - RNA, 46 nt, Mus musculus
uacuuuggucuauugaugauaagacuucaaaauucucuagcccaga

SEQ ID NO: 112633 - RNA, 45 nt, Mus musculus
agcacuugauaaacuuaaacugucaucugggagugaagaagauaa

SEQ ID NO: 112634 - RNA, 47 nt, Mus musculus
aaggaauuugagaagaaugguaguaauuagaaaguuguacccaggag

SEQ ID NO: 112635 - RNA, 44 nt, Mus musculus
gguggcaauacuaaguucagauucuaacauauauacuuaaggag

SEQ ID NO: 112636 - RNA, 46 nt, Mus musculus
ucuuauauauaaauugccuaccuuucuguuugcuuucuuuccagag

SEQ ID NO: 112637 - RNA, 42 nt, Mus musculus
cuguguauaucauucuggaguaccuauuuuccacgaggggua

SEQ ID NO: 112638 - RNA, 46 nt, Mus musculus
uuuaaguaaucguggugauucugcagugugaucuuauuuggacuug

SEQ ID NO: 112639 - RNA, 53 nt, Mus musculus
uacauucuuagcccaagagggcuguacaagagggaagcauguauggacuaaaa

SEQ ID NO: 112640 - RNA, 46 nt, Mus musculus
uuauaguuuacugaccauaaaacuugcagaaauguuuuacuagcag

SEQ ID NO: 112641 - RNA, 45 nt, Mus musculus
guuguuagcuuacaaugugugugugugugugugugugugugugug

SEQ ID NO: 112642 - RNA, 46 nt, Mus musculus
uucaguuguggggucugugcucaguccuccagcauuagggcugcag

SEQ ID NO: 112643 - RNA, 46 nt, Mus musculus
caugcagugggcaagucuugaacuaccuacaaccaaaaagcaggag

SEQ ID NO: 112644 - RNA, 45 nt, Mus musculus
caagucuccucacuagaacuauaguuguugcccuuacacuugaag

SEQ ID NO: 112645 - RNA, 45 nt, Mus musculus
uauaauugcaguauuuuuuaguauaaauuauuauaagcaggaagu

SEQ ID NO: 112646 - RNA, 44 nt, Mus musculus
aacagugguggugcugaagcagauaucagugaaggacagguuug

SEQ ID NO: 112647 - RNA, 44 nt, Mus musculus
gacaguuguagagaugaaaccaaugucagaaaaggacagguuag

SEQ ID NO: 112648 - RNA, 46 nt, Mus musculus
aaauauauuucuaucuaguuuauugacuucaguugguauccuauga

SEQ ID NO: 112649 - RNA, 46 nt, Mus musculus
uagggaacgaaaaccuuuaguguuucuaugaguguugaugcaagac

SEQ ID NO: 112650 - RNA, 46 nt, Mus musculus
aacaacucauucugaggaugcucugaguuuaaggauugugggagaa

SEQ ID NO: 112651 - RNA, 41 nt, Mus musculus
ucuucuuaucuucguauucauaugcgaacucacaccggaga

SEQ ID NO: 112652 - RNA, 25 nt, Mus musculus
ugugggaaagccuucaguacaucuu

SEQ ID NO: 112653 - RNA, 46 nt, Mus musculus
guaaaguaugugcaaggacuuuuagaaauuccucaugccuuaagac

SEQ ID NO: 112654 - RNA, 46 nt, Mus musculus
cuguacaagccugaccuucuaaucaucuuuuuacccuuuaucaaua

SEQ ID NO: 112655 - RNA, 25 nt, Mus musculus
agagagaagaugaaaaagaucaggg

SEQ ID NO: 112656 - RNA, 47 nt, Mus musculus
agauuacauuuucaugugcacacagaugagagcagaggaagugggac

SEQ ID NO: 112657 - RNA, 49 nt, Mus musculus
aaauaaaucuuuaaaaaaaaaagauguguuucuuugaugcagcaggagg

SEQ ID NO: 112658 - RNA, 46 nt, Mus musculus
ucuauuggauggaacaggguccccaauagaggagcuagagaaagua

SEQ ID NO: 112659 - RNA, 41 nt, Mus musculus
ccaagagacuaguguaguuaauggcugaguuauauaggggc

SEQ ID NO: 112660 - RNA, 45 nt, Mus musculus
caccggcucuagccuuuacuuuauaaguugagguggggagaaggu

SEQ ID NO: 112661 - RNA, 45 nt, Mus musculus
cucuuaaguucccacuggcaggucgcuaucacaucagccccaugc

SEQ ID NO: 112662 - RNA, 41 nt, Mus musculus
ccauggaguuuucauugcuauagcucugcaguaccacuuga

SEQ ID NO: 112663 - RNA, 45 nt, Mus musculus
uagucuaggcuagccugguccucacuguguagcccagggugucuu

SEQ ID NO: 112664 - RNA, 45 nt, Mus musculus
gucccuggccuggaaaguucaggguugggcagggaaugccaggua

SEQ ID NO: 112665 - RNA, 43 nt, Mus musculus
agaaaacacaagaaaggggagaccaaaguguuugguuuauaua

SEQ ID NO: 112666 - RNA, 41 nt, Mus musculus
uuuaucuguuugcagaccacaaaccaucccuuaccccuucc

SEQ ID NO: 112667 - RNA, 48 nt, Mus musculus
caaaggcaacuacucacaauacacaacaacuauuacuauagaacccgg

SEQ ID NO: 112668 - RNA, 42 nt, Mus musculus
gcaggcgcugcggcaggagggaagauggcggacgaggagaag

SEQ ID NO: 112669 - RNA, 46 nt, Mus musculus
cuccuaccucaguuucuggcuuuccgggcccguuauccgcggagga

SEQ ID NO: 112670 - RNA, 24 nt, Mus musculus
cuugguaccaugcuugacccagag

SEQ ID NO: 112671 - RNA, 69 nt, Mus musculus
gggguggggauaggggaagaggaagagagaggagaggagagaagagaggaggguaggggggagagggag

SEQ ID NO: 112672 - RNA, 54 nt, Mus musculus
agaauugggacugguccauagcuaggcagacgggcagggguagaggugugugug

SEQ ID NO: 112673 - RNA, 46 nt, Mus musculus
gggcugagagucauucuggguuacacagcugaucuagcagcagaga

SEQ ID NO: 112674 - RNA, 46 nt, Mus musculus
caguaaagguaaguuugcaagacugccuccaaaaagugaaagagaa

SEQ ID NO: 112675 - RNA, 23 nt, Mus musculus
caaaggaaacaccugaaggaaaa

SEQ ID NO: 112676 - RNA, 46 nt, Mus musculus
ggguugagaauacagcuuuggguuucuaucucuguuuaugcacaag

SEQ ID NO: 112677 - RNA, 44 nt, Mus musculus
cggguguacuacuucaaucacaucaccaacgccagccaguggga

SEQ ID NO: 112678 - RNA, 69 nt, Mus musculus
aaggugcgcugcucacaucugcuggugaagcacagccagucucggaggcccucauccuggcggcaggaa

SEQ ID NO: 112679 - RNA, 97 nt, Mus musculus
caucugagggucggucuggagauagaccagggacuaguaagcacagagcuggcccuguagagugauggguccguuuuuagcagccuauuuuugauaa

SEQ ID NO: 112680 - RNA, 42 nt, Mus musculus
gcugcacauacauacaugcaggcaaaacacccauacacauau

SEQ ID NO: 112681 - RNA, 45 nt, Mus musculus
ugcaccacaugauuccugcugcccauacaggccagaagaggacau

SEQ ID NO: 112682 - RNA, 45 nt, Mus musculus
gcacugcuauccuugauuuagagauugaaccugggaccuggugua

SEQ ID NO: 112683 - RNA, 46 nt, Mus musculus
guccauugucaccauggcagggagcagugacacaaauguccuggag

SEQ ID NO: 112684 - RNA, 46 nt, Mus musculus
uuaauuccuuggccaccaggaauuccugccuugugcacaggucuag

SEQ ID NO: 112685 - RNA, 45 nt, Mus musculus
agccugugcuaugcacucucagacaugugcaagguggggagacua

SEQ ID NO: 112686 - RNA, 46 nt, Mus musculus
uuucaacuguuuuguuguuugucugacuuuguuuuuauuuguuuag

SEQ ID NO: 112687 - RNA, 46 nt, Mus musculus
cucuuaccaaccccucaccuaaacaaauaaaaacaaagucagacaa

SEQ ID NO: 112688 - RNA, 45 nt, Mus musculus
ccagcagcccuggcuuccugaccccgcaggagagucacaacccag

SEQ ID NO: 112689 - RNA, 45 nt, Mus musculus
gucuucaugggugcacauaauaagagcacaggauaaggguguggu

SEQ ID NO: 112690 - RNA, 46 nt, Mus musculus
uaugcugaucgcacccacaacaccucccauacccucaggcccaagc

SEQ ID NO: 112691 - RNA, 42 nt, Mus musculus
ucccgcucccuguuugccccuauucggggcuguccuagccag

SEQ ID NO: 112692 - RNA, 46 nt, Mus musculus
ugccuuggcacacccccggugcccaucccucccccucagcacacag

SEQ ID NO: 112693 - RNA, 46 nt, Mus musculus
uaucuaacagcaauguucagucuuagguuuuuacaauuguguagac

SEQ ID NO: 112694 - RNA, 46 nt, Mus musculus
ggguaggaccaauugcuaauccuuuguaguugcagcaugugccgag

SEQ ID NO: 112695 - RNA, 45 nt, Mus musculus
auggguuuccuucccaauauggcauccaagucugaguucccggag

SEQ ID NO: 112696 - RNA, 46 nt, Mus musculus
uuucucuacauagccuugacuauccuggaacucacucucuguagau

SEQ ID NO: 112697 - RNA, 44 nt, Mus musculus
uccuugguuuauucuugagauggcgauuuugcccuguguccugg

SEQ ID NO: 112698 - RNA, 46 nt, Mus musculus
cccaggacacagggcaaaaucgccaucucaagaauaaaccaaggaa

SEQ ID NO: 112699 - RNA, 45 nt, Mus musculus
uggucuauuuaauuugcuuccuucugaaggaagucugggguacgg

SEQ ID NO: 112700 - RNA, 82 nt, Mus musculus
cuugguccccugaaggcuugggggcacaggaguggggcagaguagggagaggagauugugcagcacugggucaaggaagcag

SEQ ID NO: 112701 - RNA, 61 nt, Mus musculus
uguccaccucacccccagaccuccaugcaguagacuuuuaacucagagcuggugaagcccc

SEQ ID NO: 112702 - RNA, 58 nt, Mus musculus
ucaccccaggugguauacccaguugucugcuagcuccccccuccauccaacuguccau

SEQ ID NO: 112703 - RNA, 46 nt, Mus musculus
auaccaccuggggugaacagacagagggagcugggcucuccacacu

SEQ ID NO: 112704 - RNA, 64 nt, Mus musculus
uacaagggagaaagaauagucagagucacgugacccuggaucuggagucccuggggauaaacag

SEQ ID NO: 112705 - RNA, 46 nt, Mus musculus
ggguuugaacucggcuccaucugcuuuagcagcugaaguugugagg

SEQ ID NO: 112706 - RNA, 45 nt, Mus musculus
uguugucugguugaaggacaacucuucccaguuggucccuuggaa

SEQ ID NO: 112707 - RNA, 46 nt, Mus musculus
uguugagugcugcagcccaucagagguucacuuacaucugccagaa

SEQ ID NO: 112708 - RNA, 45 nt, Mus musculus
gccugggcucucggcugugcccagaggucucugcaacugcugcag

SEQ ID NO: 112709 - RNA, 42 nt, Mus musculus
acuugggggucuucuagaagaguuaggaguuuguguauugcu

SEQ ID NO: 112710 - RNA, 45 nt, Mus musculus
uaccuucucccccuuggggccagcaucucccuucaggccagggag

SEQ ID NO: 112711 - RNA, 47 nt, Mus musculus
ccccuggccgcauggguccagaaggaagagagggcgagaaaggcgcc

SEQ ID NO: 112712 - RNA, 41 nt, Mus musculus
gguauugauggcaucccaggggagaagggaaaugcugguga

SEQ ID NO: 112713 - RNA, 45 nt, Mus musculus
gagacagugggagucuugggauaguugggauagagauggagcugg

SEQ ID NO: 112714 - RNA, 42 nt, Mus musculus
cuccuggggguccuuucuugccugggggaccagcagccccug

SEQ ID NO: 112715 - RNA, 41 nt, Mus musculus
uggcccauagggacuauuacuguuaggagguguggccuggu

SEQ ID NO: 112716 - RNA, 41 nt, Mus musculus
agggugagccaggggaugcuggagacgccggacccccagga

SEQ ID NO: 112717 - RNA, 43 nt, Mus musculus
caggucugccuggaggaguaggacagccuggugcugugggcga

SEQ ID NO: 112718 - RNA, 43 nt, Mus musculus
cagcaccaggcuguccuacuccuccaggcagaccuggggggcc

SEQ ID NO: 112719 - RNA, 45 nt, Mus musculus
uacgucuccaaccucgcccuucucccccggaggacccggcagccc

SEQ ID NO: 112720 - RNA, 41 nt, Mus musculus
cacaggggcugccggguccuccgggggagaagggcgagguu

SEQ ID NO: 112721 - RNA, 75 nt, Mus musculus
ggucgccggggacccccuggccucuucgggcagaagggggaugacggaguucgaggcuuuguagguguaauuggu

SEQ ID NO: 112722 - RNA, 28 nt, Mus musculus
cugcccgaagaggccaggggguccccgg

SEQ ID NO: 112723 - RNA, 44 nt, Mus musculus
gggaaguagggaugccuggucacaaaggaagcaaaggggauaaa

SEQ ID NO: 112724 - RNA, 47 nt, Mus musculus
cuucagggccccucuggagcugcggggccuucuggggaagaaggaga

SEQ ID NO: 112725 - RNA, 46 nt, Mus musculus
aaagaacuucuauuucuguggacuggagaaacgaugacucaagugg

SEQ ID NO: 112726 - RNA, 41 nt, Mus musculus
uaucauuucuuguccuccaccccuuuuccagggcuccccgg

SEQ ID NO: 112727 - RNA, 46 nt, Mus musculus
gacccauugguuugaagggugacaaaggucccccaggcccuguugg

SEQ ID NO: 112728 - RNA, 59 nt, Mus musculus
ggccccccagggccuccuggaccuccuggugaacaaggucugccaggcauagaaggcag

SEQ ID NO: 112729 - RNA, 46 nt, Mus musculus
cuguuuuugacuugcuuuccagggcaaagcaggacagccaggagag

SEQ ID NO: 112730 - RNA, 46 nt, Mus musculus
aaagacuacaggguuuuuaaaguuagauuauguuuuacauucagag

SEQ ID NO: 112731 - RNA, 46 nt, Mus musculus
gaucuauuggauuuccuggacccuugggaccacugggggagaaagg

SEQ ID NO: 112732 - RNA, 46 nt, Mus musculus
uugccuuucucccccaguggucccaaggguccaggaaauccaauag

SEQ ID NO: 112733 - RNA, 42 nt, Mus musculus
aggagggugcggggccacucugaagaugcugcggcuggagga

SEQ ID NO: 112734 - RNA, 46 nt, Mus musculus
gauggugaaugauggguggcugguggcuuuguguaaacuugagaga

SEQ ID NO: 112735 - RNA, 46 nt, Mus musculus
uauacagaaauguggcucuguggaaacacaugugccaguguuagga

SEQ ID NO: 112736 - RNA, 46 nt, Mus musculus
uggugugugucuguguguguguguuguguguuggugugugucugug

SEQ ID NO: 112737 - RNA, 46 nt, Mus musculus
cuugaccaagcuccagguucagugagagacuuuaucucgaagaguu

SEQ ID NO: 112738 - RNA, 46 nt, Mus musculus
uuaccuuagguccugggcguccuggauaaccugggagaccuggcac

SEQ ID NO: 112739 - RNA, 44 nt, Mus musculus
gggggacugccuggugaugaggguccuccaggagcagcagggga

SEQ ID NO: 112740 - RNA, 35 nt, Mus musculus
cuggaggacccucaucaccaggcagucccccaggc

SEQ ID NO: 112741 - RNA, 41 nt, Mus musculus
gguaaccggggucuccaaggcgagaaaggagaaagggugag

SEQ ID NO: 112742 - RNA, 42 nt, Mus musculus
agacuuccucccuugaccuaaaauugugagaacaguugcaag

SEQ ID NO: 112743 - RNA, 42 nt, Mus musculus
ggccugcagggaccuccagggcccacuggccaggcuggagag

SEQ ID NO: 112744 - RNA, 41 nt, Mus musculus
ggugacuuuggacgaguagggcaaccuggucccccaggaga

SEQ ID NO: 112745 - RNA, 42 nt, Mus musculus
ggccgagcuggagcagauggggcucgggggcucccgggagac

SEQ ID NO: 112746 - RNA, 35 nt, Mus musculus
gcaucauaaucacugugcccggcaggccccgggcu

SEQ ID NO: 112747 - RNA, 42 nt, Mus musculus
agaucuggaacucagucuguaaggacugcucugcugcccgga

SEQ ID NO: 112748 - RNA, 45 nt, Mus musculus
gaaggagguggccccaccaugggccccaaguuccgggcagcagag

SEQ ID NO: 112749 - RNA, 98 nt, Mus musculus
gaugaaccagaaaccccugccccucgucgucgaaagggcaaagggaagaaaaaagggcggggucgaaagggcaagggaagaaagaaaaacaaggagac

SEQ ID NO: 112750 - RNA, 45 nt, Mus musculus
aguacagcuggacucacugugaugggaacccaggacaccagggaa

SEQ ID NO: 112751 - RNA, 46 nt, Mus musculus
ccuccuuggugacuccuucaggccccuccccaagcaagucaacauu

SEQ ID NO: 112752 - RNA, 26 nt, Mus musculus
gaagccaggcccuucagccaccccag

SEQ ID NO: 112753 - RNA, 44 nt, Mus musculus
gucagauggaggaggucagggggaguuagaugaggagucagaug

SEQ ID NO: 112754 - RNA, 45 nt, Mus musculus
uaaagcuggggacccugaggagaccccgcgcaggccuugcggcca

SEQ ID NO: 112755 - RNA, 44 nt, Mus musculus
ugcgccuggguccgggccucgcaagccuggguggcgucgccgca

SEQ ID NO: 112756 - RNA, 42 nt, Mus musculus
acuggauacauuugcuauuuucauuuccuagauggcccagaa

SEQ ID NO: 112757 - RNA, 46 nt, Mus musculus
uggagcugggucuggugacacaggaggauugcauguaacuagagaa

SEQ ID NO: 112758 - RNA, 46 nt, Mus musculus
ggguguuccuaucuccuucagcugguaucuuauagcaacacgaggu

SEQ ID NO: 112759 - RNA, 44 nt, Mus musculus
cuuauuuugaugagggcaugagagauuaggacugcugcuuuggu

SEQ ID NO: 112760 - RNA, 42 nt, Mus musculus
uauucuuguaacuacaugggacuuaugaauuuugggcaauuu

SEQ ID NO: 112761 - RNA, 46 nt, Mus musculus
gcguauguauguauguguauguguguguguguguguauacguugug

SEQ ID NO: 112762 - RNA, 46 nt, Mus musculus
ggcuuaauggugugcaggcgaaaucgggaauagaaucgagggggaa

SEQ ID NO: 112763 - RNA, 41 nt, Mus musculus
gaggucuuguguaaaaaacggaaagucauacuuugggggca

SEQ ID NO: 112764 - RNA, 45 nt, Mus musculus
uggucaaaauaaggaagugugugacccccagggggccagccacug

SEQ ID NO: 112765 - RNA, 41 nt, Mus musculus
gggcaaugggcucaucaucagacaggagcagcuggggcuca

SEQ ID NO: 112766 - RNA, 46 nt, Mus musculus
cugcugcugagguugugugauugcucagacucaaaguaaacgcccu

SEQ ID NO: 112767 - RNA, 42 nt, Mus musculus
caacagguuaccuugggcgcuccacaggugcagcugccaccc

SEQ ID NO: 112768 - RNA, 44 nt, Mus musculus
gcugcagugucauccggggcccaaucugccaacacaggggaaug

SEQ ID NO: 112769 - RNA, 46 nt, Mus musculus
gccuggcaggcauaaagcgagcccgugcaagggccgacggugacag

SEQ ID NO: 112770 - RNA, 42 nt, Mus musculus
ucaucuucaggcugaccugcccccacugccucuggcggugcc

SEQ ID NO: 112771 - RNA, 42 nt, Mus musculus
ggggggcccucugggcaagaagcagcgagggaaggagcagag

SEQ ID NO: 112772 - RNA, 46 nt, Mus musculus
auccaccucggugggauacuuuucugugauucaguucugcccagug

SEQ ID NO: 112773 - RNA, 45 nt, Mus musculus
ucagauuggcgugaccugcccaacauacaggugcggcugggagau

SEQ ID NO: 112774 - RNA, 47 nt, Mus musculus
ucugaccuccccgagauccagaauggagccucgaauucugagauccc

SEQ ID NO: 112775 - RNA, 41 nt, Mus musculus
cccagacacgaaggagggccaucaucuuggcugcagcccca

SEQ ID NO: 112776 - RNA, 45 nt, Mus musculus
cuucaguggcaugaaccgcuucaacucccgcacuuacuccaaguu

SEQ ID NO: 112777 - RNA, 45 nt, Mus musculus
gagcacucugcuggcucuccucauuaacuguuccuccuccaggga

SEQ ID NO: 112778 - RNA, 42 nt, Mus musculus
uaccguggaguacggggaagaccuacuugagagcauccagga

SEQ ID NO: 112779 - RNA, 45 nt, Mus musculus
agaauacccacagguccuacaacggauccuaucacacugacauca

SEQ ID NO: 112780 - RNA, 54 nt, Mus musculus
uucaccaucacauuuacagccuuacaucuguucuccauaguccaggaagugaaa

SEQ ID NO: 112781 - RNA, 45 nt, Mus musculus
ggggaccuuuagcacacugccucgggagccuucuuucugcaucug

SEQ ID NO: 112782 - RNA, 46 nt, Mus musculus
ugagacaaaaagaaaugcccaagguccuggaacaaauugaggaggu

SEQ ID NO: 112783 - RNA, 46 nt, Mus musculus
ccaugcgcacugguucugcgcugggacagacacaguccugggagcc

SEQ ID NO: 112784 - RNA, 42 nt, Mus musculus
cacacacccuuagucccaaguaauuuucauaggaagucaggg

SEQ ID NO: 112785 - RNA, 46 nt, Mus musculus
cuucuauuuucauuaguuuuuuuagauugauuuaucacauguagau

SEQ ID NO: 112786 - RNA, 46 nt, Mus musculus
aagccugauggugguggcacacagccuuuaaucucagcacgcggga

SEQ ID NO: 112787 - RNA, 45 nt, Mus musculus
gcagaacaaggaccgcaucuccuggcuugggcagccuaugaaggu

SEQ ID NO: 112788 - RNA, 77 nt, Mus musculus
ugaaggaggcagacgacgaugaagaggcugaugaugaugugucagagaugccaucacccaaaaagcugcaucagggg

SEQ ID NO: 112789 - RNA, 76 nt, Mus musculus
ucaggucugucagcagccugagugugggaagugcaaggcgugcaaagauauggugaaguuugguggcacuggacgg

SEQ ID NO: 112790 - RNA, 45 nt, Mus musculus
cuccaugcuuugggguagccuccugacccucucuguccaucuggg

SEQ ID NO: 112791 - RNA, 75 nt, Mus musculus
ccaccaccaagcuggucuaucagaucuuugacacuuucuucucagagcagauugagaaguaugauaaggaggaca

SEQ ID NO: 112792 - RNA, 65 nt, Mus musculus
caggcgagcaacaaggcgcgucaugggugcuaccaaggagaaggacaaagcacccacgaaagcca

SEQ ID NO: 112793 - RNA, 102 nt, Mus musculus
gaaccgguucacagaggacucccucuuacgccacgcccaguuuguagugagccagguagagaguuacgacgaagccaaggacgaugaugagacccccaucuu

SEQ ID NO: 112794 - RNA, 56 nt, Mus musculus
uuccugcaaaacaauccugaugcuguauaugaagaccugaucaauaagauugaggu

SEQ ID NO: 112795 - RNA, 77 nt, Mus musculus
uggagcccagcaaagaguaugagccaauauuugggcugaugcaggagaaaauuuacaucagcaagauuguuguugag

SEQ ID NO: 112796 - RNA, 46 nt, Mus musculus
gggccaaucaaucagugguggcucaguggcuuugaugguggcgaga

SEQ ID NO: 112797 - RNA, 46 nt, Mus musculus
ggcagccugcuggcugggucgcuggcggggauaugaguugugaguc

SEQ ID NO: 112798 - RNA, 73 nt, Mus musculus
ccaaagcaauucaugacgagaauccaucuauggaagguaugugaagugcucaaacaaggguugucccaagaag

SEQ ID NO: 112799 - RNA, 53 nt, Mus musculus
cccacagaucaacucaccaaagugccccgaguguggccagcaccuagacgacc

SEQ ID NO: 112800 - RNA, 45 nt, Mus musculus
uucaagcugaugaaauggccaacaaccuugcgcuuccuuccagau

SEQ ID NO: 112801 - RNA, 44 nt, Mus musculus
cacguaaaaaacuggagucacacaccguucccguucagagcagg

SEQ ID NO: 112802 - RNA, 45 nt, Mus musculus
gcuguccaaaccaagagagguccuguuccuuuguuuaggaggaga

SEQ ID NO: 112803 - RNA, 46 nt, Mus musculus
cacaguuagcuacuagagaggcugcuucuggcucccagaccacgcc

SEQ ID NO: 112804 - RNA, 41 nt, Mus musculus
uacaaauaauguagaaggucuacucagcgugggcuguaauu

SEQ ID NO: 112805 - RNA, 46 nt, Mus musculus
agcagagccagagcagguagcuccagagacucccgaggacagagac

SEQ ID NO: 112806 - RNA, 42 nt, Mus musculus
caagugugaacuaccaucuauggcggugcuugcuugugugug

SEQ ID NO: 112807 - RNA, 28 nt, Mus musculus
aguuguuggauuucuuggagcuggaguc

SEQ ID NO: 112808 - RNA, 63 nt, Mus musculus
gcggaaaucaaaggaggauccagacagagaagcaagaccggaaacucacuuggacgaggacga

SEQ ID NO: 112809 - RNA, 46 nt, Mus musculus
acaccagagagcuguaagugcagcugucaugccuccgugcccuaaa

SEQ ID NO: 112810 - RNA, 46 nt, Mus musculus
agacagcaagugccuucagccacagagcaucucgcuggcccuagau

SEQ ID NO: 112811 - RNA, 46 nt, Mus musculus
ggagaaacuggaagagguaacagcgggaacccagcuggguccggaa

SEQ ID NO: 112812 - RNA, 46 nt, Mus musculus
uuaguucuggcguggcagcuucuguugguguaggaaguuggguuca

SEQ ID NO: 112813 - RNA, 55 nt, Mus musculus
gaagagucggaagaggggaacucggcugagucggcugcagaggagagagaccagg

SEQ ID NO: 112814 - RNA, 46 nt, Mus musculus
guugaaacuucaccuaguuccguggcuacgaggagaaccaccaggc

SEQ ID NO: 112815 - RNA, 45 nt, Mus musculus
caaccuggagagcagaaauggcagacucaaauagauccccaagau

SEQ ID NO: 112816 - RNA, 42 nt, Mus musculus
ccaguugugugacuuggaaaccaaauuacauaaagaggaauu

SEQ ID NO: 112817 - RNA, 46 nt, Mus musculus
gguuggcuagcugucgaaccuagggucauuuucuccgcuugcaggu

SEQ ID NO: 112818 - RNA, 88 nt, Mus musculus
uaacauaauuuuuauuaacuaaauuguaguuacuacacuggggggguuguuacuguacugggguaugugugaaggucagaggucagau

SEQ ID NO: 112819 - RNA, 128 nt, Mus musculus
acaaggcaugugccaccgugcuuggcccuaauuucuuuuuuguaauuucaaggcagggucuaguuguauacuuccaggugaucuugaacucggcuucccuccugcagccuugugagccugugccaggu

SEQ ID NO: 112820 - RNA, 45 nt, Mus musculus
uucauggcaggguuuaucucuguagcccuggcugagaauguagau

SEQ ID NO: 112821 - RNA, 41 nt, Mus musculus
ggaaaccuuuaacuccauucaaaguguuuaucagggggaag

SEQ ID NO: 112822 - RNA, 42 nt, Mus musculus
uggcuguggcucaggugaugggaggacagcccugugcaagua

SEQ ID NO: 112823 - RNA, 43 nt, Mus musculus
agaugagagggggaaggggagaaacuagcacggggcggggcca

SEQ ID NO: 112824 - RNA, 45 nt, Mus musculus
gagcucgagaguggacccaacuggaagcuguuugagcugagcgag

SEQ ID NO: 112825 - RNA, 46 nt, Mus musculus
uagccuugccuggaccacgugggacauuggggagagagagagagag

SEQ ID NO: 112826 - RNA, 44 nt, Mus musculus
aggcagcaagugauaggauuuaggcaaguguacauguugcucac

SEQ ID NO: 112827 - RNA, 34 nt, Mus musculus
cuugugauugaagcauccaagaugggaggggcag

SEQ ID NO: 112828 - RNA, 46 nt, Mus musculus
ggucaauauuuacaaaauaauuuguuuuuauuuuaugugcauggau

SEQ ID NO: 112829 - RNA, 45 nt, Mus musculus
agcagaaguuguuuugcucccuggaaggccuguuuccugccucug

SEQ ID NO: 112830 - RNA, 47 nt, Mus musculus
gaaaugccaggccugggggaacccaucuccuaagaugaccugcagac

SEQ ID NO: 112831 - RNA, 46 nt, Mus musculus
guacauacgugugccaugccuuuagcucccaugggaaugucaccag

SEQ ID NO: 112832 - RNA, 48 nt, Mus musculus
gugggccucgugauggcagccucuuauguuuauaaccgccagagaaag

SEQ ID NO: 112833 - RNA, 55 nt, Mus musculus
acuccugccuggacccccugcagggcaacagcugcugcugcuuuugaacagaaug

SEQ ID NO: 112834 - RNA, 45 nt, Mus musculus
gccugggggaugcacacuuguagccucagagcuaagaggacucgg

SEQ ID NO: 112835 - RNA, 64 nt, Mus musculus
uaauuuagaguuuuaccagcuauuuauugaguacccuguauauaguagaucagugaggagguga

SEQ ID NO: 112836 - RNA, 68 nt, Mus musculus
auguauaaguuauggccuggacccugcugcagaugcugugagagucuggggaaagaucacaugggucg

SEQ ID NO: 112837 - RNA, 34 nt, Mus musculus
cuggcagugguucucugcuccuccacauccugga

SEQ ID NO: 112838 - RNA, 42 nt, Mus musculus
aggugaguggcugccagaggucguugaguccggcccgcauca

SEQ ID NO: 112839 - RNA, 46 nt, Mus musculus
aacgcauuggugcccuuaacugcugagccaucucuggcuccuggga

SEQ ID NO: 112840 - RNA, 45 nt, Mus musculus
ccaucguagcccccugcugcauagauacaguugugcagcacgcag

SEQ ID NO: 112841 - RNA, 44 nt, Mus musculus
gcggaguuaagccgguuagucccgucaaagccccccacugcaua

SEQ ID NO: 112842 - RNA, 42 nt, Mus musculus
cacccuauucacagaccacacacauuagagccccuagcacau

SEQ ID NO: 112843 - RNA, 46 nt, Mus musculus
ccaaagauaaauauugaauuccugauucuccucccucuacccccag

SEQ ID NO: 112844 - RNA, 46 nt, Mus musculus
ucaaaucccagcaaacacaugguggcucacaaccacccauaaugag

SEQ ID NO: 112845 - RNA, 44 nt, Mus musculus
gugccgcggcggguggcacaggcuggcaaccccgggcugggaga

SEQ ID NO: 112846 - RNA, 41 nt, Mus musculus
gaugcuggcuucucugggcaggaugugugggccaaccccuc

SEQ ID NO: 112847 - RNA, 45 nt, Mus musculus
cuggucagcuccauugggugugaacaacuguacuugugggcuggc

SEQ ID NO: 112848 - RNA, 45 nt, Mus musculus
uuaacaguuucagcuguuagugacagagacagcaccgaacuccag

SEQ ID NO: 112849 - RNA, 46 nt, Mus musculus
cacguuaaagucaggguccucacagugcagcuccuguuggcuccag

SEQ ID NO: 112850 - RNA, 42 nt, Mus musculus
uuaccugcaugagcuggucgugcugggcggggucaaagucag

SEQ ID NO: 112851 - RNA, 43 nt, Mus musculus
cggguaugucuugaccuauaggcagaagaggagccagagggac

SEQ ID NO: 112852 - RNA, 43 nt, Mus musculus
ucugaggagucguccacugccagcuggacuggggggccuggag

SEQ ID NO: 112853 - RNA, 49 nt, Mus musculus
cgggugguugugagccaccaugugguugcugggauuugaacaucggacc

SEQ ID NO: 112854 - RNA, 45 nt, Mus musculus
uguuuccuacggagggauuggaugucggccccaggccugcuacag

SEQ ID NO: 112855 - RNA, 47 nt, Mus musculus
ccuggagccuguggucaacggucuccccaucagaguuguccucgucc

SEQ ID NO: 112856 - RNA, 45 nt, Mus musculus
uguucucugauagaagguagcaucuuucugguaaauucgaggguc

SEQ ID NO: 112857 - RNA, 46 nt, Mus musculus
ggagucuugcggcuaaguuagcaaaguagguaaauucagugaccac

SEQ ID NO: 112858 - RNA, 45 nt, Mus musculus
aucgcuggagucagacucggaacuggagucgccaccgacguccgg

SEQ ID NO: 112859 - RNA, 46 nt, Mus musculus
gcgccgccgcccuccugccacgagccuuccggagucuucacaaccc

SEQ ID NO: 112860 - RNA, 42 nt, Mus musculus
gggggaagaguaacggccaagcgcgggagcgaggccggagga

SEQ ID NO: 112861 - RNA, 42 nt, Mus musculus
gguuuuguucuacaaguggaagcugaguggcucugagcagau

SEQ ID NO: 112862 - RNA, 44 nt, Mus musculus
acagucuugagagaggggauauggugagagcgagguggcuaaga

SEQ ID NO: 112863 - RNA, 46 nt, Mus musculus
uaaaaauccaggcaugacugugguggaaaggccuacaaucccagua

SEQ ID NO: 112864 - RNA, 46 nt, Mus musculus
gcuacacagagaaacccugucucgaaaaaccaaaaagaaaggcaac

SEQ ID NO: 112865 - RNA, 46 nt, Mus musculus
uacacaccuuuugcaagcaaccauaacuaaaucagugggaggagag

SEQ ID NO: 112866 - RNA, 46 nt, Mus musculus
aauguuucaagaaacauuuggaaucaggaacagaaagcuguuaaga

SEQ ID NO: 112867 - RNA, 42 nt, Mus musculus
ucgugggccaggugcugugcuguguaaaaggcagcguaaggg

SEQ ID NO: 112868 - RNA, 46 nt, Mus musculus
gggcgugguggugcaugccuuuaaucccaguacucgggaggcagag

SEQ ID NO: 112869 - RNA, 46 nt, Mus musculus
accgaggcucugcagcccaaggucugcaggggaccugaacuaagua

SEQ ID NO: 112870 - RNA, 46 nt, Mus musculus
gacccggucagucucugcuucgaucuccugccggacuucaucaaag

SEQ ID NO: 112871 - RNA, 46 nt, Mus musculus
auuuauacuuuuuaaaaauuuaauauauuuuuagagaaagagagag

SEQ ID NO: 112872 - RNA, 43 nt, Mus musculus
ggcggcuggucccccaccggcaccuuagugaugccugggaggu

SEQ ID NO: 112873 - RNA, 46 nt, Mus musculus
aguacacugucacugucuucagacccaccagaagagggugucagau

SEQ ID NO: 112874 - RNA, 46 nt, Mus musculus
cagguuguucugugggccuuuuagaauucuuauuuacuucugugag

SEQ ID NO: 112875 - RNA, 45 nt, Mus musculus
cacaaaugcacacauaggacgggagauaaagagagaaagagaaga

SEQ ID NO: 112876 - RNA, 46 nt, Mus musculus
aacagagacuagggagcagcaacaaagcuucagucaguugcuagaa

SEQ ID NO: 112877 - RNA, 51 nt, Mus musculus
cccccuuugagaauguaaaguuaggguugugggucaaucaagggagagcag

SEQ ID NO: 112878 - RNA, 46 nt, Mus musculus
acccagccugcuuuugccaggacccaggugcaacaaggacccacca

SEQ ID NO: 112879 - RNA, 56 nt, Mus musculus
caccacaugucaaccaagggagagaaacuuaggcccaagcuaccacuguaccccaa

SEQ ID NO: 112880 - RNA, 46 nt, Mus musculus
agggauggguggcaggguccuuucagucagucuuagcccagcguaa

SEQ ID NO: 112881 - RNA, 46 nt, Mus musculus
aagucaagagaucucagacuccuagagaugccuggagccccaggag

SEQ ID NO: 112882 - RNA, 45 nt, Mus musculus
agcuuuuuuuggggggggggcacuuuuccuucugucugcucagau

SEQ ID NO: 112883 - RNA, 47 nt, Mus musculus
guuguguguaugugaggguugugugugugaagguuguauguguguga

SEQ ID NO: 112884 - RNA, 45 nt, Mus musculus
acagggucugucucacuggcccgaagcucacagacuugccuagac

SEQ ID NO: 112885 - RNA, 45 nt, Mus musculus
acuauagcaccaaguaccgcacacaguccagcucuggcuuuggau

SEQ ID NO: 112886 - RNA, 46 nt, Mus musculus
agggggaauccgugcuggccgagaugguaucugagguggcgcagag

SEQ ID NO: 112887 - RNA, 46 nt, Mus musculus
ugucacuaguuugccuggguuuuauaggcaaguucucagccuuggg

SEQ ID NO: 112888 - RNA, 57 nt, Mus musculus
gcuugggacagaccuagccucaagccagggcagccaggaaggggggacacucccacg

SEQ ID NO: 112889 - RNA, 50 nt, Mus musculus
caaggaacagagggcauuuguccugggcacuggagucaauaaauuauggu

SEQ ID NO: 112890 - RNA, 77 nt, Mus musculus
uucuugccaggacagucacuuuuauuugaaaggaaggagcccuggccccuuggcccagaggggagccagcuaguagg

SEQ ID NO: 112891 - RNA, 28 nt, Mus musculus
ccuccacacacacuguggcuguaacccu

SEQ ID NO: 112892 - RNA, 46 nt, Mus musculus
guguguguguguguagcccuggcuguccuggaacucacucuguaga

SEQ ID NO: 112893 - RNA, 81 nt, Mus musculus
uguauaugugcuguauguguaugguguguguaguguauuuguaugguuuaugugaguguguguguuauguauguguguaug

SEQ ID NO: 112894 - RNA, 42 nt, Mus musculus
caagauaugguaacacugaaacuaggaagaaggcaggcagau

SEQ ID NO: 112895 - RNA, 46 nt, Mus musculus
ugugccuagccgggcgugguggcgcacgccuuuaaucccagcacuu

SEQ ID NO: 112896 - RNA, 46 nt, Mus musculus
aucuacuugcuuugagacagcauggaguccaggcuggccugcagcu

SEQ ID NO: 112897 - RNA, 47 nt, Mus musculus
aaagaaauuagccugauaucaucccagcacuugggaagcugaggcag

SEQ ID NO: 112898 - RNA, 46 nt, Mus musculus
agccugcggguaaccuggagccuacauguucuccagaccagcugca

SEQ ID NO: 112899 - RNA, 46 nt, Mus musculus
aagacaauuuaacugugcgcuacaauaguaucaggggagggcaucg

SEQ ID NO: 112900 - RNA, 46 nt, Mus musculus
aauuaguaaaauacagugggauuaugaaugcgagccagggaugauc

SEQ ID NO: 112901 - RNA, 37 nt, Mus musculus
ucaucacagagcugcaggagcucagggagauggagga

SEQ ID NO: 112902 - RNA, 42 nt, Mus musculus
aggaccagcaaggaggacaccugugugcaggcuaggcuacga

SEQ ID NO: 112903 - RNA, 42 nt, Mus musculus
ucagagccuucuugaacugaaagaauguacgcgccaggggga

SEQ ID NO: 112904 - RNA, 41 nt, Mus musculus
ugucaugacaacgguugucaucuagggacuuaagcguaauu

SEQ ID NO: 112905 - RNA, 44 nt, Mus musculus
augauggagcggcugcuggagaugcaggacggcgccuaccggca

SEQ ID NO: 112906 - RNA, 41 nt, Mus musculus
uucuggguuuaccauuuccucagacucuuaccugccaccaa

SEQ ID NO: 112907 - RNA, 46 nt, Mus musculus
auaaaggcaggugugugugugugugugugugugugugugugugggu

SEQ ID NO: 112908 - RNA, 46 nt, Mus musculus
cccuguggaggagggcuggaaaaagacacgagcccccuuaugccca

SEQ ID NO: 112909 - RNA, 42 nt, Mus musculus
gugauggguucggguguguccacugauugugugugugugugu

SEQ ID NO: 112910 - RNA, 44 nt, Mus musculus
gcacacugucucugcuaugacuguggagaggguguucaugugug

SEQ ID NO: 112911 - RNA, 42 nt, Mus musculus
uggcuacugaugccuugggaauugaaguuagauguagggggg

SEQ ID NO: 112912 - RNA, 46 nt, Mus musculus
ugcacagacucaacaaauaauaaauguaacuaagaaagaaagaaag

SEQ ID NO: 112913 - RNA, 46 nt, Mus musculus
ccacaaagacgaagcaagggaugauagagaaacuccgcuucaggug

SEQ ID NO: 112914 - RNA, 60 nt, Mus musculus
gaggucagagccagagguaggacuggcuggagccagaaagguggggagaugagugugggg

SEQ ID NO: 112915 - RNA, 24 nt, Mus musculus
augggguugagaaugugggucagu

SEQ ID NO: 112916 - RNA, 45 nt, Mus musculus
agaggcugugaggucaaagacagagacaaggaaacggagagagau

SEQ ID NO: 112917 - RNA, 42 nt, Mus musculus
ucugaccucuuccuaucucuuuuugcuucucuccggccccug

SEQ ID NO: 112918 - RNA, 46 nt, Mus musculus
acauaagcacacacaaacaaauaaacauaauucuuaaacacuguaa

SEQ ID NO: 112919 - RNA, 45 nt, Mus musculus
ugccucuugugucagaggccugacgagaggucuucuauucagaga

SEQ ID NO: 112920 - RNA, 43 nt, Mus musculus
uuagcaggggcgugggcagcagcagcuuccggccccgcccacc

SEQ ID NO: 112921 - RNA, 50 nt, Mus musculus
ggggcaagcccuacuuaaguagggaguuggagggugugagauggugcacc

SEQ ID NO: 112922 - RNA, 42 nt, Mus musculus
uuuccacagcccuaguaauaauagaagguuuggcggggagug

SEQ ID NO: 112923 - RNA, 42 nt, Mus musculus
uguaaaaauaaaucuaaacauuaaaaaaaguagaagccgguc

SEQ ID NO: 112924 - RNA, 42 nt, Mus musculus
ugugggagaggugcacacuugccacugugcacuuguagaggu

SEQ ID NO: 112925 - RNA, 44 nt, Mus musculus
ucgccccuggguggccggagcuggaauaauucuuuuccaucaau

SEQ ID NO: 112926 - RNA, 41 nt, Mus musculus
ggcucuguuucguguuuugagggagucugggauaugguaga

SEQ ID NO: 112927 - RNA, 45 nt, Mus musculus
cgcgagguggccuuaagucaaggccaaggaggaggugcauggugu

SEQ ID NO: 112928 - RNA, 86 nt, Mus musculus
ucccauccauguugucgucaaguuccuggaaggcacuggcugcccgcuccuguucccgccgggccuuggcagcagcuugcugcucu

SEQ ID NO: 112929 - RNA, 45 nt, Mus musculus
uccagcuccgggugagucuguaacucagccagcgagacccugagu

SEQ ID NO: 112930 - RNA, 48 nt, Mus musculus
gauggcagcccagacacggucauagaaggagguggugucagucugugu

SEQ ID NO: 112931 - RNA, 48 nt, Mus musculus
uuugggcucagucuccuccggaacagguaugucagugggcgggaccua

SEQ ID NO: 112932 - RNA, 42 nt, Mus musculus
ugggaggcugugggggcugcagugggggcggagccuccuggg

SEQ ID NO: 112933 - RNA, 42 nt, Mus musculus
ugguggaucgguuggggcccugccaacagcccgugcccugcu

SEQ ID NO: 112934 - RNA, 42 nt, Mus musculus
ucucccaccagccggggaggcaggggugaggugggugcaggg

SEQ ID NO: 112935 - RNA, 45 nt, Mus musculus
aaacaugacagucuauguuggaggugauauaaaagaacuguagaa

SEQ ID NO: 112936 - RNA, 42 nt, Mus musculus
guuucuuuuuucggcuaaaaacaaaaagaagaaagcagagag

SEQ ID NO: 112937 - RNA, 45 nt, Mus musculus
cauuuauugcccucccuccccgggcagcagagagagagagagaga

SEQ ID NO: 112938 - RNA, 47 nt, Mus musculus
accccccaccccccacccccacaccauugguuuugauggguagcuca

SEQ ID NO: 112939 - RNA, 50 nt, Mus musculus
agagaguaaagggcuugccgcacaaaccugaccaccugaguucaaucccc

SEQ ID NO: 112940 - RNA, 46 nt, Mus musculus
gagagagagagagagagagagggagggagagagagaaggagagaga

SEQ ID NO: 112941 - RNA, 42 nt, Mus musculus
gggaaugagacguggugcucagggaagugcaggggcagcaua

SEQ ID NO: 112942 - RNA, 42 nt, Mus musculus
agccaucaaggcuggcacgaagagacagacuucuaagcagca

SEQ ID NO: 112943 - RNA, 44 nt, Mus musculus
uacacaucaaccuuggauagcacacacauacacacaugcuagag

SEQ ID NO: 112944 - RNA, 45 nt, Mus musculus
cuaccccagguucagggguuugaauagaagcagcagaaagcagac

SEQ ID NO: 112945 - RNA, 45 nt, Mus musculus
acgaagcaaugcagucccauaaugccccuccccaaacagccaccc

SEQ ID NO: 112946 - RNA, 46 nt, Mus musculus
ucuaaguugcugggaccugccaaaacauuuccuccuuuauaaagau

SEQ ID NO: 112947 - RNA, 42 nt, Mus musculus
agagcguagccuauaccuccccucagacaccacaccccagaa

SEQ ID NO: 112948 - RNA, 41 nt, Mus musculus
agugggaagcuguccaguggcaggguuuguugggggauauu

SEQ ID NO: 112949 - RNA, 46 nt, Mus musculus
gcagcaucggggacauugaauccugcaaguugguucgggauaagau

SEQ ID NO: 112950 - RNA, 23 nt, Mus musculus
agguugggggggggccggccggc

SEQ ID NO: 112951 - RNA, 45 nt, Mus musculus
uggagaaauugugggagcaacaguuaauaggaaaauuaugcagua

SEQ ID NO: 112952 - RNA, 45 nt, Mus musculus
aaugaaugaaugaaugaaugaaugaaagaaagugcugcauggagg

SEQ ID NO: 112953 - RNA, 26 nt, Mus musculus
caccugggagaggcagauggauaccu

SEQ ID NO: 112954 - RNA, 45 nt, Mus musculus
acccccaguguugugauuccaggcuuguuuauguggugcuaggga

SEQ ID NO: 112955 - RNA, 45 nt, Mus musculus
acccaggcuaaguugggaguggcuaccuuuggauaacacacgagg

SEQ ID NO: 112956 - RNA, 42 nt, Mus musculus
uauaugcucaaggaggagaaagaggauucaguggccccagag

SEQ ID NO: 112957 - RNA, 42 nt, Mus musculus
agaucugccugccucuccucccauguaccaccaugccaagcu

SEQ ID NO: 112958 - RNA, 45 nt, Mus musculus
gguggauggacuuuggauccagucccaacagguuuugcugacaga

SEQ ID NO: 112959 - RNA, 66 nt, Mus musculus
guaaugccagagucagcccgagaaccuucuacuggagccgugaaggaaauccagaagcacacagau

SEQ ID NO: 112960 - RNA, 41 nt, Mus musculus
ggccagcguagcggucgccacggguaagggggcgcggggcc

SEQ ID NO: 112961 - RNA, 43 nt, Mus musculus
ugaggagaaaagacugggcugguaugaaauaauauggagaaaa

SEQ ID NO: 112962 - RNA, 67 nt, Mus musculus
ggccugaggaagaugaugagaccauucaggcagagcagcagcaggggcaaaguugagucagauagag

SEQ ID NO: 112963 - RNA, 44 nt, Mus musculus
aacaagaaaccauggaugggccagaugugguagugcacaccuuu

SEQ ID NO: 112964 - RNA, 42 nt, Mus musculus
cacguggacuucaucuaccuagcacugcgcaagaugccagag

SEQ ID NO: 112965 - RNA, 44 nt, Mus musculus
gggugguugcuauaaagacccugacuguguuauuuugggaaggu

SEQ ID NO: 112966 - RNA, 45 nt, Mus musculus
cuuccuuccugccuucaaagccaguaccauacaacacugccagau

SEQ ID NO: 112967 - RNA, 81 nt, Mus musculus
caggaagcccuguagcuccaaugugcucagacagccccacuccucuagcucagcugcccuaagccauaccccaccccagac

SEQ ID NO: 112968 - RNA, 46 nt, Mus musculus
uacacagagaaacccuuucuggaaaaaccaaagaaaagagggagau

SEQ ID NO: 112969 - RNA, 46 nt, Mus musculus
ugaugcgggauuucacccccaguggcauugcaggagccuuucggag

SEQ ID NO: 112970 - RNA, 47 nt, Mus musculus
acgcaaauaccacugaagaggggucacuggagggcauugcauggccg

SEQ ID NO: 112971 - RNA, 45 nt, Mus musculus
uggaagagcccagggcuggcuucuggagcuucaaaaacgugugag

SEQ ID NO: 112972 - RNA, 41 nt, Mus musculus
ugugagggugagugugugugugugugugugugugggugggu

SEQ ID NO: 112973 - RNA, 45 nt, Mus musculus
caagacaaaaggaaacaaagucaaugugggagucaaguaugcaga

SEQ ID NO: 112974 - RNA, 46 nt, Mus musculus
cgccagguguacgaucccaaguacugccugaacccggaguacccag

SEQ ID NO: 112975 - RNA, 46 nt, Mus musculus
aguaaguaccucccagaaccagaaacccuuccagcgaagcccccag

SEQ ID NO: 112976 - RNA, 42 nt, Mus musculus
aggagguauacauacccuccuauacacacuaggaucagugag

SEQ ID NO: 112977 - RNA, 42 nt, Mus musculus
acuuaugacuugaguucaauccuugagacccacauggccaga

SEQ ID NO: 112978 - RNA, 45 nt, Mus musculus
uacagcugucauucauucaugagcccaucaauaaaacagccagug

SEQ ID NO: 112979 - RNA, 42 nt, Mus musculus
agaugggauggaugugagugaguagauuucguggcugcagau

SEQ ID NO: 112980 - RNA, 42 nt, Mus musculus
agugaaauccuuccucagagauugaugggcaggguggcagac

SEQ ID NO: 112981 - RNA, 42 nt, Mus musculus
uguucugcauuuauugaacagcacagaagccugggcauggga

SEQ ID NO: 112982 - RNA, 48 nt, Mus musculus
cucacaaccaucuguaauaggacccaaugcucucuucugguggaucug

SEQ ID NO: 112983 - RNA, 47 nt, Mus musculus
caugaucaccuuggcaacgucucugcacagauugcauacucuaagau

SEQ ID NO: 112984 - RNA, 42 nt, Mus musculus
acgguacagcccccacucccacccugagauuuguggcugugg

SEQ ID NO: 112985 - RNA, 46 nt, Mus musculus
acuuccuggaaaaggcaguuauugcugcuguuuaugauggcgaggg

SEQ ID NO: 112986 - RNA, 49 nt, Mus musculus
ugcagggaccggagggguugguggugaguguucaaggaaggagucugga

SEQ ID NO: 112987 - RNA, 23 nt, Mus musculus
acuaaccacaaauccuaaucuca

SEQ ID NO: 112988 - RNA, 42 nt, Mus musculus
cccuagaagguaagucagagaagccagguugggaggacagug

SEQ ID NO: 112989 - RNA, 47 nt, Mus musculus; identical to SEQ ID NO: 96737

SEQ ID NO: 112990 - RNA, 46 nt, Mus musculus
cauauaaauuuuuugagguuauccucauugauccguuccauaaagc

SEQ ID NO: 112991 - RNA, 87 nt, Mus musculus
cguguccgccgugguggucguaaacgcccaguuccuaagggugcaacuuacggcaagccuguccaccaugguguuaaccagcugaaa

SEQ ID NO: 112992 - RNA, 45 nt, Mus musculus; identical to SEQ ID NO: 96740

SEQ ID NO: 112993 - RNA, 45 nt, Mus musculus
accucagaagagacuuugaacuuuggacuuuaaaacauuguugag

SEQ ID NO: 112994 - RNA, 42 nt, Mus musculus
aagauaaagguguuugcugucucuuucuaagaaucaaggggc

SEQ ID NO: 112995 - RNA, 46 nt, Mus musculus
uuaacaaagacagaucucugaauucauuugcaaugaagaaagaaag

SEQ ID NO: 112996 - RNA, 45 nt, Mus musculus
ugaguucaagauacauaguuucccaacuaugcaaaauacaaagau

SEQ ID NO: 112997 - RNA, 41 nt, Mus musculus
uacucuacaucaaauaguucacacaggugagaagcccuaug

SEQ ID NO: 112998 - RNA, 46 nt, Mus musculus
cuaaaggagcaacagaagauccaucaagggucaaaauccugcgaaa

SEQ ID NO: 112999 - RNA, 51 nt, Mus musculus
aucacaaggcauauauguggcaagcuagaaccaccgaaaauaaggcaucaa

SEQ ID NO: 113000 - RNA, 46 nt, Mus musculus
uguuaaaagauguggccuuauuggaggagguguagccuuauuagcg

SEQ ID NO: 113001 - RNA, 45 nt, Mus musculus
gaaaaucaggcgguggguccauagcacugacaaaacuguggagau

SEQ ID NO: 113002 - RNA, 45 nt, Mus musculus
uuguuaauuauucugugaguugauuucuuuauaauugcuugcuuu

SEQ ID NO: 113003 - RNA, 41 nt, Mus musculus
gccagaagucacggcccagaguccacagugggcggggaaag

SEQ ID NO: 113004 - RNA, 46 nt, Mus musculus
guuugaauucuuuguaaauucagguaaaugccaguauuggugggaa

SEQ ID NO: 113005 - RNA, 72 nt, Mus musculus
agaggaggguggcagguugaagagagagcagagccaguuagugcaggaguuguuggaaauuucacuaaaggg

SEQ ID NO: 113006 - RNA, 45 nt, Mus musculus
uuagaaucugcagagauggaauguguuugagaaacgugggguggg

SEQ ID NO: 113007 - RNA, 46 nt, Mus musculus
ccuauuuacaauggggacacugauacaggaggaggggugacccugu

SEQ ID NO: 113008 - RNA, 45 nt, Mus musculus
gagggaaaaaucacaaugugugagucaacacacgaauacauuagu

SEQ ID NO: 113009 - RNA, 46 nt, Mus musculus
uauucucgugacaaaaaauaauacucuuuggugacagugaugauga

SEQ ID NO: 113010 - RNA, 46 nt, Mus musculus
ucuaggacaguuaggacugaaagagacccugucuuaacaaagagga

SEQ ID NO: 113011 - RNA, 42 nt, Mus musculus
uugggccaagauguuuacugccuugcccgagcaugcacagug

SEQ ID NO: 113012 - RNA, 42 nt, Mus musculus
uugaggaaacacugaauagggaggagaauugccggggcagaa

SEQ ID NO: 113013 - RNA, 39 nt, Mus musculus
ucugacucagagugacagcaccacccacaggccaaagga

SEQ ID NO: 113014 - RNA, 53 nt, Mus musculus
cagaugacgacgggagcagcuccagcuccucgggggacagagagaagcgcaag

SEQ ID NO: 113015 - RNA, 45 nt, Mus musculus
gacugacgaaguccaaguuuuuguuauuuucauuuuuagacaaga

SEQ ID NO: 113016 - RNA, 45 nt, Mus musculus
ccuauguacgacaucauucgcgagaauaaaagacaugaaaaggau

SEQ ID NO: 113017 - RNA, 50 nt, Mus musculus
aggcgacaaagaaugcccuuucuuuaucaaaggcaaccagaaguuagaac

SEQ ID NO: 113018 - RNA, 46 nt, Mus musculus
uuuuguuuuuuggauuuuucuuugucuuguuuugugugugugugua

SEQ ID NO: 113019 - RNA, 42 nt, Mus musculus
cucacgcuccgacuaaaggacuguggaugccccuggggagag

SEQ ID NO: 113020 - RNA, 46 nt, Mus musculus
acauguguauuguuuucuguugaccuguuugaugaagccagcuuuu

SEQ ID NO: 113021 - RNA, 46 nt, Mus musculus
gaacagauuuaucuuauuucuuaaucucuuugcuuagcacuugagu

SEQ ID NO: 113022 - RNA, 46 nt, Mus musculus
gugcugagauuaaaggugugcaccaccacacucgaccagccuagau

SEQ ID NO: 113023 - RNA, 45 nt, Mus musculus
acucaacacagcuuugcuucuaaguacccgauauuauggccagag

SEQ ID NO: 113024 - RNA, 41 nt, Mus musculus
uagagucgcauguaggugagggaagguggcgggccucccgu

SEQ ID NO: 113025 - RNA, 41 nt, Mus musculus
cgcgggaaggcagcggacccgcagccgggccugagggugga

SEQ ID NO: 113026 - RNA, 41 nt, Mus musculus
ugcggcacgggccggugggacguuggugggguugcgcugcg

SEQ ID NO: 113027 - RNA, 45 nt, Mus musculus
ucaaacaaaccgcuaacacggcguggguagauccuauaaacaccu

SEQ ID NO: 113028 - RNA, 46 nt, Mus musculus
acauuuauugauuuauggugugugugugugugugugugugugugug

SEQ ID NO: 113029 - RNA, 71 nt, Mus musculus
gcaugccaguuaguucuauaauauuucccgcaacaacuauuaaaaauugaaacacagagcuuagcacagaa

SEQ ID NO: 113030 - RNA, 41 nt, Mus musculus
agaugaugaggaggaugaagaggaugaggaagaagaggaag

SEQ ID NO: 113031 - RNA, 46 nt, Mus musculus
caauaaugagggggaagcacguugcaaaaauuaucuaguauaagua

SEQ ID NO: 113032 - RNA, 65 nt, Mus musculus
ugaggaaaugaauggacacacgugaaggaagcucgggaccaguugaggguugaaaggcgggaggu

SEQ ID NO: 113033 - RNA, 45 nt, Mus musculus
agacaggaggcaagaaaagguuuugacuaggauccuggcugcagu

SEQ ID NO: 113034 - RNA, 45 nt, Mus musculus; identical to SEQ ID NO: 79353

SEQ ID NO: 113035 - RNA, 52 nt, Mus musculus
ccuccacucucuguggaagaugauuuugagaaacuaauaugggaaauuucag

SEQ ID NO: 113036 - RNA, 46 nt, Mus musculus
aucucagagcagugugacuaagauggaggcuaaugagacuucagau

SEQ ID NO: 113037 - RNA, 38 nt, Mus musculus
gcgccagaaacuaacauugauaaagcaccaaagaaaga

SEQ ID NO: 113038 - RNA, 45 nt, Mus musculus
gagucaguuuaaagcaaggugaauguuugaauuuuggaauaaaga

SEQ ID NO: 113039 - RNA, 46 nt, Mus musculus
acugugaagcugcacugggaaaugaaacuguuugcacacuauggca

SEQ ID NO: 113040 - RNA, 45 nt, Mus musculus
caccuuuaacuccaggaaccaugaaauaaaugucaagggcuaagu

SEQ ID NO: 113041 - RNA, 46 nt, Mus musculus
cccucugggcucuguucuuucucucauucauuuguaguaggcugcc

SEQ ID NO: 113042 - RNA, 46 nt, Mus musculus
accaagcuaguugcuucccggcugaugauccguacugcagcagugg

SEQ ID NO: 113043 - RNA, 46 nt, Mus musculus
cuaaugauucuuuaaauucccuuggugucuguuguugugccccuuu

SEQ ID NO: 113044 - RNA, 45 nt, Mus musculus
uuuaauuuaauuuuaauugggcauuuuaauuaggcaaaccaaagg

SEQ ID NO: 113045 - RNA, 46 nt, Mus musculus
auuuccucuaacaaggccacacauccuccaauaaggucacacaucc

SEQ ID NO: 113046 - RNA, 46 nt, Mus musculus
agaauuguguuguaauuuugauggggauugcuuugagucuguagau

SEQ ID NO: 113047 - RNA, 46 nt, Mus musculus
uugauggugucuuuugccuuauagaagcuuuucaguuucaugagau

SEQ ID NO: 113048 - RNA, 46 nt, Mus musculus
auucuuuauauacuuuggaaauuagcccuguguucgauguggaguu

SEQ ID NO: 113049 - RNA, 46 nt, Mus musculus
gagugaugcugcaucucuucugaccucagcuaaacaacaaggagau

SEQ ID NO: 113050 - RNA, 41 nt, Mus musculus
ggauuugggggggucuaugugcgaacagauguggguggauc

SEQ ID NO: 113051 - RNA, 44 nt, Mus musculus
uugacuuugcagcucgggaaauggcucccaauauggcggagugg

SEQ ID NO: 113052 - RNA, 36 nt, Mus musculus
uuuucucuuuuuucuuuuucuuucuuuucuuuucuu

SEQ ID NO: 113053 - RNA, 44 nt, Mus musculus
aaagacgaaggaacgugugacuuuggcaauagauuuccaaggua

SEQ ID NO: 113054 - RNA, 86 nt, Mus musculus
uaaagccgaauuagggagggacucaggagaguuuagagguagauuaggagagaaggaaagggcgcagauaacgagagagggauuag

SEQ ID NO: 113055 - RNA, 46 nt, Mus musculus
uucagccuccuacagagaggccaugccgagaccccgcaagaggcag

SEQ ID NO: 113056 - RNA, 46 nt, Mus musculus
uuaucuuguguuuuaucagguuuuacaugugugugcccuggcccug

SEQ ID NO: 113057 - RNA, 46 nt, Mus musculus
cuccucugagggaauccgcaaaccuguaugagugaaagguccugaa

SEQ ID NO: 113058 - RNA, 42 nt, Mus musculus
uggaaauaacaaucuaaggaagcaaagccaggaaggagagcu

SEQ ID NO: 113059 - RNA, 42 nt, Mus musculus
caaaaaaccccaauccagucauuuuaaaucccugcccaaguu

SEQ ID NO: 113060 - RNA, 46 nt, Mus musculus
cucuacugauggagugaacaagccaagauuuuauaagacagaagga

SEQ ID NO: 113061 - RNA, 46 nt, Mus musculus
uaauuaaaggaagcccuauggcuuuggaggcauugugcccgugauc

SEQ ID NO: 113062 - RNA, 46 nt, Mus musculus
agcagagcuaaggaaaguaaaguuuucuccaugcacaaccccaggu

SEQ ID NO: 113063 - RNA, 31 nt, Mus musculus
uguaggaagugguguuguggcggaaggguga

SEQ ID NO: 113064 - RNA, 41 nt, Mus musculus
gaaaucauuuacguuugucauuggcuuuauagcaacugaga

SEQ ID NO: 113065 - RNA, 46 nt, Mus musculus
uauuugucccaggggacaaaggacugccucuggauagagaagagac

SEQ ID NO: 113066 - RNA, 64 nt, Mus musculus
ucuuagcacaaaggagauucauuugccucagagggucaaaggacagggaauaagagacggagga

SEQ ID NO: 113067 - RNA, 24 nt, Mus musculus
ccaucuaggguccaggaagcuggg

SEQ ID NO: 113068 - RNA, 46 nt, Mus musculus
guaaaucaaguaucuuaaagucaccugguaauugagauugggaggc

SEQ ID NO: 113069 - RNA, 42 nt, Mus musculus
uuaugaauaacucaaaagcgucccugccucacuccggcagau

SEQ ID NO: 113070 - RNA, 41 nt, Mus musculus
gucagccugccccuggacucgagugugggacgggcugggag

SEQ ID NO: 113071 - RNA, 51 nt, Mus musculus
agccuaucacugaagaaccccaacaagcgacuagagcaccagggcaucaag

SEQ ID NO: 113072 - RNA, 45 nt, Mus musculus
aaaucuugcugaaugaugcggagaguaggaagcgagcggagcaca

SEQ ID NO: 113073 - RNA, 42 nt, Mus musculus
uguaaacaaagcgcccuuuggcacugcacaugcgcagaugag

SEQ ID NO: 113074 - RNA, 46 nt, Mus musculus
gucacuaguguuuuucuuaccgucauaucguucuuacacggcaggg

SEQ ID NO: 113075 - RNA, 45 nt, Mus musculus
uugccucuguugauuggccaguacugucauuuccauccuggagaa

SEQ ID NO: 113076 - RNA, 25 nt, Mus musculus
uccugacaaagccacccgggcagaa

SEQ ID NO: 113077 - RNA, 46 nt, Mus musculus
auuguucuugcugugauuacgaugggcaucugcugugcguacagac

SEQ ID NO: 113078 - RNA, 25 nt, Mus musculus
uaugauaucaggggcuaugguagcu

SEQ ID NO: 113079 - RNA, 45 nt, Mus musculus
gagaauuacuguaggguaauucacugcuguaggaaggugugcaga

SEQ ID NO: 113080 - RNA, 45 nt, Mus musculus
ugccuacagauuccagagccaaucccagguuccagaauuccucuu

SEQ ID NO: 113081 - RNA, 42 nt, Mus musculus
ugaggucguugcucuaaaugaccgaaaagaaguugaugagau

SEQ ID NO: 113082 - RNA, 45 nt, Mus musculus
uaacuccaagccaucuguuaauuccagcucugggggaucuaacac

SEQ ID NO: 113083 - RNA, 45 nt, Mus musculus
uguaggcuaucugauaugcaacccccaaaguggucauggcccaca

SEQ ID NO: 113084 - RNA, 46 nt, Mus musculus
gaaucagggugacaaaccagguuuccucucccucccgcguccaggu

SEQ ID NO: 113085 - RNA, 44 nt, Mus musculus
gaucugggugacggcuucagguccgcugggaccaaggccagucc

SEQ ID NO: 113086 - RNA, 45 nt, Mus musculus
uaagaaaagugccguuccgacgcgggcgaguagggcagccuggga

SEQ ID NO: 113087 - RNA, 46 nt, Mus musculus
auugucucuuaaauaaugaggaaaacucccuuuacgagucuaggag

SEQ ID NO: 113088 - RNA, 42 nt, Mus musculus
uccacauuccugaugcucagaccuccaugugcauacccacug

SEQ ID NO: 113089 - RNA, 29 nt, Mus musculus
ggagaagauauacaggaaaugccaaacac

SEQ ID NO: 113090 - RNA, 45 nt, Mus musculus
uguguuauauguaaguauacuguagcugucuucagacacuccaga

SEQ ID NO: 113091 - RNA, 45 nt, Mus musculus
guugugagcuaccaugugguugaugggaaaugaacucaggaccuc

SEQ ID NO: 113092 - RNA, 46 nt, Mus musculus
ccucuugcuuuccugguagcugggacuuucugguggcuacccccag

SEQ ID NO: 113093 - RNA, 43 nt, Mus musculus
auauuuccuuuagauagcaauucuggauuaaaaauuuggagac

SEQ ID NO: 113094 - RNA, 42 nt, Mus musculus
auacagagagguaggcagguuuucaguuaccugacugaaggu

SEQ ID NO: 113095 - RNA, 45 nt, Mus musculus
caucgccgggcgugguggugcacgccuuuaaucccagcacuuggg

SEQ ID NO: 113096 - RNA, 42 nt, Mus musculus
cgaaagaaaucacugcaagcugcuaguacuaccuugugagcc

SEQ ID NO: 113097 - RNA, 45 nt, Mus musculus
guacuagcaacacuaaacauuugcauauagcuggcugccgcuaga

SEQ ID NO: 113098 - RNA, 42 nt, Mus musculus
aacaauguagcuuuugcgcuuccuccgggacucucggcagac

SEQ ID NO: 113099 - RNA, 46 nt, Mus musculus
aagagggcugaagaucuagugguagaaaacuuuugcaugccuagug

SEQ ID NO: 113100 - RNA, 46 nt, Mus musculus
augauuaguuuugccugauggaggucauccuugagauuuucuagua

SEQ ID NO: 113101 - RNA, 33 nt, Mus musculus
gaaugaaaucagggaccaauaauuuccaaagua

SEQ ID NO: 113102 - RNA, 46 nt, Mus musculus
ugugcuguuuuagauucugaauacgggugaagcggaccccacaggu

SEQ ID NO: 113103 - RNA, 41 nt, Mus musculus
ucagauucuagaucugccugccuuagacuugagugguggga

SEQ ID NO: 113104 - RNA, 46 nt, Mus musculus
aaagauuaaugaucacuuccagugauucucuggacacuucaaaggc

SEQ ID NO: 113105 - RNA, 46 nt, Mus musculus
agauucuggucuuaacaaucccucccuccaugucugagucacagau

SEQ ID NO: 113106 - RNA, 46 nt, Mus musculus
cacagccaugaggaauauuuauaacuaaauacauguuuuaaaugag

SEQ ID NO: 113107 - RNA, 46 nt, Mus musculus
ucagaaccaugauaagaaagucagauugagguaauaaaccagagag

SEQ ID NO: 113108 - RNA, 49 nt, Mus musculus
uuaaucuuuaagcuggccuuuauuaauggucacaaaguugcaguuagaa

SEQ ID NO: 113109 - RNA, 31 nt, Mus musculus
gcuuaugcugggcgugccauaucuucagcuu

SEQ ID NO: 113110 - RNA, 46 nt, Mus musculus
cucagcagguaaaggcauuucccauggagaaugaccccagugugaa

SEQ ID NO: 113111 - RNA, 40 nt, Mus musculus
caugucaucaaucucacaaugcuuccugaagaaguugaug

SEQ ID NO: 113112 - RNA, 45 nt, Mus musculus
cacucuguaucuuguaaacaucauguuugauauuugaaugcacca

SEQ ID NO: 113113 - RNA, 45 nt, Mus musculus
guuaaaagcugauagcuugaaucuuucagguacuugucugcaguu

SEQ ID NO: 113114 - RNA, 45 nt, Mus musculus
gcucuaaugucgaggggaaaguuuucauuuuaucaaaaagcccag

SEQ ID NO: 113115 - RNA, 35 nt, Mus musculus
ggagcugaacaagaugcagccccuggaguccagga

SEQ ID NO: 113116 - RNA, 26 nt, Mus musculus
cucccuacaaaugcuguccccaggcc

SEQ ID NO: 113117 - RNA, 46 nt, Mus musculus
cucugccuccaggcuuuggguauauauagcuguguuuaagaaggag

SEQ ID NO: 113118 - RNA, 46 nt, Mus musculus
uacaaauacauacauacuuaaggagagagagagagagagagaaaga

SEQ ID NO: 113119 - RNA, 47 nt, Mus musculus
guacuaaaauacgcccaaugcugggaaccagagugcgaggugggggc

SEQ ID NO: 113120 - RNA, 42 nt, Mus musculus
cagacacauugacacuguagacugcauucauuacagcgggaa

SEQ ID NO: 113121 - RNA, 46 nt, Mus musculus
aucucucuaugaaaaauuuauuuggucuaaauugagaaguccccca

SEQ ID NO: 113122 - RNA, 42 nt, Mus musculus
ccaguaauaucuuuucuccauuaaucucacacaccaccccag

SEQ ID NO: 113123 - RNA, 44 nt, Mus musculus
gcuggcaacaagaucaacugugggccugcccuuaccuggaugga

SEQ ID NO: 113124 - RNA, 43 nt, Mus musculus
aagcucuuucuuccuucucuuguuagacaguguugagcccuga

SEQ ID NO: 113125 - RNA, 45 nt, Mus musculus
ggguuuaaauuauaccaggacucuuuuuucuucaaacuucuggga

SEQ ID NO: 113126 - RNA, 42 nt, Mus musculus
acacucuguaaaguguuucugucccucaucccccgccccccc

SEQ ID NO: 113127 - RNA, 44 nt, Mus musculus
aaagcucacugggugugggagugggaccuugccucaagaagaau

SEQ ID NO: 113128 - RNA, 52 nt, Mus musculus
guuaaaaauccccacaagcuuuuuguagaaauugaugagcagauuaaagaau

SEQ ID NO: 113129 - RNA, 46 nt, Mus musculus
uaaaaaaaggaacuugggucgacaaagugaguuccaggacagccag

SEQ ID NO: 113130 - RNA, 46 nt, Mus musculus
aguuguagugaccagggguugccuggcagcaaggguagagggcaag

SEQ ID NO: 113131 - RNA, 45 nt, Mus musculus
ccuguugugugcucagagcccagacuacaguucuaugagacagag

SEQ ID NO: 113132 - RNA, 26 nt, Mus musculus
agacaucaugauguguuuuuguggga

SEQ ID NO: 113133 - RNA, 45 nt, Mus musculus
caccugagugcugacucacuccuuguucacaaccacucacgggag

SEQ ID NO: 113134 - RNA, 23 nt, Mus musculus
uugauuguagugauaucagugcc

SEQ ID NO: 113135 - RNA, 41 nt, Mus musculus
augugcauuucaguguuggguaauuuugauggacugugggu

SEQ ID NO: 113136 - RNA, 45 nt, Mus musculus
ggcuacagaggcugugaugcugaaagugauuuauggaaugaagag

SEQ ID NO: 113137 - RNA, 45 nt, Mus musculus
uaacgagaucugacuccccucuucuggagugucugaagacagcua

SEQ ID NO: 113138 - RNA, 45 nt, Mus musculus
uuccucuaguuccguuuuguucaacguuguaaaaguaguugccag

SEQ ID NO: 113139 - RNA, 46 nt, Mus musculus
aguaaucucagaagccguugcaguggagaaaguuaaucaccuggag

SEQ ID NO: 113140 - RNA, 45 nt, Mus musculus
uauucucuuaugucuuuguauggauacuuuauauugacguguccu

SEQ ID NO: 113141 - RNA, 46 nt, Mus musculus
uucuuaaacaguaaugucauagcuucauuaccaguaucaacaugug

SEQ ID NO: 113142 - RNA, 46 nt, Mus musculus
ucaggacuagugggaagcagaguaugcuucuguuguuguccuucag

SEQ ID NO: 113143 - RNA, 55 nt, Mus musculus
cauauauauauauauauaugaaccucaaacauagcacacagacauuaccagccuc

SEQ ID NO: 113144 - RNA, 86 nt, Mus musculus
uauauaauaaugaaauuacaguauacuuuugauauaugagcuucagaacacaaaagaccagggacccuaauugaaauaguguacag

SEQ ID NO: 113145 - RNA, 45 nt, Mus musculus
gugggagaggagccucucuggaugcccccauaaauaggcuugcag

SEQ ID NO: 113146 - RNA, 46 nt, Mus musculus
uaaguucucauggucccuuaaaacuauguaagaaauagaccccuag

SEQ ID NO: 113147 - RNA, 45 nt, Mus musculus
ccagcaggagggacaggugagcuagagagagaacagagagaugga

SEQ ID NO: 113148 - RNA, 46 nt, Mus musculus
auagggguaaaagaaaagacucagaguagcuguuuugggugacaag

SEQ ID NO: 113149 - RNA, 45 nt, Mus musculus
agccccucggccuucuucauuuguaagaucagauaacagcaccag

SEQ ID NO: 113150 - RNA, 48 nt, Mus musculus
uuaaaaaauccaguucaguggagauaguguggcacuggugaggggucu

SEQ ID NO: 113151 - RNA, 45 nt, Mus musculus
uuaaauacugaucuuaaaacgugcaucacagcaagagguaaggag

SEQ ID NO: 113152 - RNA, 46 nt, Mus musculus
uagaagagagcagaaaucuaaaauuaccuggaaaauugaaggagag

SEQ ID NO: 113153 - RNA, 47 nt, Mus musculus
uuaaguuagaaacaaaugagaggacugagauggaagaaucaaaucca

SEQ ID NO: 113154 - RNA, 42 nt, Mus musculus
uuaugaugugaaugcauacaccuuacucagggugaacccagg

SEQ ID NO: 113155 - RNA, 45 nt, Mus musculus
caauaucuggucuggucuaggcugguccaucucuaaguggcucua

SEQ ID NO: 113156 - RNA, 41 nt, Mus musculus
ggauuugccgaauaauguguaguaacaagaauuggacuuga

SEQ ID NO: 113157 - RNA, 46 nt, Mus musculus
uacuuucuugcgaacauucaugaagucucgcccaacaaaacagaag

SEQ ID NO: 113158 - RNA, 47 nt, Mus musculus
ugggagggugacaggugagacuguaacauacugaaaccaacugcgua

SEQ ID NO: 113159 - RNA, 58 nt, Mus musculus
auucgaaguucuguugacaaaaaugaguucuuuaguauccagauuaauuguuuuauuu

SEQ ID NO: 113160 - RNA, 46 nt, Mus musculus
caaucaugaaaaaaaaucagauauuuuauauacaacuugagaggag

SEQ ID NO: 113161 - RNA, 46 nt, Mus musculus
agaaggaaagugaggagaauaugaucaaaguaaaguacagggucag

SEQ ID NO: 113162 - RNA, 45 nt, Mus musculus
ccagaguuagccugcgauaacaugcuuacgucuuuaguucugaaa

SEQ ID NO: 113163 - RNA, 44 nt, Mus musculus
aagucaaaauauaaacuuauaaaauaaaauuuuauagcagcuaa

SEQ ID NO: 113164 - RNA, 42 nt, Mus musculus
aaugugagcucacuaaaaguuacagguauuuauagggccgcu

SEQ ID NO: 113165 - RNA, 45 nt, Mus musculus
cugcuauuguuuucacugaaggcuugugcaugcacauguggcaga

SEQ ID NO: 113166 - RNA, 41 nt, Mus musculus
guguuguagaugacugauggauugugugugugugugugugu

SEQ ID NO: 113167 - RNA, 46 nt, Mus musculus
gcucaggucaguucuccuauugugacggaaaauaaguacaucgaag

SEQ ID NO: 113168 - RNA, 46 nt, Mus musculus
ggggaugguggaauggggggaggacuugcaugagggaguacuggga

SEQ ID NO: 113169 - RNA, 69 nt, Mus musculus
gagaacuuucaacuugggaguugaagaagguacaguucaccugaucuuuaaggcgacugagaguccuuu

SEQ ID NO: 113170 - RNA, 81 nt, Mus musculus
cucaggagaugagagcaggcuggggagaggaacaacuuggagaagagauuuguaaagaacucagagaaauuguugucaaga

SEQ ID NO: 113171 - RNA, 46 nt, Mus musculus
guaagcugaauaugacugcgaaauggacagcucaucacacuuggag

SEQ ID NO: 113172 - RNA, 46 nt, Mus musculus
gaccuagaagacccagauccagcagcgaugcgcucucugccucuuu

SEQ ID NO: 113173 - RNA, 47 nt, Mus musculus
uggggaaccggugcaauuccuaugacaaucugccccacgacaacgag

SEQ ID NO: 113174 - RNA, 46 nt, Mus musculus
cuucagcucccuuaacagacucagagaagucugaugaucauggaag

SEQ ID NO: 113175 - RNA, 42 nt, Mus musculus
gcaguucaaauuaccacuccuuugucccuucgucagccucag

SEQ ID NO: 113176 - RNA, 46 nt, Mus musculus
ggcuauuucucugguaaugaccauaauguagucacuaugcccccca

SEQ ID NO: 113177 - RNA, 55 nt, Mus musculus
gaggaggaacacuucucucagucuauggucccaccccccaaaccagagaggaguc

SEQ ID NO: 113178 - RNA, 45 nt, Mus musculus
cgugcuauaccaguaucagacacacagcaagcgccagagcagcau

SEQ ID NO: 113179 - RNA, 45 nt, Mus musculus
ugaacagcuuugcccacauguuucucuaauucugugggggcagaa

SEQ ID NO: 113180 - RNA, 42 nt, Mus musculus
ugagcagagcaggagagccgguugucaguuuggaagcagcag

SEQ ID NO: 113181 - RNA, 46 nt, Mus musculus
gcccuauuggucacccauucaguaugauggcaaagugucaccugag

SEQ ID NO: 113182 - RNA, 46 nt, Mus musculus
ggccuuggauugaucuccagggagaucugggauguuuuaaugugag

SEQ ID NO: 113183 - RNA, 44 nt, Mus musculus
acaccaagagauuauuuaacauucuauuuaauuaagggguagga

SEQ ID NO: 113184 - RNA, 46 nt, Mus musculus
uuuguuuuguuuuguuuuguuucguuuuguuuugucuuguauuguu

SEQ ID NO: 113185 - RNA, 49 nt, Mus musculus
uccagaugccuccaacaagaagcagaccauccacuacuaugaacagauc

SEQ ID NO: 113186 - RNA, 49 nt, Mus musculus
gcucaguugugcucuacuuauuuaauacagagaaugucaggaggagggg

SEQ ID NO: 113187 - RNA, 46 nt, Mus musculus
uuccauauuauuauuuaaggaaguuggagugggaacucaugcagag

SEQ ID NO: 113188 - RNA, 50 nt, Mus musculus
uuacuauugcugugaugaaacgccacgagcaaaggcaaguuggggagaag

SEQ ID NO: 113189 - RNA, 48 nt, Mus musculus
agccacuggcagcucaaaucugacugacuucaccucugagcucagcau

SEQ ID NO: 113190 - RNA, 45 nt, Mus musculus
cuagggucccccuguucuugcagacuguggucugagggaagaggu

SEQ ID NO: 113191 - RNA, 45 nt, Mus musculus
uaugguaauuuuuuuucaaacuugucuuaggugaaacauguuugg

SEQ ID NO: 113192 - RNA, 46 nt, Mus musculus
gcgguccuacauuggaacauacugaucuguuggagugaguggagac

SEQ ID NO: 113193 - RNA, 57 nt, Mus musculus
cuuuauggagauugcagcagacaagcuccugagccugcccauacaacagccucgaaa

SEQ ID NO: 113194 - RNA, 58 nt, Mus musculus
aacagccuccccucaucugggaugucaaccccaaacagguccggauucuaaaccccuu

SEQ ID NO: 113195 - RNA, 46 nt, Mus musculus
agcucgcugggcggugucaucaacaaguacgacguggucaucaggu

SEQ ID NO: 113196 - RNA, 44 nt, Mus musculus
augucuggguucuuuugcccaggcucagguaccuaugucaagga

SEQ ID NO: 113197 - RNA, 42 nt, Mus musculus
cuuguuguugucauggugugguauuccaucucccgagaagau

SEQ ID NO: 113198 - RNA, 46 nt, Mus musculus
gaaugagugugguggcagcugccaauuaucucagcauguagaagga

SEQ ID NO: 113199 - RNA, 45 nt, Mus musculus
caaggcuugguguuccguuucucagggaaagguggagaugguaga

SEQ ID NO: 113200 - RNA, 46 nt, Mus musculus
cacaucuuuaaaacauagaggcugauuuaauuuaguaggguuuuuu

SEQ ID NO: 113201 - RNA, 46 nt, Mus musculus
agacagcagagacaagcuggagaugggcaauaccacuuggccaauu

SEQ ID NO: 113202 - RNA, 42 nt, Mus musculus
uggggacugccucaucccaugguagaagagagaaaggcaaau

SEQ ID NO: 113203 - RNA, 46 nt, Mus musculus
aaaggaaaggaaaggaaaggaaaggaaaggaaaggaaacgaaagga

SEQ ID NO: 113204 - RNA, 46 nt, Mus musculus; identical to SEQ ID NO: 113203

SEQ ID NO: 113205 - RNA, 42 nt, Mus musculus
guagguuccaacagaugugcuggcaaguaaaugcaagcaggu

SEQ ID NO: 113206 - RNA, 46 nt, Mus musculus
cucaccaaggcauggaggcaagacacaugagaaaacaggccaugaa

SEQ ID NO: 113207 - RNA, 29 nt, Mus musculus
ugucugguuccugcuucucugcucugcuc

SEQ ID NO: 113208 - RNA, 23 nt, Mus musculus
cccccccccggagggggggggga

SEQ ID NO: 113209 - RNA, 41 nt, Mus musculus
ccacgucccuucguucugugauauaauguaacuguaggugc

SEQ ID NO: 113210 - RNA, 46 nt, Mus musculus
ggcuguggagugaguagggcaggggaaggaaugggagcuguguuug

SEQ ID NO: 113211 - RNA, 46 nt, Mus musculus
gcauauagcuccagggaccuucaaccaaacaaauaaacagcaggag

SEQ ID NO: 113212 - RNA, 32 nt, Mus musculus
gaggggagcuggugagaccacuaaggagaaga

SEQ ID NO: 113213 - RNA, 46 nt, Mus musculus
ucucuggggacaggcuguaagcccuuccuuccuacccucugcaguc

SEQ ID NO: 113214 - RNA, 46 nt, Mus musculus
ucauggaaguggucuguucaucuccuugucgaagacugcaccagcu

SEQ ID NO: 113215 - RNA, 42 nt, Mus musculus
aaaagcacuugcuacguaagcuugagggcuagcugggcagug

SEQ ID NO: 113216 - RNA, 46 nt, Mus musculus
auaaaaaguaaaagagguagacaccauauaggggaggggacaggag

SEQ ID NO: 113217 - RNA, 46 nt, Mus musculus
ccuagcaaccacaugguggcucacaaccaaccaucuguaauggaau

SEQ ID NO: 113218 - RNA, 42 nt, Mus musculus
uggaagagcagucagugcucuuaaccaucucuccagccccca

SEQ ID NO: 113219 - RNA, 46 nt, Mus musculus
ugaaguauugugccauuaaaaaggcagcuuugggggcuggagagau

SEQ ID NO: 113220 - RNA, 59 nt, Mus musculus
cugaugcagagaaaucugaccagagccaaggcacagaacauucuaggauaaccuggccc

SEQ ID NO: 113221 - RNA, 46 nt, Mus musculus
cucauuccauguccagagacaccggggaagaggccugguuuaaggg

SEQ ID NO: 113222 - RNA, 45 nt, Mus musculus
gauauuguacuccuguaacuucucuccuaaguaaaagcggguaaa

SEQ ID NO: 113223 - RNA, 45 nt, Mus musculus
uuacaaaaguuuaggauguauuuguguguguacaaguguggucug

SEQ ID NO: 113224 - RNA, 42 nt, Mus musculus
aaugagccuucacauccagcagucaagagaaauggggcauuu

SEQ ID NO: 113225 - RNA, 45 nt, Mus musculus
guggugcgugguuccccaccaucuugugaaaggagauagaguagg

SEQ ID NO: 113226 - RNA, 46 nt, Mus musculus
ggaacuucaguucaacccuuccggcugucucuugcuagcuucagaa

SEQ ID NO: 113227 - RNA, 54 nt, Mus musculus
cuggggugggagucccuucuuuagcccagagaucaguagccuagcugguaaggg

SEQ ID NO: 113228 - RNA, 83 nt, Mus musculus
augcaaaggggaaucauuuuucaaggagcaaguauggguaaauguucuggagcacguguaaucggagcacuugggaggcacag

SEQ ID NO: 113229 - RNA, 82 nt, Mus musculus
cuuuuggcugaagaagcuggagaguagaagaggugccauucgggugcuggugguggagcaggaccacacggugaggucaggg

SEQ ID NO: 113230 - RNA, 41 nt, Mus musculus
cuguaugacaccagccaccugcccccagaacaggcggaugu

SEQ ID NO: 113231 - RNA, 44 nt, Mus musculus
gaaguauacuagggacucguucccugggccuggcauaucugaga

SEQ ID NO: 113232 - RNA, 45 nt, Mus musculus
gggaguacuguaauccaagacuuccuuguuagcacagccaccuag

SEQ ID NO: 113233 - RNA, 46 nt, Mus musculus
guauuuugaguggccccuucaucaucugagcugcugcaauccagau

SEQ ID NO: 113234 - RNA, 44 nt, Mus musculus
cuaugauauggagucuguaggcagagugaaggggaugccugagu

SEQ ID NO: 113235 - RNA, 46 nt, Mus musculus
ccagggacccagaagcuguauucuucuagauagaugccauuaagau

SEQ ID NO: 113236 - RNA, 53 nt, Mus musculus
gcccuguuccuagaggccgucaagcauaaaucugaccuagaacauuucauguu

SEQ ID NO: 113237 - RNA, 41 nt, Mus musculus
guguacuuacauauaauaaauaaagaaaucuuugggccaga

SEQ ID NO: 113238 - RNA, 45 nt, Mus musculus
ggucaagcuguguaugaauugugcagguccuggagugggcucagg

SEQ ID NO: 113239 - RNA, 41 nt, Mus musculus
cuaguaagacucaacccuuaccuuuuuauucauccccaaga

SEQ ID NO: 113240 - RNA, 46 nt, Mus musculus
ucaguuaguauaugcuugcacuauuaugaaguauggccuuguugga

SEQ ID NO: 113241 - RNA, 46 nt, Mus musculus
acucuaugugggacuagaaagaugaauuacgggguaaaguacagga

SEQ ID NO: 113242 - RNA, 93 nt, Mus musculus
ugugagagggaagggaguugagacaugcuguccucaugcuguagucagugugagagggaagggaguugagacaugcuguccucaugcuguagu

SEQ ID NO: 113243 - RNA, 93 nt, Mus musculus; identical to SEQ ID NO: 113242

SEQ ID NO: 113244 - RNA, 93 nt, Mus musculus; identical to SEQ ID NO: 113242

SEQ ID NO: 113245 - RNA, 93 nt, Mus musculus; identical to SEQ ID NO: 113242

SEQ ID NO: 113246 - RNA, 46 nt, Mus musculus
aucagccagugcucuuaaccacuaagccaucucuccagccccugaa

SEQ ID NO: 113247 - RNA, 24 nt, Mus musculus
gcaggaaaggauuucaagccaagc

SEQ ID NO: 113248 - RNA, 46 nt, Mus musculus
gagggcagaaugagguagauucugaugucagugaagaacugcagcc

SEQ ID NO: 113249 - RNA, 82 nt, Mus musculus
aguucaucaagaagagagugggcacgcacauccgcgccaagagaaagcgggaggagcugagcaacgugcuggcagccaugag

SEQ ID NO: 113250 - RNA, 45 nt, Mus musculus
cccaucagaggccagaacugaggauucaggaggccacagggccag

SEQ ID NO: 113251 - RNA, 46 nt, Mus musculus
cuacagcaaggccacggaggagagccaguacccccuguccccagau

SEQ ID NO: 113252 - RNA, 46 nt, Mus musculus
aucaaaacuuuagaaagaagacccagaagcaguaagugagguaugg

SEQ ID NO: 113253 - RNA, 46 nt, Mus musculus
auguauuccagagaucagauaugaaggaagguggggaggaucagaa

SEQ ID NO: 113254 - RNA, 46 nt, Mus musculus
guucaugaucaaaggacucugaaaagggaaaguuggagaagagaug

SEQ ID NO: 113255 - RNA, 42 nt, Mus musculus
cuggagguacugaagaugcuuaaauauuucagagaacagaug

SEQ ID NO: 113256 - RNA, 46 nt, Mus musculus
guucaugaucaaaggauucugaaaagggaaaguuggagaagagaug

SEQ ID NO: 113257 - RNA, 41 nt, Mus musculus
accaaguuucuagaugacacugacugaaaaggggcgggagu

SEQ ID NO: 113258 - RNA, 46 nt, Mus musculus
uaaaaauuacacacuuaaacaauuuuuucuagauucacagccauau

SEQ ID NO: 113259 - RNA, 41 nt, Mus musculus
aagaaacaauaaguugauuuucaaaauaaauuugguagaaa

SEQ ID NO: 113260 - RNA, 45 nt, Mus musculus
ucucuucauguauacucuuugguuagugguuuagucccugggagc

SEQ ID NO: 113261 - RNA, 46 nt, Mus musculus
agcuuuuuuucuuaagauuuaugcauuuuuaaaauauggaugagug

SEQ ID NO: 113262 - RNA, 45 nt, Mus musculus
cgucugagaacauagcagaggccauuucauuuuccuugaugaaga

SEQ ID NO: 113263 - RNA, 46 nt, Mus musculus
ucuuucaaagcauggucaguuauuagauaacuugcaagcacaaggu

SEQ ID NO: 113264 - RNA, 45 nt, Mus musculus
ccugcauuuuacagucgcugugcuuggagucauggcagugccuuu

SEQ ID NO: 113265 - RNA, 45 nt, Mus musculus
guucaguauuaugacguggguaaauaugguucagauguaagauga

SEQ ID NO: 113266 - RNA, 106 nt, Mus musculus
gagggagugguccagacuagcagagaggugggagggccgcccggagcccgggcuggagcggguggcccguggcucuccagcauaaagggaccagagcgauuguaag

SEQ ID NO: 113267 - RNA, 124 nt, Mus musculus
agcugugcauuuggauuccuguggcagcuggcaaaggacugcuuggugagaagggcguccugaacagugggaaagaacuccagcaaaggacccagagggcuuguuuaguguggacgggcgcggg

SEQ ID NO: 113268 - RNA, 48 nt, Mus musculus
agcuugugucuuaacuacggccacaucagaauuucagccaguauuaga

SEQ ID NO: 113269 - RNA, 44 nt, Mus musculus
uggcacacgccccgugccauuuccauuucauucggacucagaga

SEQ ID NO: 113270 - RNA, 44 nt, Mus musculus
uggcagggaaccuggguucuuggcccaacugguggcgcagucug

SEQ ID NO: 113271 - RNA, 45 nt, Mus musculus
auggcaguuauuuugaugaguauuugucuauucuuugccccagau

SEQ ID NO: 113272 - RNA, 45 nt, Mus musculus
cuuaauaaauuuuuaucaaaugaauaaauguuucugggaccagag

SEQ ID NO: 113273 - RNA, 47 nt, Mus musculus
auguaaacaacaacuuugucacacuuuuuuguuuuuuagcacccagg

SEQ ID NO: 113274 - RNA, 123 nt, Mus musculus
gaauugucugcaaguuuugcccuggacaauaugggcugggccaagugaaaugauuuuuauaauucugagcagguuaccaaaugaaauguuauggcuuuacuuuggucaauuaaaagggggggg

SEQ ID NO: 113275 - RNA, 85 nt, Mus musculus
ugagcauuaugcuucgcacugagcgcgucauguugaggacgcugaagauguuuuuuauaugcaguuuauaagaacagccggaugg

SEQ ID NO: 113276 - RNA, 48 nt, Mus musculus
gcuugauguccuggaggaagcguauaccacagaacacuggcuagucag

SEQ ID NO: 113277 - RNA, 46 nt, Mus musculus
uaauguuaaugucauuuuuauauuugaagaaguugagcccacaggu

SEQ ID NO: 113278 - RNA, 50 nt, Mus musculus
uauguacaaaauguguuacuaccgcuuugggcaggucuacacagaagcca

SEQ ID NO: 113279 - RNA, 49 nt, Mus musculus
agauaucaacaaguuucuuuggaugguccggauuggaggaagcacagag

SEQ ID NO: 113280 - RNA, 51 nt, Mus musculus
uuuagaaauagugauauuuucagugaguuccugagaaccggcagccuuucu

SEQ ID NO: 113281 - RNA, 42 nt, Mus musculus
cccuauguaauuuguaggaauacuuucaguguggcuuaagac

SEQ ID NO: 113282 - RNA, 45 nt, Mus musculus
guauuauauucuuacagcacuucuaaauugguaagaaucauacuu

SEQ ID NO: 113283 - RNA, 64 nt, Mus musculus
cucacucaugacuuucgcuggcauaucuccaaguucagugacacccucucucaagggaguacgg

SEQ ID NO: 113284 - RNA, 46 nt, Mus musculus
uuacuuuccuuccuauaucaaauauuuucuuuuccuacagcuagug

SEQ ID NO: 113285 - RNA, 42 nt, Mus musculus
ggcauccacagaagaaaaagccuaugaaaucaugagggagcu

SEQ ID NO: 113286 - RNA, 46 nt, Mus musculus
augucauggugggauuauggcuaccaaauuacugcaauggcaaauc

SEQ ID NO: 113287 - RNA, 45 nt, Mus musculus
uacuccagagguaaaaauuugggaggaguuggguacuuggauagu

SEQ ID NO: 113288 - RNA, 46 nt, Mus musculus
ucuucucccuccauuguucugucugcucgugguggggauggcagua

SEQ ID NO: 113289 - RNA, 42 nt, Mus musculus
auuggcaccuguuaugugcauucuuucuggcauugguguuuc

SEQ ID NO: 113290 - RNA, 45 nt, Mus musculus
cagucagucuucuuaaccacugacccuucucuccagcccccagaa

SEQ ID NO: 113291 - RNA, 23 nt, Mus musculus
uguuguuaaggcagagaagauuu

SEQ ID NO: 113292 - RNA, 46 nt, Mus musculus
auuaagccaccaugugguugcugggauuugaacucaggacauuuag

SEQ ID NO: 113293 - RNA, 81 nt, Mus musculus
aauaacauucccauuauugcaucuguuucugagcaccagcccacaaccuggucuuccuacuauuuugaucuacagcuccuu

SEQ ID NO: 113294 - RNA, 56 nt, Mus musculus
agauuaccugcgcagcaaguugaauccacagcaauucgaaguucuuuuccggagug

SEQ ID NO: 113295 - RNA, 58 nt, Mus musculus
caucagaacacauggcagccuuuggaguguuuggucucugucagauccaugcuuucgu

SEQ ID NO: 113296 - RNA, 45 nt, Mus musculus
aucaaaguuuaaauuucaaaaaaagguuaaaauuccagcccuuuu

SEQ ID NO: 113297 - RNA, 41 nt, Mus musculus
uugugugaggaggaggaggaggaggaggaggaggaggagag

SEQ ID NO: 113298 - RNA, 46 nt, Mus musculus
ccuacuguacuguuuacugccugggcaccauucuuucuaugcagau

SEQ ID NO: 113299 - RNA, 57 nt, Mus musculus
uugauuccucuacauguccuggugcuaaugcugacaggccguuuuucucaccggauc

SEQ ID NO: 113300 - RNA, 45 nt, Mus musculus
ugguugugacccaccaugugguugcugggaauugaacucaguacc

SEQ ID NO: 113301 - RNA, 45 nt, Mus musculus
cuguaguuccuggguauauuucucgaucuguagcuggcuccuaug

SEQ ID NO: 113302 - RNA, 46 nt, Mus musculus
uuuugugaucuauagucacuguuaggggauuaauaagccuguagca

SEQ ID NO: 113303 - RNA, 46 nt, Mus musculus
augaaauagcaacaagaaauaauuuuaugguuugggguccgacaac

SEQ ID NO: 113304 - RNA, 46 nt, Mus musculus
auuaaagaaauaugggugagggguuacuuaaauaaaagcaggaaug

SEQ ID NO: 113305 - RNA, 89 nt, Mus musculus
uuccauaucaccauugacauucggaaugucuguguuuuccuggccccgcuuuucuccucuuucaccaccaucguuacguaccaccuuac

SEQ ID NO: 113306 - RNA, 46 nt, Mus musculus
ugguacccuuugggccgaaucauuggaggaacaauuuacccaggug

SEQ ID NO: 113307 - RNA, 46 nt, Mus musculus
uuuccuucagagaaaagcagugcuguaauugauacaagugugagau

SEQ ID NO: 113308 - RNA, 45 nt, Mus musculus
gaggccucugacaucuugagacaccuucauaaacacauaguuaaa

SEQ ID NO: 113309 - RNA, 95 nt, Mus musculus
gcacuugggaggagaggcaggcagaucucugagaucaagaccagguugguuuacauagugaguuccaggccagcuaagccuucaaggcaguaccg

SEQ ID NO: 113310 - RNA, 45 nt, Mus musculus
uaugaagacaaaauaacucaagaaauguaaaccuuaggcuguuga

SEQ ID NO: 113311 - RNA, 52 nt, Mus musculus
cgaggugcuggacacaagccuguagagguggggagcagagccugccugcggc

SEQ ID NO: 113312 - RNA, 46 nt, Mus musculus
agacccacugggaggcugggcuaguguguaugaggaguggcaggug

SEQ ID NO: 113313 - RNA, 42 nt, Mus musculus
ugggguacgggagcugucauaaguacuaaauguaggggaacu

SEQ ID NO: 113314 - RNA, 46 nt, Mus musculus
agccugaaggguaacgccaaggcccucuccacugucacggccauua

SEQ ID NO: 113315 - RNA, 46 nt, Mus musculus
auaaugaagagauugaggauagacacaaaagauguuugugggagag

SEQ ID NO: 113316 - RNA, 45 nt, Mus musculus
cucugugguuucuuggagugaugggaacaggggaagacugcagag

SEQ ID NO: 113317 - RNA, 46 nt, Mus musculus
uugagccccuuuccauucugccuucucucauguuucccagggagug

SEQ ID NO: 113318 - RNA, 55 nt, Mus musculus
uugugcagacuacaggcuggccaucuguggugaccuguguuggcaacugguuugg

SEQ ID NO: 113319 - RNA, 46 nt, Mus musculus
aaggacacccaggcuggaggcaucagagagcacaguggggcaagua

SEQ ID NO: 113320 - RNA, 41 nt, Mus musculus
cauuguggaaguguuggguagucauguagugcaagcuuaga

SEQ ID NO: 113321 - RNA, 46 nt, Mus musculus
guggguauggccaaaguucucuaagcacagcccugcacauguagau

SEQ ID NO: 113322 - RNA, 46 nt, Mus musculus
ggaagacugugggacauguggggccugguaguugugugcugcaauc

SEQ ID NO: 113323 - RNA, 46 nt, Mus musculus
uuuucccucacccaucucccagcccuaguugacuuagccaucuccu

SEQ ID NO: 113324 - RNA, 45 nt, Mus musculus
uccuccagauauccuaagccaugcagugcucccacacccgcagug

SEQ ID NO: 113325 - RNA, 46 nt, Mus musculus
gaugguuccugucucucaucuuauuuuccuguucuuuuaaagagau

SEQ ID NO: 113326 - RNA, 45 nt, Mus musculus
uccacaaacugcauuaccugauccauguuuguuggauggcggauu

SEQ ID NO: 113327 - RNA, 45 nt, Mus musculus
cauugagcuuuuggagcaguguacuuggucugcaagaggugggga

SEQ ID NO: 113328 - RNA, 45 nt, Mus musculus
gacuucaucucucaucuccagauucauacauuuggcugcauaggu

SEQ ID NO: 113329 - RNA, 45 nt, Mus musculus
cccauauggaaaaccagccaacuuaaaaaaaaauguagaagagaa

SEQ ID NO: 113330 - RNA, 42 nt, Mus musculus
gcuaguuuuaugucaacuugacacaaguuagacucaccagag

SEQ ID NO: 113331 - RNA, 45 nt, Mus musculus
ugagaaggaguugagaguucuacaucucgaucaacaggcagcagc

SEQ ID NO: 113332 - RNA, 45 nt, Mus musculus
guacuuuuauccacugagccaucucuccagugccagccaagaaua

SEQ ID NO: 113333 - RNA, 46 nt, Mus musculus
caacucaggguuucuacacugccuuugaccauuuuaguucccagau

SEQ ID NO: 113334 - RNA, 67 nt, Mus musculus
caggaagacauuuagcuugagaaguguuucccaagcacggcaggaagacagacaagaaggcaucagu

SEQ ID NO: 113335 - RNA, 46 nt, Mus musculus
uggaagaaacuuaugacccuuaacaaaucuacacuaaguaggcagg

SEQ ID NO: 113336 - RNA, 46 nt, Mus musculus
agcgaagcgcaccgaggcugcggaggcagagcugcaugcugggcgc

SEQ ID NO: 113337 - RNA, 46 nt, Mus musculus
uuccgcugguaccauuucccucucccuuucggggagugucauccag

SEQ ID NO: 113338 - RNA, 42 nt, Mus musculus
ugcaaaguuauguuccuuagccaggagggguucagggcuagc

SEQ ID NO: 113339 - RNA, 46 nt, Mus musculus
ccccacccuuaacuaccuucaccaucuucuccacucccagcccaac

SEQ ID NO: 113340 - RNA, 45 nt, Mus musculus
cagacucccagggaaugugguaagaguagugcccuguaagauugg

SEQ ID NO: 113341 - RNA, 41 nt, Mus musculus
ucuguguugggggguucugaauaagcuggggucaccuggga

SEQ ID NO: 113342 - RNA, 42 nt, Mus musculus
gcuagcucccacaacugucgaaggcaaggauuacagaccugg

SEQ ID NO: 113343 - RNA, 46 nt, Mus musculus
auauucuaggaccacauagagucagggugaugguggccaaccccag

SEQ ID NO: 113344 - RNA, 46 nt, Mus musculus
auuuugacaggguaggaguguguauguguaugugugugugcaugug

SEQ ID NO: 113345 - RNA, 44 nt, Mus musculus
aggagaaggagaaggagaaggagaaggagaaggagaaggccuau

SEQ ID NO: 113346 - RNA, 45 nt, Mus musculus
uuuucuuugcuacaagagguuagauugcuucugacuaucuuugau

SEQ ID NO: 113347 - RNA, 45 nt, Mus musculus
ucuaucuguugcccuccaccugaauccacuccaugcugccaccag

SEQ ID NO: 113348 - RNA, 46 nt, Mus musculus
guaaguguauguguauguguauguguauguguauguguaugugccu

SEQ ID NO: 113349 - RNA, 44 nt, Mus musculus
cguguguauguguguguguguguguguguguguguguauggugu

SEQ ID NO: 113350 - RNA, 41 nt, Mus musculus
gagagagagagagagagagagaggagggaaggagaggggga

SEQ ID NO: 113351 - RNA, 41 nt, Mus musculus
caacuaaucauuuugcuucuaaauauuaucuugugggcagg

SEQ ID NO: 113352 - RNA, 32 nt, Mus musculus
cuugggucugaggggauucuaugccucagauu

SEQ ID NO: 113353 - RNA, 41 nt, Mus musculus
ucccuugcugacuguggcacuuggguaaauuagcuagagca

SEQ ID NO: 113354 - RNA, 46 nt, Mus musculus
aucaccaucugugaggugcauggaagguucauuuuagugacuugag

SEQ ID NO: 113355 - RNA, 46 nt, Mus musculus
agcauaaaagcacaggagcagacugauagaguuuggcagucaucag

SEQ ID NO: 113356 - RNA, 47 nt, Mus musculus
uacuggacccuaugaagccugggggaccuuuugaagugauggcgcaa

SEQ ID NO: 113357 - RNA, 63 nt, Mus musculus
ggagaugucuggcuuugcagugggcagaguaacaugcagaugacuguuucacagguaauggag

SEQ ID NO: 113358 - RNA, 58 nt, Mus musculus
caucucagcuaagucaguguuggugauaaugaaggagaaggaaaaaggaguaacaagg

SEQ ID NO: 113359 - RNA, 46 nt, Mus musculus
acuagguuuucucccuaaaaagguuaaagguuacugcuaucccuag

SEQ ID NO: 113360 - RNA, 23 nt, Mus musculus
gguagggggauagagaggacuca

SEQ ID NO: 113361 - RNA, 46 nt, Mus musculus
ggaaccaugggauagugauguaauucauaguguucuuuagccucau

SEQ ID NO: 113362 - RNA, 41 nt, Mus musculus
uuccuuuucccuuuccccuuuccccuuuccccuuuccccuu

SEQ ID NO: 113363 - RNA, 45 nt, Mus musculus
uuggucagcccgagauaaagcccaugaggaaugaauguaacagug

SEQ ID NO: 113364 - RNA, 45 nt, Mus musculus
caagucaagaggguuuuauauucguuuaacucaguaacagcagua

SEQ ID NO: 113365 - RNA, 46 nt, Mus musculus
gcucugugcucgugagcacugucuguuucacuuugggaagguuucu

SEQ ID NO: 113366 - RNA, 57 nt, Mus musculus
cuaugugaaaacaugcugggugcuagcauuuauuauuguuguaagaagucaggacau

SEQ ID NO: 113367 - RNA, 63 nt, Mus musculus
uugcagggagagcugucuuguuaggaaagaugacagaugguguuugaaguaaugcagcgguga

SEQ ID NO: 113368 - RNA, 46 nt, Mus musculus
ucucucucucucucucucuguguguguguguguguguguuggugca

SEQ ID NO: 113369 - RNA, 45 nt, Mus musculus
caauauuuucuguacauucugguugucuuuggugaguugcccuag

SEQ ID NO: 113370 - RNA, 45 nt, Mus musculus
uauaaauauuaagccuuuugccaccguaaugaguuccugagacaa

SEQ ID NO: 113371 - RNA, 45 nt, Mus musculus
auaaaccccucauugaauagcucccagcuagcauauggccccucc

SEQ ID NO: 113372 - RNA, 45 nt, Mus musculus
aaggcuguggaggcuggugcuuuguguguucuuuacaacccccug

SEQ ID NO: 113373 - RNA, 46 nt, Mus musculus
caaaccuuacuaccccaugacaggccuuucaggucgccucugacag

SEQ ID NO: 113374 - RNA, 42 nt, Mus musculus
aaaaguucaacuaagccuaagccuaauucccacggaaggaag

SEQ ID NO: 113375 - RNA, 42 nt, Mus musculus
aacucacaagugauaaaucuucuggauuguacaucagcgcac

SEQ ID NO: 113376 - RNA, 45 nt, Mus musculus
uauaaaaagcaggggcuggugaucugauauuccuaacuaggguca

SEQ ID NO: 113377 - RNA, 54 nt, Mus musculus
ugggcacuucaugcuagcauacacucggguacugcaguagcccacaggauagau

SEQ ID NO: 113378 - RNA, 41 nt, Mus musculus
auuuucuggggucaguauggaucaacaaaggggugcugcca

SEQ ID NO: 113379 - RNA, 46 nt, Mus musculus
cagcggccuguggcuccccuucaguuagagcauguaucuggaggag

SEQ ID NO: 113380 - RNA, 42 nt, Mus musculus
gaagcgagcgcggugcagccggagcggcgcgggggggggggg

SEQ ID NO: 113381 - RNA, 42 nt, Mus musculus
cuguucuacugaccaucuugcccuccaccuccaggcacagcc

SEQ ID NO: 113382 - RNA, 45 nt, Mus musculus
cuuaaagaaaaucaugaauggacucacaccaucuucacgguaguc

SEQ ID NO: 113383 - RNA, 41 nt, Mus musculus
cugugcuuacaaaaacagaacucacaagcucauuggcauag

SEQ ID NO: 113384 - RNA, 46 nt, Mus musculus
aauaacaaaggucaaugaaagacaaguuuaaaaggaaaaaguacau

SEQ ID NO: 113385 - RNA, 46 nt, Mus musculus
cauaacauuacagauuuuggggcucuuuuucacaauaaagccacua

SEQ ID NO: 113386 - RNA, 46 nt, Mus musculus
gggaacaccuucauagaagcagggguagggggauaguacagggggu

SEQ ID NO: 113387 - RNA, 45 nt, Mus musculus
uagaaaaaauuacauucuuugcuaaagaaaguuugguuagucuua

SEQ ID NO: 113388 - RNA, 46 nt, Mus musculus
gguguucuucucuacuacaaaauuaauuagcauuuuggggguaaag

SEQ ID NO: 113389 - RNA, 45 nt, Mus musculus
agaacucacagaagggaaaaauaugucaaaaauagacaauuuaca

SEQ ID NO: 113390 - RNA, 42 nt, Mus musculus
agguugcucaagaaaaaguacauggguguguggagucguggg

SEQ ID NO: 113391 - RNA, 41 nt, Mus musculus
auuggaugcguuuugugcuuccuguacacagugauggccua

SEQ ID NO: 113392 - RNA, 46 nt, Mus musculus
aggaagaggggcagcugcagcucugguuuguuuguuaacccuguga

SEQ ID NO: 113393 - RNA, 42 nt, Mus musculus
cugugacuguggagaaccacauaucaauaaaggagagguugg

SEQ ID NO: 113394 - RNA, 46 nt, Mus musculus
augugagagcugcaggugcugagggccuuggaccuacccuuugcag

SEQ ID NO: 113395 - RNA, 46 nt, Mus musculus
aaccaccaguucauugauggaggugcuugugcaggacagcuucaag

SEQ ID NO: 113396 - RNA, 40 nt, Mus musculus
cgacuuaaagaaaaggauaggcugaagccuaagaagaaag

SEQ ID NO: 113397 - RNA, 48 nt, Mus musculus
caauaaugaguccauugcccgaaaggguuaauauguagaugagaaaga

SEQ ID NO: 113398 - RNA, 41 nt, Mus musculus
gcugcccagaaucaagaacucagugguacccaggaagaagu

SEQ ID NO: 113399 - RNA, 42 nt, Mus musculus
cccaaccauuaugaccagcaaucucugccuacagcuggcccu

SEQ ID NO: 113400 - RNA, 45 nt, Mus musculus
uuuggcggccaguggcugaagggauccguaggaugguggauaaga

SEQ ID NO: 113401 - RNA, 45 nt, Mus musculus
uaguguuuaguacagacaccaccuuauuaaucuuaaaggaggagu

SEQ ID NO: 113402 - RNA, 46 nt, Mus musculus
ccuuuauuuacaccauuagaaacaaagaggugaagggggcccuaag

SEQ ID NO: 113403 - RNA, 46 nt, Mus musculus
uacgagacagccacagcccaggggaaagugugugagaggaccaggu

SEQ ID NO: 113404 - RNA, 47 nt, Mus musculus
ggagugccacaucuaggguuuugcugucagguuauucuguccauagu

SEQ ID NO: 113405 - RNA, 45 nt, Mus musculus
cugucuuaaaagcauguaauaucauaaauaacucacacucgaaug

SEQ ID NO: 113406 - RNA, 83 nt, Mus musculus
cauuuauuauuuggcagccaaaguuaugcagauauauuaaaauucccacaacaaauacaggcaacaauaaucuuacaacagag

SEQ ID NO: 113407 - RNA, 75 nt, Mus musculus
caaacucuuuguuuacuguuggauucacaauggaucagugagggauaaugaaggaggcuuauuuaagaaccgaga

SEQ ID NO: 113408 - RNA, 71 nt, Mus musculus
gguguggcauccuggaccaguuguaucaauaggcucauuuugaaggagaugauuuuucuaucuaaaggcaa

SEQ ID NO: 113409 - RNA, 57 nt, Mus musculus
gcuuauuacaauagcuuuuaagaaacagaaagaggaauggaaaaugagaagauagga

SEQ ID NO: 113410 - RNA, 67 nt, Mus musculus
uguuuuguuuugccacuucuucucucauaaaagucauauuugagaagcaagagaauauuggcucaaa

SEQ ID NO: 113411 - RNA, 46 nt, Mus musculus
uuggcauauucauggcuaugagucacaugcauccugacaacugcag

SEQ ID NO: 113412 - RNA, 42 nt, Mus musculus
gaggcaguauaaauugaauuaaguaaguuguugaacacagau

SEQ ID NO: 113413 - RNA, 46 nt, Mus musculus
acuaaauucuugacuguugucuuccaaugcugcugugccacaaaag

SEQ ID NO: 113414 - RNA, 42 nt, Mus musculus
uuacuaaugaacucaaugacuuaccaaccuauauggguagaa

SEQ ID NO: 113415 - RNA, 45 nt, Mus musculus
auugcaaaacugaagagacugauauaaucugucaagcugcugaga

SEQ ID NO: 113416 - RNA, 45 nt, Mus musculus
acaguuguuuauauucacagauuucugcugucaucagugucuaau

SEQ ID NO: 113417 - RNA, 46 nt, Mus musculus
uggaugcuuacagucagcuauuggauggaacacaaggcccccaaug

SEQ ID NO: 113418 - RNA, 45 nt, Mus musculus
aaauacccauggaaggaguuacagagacgaaguuuggagcugaga

SEQ ID NO: 113419 - RNA, 42 nt, Mus musculus
guacccacgauacaauuugcaaaacacaggaaacucaagacg

SEQ ID NO: 113420 - RNA, 50 nt, Mus musculus
cuacuaugaacauauagcgguuacaacaauuacauaugcagccaauugcu

SEQ ID NO: 113421 - RNA, 41 nt, Mus musculus
uucugacacuaugaaagccagaaccagcaggugagaaccuu

SEQ ID NO: 113422 - RNA, 45 nt, Mus musculus
ccacugggaaaauaagugagugaagagggcaaaaguaagucagaa

SEQ ID NO: 113423 - RNA, 44 nt, Mus musculus
cacagugacaaugacagguugaggcaugcacuaacacugaucgg

SEQ ID NO: 113424 - RNA, 73 nt, Mus musculus
caugcccauucaaaaggcaugcaacacaacuaacaaggacacagaaucugaaaggaucaaagaugaguugggg

SEQ ID NO: 113425 - RNA, 46 nt, Mus musculus
uaacuagcuauuuggacuuaaaugauuauauuuaguagacuuagau

SEQ ID NO: 113426 - RNA, 45 nt, Mus musculus
cucacacacaccagaaccaacccuguaaaagguaaagcccuguag

SEQ ID NO: 113427 - RNA, 52 nt, Mus musculus
gauaguccugcugcucgcuuuguauuuacuuuagcaaucgcaaaaacucagg

SEQ ID NO: 113428 - RNA, 46 nt, Mus musculus
ggucuucaaggagcaucauguccaaaagguuccauacacugcgagu

SEQ ID NO: 113429 - RNA, 46 nt, Mus musculus
gcuuaauaaaaagaucucuauuauuuuaaaugucugagaaccagau

SEQ ID NO: 113430 - RNA, 72 nt, Mus musculus
ccagacauuaaauaauuuaaugucaauacucacuauuuacccagauauauaucccuuuaugcuaacauucac

SEQ ID NO: 113431 - RNA, 46 nt, Mus musculus
aacgagacuauaagauccugaagggaggagcacacugcacccuaaa

SEQ ID NO: 113432 - RNA, 45 nt, Mus musculus
uggcuccauucuugcaucugaucuauucugaguuugccccacuga

SEQ ID NO: 113433 - RNA, 46 nt, Mus musculus
cucucauggaaguggcacucacaguagagaagagaggccccaagag

SEQ ID NO: 113434 - RNA, 45 nt, Mus musculus
accagaucucuuggggccucucuucucuacugugagugccacuuc

SEQ ID NO: 113435 - RNA, 57 nt, Mus musculus
gaagacugugauuuaccguuuguacagguaccugaggaggccagaagaguuacaggu

SEQ ID NO: 113436 - RNA, 46 nt, Mus musculus
aaaacugguggugcacaccuuuaauccuagcacuugggaggcagag

SEQ ID NO: 113437 - RNA, 41 nt, Mus musculus
uagcaguaagcaccauuacccauuaaaccaucuugccuagu

SEQ ID NO: 113438 - RNA, 46 nt, Mus musculus
gcagcugggauccuuggcaagggggcacagcugaaugcuccaagau

SEQ ID NO: 113439 - RNA, 46 nt, Mus musculus
cuucccaagggaaaacauaaacaauaucuauccuuugucucaaguu

SEQ ID NO: 113440 - RNA, 46 nt, Mus musculus
auuugagaucaaaugucuuacuguuuucuguguucagaagggagau

SEQ ID NO: 113441 - RNA, 46 nt, Mus musculus
aguagaagaaaggcauuaggagguaaagccacacuauugugaguag

SEQ ID NO: 113442 - RNA, 46 nt, Mus musculus
cccagauccagccuugaggaacagucccccuccacaucacacagau

SEQ ID NO: 113443 - RNA, 41 nt, Mus musculus
ccugaucugugugauguggagggggacuguuccucaaggcu

SEQ ID NO: 113444 - RNA, 45 nt, Mus musculus
cugcuuuuggguuucaucuagaaccaugagcccgguggggccggg

SEQ ID NO: 113445 - RNA, 42 nt, Mus musculus
ggaccccaagguucaacauccaaagaaauuuaaaacccaauc

SEQ ID NO: 113446 - RNA, 46 nt, Mus musculus
cuucagggcugcuuacuguuuguuuucucagauuaccauccuagga

SEQ ID NO: 113447 - RNA, 55 nt, Mus musculus
acaaagggaacgagaugaggaggggaaacucaagcugcaaaggcacacgaagaac

SEQ ID NO: 113448 - RNA, 42 nt, Mus musculus
ccucgucaugcugcaaggucuccuguuccuguguccccagau

SEQ ID NO: 113449 - RNA, 46 nt, Mus musculus
ccacuagugaauucuaucugcuuuucucagccccguaauuucagau

SEQ ID NO: 113450 - RNA, 46 nt, Mus musculus
gcuucagguauccuacuguauuuugagguaggcuccauccagagac

SEQ ID NO: 113451 - RNA, 46 nt, Mus musculus
uccaagacauacucuccauagaauucuuuuuguguuggauccagau

SEQ ID NO: 113452 - RNA, 50 nt, Mus musculus
gggugucaucuuugucagcuaacugaucuuuaaucucacugugggguagg

SEQ ID NO: 113453 - RNA, 65 nt, Mus musculus
cuguauuuucucauuuucuauucacuguuuuuucaagcaccguucuuucuuccuuucuguuggaa

SEQ ID NO: 113454 - RNA, 49 nt, Mus musculus
ugcugcccaucuugagcauuucuagugcuuucacccgagccucaguaac

SEQ ID NO: 113455 - RNA, 34 nt, Mus musculus
cagagcaaaggccucuguuaacuggucggacauc

SEQ ID NO: 113456 - RNA, 87 nt, Mus musculus
gguaucaucuagucugggaauuggaaaugcugcucaagagacgggaaaaagaguacaucaugauuggcucaacacuucuuugacuua

SEQ ID NO: 113457 - RNA, 27 nt, Mus musculus
auaugccaucuaucacuaaugcuuccu

SEQ ID NO: 113458 - RNA, 48 nt, Mus musculus
aucuguuauacaaugagaggauuuugaauggguuuucuaagaaaugga

SEQ ID NO: 113459 - RNA, 42 nt, Mus musculus
cuucugaggcaucucugaccugcccguaccuuacaucaccuc

SEQ ID NO: 113460 - RNA, 87 nt, Mus musculus
ggaaaggagcagccugucaaaauccuugugaaggagccuuaaggauuuguccuucaaaauucuuccccuuugucuccagcaucaaag

SEQ ID NO: 113461 - RNA, 46 nt, Mus musculus
aagagcuuuagaucccuucucacaagccaaaugaaggagggcaggc

SEQ ID NO: 113462 - RNA, 41 nt, Mus musculus
cuuccuucucaugcuuuaaucccacauccugugccccauuu

SEQ ID NO: 113463 - RNA, 45 nt, Mus musculus
gaauuauaugcugugggcuauauucuauuuuauuuuacugguaga

SEQ ID NO: 113464 - RNA, 45 nt, Mus musculus
caguucugaugaguacccuccuuauauaggauaccaaacaaacac

SEQ ID NO: 113465 - RNA, 60 nt, Mus musculus
uuagugugauuauucagauagucaaaacagaagcccacgccuuauaauauaccuaucugc

SEQ ID NO: 113466 - RNA, 45 nt, Mus musculus
uugacuugacuucuugugucauaagguuugaacguugguugggga

SEQ ID NO: 113467 - RNA, 46 nt, Mus musculus
uuuccaugcuggaagacacccacacaggaguagguggugccgagau

SEQ ID NO: 113468 - RNA, 51 nt, Mus musculus
gcacaaagaugcuggcgacuuaccaaaaacuguguuggugggguucauugc

SEQ ID NO: 113469 - RNA, 45 nt, Mus musculus
ucuagauggacguaaucucuagugcaggaagccaaggcccauauu

SEQ ID NO: 113470 - RNA, 52 nt, Mus musculus
acuuggaccuugggccugccugcaucauucaccaccaugaagggccagugcu

SEQ ID NO: 113471 - RNA, 45 nt, Mus musculus
auucccucauagagagaaucaaucucaauacuggccugggugcug

SEQ ID NO: 113472 - RNA, 42 nt, Mus musculus
cugccuuucagguacaacuuuuauguaauaaaagccagagca

SEQ ID NO: 113473 - RNA, 46 nt, Mus musculus
ugaaacgccaugauugucuaaacaagucuccccucugcccugaucc

SEQ ID NO: 113474 - RNA, 46 nt, Mus musculus
uuguuuuucuaagacacagaaauguauuuaauaaaaccuucaagag

SEQ ID NO: 113475 - RNA, 45 nt, Mus musculus
cuuugcuaaaacugauuccagaccuccauaucucugccccaaguu

SEQ ID NO: 113476 - RNA, 41 nt, Mus musculus
cuucucugggaucuccccccaaacaggaaacaaccccaagg

SEQ ID NO: 113477 - RNA, 46 nt, Mus musculus
agccuucaggaugcuaacagaccuguaguucuccaugcccucagcu

SEQ ID NO: 113478 - RNA, 44 nt, Mus musculus
ugauacgagaaguaaguugagaguggaaggauuuggcuggcagu

SEQ ID NO: 113479 - RNA, 45 nt, Mus musculus
aacuacacuuucacgguccaagcgcggugucucuuugguagccag

SEQ ID NO: 113480 - RNA, 45 nt, Mus musculus
aguguaaugaacaguaagguauuccggcaaccaugagcaggaaac

SEQ ID NO: 113481 - RNA, 46 nt, Mus musculus
aucaagaaaacgcccuacagacugucacaggcuaaaugauggagau

SEQ ID NO: 113482 - RNA, 46 nt, Mus musculus
aagagcguaacuacuucgcuccacaauaagacagucaucgucagca

SEQ ID NO: 113483 - RNA, 42 nt, Mus musculus
gcuacguggugaaccuuuucuggucauuugaugcccacaaac

SEQ ID NO: 113484 - RNA, 46 nt, Mus musculus
aguggagccugccucagucagggacguggugguaaaagagauggau

SEQ ID NO: 113485 - RNA, 46 nt, Mus musculus
aggguugcauaucagauaucuaccuuaugauuaauagcagcagcua

SEQ ID NO: 113486 - RNA, 41 nt, Mus musculus
agagagagagagagagagagagagagagagacuggaaccag

SEQ ID NO: 113487 - RNA, 46 nt, Mus musculus
uguaugaguguguguucauguauguacacacuccugugucugugua

SEQ ID NO: 113488 - RNA, 73 nt, Mus musculus
ggagugugcaucagcuugauuuggaaaugcgaugggauggaugacugcggggacuacucugacgaggccaacu

SEQ ID NO: 113489 - RNA, 45 nt, Mus musculus
uucuguuagaacacauggcaucucucaucuuguggcaucuguagg

SEQ ID NO: 113490 - RNA, 46 nt, Mus musculus
gggggaaucuauauucuggauucauuuucuuagucccuaguuaguu

SEQ ID NO: 113491 - RNA, 28 nt, Mus musculus
ugggugugcgauggagacaacgacugua

SEQ ID NO: 113492 - RNA, 42 nt, Mus musculus
aucagagguguguguguguguguguguguguguguguacacg

SEQ ID NO: 113493 - RNA, 45 nt, Mus musculus
uagugcaggagcccggagcaccuaucagucuagaaggagagugag

SEQ ID NO: 113494 - RNA, 46 nt, Mus musculus
uccuuagugggauuuuccaauauggcaggaucucuucaugucagag

SEQ ID NO: 113495 - RNA, 46 nt, Mus musculus
gucgucuguguguguguguguguguguguguguguguguguagggg

SEQ ID NO: 113496 - RNA, 45 nt, Mus musculus
augggacaucucucacagacaacagaguuuauguugcuugcuugg

SEQ ID NO: 113497 - RNA, 44 nt, Mus musculus
ggaaaagagcaggucucccagggauaucaaccgaacauggcaua

SEQ ID NO: 113498 - RNA, 46 nt, Mus musculus
guauaacccagaucagcaguuuuuggauguuacuggaauagcagac

SEQ ID NO: 113499 - RNA, 79 nt, Mus musculus
gcauggggaacauugagcagagguagagugaggagcauggggagcacugagcagagguagagugaggagcauggggagc

SEQ ID NO: 113500 - RNA, 83 nt, Mus musculus
agagguagggugaggagcauggggagcacugagcagagguagggugaggagcauggggagcacuaagcagagguagagugagg

SEQ ID NO: 113501 - RNA, 58 nt, Mus musculus
ugagcagagguagggugaggagcauggggagcauugagcagagguagagugaggagca

SEQ ID NO: 113502 - RNA, 46 nt, Mus musculus
ucuggacugacuggggggaccugaagccugggauuuaccggagcua

SEQ ID NO: 113503 - RNA, 42 nt, Mus musculus
ccccagugguucuagaaugagacccgggaguagagggcaggu

SEQ ID NO: 113504 - RNA, 79 nt, Mus musculus
aauuccggccuggagaccguggaggcuuuggccuucgaaccccucagccaauuacuuuacuggguggaugccggcuuua

SEQ ID NO: 113505 - RNA, 46 nt, Mus musculus
gaacuugguuggaaggcuuuaguaguccccaaguagucaccaaggu

SEQ ID NO: 113506 - RNA, 44 nt, Mus musculus
ucaucuugccagcccaguauugagguucuuauaaagcagguuau

SEQ ID NO: 113507 - RNA, 44 nt, Mus musculus
gccuuguccuguggguucuucauacaggagaacgagaggguaug

SEQ ID NO: 113508 - RNA, 42 nt, Mus musculus
gcauccagcuguguggacagggcaacaucaggcagugcagca

SEQ ID NO: 113509 - RNA, 88 nt, Mus musculus
caccugcacagauccccgugacaggagaugagaagucaccugagaggaagauuggcugccuuuaguguggagcuugaaaggauggaga

SEQ ID NO: 113510 - RNA, 45 nt, Mus musculus
ccucaugccacgugcuuuaauggggaagacuuugaccggccagug

SEQ ID NO: 113511 - RNA, 42 nt, Mus musculus
uccccaucugaugagcgaggaaaugaguguuugcuaggacac

SEQ ID NO: 113512 - RNA, 45 nt, Mus musculus
ucuuguguaguaccugguaguaagucuaaauauauauaugcugaa

SEQ ID NO: 113513 - RNA, 44 nt, Mus musculus
uuccuuuggaagaaugagggggauagauguauuccagagaagac

SEQ ID NO: 113514 - RNA, 42 nt, Mus musculus
agcacggugacaucauggccauuuagcaagacagcagcaggc

SEQ ID NO: 113515 - RNA, 45 nt, Mus musculus
ggaucugccugugcccaugggaacgcuagggcgucggagccaguu

SEQ ID NO: 113516 - RNA, 41 nt, Mus musculus
agagguguuugcuccuccuuccgcuguucuaaaaggcagag

SEQ ID NO: 113517 - RNA, 46 nt, Mus musculus
agaaugaucaccacccuacuguuuucauauucuaaucugcucagac

SEQ ID NO: 113518 - RNA, 42 nt, Mus musculus
uguguguguguauguguguguguguguuugugugcauauguc

SEQ ID NO: 113519 - RNA, 46 nt, Mus musculus
aaggcugaacaucauaguagaacaagcuugauugaucauggcagac

SEQ ID NO: 113520 - RNA, 44 nt, Mus musculus
accgugaacauuaaccaucauaggugguauguuagcuuucuguc

SEQ ID NO: 113521 - RNA, 45 nt, Mus musculus
gagucuauauugccacccugauuaaugguucuaugaaugaggaga

SEQ ID NO: 113522 - RNA, 46 nt, Mus musculus
gccuggcaaaagcuggcaggcaguaaaugcuaaagcccccagaaga

SEQ ID NO: 113523 - RNA, 46 nt, Mus musculus
uaggacaggugcucuuugagugcuaccuucucugagggcuggggag

SEQ ID NO: 113524 - RNA, 31 nt, Mus musculus
gcaggugcauagagccucugccaguggacac

SEQ ID NO: 113525 - RNA, 46 nt, Mus musculus
gaguaccugggaugugccaaucugauuaguguuguuacugggacga

SEQ ID NO: 113526 - RNA, 46 nt, Mus musculus
cccugaacgucagggaggauggaugugguauagacauccuguuuau

SEQ ID NO: 113527 - RNA, 46 nt, Mus musculus
uugucagugaacauaccugaagaagguagaaggccagaguggagaa

SEQ ID NO: 113528 - RNA, 36 nt, Mus musculus
uguguucacauuuguguguucacaugugugugcgug

SEQ ID NO: 113529 - RNA, 45 nt, Mus musculus
uggagaagagaacaugucaccagccgcccccacacuagcaucuga

SEQ ID NO: 113530 - RNA, 46 nt, Mus musculus
gaggaaggggccggggccgagaaagcuaguaaauguaugugcagau

SEQ ID NO: 113531 - RNA, 47 nt, Mus musculus
gagccaucucuaccauccccaaauuuaucauuuuaaugagcagcaua

SEQ ID NO: 113532 - RNA, 46 nt, Mus musculus
ugcauguauauguauggaucccaagugugccuggugcguacagagu

SEQ ID NO: 113533 - RNA, 45 nt, Mus musculus
agaaagagagggaaaacaaaacaaaacaaaaaaggcagaaaagaa

SEQ ID NO: 113534 - RNA, 46 nt, Mus musculus
uuguccagagcaucuaggaucaguuuucuagacauuguuguuagau

SEQ ID NO: 113535 - RNA, 45 nt, Mus musculus
guugcauaaaccugugaacucuucagguucuguauaaguucuggc

SEQ ID NO: 113536 - RNA, 41 nt, Mus musculus
ggcccucaugccucucgcucaucuuuaucuuggccccaccu

SEQ ID NO: 113537 - RNA, 45 nt, Mus musculus
uugcauguguguguauguguguauguauguauguauguguguaug

SEQ ID NO: 113538 - RNA, 46 nt, Mus musculus
guguauguauguguguauguguguguauguauguguguaugugcau

SEQ ID NO: 113539 - RNA, 41 nt, Mus musculus
auguccuuggacugauucccuugccuugguugccuuguaga

SEQ ID NO: 113540 - RNA, 45 nt, Mus musculus
uaaugaggcugcugccgagugugagauuuacauuagaugcugggg

SEQ ID NO: 113541 - RNA, 36 nt, Mus musculus
gaggucaguagugggagcagaguugguaggggccua

SEQ ID NO: 113542 - RNA, 33 nt, Mus musculus
uuggccacugugccaucucuucagcccccgccc

SEQ ID NO: 113543 - RNA, 45 nt, Mus musculus
guacuagaggaggccagaagaggacguuagaucccuggagucaga

SEQ ID NO: 113544 - RNA, 41 nt, Mus musculus
gcugucuggguuggguguauucagaguuagucucaggaugu

SEQ ID NO: 113545 - RNA, 82 nt, Mus musculus
ugucucuugauuucaguguggugucuggugcuuggugagugguagagagagaggcauuaagaagcagcagaaacacuucuca

SEQ ID NO: 113546 - RNA, 45 nt, Mus musculus
ggggacuucuguuagcaguaaucuaaaaggcuacuuuuguucaga

SEQ ID NO: 113547 - RNA, 42 nt, Mus musculus
ugucauuuacauaggugucuuguuuguuccuagggugcagau

SEQ ID NO: 113548 - RNA, 42 nt, Mus musculus
gaccuuccucuccuggcucccuugacuguccuuggggugcau

SEQ ID NO: 113549 - RNA, 45 nt, Mus musculus
aguguccuucugauucugauauuuccuuuauuaucuuacccacaa

SEQ ID NO: 113550 - RNA, 46 nt, Mus musculus
ggccuggaacccugcugcggguaguagaaguaccuuugggggaagu

SEQ ID NO: 113551 - RNA, 83 nt, Mus musculus
gcuccucuccauucccagauggauauccuguagcucagacagagaagcgacuuuccccagguuagacagcuaaugaauugugg

SEQ ID NO: 113552 - RNA, 89 nt, Mus musculus
gucuuacucuuagguuccaggccuagugaugccgauguuaaauuuguauguggagcugugcuguaaagaacggcugauuggggcagaaa

SEQ ID NO: 113553 - RNA, 49 nt, Mus musculus
cagguuuccugaaaguguuaauugucacuaguugaaaaaguuaguguag

SEQ ID NO: 113554 - RNA, 46 nt, Mus musculus
agcaggagaagaaguauuaggugugccgggcgaaaguuggggagag

SEQ ID NO: 113555 - RNA, 45 nt, Mus musculus
uggaggagccucgcauuguugacuggagucuucuuccuuagagau

SEQ ID NO: 113556 - RNA, 45 nt, Mus musculus
uuuuagaggacggagaggauacaguguccugguuugagacuagaa

SEQ ID NO: 113557 - RNA, 42 nt, Mus musculus
agggagguggugagaaggucacuagccucaggggggacagaa

SEQ ID NO: 113558 - RNA, 31 nt, Mus musculus
agcaaacaaagaaaacaauugaacucgaggu

SEQ ID NO: 113559 - RNA, 41 nt, Mus musculus
uuauuaaucuguaugcuuguuugaacucuuacccugcacca

SEQ ID NO: 113560 - RNA, 42 nt, Mus musculus
ugggauuucugccacaagcucuaaccuggugcaggcccuucg

SEQ ID NO: 113561 - RNA, 41 nt, Mus musculus
guacccguccucacuagggcugccuuccuaggcccccauuc

SEQ ID NO: 113562 - RNA, 46 nt, Mus musculus
gaggggaaaaaccaacaacauagcaacagacaagaagaggcaucag

SEQ ID NO: 113563 - RNA, 45 nt, Mus musculus
agagcaucaggcccuaaugggucagccccggcccaaagcaggaga

SEQ ID NO: 113564 - RNA, 27 nt, Mus musculus
gaagcacauggccuggaaaaacugcaa

SEQ ID NO: 113565 - RNA, 46 nt, Mus musculus
uacugcaacacagucucuguggccuacuggaaggaagagguguucu

SEQ ID NO: 113566 - RNA, 46 nt, Mus musculus
gccuuucuuacaccugcaguucaaagcauucagcaugacaaaggac

SEQ ID NO: 113567 - RNA, 45 nt, Mus musculus
cuccaaagcccagcuccauccuagggcuucuuuaguuugcauuga

SEQ ID NO: 113568 - RNA, 79 nt, Mus musculus
gauaaaggcaggccagagggaacugacaccuacauauagggagaggaaaagagggacacacggugacuguuucugccag

SEQ ID NO: 113569 - RNA, 46 nt, Mus musculus
ucccccuauaacuuuaucugacuuuauaaauaaaaaaacacggaag

SEQ ID NO: 113570 - RNA, 46 nt, Mus musculus
cagccuaggcuacauagucagaccuugucucaagaaagaaagagag

SEQ ID NO: 113571 - RNA, 45 nt, Mus musculus
agaauaaacuuccuaagaagggcaggaaggcuuuaccaggguuug

SEQ ID NO: 113572 - RNA, 44 nt, Mus musculus
auuuuuguugcuguagcauucuuuuuaaaaaugugccauaaaca

SEQ ID NO: 113573 - RNA, 42 nt, Mus musculus
uacagaaauauguaaguaaaaucgaaaacaagacacugauca

SEQ ID NO: 113574 - RNA, 49 nt, Mus musculus
ggaaguuuggguaugagaaagguagaguggauaugaucgaaaugcgagg

SEQ ID NO: 113575 - RNA, 46 nt, Mus musculus
caucuccaucaucccuaacccccgaaggaagaggaggcagagagau

SEQ ID NO: 113576 - RNA, 46 nt, Mus musculus
aauggcuauuugugcaaaaaaaaaaaacaccaauaaaaguugauca

SEQ ID NO: 113577 - RNA, 71 nt, Mus musculus
uguauuucucaguuacaaagcugacuuuuuuuuaaugaagggaauaauugccaaguacuuaaaucuaccug

SEQ ID NO: 113578 - RNA, 78 nt, Mus musculus
caugaaucuggauaaugcuagguauaaacuuguggcacccagugacaucuuuuuuuaaucaaguggacacacuuuuga

SEQ ID NO: 113579 - RNA, 45 nt, Mus musculus
gcuguccuggaacucuguagacugggcuggccucgaacucagaga

SEQ ID NO: 113580 - RNA, 47 nt, Mus musculus
gcucuuccauaauucagucuagauaggagauuauuuaacugaagauc

SEQ ID NO: 113581 - RNA, 47 nt, Mus musculus
guacuuccuauacagaggcaccuuacucucuggggcauuaucagauu

SEQ ID NO: 113582 - RNA, 44 nt, Mus musculus
auaggaauaucaguccaagcaagcugauacgugaguggcagugg

SEQ ID NO: 113583 - RNA, 44 nt, Mus musculus
acagcuuugcagaaaacggcuguaaaggcaaaaaaguaggcaau

SEQ ID NO: 113584 - RNA, 45 nt, Mus musculus
ucuuugacuauaacuauggacaguauuucacauugugggauagaa

SEQ ID NO: 113585 - RNA, 46 nt, Mus musculus
agguagugcacuuuccuaagguagaacuuaggaaagcugauaggaa

SEQ ID NO: 113586 - RNA, 41 nt, Mus musculus
aggagguagcugauuagaaggggcuuugacaaugcgugaga

SEQ ID NO: 113587 - RNA, 44 nt, Mus musculus
gcuauuauuuugucuaugaucauuccuuaaugaaacacccacag

SEQ ID NO: 113588 - RNA, 45 nt, Mus musculus
ugacccugccgugugaucaaugucuaauugcaaccauguuuaaaa

SEQ ID NO: 113589 - RNA, 46 nt, Mus musculus
gcaucugguaauaacuagaguuuaagcuaaaacuuaggaugauaaa

SEQ ID NO: 113590 - RNA, 45 nt, Mus musculus
ugaucauguugcuucuaguggcaugauugagaaacugccggaaag

SEQ ID NO: 113591 - RNA, 44 nt, Mus musculus
acacuaaaaagacauugauacuuaacuccaucaggccccgaaua

SEQ ID NO: 113592 - RNA, 44 nt, Mus musculus
gguuuucuugcaggaauguuccuccuggugcccacacauucucc

SEQ ID NO: 113593 - RNA, 43 nt, Mus musculus
uucucuugaaagcugccuggacaacagcuauucugccacguuu

SEQ ID NO: 113594 - RNA, 44 nt, Mus musculus
ccuucaaguuaccacacgucacgggaagcaacucagcacuaaaa

SEQ ID NO: 113595 - RNA, 46 nt, Mus musculus
gagggugugaaccaguuuccauucugacacuguauggacuucacag

SEQ ID NO: 113596 - RNA, 48 nt, Mus musculus
gggaacgaugcaaguucuguguucucugcucuuuucuuuugcgaugua

SEQ ID NO: 113597 - RNA, 85 nt, Mus musculus
uaugacaguccucauggaaggcucuggaacaaguaucacagcagaagaguauuccuccaucccggcacaccucacauucaucuga

SEQ ID NO: 113598 - RNA, 42 nt, Mus musculus
ggggagccaucucccucugcaguaucucagauucuggaagac

SEQ ID NO: 113599 - RNA, 46 nt, Mus musculus
ugaauuccagauuuuuaaugcaaaauauuuaucauuuguaccagaa

SEQ ID NO: 113600 - RNA, 45 nt, Mus musculus
cccugggggcaacggggaguagggaugcugccuccaagaccaccg

SEQ ID NO: 113601 - RNA, 54 nt, Mus musculus
gcaacugugccucugggaugaggaccccuaacaacaggagacagaggaccaaga

SEQ ID NO: 113602 - RNA, 54 nt, Mus musculus
ccuggccugguacccaugcaugcucaaguauugccacagucgugaucggccagc

SEQ ID NO: 113603 - RNA, 53 nt, Mus musculus
uucgaggcucugcccaaggcauuagaacaggcggaauuaccucguuguggacg

SEQ ID NO: 113604 - RNA, 42 nt, Mus musculus
uaugugcugaggccacagaugccaucuacacccgccaggagg

SEQ ID NO: 113605 - RNA, 75 nt, Mus musculus
caggcacuuugcuuugucacaaggcugcaccacaaugacaucauccccagugaggccauggccaagcuccggcag

SEQ ID NO: 113606 - RNA, 45 nt, Mus musculus
accccgugucaggaacccugagucagcuagacaguggggagcagu

SEQ ID NO: 113607 - RNA, 45 nt, Mus musculus
aagggcugaacuacuugggagccagaggaccuaggcagaguuggg

SEQ ID NO: 113608 - RNA, 42 nt, Mus musculus
caagaguccugucccacccaccacggagggcgggcaagcugu

SEQ ID NO: 113609 - RNA, 45 nt, Mus musculus
uguauauuccauguaggaggaugugacugguaaaagagcgggauc

SEQ ID NO: 113610 - RNA, 45 nt, Mus musculus
aaaguaaaauaucagccugcauugacacccauccccugcccccug

SEQ ID NO: 113611 - RNA, 46 nt, Mus musculus
uccuuuuuauuggggagacucaaguccucugagaaguucuggagag

SEQ ID NO: 113612 - RNA, 46 nt, Mus musculus
guguguguguguguguggugugguaugagugugugguguguguauu

SEQ ID NO: 113613 - RNA, 43 nt, Mus musculus
ugacacucaggcaagcacauggaaacucucccugccugcuauu

SEQ ID NO: 113614 - RNA, 48 nt, Mus musculus
caggguucaugcaccauuuuauaguccucaaaacuaggcagcuauuag

SEQ ID NO: 113615 - RNA, 46 nt, Mus musculus
ccugucaccugaccuaauguuagugacccagagacucuggcaagaa

SEQ ID NO: 113616 - RNA, 56 nt, Mus musculus
agagaggagaagaggggaggggaagggaagagguaggaggaggaggaagggaggag

SEQ ID NO: 113617 - RNA, 41 nt, Mus musculus
gaggcgaagggggcaugacucgugcaacuuacugcgggcau

SEQ ID NO: 113618 - RNA, 45 nt, Mus musculus
ugccagcagaaucagcccugggcuggggagggaagaugggauuuc

SEQ ID NO: 113619 - RNA, 58 nt, Mus musculus
uucagcauuaguguaaugucuuaugagaaacagcggggaucaaaggauauggguaagg

SEQ ID NO: 113620 - RNA, 46 nt, Mus musculus
aauaggguuugaugauaaaagaugguguaaugugaccuucggccag

SEQ ID NO: 113621 - RNA, 45 nt, Mus musculus
cgcccugugugacuucucagucacacagaauaccaggcagacaag

SEQ ID NO: 113622 - RNA, 42 nt, Mus musculus
guggggauacaguccacccuagaaggaaagguguaagugcag

SEQ ID NO: 113623 - RNA, 28 nt, Mus musculus
ggaacaccgcuugccuccuuuuuauuca

SEQ ID NO: 113624 - RNA, 46 nt, Mus musculus
cucaucucaccugcaaauaaauaaaagcaaguaucauugccaccaa

SEQ ID NO: 113625 - RNA, 46 nt, Mus musculus
ccaggaaccuucagaagagguuccaucguggagaacuaacuugcag

SEQ ID NO: 113626 - RNA, 42 nt, Mus musculus
aaacggacuuucccuucagcaaaaaggauggagauuaaacag

SEQ ID NO: 113627 - RNA, 42 nt, Mus musculus
cuggaaaaagagccacagcuuacugggucaagguagccccag

SEQ ID NO: 113628 - RNA, 45 nt, Mus musculus
ugccugcaccuugauucucuaagguggacagaccuccagcccccc

SEQ ID NO: 113629 - RNA, 44 nt, Mus musculus
aauuguaagucacuucacucuacugaguagucuccauccuccuc

SEQ ID NO: 113630 - RNA, 23 nt, Mus musculus
cccaaggcugcggagcgggcagg

SEQ ID NO: 113631 - RNA, 46 nt, Mus musculus
aaggcuaaaccgcuaucccgcagugacuaaggaaugaguuuuguag

SEQ ID NO: 113632 - RNA, 45 nt, Mus musculus
cugacucucuggucuccucacucccaugugucccugccaggcagg

SEQ ID NO: 113633 - RNA, 45 nt, Mus musculus
aagaccacccagggacaauuguacagaaucuggacauagccucag

SEQ ID NO: 113634 - RNA, 45 nt, Mus musculus
ucaggccuucccacauucaagcaaaggcaggagagccaugcccag

SEQ ID NO: 113635 - RNA, 46 nt, Mus musculus
caugcccaugugugcacccugagcacacaguaccaccuaacccaug

SEQ ID NO: 113636 - RNA, 45 nt, Mus musculus
gaagccugcuguguaagacagaugcugagcugggcuaggcuuuga

SEQ ID NO: 113637 - RNA, 42 nt, Mus musculus
aagaauuauaaauguaauggcugccguaaaggucaagggcag

SEQ ID NO: 113638 - RNA, 64 nt, Mus musculus
aggaagggacaggaugacaagguuuugguggccaccugcaccucagccaaugggaagccuccca

SEQ ID NO: 113639 - RNA, 61 nt, Mus musculus
gugcgguguccugggaaacacggcuaaagggcgaggcagaguaccaggaaauucggaaccc

SEQ ID NO: 113640 - RNA, 46 nt, Mus musculus
uaucaccuggaccgcuucagggagagccuuacgcucaacgugcagu

SEQ ID NO: 113641 - RNA, 45 nt, Mus musculus
cuguuccccugaccucacccucuuccaacauccucccuugccuca

SEQ ID NO: 113642 - RNA, 42 nt, Mus musculus
cggaugcuaacccgccagccacugaguaccacuggaccacgu

SEQ ID NO: 113643 - RNA, 45 nt, Mus musculus
aauggcucucuccccaaggguguagaggcccagaacaggacccuc

SEQ ID NO: 113644 - RNA, 46 nt, Mus musculus
ggcaggaaccuacaucugugaggccaccaacccuauuggcacccga

SEQ ID NO: 113645 - RNA, 41 nt, Mus musculus
uccaucuggagagaggaauagugagcagcugggguggggua

SEQ ID NO: 113646 - RNA, 42 nt, Mus musculus
aaguuccauugcucugagguucuguccaucccaggcccccag

SEQ ID NO: 113647 - RNA, 45 nt, Mus musculus
ugggugucgauaaccauaaauaauccaguugagagauggcggugu

SEQ ID NO: 113648 - RNA, 41 nt, Mus musculus
aggacagccaggguuaugucaugagauacuugucaggucag

SEQ ID NO: 113649 - RNA, 46 nt, Mus musculus
aggacaguuauccaaaucacagcagucagcaaugaaggugcaugag

SEQ ID NO: 113650 - RNA, 41 nt, Mus musculus
gucagugcaccuaagagguuuuagaggaguucuccguggua

SEQ ID NO: 113651 - RNA, 46 nt, Mus musculus
cuccaccucuuacccguucccagcucaggaagggaucagcccacag

SEQ ID NO: 113652 - RNA, 42 nt, Mus musculus
cccaagcucaaagugccucgguuucuccaucugugcccccag

SEQ ID NO: 113653 - RNA, 42 nt, Mus musculus
ucccagggccugccugucaggaucucagccaacucagcccua

SEQ ID NO: 113654 - RNA, 42 nt, Mus musculus
guuuggggaagaaaauucuggggccuuucuagccacagggag

SEQ ID NO: 113655 - RNA, 46 nt, Mus musculus
gguuuuuauuuuuauauugagaaacagaaaggauguugauccagau

SEQ ID NO: 113656 - RNA, 42 nt, Mus musculus
uucuuguucgcugccugcugcugcugucgccgugccgcgggu

SEQ ID NO: 113657 - RNA, 44 nt, Mus musculus
uugcgggugugcagccuagguuuuagaguauucugggaacggac

SEQ ID NO: 113658 - RNA, 66 nt, Mus musculus
gguggcuacucuggcccugagucacgucacuccccaugaugagcgaauguuccuguguaagagcaa

SEQ ID NO: 113659 - RNA, 41 nt, Mus musculus
uucaagccaaugucgugggcauccauguggacaggcaagag

SEQ ID NO: 113660 - RNA, 46 nt, Mus musculus
cauuccucaaguccuaugguacaagaacagucugcccuugcaagag

SEQ ID NO: 113661 - RNA, 46 nt, Mus musculus
ccagucaucacagauugucgaguccaguggcuuguacaccuugaag

SEQ ID NO: 113662 - RNA, 41 nt, Mus musculus
gccugccgaaaagcaccauagcgggcucuaccagugucaga

SEQ ID NO: 113663 - RNA, 45 nt, Mus musculus
cugcgaggcagaaaguaaccaggaccuugaguuugaguggcugag

SEQ ID NO: 113664 - RNA, 41 nt, Mus musculus
ugccaaccucucaccucccuucucccagcacgcugcccccg

SEQ ID NO: 113665 - RNA, 44 nt, Mus musculus
uacaauagccaagaaccagcucccaagacucuaagguauccaca

SEQ ID NO: 113666 - RNA, 42 nt, Mus musculus
guguauggccagccuaucguccagcuuccuaccaacccccag

SEQ ID NO: 113667 - RNA, 46 nt, Mus musculus
cuuaguuacugauaucagagggaggcaguuagcaguuaccaaggag

SEQ ID NO: 113668 - RNA, 46 nt, Mus musculus
agagagucucauugagggacugucuagaucucgcugacccauugug

SEQ ID NO: 113669 - RNA, 45 nt, Mus musculus
ccaggauagccagggcuacacagaaauccugucuuggggugagag

SEQ ID NO: 113670 - RNA, 43 nt, Mus musculus
uuuagcaucaguuaucucaggaauccucacaacagccccauga

SEQ ID NO: 113671 - RNA, 46 nt, Mus musculus
uucacaaaccucgggaggcccuugguuugaucugcagagcccacau

SEQ ID NO: 113672 - RNA, 46 nt, Mus musculus
aaauuuaacguaauccaguaaggaguagaaugcuucagggucaugu

SEQ ID NO: 113673 - RNA, 51 nt, Mus musculus
ggcuccuucagucaaauggaaucuacauuuuaacguuaaaggaguaguggg

SEQ ID NO: 113674 - RNA, 42 nt, Mus musculus
agaagaugacaaccgugcugagugagagcagcggccccagca

SEQ ID NO: 113675 - RNA, 40 nt, Mus musculus
aaucugggcacgcccaccuccuccaccccucgccccagca

SEQ ID NO: 113676 - RNA, 43 nt, Mus musculus
gugccgcugagcuugacaaccccaugcaacaaaaguggaccaa

SEQ ID NO: 113677 - RNA, 46 nt, Mus musculus
gagaagccacccacgaugucccaggcccagccauccauccccagac

SEQ ID NO: 113678 - RNA, 42 nt, Mus musculus
gcccagaacucagccuaaaggugcuucccaaguugcagacua

SEQ ID NO: 113679 - RNA, 45 nt, Mus musculus
ccauggagaccuaccacgucacucugacacugccaccaacacagg

SEQ ID NO: 113680 - RNA, 45 nt, Mus musculus
gauaggcaaaguaaguguguguguaugugggggucuguuucuagg

SEQ ID NO: 113681 - RNA, 43 nt, Mus musculus
gcuggggaucaacuggagaacccuccagcuuucucuuucagau

SEQ ID NO: 113682 - RNA, 46 nt, Mus musculus
ggggcccgcgccgaggccgcccagcccuccccacaccuccacaaag

SEQ ID NO: 113683 - RNA, 27 nt, Mus musculus
uccucuccccuccccgcccucgcgcca

SEQ ID NO: 113684 - RNA, 45 nt, Mus musculus
ccauccccucuuccccagcgacucaacuacaacccaaacaccuag

SEQ ID NO: 113685 - RNA, 43 nt, Mus musculus
auuacaaguuuagaaccuuaaguggggagauuuaaugggcuaa

SEQ ID NO: 113686 - RNA, 46 nt, Mus musculus
guaguguuguuggcagaauggucaggaagaaaucaaggcaggagag

SEQ ID NO: 113687 - RNA, 42 nt, Mus musculus
ccuggcccacccgguucugccagcccaugcgcuguaggccag

SEQ ID NO: 113688 - RNA, 45 nt, Mus musculus
agcaacgcuccacagcggggaaaccucaacacccgccuccggaag

SEQ ID NO: 113689 - RNA, 46 nt, Mus musculus
agaccagauuuagccuugaauucauggagaucuguaucugccucca

SEQ ID NO: 113690 - RNA, 46 nt, Mus musculus
augcagacaucagaggaagaaagacugccauguggcaguggcagga

SEQ ID NO: 113691 - RNA, 46 nt, Mus musculus
guacagaaaauguauuuguggagaagugaaaagcaaacuaguaggu

SEQ ID NO: 113692 - RNA, 45 nt, Mus musculus
agcucacaacugucuauaccuucaguucuaaugacucuggcaccc

SEQ ID NO: 113693 - RNA, 42 nt, Mus musculus
aacuccccuucguuugcaaacuguuacaguggccaccaaccu

SEQ ID NO: 113694 - RNA, 42 nt, Mus musculus
ggagcgaaggacacaggagcugaaggccagagggagcggggg

SEQ ID NO: 113695 - RNA, 41 nt, Mus musculus
cccgaaugugagacacuugggaggauguuuaaaaugauuga

SEQ ID NO: 113696 - RNA, 46 nt, Mus musculus
caagaggacagccaccaaggcccaacagaguagccuccuuggccuc

SEQ ID NO: 113697 - RNA, 46 nt, Mus musculus
uuuauagugcccacuucagacugugauggcugagcccccguaugag

SEQ ID NO: 113698 - RNA, 51 nt, Mus musculus
cggaggaaaacuccagugacugugaccuugaaagaaaaugaaagguuuuua

SEQ ID NO: 113699 - RNA, 46 nt, Mus musculus
ggguuauccgccuguuuuccaaggaggugcuggaaauaacggagcg

SEQ ID NO: 113700 - RNA, 47 nt, Mus musculus
gcaccuccuuggaaaacaggcggauaacccucauguggcccuuuacc

SEQ ID NO: 113701 - RNA, 46 nt, Mus musculus
aaccaugcccaguaccuccucgggagagaacugcagcugccugagg

SEQ ID NO: 113702 - RNA, 45 nt, Mus musculus
gagguacugggcaugguucugaacuacucccguuccuuggcugaa

SEQ ID NO: 113703 - RNA, 47 nt, Mus musculus
uguggcaguguugucauugaugagcugcagcaccuugaggccagcca

SEQ ID NO: 113704 - RNA, 28 nt, Mus musculus
cacugccacagcccucagcuacgguguc

SEQ ID NO: 113705 - RNA, 46 nt, Mus musculus
cucgaauuccacccgaguuacuuuggccuugaaguccacaucaucc

SEQ ID NO: 113706 - RNA, 42 nt, Mus musculus
aggccaaaguaacucggguggaauucgaggagcugugugcag

SEQ ID NO: 113707 - RNA, 45 nt, Mus musculus
ccuugcagagugcagagaugagcuuggugagggaugagggggaca

SEQ ID NO: 113708 - RNA, 45 nt, Mus musculus
cguguucccaaaguucaagaagugcugcucaaggccgugggcaag

SEQ ID NO: 113709 - RNA, 45 nt, Mus musculus
cuuugaaggccuugcugagcgccgcugccugguacacagccccca

SEQ ID NO: 113710 - RNA, 46 nt, Mus musculus
agcgguuaaaggugaugacuuugcgcugaggguagggccccauucg

SEQ ID NO: 113711 - RNA, 42 nt, Mus musculus
gcucccagaaucugaccacaguaaaacuaaaaggcgugggag

SEQ ID NO: 113712 - RNA, 43 nt, Mus musculus
agcucucucccacgccuuuuaguuuuacuguggucagauucug

SEQ ID NO: 113713 - RNA, 46 nt, Mus musculus
acuaugaguccaaaggcaucaaggcccacuuuaaccuggaugagag

SEQ ID NO: 113714 - RNA, 38 nt, Mus musculus
cuaagugcugcaccaccacaccuggcucaaaauuacuc

SEQ ID NO: 113715 - RNA, 45 nt, Mus musculus
ccucugggcuauccuccaccagggucucaaauacggacuccaccu

SEQ ID NO: 113716 - RNA, 46 nt, Mus musculus
gaugagguaccaccuccaaacaggcuggauaugguguugccaaguu

SEQ ID NO: 113717 - RNA, 46 nt, Mus musculus
guaccucaucagaugccaaagagaaugguacugaugcuguacaggu

SEQ ID NO: 113718 - RNA, 61 nt, Mus musculus
gaggaagaggagagccccgcugaggggagcaaggaugagccugcagagcagggggaacuca

SEQ ID NO: 113719 - RNA, 53 nt, Mus musculus
cccuuaggcucagaggguggaggcugagaggucuccucugcuggggguucagc

SEQ ID NO: 113720 - RNA, 61 nt, Mus musculus
cccagcagaggagaccucucagccuccacccucugagccuaagggggaugcagcccgugag

SEQ ID NO: 113721 - RNA, 45 nt, Mus musculus
ggaccugccugacuugccagaggaugagcuggcccguucugugca

SEQ ID NO: 113722 - RNA, 41 nt, Mus musculus
agccugaguaccaggaaguguccacugaggaacagcgggag

SEQ ID NO: 113723 - RNA, 46 nt, Mus musculus
agggauuuggagccaccacuguggugaggagccuucugagaugugg

SEQ ID NO: 113724 - RNA, 45 nt, Mus musculus
ggcacccgggcagaaccuccccucaaugccagugcuggugaccaa

SEQ ID NO: 113725 - RNA, 45 nt, Mus musculus
cucuaggccagacugaagaggcgaaacccauuuuagaaccugaca

SEQ ID NO: 113726 - RNA, 46 nt, Mus musculus
acccauagagcuacucuaggacugagcagccaccuccugucccagc

SEQ ID NO: 113727 - RNA, 46 nt, Mus musculus
ggucuccaacaacuacuggcagccauucucucacuuacccacaggc

SEQ ID NO: 113728 - RNA, 46 nt, Mus musculus
guaguuguuggagaccugguagugggaaggauguuaugggucacug

SEQ ID NO: 113729 - RNA, 42 nt, Mus musculus
aucuuuuccucuuccacaaaaucaguguccuguuugggccag

SEQ ID NO: 113730 - RNA, 46 nt, Mus musculus
ccuuuccuucccugugcagacaggacuauggucuucuugcccaaag

SEQ ID NO: 113731 - RNA, 31 nt, Mus musculus
ccugucugcacagggaaggaaaggacagaag

SEQ ID NO: 113732 - RNA, 46 nt, Mus musculus
agguccggagaguggcuggcaaggaugcaaguauacugcaggcacu

SEQ ID NO: 113733 - RNA, 46 nt, Mus musculus
cccugggcugaccaaaaaugugcuaucuacugugagccccuuuccc

SEQ ID NO: 113734 - RNA, 42 nt, Mus musculus
cccugaccccucgucuuuacccacaaagcuugccugagagug

SEQ ID NO: 113735 - RNA, 42 nt, Mus musculus
gccuagagugccuguccuccaguauugcaccuguagccggag

SEQ ID NO: 113736 - RNA, 46 nt, Mus musculus
uucuaccccaaccucacccucucacccuacuuuccaccccccaccc

SEQ ID NO: 113737 - RNA, 45 nt, Mus musculus
aaacagacaccuucaaacugcacugcuuccaaacacugacaggua

SEQ ID NO: 113738 - RNA, 45 nt, Mus musculus
uuggccaucaauggcauggacgugaauggcaaguacacggcugac

SEQ ID NO: 113739 - RNA, 42 nt, Mus musculus
uggcuugcgcgugcgcuuuaggaggggggagggccgcaggag

SEQ ID NO: 113740 - RNA, 42 nt, Mus musculus
uccuccagcaggacgguggagacgcggagaaggcaggcaggc

SEQ ID NO: 113741 - RNA, 45 nt, Mus musculus
gacacacagacacacagacacacacacacacacacacucgugcac

SEQ ID NO: 113742 - RNA, 46 nt, Mus musculus
acccuguggccucucuacaggugcccugcugagccaggccugagau

SEQ ID NO: 113743 - RNA, 41 nt, Mus musculus
guugccucccuagcaccgggagccccuggagauguggugug

SEQ ID NO: 113744 - RNA, 42 nt, Mus musculus
cuaaaucaagucagugggcuuuucacacaugagcccccagaa

SEQ ID NO: 113745 - RNA, 46 nt, Mus musculus
ucuucgcaccuucuaggguuuaagacuccuuuccaaggccccagac

SEQ ID NO: 113746 - RNA, 45 nt, Mus musculus
ugaguuguccggaaaagggauuaccugagagaccuucgacagagg

SEQ ID NO: 113747 - RNA, 42 nt, Mus musculus
acgaacugugacggaggcuuuccugggacgcccccaccccca

SEQ ID NO: 113748 - RNA, 45 nt, Mus musculus
auccauaggcccucggaguugugcacccauuccagguggccacug

SEQ ID NO: 113749 - RNA, 42 nt, Mus musculus
auguccuggggcauggcuugguaaggucccuggcccccagag

SEQ ID NO: 113750 - RNA, 78 nt, Mus musculus
cagaugucccaugcccggugagcccaucugauuaauacugauggugagaucugaaggccgccugccuagcccccuguu

SEQ ID NO: 113751 - RNA, 44 nt, Mus musculus
gaaggcaaggguaccaucugggagggagucuggggugacuugag

SEQ ID NO: 113752 - RNA, 88 nt, Mus musculus
gagacuugagccugcugggugagccagugggugaacgcacaccgagggaagagcugaggaccuggggugacuugagaggucccggugg

SEQ ID NO: 113753 - RNA, 48 nt, Mus musculus
aacgguaggcugggguucaugaggccacuggaaggguuggcgggagga

SEQ ID NO: 113754 - RNA, 45 nt, Mus musculus
guccccugugcauugggaugcaguggaauguuggaccccagaggg

SEQ ID NO: 113755 - RNA, 42 nt, Mus musculus
ugggucauucaguaccgaugccaccccagggagcaccccggg

SEQ ID NO: 113756 - RNA, 34 nt, Mus musculus
accugaagcgccgccggcaaggugacaguccacg

SEQ ID NO: 113757 - RNA, 45 nt, Mus musculus
ggcaccugcccaccuggccagcugccugcagggggcgugggagag

SEQ ID NO: 113758 - RNA, 42 nt, Mus musculus
gggcuuggugccuggccuggcugaugguggacagcaccagac

SEQ ID NO: 113759 - RNA, 42 nt, Mus musculus
cugggcaggguagggaugugggugggggcacaaggcccagau

SEQ ID NO: 113760 - RNA, 42 nt, Mus musculus
uggccucggugguaggacucgggcccgagccgcggggcgugg

SEQ ID NO: 113761 - RNA, 46 nt, Mus musculus
cuauuguuucccacucgcagagcugguuccggcucuuguggcgcag

SEQ ID NO: 113762 - RNA, 46 nt, Mus musculus
ggaagggguaggacgaaaaauuucccacugagccauaaagcugcag

SEQ ID NO: 113763 - RNA, 41 nt, Mus musculus
gauaaccaguacuaauuaagcuaguguuucgggugccagug

SEQ ID NO: 113764 - RNA, 45 nt, Mus musculus
aacucuuucuuaaaauaacuguuaauuagacgcuguauucuaggu

SEQ ID NO: 113765 - RNA, 46 nt, Mus musculus; identical to SEQ ID NO: 66607

SEQ ID NO: 113766 - RNA, 45 nt, Mus musculus
agagaacccuguuaucaugggucuguccagucagaacggccagcu

SEQ ID NO: 113767 - RNA, 45 nt, Mus musculus
caaauaggcaagcaaaauuuaggcuccuuucauucccaaaggcag

SEQ ID NO: 113768 - RNA, 90 nt, Mus musculus
cggucaugagguagcgcagagccauggcuugcugcucuccgauggggacaggaagaguagauuuuucauuuuuaagauuuuaaugauucu

SEQ ID NO: 113769 - RNA, 46 nt, Mus musculus
gcucuuugagaggaucuggguucaauucccaacacccacauggcag

SEQ ID NO: 113770 - RNA, 48 nt, Mus musculus
ugcacauaaaaauaacuguuuuuaaaaaagauauaguuggccgggcgc

SEQ ID NO: 113771 - RNA, 51 nt, Mus musculus
ugaugaaauuauuagacacccaguuuguauuugagagaauagagguuuggg

SEQ ID NO: 113772 - RNA, 45 nt, Mus musculus
acaggccuguaaagucuugucugguuuauauagugcuggauggag

SEQ ID NO: 113773 - RNA, 49 nt, Mus musculus
gguuuuuuacuauuguuguuucauguguguuuguguuugcagauagggc

SEQ ID NO: 113774 - RNA, 46 nt, Mus musculus
auauguacuguuacuaaccaaccacacucccucccugaacccacag

SEQ ID NO: 113775 - RNA, 45 nt, Mus musculus
uccaagguacacauggagaugaaagcacguuuuagauaugggacu

SEQ ID NO: 113776 - RNA, 46 nt, Mus musculus
ggcucugaaacaauauacaguuuucuaaaacauugucuuugaggag

SEQ ID NO: 113777 - RNA, 41 nt, Mus musculus
gagugcuucucaugcuuuuagguuuugagaugaauaaggga

SEQ ID NO: 113778 - RNA, 54 nt, Mus musculus; identical to SEQ ID NO: 66609

SEQ ID NO: 113779 - RNA, 45 nt, Mus musculus
guggcaaagguugaccauguccagaugauagugcuagaugaggua

SEQ ID NO: 113780 - RNA, 46 nt, Mus musculus
agccaaauguuuuaccugggagguagagucagaugucugucuugaa

SEQ ID NO: 113781 - RNA, 46 nt, Mus musculus
cuaauuuuugguuguucuauuacuacagaaaaauaagccuggguag

SEQ ID NO: 113782 - RNA, 46 nt, Mus musculus
aauuuaaucuuacuauuagugugagaagaagaaucauuugaggaag

SEQ ID NO: 113783 - RNA, 46 nt, Mus musculus
caaaaagaauucagugucgugagugguuuuggaagguuguugugag

SEQ ID NO: 113784 - RNA, 46 nt, Mus musculus
uauugaggagcagcuggggacagagaucaaacccaucccaagcaac

SEQ ID NO: 113785 - RNA, 51 nt, Mus musculus
gcucuucucuuuguggguuuuuucaucuuuauuuuggaacuaugaagaguu

SEQ ID NO: 113786 - RNA, 63 nt, Mus musculus
ugcacuaacugcuggucuuuaaagauguuuucuggggaaaggggacaaggaaggaggaaaaga

SEQ ID NO: 113787 - RNA, 59 nt, Mus musculus
aaagaaggggagaaacccuaaaaaagagaagaauuugggugaacacaugcaccugucua

SEQ ID NO: 113788 - RNA, 45 nt, Mus musculus
augcuacaagaccauuaagaauaucaucuuuacacacagcccaag

SEQ ID NO: 113789 - RNA, 46 nt, Mus musculus
uacauacauauauauauauuauuuuuuuuggaugaagguugcuggg

SEQ ID NO: 113790 - RNA, 45 nt, Mus musculus
uuuuuuuaaaaauguuuuuaauucccuuuuaacccaguauacuag

SEQ ID NO: 113791 - RNA, 47 nt, Mus musculus
gaucccucuuaauaaggaauauugcuacuauuggaaauugucuuuca

SEQ ID NO: 113792 - RNA, 46 nt, Mus musculus
ucuguguaucuuuaaaauuguuacuguggaaugauuuucuugccaa

SEQ ID NO: 113793 - RNA, 48 nt, Mus musculus
gagggagcuagccuggccuggacucugccccuccacagcugacagacu

SEQ ID NO: 113794 - RNA, 100 nt, Mus musculus
guuccacuuugagcaguaggaacuuaaaaauuugaaaacauuuggggaaagggaaaauuggcuuucuguuuaauuggcaaauguuccaguggggaggguc

SEQ ID NO: 113795 - RNA, 41 nt, Mus musculus
cccucaccuguaaucaauuccagguaaauuaggaaacugag

SEQ ID NO: 113796 - RNA, 46 nt, Mus musculus
uguaaucguauuuccuuuugcuuagaccaaaauuguugagaaccag

SEQ ID NO: 113797 - RNA, 46 nt, Mus musculus
aagccagccccaauuaaauguuguccuuuauuagaccugccuuggu

SEQ ID NO: 113798 - RNA, 46 nt, Mus musculus
caguaauauagauuccuaguucccucccaaagucucaaagguccua

SEQ ID NO: 113799 - RNA, 64 nt, Mus musculus
cucuugguguuagaugaaccaucgacaaagcagucggacccuaccgugcuuucgcugugguuaa

SEQ ID NO: 113800 - RNA, 60 nt, Mus musculus
ccuggaggaugcagagaagaaucccaaagccauugacaccuggauugagagcaucucuga

SEQ ID NO: 113801 - RNA, 42 nt, Mus musculus
ugaacucaggguacaaggcuugcaaggccacuggcagcaaua

SEQ ID NO: 113802 - RNA, 41 nt, Mus musculus
guuuauuuguuuguuugugacagucucucaauguagcccca

SEQ ID NO: 113803 - RNA, 46 nt, Mus musculus
ccuauguugagccuuuugacugugggccauccuauguuuccaccag

SEQ ID NO: 113804 - RNA, 46 nt, Mus musculus
cgagaucgauugcagccuggcugaguacauugacaugaucuguggu

SEQ ID NO: 113805 - RNA, 91 nt, Mus musculus
cacgcgcuugucuguugcagcgauccuggacauuccuuucuauaagagccggauucagucucuccaccugcucuuuucccucuacucagag

SEQ ID NO: 113806 - RNA, 32 nt, Mus musculus
ucuugcugaaggcaaaaaaguauucaccccuc

SEQ ID NO: 113807 - RNA, 46 nt, Mus musculus; identical to SEQ ID NO: 84085

SEQ ID NO: 113808 - RNA, 45 nt, Mus musculus; identical to SEQ ID NO: 22841

SEQ ID NO: 113809 - RNA, 46 nt, Mus musculus
uuguuuuucuuguuggucaagaauauaaaacggauacugaauauuu

SEQ ID NO: 113810 - RNA, 46 nt, Mus musculus
aguaacugcuguggccagagccuuugccuggggaaggguggcaguc

SEQ ID NO: 113811 - RNA, 42 nt, Mus musculus
aagaucuugcacauguacuaccacugagccacauccccagac

SEQ ID NO: 113812 - RNA, 46 nt, Mus musculus
uaccaaaugacucuagcuuucauuaaguugacacaaaacuagcgag

SEQ ID NO: 113813 - RNA, 46 nt, Mus musculus
aguacacuauagcugucuccagacacaccagaagagggcgucagau

SEQ ID NO: 113814 - RNA, 46 nt, Mus musculus
aucuuugaaaguuauguuugcuuaccauccugguuagagccuagag

SEQ ID NO: 113815 - RNA, 46 nt, Mus musculus
aucagaccucauagcuggucugcgucucagcgaaguauuugaaagc

SEQ ID NO: 113816 - RNA, 41 nt, Mus musculus
agauaaauacgcaaaggaacauaagguuaagcguggugcug

SEQ ID NO: 113817 - RNA, 78 nt, Mus musculus
uugacauuaugaaugaaaacaacaaaaacaaaccaggaaacccaaaaacuauguaggaaaguaacauuugaugaggag

SEQ ID NO: 113818 - RNA, 46 nt, Mus musculus
uaaaauucauggggugguuagaaaaguuagaagugggaucaaggaa

SEQ ID NO: 113819 - RNA, 45 nt, Mus musculus
ccuaagcugagauccugcaugccacagguaugggaauagaauaag

SEQ ID NO: 113820 - RNA, 46 nt, Mus musculus
auuugagacauuccaggaaaguuacuuuuugucagacuugccugug

SEQ ID NO: 113821 - RNA, 46 nt, Mus musculus
gaaaauugagggacacuugagaaguagcauaacgaacggugcaggu

SEQ ID NO: 113822 - RNA, 48 nt, Mus musculus
aaaaagaaacucuaaagacuuccauccugguacaauaagaggcauaug

SEQ ID NO: 113823 - RNA, 46 nt, Mus musculus
aaacucuucugauacuuuccuaugaauggccgugacgccacccaag

SEQ ID NO: 113824 - RNA, 71 nt, Mus musculus
ccagcagcuuucuagugaaugggcuccgugcugccuccagugucuguauucugcuucugaacugaaccguc

SEQ ID NO: 113825 - RNA, 31 nt, Mus musculus
ccagagugaaugcgggaggaugcuuuuacgc

SEQ ID NO: 113826 - RNA, 42 nt, Mus musculus
cuugcaguaaaaggauaaaugagaagcuauugggccccuuuc

SEQ ID NO: 113827 - RNA, 46 nt, Mus musculus
auccuaaauuauauuaaguccaacaacaaaaauguccugccauuuu

SEQ ID NO: 113828 - RNA, 42 nt, Mus musculus
ccccaguaccacauaagccagggauggugauacaugucugug

SEQ ID NO: 113829 - RNA, 46 nt, Mus musculus
ccaucugugacgagauuugacgcccucuucuggugugucugaggac

SEQ ID NO: 113830 - RNA, 46 nt, Mus musculus
aaaccuaguguaaaugcaaaagaacuuuauggaauaaaauucagga

SEQ ID NO: 113831 - RNA, 42 nt, Mus musculus
caagauaaagauucagcagauugagaaagaccgaggagaaug

SEQ ID NO: 113832 - RNA, 45 nt, Mus musculus
ccuauguaucccauccuaagauacaugugggggacagauugcuau

SEQ ID NO: 113833 - RNA, 46 nt, Mus musculus
aaaagcaaagaauaaguugaaauagccaaguaauaguagcccaugc

SEQ ID NO: 113834 - RNA, 46 nt, Mus musculus
aaccucacuguguccaacacucgaacaguucuccucaccccagaga

SEQ ID NO: 113835 - RNA, 46 nt, Mus musculus
cuacucuguaucugagauuagccgcuccuuccggacacaccaagaa

SEQ ID NO: 113836 - RNA, 42 nt, Mus musculus
uccuuucaguauagacuccucuauucccauacugccucugga

SEQ ID NO: 113837 - RNA, 44 nt, Mus musculus
guuugcagcaauccagaaagagcagcugaagcagcaguccggua

SEQ ID NO: 113838 - RNA, 47 nt, Mus musculus
cuggauggaggacaccuuaaagugaaaugacagaccaggagaauaac

SEQ ID NO: 113839 - RNA, 46 nt, Mus musculus
gcagucagugucuguugagccuugugaguuuuagcuguguccaguu

SEQ ID NO: 113840 - RNA, 47 nt, Mus musculus
augaaaaccugccuuuuagaaaagagaagaaaaaggagcgagaaggg

SEQ ID NO: 113841 - RNA, 46 nt, Mus musculus
ccaggcaugguaguacauguuuguaauccuagcauuagguggaggc

SEQ ID NO: 113842 - RNA, 42 nt, Mus musculus
uagaguaaguauuaagccaaaccagguaucgaggguccauuu

SEQ ID NO: 113843 - RNA, 46 nt, Mus musculus
guucuuuuuuuguuuucggacguguaugugcuucacuugaugagau

SEQ ID NO: 113844 - RNA, 45 nt, Mus musculus
uaagucugagucuaguagcucaggcagaacccaaagcugccaggc

SEQ ID NO: 113845 - RNA, 46 nt, Mus musculus
ccuuugaaagagccgucccggacccaaccucaaucagggacaagga

SEQ ID NO: 113846 - RNA, 24 nt, Mus musculus
gaagcugagcacggaugaccugaa

SEQ ID NO: 113847 - RNA, 42 nt, Mus musculus
aagccccuccccgugcccuaucuccucucacucucugcccug

SEQ ID NO: 113848 - RNA, 45 nt, Mus musculus
uuugaggaagaaagacuuguguggucccaaagacaggauggggga

SEQ ID NO: 113849 - RNA, 27 nt, Mus musculus
caugggaaugacuugugaagauggcua

SEQ ID NO: 113850 - RNA, 45 nt, Mus musculus
uuuggggauuuucgagcaggguuucucugccuggcuuuuggcaag

SEQ ID NO: 113851 - RNA, 46 nt, Mus musculus
aggacuaagacagucucagggaccaauacuugccucuguuuaucag

SEQ ID NO: 113852 - RNA, 45 nt, Mus musculus
guuugggaaagugagggugcaaggggagggggaagguacugcugg

SEQ ID NO: 113853 - RNA, 42 nt, Mus musculus
aagguaagaagggaagggacagacaaauguggucaagucaag

SEQ ID NO: 113854 - RNA, 50 nt, Mus musculus
ccauaccugggaaagaauaugaauccaugaagaugguaggcggaaccgug

SEQ ID NO: 113855 - RNA, 45 nt, Mus musculus
uuugaauccauuuccuuaucggcuccacucuggagugcuggcaug

SEQ ID NO: 113856 - RNA, 41 nt, Mus musculus
gugugccaagacagugagcugagaggcuaggaaugaauaga

SEQ ID NO: 113857 - RNA, 42 nt, Mus musculus
agugcugggauuguaggugugugccaccaugccuggcuggaa

SEQ ID NO: 113858 - RNA, 46 nt, Mus musculus
acacacacaaacucacucacacucacacacacacacacucaugcac

SEQ ID NO: 113859 - RNA, 41 nt, Mus musculus
ucucccuggucaaaaucuugaucauuuacguauccccugca

SEQ ID NO: 113860 - RNA, 41 nt, Mus musculus
auugggggguugguguuugcugugguccucuucuccguugg

SEQ ID NO: 113861 - RNA, 46 nt, Mus musculus
uauacauacacuaugcauacacacaucaaacauaccacacaugcac

SEQ ID NO: 113862 - RNA, 46 nt, Mus musculus
uugacaugugaguugugucuccacagccuccagaagccaaggccag

SEQ ID NO: 113863 - RNA, 45 nt, Mus musculus
cugugaacugugugcuuccucucccacgcuaccaucggcgccuug

SEQ ID NO: 113864 - RNA, 44 nt, Mus musculus
ucauccaccuuuccugcuucuaagacuuccaucucuggcccgau

SEQ ID NO: 113865 - RNA, 46 nt, Mus musculus
guagggagggcucccuaggccccuccuguuauuaugggcgucuggg

SEQ ID NO: 113866 - RNA, 44 nt, Mus musculus
ggguuucuuacuccuuggaggccauguaggucaugagguccacc

SEQ ID NO: 113867 - RNA, 42 nt, Mus musculus
agcccggagucccugucgguccccaagcugcaaagcccgccu

SEQ ID NO: 113868 - RNA, 46 nt, Mus musculus
cggccagggcuacuauguggagaugaccguaggcagccccccacag

SEQ ID NO: 113869 - RNA, 42 nt, Mus musculus
gucggagccaagucagagcuagaguucagucugagccaagag

SEQ ID NO: 113870 - RNA, 47 nt, Mus musculus
cgaagcucacuuucuguggagaaggcgugagguugcgguaagaggga

SEQ ID NO: 113871 - RNA, 43 nt, Mus musculus
gacaagcaucuguuagacaagggccugaugagggaggaggcag

SEQ ID NO: 113872 - RNA, 41 nt, Mus musculus
gucccuucucccuaaccucucaguuuguuuguauaggugaa

SEQ ID NO: 113873 - RNA, 46 nt, Mus musculus
gggcugacuugagguccuccuguuugaacuuauucuuguggcuaca

SEQ ID NO: 113874 - RNA, 45 nt, Mus musculus
agauggccacguugcucauacucucugggucuguuucuuucucuu

SEQ ID NO: 113875 - RNA, 48 nt, Mus musculus
cuuuacaccaaaggcuuguucuugcuuagcccccagcucuaagguaca

SEQ ID NO: 113876 - RNA, 46 nt, Mus musculus
uuuaugcucaggcuuaaagaugaagaaguaagacacagaaccaaga

SEQ ID NO: 113877 - RNA, 55 nt, Mus musculus
gaaguccuguaauaucccaggguaaaaugaugccaacugggccaaagggugguaa

SEQ ID NO: 113878 - RNA, 80 nt, Mus musculus
cugagagcuuagcuugugaagagaggguagcuggaggcgggugugagauucaggaagguuuguguuguuuuuaaugaaga

SEQ ID NO: 113879 - RNA, 46 nt, Mus musculus
uuguaaaggccagugggaaggauuuggauucuuuggugcugggaug

SEQ ID NO: 113880 - RNA, 42 nt, Mus musculus
uucgcaaggugacuaggucagagcuuugcugacuucacugag

SEQ ID NO: 113881 - RNA, 46 nt, Mus musculus
caguaguaacuuugcagugggggcugccccacacccuuuccugcau

SEQ ID NO: 113882 - RNA, 46 nt, Mus musculus
ucuucuacuagggagggggaaagcaaaaggaggcagcuggggccag

SEQ ID NO: 113883 - RNA, 42 nt, Mus musculus
aauggcuccuuuucucugugagugugauggaucugggguggg

SEQ ID NO: 113884 - RNA, 42 nt, Mus musculus
cuauacacgggcagucucugguacacacccauccggcgggag

SEQ ID NO: 113885 - RNA, 46 nt, Mus musculus
acaagagcauuguggacagugggaccaccaaccuucgcuugcccaa

SEQ ID NO: 113886 - RNA, 93 nt, Mus musculus
cucaccaaccugccaaugcuucuggcgugacagaacagagaaaucaggcaagcuggauuacagggcuugcaccuguaggacacaggagaggga

SEQ ID NO: 113887 - RNA, 46 nt, Mus musculus
uaggauagagacaggaaggagaugguagcaaaacugggaaaggcag

SEQ ID NO: 113888 - RNA, 42 nt, Mus musculus
ucuuagaggaacagugcucaugagaaaagucccacuggacag

SEQ ID NO: 113889 - RNA, 42 nt, Mus musculus
cugccuggauuuuguuuuuauuuucuuucuuuuugcccagug

SEQ ID NO: 113890 - RNA, 46 nt, Mus musculus
ugaacggaggcccagugggcagaggugauacaaacaggcauggcag

SEQ ID NO: 113891 - RNA, 45 nt, Mus musculus
cuuaaccuuuggggggaggggauagcuagauuaggaaaccagagg

SEQ ID NO: 113892 - RNA, 24 nt, Mus musculus
agaaggacuaaggagcuggccccg

SEQ ID NO: 113893 - RNA, 42 nt, Mus musculus
ugucccuaagcaaaauguuaacccccagguagaguaugagcc

SEQ ID NO: 113894 - RNA, 46 nt, Mus musculus
uuccuuccucucaccuucuaggcuguccagauguacggcccagcuc

SEQ ID NO: 113895 - RNA, 45 nt, Mus musculus
cuaugcuaaauggaguaaguugggcacuauaaugaaggcgggaug

SEQ ID NO: 113896 - RNA, 45 nt, Mus musculus
aaaaggccacauccuggaagggguaggaaggacacaguaugcagu

SEQ ID NO: 113897 - RNA, 45 nt, Mus musculus
ucccuugcaggggacaggauucgagggucacauaacucugccagg

SEQ ID NO: 113898 - RNA, 46 nt, Mus musculus
cugaauaaacucccuuuacaaaucuggacaaauuacaguucagaug

SEQ ID NO: 113899 - RNA, 45 nt, Mus musculus
uauccaccucuggguuuaacauagagcacaccccuugggucagaa

SEQ ID NO: 113900 - RNA, 46 nt, Mus musculus
cuuaaaagagagagagagagagagagagagagagagagccgggugu

SEQ ID NO: 113901 - RNA, 46 nt, Mus musculus
augaagaagaaccuggguucaauuacuauuaggaaagcaaggaggg

SEQ ID NO: 113902 - RNA, 46 nt, Mus musculus
aaucuuaagcauuaaaaaauucauauuaacaauuagcucagaagau

SEQ ID NO: 113903 - RNA, 47 nt, Mus musculus
ggagaagugggcugggguagccuggcuguaggccagcccacuguccu

SEQ ID NO: 113904 - RNA, 46 nt, Mus musculus
gacugcacaugggcagcucccaccuauccuuagccucagcccagca

SEQ ID NO: 113905 - RNA, 46 nt, Mus musculus
agccucgcaggcuggcaugacaggcuaugggcgaccccggcagauc

SEQ ID NO: 113906 - RNA, 46 nt, Mus musculus
agcccaggagcauaagagggacuucacagacagccaacugcaggag

SEQ ID NO: 113907 - RNA, 42 nt, Mus musculus
agcagauggaacagguggcucaauucuugaaggcagcugaag

SEQ ID NO: 113908 - RNA, 41 nt, Mus musculus
gagcuggaggagcgacuaguggaguggauuguagugcagug

SEQ ID NO: 113909 - RNA, 46 nt, Mus musculus
ggguaaagcuggucuaggucaugcuaugaugucuagggucccucag

SEQ ID NO: 113910 - RNA, 42 nt, Mus musculus
gcuagucuuggcaaaguaaaaaugcucugauagccagcccgg

SEQ ID NO: 113911 - RNA, 34 nt, Mus musculus
ugguuauucuguuuuucucucaauguugguguug

SEQ ID NO: 113912 - RNA, 46 nt, Mus musculus
gccucuuucacgggagcaggagucccagugccugucguggaaaggg

SEQ ID NO: 113913 - RNA, 45 nt, Mus musculus
acucacuguccccuuccacacccucaguccugccaagccccagau

SEQ ID NO: 113914 - RNA, 46 nt, Mus musculus
caggccuagcgccugccucugcaucaccugccaguugccacaagaa

SEQ ID NO: 113915 - RNA, 42 nt, Mus musculus
accgcgacugcauccuccucgacuucuuugaugaccacgaua

SEQ ID NO: 113916 - RNA, 65 nt, Mus musculus
cucaucaugcgccccaaugacuuugcuuccuacuugcuggcaauuggcaucugcaaccugcugcu

SEQ ID NO: 113917 - RNA, 45 nt, Mus musculus
ggaccgcauggugcuucuggucaugggcaacauuaucaacugguc

SEQ ID NO: 113918 - RNA, 45 nt, Mus musculus
ugugcucuacacagacugcauccggcagugcagcgggccccuuua

SEQ ID NO: 113919 - RNA, 55 nt, Mus musculus
cacaucaucuccacccugcuccucagcacucagcucuauuacaugggccgcugga

SEQ ID NO: 113920 - RNA, 42 nt, Mus musculus
ugcuuggccaucgucaucuucuucuccguucugggcguggug

SEQ ID NO: 113921 - RNA, 46 nt, Mus musculus
uguacaugauugcuggccucugcaugcugaagcucuaccagaagcg

SEQ ID NO: 113922 - RNA, 45 nt, Mus musculus
gauggaggggcuacuuagugccuguuaccacgucugccccaacua

SEQ ID NO: 113923 - RNA, 46 nt, Mus musculus
uccugcucaucauccugcagcgagagaucaaucauaaccgggcccu

SEQ ID NO: 113924 - RNA, 45 nt, Mus musculus
accauugcggucuucuacgcacuuccuguggugcagcuggugauc

SEQ ID NO: 113925 - RNA, 45 nt, Mus musculus
gaaaaugguuccggauccacugacggguugguugaaagcgcaggu

SEQ ID NO: 113926 - RNA, 46 nt, Mus musculus
ccucaggcuuccucucagacccaagaaaaagcagcuguuuucagaa

SEQ ID NO: 113927 - RNA, 42 nt, Mus musculus
cccuucuacccuuuuguggaagguauguuucauguacugguu

SEQ ID NO: 113928 - RNA, 42 nt, Mus musculus
uuauuuauuuauuauaaguaaguacacuguagcuguccucag

SEQ ID NO: 113929 - RNA, 24 nt, Mus musculus
aaugaucaguguugagggugccac

SEQ ID NO: 113930 - RNA, 42 nt, Mus musculus
agagcuguuuacuuuuaauaccacugcagcccagccccaggu

SEQ ID NO: 113931 - RNA, 42 nt, Mus musculus
acgaacucugugucagccccccaccaagaaugagucugagau

SEQ ID NO: 113932 - RNA, 46 nt, Mus musculus
ggguuauuucuuuauuuucuuagagagggugaaucaagguucagau

SEQ ID NO: 113933 - RNA, 45 nt, Mus musculus
agcuuccagcaucucaccgggaccagaacuuuaaccccggccuca

SEQ ID NO: 113934 - RNA, 42 nt, Mus musculus
agccgggauccgcgcgaggcccaggagcggcuccagggaggg

SEQ ID NO: 113935 - RNA, 69 nt, Mus musculus
gggagauggugucaguuguaagccugaggaaguauacuugauuaugggaagagucagugaagaaagcag

SEQ ID NO: 113936 - RNA, 46 nt, Mus musculus
uuuuuauaucaaaauauugauuaaaaaaaaucuaugacaagcuggu

SEQ ID NO: 113937 - RNA, 45 nt, Mus musculus
uuuuuuucuuucuguuuccuucuuuaugucacugaauggucugag

SEQ ID NO: 113938 - RNA, 45 nt, Mus musculus
ugcuugguguguuuucaaaagcugugcuaauuauuuuauggcuag

SEQ ID NO: 113939 - RNA, 46 nt, Mus musculus
ucucagagaaucaauaggaaggagaagagaccccauugccucuuua

SEQ ID NO: 113940 - RNA, 24 nt, Mus musculus
uccuccugauagcuggggcucuaa

SEQ ID NO: 113941 - RNA, 46 nt, Mus musculus
gaacacuuggcaagcacuaccacagggcaacauccccagcccccug

SEQ ID NO: 113942 - RNA, 45 nt, Mus musculus
guuagaauuugcaugaaucaaacugaauuugauaaugggccacga

SEQ ID NO: 113943 - RNA, 42 nt, Mus musculus
cuucucagaggucacuguucaucuccucagcucuacccccag

SEQ ID NO: 113944 - RNA, 46 nt, Mus musculus
gcacugggauuuuacauuuugucuguuuucuuauuuguacagcaag

SEQ ID NO: 113945 - RNA, 45 nt, Mus musculus
uauuaucuauuauuguaaguggugugugugugugguguacauauu

SEQ ID NO: 113946 - RNA, 24 nt, Mus musculus
aaagggggaaaagaaacaaaauga

SEQ ID NO: 113947 - RNA, 45 nt, Mus musculus
ugcgucaggagaaguuagcuggcuccuguugauuuguugccccga

SEQ ID NO: 113948 - RNA, 46 nt, Mus musculus
augaaagacuagaagaaaccccaaggaacauaauuaauggaggcac

SEQ ID NO: 113949 - RNA, 46 nt, Mus musculus
auacagagaaacccugucucgaaaaaccaaaaaaaaaaaagagaca

SEQ ID NO: 113950 - RNA, 27 nt, Mus musculus
caagacacuguggagcaggaggaaagc

SEQ ID NO: 113951 - RNA, 42 nt, Mus musculus
aguaggccacagcuuuuuaaauuguggggaacaauccgggag

SEQ ID NO: 113952 - RNA, 48 nt, Mus musculus
ccagcacucagcguuuaaucucaggacuugacuuuagcccucauuaag

SEQ ID NO: 113953 - RNA, 45 nt, Mus musculus
ccagguucugaccaccacacugauguaauuuuagaaagggguggg

SEQ ID NO: 113954 - RNA, 44 nt, Mus musculus
uccaguugcucuuuugcucuuuguuuccucuuuuaaagucccag

SEQ ID NO: 113955 - RNA, 46 nt, Mus musculus
cuugagaaaaaagaauggaaacaugcaauaauuaaaaaaagaagaa

SEQ ID NO: 113956 - RNA, 27 nt, Mus musculus
ugugcaagguccugguuucauuuucag

SEQ ID NO: 113957 - RNA, 46 nt, Mus musculus
aucuugacagguuuaguuaguuuacucuugaauugagacuggccau

SEQ ID NO: 113958 - RNA, 46 nt, Mus musculus
auccagucauuaacauguaagacauauaggucuuaauuguagccca

SEQ ID NO: 113959 - RNA, 42 nt, Mus musculus
uggugauaauugaaguuuccucguguuuucuguuggcuucac

SEQ ID NO: 113960 - RNA, 56 nt, Mus musculus
cugccccugggggguuaucuugguuguguuaauugacaugaaagauccaucuuggu

SEQ ID NO: 113961 - RNA, 43 nt, Mus musculus
cucccauucguugcucauaucaggguguuuuaucacgggggca

SEQ ID NO: 113962 - RNA, 85 nt, Mus musculus
ugcagaggggugagugaugcugcagaggggugagugaugcugcagaggggugagugaugcugcagaggggugagugaugcugcag

SEQ ID NO: 113963 - RNA, 45 nt, Mus musculus
ugcagaggggugagugaugcugcagaggggugagugaugcugcag

SEQ ID NO: 113964 - RNA, 95 nt, Mus musculus
aggggugagugaugcugcagaggggugagugaugcugcagaggggugagugaugcugcagaggggugagugaugcugcagaggggugagugaugc

SEQ ID NO: 113965 - RNA, 55 nt, Mus musculus
aggggugagugaugcugcagaggggugagugaugcugcagaggggugagugaugc

SEQ ID NO: 113966 - RNA, 46 nt, Mus musculus
uuaggaaucauuuuauugcuacauccauuuagcagaauagcaguag

SEQ ID NO: 113967 - RNA, 50 nt, Mus musculus
ucgagggagacccuguuuuaaagccacaacagcaaaagaggggaaggaag

SEQ ID NO: 113968 - RNA, 46 nt, Mus musculus
uauagaaaugaauguaugucuuuuguacuaauuuaaggucuuggag

SEQ ID NO: 113969 - RNA, 45 nt, Mus musculus
uuauaauuugaauauggagaugguuuuaggaacucuucugggucu

SEQ ID NO: 113970 - RNA, 42 nt, Mus musculus
aaugagaggguggcucauggaaggagugauagagaaugggag

SEQ ID NO: 113971 - RNA, 41 nt, Mus musculus
cagagaaacccugucucgaaaaaaacaaaaacaaaaaaacc

SEQ ID NO: 113972 - RNA, 46 nt, Mus musculus
ggaaccaccucaauuagcaccuuaguaggcugacucuagugugugu

SEQ ID NO: 113973 - RNA, 45 nt, Mus musculus
gugacuuugauagguucuccuucuccuuugcuauauagccgaggc

SEQ ID NO: 113974 - RNA, 42 nt, Mus musculus
aaaagcuuucaucaaaagcugcuuucauaagcauggacagag

SEQ ID NO: 113975 - RNA, 107 nt, Mus musculus
uucugcuucuguuaaucagagccagcccuuccccuuccacuacaguuuacaguauauaauagcuuguuucuuuagaaguguagaacccaguuucauauugcccacua

SEQ ID NO: 113976 - RNA, 46 nt, Mus musculus
uaagauucuauuuccaaaauagcacccuaauuuguuaccucccccu

SEQ ID NO: 113977 - RNA, 46 nt, Mus musculus
uguguuaguuagguuucgacaguuggaacccaaagcagcuugggaa

SEQ ID NO: 113978 - RNA, 45 nt, Mus musculus
aauuaaaaaaaaaaaaugugugugugugugugugugugugugugu

SEQ ID NO: 113979 - RNA, 45 nt, Mus musculus
ggcacauucacauacauguaaaaauaaugaaugaaauagugagaa

SEQ ID NO: 113980 - RNA, 48 nt, Mus musculus
ugaggaguauuuacugucuagaauuccuuucuagagaaaaauuaggug

SEQ ID NO: 113981 - RNA, 46 nt, Mus musculus
uguaugagaagacugugcuguggaccuagcacgugggcuacuguag

SEQ ID NO: 113982 - RNA, 46 nt, Mus musculus
uaggagugugugugaacaaauccaacuggauaaguugggugccugg

SEQ ID NO: 113983 - RNA, 46 nt, Mus musculus
gcuaaggaugaccuugaacauaggacccucuugccuauacucccag

SEQ ID NO: 113984 - RNA, 45 nt, Mus musculus
aacuuaauuucuuucuuaccagaugccaauuuaaaaagaauucgu

SEQ ID NO: 113985 - RNA, 46 nt, Mus musculus
uaagaauuacagagaacccaucugcucuuggagccuauccguugag

SEQ ID NO: 113986 - RNA, 44 nt, Mus musculus
acaauuuugaguccgagaaguugaguaguaaaagaacauaggca

SEQ ID NO: 113987 - RNA, 45 nt, Mus musculus
auacauaagauaaauaaauaaauuagagagagaaaaaagggggag

SEQ ID NO: 113988 - RNA, 46 nt, Mus musculus
ucauuaauauuuaucaucuuuccuguuaccuguuggggaggcugug

SEQ ID NO: 113989 - RNA, 41 nt, Mus musculus
ucugcacagugggaggagacuguaaggagcauccucugcac

SEQ ID NO: 113990 - RNA, 45 nt, Mus musculus
gggaggagacagacaggagcauccucugcacagugggaggagaca

SEQ ID NO: 113991 - RNA, 45 nt, Mus musculus; identical to SEQ ID NO: 113990

SEQ ID NO: 113992 - RNA, 45 nt, Mus musculus; identical to SEQ ID NO: 113990

SEQ ID NO: 113993 - RNA, 45 nt, Mus musculus; identical to SEQ ID NO: 113990

SEQ ID NO: 113994 - RNA, 45 nt, Mus musculus; identical to SEQ ID NO: 113990

SEQ ID NO: 113995 - RNA, 45 nt, Mus musculus; identical to SEQ ID NO: 113990

SEQ ID NO: 113996 - RNA, 46 nt, Mus musculus
uuugaguguauagagaaaaggaagcagaugggaaguuugaccugga

SEQ ID NO: 113997 - RNA, 47 nt, Mus musculus
ucgacggaaguucaaacagaucgucacagcgguguauuuuugucacu

SEQ ID NO: 113998 - RNA, 46 nt, Mus musculus
gaggugugugugcacgugcgcauguguguguguguaugugcugaag

SEQ ID NO: 113999 - RNA, 46 nt, Mus musculus
cucuggaggucaguagaauaaaaaacauccgguuagcagcuguggu

SEQ ID NO: 114000 - RNA, 42 nt, Mus musculus
uaauguggucauacaccaccaucucugccauucugggggugg

SEQ ID NO: 114001 - RNA, 46 nt, Mus musculus
acagauuuuaauuaugaaauguaagcaguuaacauuuuuaugccag

SEQ ID NO: 114002 - RNA, 46 nt, Mus musculus
guagacaaagccuucuaagccgaaggaagauaaugcaaggccagag

SEQ ID NO: 114003 - RNA, 42 nt, Mus musculus
gguuuaagagacaguggaaaguucgggccucggcgcagugag

SEQ ID NO: 114004 - RNA, 41 nt, Mus musculus
cucgcuugugguagugauugccaugguaaucucaccaggag

SEQ ID NO: 114005 - RNA, 46 nt, Mus musculus
aacaggauggccuauacagagaagccugucgaaggaagaaaggaag

SEQ ID NO: 114006 - RNA, 25 nt, Mus musculus
cauugcuuugggagcaccgagaaca

SEQ ID NO: 114007 - RNA, 45 nt, Mus musculus
ccgucuucagacacacacuagaagagggcaucagaucccauuaca

SEQ ID NO: 114008 - RNA, 24 nt, Mus musculus
uccagaacacuugcugcuucauug

SEQ ID NO: 114009 - RNA, 52 nt, Mus musculus
uguguggcgcccugccguuugaugggagcacacugcagaaucugcgggcccg

SEQ ID NO: 114010 - RNA, 48 nt, Mus musculus
ugucucaucaggucuucauuuuuuauuccucuccaacaaaaucucaua

SEQ ID NO: 114011 - RNA, 48 nt, Mus musculus
agauccauuccuucuguccccuaaguauacucuuagucaucucugcca

SEQ ID NO: 114012 - RNA, 45 nt, Mus musculus
guucaguuucaagggaaguacacuugagagucucacccggggucc

SEQ ID NO: 114013 - RNA, 73 nt, Mus musculus
ugcugguguuagauccaaauaagcgccucucaauggaacagaucugcaggcacaaguggaugaagcucggaga

SEQ ID NO: 114014 - RNA, 46 nt, Mus musculus
augaguucaaggcuagccuggguuacauagcaagagcaugucuuag

SEQ ID NO: 114015 - RNA, 46 nt, Mus musculus
gcuaugaaccuuagcgucccucaaguucagcugaucaacccagaga

SEQ ID NO: 114016 - RNA, 44 nt, Mus musculus
uuuagaaaaguguaguagugcaagccuuucaucccagcacuuag

SEQ ID NO: 114017 - RNA, 45 nt, Mus musculus
agaacauuuggguuccacacagaaugugucacugccaacgagggg

SEQ ID NO: 114018 - RNA, 45 nt, Mus musculus
ugaguuggaagccagucuggucuauagagcaaguaacaugacagc

SEQ ID NO: 114019 - RNA, 26 nt, Mus musculus
gaagcugcugccuggcuuuccuggag

SEQ ID NO: 114020 - RNA, 46 nt, Mus musculus
gauguuugugaauaaacagauuucaucucuccaucucugcccccuu

SEQ ID NO: 114021 - RNA, 45 nt, Mus musculus
guuaccacuggcuuccccuugcacccugcaaguaaagagacccca

SEQ ID NO: 114022 - RNA, 42 nt, Mus musculus
aacagaagacugcccagaaaauuucauuucuauaagcgccau

SEQ ID NO: 114023 - RNA, 46 nt, Mus musculus
uguuuucccuugagggaaguugaaauaaaaugguuuucaugggcuc

SEQ ID NO: 114024 - RNA, 26 nt, Mus musculus
uggcuggcgagcugcccccaccccaa

SEQ ID NO: 114025 - RNA, 46 nt, Mus musculus
acaucccugggugacggaaaccugucuauugccugaaaauacugaa

SEQ ID NO: 114026 - RNA, 46 nt, Mus musculus
uucaagcccaccccccaaccaucccagcaaccaucucuucagacag

SEQ ID NO: 114027 - RNA, 45 nt, Mus musculus
aaggagcagaucugucagauggaaggacucaacuuuuauguguau

SEQ ID NO: 114028 - RNA, 46 nt, Mus musculus
agagaauuuaacagacaggaaaacacauggggggagagugcugguc

SEQ ID NO: 114029 - RNA, 46 nt, Mus musculus
aaguuaaugaguuugaaauuuaacguaaguguuacauacuaguaag

SEQ ID NO: 114030 - RNA, 62 nt, Mus musculus
auuuuccuuuggagauaacuuauucucuuugccuugcccaccccuacccccuugagcauauu

SEQ ID NO: 114031 - RNA, 45 nt, Mus musculus
uuccggccccucagcgccgaggaugaggagcaacagcccaccgag

SEQ ID NO: 114032 - RNA, 45 nt, Mus musculus
aaggagcucacgaugauuucucuaaagaaggggaucuuggugagc

SEQ ID NO: 114033 - RNA, 68 nt, Mus musculus
gguguagcgcacucccugguccuggauccugccugcagacuggaucuccguguuguuccagccacagu

SEQ ID NO: 114034 - RNA, 46 nt, Mus musculus
cugaaguaguuuggacucuucugaauggaaggcgggaagaagaaag

SEQ ID NO: 114035 - RNA, 46 nt, Mus musculus
uuuaagaucaggugugugaggugugugagcuguucacaagcugaga

SEQ ID NO: 114036 - RNA, 46 nt, Mus musculus
gagacagaccacggugugcuuaguuuagagcuuuauagaugaggag

SEQ ID NO: 114037 - RNA, 46 nt, Mus musculus
cacaagaagcucaucugaaguuuauaaacgaugcuggggguuagga

SEQ ID NO: 114038 - RNA, 46 nt, Mus musculus
ugcuccacuuuuuuaucuuuagguugggcuucagcauagccuagcc

SEQ ID NO: 114039 - RNA, 53 nt, Mus musculus
cgggaaacagcuuuguagaaaacccacaugcuccccagaaagauaaugccuug

SEQ ID NO: 114040 - RNA, 75 nt, Mus musculus
auaguaugugaucaccaaggcauuaucuuucuggggagcauguggguuuucuacaaagcuguuucccgagggauc

SEQ ID NO: 114041 - RNA, 25 nt, Mus musculus
gaagcaccagaggagaaggcggaag

SEQ ID NO: 114042 - RNA, 42 nt, Mus musculus
aauuagccuagagagaaguuggaaauacaagauugcaagaug

SEQ ID NO: 114043 - RNA, 45 nt, Mus musculus
gaacucaggggagcugucgggaauggauuugguggcugcugugga

SEQ ID NO: 114044 - RNA, 45 nt, Mus musculus
cagguguguguguguguguguguguguguguguguguggagugac

SEQ ID NO: 114045 - RNA, 46 nt, Mus musculus
ccauggugaagagguuaccacuugaguuagaaauguaagcacccaa

SEQ ID NO: 114046 - RNA, 42 nt, Mus musculus
aaccuccaaaagaaggucaaggagcacaguagggcugcagcu

SEQ ID NO: 114047 - RNA, 78 nt, Mus musculus
acaaguuucugcuggcucugggcaugugaaguacugacucagcagggaaggaugucggaggggccgagcaggcacagg

SEQ ID NO: 114048 - RNA, 45 nt, Mus musculus
agaaaauaagauucgugauuaacagugagaagaguaggucuggca

SEQ ID NO: 114049 - RNA, 45 nt, Mus musculus
caauccccagcaacuacaugguggcucacaaccaucuguaaagaa

SEQ ID NO: 114050 - RNA, 43 nt, Mus musculus
ccagacccaucuccucccaggagaguucgucaugacaccccgg

SEQ ID NO: 114051 - RNA, 45 nt, Mus musculus
cccggaucuaucuccucccaggagaguccgccaugacaccccgga

SEQ ID NO: 114052 - RNA, 35 nt, Mus musculus
guaagaaugaguuucuuuuggaaaguuuugaaaaa

SEQ ID NO: 114053 - RNA, 41 nt, Mus musculus
ggcucagaggcucagaggguaaagcauugucuucaccacug

SEQ ID NO: 114054 - RNA, 45 nt, Mus musculus
cauguacacacaugcacacauacaguaauaauaaauacacugacg

SEQ ID NO: 114055 - RNA, 42 nt, Mus musculus
ucaaagucaccagacacugguagccaggaaaccaagcccccg

SEQ ID NO: 114056 - RNA, 66 nt, Mus musculus
cggagcaaaaacuggguuggucacugauguucagcgggagcaccaggaacucaagaaacaagacca

SEQ ID NO: 114057 - RNA, 50 nt, Mus musculus
uugaagcuagagcgcuuggaacagaggagaaaagcagagaaagacucaga

SEQ ID NO: 114058 - RNA, 50 nt, Mus musculus
cccagagccggcagcagcaacagaauguagaagaugcaaugaaggagaug

SEQ ID NO: 114059 - RNA, 46 nt, Mus musculus
agugguccugcuccuccucccaauagauucaacauuuggccugggu

SEQ ID NO: 114060 - RNA, 42 nt, Mus musculus
ugugugcgugcgugcgugcgugcgugugugugugcgugugug

SEQ ID NO: 114061 - RNA, 46 nt, Mus musculus
uuugaacagaagcgcuuugccaggcucgccagcaagaaggcugugg

SEQ ID NO: 114062 - RNA, 25 nt, Mus musculus
ggaguccugcuaagagacgcagacc

SEQ ID NO: 114063 - RNA, 46 nt, Mus musculus
caaaagauagguuccuucauguauaguuggagaagggcugggugau

SEQ ID NO: 114064 - RNA, 46 nt, Mus musculus
ggggccaagagauugaacucacguugucaggguuuggaggcaagaa

SEQ ID NO: 114065 - RNA, 45 nt, Mus musculus
ggggggacguuuccaugacaaccuucccccacuuccuaaauccaa

SEQ ID NO: 114066 - RNA, 42 nt, Mus musculus
cugggcuaagcuuucgcccccuccguuccagcucgccccccc

SEQ ID NO: 114067 - RNA, 46 nt, Mus musculus
accucuccugcgguuuaguuuauuuugagcaagguuuuguuuggau

SEQ ID NO: 114068 - RNA, 29 nt, Mus musculus
ugauuacccuuuacccacagacuuuugua

SEQ ID NO: 114069 - RNA, 46 nt, Mus musculus
guaacugaagugaugaaagucccuucuguggcaugagacacccaug

SEQ ID NO: 114070 - RNA, 70 nt, Mus musculus
ucugucaaaguaacacuuugagcccccaagugaaguuuucaaaggaggaccgucucucaagggugagaaa

SEQ ID NO: 114071 - RNA, 45 nt, Mus musculus
agugugauuugacaguagcucauucgcaucaaagguggcccauug

SEQ ID NO: 114072 - RNA, 92 nt, Mus musculus
gucagaggacaguguggaggaaaugguucucucuugccggaggaucuuggggacugaacucagguuauaggcaccuuuacucacugagccau

SEQ ID NO: 114073 - RNA, 96 nt, Mus musculus
ggcuaaccuuaaguggauucuaccccggaacugcaucuaguuauuucuccaaggaaucccguuuccuguuuguggaggaaugcucaguaaauagag

SEQ ID NO: 114074 - RNA, 41 nt, Mus musculus
ccaagaccacuguggaccaugaucuuagcaaguaaaucgca

SEQ ID NO: 114075 - RNA, 46 nt, Mus musculus
uuucccuguacgguaauaaagauguauguggagucaguggcugcag

SEQ ID NO: 114076 - RNA, 45 nt, Mus musculus
aaaaaugaggucaucaucuucaagauuuuggccugaacaucucau

SEQ ID NO: 114077 - RNA, 46 nt, Mus musculus
gugcuuugcuuuuuacuuguuugucuuguuuuauuuuaguuuaaag

SEQ ID NO: 114078 - RNA, 46 nt, Mus musculus
cauugaaaugaaguucugaaagugcaagagacacuuagaaagagag

SEQ ID NO: 114079 - RNA, 62 nt, Mus musculus
gacuaaaggcuuauggguagaaaagugaaaauggcuagugagaaaugggauuagcaaaagau

SEQ ID NO: 114080 - RNA, 45 nt, Mus musculus
agcuuuuugaauagugaaguaaaaacaaguuucauuuaggaugug

SEQ ID NO: 114081 - RNA, 59 nt, Mus musculus
cuaaugaaggcuugaaguggggcagugcucagagaggcagagcugacuggauucggggc

SEQ ID NO: 114082 - RNA, 49 nt, Mus musculus
gcaguuugaaaauaagguucuuauuggaguuggagagaauuugagagua

SEQ ID NO: 114083 - RNA, 46 nt, Mus musculus
gaguguucaagugagccugaaggaggaugguguguugaggacaaga

SEQ ID NO: 114084 - RNA, 46 nt, Mus musculus
guuuauuccaugcgauaccuguaugggagcuagagguauagacuag

SEQ ID NO: 114085 - RNA, 42 nt, Mus musculus
aaccagggagaccccaucacauuggagguaccacagcaggag

SEQ ID NO: 114086 - RNA, 46 nt, Mus musculus
aguucuauuugcauauaguugaauuucuguaaugaauauggguuag

SEQ ID NO: 114087 - RNA, 42 nt, Mus musculus
cagugcuuucuuccucucccuucaguuuguguccaccccuag

SEQ ID NO: 114088 - RNA, 46 nt, Mus musculus
auacaaccccuguccuauauucaguguucuauaaauguccccuuua

SEQ ID NO: 114089 - RNA, 46 nt, Mus musculus
acuagaaaugggauuaaauuuuccagcauuuugaauuaacauuaag

SEQ ID NO: 114090 - RNA, 45 nt, Mus musculus
ugugcuuuaauuuaauguucuccauaaagauucaggaccugucag

SEQ ID NO: 114091 - RNA, 31 nt, Mus musculus
agcaccuccccuuccugcaucauugcuguac

SEQ ID NO: 114092 - RNA, 45 nt, Mus musculus
agugacaucucaucagagggagaaucugaaggaaucaaaccggag

SEQ ID NO: 114093 - RNA, 42 nt, Mus musculus
cucaaacucagagaugccugauuuugaauacugagugcuggg

SEQ ID NO: 114094 - RNA, 45 nt, Mus musculus
gaauacuaaguuguugggcaaggagagaaaugcuaauguccccga

SEQ ID NO: 114095 - RNA, 45 nt, Mus musculus
cgaguucagucucugggacagaccacaggguguaagagaacugag

SEQ ID NO: 114096 - RNA, 45 nt, Mus musculus
caucuccugugggaaucugccauuuuccauggagauuucggggga

SEQ ID NO: 114097 - RNA, 25 nt, Mus musculus
uuuguguugugucucugggagccau

SEQ ID NO: 114098 - RNA, 42 nt, Mus musculus
ccagguugccuggucaagaaccagcgauucccuuacccccac

SEQ ID NO: 114099 - RNA, 45 nt, Mus musculus
cuuucuuuuuuguuuuuuuguuuguuuuuuaaacagcagccacag

SEQ ID NO: 114100 - RNA, 46 nt, Mus musculus
uaaucuguuguccaagagauuggcaucuccgaaaggccacagcgag

SEQ ID NO: 114101 - RNA, 46 nt, Mus musculus
aagaccauugagccccuuaguugacagacaaugcugacaagcugag

SEQ ID NO: 114102 - RNA, 45 nt, Mus musculus
ucacaguuuuggguagucuguccauuuugucaguaauuuaaucua

SEQ ID NO: 114103 - RNA, 46 nt, Mus musculus
uuuguuuaaugccaauauaaaugacuagguucuuuuacaccccccc

SEQ ID NO: 114104 - RNA, 49 nt, Mus musculus
uuagugucuguccuuacucuaauuauugacuuuaccuuggccgacuuuc

SEQ ID NO: 114105 - RNA, 55 nt, Mus musculus
cauaguccuagugacuugauuuuaagguauuuguaagcgagacagugggcccaau

SEQ ID NO: 114106 - RNA, 56 nt, Mus musculus
cuacugcaugggaacagacagagucacaaacuguggaaccggaaugaagugugugu

SEQ ID NO: 114107 - RNA, 46 nt, Mus musculus
cccuuuuuuaucacauucuucuuuugauugagaagagaggcaccuc

SEQ ID NO: 114108 - RNA, 48 nt, Mus musculus
aacaaccaguaaucuggggcaguugcaacuugaaacuguacuuugaga

SEQ ID NO: 114109 - RNA, 24 nt, Mus musculus
cauuugggaccccugccucucuaa

SEQ ID NO: 114110 - RNA, 44 nt, Mus musculus
ugucucgugaccuccagaguuagccagguuaggcuggacuggaa

SEQ ID NO: 114111 - RNA, 25 nt, Mus musculus
acuuggugacguagacaaggagguu

SEQ ID NO: 114112 - RNA, 46 nt, Mus musculus
caguccugauaguucaacuaaaaguauccagauuuugagaagaaaa

SEQ ID NO: 114113 - RNA, 30 nt, Mus musculus
ucuuuaauuucacgauuuaauggaaaccag

SEQ ID NO: 114114 - RNA, 42 nt, Mus musculus
uggugguauaauuggagucagccuucuugaagauggagccuu

SEQ ID NO: 114115 - RNA, 42 nt, Mus musculus
caaaugcuuuugaguauauuguucuaggaacuccaccccuau

SEQ ID NO: 114116 - RNA, 46 nt, Mus musculus
gacuauacauaaaaacagauuauguuauuuuacuaauugaguggag

SEQ ID NO: 114117 - RNA, 42 nt, Mus musculus
agagugacauuauuugaaaggauuaggacauguggccuuguu

SEQ ID NO: 114118 - RNA, 45 nt, Mus musculus
gaaagaaagaaagaaagaaagaaagaaagaaagaaagaagcccua

SEQ ID NO: 114119 - RNA, 42 nt, Mus musculus
aucucucucucucucucaguuccacuguagucagccagccag

SEQ ID NO: 114120 - RNA, 45 nt, Mus musculus
uaccuuuauaaugaucgucuccgcguuuuguugaggaagcuucag

SEQ ID NO: 114121 - RNA, 46 nt, Mus musculus
cuccugcucccugucagucucugagcucacucacauuuaugcgaag

SEQ ID NO: 114122 - RNA, 43 nt, Mus musculus
uuuuuuuuccggaaauuguuaucgaauaguuugcgggugcuuu

SEQ ID NO: 114123 - RNA, 45 nt, Mus musculus
cugccaauugaacucagggcaagggaacccaucacaggugcccug

SEQ ID NO: 114124 - RNA, 46 nt, Mus musculus
aaacagucaucagaugauucugacacuuuguuuccuugcucccgga

SEQ ID NO: 114125 - RNA, 45 nt, Mus musculus
ugggcuaacacuggagacugaacguucacuuucugacacuggcuu

SEQ ID NO: 114126 - RNA, 42 nt, Mus musculus
ugccuugcacccucaaagaacaugugcaaauguuaaguccag

SEQ ID NO: 114127 - RNA, 41 nt, Mus musculus
gugguuagcgccaaacacaugcaaaacaugagaaugcuagu

SEQ ID NO: 114128 - RNA, 46 nt, Mus musculus
uuucaaaugcaaauucagcuuauuccugucacaugcgaggucucuc

SEQ ID NO: 114129 - RNA, 45 nt, Mus musculus
ugggcuacaugagauguuccaggccaaccuggacuauaaccggag

SEQ ID NO: 114130 - RNA, 46 nt, Mus musculus
uuauaucaguuacccaaacucucgucuuuuacucccccgcccccuu

SEQ ID NO: 114131 - RNA, 45 nt, Mus musculus
aauauuauuaaggauacuguauuuuaugacauaccaaaaugacag

SEQ ID NO: 114132 - RNA, 46 nt, Mus musculus
ggagucugugaauuaucaaguaauagcauugcuugaaggaagggag

SEQ ID NO: 114133 - RNA, 48 nt, Mus musculus
guuuagaagccauagucuggucauagaggaugccuguugcuauuaggg

SEQ ID NO: 114134 - RNA, 46 nt, Mus musculus
ugugcacaugagugugcacacacauaauuuauguaguuucuuggag

SEQ ID NO: 114135 - RNA, 46 nt, Mus musculus
uaaucaguaguaugggaauucauuggcaguguuuuccaugugggag

SEQ ID NO: 114136 - RNA, 46 nt, Mus musculus
ugugguagcuuucagucauguuaacccaaagaugaaaugggagaca

SEQ ID NO: 114137 - RNA, 46 nt, Mus musculus
gauugcuuaugaugcuuaaagaaguuacucggaaaaaucugaaaaa

SEQ ID NO: 114138 - RNA, 45 nt, Mus musculus
ggauauauaaaacaacaacacagagucuaugcugugaagaauaga

SEQ ID NO: 114139 - RNA, 46 nt, Mus musculus
ugguaaaugugucauucaugaauuuuaaaaaaguguuauaccgcag

SEQ ID NO: 114140 - RNA, 49 nt, Mus musculus
aaaaguggcugcagcgacaauaaaggcacuuuugugccuggagaguucu

SEQ ID NO: 114141 - RNA, 81 nt, Mus musculus
agucaauauaaagaggucauaaggaaggccauacugugggcagaagugaguaaaagcuggcugcugacagccaagugguag

SEQ ID NO: 114142 - RNA, 46 nt, Mus musculus
uuuccagugauggccgaauaggccaucuuuugauauauaugcagcu

SEQ ID NO: 114143 - RNA, 46 nt, Mus musculus
auguauguguauaucugugugugugugugugugugugugugugugu

SEQ ID NO: 114144 - RNA, 46 nt, Mus musculus
ucagcagguagagcccuugcugcccaaagugaugaucuaaguucag

SEQ ID NO: 114145 - RNA, 42 nt, Mus musculus
gucauuugguuuuggucucagugagagguguagauccccaag

SEQ ID NO: 114146 - RNA, 46 nt, Mus musculus
uccgaguugcuuucagauuguucauuuguacuguacuuacacuuag

SEQ ID NO: 114147 - RNA, 46 nt, Mus musculus
ucaaguggcgauuugacuuccagggaggccaggugugucuggugag

SEQ ID NO: 114148 - RNA, 41 nt, Mus musculus
gcagucagugcucuuaaccuccgagccaucuccccagccca

SEQ ID NO: 114149 - RNA, 46 nt, Mus musculus
cagguaagaaggagcuaaaugugugaaggaagaagacaguccagug

SEQ ID NO: 114150 - RNA, 46 nt, Mus musculus
uggcuacacuaucuuuccugacauuuuaaagucucucgugccucua

SEQ ID NO: 114151 - RNA, 45 nt, Mus musculus
cccugagaaacaugcucuuuucugaagggaaauguagaaggagcg

SEQ ID NO: 114152 - RNA, 46 nt, Mus musculus
gguacugagccuccuaagucucugugacagaaagauaccgauggag

SEQ ID NO: 114153 - RNA, 27 nt, Mus musculus
cacaguuuugcucacggcacuuaucca

SEQ ID NO: 114154 - RNA, 52 nt, Mus musculus
ucugggaggcaacagagugccuuucauuuaaacuacgcacagcuaaucuuua

SEQ ID NO: 114155 - RNA, 47 nt, Mus musculus
agaaauuacuauuaaauuugauuaacaaaugacagauuucagcccag

SEQ ID NO: 114156 - RNA, 46 nt, Mus musculus
acacuccacucugucaaacaaauguuuuuccuucucucugaaacag

SEQ ID NO: 114157 - RNA, 45 nt, Mus musculus
agagaaggcuccucagggguuaagaucauugcuacuccugcaccc

SEQ ID NO: 114158 - RNA, 41 nt, Mus musculus
guucuuauuaaaguaggauggucaguaaucuaaucaggcag

SEQ ID NO: 114159 - RNA, 42 nt, Mus musculus
caacaaaaauggagugaagaaauguuugaacaccuugggggg

SEQ ID NO: 114160 - RNA, 42 nt, Mus musculus
ccuuguccugucccuugcugagcccugacauuuucagugcag

SEQ ID NO: 114161 - RNA, 42 nt, Mus musculus
cucugauuacuuucaucuaauuucuuuaaaaacaacccccca

SEQ ID NO: 114162 - RNA, 46 nt, Mus musculus
cacgucacuaacccgagucaucucaguggcaccagacugucccaag

SEQ ID NO: 114163 - RNA, 46 nt, Mus musculus
caauagugauaaccacccuggcuauuaaggcauggguguuaggcag

SEQ ID NO: 114164 - RNA, 46 nt, Mus musculus
aaaccaaacacuaagagacuugccaagacuuccuuucccuaaucuc

SEQ ID NO: 114165 - RNA, 46 nt, Mus musculus
uuacacuucccccaugcuucucuagaaacguccugucugcccccuu

SEQ ID NO: 114166 - RNA, 46 nt, Mus musculus
cacccccaaaaagcagagaaucugauuccauaguguauauaugaag

SEQ ID NO: 114167 - RNA, 46 nt, Mus musculus
ucagggggaaagacaggugaucgcuguugcuggugcauuaaaggug

SEQ ID NO: 114168 - RNA, 46 nt, Mus musculus
uagucaccaggguaaugcaaaucaaaaccgccucacuacccaccag

SEQ ID NO: 114169 - RNA, 56 nt, Mus musculus
uauucauaaucacaaaacccagaaacaacccaaaugcacacugcuuaacaaaucga

SEQ ID NO: 114170 - RNA, 45 nt, Mus musculus
cguaaauuugugcuguuuaauagguuuggguuuaauuuugccuca

SEQ ID NO: 114171 - RNA, 45 nt, Mus musculus
uuguuuuuguuuuauuuguauuuuuugguuuguugcuguuuguug

SEQ ID NO: 114172 - RNA, 23 nt, Mus musculus
caucucucuguccucagacuuuu

SEQ ID NO: 114173 - RNA, 46 nt, Mus musculus
aauauucuugccaugugggcaaugcaaucugcucucaaguuugaag

SEQ ID NO: 114174 - RNA, 45 nt, Mus musculus
aaaucacuaucauaacuauuacauucauauguuugauuagccaga

SEQ ID NO: 114175 - RNA, 47 nt, Mus musculus
cuaucuauccuaucuaucuaucaucuaucuauccauuaauccaucua

SEQ ID NO: 114176 - RNA, 46 nt, Mus musculus
gucgcuuuuagcacaaugucucuauuuaaguuuucuuugaagccag

SEQ ID NO: 114177 - RNA, 46 nt, Mus musculus
ugaauccauguuguaccugucuaacauuauaaagcacaggcggcau

SEQ ID NO: 114178 - RNA, 42 nt, Mus musculus
uacacauacacagugcacaccuaugcaggugcccacaggcau

SEQ ID NO: 114179 - RNA, 46 nt, Mus musculus
gugcaucuguaacgguccgugaacuguacauucugccuguguguga

SEQ ID NO: 114180 - RNA, 41 nt, Mus musculus
gauguacauggaauuaggcaggacuuccuuuucaguaugga

SEQ ID NO: 114181 - RNA, 31 nt, Mus musculus
agacaggccuuguagucuucauuacuccuag

SEQ ID NO: 114182 - RNA, 136 nt, Mus musculus
gcuuucccauauacagcucacucucuaaugccacccaggccccucugaucucagaaaugccacggaagggcugcucugcugucucucagaauucuguuuccagcugaauuugucaggccaaauuuaaaagcgccaa

SEQ ID NO: 114183 - RNA, 46 nt, Mus musculus
caaacguugucucaagacaaaaaugucagcuucucauugucuccag

SEQ ID NO: 114184 - RNA, 45 nt, Mus musculus
agacauguagaagcuuccucagcauccucaguucuucagcacgca

SEQ ID NO: 114185 - RNA, 42 nt, Mus musculus
ccugucuuccuccacccuguccuuguuucucuaggcccccau

SEQ ID NO: 114186 - RNA, 46 nt, Mus musculus
auugguuaccauaggagaauuauuuucuuacuaaucugggcugcac

SEQ ID NO: 114187 - RNA, 41 nt, Mus musculus
gaaggguaaacuuacuucagcuggaaagguuuauggggaca

SEQ ID NO: 114188 - RNA, 45 nt, Mus musculus
uuccuuuuaagauuuuaaccaaaaaaagcaaauccuauagacuuc

SEQ ID NO: 114189 - RNA, 42 nt, Mus musculus
uugguguguuacaguuuuuacuguggcaucucugcauggcag

SEQ ID NO: 114190 - RNA, 46 nt, Mus musculus
gcucugagcagagccugucaaaaccucucugaagaacaguuaccaa

SEQ ID NO: 114191 - RNA, 30 nt, Mus musculus
gagcugagacggggcuaguacuaggcaaua

SEQ ID NO: 114192 - RNA, 42 nt, Mus musculus
gguuauuuaaagaagagggggacaugaaauugacaagguggg

SEQ ID NO: 114193 - RNA, 46 nt, Mus musculus
uuaucacuuaucucuaauuucagugaugauuaaucagcagcccaca

SEQ ID NO: 114194 - RNA, 24 nt, Mus musculus
gaaaaagaagaaccuuaaaaauaa

SEQ ID NO: 114195 - RNA, 42 nt, Mus musculus
cucggguuaaucuuugcauuguuguucuacuccacacugcag

SEQ ID NO: 114196 - RNA, 60 nt, Mus musculus
gaugcugcccugagggguggggacugaaaacgugagcccuugaucuacaggcgccaaacc

SEQ ID NO: 114197 - RNA, 51 nt, Mus musculus
cauaggaaauugacauacagauuacagaaucuugaguuucaucuucuaaga

SEQ ID NO: 114198 - RNA, 45 nt, Mus musculus
uguagaggguuuaagagaaauuacaguguauuaugaaaaccucag

SEQ ID NO: 114199 - RNA, 46 nt, Mus musculus
cuaacuaauuagaaggauguugcugaaggcacauggauggggacag

SEQ ID NO: 114200 - RNA, 46 nt, Mus musculus
caguacuaccugcaauaauucaccgcauucugaugacaaacccuua

SEQ ID NO: 114201 - RNA, 46 nt, Mus musculus
acguucauccuuggcugguacaggcccuuuaaagcagcagccccuu

SEQ ID NO: 114202 - RNA, 46 nt, Mus musculus
uucagguucagugagagacucugucucaaaaaauaaggugaagaag

SEQ ID NO: 114203 - RNA, 45 nt, Mus musculus
augugcugcccuacagugacucuaucauaacacaagaaccgcaca

SEQ ID NO: 114204 - RNA, 45 nt, Mus musculus
auuaguuuuaagcccccagucugucacacucagugaacaauucua

SEQ ID NO: 114205 - RNA, 46 nt, Mus musculus
cugacuagagagggccugguaggagaaacaccauugaaaacugcag

SEQ ID NO: 114206 - RNA, 28 nt, Mus musculus
auaacaucugguaaaauggaaggaucag

SEQ ID NO: 114207 - RNA, 45 nt, Mus musculus
cuucaaaugcuuuuggcuuuucauuuauuauugcuugucacgcgg

SEQ ID NO: 114208 - RNA, 46 nt, Mus musculus
gccugcuagucuucuccauagaaguccugacuuuucuuacauccug

SEQ ID NO: 114209 - RNA, 32 nt, Mus musculus
uauguagaacacuuugauauucaucgggccac

SEQ ID NO: 114210 - RNA, 23 nt, Mus musculus
caaccaauaagcaaagggccccg

SEQ ID NO: 114211 - RNA, 46 nt, Mus musculus
ccccugguuagaugggcccccacugcugcucuaucaaucacccgag

SEQ ID NO: 114212 - RNA, 41 nt, Mus musculus
caucugguuugaugaacuaaucaaaaacugauuagcaccuu

SEQ ID NO: 114213 - RNA, 42 nt, Mus musculus
caaguugccuguggcuauggagaaguagcaccaaguagugag

SEQ ID NO: 114214 - RNA, 46 nt, Mus musculus
ggaaagcaggcagccauaggggcccacgcaguuuacaaggacagag

SEQ ID NO: 114215 - RNA, 45 nt, Mus musculus
uugugugugugugucugugugugugugucuguguaugugucugug

SEQ ID NO: 114216 - RNA, 46 nt, Mus musculus
uugccaugcuaugcuugcucaucauucugggccgcuauuuugccag

SEQ ID NO: 114217 - RNA, 46 nt, Mus musculus
uggccuguuuagaugauaaagagacagugauacuggaacuuucgag

SEQ ID NO: 114218 - RNA, 45 nt, Mus musculus
agaaaaaaaaaaaaaaagaaaaaaaaaagaaaaaaaaaagaaaac

SEQ ID NO: 114219 - RNA, 46 nt, Mus musculus
gaggucugucuguuuuauguaaguggacaaauuugagaugucacag

SEQ ID NO: 114220 - RNA, 46 nt, Mus musculus
guaagcuccagacuccaaaacagccccucuggaaagauggcaucag

SEQ ID NO: 114221 - RNA, 45 nt, Mus musculus
cugguugcacugggaacugcucucgcaacccgaaucucagcguag

SEQ ID NO: 114222 - RNA, 55 nt, Mus musculus
acugcggagcugcagcaggacgacucggcgggggcggcggacggccauggcucgg

SEQ ID NO: 114223 - RNA, 41 nt, Mus musculus
gacccggugcuagggacccuaacgggagggguugcacguga

SEQ ID NO: 114224 - RNA, 46 nt, Mus musculus
gagugaugacauuuacugguuaguauucccagagauuuugccccag

SEQ ID NO: 114225 - RNA, 45 nt, Mus musculus
acuggggaagggaaaacguggcaaguuuuaaauagcuccugagug

SEQ ID NO: 114226 - RNA, 47 nt, Mus musculus
gguuugguuugguuuuugagaccaaggcuggccuggaacuugggagu

SEQ ID NO: 114227 - RNA, 34 nt, Mus musculus
cguaaacagauaaucucuuaucagguggcccggu

SEQ ID NO: 114228 - RNA, 42 nt, Mus musculus
ucccagcaaccacaugguggcucacaccauccgaaacgagau

SEQ ID NO: 114229 - RNA, 46 nt, Mus musculus; identical to SEQ ID NO: 64251

SEQ ID NO: 114230 - RNA, 24 nt, Mus musculus
acaagaacaaaaaacgaaagagua

SEQ ID NO: 114231 - RNA, 46 nt, Mus musculus
cuuccagaggacccagguucaauucucagcacccacauggcagcuc

SEQ ID NO: 114232 - RNA, 42 nt, Mus musculus
aaggccaccugaccuguauaauauguuccaggcagaccugag

SEQ ID NO: 114233 - RNA, 45 nt, Mus musculus
cuuaagcuucuaaaaggcuaauaugcaaaugagucccccagggau

SEQ ID NO: 114234 - RNA, 46 nt, Mus musculus
ggauagaauucccuuucugcugugaauaggagcccuuaaucccgag

SEQ ID NO: 114235 - RNA, 69 nt, Mus musculus
cccuccaaaaccuugucaacagcauuuucugcuguccccgcccccagauguaguucucuugguuuccag

SEQ ID NO: 114236 - RNA, 46 nt, Mus musculus
ucaggccucuuccccuggucacacugagaaaauacugugccaccau

SEQ ID NO: 114237 - RNA, 37 nt, Mus musculus
gguagguggagcuccaaguuucaggauagccaggacu

SEQ ID NO: 114238 - RNA, 45 nt, Mus musculus
uauuuuacacacacaauuuauuagagagucagagggcacgugugc

SEQ ID NO: 114239 - RNA, 46 nt, Mus musculus
uguuuuaaaauaauuuuuuaauuuuuuuauuauuuauauguaugua

SEQ ID NO: 114240 - RNA, 42 nt, Mus musculus
augcuccccaccuuaagccguuucuccagccugaaccuguga

SEQ ID NO: 114241 - RNA, 86 nt, Mus musculus
uguaucaugagccuuccuagacccaaacuuccugaugcccacuugacuggaaggcgcuugaaccugcuucauaccucucaaggcag

SEQ ID NO: 114242 - RNA, 42 nt, Mus musculus
agacauuucagcugagugacagggcuuuugggcaaagcagug

SEQ ID NO: 114243 - RNA, 46 nt, Mus musculus
uaaauaaucaaaauauuaaaaauuguaaauacacuuucugagccag

SEQ ID NO: 114244 - RNA, 45 nt, Mus musculus
ggcagcaagcaccugguaucugcuaugccauccuccuggcucaga

SEQ ID NO: 114245 - RNA, 45 nt, Mus musculus
auucccagcaaccacaugguggcucacaaucaucuguaaagagau

SEQ ID NO: 114246 - RNA, 42 nt, Mus musculus
cggaagagcagucagugcucuuaaccaucucuccagccccua

SEQ ID NO: 114247 - RNA, 42 nt, Mus musculus
ggugauacaagugugaugauauguguccccaucuguguggag

SEQ ID NO: 114248 - RNA, 46 nt, Mus musculus
uguuaaggucuuggaccaaauucuggucaccagacuuggaaugcag

SEQ ID NO: 114249 - RNA, 82 nt, Mus musculus
aaaugggaugaaaauacccauugggguaauuaucuaccuuguauaaaaaaagaagaaagggaggguaggagggaggggcugg

SEQ ID NO: 114250 - RNA, 46 nt, Mus musculus
ucaugguccucccagaggaccuauggguagauaaugauugcuagga

SEQ ID NO: 114251 - RNA, 45 nt, Mus musculus
ugccagaugcuguuaaaucagcugcgagaaaucacaggcauccag

SEQ ID NO: 114252 - RNA, 46 nt, Mus musculus
gccuuuuagacuauuuucuuaguaagaaguucaaggggcuggugag

SEQ ID NO: 114253 - RNA, 46 nt, Mus musculus
ucccagcaaucacaugguggcucacaaccauccguaagaucugacu

SEQ ID NO: 114254 - RNA, 46 nt, Mus musculus
cuacaguguacuuacacauaauaaauaaaucuuuaaaaaaaaaaaa

SEQ ID NO: 114255 - RNA, 76 nt, Mus musculus
aguaauggugacaucacccaggcugucagccuucucacagaccaaagaguuaaggagcccagucacgacacaacug

SEQ ID NO: 114256 - RNA, 56 nt, Mus musculus
cugcagaaccaucugaaguagaagagagugcuaccagcaaagaucucuuagcaagu

SEQ ID NO: 114257 - RNA, 82 nt, Mus musculus
augggugauggaacuugaacucaggucuuuaugcuuaagcagcagguguucugugcacugaucauaccccagcccaggagaa

SEQ ID NO: 114258 - RNA, 50 nt, Mus musculus
ggauugcagugcagcuauauugcucauuugccuuugagacaguuacaaga

SEQ ID NO: 114259 - RNA, 95 nt, Mus musculus
gaccucacucacgacaacaaagaugaccugcaggcagccauugccuugagucuccuggagucuccuaacauucaggcugacaacagagaucuuaa

SEQ ID NO: 114260 - RNA, 56 nt, Mus musculus
cgcaugaggcuaacucugcagaaacuaaacgcucaaagagaaaacgcugugaaguu

SEQ ID NO: 114261 - RNA, 44 nt, Mus musculus
ugguuggccaguugggcugaaaaauguuggcaacacauguuggu

SEQ ID NO: 114262 - RNA, 84 nt, Mus musculus
cuuccaugguaccgagucuggcugccagcaugagguccaaaucaccacuaauuucacagcuccagcugaccagcaucacuuguc

SEQ ID NO: 114263 - RNA, 47 nt, Mus musculus
ucagccccagcuaaccagaaccacagaaucuucccacaaaagcccag

SEQ ID NO: 114264 - RNA, 25 nt, Mus musculus
cacugaacucucgacacucaguggc

SEQ ID NO: 114265 - RNA, 45 nt, Mus musculus
uaucuuagguaggguuucuauuguuacaguaaaacacaugaccaa

SEQ ID NO: 114266 - RNA, 47 nt, Mus musculus
aaacauuucauugaggcuggcucacaguucagagauuuagccuggaa

SEQ ID NO: 114267 - RNA, 45 nt, Mus musculus
cuaugaugauuccaggcuaaaucucugaacugugagccagccuca

SEQ ID NO: 114268 - RNA, 31 nt, Mus musculus
gccuccuucagugccagcgcaucgugcaccu

SEQ ID NO: 114269 - RNA, 46 nt, Mus musculus
guaaguggggaggauggcucuugccuuaaccagcagaggcuuuuga

SEQ ID NO: 114270 - RNA, 44 nt, Mus musculus
gcuggugcaacagcaacagcucugagcucaguagcagguggaga

SEQ ID NO: 114271 - RNA, 56 nt, Mus musculus
gcuguugcaccagcuuugggcuccacaaugugaaacccccacacuauuacauggcu

SEQ ID NO: 114272 - RNA, 46 nt, Mus musculus
cagugguggugcauggcuguaaucacaugagaaugaggcugauaua

SEQ ID NO: 114273 - RNA, 45 nt, Mus musculus
gaaauguuucucauggucuccuauuugaacccuuccuguccagga

SEQ ID NO: 114274 - RNA, 42 nt, Mus musculus
aaugcuuccacaagucuaccaugaaaaaaaaguggggcagaa

SEQ ID NO: 114275 - RNA, 52 nt, Mus musculus
uauuuccacaucacaguccaucauugaagaaaauuagggcaggaacuaaagc

SEQ ID NO: 114276 - RNA, 46 nt, Mus musculus
cuuacauauaauaaauaaauaaaucuuaaaaaaaaaagagagaucu

SEQ ID NO: 114277 - RNA, 46 nt, Mus musculus
uccauuuuacauuuugugagacugcccaccaccccaagagauggag

SEQ ID NO: 114278 - RNA, 59 nt, Mus musculus
gggccaugguggaaggugacaucgcgcugcuuccuucggaucguuccgugaaguauggg

SEQ ID NO: 114279 - RNA, 88 nt, Mus musculus
uaagagacugauuaaucaggauuguuacaaguucaaggccagcguuggcugucuagugagugagauccugucucaagaagcaaacaac

SEQ ID NO: 114280 - RNA, 46 nt, Mus musculus
gauuauuuuccucagaaacaugagacuuuuacauuuuuauuuguaa

SEQ ID NO: 114281 - RNA, 46 nt, Mus musculus
ugcuuagguacauguauaagagcaaagagcuuauccgaaguaagag

SEQ ID NO: 114282 - RNA, 46 nt, Mus musculus
gucuucugggucguuucaugcuuugaaacauaaagcaacuauuaag

SEQ ID NO: 114283 - RNA, 46 nt, Mus musculus
aaagaacacuuccaaaaaugcacagggaauaaaaaaggaguugaag

SEQ ID NO: 114284 - RNA, 46 nt, Mus musculus
aaaauaaauacaccuuuaaaaaaaaaaagaaagaaaaacaccagcu

SEQ ID NO: 114285 - RNA, 46 nt, Mus musculus
gcucagcaguuaagagcacugacaguuuuuccagagguccugaguu

SEQ ID NO: 114286 - RNA, 42 nt, Mus musculus
cgugucccuuggagaaauuaaugaccuagcaguggacccgug

SEQ ID NO: 114287 - RNA, 37 nt, Mus musculus
caauauuaacauuuaacauuauuugcugcguguaggg

SEQ ID NO: 114288 - RNA, 41 nt, Mus musculus
gaggggaugaacaugugugcuucgcauucauaugaugguca

SEQ ID NO: 114289 - RNA, 46 nt, Mus musculus
ggucacuggccccguuauuuuuaggaaacuuaaagaaaccaagaau

SEQ ID NO: 114290 - RNA, 46 nt, Mus musculus
ugugugauuaugugcaucuggcagugcuaguaccucuggaggccag

SEQ ID NO: 114291 - RNA, 46 nt, Mus musculus
ccaaaaacuaauaaacaugcugugagauacagaaaugaggugggag

SEQ ID NO: 114292 - RNA, 46 nt, Mus musculus
uuuguuuuuauccugugcuaagacuugaacaccuuguacaucguag

SEQ ID NO: 114293 - RNA, 27 nt, Mus musculus
cucugcucucugugaagugugcacuga

SEQ ID NO: 114294 - RNA, 42 nt, Mus musculus
auggugcagauauacuugcaggcaaaguaucuauacccauaa

SEQ ID NO: 114295 - RNA, 46 nt, Mus musculus
ucaaaucccagcaaccucaugguggcucacaaccauccauaaugag

SEQ ID NO: 114296 - RNA, 46 nt, Mus musculus
aguucucaugacauuuucuuuguccuuccuaaaccaacugccucau

SEQ ID NO: 114297 - RNA, 61 nt, Mus musculus
cacuucccgacauguugaaauacguuauugaauuugccaguacaaaaccugccucugaaag

SEQ ID NO: 114298 - RNA, 42 nt, Mus musculus
ccacguugaggaauccucugacucuaccuauuuaaccggcag

SEQ ID NO: 114299 - RNA, 53 nt, Mus musculus
aaagaacuguaucucgagcagcacgaaggcgauugagcagauguacugugacc

SEQ ID NO: 114300 - RNA, 46 nt, Mus musculus
aggugccuuaucgcuuacaugcaguucuuguucacgaaggacaagc

SEQ ID NO: 114301 - RNA, 46 nt, Mus musculus
caaugacaacuugccccacuucagugcagguaaacaugcugacuag

SEQ ID NO: 114302 - RNA, 42 nt, Mus musculus
cccagcaaccacaugguggcucacaaccaucuaaugggaucu

SEQ ID NO: 114303 - RNA, 46 nt, Mus musculus
gguaaauggugccuagucaagucauuaaguacuuuggcucagagau

SEQ ID NO: 114304 - RNA, 46 nt, Mus musculus
cacuucauuaaaugugaaggcacugcucugagcgcacucgggaggc

SEQ ID NO: 114305 - RNA, 90 nt, Mus musculus
cacacagcuacaaccucagggcagcuccacaggugaaggcaagaucaggagcccgcaagguaggaaaggcuagaugagcuauugccuccg

SEQ ID NO: 114306 - RNA, 45 nt, Mus musculus
gcugugugcuaccaugcccagccgggacguucuuaccacucucag

SEQ ID NO: 114307 - RNA, 41 nt, Mus musculus
uggaagcccugucuguggaacucaggcaguacauucaggaa

SEQ ID NO: 114308 - RNA, 46 nt, Mus musculus
aagagguggaggaaugggaggaagaacaguccuguaagaucccaca

SEQ ID NO: 114309 - RNA, 44 nt, Mus musculus
ggauccucagugacaugucaauaucucucuucacagugacauuc

SEQ ID NO: 114310 - RNA, 60 nt, Mus musculus
uucugagcaugcugugauugcaaaagaacagacugcccaggcaauugccaacacagcuca

SEQ ID NO: 114311 - RNA, 47 nt, Mus musculus
acuccauuugguauuaugaacaaaaauacgcuuaccuuugagagauu

SEQ ID NO: 114312 - RNA, 46 nt, Mus musculus
ucuuggacaccuuuguuuaucucauagacuuagaaugugcacauag

SEQ ID NO: 114313 - RNA, 45 nt, Mus musculus
aaauaaauaaauaaaucuuaaaaaaaaaagauuuuaaaacaagag

SEQ ID NO: 114314 - RNA, 46 nt, Mus musculus
gagcagucagugcucuuacccacugagccauuucuccagcccccuu

SEQ ID NO: 114315 - RNA, 45 nt, Mus musculus
gcccaacuucuccucccccccacaaauguauguuggauagaauuu

SEQ ID NO: 114316 - RNA, 45 nt, Mus musculus
aucaugaagguggcucaggccaaauugauggaaauugguccagau

SEQ ID NO: 114317 - RNA, 45 nt, Mus musculus
uucaagcccagccuggccuacauaaggaguucuaggacagccgag

SEQ ID NO: 114318 - RNA, 44 nt, Mus musculus
aggcagugacgggaagccuaaaccaucccuaguauagcaguagg

SEQ ID NO: 114319 - RNA, 95 nt, Mus musculus
aggugcauuagaaucaucacaggaguuauaaagccccagggcccagaucaccuacauccuaauuaugucagaacaucuggggcaggagccagugc

SEQ ID NO: 114320 - RNA, 45 nt, Mus musculus
aauauauugcaacuucaaaccucaagaaaguuuaaagagccauca

SEQ ID NO: 114321 - RNA, 46 nt, Mus musculus
gcugacccuggaguggcuucagcugcugacugagguaaggaggcag

SEQ ID NO: 114322 - RNA, 47 nt, Mus musculus
uguguuuaagggauuaaggauaaaguugcacauuuuagguacagaac

SEQ ID NO: 114323 - RNA, 28 nt, Mus musculus
gacaaaauaacuagaaacugcuccccug

SEQ ID NO: 114324 - RNA, 64 nt, Mus musculus
uaaagaacuucuaauuggaaacucauguuuuaaccaaauuuuaaggauuaauggagcaaucaug

SEQ ID NO: 114325 - RNA, 24 nt, Mus musculus
gaguucuguacuaggucuggagcc

SEQ ID NO: 114326 - RNA, 40 nt, Mus musculus
uguuuaggguauguguggugugugaugugugugugugugu

SEQ ID NO: 114327 - RNA, 46 nt, Mus musculus
uuguuuuaguuuuuggaaggagggauggacuccaccagugucagug

SEQ ID NO: 114328 - RNA, 45 nt, Mus musculus
aaaaaaacaaauaucgucuggaguuauaauacaacucuccuggau

SEQ ID NO: 114329 - RNA, 46 nt, Mus musculus
aauauauacauaccacuuccuuuagagcccagaaucuagauuugaa

SEQ ID NO: 114330 - RNA, 46 nt, Mus musculus
cccuuccucugaaggacuccuuuggcuuuguugaaugaagcagaga

SEQ ID NO: 114331 - RNA, 46 nt, Mus musculus
aaugcuuccaagaacuuagacuaaggaaugaaccaagcccacaguu

SEQ ID NO: 114332 - RNA, 47 nt, Mus musculus
ggccccagauuaagaaucuaggaagcucagaucgaaaaagaaagaaa

SEQ ID NO: 114333 - RNA, 46 nt, Mus musculus
caaauaaucccccccccucucucucucucacauacacacacacaca

SEQ ID NO: 114334 - RNA, 41 nt, Mus musculus
cccaacgaugccacacaaacaaaagagaaugagagcaaagc

SEQ ID NO: 114335 - RNA, 45 nt, Mus musculus
ucauaguuagucaagguauaugcuuacuuguccuaauguacaggu

SEQ ID NO: 114336 - RNA, 46 nt, Mus musculus
gugcccucaaagacuaccugacugggcuuccaggauucgugaagau

SEQ ID NO: 114337 - RNA, 27 nt, Mus musculus
acccgguggugaaaccuucagcuggcu

SEQ ID NO: 114338 - RNA, 26 nt, Mus musculus
uugaauauuuauacagcagguucaga

SEQ ID NO: 114339 - RNA, 46 nt, Mus musculus
aaaaaaaaaaacuuguguaaaguuuacggggaugucgccaccaucu

SEQ ID NO: 114340 - RNA, 24 nt, Mus musculus
gacucggggaauagugaggcuugg

SEQ ID NO: 114341 - RNA, 46 nt, Mus musculus
ugggaugcuuuuaacaaguaccggaaacucugcccaucagccagac

SEQ ID NO: 114342 - RNA, 46 nt, Mus musculus
caugauugacccuacagaaaaggaaauaaaauuauagccugaugaa

SEQ ID NO: 114343 - RNA, 24 nt, Mus musculus
cugauuagaggaauaaaccuggag

SEQ ID NO: 114344 - RNA, 46 nt, Mus musculus
aaggcccucggcuaggcaacaagagccuuugcacugugacugugua

SEQ ID NO: 114345 - RNA, 46 nt, Mus musculus
ugcuagaaaaauaauagaacaaugccaccuccuaggcugcuggguu

SEQ ID NO: 114346 - RNA, 45 nt, Mus musculus
uccaaaacuaaagauagacuccccuuuaugguaugcauauuugua

SEQ ID NO: 114347 - RNA, 42 nt, Mus musculus
cuggagacccucugcuauuaaguucaugaucugcgugcugca

SEQ ID NO: 114348 - RNA, 31 nt, Mus musculus
cagggguguagguuaaucacagccagagaag

SEQ ID NO: 114349 - RNA, 45 nt, Mus musculus
acugaguuccagugugacccugucucaagauaaaaugaaaagaga

SEQ ID NO: 114350 - RNA, 41 nt, Mus musculus
guagcagccagaggccaccaaugauuaacuuugguggagag

SEQ ID NO: 114351 - RNA, 45 nt, Mus musculus
cucucugccuuccuccuucccuuccuccaaaccccgggugugugu

SEQ ID NO: 114352 - RNA, 46 nt, Mus musculus
cagaggccacagggggcgugcccauucucaaguacaaggcugagug

SEQ ID NO: 114353 - RNA, 46 nt, Mus musculus
auggugguucgcagccaugcucguguguccuccuugacccugaaga

SEQ ID NO: 114354 - RNA, 46 nt, Mus musculus
ggugcaacagugcuccuguguuauccugguugcuuugguuggaggu

SEQ ID NO: 114355 - RNA, 45 nt, Mus musculus
cacuaaaacacucccuggcuggaaaacgacuauaucaggccaucu

SEQ ID NO: 114356 - RNA, 45 nt, Mus musculus
ugguaaccugaacagaucccagugagguuaucaucuugacccaga

SEQ ID NO: 114357 - RNA, 45 nt, Mus musculus
uccccuccaucaccuggagaacauccacccggaacaucagcagug

SEQ ID NO: 114358 - RNA, 46 nt, Mus musculus
aaacucuacccgugagcuucaguggcuuguggguacacucccagcu

SEQ ID NO: 114359 - RNA, 46 nt, Mus musculus
guaagcccaauaguguagguugacugcagguaggccuggugaauau

SEQ ID NO: 114360 - RNA, 45 nt, Mus musculus
uggacacacauacagagagagagagagagagagagagagagagag

SEQ ID NO: 114361 - RNA, 46 nt, Mus musculus
cacacacagagagagagagagagagagagagagagagagguauuag

SEQ ID NO: 114362 - RNA, 36 nt, Mus musculus
gugguguaguguguaguguaguguagucuaguguau

SEQ ID NO: 114363 - RNA, 46 nt, Mus musculus
guguucaaauuuucuaaaugaaaauguguuuggaaggccauguguu

SEQ ID NO: 114364 - RNA, 45 nt, Mus musculus
gccaaucaaagcaagcaugcacacaauaaccaggaaacagagaaa

SEQ ID NO: 114365 - RNA, 24 nt, Mus musculus
gagaucuggggguuucuugaacac

SEQ ID NO: 114366 - RNA, 46 nt, Mus musculus
ucacgucugcucagcuaagcaauuuggugucuguugauagccaaac

SEQ ID NO: 114367 - RNA, 46 nt, Mus musculus
guuucucauagaaauucuuucauguuucugcaacucaaggccuaug

SEQ ID NO: 114368 - RNA, 45 nt, Mus musculus
aacugccgggugaugucauacuugggugggagacuggcauuucuu

SEQ ID NO: 114369 - RNA, 46 nt, Mus musculus
aagccagccacuguuaaaauuuucaugaaaacaaagaaaugagggg

SEQ ID NO: 114370 - RNA, 45 nt, Mus musculus
cggggaagugacugcaugcuugaucuccaccguuuuaagagcagc

SEQ ID NO: 114371 - RNA, 44 nt, Mus musculus
auacacacacacauacacauagagacacacagagacagacagaa

SEQ ID NO: 114372 - RNA, 49 nt, Mus musculus
auguugucagguuccacucaucaaaaauacugcaugugaaagaaaauag

SEQ ID NO: 114373 - RNA, 46 nt, Mus musculus
aauaaagcuguuuuaccaugaaaaguagguauuuugucuuggaucu

SEQ ID NO: 114374 - RNA, 46 nt, Mus musculus
agagagagagagagagagagaggagagagagagaugcuaaccagau

SEQ ID NO: 114375 - RNA, 44 nt, Mus musculus
uguuguuuugguuugguuuuguguuuuguguuugugagugugug

SEQ ID NO: 114376 - RNA, 42 nt, Mus musculus
agagagagagagagagagagagaagaaagaaggaagggaaug

SEQ ID NO: 114377 - RNA, 46 nt, Mus musculus
aaaaaauggauucaccaaaucauugacaaauguauugacaggaaua

SEQ ID NO: 114378 - RNA, 44 nt, Mus musculus
gguggcauauguugcaaagucacccuacagagaagcugcagaga

SEQ ID NO: 114379 - RNA, 28 nt, Mus musculus
agucaaucacauguagacuugcccagga

SEQ ID NO: 114380 - RNA, 51 nt, Mus musculus
gagauauauguaccgggaagagggcaaggagaaaccaaagacaggaagggg

SEQ ID NO: 114381 - RNA, 45 nt, Mus musculus
uucuuuacgucagucaggcugauacccaaacugagacaccagaga

SEQ ID NO: 114382 - RNA, 41 nt, Mus musculus
uccgugacauuguucagacagacucugauuggcaguggcuc

SEQ ID NO: 114383 - RNA, 42 nt, Mus musculus
uaugguugaagacagagccagcgggaauagaagaaaacggaa

SEQ ID NO: 114384 - RNA, 46 nt, Mus musculus
ccccacauuugcacagcagcccuuuauggacugugccacccccagu

SEQ ID NO: 114385 - RNA, 41 nt, Mus musculus
agagagagagagagagagagagagagagacacagacacaaa

SEQ ID NO: 114386 - RNA, 89 nt, Mus musculus
uaaguguacaugucuguguauauuuguguguauguagguguuagugugaguguaagugugugugucuguguuugaagauguuuguguga

SEQ ID NO: 114387 - RNA, 46 nt, Mus musculus
uguguuugaagaugauugugugagugugugugaguguguguuugau

SEQ ID NO: 114388 - RNA, 45 nt, Mus musculus
gugcaugugaguguguuuuugaguguguguuugugugugagagau

SEQ ID NO: 114389 - RNA, 43 nt, Mus musculus
uugaguguguaugcaugugaauguguuugagugugugugagag

SEQ ID NO: 114390 - RNA, 46 nt, Mus musculus
ugacagaguuuguguguguguguguguguguguguguguguguauu

SEQ ID NO: 114391 - RNA, 45 nt, Mus musculus
cagaaucuaugagccauuugggcuaggauccccacaaucuguuga

SEQ ID NO: 114392 - RNA, 41 nt, Mus musculus
cccggcucugauccucagcaccccaaaaaaagagagagaga

SEQ ID NO: 114393 - RNA, 45 nt, Mus musculus
agagggagagagagagagagagagagagagagagagacuguguga

SEQ ID NO: 114394 - RNA, 46 nt, Mus musculus
auuucauuuuccuuccuucaugauuuuauuaaaaaucagagcagag

SEQ ID NO: 114395 - RNA, 42 nt, Mus musculus
agagagagggagagggagagggagagagagagagagaaccca

SEQ ID NO: 114396 - RNA, 46 nt, Mus musculus
uucauggauuguuuuuccuuugagaggacuuggucaggaucuagau

SEQ ID NO: 114397 - RNA, 45 nt, Mus musculus
uaucuaucuaucugucuaucuaucuauuuauuaccucugugucag

SEQ ID NO: 114398 - RNA, 46 nt, Mus musculus
gaaaauuugcaggucauuacgcaaaacuaguucuggaggggugaag

SEQ ID NO: 114399 - RNA, 42 nt, Mus musculus
gugggagauggugggggugccaaggguuauugauuugcagau

SEQ ID NO: 114400 - RNA, 45 nt, Mus musculus
aaagaaagaaagaaagaaagaaagaaagaaagaaagaugguaucc

SEQ ID NO: 114401 - RNA, 45 nt, Mus musculus
guguaagggcugugcaggugacauuuacuccagguacucucagau

SEQ ID NO: 114402 - RNA, 46 nt, Mus musculus
agaaggacuggauuuugguauuuugcucaggucuuaacaaaggaua

SEQ ID NO: 114403 - RNA, 44 nt, Mus musculus
gaaaacccaaaacaagcaagaaacuggacuaugacaggacagca

SEQ ID NO: 114404 - RNA, 42 nt, Mus musculus
ggcuauccccaaacucaacucuaucuuccucuugccccagcu

SEQ ID NO: 114405 - RNA, 45 nt, Mus musculus
aaagaacaaagaggacugugugcacgcugaauucuuaccgggacg

SEQ ID NO: 114406 - RNA, 42 nt, Mus musculus
gaaacaggccuggggcuugcaggguggaggaaggggccuaaa

SEQ ID NO: 114407 - RNA, 45 nt, Mus musculus
aaccuuuguccaagcuugguuuguugaagccaucuuuuuucguau

SEQ ID NO: 114408 - RNA, 46 nt, Mus musculus
acgugacaugguuguacgcauuucccuucuggagagaaccacagca

SEQ ID NO: 114409 - RNA, 46 nt, Mus musculus
cuuugucuauaucaacucucacauccagaugcccuugaggagagau

SEQ ID NO: 114410 - RNA, 42 nt, Mus musculus
ucacuauaaaggaaagacuaggucauuuucugauggugagag

SEQ ID NO: 114411 - RNA, 45 nt, Mus musculus
uauccagaaagagagagagagagagagagagagagagagagagag

SEQ ID NO: 114412 - RNA, 86 nt, Mus musculus
aagaugaauaguucaagacaaaauaucuacagggaagaagucguucuuuaauuuaauuuuaaucuuauaaaagaccauagaaaggu

SEQ ID NO: 114413 - RNA, 99 nt, Mus musculus
aguaugguagguguggauuuauuuaauugauuacugucagauaagucauuuucauaaaaggaaugcauaccaagaucccuuugaacccccacaacuaag

SEQ ID NO: 114414 - RNA, 46 nt, Mus musculus
auugcaugcagccaaugugcaggauguuaacacuuuguaaauugau

SEQ ID NO: 114415 - RNA, 83 nt, Mus musculus
gaaacugucacaguugggaggagucucaggagacauggugaugagauggaauggagucugugcuguucccgguaaaguccaga

SEQ ID NO: 114416 - RNA, 46 nt, Mus musculus
uaaaauaaaugcaauguuuaacauaaauaaagauggcugccaagag

SEQ ID NO: 114417 - RNA, 46 nt, Mus musculus
ugucuccauucuauaugagacccaggcccuuucacucccaacagau

SEQ ID NO: 114418 - RNA, 46 nt, Mus musculus
ucugcaguguugaagaaggaaguauucuuucugcaagcaaagagga

SEQ ID NO: 114419 - RNA, 46 nt, Mus musculus
auuauguauucaauucaauauucacuuucuugagggaaugccagcc

SEQ ID NO: 114420 - RNA, 101 nt, Mus musculus
caaaaaaggcagauagggagguaaacagggaggauggaaaggaaggaagagaggaggaggaagagaaggaagaagaaagguggguaaugaaugaguggaua

SEQ ID NO: 114421 - RNA, 46 nt, Mus musculus
ccagauguagguguucuuagaagcccuagacugauugguugcuguu

SEQ ID NO: 114422 - RNA, 46 nt, Mus musculus
augcuuguauggcuagucaacuagcucugucuuuaccuuaggaguc

SEQ ID NO: 114423 - RNA, 45 nt, Mus musculus
cagauauuaauguuuggccccauagaguugaaauuagccacagac

SEQ ID NO: 114424 - RNA, 46 nt, Mus musculus
ccagcaagaucuugauggagacccccccuccgucaguagauaagau

SEQ ID NO: 114425 - RNA, 46 nt, Mus musculus
cuucaacaugcuugggagguacugccucucagccccagccccagug

SEQ ID NO: 114426 - RNA, 46 nt, Mus musculus
gacuccagagagaagugaauggaagccugcugucaacuggaggguu

SEQ ID NO: 114427 - RNA, 45 nt, Mus musculus
gagaugggcuucagcaaacuaagugagaaagucaagaaagccggu

SEQ ID NO: 114428 - RNA, 46 nt, Mus musculus
uggcuuuuacuagacaguacuaaagcccuggcauaaagguagagaa

SEQ ID NO: 114429 - RNA, 46 nt, Mus musculus
uauuguguuauaagaauaguguggcuuuuaaaacccugcuagagac

SEQ ID NO: 114430 - RNA, 42 nt, Mus musculus
gauaguucuuauugauguauuauaucaauuaaagccccgaca

SEQ ID NO: 114431 - RNA, 45 nt, Mus musculus
uuggacucuuaugucucugucauucaucaccuacuuggcccagau

SEQ ID NO: 114432 - RNA, 46 nt, Mus musculus
gcugcuuugaaaucacguguacaauuccagcaguuuacauggaggu

SEQ ID NO: 114433 - RNA, 45 nt, Mus musculus
uacuugagacccugaagauuaccagacaucuagucagcuggagaa

SEQ ID NO: 114434 - RNA, 28 nt, Mus musculus
ggacugauccuggaggagcagguguucc

SEQ ID NO: 114435 - RNA, 45 nt, Mus musculus
auauuuguucguccccugcugucaaccccagcucuggccccaucu

SEQ ID NO: 114436 - RNA, 46 nt, Mus musculus
ucuguuuggcugguucuauugaugugauccaucuaugccacaugac

SEQ ID NO: 114437 - RNA, 45 nt, Mus musculus
gcucucuggccauaucucaaguauaaauguaacaugguaccaagg

SEQ ID NO: 114438 - RNA, 46 nt, Mus musculus
caaugggugaaaaaaaaauggaaugguugcauuuaagaaagauaau

SEQ ID NO: 114439 - RNA, 46 nt, Mus musculus
aaaguacuugccagggcaggcauaagugcccuggucaguggcugag

SEQ ID NO: 114440 - RNA, 46 nt, Mus musculus
uugguggacuaaauugucuuugggaccuuggccuuuguacugggau

SEQ ID NO: 114441 - RNA, 46 nt, Mus musculus
ggucugcuuuuauuaucagguuagcgcugacuuauuaaaaugaguu

SEQ ID NO: 114442 - RNA, 46 nt, Mus musculus
auuuauccugguucuguuuuaauaaagaagucuuuugcagcccauc

SEQ ID NO: 114443 - RNA, 52 nt, Mus musculus
agaguugguuuuguuacauguguccaaaguguuaaaaucauagaaagcccag

SEQ ID NO: 114444 - RNA, 37 nt, Mus musculus
aaagaaccaauugcagaccuuuccccaauauucacau

SEQ ID NO: 114445 - RNA, 46 nt, Mus musculus
uccgagucuaaguuagaggaaggacugcagucauuaagcaggagau

SEQ ID NO: 114446 - RNA, 49 nt, Mus musculus
aaaggggagguuggucagcuugauguuuguuuggguggauguggagcag

SEQ ID NO: 114447 - RNA, 46 nt, Mus musculus
aagugggaaggcuggaugcuggagaauuggugcaguguuugcugga

SEQ ID NO: 114448 - RNA, 46 nt, Mus musculus
gguagcacacaccuucagucccagaacuugggaggcagaggcagga

SEQ ID NO: 114449 - RNA, 45 nt, Mus musculus
uuguugcaguaggaguggucuuguuggaguagguauggccuuguu

SEQ ID NO: 114450 - RNA, 37 nt, Mus musculus
aauuuaacaacauaaagguuggagaaauggcucaguc

SEQ ID NO: 114451 - RNA, 50 nt, Mus musculus
cuguacaugcacauauaggauguaucuguacaaagcccagcuaaggagga

SEQ ID NO: 114452 - RNA, 45 nt, Mus musculus
acacauuaauaaagaaguaaagaagggaaagaggaaggaauaaug

SEQ ID NO: 114453 - RNA, 47 nt, Mus musculus
uagagcagcucauuuugaaaagucaucauuuuaaugacuuuggagag

SEQ ID NO: 114454 - RNA, 46 nt, Mus musculus
cagagaaacccuguuuugaaaaacagagagagagagagagagagag

SEQ ID NO: 114455 - RNA, 39 nt, Mus musculus
aaugaagacugauuuaaggugugugugugugugugugug

SEQ ID NO: 114456 - RNA, 42 nt, Mus musculus
gcuuuggagauugugccuaguuuugguuuauagcgucaagag

SEQ ID NO: 114457 - RNA, 51 nt, Mus musculus
ggaacgaaagaauccuuauucugccccuaaacccaggcggcgaggacgaag

SEQ ID NO: 114458 - RNA, 46 nt, Mus musculus
agcaugacaauggagaccuaaucuuccaugaugcgucuuuuuagga

SEQ ID NO: 114459 - RNA, 42 nt, Mus musculus
acugguccagaucucuaagccuuggguguggagcccacagag

SEQ ID NO: 114460 - RNA, 45 nt, Mus musculus
aggauuugugcuuuggcgucccaauggacugggagagggggaagc

SEQ ID NO: 114461 - RNA, 47 nt, Mus musculus
ggcugugccaccgcccagagauccuuagcauucgggaagggggcgca

SEQ ID NO: 114462 - RNA, 48 nt, Mus musculus
uguauguguggugugugugucuguguguguguguguggugugugucug

SEQ ID NO: 114463 - RNA, 45 nt, Mus musculus
guggucagucugcauguuguacagccuuuacuaacucgugaaguu

SEQ ID NO: 114464 - RNA, 45 nt, Mus musculus
cauggagagguacgugcuggaaaggggcugugaauuuguucagau

SEQ ID NO: 114465 - RNA, 44 nt, Mus musculus
ccuauuuggagaaaaguugaaguauagccuuggggaccguagau

SEQ ID NO: 114466 - RNA, 46 nt, Mus musculus
caaaaugaguuaaagcauuuucuuugacauucaaaugcauaauaaa

SEQ ID NO: 114467 - RNA, 46 nt, Mus musculus
ugaaggucuuggaugauuuaugugguaaucuaguuuaauuagagag

SEQ ID NO: 114468 - RNA, 50 nt, Mus musculus
accaggcguuguaacuccgcuucguccgcuucaccaagcucggccauugu

SEQ ID NO: 114469 - RNA, 45 nt, Mus musculus
uaucccaacauaguuccaugaagugaugcaccuaagggcagagaa

SEQ ID NO: 114470 - RNA, 45 nt, Mus musculus
cggugauggcaagaguagugucaaugaagcgauccacacagcuag

SEQ ID NO: 114471 - RNA, 42 nt, Mus musculus
acauuuugccugauuuaacaccccugccccaccaccccgcac

SEQ ID NO: 114472 - RNA, 46 nt, Mus musculus
aucacuuaggguagaauaccuauacagcaaauuaaagaacccagaa

SEQ ID NO: 114473 - RNA, 46 nt, Mus musculus
aggacaucgaggaaagagauacuaagaaaaccaaacggaaaaagaa

SEQ ID NO: 114474 - RNA, 46 nt, Mus musculus
uaaaaucaucugcccgugaaucucgaaaacauaagaagucaaagaa

SEQ ID NO: 114475 - RNA, 45 nt, Mus musculus
uggaacaagaaguuauaugauuaugaauccaauauaccagacagg

SEQ ID NO: 114476 - RNA, 46 nt, Mus musculus
cagguugcuuauaaaucuaaaaguuugucuguuuucauuuauaguc

SEQ ID NO: 114477 - RNA, 46 nt, Mus musculus
cauguaaguaugcuauaugucuguugguggucagcaggggacagaa

SEQ ID NO: 114478 - RNA, 46 nt, Mus musculus
aggaggagucugacauguggaaaaucagagaacuagagaagcagau

SEQ ID NO: 114479 - RNA, 83 nt, Mus musculus
uuacccuugaggaggugagguggugugacugccacauaugucaguuuagaccgaugauuugucagugugguagaagauagaug

SEQ ID NO: 114480 - RNA, 44 nt, Mus musculus
uaaacuuucucuucugagcaauaaagaagacaucagcuaggagu

SEQ ID NO: 114481 - RNA, 48 nt, Mus musculus
cuuuaggguccuggaacugauccgucauggaucuugacuacuugacag

SEQ ID NO: 114482 - RNA, 46 nt, Mus musculus
uaaauaaaauagcuuccccucaagauaaagauauaagcccgcuucu

SEQ ID NO: 114483 - RNA, 46 nt, Mus musculus
uaauuuauuuguaauagacauaaagaaucuuuuguaaaugccaguu

SEQ ID NO: 114484 - RNA, 46 nt, Mus musculus
uuucucugcaauuauuaauccaccucaggcauguauucuggcaauc

SEQ ID NO: 114485 - RNA, 45 nt, Mus musculus
ucauuauuaccuuucugucgauguaaauaugggagaggugcuguu

SEQ ID NO: 114486 - RNA, 48 nt, Mus musculus
ggugaagagagaguucuagccaacuguguuuucauaacgaagggaagg

SEQ ID NO: 114487 - RNA, 45 nt, Mus musculus
ucagggacuuaaauuuauuucuuuauucauuauuggggcugugga

SEQ ID NO: 114488 - RNA, 46 nt, Mus musculus
cuuguuuguaagguggggaacguuccgaccucacuggccggcagga

SEQ ID NO: 114489 - RNA, 45 nt, Mus musculus
uuguuccuucuuccucuuggugagugggcuuguugggguggcacu

SEQ ID NO: 114490 - RNA, 42 nt, Mus musculus
aauaugaaccuguguucugucagauuaucuuugcagugauga

SEQ ID NO: 114491 - RNA, 57 nt, Mus musculus
caaccacaugguggcucacaaccauccguaacgagaucuggcucccucuucuggagu

SEQ ID NO: 114492 - RNA, 42 nt, Mus musculus
agcacugccauugucuaaacaugggaaaagaaggagggagga

SEQ ID NO: 114493 - RNA, 41 nt, Mus musculus
gugggcgagaagcugagugaaggagacuugcuggcagagau

SEQ ID NO: 114494 - RNA, 46 nt, Mus musculus
cccauauacagucaccaaacucagguacuauuauggaugccaagca

SEQ ID NO: 114495 - RNA, 46 nt, Mus musculus
aaauauucacgggaggaaaagcagagacaaaguguggagcagagac

SEQ ID NO: 114496 - RNA, 46 nt, Mus musculus
ucauuagugaaaaaauaacaauaaagaauaaguaugauggugaugg

SEQ ID NO: 114497 - RNA, 46 nt, Mus musculus
uuuauaaauucuauauuuauguauucuuuuucuucaggccucagga

SEQ ID NO: 114498 - RNA, 45 nt, Mus musculus
ccacuguuggguuugagagccuggaggagugcuauauggccaaga

SEQ ID NO: 114499 - RNA, 41 nt, Mus musculus
gggcacagggaugaaaggcgauaucuggagacaugggccag

SEQ ID NO: 114500 - RNA, 42 nt, Mus musculus
gaaugggagaugguucaccucaggaguucacuuaagccccag

SEQ ID NO: 114501 - RNA, 87 nt, Mus musculus
cugcauucaucuagccacaauggacaucgccauccaccaccccuggauccggcgccccuucuuccccuuccacuccccaagccgccu

SEQ ID NO: 114502 - RNA, 48 nt, Mus musculus
ggagagcaccuguuggagucugaccucuucucaacagccacuucccug

SEQ ID NO: 114503 - RNA, 41 nt, Mus musculus
agguucugggggacgugauugagguccacggcaagcacgaa

SEQ ID NO: 114504 - RNA, 43 nt, Mus musculus
cagccgauguggauccucucaccaucacuucaucccugucauc

SEQ ID NO: 114505 - RNA, 72 nt, Mus musculus
caggugucuggcccugagcgcaccauucccaucacccgugaagagaagccugcugucgccgcagccccuaag

SEQ ID NO: 114506 - RNA, 43 nt, Mus musculus
acccaaccaugcauugaguggugguguuuguccagguuuacag

SEQ ID NO: 114507 - RNA, 70 nt, Mus musculus
uuugggcacuucgguggaauuuguccuucaaccaaacggaaaggauuauauaauucaugugaagucucuu

SEQ ID NO: 114508 - RNA, 46 nt, Mus musculus
caccccacagcuggcagcagcaaugcagucccaguucagaaaagag

SEQ ID NO: 114509 - RNA, 42 nt, Mus musculus
ucuugcuucagacugacuugugaccucugcuccugcccccaa

SEQ ID NO: 114510 - RNA, 41 nt, Mus musculus
auggcggaccuguugcuuaacagacaacccuucaccccaga

SEQ ID NO: 114511 - RNA, 47 nt, Mus musculus
gggaccacuggccaccaggacuguucccacucacaugaacgaccaga

SEQ ID NO: 114512 - RNA, 46 nt, Mus musculus
ugccccugggcucccuggucaucaguuuuuuuguaguguguguggg

SEQ ID NO: 114513 - RNA, 46 nt, Mus musculus
ccaggaauguacauuugugacccucagucgaaggucaguaggucag

SEQ ID NO: 114514 - RNA, 42 nt, Mus musculus
gcgcagcagggccaggguccgguccgggggcagcggguggag

SEQ ID NO: 114515 - RNA, 64 nt, Mus musculus
caguauuaagaaguuaucaacuauagcucuagcacucgggguagaaaggacucgaacggaacug

SEQ ID NO: 114516 - RNA, 41 nt, Mus musculus
uuuuauaugcauugguguuuugccugcaugugaaagugaca

SEQ ID NO: 114517 - RNA, 46 nt, Mus musculus
augguuccuagcucuaccuugaugguucuguagaacuccagacaua

SEQ ID NO: 114518 - RNA, 87 nt, Mus musculus
cuuccaaauugggugaauuugcaaaaguuuuggaauuagacagugugaaaacugaaauugucccauuguucacgaauuuggcuucag

SEQ ID NO: 114519 - RNA, 41 nt, Mus musculus
uagaacauggagguugaaagaagccagugaagacaggagug

SEQ ID NO: 114520 - RNA, 46 nt, Mus musculus
agaaguucguuuaaauaucaucuccaauuuggauugugugaaugaa

SEQ ID NO: 114521 - RNA, 46 nt, Mus musculus
auagauugcuugcauuuaucuuuggguacuugugacuagguaguag

SEQ ID NO: 114522 - RNA, 45 nt, Mus musculus
ugugucuguguaaguaguguaucuguaugugaguuugugcuugug

SEQ ID NO: 114523 - RNA, 48 nt, Mus musculus
cuuugccaugggcuuccucccagcuuuuguaguuucgguuagauuuuu

SEQ ID NO: 114524 - RNA, 46 nt, Mus musculus
ccugccacauggccuuguaguaagacugaucauucaaaaccaguag

SEQ ID NO: 114525 - RNA, 46 nt, Mus musculus
uaaaggaagaauggaggagaggucuggagcacaaauuauguacgag

SEQ ID NO: 114526 - RNA, 42 nt, Mus musculus
auucgggaggcagccaccaacaaccucaugaaguuaguccag

SEQ ID NO: 114527 - RNA, 45 nt, Mus musculus
uuugcaguaaaauuucauuaauauguccagaaauuuaaggugaca

SEQ ID NO: 114528 - RNA, 46 nt, Mus musculus
auuguugauuuuacuuacaaauccuuuuagauauaacaagcccugu

SEQ ID NO: 114529 - RNA, 45 nt, Mus musculus
cagagcuugcugcugcuauagggagucacagcaaagugggcagag

SEQ ID NO: 114530 - RNA, 45 nt, Mus musculus
aaaucuuccacagucugagaugagacccauguaacacaaggguag

SEQ ID NO: 114531 - RNA, 46 nt, Mus musculus
uggagaagggaugcagaauccuaguucagcagucaccggggccagu

SEQ ID NO: 114532 - RNA, 45 nt, Mus musculus
uaaaccacugacagacaaaaggggcugucuuuaaauuaccgggcu

SEQ ID NO: 114533 - RNA, 42 nt, Mus musculus
agggugccugccuugcuuuuguuucacaaaugcucugggguu

SEQ ID NO: 114534 - RNA, 42 nt, Mus musculus
ggcagaaggguaagaggguggguaugaggggagaacuggaua

SEQ ID NO: 114535 - RNA, 46 nt, Mus musculus
guguacuuacauauaauaauaaaauaaaucuuaaaaaaaauauuaa

SEQ ID NO: 114536 - RNA, 46 nt, Mus musculus
cacaauggccuauaauguauuuaugaauaaauaugagaaaggagcu

SEQ ID NO: 114537 - RNA, 46 nt, Mus musculus
uuaaauaagccaguacuccaugaaauuggaugacuggagggcagaa

SEQ ID NO: 114538 - RNA, 42 nt, Mus musculus
gggcucagacaguaugugcuguucuggggauggguggcagca

SEQ ID NO: 114539 - RNA, 41 nt, Mus musculus
cuaugaauucuccccggaccgaauggggaggagcaaggaga

SEQ ID NO: 114540 - RNA, 46 nt, Mus musculus
gcugugaacccuucggaaaguggguuugugacuuuggcaaguaugg

SEQ ID NO: 114541 - RNA, 55 nt, Mus musculus
ccuuacuuccagaagaaacacagaaagaagacaccaaagaaacauuuaaagaacg

SEQ ID NO: 114542 - RNA, 46 nt, Mus musculus
ggcugagaaaggaaaggaucuaauuuacuuaggaugagaagcaaga

SEQ ID NO: 114543 - RNA, 29 nt, Mus musculus
uacauguuccaguggaaugaugaccggug

SEQ ID NO: 114544 - RNA, 44 nt, Mus musculus
cagagcaauaacacagccugccaggaccuuuaugcuuggacaga

SEQ ID NO: 114545 - RNA, 72 nt, Mus musculus
ugaggaagccaaagaaaccugcauggaggaugggggacagcucgucagcauugagacagaggaugagcagag

SEQ ID NO: 114546 - RNA, 42 nt, Mus musculus
uagggcagcuggucugccgaggaggaacacggaggccuugcu

SEQ ID NO: 114547 - RNA, 45 nt, Mus musculus
gagcccucccuacucucuugaauaccaucaauaaaguugcugcac

SEQ ID NO: 114548 - RNA, 46 nt, Mus musculus
uuguuucaaauucagcugcccugauucagcaagccacaacaguuaa

SEQ ID NO: 114549 - RNA, 44 nt, Mus musculus
uccagaaacgagauccugaucacaagaacaauuugggcucuuuu

SEQ ID NO: 114550 - RNA, 46 nt, Mus musculus
uuaaaaaaaagcccgcaauccuaaacauuaggcucucuuuucagau

SEQ ID NO: 114551 - RNA, 41 nt, Mus musculus
aaggccuaacuauaaccauuuucagucuuuugggagucaaa

SEQ ID NO: 114552 - RNA, 45 nt, Mus musculus
uugugagagagaaggaccuguaaggugggguagaccugcugagga

SEQ ID NO: 114553 - RNA, 46 nt, Mus musculus
uaccuuagcaucccucuguguuccucaugccaguucuguauucucu

SEQ ID NO: 114554 - RNA, 46 nt, Mus musculus
uucuuauucuugauuucaaaguaguugacaccauacaucucuagau

SEQ ID NO: 114555 - RNA, 31 nt, Mus musculus
aggacaacggagacaacuuucacaagcagag

SEQ ID NO: 114556 - RNA, 45 nt, Mus musculus
uaaggccaaaauucguuuauugauucucagacgaggugcauagaa

SEQ ID NO: 114557 - RNA, 44 nt, Mus musculus
accuuucuagcugcuucugaugcuuuuccucccgggccugagcc

SEQ ID NO: 114558 - RNA, 42 nt, Mus musculus
aagagagaaagagagaaagagagagagagagagagagggaga

SEQ ID NO: 114559 - RNA, 46 nt, Mus musculus
uacuuuuucuuaguauaaaagccugaauuuggaaacuugugcagau

SEQ ID NO: 114560 - RNA, 26 nt, Mus musculus
aauggauagaaacaaauugaugccau

SEQ ID NO: 114561 - RNA, 46 nt, Mus musculus
ggggccgcucucuggucaaauggcagcaucugaagcuaacacagag

SEQ ID NO: 114562 - RNA, 46 nt, Mus musculus
gcuauuuuccuucaguguauuugccaauuccccaaugagcacauaa

SEQ ID NO: 114563 - RNA, 42 nt, Mus musculus
uggaguuacuguaaaaggcauaaaccaggagcuggucagagc

SEQ ID NO: 114564 - RNA, 70 nt, Mus musculus
uuuuucuucuuggcuucuucuaaaagugcaaucuuggcagugaauucggcaaguucugcugccugaaauu

SEQ ID NO: 114565 - RNA, 50 nt, Mus musculus
gucaugcucguucuccgugggagggaugacuggaggagggggagguggag

SEQ ID NO: 114566 - RNA, 42 nt, Mus musculus
uuucggugacccgcuccuccucgcuucggugguucaucaccc

SEQ ID NO: 114567 - RNA, 30 nt, Mus musculus
guguguguggugggggagauuugucagccg

SEQ ID NO: 114568 - RNA, 46 nt, Mus musculus
ggaaccagaucauugcuuuucugguuacuuuuucuugggucuuaaa

SEQ ID NO: 114569 - RNA, 25 nt, Mus musculus
uugaucacaaacuaaaguucuagaa

SEQ ID NO: 114570 - RNA, 45 nt, Mus musculus
ggucauuggaagcuggucacauugcaucaguaguuaagaagcagu

SEQ ID NO: 114571 - RNA, 45 nt, Mus musculus
uagguccuacagaagugcugauagauaacaccaaacccggaugga

SEQ ID NO: 114572 - RNA, 46 nt, Mus musculus
agguggugcugguaggaguuucuaaaucagcauuagcugggcagua

SEQ ID NO: 114573 - RNA, 45 nt, Mus musculus
aaaagaaagccagauaugaaacacaguagggucagugauguuagu

SEQ ID NO: 114574 - RNA, 46 nt, Mus musculus
gucacuacaauaaaaucuguuccuucagcagcccuuuguguuagau

SEQ ID NO: 114575 - RNA, 46 nt, Mus musculus
uucuagcuuaagcugagauauuuaaauuuucaguaugggagaagaa

SEQ ID NO: 114576 - RNA, 46 nt, Mus musculus
ugcuggucuuuggugugaaaacaaaucaguuaaaguaguuugagau

SEQ ID NO: 114577 - RNA, 46 nt, Mus musculus
guuuucucuggcuuuucuuccaucucuuuccuuuuugggccugugg

SEQ ID NO: 114578 - RNA, 46 nt, Mus musculus
gugugugugugugugugugugugcguguguguguguguguggugcu

SEQ ID NO: 114579 - RNA, 71 nt, Mus musculus
uuaccuucaccuggagcucaauugaguugcaucgagauggaaaacaccacacaaucuuaguuuagaaucaa

SEQ ID NO: 114580 - RNA, 47 nt, Mus musculus
caaguacacuuccagauccugacaagcacagaaguucugaagagucg

SEQ ID NO: 114581 - RNA, 46 nt, Mus musculus
guuuuuagacaucauaucaccuaaauuuaaugauccagagaaguga

SEQ ID NO: 114582 - RNA, 45 nt, Mus musculus
uuuguacccaaaagacaguuacucaguuuuuguuuagcugcagau

SEQ ID NO: 114583 - RNA, 70 nt, Mus musculus
ccaucaauguaauccacuauauaaacaaaggaaaaaaauaccacaugaucaugucauuagcugcugagaa

SEQ ID NO: 114584 - RNA, 46 nt, Mus musculus
guaacacaaaguuuugguacccaauucauucuaugaagccacaauu

SEQ ID NO: 114585 - RNA, 46 nt, Mus musculus
cucucgaacacagccucugugcucucagaaaacacuucgagaagau

SEQ ID NO: 114586 - RNA, 41 nt, Mus musculus
agagagagagagagagagagagagacaaacagacagugggu

SEQ ID NO: 114587 - RNA, 42 nt, Mus musculus
aggaagugaucugcuauagaguuugaagugauacuggggaau

SEQ ID NO: 114588 - RNA, 58 nt, Mus musculus
cagagggauccuagagaaugauugcugcuuuggggggauaagacaaggggaugagugg

SEQ ID NO: 114589 - RNA, 47 nt, Mus musculus
ccucugggcuucucuccuucucuccauaccugauccugucccucuuu

SEQ ID NO: 114590 - RNA, 42 nt, Mus musculus
acucaaaucugugcagccacacaucugucuuucacugcgaua

SEQ ID NO: 114591 - RNA, 46 nt, Mus musculus
aagaauauuauagaagaaaaaagaaagcaguaagaggcgaggagaa

SEQ ID NO: 114592 - RNA, 42 nt, Mus musculus
gucaagcaugcuuacccacugagcauuuuacuggcuccaaga

SEQ ID NO: 114593 - RNA, 25 nt, Mus musculus
aaaugagagcugucuccuuugagag

SEQ ID NO: 114594 - RNA, 50 nt, Mus musculus
cggcuaaaagaaagagaggccagaagagaagccaacaaaagacaagcaaa

SEQ ID NO: 114595 - RNA, 27 nt, Mus musculus
ugugggagucagaugagagaaggugag

SEQ ID NO: 114596 - RNA, 66 nt, Mus musculus
aaaggcuucaggaagaggacaaauuugacaaagaagaauacaggaagaaaauuaaggcaaagcacc

SEQ ID NO: 114597 - RNA, 91 nt, Mus musculus
guucagcaguggccacagauucagaaaugugcuauaaaagauguggaggaagaagaugacacuggugguaucaaccuagacaaagcaaagg

SEQ ID NO: 114598 - RNA, 45 nt, Mus musculus
agcugaaaaauaacaaaauauaagguauuucagaguugcuagaag

SEQ ID NO: 114599 - RNA, 79 nt, Mus musculus
cuucuaaauccagugucaagaaaaaauuaaccaaaguugcagaagcaaaaaaaguaaugaaaagaaguuuuaaagugaa

SEQ ID NO: 114600 - RNA, 45 nt, Mus musculus
uuucucuugcugugauaaaaaccacauucaaaagcaauauggaga

SEQ ID NO: 114601 - RNA, 44 nt, Mus musculus
uacaaaguugucauugagagcaaugccaaccccagcaucaaagg

SEQ ID NO: 114602 - RNA, 44 nt, Mus musculus
gcacuagccaugagauauucugggcuuugauuggcauagagugc

SEQ ID NO: 114603 - RNA, 45 nt, Mus musculus
aaugagguauaaagugaagaaacaccuguuaagauugggggaaga

SEQ ID NO: 114604 - RNA, 45 nt, Mus musculus
aaauuuuuuaauagauuauagguuauuauauuucuacaacccaga

SEQ ID NO: 114605 - RNA, 46 nt, Mus musculus
gguuccaguaaggccuuuuucuuuccuuuuuagagaacugacauua

SEQ ID NO: 114606 - RNA, 46 nt, Mus musculus
ucuuucuaaaagauacuucuaaaauaauugaguuaucagguaagac

SEQ ID NO: 114607 - RNA, 46 nt, Mus musculus
uuacaucuuuauauaaaauaaugaagaguuaaauuuagugucagag

SEQ ID NO: 114608 - RNA, 46 nt, Mus musculus
uuuuaacaauauaauuaaaaacauacaaauucuuacuguauauaga

SEQ ID NO: 114609 - RNA, 46 nt, Mus musculus
aauguaggcugugcagcaguccugguauuucuguucuggggccaug

SEQ ID NO: 114610 - RNA, 46 nt, Mus musculus
ggguccucuuuguguagccauucuguuagucuaugucuuuuuauug

SEQ ID NO: 114611 - RNA, 45 nt, Mus musculus
uuucuuugauguguggugaggccuuuguuuauaguuugguugaug

SEQ ID NO: 114612 - RNA, 118 nt, Mus musculus
aggucaaggaaguuucugugcaguucuuaaacagagaugaugaugaugaagauggaccugaugcugacuuccucacagugaagcggcgggauguguuuggguuggaucuuaaagagaa

SEQ ID NO: 114613 - RNA, 46 nt, Mus musculus
acagacuggcuaguggugacggugacgaagaacaggaugaagagac

SEQ ID NO: 114614 - RNA, 46 nt, Mus musculus
ugucuacauucugggauggccaagucagccuaauuaaucuuuagau

SEQ ID NO: 114615 - RNA, 42 nt, Mus musculus
auugauguucagaaaaaauuagaaucauuuuuagcucaagau

SEQ ID NO: 114616 - RNA, 87 nt, Mus musculus
gucaggauaucauuuucaauggcuucuuaccuuauuauuuugagauaagaucuuuaacugaaccugucugucugucaagcuccuagg

SEQ ID NO: 114617 - RNA, 47 nt, Mus musculus
cauacuugaagucaucuacauuuucuccuauguuaguugcuagaaag

SEQ ID NO: 114618 - RNA, 46 nt, Mus musculus
gagaaugccugagccugaugcucccgauucuaaugcagccuagucu

SEQ ID NO: 114619 - RNA, 45 nt, Mus musculus
cucucuugugucacuguaauuagcauuggcgagauccaccuuaga

SEQ ID NO: 114620 - RNA, 45 nt, Mus musculus
ccaucccugcaguucuuucagauagggacaauuaugggucagagu

SEQ ID NO: 114621 - RNA, 46 nt, Mus musculus
ucauaaugcuuguagauagagacuuagaacaacacugcaaugcuga

SEQ ID NO: 114622 - RNA, 42 nt, Mus musculus
aaguguuuucugacugaucugaauuuauaccaugggccacca

SEQ ID NO: 114623 - RNA, 46 nt, Mus musculus
cuaaguucuugcugcacacagacugcuucucuagcuggcuuugucu

SEQ ID NO: 114624 - RNA, 41 nt, Mus musculus
aagagccgggcgugguggcgcacgccuuuaaucccagaacu

SEQ ID NO: 114625 - RNA, 42 nt, Mus musculus
caggguugguaggcaucauagauuucuuuuucugagugagac

SEQ ID NO: 114626 - RNA, 45 nt, Mus musculus
aaacuguauaauugcuuaucaguuuaguugaaggcaggacuagcc

SEQ ID NO: 114627 - RNA, 45 nt, Mus musculus
ccuugcucuccauggccggcagcagcagaugagaagaauggaggu

SEQ ID NO: 114628 - RNA, 44 nt, Mus musculus
ucaaaccccaauaaaguuguaggcauuaacuaccagcccagcaa

SEQ ID NO: 114629 - RNA, 46 nt, Mus musculus
cauuaacccaucuuaauguuggaugacuuugaaguaacuugcagau

SEQ ID NO: 114630 - RNA, 45 nt, Mus musculus
ugagaauauuuuaauguaacauuucugaaaauggggucuggagaa

SEQ ID NO: 114631 - RNA, 46 nt, Mus musculus
uaucaccuacucgagaacuggccuaucagacauuugagguucuacg

SEQ ID NO: 114632 - RNA, 42 nt, Mus musculus
agagagagagagaagaaaggcuagggaguaagagggagagag

SEQ ID NO: 114633 - RNA, 46 nt, Mus musculus
uagaagagagagcauagggggagagguucccacgaaggugagagua

SEQ ID NO: 114634 - RNA, 46 nt, Mus musculus
gguaccccaaguaaguaaggaggaacacaucuaaguccugcuugga

SEQ ID NO: 114635 - RNA, 47 nt, Mus musculus
uuuccugggugaaucuauauccuuucaaguugacagucacuauuacc

SEQ ID NO: 114636 - RNA, 75 nt, Mus musculus
auccagucuguuuuggcagggagaaggaugguagcaggagugugagauggcugggcauguuuuguccacagauag

SEQ ID NO: 114637 - RNA, 31 nt, Mus musculus
acagcaacagccccaguuuuuaccauuguuc

SEQ ID NO: 114638 - RNA, 42 nt, Mus musculus
gcccauuaagccugaauuaaaucauuccacugcuguccagau

SEQ ID NO: 114639 - RNA, 46 nt, Mus musculus
guuugguggcacacaccuuuaaucccagcacuugggaggcacuugg

SEQ ID NO: 114640 - RNA, 45 nt, Mus musculus
guuuuagagcuuuauuguagaaaggcagggggaaagggauaaggu

SEQ ID NO: 114641 - RNA, 42 nt, Mus musculus
ugggcugcugagggagggaggaaggcgcgcccugcaggccag

SEQ ID NO: 114642 - RNA, 42 nt, Mus musculus
gcaacaaguugaaaccagcuggacaaguccagagaagcaauc

SEQ ID NO: 114643 - RNA, 46 nt, Mus musculus
gccaaggaguucucugccucuuugcaggcaaaacaggacgccagau

SEQ ID NO: 114644 - RNA, 42 nt, Mus musculus
aacucuggcagugcaggacaaaagaugaacaaacuuagagau

SEQ ID NO: 114645 - RNA, 42 nt, Mus musculus
gaacaacagcaccccgcucguccccaaaucuuguggggaccu

SEQ ID NO: 114646 - RNA, 46 nt, Mus musculus
ugugugugugugugugugugugugagagagagagagagcgagagag

SEQ ID NO: 114647 - RNA, 46 nt, Mus musculus
acuaacugacuuacacacacacacacacacacacacacacacacac

SEQ ID NO: 114648 - RNA, 49 nt, Mus musculus
gcccacaaagaaagcuuggugcaagcgugggaggugugugacaggaagg

SEQ ID NO: 114649 - RNA, 46 nt, Mus musculus
cuguaauaguagcaguaaagccugggcggcuggagcaggucccugg

SEQ ID NO: 114650 - RNA, 46 nt, Mus musculus
caacuucuuuuucuccuaguucugcuaggacuauucagccucaaac

SEQ ID NO: 114651 - RNA, 46 nt, Mus musculus
caguauuaaaaguggcuaauggacuauauggacaauugguuaaguu

SEQ ID NO: 114652 - RNA, 46 nt, Mus musculus
ugcuguaccccucaaaugguccccagucagguccuaaggcuaaggu

SEQ ID NO: 114653 - RNA, 42 nt, Mus musculus
aggaggcagcaugucugucugucugcaguaaaggaggcagca

SEQ ID NO: 114654 - RNA, 42 nt, Mus musculus
cacucauacacacaagcacacaccgugugugggaauccagag

SEQ ID NO: 114655 - RNA, 41 nt, Mus musculus
uuccagacugugugugugugugugugugugugugugugugu

SEQ ID NO: 114656 - RNA, 45 nt, Mus musculus
cuucacccuuaaacucgaacuucagaaaugacaucucacccacca

SEQ ID NO: 114657 - RNA, 46 nt, Mus musculus
gauuggacuaugaauccuuuaaaagcucuguaucuacagcagagac

SEQ ID NO: 114658 - RNA, 46 nt, Mus musculus
agauccuucccacuccagaaacaguuccuuuuagacucagcagaga

SEQ ID NO: 114659 - RNA, 46 nt, Mus musculus
uugggacuagcguugggacaaggagcuuggauuugaggccguuuuu

SEQ ID NO: 114660 - RNA, 46 nt, Mus musculus
auuuuagguaauuuucugagcgauuuggaccaggaaguugagagag

SEQ ID NO: 114661 - RNA, 73 nt, Mus musculus
ucacuguaagauuggauggcaguugagucaaguucucaagacaagaaggaagggugacugagaagguggagau

SEQ ID NO: 114662 - RNA, 39 nt, Mus musculus
agauuuuucuguaagugucagcaccagaggugagggagu

SEQ ID NO: 114663 - RNA, 70 nt, Mus musculus
aaagaugcggaucuuucauuaauauuuugucaucagacaguucggaugucagcguguuacaaauaugagg

SEQ ID NO: 114664 - RNA, 46 nt, Mus musculus
cucaccuuuuauugccccuauaaucuauuagcuguuucguguacau

SEQ ID NO: 114665 - RNA, 46 nt, Mus musculus
aaugauuucagugccaaucagugccaaaagaaaaugauggugaguc

SEQ ID NO: 114666 - RNA, 46 nt, Mus musculus
aggucuuccagaugugcaauacacuacugcagagaaacacugagac

SEQ ID NO: 114667 - RNA, 41 nt, Mus musculus
uuuacccaaaauaauagauuguguggguucugauggcaagg

SEQ ID NO: 114668 - RNA, 42 nt, Mus musculus
caaccaucuguaacaagaucugacucccucuucuggccuguc

SEQ ID NO: 114669 - RNA, 46 nt, Mus musculus
ccuuagcaaaugcgaacaaagaugaauuuuugagcaaaccagagac

SEQ ID NO: 114670 - RNA, 46 nt, Mus musculus
cagauaacacagaggaguccauaggggggaaugcuagacuggagaa

SEQ ID NO: 114671 - RNA, 45 nt, Mus musculus
uuaagcaauauaauucagcuauuuguggaauuucugaguggcauu

SEQ ID NO: 114672 - RNA, 42 nt, Mus musculus
auuuaucaaauucuauuaaaggaaugguauaaaagcagaguu

SEQ ID NO: 114673 - RNA, 46 nt, Mus musculus
ggucaguguaguuuguugauaguaccuuuauuacccgagagcagaa

SEQ ID NO: 114674 - RNA, 45 nt, Mus musculus
guacccugccacugucuucagacacaccagaaaagggcaucagau

SEQ ID NO: 114675 - RNA, 45 nt, Mus musculus
augaacauuucagacuucuacuguuuaaaucguuucuguccuugg

SEQ ID NO: 114676 - RNA, 42 nt, Mus musculus
cucagcaaccacacgguggcucacaaccaucuguagggggau

SEQ ID NO: 114677 - RNA, 46 nt, Mus musculus
uuauuucagacuucaugagguagaauaguauuagcaaggcauagag

SEQ ID NO: 114678 - RNA, 49 nt, Mus musculus
uauggcgguaaugacagcuguuaguaaagaauggggugaugaacuggaa

SEQ ID NO: 114679 - RNA, 46 nt, Mus musculus
ccagcaauggagaaguguucuuucuuucuccacauccuugccagaa

SEQ ID NO: 114680 - RNA, 46 nt, Mus musculus
caauuuuacuuccauggugagaagugaguauuuuucaggccuuaaa

SEQ ID NO: 114681 - RNA, 46 nt, Mus musculus
uugcgaauuaauuaacuucugaaauguuucauaacuaugacuggug

SEQ ID NO: 114682 - RNA, 41 nt, Mus musculus
uugguagauugcuuuccgaagauucuugugcacauccuucc

SEQ ID NO: 114683 - RNA, 45 nt, Mus musculus
gucaguaaagugguaguuucuucacuucauacagugaugacauaa

SEQ ID NO: 114684 - RNA, 45 nt, Mus musculus
ugugagccaucaugugguugcugggauuugaacucagaacguuca

SEQ ID NO: 114685 - RNA, 46 nt, Mus musculus
uauauauauauuguguguauguauguacgaauguaugugucagaga

SEQ ID NO: 114686 - RNA, 46 nt, Mus musculus
gacuaggcuacuacucagagaaauccuccugccucugccuccccag

SEQ ID NO: 114687 - RNA, 46 nt, Mus musculus
gccuacagaggacccuccuacagcaaugaucaaucaagucccuaca

SEQ ID NO: 114688 - RNA, 47 nt, Mus musculus
uuguaaauaaacgguggcacagcccaacaaguaggaaaaauaggcag

SEQ ID NO: 114689 - RNA, 46 nt, Mus musculus
aaugugaaaauauuuaaaaacucguuuuuaauugauuggcucaguu

SEQ ID NO: 114690 - RNA, 45 nt, Mus musculus
gaugcagggaaauucacauaacaacaauaaauaaacaauccagaa

SEQ ID NO: 114691 - RNA, 26 nt, Mus musculus
ucucacauagccccuggccacccacc

SEQ ID NO: 114692 - RNA, 45 nt, Mus musculus
gccugaagguacuuagagacuuaacagauugugggagggggaggg

SEQ ID NO: 114693 - RNA, 46 nt, Mus musculus
ccacugauuacaguguaccuugcaaaagaaggaaaauagacguagg

SEQ ID NO: 114694 - RNA, 46 nt, Mus musculus
gaaaguuuuagaugagaacgugaggacauuuauaacaaccacaguu

SEQ ID NO: 114695 - RNA, 46 nt, Mus musculus
cggaugguugugagccaccaugugguugcugggauuugacucagga

SEQ ID NO: 114696 - RNA, 46 nt, Mus musculus
aauggaaagucugagaacagcaaaaucaaauguaucagccaccaca

SEQ ID NO: 114697 - RNA, 54 nt, Mus musculus
acucaaugaucugcucauuugcugccggcaguuagagcaugacagagcuacaga

SEQ ID NO: 114698 - RNA, 45 nt, Mus musculus
cagaaccagcugcuagauccgugcacgcgggaaaaggcgaagcga

SEQ ID NO: 114699 - RNA, 42 nt, Mus musculus
aagaccaggggcugagggggagggcugcucgggguggggaag

SEQ ID NO: 114700 - RNA, 43 nt, Mus musculus
cuggcccaccauaguggcuugaaacgccaauugcauauuucag

SEQ ID NO: 114701 - RNA, 45 nt, Mus musculus
auuuucaguucugugauuuaguacuaucuuuacacacacacacac

SEQ ID NO: 114702 - RNA, 45 nt, Mus musculus
ucuuuguuguugguuguucuguugucuuguuccaaacacugccag

SEQ ID NO: 114703 - RNA, 46 nt, Mus musculus
uuacugcacugaauuauucaccuaaguguucucuacucagccagcu

SEQ ID NO: 114704 - RNA, 46 nt, Mus musculus
acugguuuaagggcaaaaagaacuaauacuggcauauucuuaagag

SEQ ID NO: 114705 - RNA, 23 nt, Mus musculus
caagcuuguacugauuuacaaug

SEQ ID NO: 114706 - RNA, 45 nt, Mus musculus
augaaguagaugccuuuaccagcugaagcuaucuugcuaugccag

SEQ ID NO: 114707 - RNA, 46 nt, Mus musculus
aguacaaccuacugaaggcuguaacaugggcauguuuugccugagg

SEQ ID NO: 114708 - RNA, 64 nt, Mus musculus
gaguauacacacaugacuacagcaacucugggaguauacacacaugaauacagcaacucuggga

SEQ ID NO: 114709 - RNA, 36 nt, Mus musculus
aauaaugucaucucuauggaagaagcuagaccacac

SEQ ID NO: 114710 - RNA, 42 nt, Mus musculus
ucagcucgaacgagaaauggaauugcagaaaucaagcggcag

SEQ ID NO: 114711 - RNA, 45 nt, Mus musculus
augguguguaacuugcuguucaguaacuuugugugaugaugugca

SEQ ID NO: 114712 - RNA, 47 nt, Mus musculus
uaggccuuccgguauggguagauguguguggggaugagugugagaga

SEQ ID NO: 114713 - RNA, 60 nt, Mus musculus
uuuguuuuaaaaucauugccaaaaaauuacauggguauaaucuaauuuaaaguaauuaaa

SEQ ID NO: 114714 - RNA, 103 nt, Mus musculus
agugacaaaugcaccaaguaaaagcuauuugugauugccagcuccugggguuuagcugaacauuugaccaggaucaggucauugaagaccuuguguaaaacgu

SEQ ID NO: 114715 - RNA, 45 nt, Mus musculus
guuuaucaaaacuagccacuugguuuugugacauuuuggggguuu

SEQ ID NO: 114716 - RNA, 77 nt, Mus musculus
ccagaaacgucaauugaugaacugcuaggccuuccgguauggguagauguguguggggaugagugugagagagugug

SEQ ID NO: 114717 - RNA, 58 nt, Mus musculus
uguucauucaucacaaauaugaucuguuucugaacacauuuggguagugaauacagug

SEQ ID NO: 114718 - RNA, 64 nt, Mus musculus
uucaagccagcagaugucuuggagucuguugggaguuugggaagcacacaugguacugagauug

SEQ ID NO: 114719 - RNA, 48 nt, Mus musculus
aaacuucaggcuucucaguucuuacaacagugaacuuaaaagcagaca

SEQ ID NO: 114720 - RNA, 72 nt, Mus musculus
uauucuguauaccauuggcuacccuagaguauaucaacugagagaguggcaaccuuagcaacuuacaaacug

SEQ ID NO: 114721 - RNA, 47 nt, Mus musculus
agagauucccacccugaaccuuuggacucauagauuaaaugcggcag

SEQ ID NO: 114722 - RNA, 46 nt, Mus musculus
cucuagucaaccuauggagacuaauucuaauauagucuugccugaa

SEQ ID NO: 114723 - RNA, 45 nt, Mus musculus
auacugagucaaucucaguaucagccugaucagcccagugugcca

SEQ ID NO: 114724 - RNA, 43 nt, Mus musculus
gacggagccacuucagucugccagugcucaagagcccgagccc

SEQ ID NO: 114725 - RNA, 46 nt, Mus musculus
ccauguguuccuaaggacggaggauacauacaguugaugccuacca

SEQ ID NO: 114726 - RNA, 46 nt, Mus musculus
cguggaugguuaggaaauugucaguuugcaugaaaauaagaucaau

SEQ ID NO: 114727 - RNA, 42 nt, Mus musculus
auuugggugagagauuacuaacagcagaaaugacugcagcau

SEQ ID NO: 114728 - RNA, 59 nt, Mus musculus
aaaugccacuucuguagguggaacugugaaggaucaaaaacaagagcagaguaaaccug

SEQ ID NO: 114729 - RNA, 45 nt, Mus musculus
agggcuacacagagaaacccugucuugaaaaaaaaaaaaagcaaa

SEQ ID NO: 114730 - RNA, 46 nt, Mus musculus
ucauugcauuaugaugagugaacgaacacccagacacagagaccag

SEQ ID NO: 114731 - RNA, 42 nt, Mus musculus
gguuaguaaaauaucuaaucaguaaacaacaguuggaugaug

SEQ ID NO: 114732 - RNA, 44 nt, Mus musculus; identical to SEQ ID NO: 42525

SEQ ID NO: 114733 - RNA, 26 nt, Mus musculus
acucugcaaggccacacagcacacag

SEQ ID NO: 114734 - RNA, 42 nt, Mus musculus
uggagcugagaccaugguggcucagugauuggcugggggcag

SEQ ID NO: 114735 - RNA, 46 nt, Mus musculus
agggagugaagaauguuggacaccugauggccuccucuggccugag

SEQ ID NO: 114736 - RNA, 42 nt, Mus musculus
aacucagaaauccaucugccucugccucccaaaugcugggau

SEQ ID NO: 114737 - RNA, 45 nt, Mus musculus
cucuccuaagguugagacuacaaguuccuuacaccaugccuaguu

SEQ ID NO: 114738 - RNA, 46 nt, Mus musculus; identical to SEQ ID NO: 71556

SEQ ID NO: 114739 - RNA, 46 nt, Mus musculus
acgauggcuacauugaccuucaguuuacaaaaagcccuccuaagau

SEQ ID NO: 114740 - RNA, 46 nt, Mus musculus
guuuacacuucuggaguuauccagggauaugauuuaauauauaggu

SEQ ID NO: 114741 - RNA, 45 nt, Mus musculus
guucugugaaggauauuacauccugcugcuuuccugccaccaugg

SEQ ID NO: 114742 - RNA, 42 nt, Mus musculus
aacucaauauguagaccaggcuggccucgaacucacagagau

SEQ ID NO: 114743 - RNA, 41 nt, Mus musculus
accuuuuccccugacucccagcuccuugucacggcuucaga

SEQ ID NO: 114744 - RNA, 46 nt, Mus musculus
uucccccuccauuucucucucccucccucccuugcucccuugagac

SEQ ID NO: 114745 - RNA, 42 nt, Mus musculus
cacauggggaaagugaacauuuuugguguggaaaguggaaaa

SEQ ID NO: 114746 - RNA, 76 nt, Mus musculus
ggaggccaccacccacagguaugauauuaguaggacuuauuucauaaggcagcugugauuaagacaacagggaagg

SEQ ID NO: 114747 - RNA, 48 nt, Mus musculus
auccuaccucuguccuucuuagcuuugugccuucuggagaacaacaag

SEQ ID NO: 114748 - RNA, 46 nt, Mus musculus
uuagaaauguggcucuggagaguuguaaccaggccugggugaagcu

SEQ ID NO: 114749 - RNA, 46 nt, Mus musculus
ccaucagguccaagcuuagcaggcuugggucuggucuauguaagga

SEQ ID NO: 114750 - RNA, 46 nt, Mus musculus
cccaauaaaagcucuuccacuccaaauaagugacucuuagguaguc

SEQ ID NO: 114751 - RNA, 58 nt, Mus musculus
aaggcuguggcuguggcagugacagugacagugacagugaugggaauagcagcagcau

SEQ ID NO: 114752 - RNA, 84 nt, Mus musculus
guaauacugagcuuuccugaugccagaguaggaggccauauucugaggcucagagugcucuuaaugucuguacucuacggagau

SEQ ID NO: 114753 - RNA, 42 nt, Mus musculus
cuccuaggucugaggugaagaaaguguaacuggucuuagauu

SEQ ID NO: 114754 - RNA, 45 nt, Mus musculus
cacacuaagauuacuucaugcuguugccacauuuuagagggggac

SEQ ID NO: 114755 - RNA, 104 nt, Mus musculus
uuagcgcuucauccuugguuaaggaaaugaccaaccagguaaggucugcagugagagggaaagcuucaguuaguuacuggcaaauucagacuuaauagauugcc

SEQ ID NO: 114756 - RNA, 60 nt, Mus musculus
gcagggacugauccauagagagguaucagaaucuuauaacggugucaccauggugcagag

SEQ ID NO: 114757 - RNA, 68 nt, Mus musculus
guguguauuucuugacccccugggagaaagaucacacaccaccacaugauaggacugugauggggccu

SEQ ID NO: 114758 - RNA, 46 nt, Mus musculus
uuucucugggguuuagugccaugccuucucauuuuuguguuuuggu

SEQ ID NO: 114759 - RNA, 46 nt, Mus musculus
aauuuuagaagaugugcaggguguugaaucuuuugagucacgugau

SEQ ID NO: 114760 - RNA, 45 nt, Mus musculus
uaggauuacggaacugcuggcaggauguuguuuauguccugaggu

SEQ ID NO: 114761 - RNA, 65 nt, Mus musculus
aguauuaaauaugacuuuguuaacggcuuuagcgaucacagguguuuucauaucagaauguugug

SEQ ID NO: 114762 - RNA, 49 nt, Mus musculus
aacauuuguuagucuuugguuugcauauuugaagcagguagcaugagcc

SEQ ID NO: 114763 - RNA, 46 nt, Mus musculus
agucacaagucagcacaccugauuaagaucucuuaggccaggacua

SEQ ID NO: 114764 - RNA, 42 nt, Mus musculus
guggcuuucgugacucuauuuaacuuggcuaguccgcgaggc

SEQ ID NO: 114765 - RNA, 45 nt, Mus musculus; identical to SEQ ID NO: 93771

SEQ ID NO: 114766 - RNA, 45 nt, Mus musculus
gacauaagggcaucauaaaguguugaauauaaggaaaaaaaacag

SEQ ID NO: 114767 - RNA, 42 nt, Mus musculus
ggucuuauggucuuuuaccccucccuccuugaagguccugug

SEQ ID NO: 114768 - RNA, 46 nt, Mus musculus
ugugugcaugaguguguuuuguguauguguguguguuggauaacug

SEQ ID NO: 114769 - RNA, 45 nt, Mus musculus
uauccaacacacacacauacacaaaacacacucaugcacacacaa

SEQ ID NO: 114770 - RNA, 102 nt, Mus musculus; identical to SEQ ID NO: 93774

SEQ ID NO: 114771 - RNA, 46 nt, Mus musculus
ggccuuccagacaauugcucggaaugcccuuaaacaggaaacagag

SEQ ID NO: 114772 - RNA, 103 nt, Mus musculus
uuguuguguugggaaacaagauugaccuggaaaacagacaaguggccacaaagagggcacaggcuuggugcuacagcaaaaacaacauuccuuacuucgagac

SEQ ID NO: 114773 - RNA, 48 nt, Mus musculus
gugcagauugcuguguucugguguuugaugugacugcccccaacacuu

SEQ ID NO: 114774 - RNA, 45 nt, Mus musculus
uugggggcagucacaucaaacaccagaacacagcaaucugcaccu

SEQ ID NO: 114775 - RNA, 46 nt, Mus musculus
aggugaugguggaugacagacuuguuaccaugcagaucugggacac

SEQ ID NO: 114776 - RNA, 42 nt, Mus musculus
ggccugcguugugucuccuccuccguugacccugcgcuucaa

SEQ ID NO: 114777 - RNA, 24 nt, Mus musculus
cucgggcugccuggucgggaggag

SEQ ID NO: 114778 - RNA, 70 nt, Mus musculus
cguguuuuggaaaagcucauggaaccuuccacgcggcaggugguguggugagugugcaagcugucccacc

SEQ ID NO: 114779 - RNA, 71 nt, Mus musculus
ugugcccugugcggaagccuggacguuaccaggaggggaaaggagaugcuucgcaguuuauuaccggggaa

SEQ ID NO: 114780 - RNA, 45 nt, Mus musculus
uuucaaaggccuuaacuuuaugauaguuaucaaacucuauuggag

SEQ ID NO: 114781 - RNA, 41 nt, Mus musculus
gcauaggcagagaggcagagagggaggcagagaggcaggca

SEQ ID NO: 114782 - RNA, 70 nt, Mus musculus
aguuaaugcuaagacuugaaaaguccaggcuuguaggcuggugaagauuuuccaaauauggaaggcagaa

SEQ ID NO: 114783 - RNA, 45 nt, Mus musculus
uagacuggccuggacagcuggaggguuauucagguagaacuugga

SEQ ID NO: 114784 - RNA, 46 nt, Mus musculus
aacuauaaaacauuacaggagagaaacacaacaaggcuugccccua

SEQ ID NO: 114785 - RNA, 41 nt, Mus musculus
cuauaaggaagcagacugagcaaaccaauauguagcacccc

SEQ ID NO: 114786 - RNA, 46 nt, Mus musculus
uucugaccacugagcugcuucccagcugggaauauuuuugagugag

SEQ ID NO: 114787 - RNA, 46 nt, Mus musculus
ccacuguuaagaccuucacuugugggaagguagcagcacuuuccag

SEQ ID NO: 114788 - RNA, 45 nt, Mus musculus
uucuguuuuguguaugugugugugugugugugugugugugugcgu

SEQ ID NO: 114789 - RNA, 45 nt, Mus musculus
ggguccccuguaacagcaaucaauucuuuacugcuaagccauuag

SEQ ID NO: 114790 - RNA, 51 nt, Mus musculus
ccaucucugugcagcagccuacagaagccagagguuguuggauuuccugga

SEQ ID NO: 114791 - RNA, 46 nt, Mus musculus
gccaugcagaguucuccauagguggcagcugauuuucuucacccgg

SEQ ID NO: 114792 - RNA, 45 nt, Mus musculus
gugugugugugugugugugugugugugugugugguguuauacaca

SEQ ID NO: 114793 - RNA, 46 nt, Mus musculus
augauugcaacaaauuaaacaccuaggguaaauuuaaauaugggag

SEQ ID NO: 114794 - RNA, 46 nt, Mus musculus
aaaaaauuugcccaaacaguaaaugaaauaaaauauuaacuauuag

SEQ ID NO: 114795 - RNA, 46 nt, Mus musculus
ugcaaaugacaauuuagaauaaguaaagcuggcguuuuaacccagg

SEQ ID NO: 114796 - RNA, 77 nt, Mus musculus
acaaugaagaauauaaguuucaaaaguuuguaaaagaguccagaucuuaagagccaugaaacucggaguaauuaaac

SEQ ID NO: 114797 - RNA, 46 nt, Mus musculus
accaaaaacuuguucacuuaccuaaauaguuuagacccucccugug

SEQ ID NO: 114798 - RNA, 46 nt, Mus musculus
caauauauccugaacuugaagucugucuuguuuuuccuggguguag

SEQ ID NO: 114799 - RNA, 46 nt, Mus musculus
ucaguuggggcuggacacuaccagcccacuuauucuuuguguuuug

SEQ ID NO: 114800 - RNA, 46 nt, Mus musculus
cucaacaaugcuuuuuacccuuggugcagacuuguguuugggaccu

SEQ ID NO: 114801 - RNA, 46 nt, Mus musculus
uucuuauuuugucccaggaaaggaauaagugauuagagagaugcag

SEQ ID NO: 114802 - RNA, 45 nt, Mus musculus
gaagaaguaacuucagaagaagaggaagaggaggagauggcugaa

SEQ ID NO: 114803 - RNA, 42 nt, Mus musculus
uucaagaauuggacucaagccuuagacuuagacuccggggaa

SEQ ID NO: 114804 - RNA, 45 nt, Mus musculus
uuagaauacccaggacuaggucauuuauauugguauaguuuugag

SEQ ID NO: 114805 - RNA, 41 nt, Mus musculus
cucugcuuuucuuuuacuucucaugagauugacaaggggca

SEQ ID NO: 114806 - RNA, 46 nt, Mus musculus
ggagaugacuugagguuggaggaggagauacagguuaaggagacgu

SEQ ID NO: 114807 - RNA, 46 nt, Mus musculus
uuucauuucaggguuuuuauugauagaaaaaaauuaugcuggcugu

SEQ ID NO: 114808 - RNA, 82 nt, Mus musculus
ugcagugucugggucaguacaagcaucagacagacugaugaaggagcucagggacgucuacagaucacagagcuacaaggca

SEQ ID NO: 114809 - RNA, 45 nt, Mus musculus
aaacaaacaaacaaacaaacaaacaaacaaaaauuacaggggcug

SEQ ID NO: 114810 - RNA, 45 nt, Mus musculus
ccaaggagcuagagagcccauagugacaccccccacccaccccac

SEQ ID NO: 114811 - RNA, 46 nt, Mus musculus
uuuauauagaauucaaaaauuguaaaauuaguuuuguauagggcau

SEQ ID NO: 114812 - RNA, 49 nt, Mus musculus
gcucuuugugcuguaaaccagccauaggggguuuuuauuugagggcaua

SEQ ID NO: 114813 - RNA, 44 nt, Mus musculus
uauauggcuuuggugcuacagguggcacagguggauauaagaug

SEQ ID NO: 114814 - RNA, 46 nt, Mus musculus
caguaccaccugggugacccuuacauauuaccaagucccguuggag

SEQ ID NO: 114815 - RNA, 45 nt, Mus musculus
ugguauguaggaaaaaggaaauaauuuuuuaaaauguucuaggaa

SEQ ID NO: 114816 - RNA, 44 nt, Mus musculus
auguaacagacacacacacacaccacauauauacaaaagcgagg

SEQ ID NO: 114817 - RNA, 59 nt, Mus musculus
uauagaugagaucccauugccacaggaucaagugucagaagaccuaauggaaggaggag

SEQ ID NO: 114818 - RNA, 46 nt, Mus musculus
aggauuuuguaugcuugcuuuccuuuuuuuaaagguauguguuggg

SEQ ID NO: 114819 - RNA, 46 nt, Mus musculus
cggaugguuguaagccuccaugugguugcugggauuugaacuccua

SEQ ID NO: 114820 - RNA, 44 nt, Mus musculus
guguucccacauacacacauaaaauaaaugcaacaaaaagggaa

SEQ ID NO: 114821 - RNA, 45 nt, Mus musculus
acugauacgcaugcuggaaaucugaguucuuuucaguagacauga

SEQ ID NO: 114822 - RNA, 46 nt, Mus musculus
aggagggaagauuguaaauuugaggccaugugggcuacauugugag

SEQ ID NO: 114823 - RNA, 46 nt, Mus musculus
aaauagcuaaguaaauggucauauguuauaaccccugcacuuagag

SEQ ID NO: 114824 - RNA, 45 nt, Mus musculus
acccucauaaaugcacagggaaauccagaucaauauaccaacaaa

SEQ ID NO: 114825 - RNA, 33 nt, Mus musculus
gggagaggcuggacgccaugaagguacaagggu

SEQ ID NO: 114826 - RNA, 45 nt, Mus musculus; identical to SEQ ID NO: 55693

SEQ ID NO: 114827 - RNA, 45 nt, Mus musculus
guugugagccaccauuugguugcugggauuugaacucuggaccuu

SEQ ID NO: 114828 - RNA, 46 nt, Mus musculus
ccugcggcaggaaauagggucuauaggaaauaggguuuguugacag

SEQ ID NO: 114829 - RNA, 46 nt, Mus musculus
cauugucagaugccuuccuaccucauggucaaaccuauaacccuac

SEQ ID NO: 114830 - RNA, 27 nt, Mus musculus
uuguaguagugaaagggaaacuaaugc

SEQ ID NO: 114831 - RNA, 46 nt, Mus musculus
guucuaaaguaugaggucauuuuaccuuuccauuuauuagcggggu

SEQ ID NO: 114832 - RNA, 43 nt, Mus musculus
augaugauagacuaagccucugaaacuauaaacaagcccccag

SEQ ID NO: 114833 - RNA, 45 nt, Mus musculus
caugccuauacagcagacacuuaaccaaacugaucccugucccca

SEQ ID NO: 114834 - RNA, 42 nt, Mus musculus
uguggcuggcuuacucugcuguaguuuuaauuuggaccgccc

SEQ ID NO: 114835 - RNA, 25 nt, Mus musculus
auagccuugggguggagggugaggu

SEQ ID NO: 114836 - RNA, 46 nt, Mus musculus
cguuuccuacuuucuggaucauucgaaaguggucucacuuuuagag

SEQ ID NO: 114837 - RNA, 45 nt, Mus musculus
ugagagccucgggaguuguguucuccguggcccggaccauguagg

SEQ ID NO: 114838 - RNA, 45 nt, Mus musculus
gagaaaagguauccaucccacccggagccaagggaagaaggccag

SEQ ID NO: 114839 - RNA, 44 nt, Mus musculus
gaagagguggaaaucgaagugcgacuccagcaagggagggggaa

SEQ ID NO: 114840 - RNA, 66 nt, Mus musculus
uuuugcaccacuuuugagcauagaaccccagguucuggagagcaaguugggaauuaaauuguuuug

SEQ ID NO: 114841 - RNA, 46 nt, Mus musculus
cgggcgagcaaggcgcagagagacagugacaguuccccacgcagcg

SEQ ID NO: 114842 - RNA, 41 nt, Mus musculus
gucgucaguggcggcgguggccggggcuccacaccccagcc

SEQ ID NO: 114843 - RNA, 43 nt, Mus musculus
ggcuuucugcguccucgccgagcgggcgcgaugcggcugggcc

SEQ ID NO: 114844 - RNA, 46 nt, Mus musculus
cuggcgccagccaccgcggcguacagcagcagcggcagcagcaguc

SEQ ID NO: 114845 - RNA, 43 nt, Mus musculus
caccgggcggacuacgaccgcgaagcgcugcuggguguccagg

SEQ ID NO: 114846 - RNA, 30 nt, Mus musculus
gacgucgaugaguauguuaaacuuggccac

SEQ ID NO: 114847 - RNA, 25 nt, Mus musculus
ucgacugcaaucgucuuugcugcuc

SEQ ID NO: 114848 - RNA, 44 nt, Mus musculus
ccaauaguauuaauaaaaauaaggaauggggagagcuggcagag

SEQ ID NO: 114849 - RNA, 44 nt, Mus musculus
uuguggaguaugauaagaacagcgacggcgcugugacgugggau

SEQ ID NO: 114850 - RNA, 45 nt, Mus musculus
ugcgugguagacaagugcuccacuaugagcuauuucccagcccac

SEQ ID NO: 114851 - RNA, 46 nt, Mus musculus
acacagagaaagcuuguguagaaaacaaaaacaacaaaaagcccag

SEQ ID NO: 114852 - RNA, 46 nt, Mus musculus
uucccagaagugagauuauuggaucgccucuguuuuuaguuuuuug

SEQ ID NO: 114853 - RNA, 42 nt, Mus musculus
uaaaugcccuuaacuucugagccaugucucuagcccccagcc

SEQ ID NO: 114854 - RNA, 46 nt, Mus musculus
auauauugacucauuuaauaugaggcacuguuuugauaggcuuaag

SEQ ID NO: 114855 - RNA, 46 nt, Mus musculus
guccuggucugagucuugaagaguucauugcguuugagcacccuga

SEQ ID NO: 114856 - RNA, 47 nt, Mus musculus
uucuucagggugcucaaacgcaaugaacucuucaagacucagaccag

SEQ ID NO: 114857 - RNA, 46 nt, Mus musculus
uugagaagugagagcugaaggaaagaaacgcuccacagugagacag

SEQ ID NO: 114858 - RNA, 98 nt, Mus musculus
auccaagaggcuuuggaagaacaugacaaaaauggcgauggguuuguuaguuuggaagaauuucuuggcgauuacaggcgggauccaaguaaguuucc

SEQ ID NO: 114859 - RNA, 83 nt, Mus musculus
ugcaaaugaagacccagaauggauacuuguugaaaaggacagauuugugaaugauuaugacaaagauaaugauggccggcuug

SEQ ID NO: 114860 - RNA, 45 nt, Mus musculus
cagagagcuuuuugucacuauucaaauccaucucaucaaucagau

SEQ ID NO: 114861 - RNA, 73 nt, Mus musculus
gaauagugacaaaaagcucucugaagaagagauucuggaaaaccaagacuuguuccuuaccagcgaagccacg

SEQ ID NO: 114862 - RNA, 27 nt, Mus musculus
agcuuuaacccccgagugcgccccagc

SEQ ID NO: 114863 - RNA, 60 nt, Mus musculus
acuucagaugaucuaaauguagauuauaacuuuuggccuuuucaaagaaaacaaaacaag

SEQ ID NO: 114864 - RNA, 45 nt, Mus musculus
caugucuaaacaauaguauuuaaguagcacgugaugaagcuguca

SEQ ID NO: 114865 - RNA, 43 nt, Mus musculus
ucugcugggguuaugaaucagaauggcugaaggagcagagacc

SEQ ID NO: 114866 - RNA, 47 nt, Mus musculus
uccaauugguaaaaugccuuugcaacagguuacuugcaugguaaggg

SEQ ID NO: 114867 - RNA, 74 nt, Mus musculus
cgcuugcuuucucccuagugcuguugcugcugcugccuggcaccugagacccuugugccccuuccguuuugccc

SEQ ID NO: 114868 - RNA, 58 nt, Mus musculus
gcucugugcuguuggaaaacccuuuagcuuggggacagucugugagcuugcugggggu

SEQ ID NO: 114869 - RNA, 41 nt, Mus musculus
uggcucaucauggaugauaaugggaaaagguggcaucccgg

SEQ ID NO: 114870 - RNA, 42 nt, Mus musculus
ccgacuuauggcaguuuuuccuuggagggacauuuggcccag

SEQ ID NO: 114871 - RNA, 46 nt, Mus musculus
ucuggcuucucaguauguacugcaaucuugccauccuucuccugua

SEQ ID NO: 114872 - RNA, 29 nt, Mus musculus
cuuggaacccggagaugaaaggagcacac

SEQ ID NO: 114873 - RNA, 44 nt, Mus musculus
uccuuacuaggauugaugauggggcagcugguuucuuagugcca

SEQ ID NO: 114874 - RNA, 46 nt, Mus musculus
ggacccagcucucuuggcugcagacucugugcucuuaagccccuau

SEQ ID NO: 114875 - RNA, 45 nt, Mus musculus
guguguguguaagguuuuguguggauguaaucugcuguccuguca

SEQ ID NO: 114876 - RNA, 45 nt, Mus musculus
uugagagugguugagaaugaguucuggcuuucaaaccuaccugga

SEQ ID NO: 114877 - RNA, 46 nt, Mus musculus
auugcugcuuuuguauacacuggacacuuguugucccuuggaccag

SEQ ID NO: 114878 - RNA, 42 nt, Mus musculus
aaguggaggacuggggcaggggaagcucacaugguuuggcaa

SEQ ID NO: 114879 - RNA, 25 nt, Mus musculus
gcuugaagagacaggaggaggggcu

SEQ ID NO: 114880 - RNA, 45 nt, Mus musculus
cacacaccaucugaauccaaugauuuguggcagaaaggccccuac

SEQ ID NO: 114881 - RNA, 45 nt, Mus musculus
gguggacuuccuaaacugggaagucaccgaccacaaccuccacga

SEQ ID NO: 114882 - RNA, 42 nt, Mus musculus
cuguggcuuuuguggagcagggucauguccgcgugggcccag

SEQ ID NO: 114883 - RNA, 46 nt, Mus musculus
ugaguacacuguaucugucuucagacacaccagaagagggcaccag

SEQ ID NO: 114884 - RNA, 46 nt, Mus musculus
guaugagcacuugccugcauguauguguugccuuauauccauggag

SEQ ID NO: 114885 - RNA, 42 nt, Mus musculus
uucccaagaaccauaugguggcucacaaccaucuguaauggg

SEQ ID NO: 114886 - RNA, 46 nt, Mus musculus
ugaauacucuguugcugucuuuagacacaccagaagagggcaucag

SEQ ID NO: 114887 - RNA, 45 nt, Mus musculus
gaagaugacuggacagguauggagaguggggaagaggaaaacaag

SEQ ID NO: 114888 - RNA, 46 nt, Mus musculus
aaauuauuuaauuuuuauuguaugugcauuggugugagguugucag

SEQ ID NO: 114889 - RNA, 46 nt, Mus musculus
gaaaagucuguugccagccaucuuugggcucaugacaacccuauag

SEQ ID NO: 114890 - RNA, 28 nt, Mus musculus
uacaggguucaacaagugccuacacuaa

SEQ ID NO: 114891 - RNA, 45 nt, Mus musculus
gguagcaggugcuugugaucccagcaugcugaaagucgggcacag

SEQ ID NO: 114892 - RNA, 42 nt, Mus musculus
ggcaccugucuauaaucuuagcacuugggagagagaagcaag

SEQ ID NO: 114893 - RNA, 46 nt, Mus musculus
ucaaaucccagcaaccacgugguggcucgcaaccauccguaauggg

SEQ ID NO: 114894 - RNA, 82 nt, Mus musculus
uguagacuacaccauucuggauugcauuuacagugaggugaaucagacauacuauguuuuggaugugaugugcuggcgggga

SEQ ID NO: 114895 - RNA, 42 nt, Mus musculus
guaauugagcccugagugucaugcuuacuuagcacugagcug

SEQ ID NO: 114896 - RNA, 46 nt, Mus musculus
aaaaaaaaaaaaaaaaaaaaaaaaaagaaaaaaaagaaaaagaaaa

SEQ ID NO: 114897 - RNA, 46 nt, Mus musculus
guauggugucuuagguuuauaaucccaguacuuaggaagcugagac

SEQ ID NO: 114898 - RNA, 51 nt, Mus musculus
ggaggcgggagccgauuuguuaggccuguggcuggggcgguauggggaggg

SEQ ID NO: 114899 - RNA, 42 nt, Mus musculus
uaggggcguggagaaggugagcggcucgcucuccccucccag

SEQ ID NO: 114900 - RNA, 42 nt, Mus musculus
gcgcacggaggggcggguccuagucccgccgaucagaggcgg

SEQ ID NO: 114901 - RNA, 41 nt, Mus musculus
gggcgugaagccuguguucccccgccuuagcgggauccggu

SEQ ID NO: 114902 - RNA, 45 nt, Mus musculus
uuucuguuauuuuucacuguguguauggaugugggggugugcacc

SEQ ID NO: 114903 - RNA, 55 nt, Mus musculus
cagcaaccacaugugacuuacagccaucuguaaugggaucugaugcucuauucug

SEQ ID NO: 114904 - RNA, 46 nt, Mus musculus
uaagaaagaaaagcuaccaaccaggccuccuaaucccugcccaaga

SEQ ID NO: 114905 - RNA, 45 nt, Mus musculus
agccggcucagccaggagguugugcuagauguuggcugccccuau

SEQ ID NO: 114906 - RNA, 46 nt, Mus musculus
ggugggacuuguacucucccugucuggggagagacuguggguugag

SEQ ID NO: 114907 - RNA, 46 nt, Mus musculus
ccagccugcuucauucuguggaggagcccaugguacaucugcagcu

SEQ ID NO: 114908 - RNA, 42 nt, Mus musculus
cugagauggucccaguccucugugggcccugcagccugagac

SEQ ID NO: 114909 - RNA, 45 nt, Mus musculus
gugcacugguuuacuuaggguugggaggagagaggcucagggugg

SEQ ID NO: 114910 - RNA, 42 nt, Mus musculus
acagcuauuaaagcauuuggguuguuuuuggagcugggaucu

SEQ ID NO: 114911 - RNA, 46 nt, Mus musculus
ucuguuugcaugcaaaugcucuuggguccgcuccuggguuucauug

SEQ ID NO: 114912 - RNA, 46 nt, Mus musculus
cacagaaggaugccaggccucccagcuccccaccaaugcccgugau

SEQ ID NO: 114913 - RNA, 45 nt, Mus musculus
agauguggcugcccagcugcaggaaagagcaacuccagcccaggc

SEQ ID NO: 114914 - RNA, 45 nt, Mus musculus
gaacagugugcagccugugccacagcccggugccuuccagcgagc

SEQ ID NO: 114915 - RNA, 45 nt, Mus musculus
gaaaagcagggaagcuauggcucguugcucccacugccaccucua

SEQ ID NO: 114916 - RNA, 45 nt, Mus musculus
ccuugccaggaugcaguggcagcccacuauccacugcccccaccg

SEQ ID NO: 114917 - RNA, 45 nt, Mus musculus
agagaagaagaaaggaaagaaggaaaugggaacagcaccagggag

SEQ ID NO: 114918 - RNA, 46 nt, Mus musculus
ggaaguaacagaggacuaagagaaagggagcugggagaagggaaga

SEQ ID NO: 114919 - RNA, 23 nt, Mus musculus
cagucuagagagagaugaggguu

SEQ ID NO: 114920 - RNA, 41 nt, Mus musculus
gucacuuugagaagcuagaagcccuucugagcuggggccag

SEQ ID NO: 114921 - RNA, 46 nt, Mus musculus
ccagcuagggaaaugagcacaaagaaucucacaaugagggaggaac

SEQ ID NO: 114922 - RNA, 46 nt, Mus musculus
cuaccaaugcacagaaaacacuucuugugcagugcaaaguucccag

SEQ ID NO: 114923 - RNA, 46 nt, Mus musculus
ccacacagaagauguggcuuaagcccccugucccacuggcccccag

SEQ ID NO: 114924 - RNA, 45 nt, Mus musculus
aaaauaaauaaaucuuuaaaaaaaaaagaaagaaagaaagaaaag

SEQ ID NO: 114925 - RNA, 46 nt, Mus musculus
acauagauuaacggcccuacuggcauagcgauacuuggcucuguug

SEQ ID NO: 114926 - RNA, 42 nt, Mus musculus
guaaaugggccgaaaccagcagacguaggagcaaggugugaa

SEQ ID NO: 114927 - RNA, 46 nt, Mus musculus
auauguggacauacaugcauaaaugcaaacacagagagagagagag

SEQ ID NO: 114928 - RNA, 45 nt, Mus musculus
uguauguguauguguauguguauguguauguguguauguguaugu

SEQ ID NO: 114929 - RNA, 48 nt, Mus musculus
aucugauggccaaugagcugaggcaggauuagaaggugggacaucugg

SEQ ID NO: 114930 - RNA, 42 nt, Mus musculus
aauaaugggucacaaaacacuggaaaaggugucgccuggcag

SEQ ID NO: 114931 - RNA, 42 nt, Mus musculus
uggcuaaaaccacagcagguggcucccacauauuggccccag

SEQ ID NO: 114932 - RNA, 64 nt, Mus musculus
accguguucucuuguaaccugggagagaaguuugaugaaacgacagcugauggcagaaaaacug

SEQ ID NO: 114933 - RNA, 58 nt, Mus musculus
ccugguccagcaccagcaaugggacgggaaggagagcacgauaacaagaaaacugaag

SEQ ID NO: 114934 - RNA, 68 nt, Mus musculus
caaugagggcuuccucgucauccuggacaggaguuagcugccagagugaauaugcucaauucagugag

SEQ ID NO: 114935 - RNA, 44 nt, Mus musculus
gagaaaggcgggaggcuggaaggaaggagauuaagugaggagga

SEQ ID NO: 114936 - RNA, 41 nt, Mus musculus
aaucuuaauucuuguagauuucacagggagaagcaggcucu

SEQ ID NO: 114937 - RNA, 46 nt, Mus musculus
gauaggauagcauuaaaggaugagaugguugcuggagucccgggag

SEQ ID NO: 114938 - RNA, 44 nt, Mus musculus
uccuucacucaggcugugcuggggguauggugagaggcagagag

SEQ ID NO: 114939 - RNA, 42 nt, Mus musculus
uaagcuuuugagaaguauugauggaugagagguguccuggug

SEQ ID NO: 114940 - RNA, 29 nt, Mus musculus
cuuggcagcaucacaagaaggaagauggg

SEQ ID NO: 114941 - RNA, 45 nt, Mus musculus
auccaggcuucuagggcucugcagagguggaguccucaugugcag

SEQ ID NO: 114942 - RNA, 46 nt, Mus musculus
caaaaaaacagggaugguggcacaugccuguaaucccagcacccgg

SEQ ID NO: 114943 - RNA, 41 nt, Mus musculus
ccuggaaacugaccaagagaagaggcgcucagccugggcca

SEQ ID NO: 114944 - RNA, 38 nt, Mus musculus
aggacacuaaaaggggccaaacuuagaugguccuaaga

SEQ ID NO: 114945 - RNA, 46 nt, Mus musculus
gccugaguuccaguugcugauuggagaugaugccacagcacagcug

SEQ ID NO: 114946 - RNA, 42 nt, Mus musculus
ccagcuguggauggggacacacccccggggagaugccaagau

SEQ ID NO: 114947 - RNA, 46 nt, Mus musculus
gcugugauggacauuuuuugcacacacuaacaauaucuacacacag

SEQ ID NO: 114948 - RNA, 48 nt, Mus musculus
ucagaggucacugggccuuuccuuucugggauccaucucuccagcaga

SEQ ID NO: 114949 - RNA, 41 nt, Mus musculus
ucugauuaauuuuccacaugcauauuuucuguucugggaca

SEQ ID NO: 114950 - RNA, 46 nt, Mus musculus
uuuccuggucuuggucacagagcagauaucaauguucuuucugggc

SEQ ID NO: 114951 - RNA, 42 nt, Mus musculus
gccagguggggcggagacaggcagcccgaccucugcccccag

SEQ ID NO: 114952 - RNA, 42 nt, Mus musculus
ucaggggugcaaaaauagugaaaaggaaucccuaugacccgg

SEQ ID NO: 114953 - RNA, 41 nt, Mus musculus
gacucuggacccgugugggcugcccgccggcgccuggccca

SEQ ID NO: 114954 - RNA, 45 nt, Mus musculus
uaggauccagggccagaacaucacaggcaagcuuaaaacugguag

SEQ ID NO: 114955 - RNA, 46 nt, Mus musculus
agcaagaagcacaagaggcuggcuacgugggagaacugcgucuuca

SEQ ID NO: 114956 - RNA, 41 nt, Mus musculus
aauaaggacaaugaugccaguuucaggagacaguugugagg

SEQ ID NO: 114957 - RNA, 46 nt, Mus musculus
cauggaaccgauguguuugugugggucuugguaggaguuugcuaag

SEQ ID NO: 114958 - RNA, 46 nt, Mus musculus
ggcccuccuuaaaguguuguuauagcuaaaucaaaagcuggagaag

SEQ ID NO: 114959 - RNA, 46 nt, Mus musculus
accagccacuugcuccaaaaucuauucuucaguugccagagacaga

SEQ ID NO: 114960 - RNA, 46 nt, Mus musculus
uucuaaacagaacaaaaacaucuuuuguauccauaugggaagugag

SEQ ID NO: 114961 - RNA, 46 nt, Mus musculus
acuuccuuccuaauguauacaaaugugaagcagucauuguauggag

SEQ ID NO: 114962 - RNA, 46 nt, Mus musculus
aagaagcggcaagggcugcuuaaggaauagaaaagcccagggaugg

SEQ ID NO: 114963 - RNA, 48 nt, Mus musculus
gcucaaugaagcaguguggagagagagagagagagagagagagagaga

SEQ ID NO: 114964 - RNA, 46 nt, Mus musculus
aggaauuuuaagcucggugaaguagacauagguauauagggcauaa

SEQ ID NO: 114965 - RNA, 43 nt, Mus musculus
ccaauguccucugguguccagucagggacacccaucaccaacg

SEQ ID NO: 114966 - RNA, 46 nt, Mus musculus
aaguuuaagcugauugguagaggucagagguuugguaagccaggua

SEQ ID NO: 114967 - RNA, 83 nt, Mus musculus
ggaccacaccugaggacuauccuaaagaucugaacaguggagacagaaugaagagagcuugcuuggacagcuuuauguagcag

SEQ ID NO: 114968 - RNA, 69 nt, Mus musculus
ugaagggugaguaguucauugaguuaaaacagguauuguccaggucuggauaaaaggggagagggcaau

SEQ ID NO: 114969 - RNA, 46 nt, Mus musculus
aaggucuggagcacuuugccuuacuuucugggccucacugcugcag

SEQ ID NO: 114970 - RNA, 24 nt, Mus musculus
ccuguguggaagaaggcagggguu

SEQ ID NO: 114971 - RNA, 45 nt, Mus musculus
uaagggaaaggcaggaaaggcagggagcagaaagauacccgccua

SEQ ID NO: 114972 - RNA, 63 nt, Mus musculus
gaauccagaauggaccccacaagaauguucuucacuugucugcccaaccucuuccucuugccu

SEQ ID NO: 114973 - RNA, 66 nt, Mus musculus
ucuguucucccaccaccuccgcucucccuccuuauccucaccaacaagaauccaagaacacuccag

SEQ ID NO: 114974 - RNA, 45 nt, Mus musculus
gaugccccaauccugaguaugacaagccuugccacacccccacac

SEQ ID NO: 114975 - RNA, 51 nt, Mus musculus
cugccuugccaagcuuuuuaucugcuucucauuauccucgcccucugccug

SEQ ID NO: 114976 - RNA, 45 nt, Mus musculus
gcccuggagggggcgggucuuaguuggcuccacccucgcccauca

SEQ ID NO: 114977 - RNA, 46 nt, Mus musculus
ggcccugaggcuugagguucaggauccccaguggggcagcucaaag

SEQ ID NO: 114978 - RNA, 47 nt, Mus musculus
gaugaaggcuaagaaacugacaccggucucuaugaccugccccaguu

SEQ ID NO: 114979 - RNA, 89 nt, Mus musculus
aggcuucguagaaagcgcuuuagaggauggcagggaggcacaggagagaagagacagggauaugacagggagacugguguugugggaag

SEQ ID NO: 114980 - RNA, 46 nt, Mus musculus
uaauucuuaccccaugcacagaauggguuaguuauuuuccccuugu

SEQ ID NO: 114981 - RNA, 45 nt, Mus musculus
gaccauaugacccagaagaucugaugguacuugaggagucagugg

SEQ ID NO: 114982 - RNA, 42 nt, Mus musculus
agcuccagggaaaaggaugguguccuuaagaaacagcagcuu

SEQ ID NO: 114983 - RNA, 44 nt, Mus musculus
gaauagaggaaugaaaggaugaaaggaggaauggaaugauggaa

SEQ ID NO: 114984 - RNA, 49 nt, Mus musculus
guuugguagcauguauaguuaggagugugugugugugugugugugugug

SEQ ID NO: 114985 - RNA, 45 nt, Mus musculus
ucucccuggggacagcuauuauccucuagcucuguacagccaggu

SEQ ID NO: 114986 - RNA, 42 nt, Mus musculus
uagaagaccuugacacucaguaugaucgcaucacgaagccug

SEQ ID NO: 114987 - RNA, 45 nt, Mus musculus
gugaucagaaauccagagucauccucagcuauacugugaacuaga

SEQ ID NO: 114988 - RNA, 42 nt, Mus musculus
guauucucuagcuuugacaccccucuccuugcucagggagau

SEQ ID NO: 114989 - RNA, 45 nt, Mus musculus
ucugcauuagcauccucuuuugguucugcaucaggguuuggaggg

SEQ ID NO: 114990 - RNA, 42 nt, Mus musculus
ggcaaaggccuaggggggaguaaggagcaugaggauggaggg

SEQ ID NO: 114991 - RNA, 45 nt, Mus musculus
ugagugcugcuguuccuugugacccuccgggucuguucuggggcc

SEQ ID NO: 114992 - RNA, 46 nt, Mus musculus
aagcaggugccuucaucuaucccagcagcucagccaaaccccaguu

SEQ ID NO: 114993 - RNA, 45 nt, Mus musculus
cuuugugcugcaacugcaucacuuuuauggaguguagacauuggc

SEQ ID NO: 114994 - RNA, 42 nt, Mus musculus
gccugcugagagccugcaggacugggcacuaugggccaaaau

SEQ ID NO: 114995 - RNA, 42 nt, Mus musculus
uccaggcacagccaccugccuucuccuggucagccuggauua

SEQ ID NO: 114996 - RNA, 45 nt, Mus musculus
cagcuacaguguacuuagacauaauaauaaauaaagcuaggaagg

SEQ ID NO: 114997 - RNA, 45 nt, Mus musculus
aggggagagguuacuuuacuaacaguucuugcuuugaugcccaga

SEQ ID NO: 114998 - RNA, 46 nt, Mus musculus
cuaucccuguccuccuuugcccugggcugggagaggcuugggaguu

SEQ ID NO: 114999 - RNA, 47 nt, Mus musculus
gcaucucccuguccucaagcuuugaucagucauuaauaugcccagaa

SEQ ID NO: 115000 - RNA, 106 nt, Mus musculus
aguucauuuaaaucuccuaguuuuaagcugcaaguccuaguauuuauuacugguaaaaaccaaauguuggcaguucugagaaaugaggaaaauucuagugagcucc

SEQ ID NO: 115001 - RNA, 62 nt, Mus musculus
uuugccagacaaacauguccucauuuggaaaucauggcuucaucauacaguuuuaaggagaa

SEQ ID NO: 115002 - RNA, 45 nt, Mus musculus
uaacuugaauugcauaagcuucuguucuuccuauaagccucacac

SEQ ID NO: 115003 - RNA, 46 nt, Mus musculus
ucaccaucauuuccacuccagcagccucgcuucuccagcccgcagu

SEQ ID NO: 115004 - RNA, 47 nt, Mus musculus
aaauggugcuguaguacuguaauugauaguuuuauuacuagauugga

SEQ ID NO: 115005 - RNA, 46 nt, Mus musculus
auauuuucucuacuuuaauagguucuuuaugugaauacccccaguu

SEQ ID NO: 115006 - RNA, 51 nt, Mus musculus
aaggaggggaaugagaccaaaaaugaugaugcccuuugacucucagccacc

SEQ ID NO: 115007 - RNA, 64 nt, Mus musculus
aacucucaagauaucacaccaguggacaauuccauggauagcaauauccaucaaaggcggaauu

SEQ ID NO: 115008 - RNA, 91 nt, Mus musculus
ccuauggauccaucacgagagacuagaguugaagccuauugacaagucuccagauccuaacccugucaugacugauacuccaaucccucga

SEQ ID NO: 115009 - RNA, 63 nt, Mus musculus
gugcaaaucagugaauggcucccauaaguacaagggcaauugcaaagaugugaagccuccaga

SEQ ID NO: 115010 - RNA, 47 nt, Mus musculus
ggucauugcugucuuuuguacccggcgcaccaccucucaccagaaga

SEQ ID NO: 115011 - RNA, 46 nt, Mus musculus
gucuacuuagaugucuguaaaaaucauagaaucaaaguugggaggu

SEQ ID NO: 115012 - RNA, 46 nt, Mus musculus
uccuuggguuuugcaugaugugaucuacagacauauaugggcaaaa

SEQ ID NO: 115013 - RNA, 26 nt, Mus musculus
ucagaugacaguguaagcaaccagaa

SEQ ID NO: 115014 - RNA, 41 nt, Mus musculus
uuucuggcuaguaacuuggaauugaggaauaucuuuaugga

SEQ ID NO: 115015 - RNA, 46 nt, Mus musculus
aguccauguuuauagcccuugggauaucugaaaagcugagggaguc

SEQ ID NO: 115016 - RNA, 45 nt, Mus musculus
ugagauccugaugcccucuucuggugcaucugaagacagcuacag

SEQ ID NO: 115017 - RNA, 46 nt, Mus musculus
guaaagacuuccaaagaauuccucuccuacccacuggccaccaaau

SEQ ID NO: 115018 - RNA, 42 nt, Mus musculus
guuauugaaccaguugugggaaacagacugacucaccagauu

SEQ ID NO: 115019 - RNA, 42 nt, Mus musculus
uagucuguauagacugugcuuuucuacuuacaagccccacca

SEQ ID NO: 115020 - RNA, 45 nt, Mus musculus
caucauagugaauuggcagccucccucugaagcuaacggcaagau

SEQ ID NO: 115021 - RNA, 46 nt, Mus musculus
ggauuaccugggcagacaacucccugcccaaacaccagaagauuac

SEQ ID NO: 115022 - RNA, 46 nt, Mus musculus
gguuuugucagugccucauauuagacacacagaacgauauccagug

SEQ ID NO: 115023 - RNA, 46 nt, Mus musculus
acucguguuccugaagugcccagcucucuucauguccguccgcucg

SEQ ID NO: 115024 - RNA, 46 nt, Mus musculus
aggugguuauguguaguuaguuccuuuaacaaugauggugccagau

SEQ ID NO: 115025 - RNA, 41 nt, Mus musculus
uacauuaggaacuuugguuauguaacuguuucaccaacaga

SEQ ID NO: 115026 - RNA, 46 nt, Mus musculus
ggauauugauguuucaagucacuccuacaccauuaauggacugaag

SEQ ID NO: 115027 - RNA, 46 nt, Mus musculus
uauaggaaauuaagugaugaugguaucuguuuuguuguaccaagau

SEQ ID NO: 115028 - RNA, 46 nt, Mus musculus
acaaauuguacuacauggaaaaaggaacugauaaagaacagguaug

SEQ ID NO: 115029 - RNA, 47 nt, Mus musculus
cuggcccagcaccuaauauccgugcuuaugcaacgucaccuacuucu

SEQ ID NO: 115030 - RNA, 43 nt, Mus musculus
aagggaggcaccauaauugagagauucuagacaaagauucaga

SEQ ID NO: 115031 - RNA, 46 nt, Mus musculus
ugguagugaugaugcugaagccaugagucagcucuaggcaagaaca

SEQ ID NO: 115032 - RNA, 46 nt, Mus musculus
gaaagaauucacgaacuuugccucguggguggaauaagggcaagga

SEQ ID NO: 115033 - RNA, 42 nt, Mus musculus
auacaguuucagcaauguaauacuuaggaucagaaggcagau

SEQ ID NO: 115034 - RNA, 45 nt, Mus musculus
uugagcaauugugcccccuguuuguagccagcaguauuuugagag

SEQ ID NO: 115035 - RNA, 41 nt, Mus musculus
ggagacaaucucaccuacucuguguucuacaccaaggaagg

SEQ ID NO: 115036 - RNA, 45 nt, Mus musculus
cuccugagaaguugaggagagggagacagagaaaggguuuaggag

SEQ ID NO: 115037 - RNA, 39 nt, Mus musculus
uuguuuaauacaaaauggaauuuaugauguccugguuau

SEQ ID NO: 115038 - RNA, 46 nt, Mus musculus
uccugcugcccaggguggguaagggcacccuuagucagagcuagau

SEQ ID NO: 115039 - RNA, 61 nt, Mus musculus
caccuacucaaaucuacacccuuucuccaccccuccccccaucagaaaacaaacaggcauc

SEQ ID NO: 115040 - RNA, 45 nt, Mus musculus
cauugcuuuuguugcuuauucuguuaucuucucuuagcccucuac

SEQ ID NO: 115041 - RNA, 53 nt, Mus musculus
uuuuccucgugugcaggugacauguuccugccauccaacagcaguuuuaaaua

SEQ ID NO: 115042 - RNA, 46 nt, Mus musculus
ccauuaucaaacuuugucauuuucuuugaugauugucacuucagau

SEQ ID NO: 115043 - RNA, 46 nt, Mus musculus
uuguuaaauguuaaguagcuauuccuacaaagaagguagaaccaga

SEQ ID NO: 115044 - RNA, 45 nt, Mus musculus
ugugaagucacugggaagccaacuccaacugugaagugggucaag

SEQ ID NO: 115045 - RNA, 46 nt, Mus musculus
uccuaccuggcuccauaaauuccccuuggcucccccugucccaggu

SEQ ID NO: 115046 - RNA, 46 nt, Mus musculus
gggaagcuuucucuggaaauggugugugugugugugucugugugug

SEQ ID NO: 115047 - RNA, 46 nt, Mus musculus
aaaugcuuuaaauugggaucuguaggaugucuacuugucagcuaaa

SEQ ID NO: 115048 - RNA, 45 nt, Mus musculus
acuagcauaaaaacauugaauccuugacacacauuuugggggaag

SEQ ID NO: 115049 - RNA, 40 nt, Mus musculus
uucuuucuguaauuaaauuuugcuuugguuacccccuuca

SEQ ID NO: 115050 - RNA, 100 nt, Mus musculus
uucuuggaugccuccacguuuccaucuuauccuggagauacccccaccuccucacuucugucaguugcagauuuccauucauuuucauggccaucuaguc

SEQ ID NO: 115051 - RNA, 45 nt, Mus musculus
aagacagcuacaguguacuuacauauaauaaauaaaaaccuaaca

SEQ ID NO: 115052 - RNA, 44 nt, Mus musculus
uggaacucacucuguagaccaggcuggccucaaacucaaggauc

SEQ ID NO: 115053 - RNA, 46 nt, Mus musculus
uuuaaaaaaucucagaagcacuuuuaaaagaaacuaggcacaaaga

SEQ ID NO: 115054 - RNA, 24 nt, Mus musculus
ugcgcccaguacacacccugggag

SEQ ID NO: 115055 - RNA, 46 nt, Mus musculus
guguugccauguguugucucagggcuuccugcuccaguuguuagau

SEQ ID NO: 115056 - RNA, 46 nt, Mus musculus
uuugaauguuaagucacuuuaacuuuccaauuuuggcggggggauu

SEQ ID NO: 115057 - RNA, 45 nt, Mus musculus
gauguuagcagaacagagcuucuuaacucaagucaaccagggagu

SEQ ID NO: 115058 - RNA, 46 nt, Mus musculus
uuaagaagucuaauuuauagaaaagggacugcguuuucaguuagau

SEQ ID NO: 115059 - RNA, 46 nt, Mus musculus
uacuacuacuuuacuagaucaacauuauuuuuaacugcauucuaag

SEQ ID NO: 115060 - RNA, 53 nt, Mus musculus
gacauagacucagucuaauguggaaagcaaguuggcaguugggaggaguuaau

SEQ ID NO: 115061 - RNA, 46 nt, Mus musculus
acuugggaggguccaugacagcuagucucuuacaucagcagagaag

SEQ ID NO: 115062 - RNA, 81 nt, Mus musculus
auggccaccagccuagcuccagguuuagugagagacucagagauaaucagggaaauuaggcagagauugauagaacaggac

SEQ ID NO: 115063 - RNA, 46 nt, Mus musculus
gaucuucuuccuuuuauaaaauuuacuuguguguauaccuguguac

SEQ ID NO: 115064 - RNA, 46 nt, Mus musculus
uggagauagauagguaagaugaaauggauguguucucuguguuuag

SEQ ID NO: 115065 - RNA, 45 nt, Mus musculus
ugggcuuccuaucccagucagccaagggggagggaagggagagag

SEQ ID NO: 115066 - RNA, 46 nt, Mus musculus
gggaacacugucaagugaaauaugauuguaaaauggaggccaaauu

SEQ ID NO: 115067 - RNA, 46 nt, Mus musculus
uuggugaguauggauacaauacuacagugcacccauaccaggagaa

SEQ ID NO: 115068 - RNA, 41 nt, Mus musculus
ggcaacugugugugugugugugugugugugugucuugaauu

SEQ ID NO: 115069 - RNA, 51 nt, Mus musculus
gaagaggaaaaagcaaaugagauuaugguagaaggugguuagcagugggga

SEQ ID NO: 115070 - RNA, 26 nt, Mus musculus
ggcgcugcuguccgccaccgccgcug

SEQ ID NO: 115071 - RNA, 42 nt, Mus musculus
gaauguacugauucuccucugcucuccuccccgccccgcugc

SEQ ID NO: 115072 - RNA, 46 nt, Mus musculus
ugcugaacccuggccuacccagcaccacauagaaguccaggccgua

SEQ ID NO: 115073 - RNA, 43 nt, Mus musculus
caugagguucuccuuuuccccuugaucuugcgccaugguggag

SEQ ID NO: 115074 - RNA, 42 nt, Mus musculus
uuacuguuuccaaagauccucaaaagagaagaugagcugcag

SEQ ID NO: 115075 - RNA, 44 nt, Mus musculus
uauucuuggagaagacuggguugccuuugauucuauugcuuuca

SEQ ID NO: 115076 - RNA, 29 nt, Mus musculus
aaaacaaaaaagcuguaaaugucuuuuca

SEQ ID NO: 115077 - RNA, 34 nt, Mus musculus
aacaccaacaaaauagugaaggagaaaaaaaaug

SEQ ID NO: 115078 - RNA, 41 nt, Mus musculus
acacacacgcacacacacacuugaccaaucugauuaaggag

SEQ ID NO: 115079 - RNA, 44 nt, Mus musculus
aggccagcugugugaaaaauauuacaguuccugaaaaugaggau

SEQ ID NO: 115080 - RNA, 47 nt, Mus musculus
aguucugaaaagagucauuaagucaccuagugagcacuaguaagcag

SEQ ID NO: 115081 - RNA, 46 nt, Mus musculus
uggcggucuggggccaucugugguaaugauacuuagaagcagggau

SEQ ID NO: 115082 - RNA, 47 nt, Mus musculus
uaagucccaguggcucccaauggcuggaaacuguuggaggaggagga

SEQ ID NO: 115083 - RNA, 41 nt, Mus musculus
gaugugcagagguggcugauguguagugcgggugggucaug

SEQ ID NO: 115084 - RNA, 42 nt, Mus musculus
cccagaaaccacaugguggcucacaaccaucuguaacaggau

SEQ ID NO: 115085 - RNA, 45 nt, Mus musculus
uguucagggggauguuuuuuaggugaauauaugcuauuauuagag

SEQ ID NO: 115086 - RNA, 37 nt, Mus musculus
uuuucuuuuugagacaaggucucacugugaagccccu

SEQ ID NO: 115087 - RNA, 49 nt, Mus musculus
ggagaagaagguaaagucagguguagcguugcaggcguucugcgagacu

SEQ ID NO: 115088 - RNA, 45 nt, Mus musculus
aaggcucggggaguugcaaaaaccagggcugaggcacagcuggca

SEQ ID NO: 115089 - RNA, 45 nt, Mus musculus
uguaaugcaggucuuuuccccaagagguuuaaguaggaauuagug

SEQ ID NO: 115090 - RNA, 44 nt, Mus musculus
guuaaccugggcaauacuuugucucacaaaacaaaauagcaaaa

SEQ ID NO: 115091 - RNA, 25 nt, Mus musculus
gcaggcugcuggggaaagugggaac

SEQ ID NO: 115092 - RNA, 48 nt, Mus musculus
uccgucgucacagcugaauguaaugaauuuccuaauuuggagucggua

SEQ ID NO: 115093 - RNA, 43 nt, Mus musculus
gcugagggcacgguaagucugaccccagcaggagucuagggag

SEQ ID NO: 115094 - RNA, 45 nt, Mus musculus
uggaggauagcuauuuuggagaacauucauacauuguauuuuggg

SEQ ID NO: 115095 - RNA, 51 nt, Mus musculus
uuccucgauucccucaccggggcguacugcuggauacaucucgccauuacc

SEQ ID NO: 115096 - RNA, 45 nt, Mus musculus
ugguggacgacucuuccuucccauaugagagcuucacuuucccag

SEQ ID NO: 115097 - RNA, 45 nt, Mus musculus
uucgggguauccgugugcuggcagaauuugacacuccuggccaca

SEQ ID NO: 115098 - RNA, 46 nt, Mus musculus
ucuuccugccugggcugcuccuaggaaaaauuuaauuuaugcagag

SEQ ID NO: 115099 - RNA, 45 nt, Mus musculus
gcauauugauagacaucuguaaacccaacacuuaggaaaccacaa

SEQ ID NO: 115100 - RNA, 46 nt, Mus musculus
cucuggcacauuuggaccggugaaccccagucucaacagcaccuau

SEQ ID NO: 115101 - RNA, 43 nt, Mus musculus
acaucgucucugauuaugacaagggcuaugugguguggcagga

SEQ ID NO: 115102 - RNA, 51 nt, Mus musculus
aucauacagguguggcgggaagaaaugccaguagaguacauguuggagaug

SEQ ID NO: 115103 - RNA, 46 nt, Mus musculus
aaaugagauggccuuucugaggagaaggccgcacuggaaggauagu

SEQ ID NO: 115104 - RNA, 45 nt, Mus musculus
uucagguacgccugaacagaaggcucuggucauuggaggggaggc

SEQ ID NO: 115105 - RNA, 34 nt, Mus musculus
cgucgcugagagacuguggagcaguaaccugaca

SEQ ID NO: 115106 - RNA, 45 nt, Mus musculus
ggcuggugcuggcacugguguucaauaaagaucuauguggcauuu

SEQ ID NO: 115107 - RNA, 46 nt, Mus musculus
gucaugagccaccauaugguugcugggauuugaauucaggaccuuu

SEQ ID NO: 115108 - RNA, 45 nt, Mus musculus
auggaugguugugagccaccaugugauugcugggauuugagcuca

SEQ ID NO: 115109 - RNA, 51 nt, Mus musculus
aggugggcgaugccaacauuaauacucaggaccccaagauucagaaggaaa

SEQ ID NO: 115110 - RNA, 46 nt, Mus musculus
cccauagaccccauuuguguaacugucagaucauugaagccugcag

SEQ ID NO: 115111 - RNA, 43 nt, Mus musculus
uaaccuugaggcccagucggcgcagccccgcacagcagcgacu

SEQ ID NO: 115112 - RNA, 91 nt, Mus musculus
cuucacuugacugacguccgcucuagguaucgcagcaggaaccgaaguacgcccgaggugagcggggagaaccuaagccaucuguccccag

SEQ ID NO: 115113 - RNA, 110 nt, Mus musculus
uuucccacggucucauucugcucucucuuccaucucaaucugguuccagccucuuaucuuacuauugcuauccucgccacccuguucucgcccugcuccgaugcucgucc

SEQ ID NO: 115114 - RNA, 82 nt, Mus musculus
uagucagaggcuaaggccucugaaauugagauguugcagcaccaagagcucagguuagguaaggagguuggaaggcggagua

SEQ ID NO: 115115 - RNA, 42 nt, Mus musculus
aggaaaggaaaguucuugcagguaguggagaauaaguggggg

SEQ ID NO: 115116 - RNA, 47 nt, Mus musculus
ggaaaauguuagaaauuggcagugagccauaaaugaaagagacagga

SEQ ID NO: 115117 - RNA, 46 nt, Mus musculus
ugugguaaucuccauacuauuaaugaucuaaaacauaggagcaguu

SEQ ID NO: 115118 - RNA, 46 nt, Mus musculus
cgucauuaaaauaaauggcuauagacugggagcauaacuuugagga

SEQ ID NO: 115119 - RNA, 46 nt, Mus musculus
cagaguccccgcugcagcuacucaccccgacauacaucacaaagaa

SEQ ID NO: 115120 - RNA, 42 nt, Mus musculus
ggaagugguggugcacaccuuuaaucccagcacucgggaggc

SEQ ID NO: 115121 - RNA, 46 nt, Mus musculus
aauucuuccauaaguucauuugucaugccaucucaucacagcagua

SEQ ID NO: 115122 - RNA, 46 nt, Mus musculus
uauuauuaguauguauguuucucccuuuaaacugucaccccaacuc

SEQ ID NO: 115123 - RNA, 46 nt, Mus musculus
guguguguguguguguguguguguguguguguaauugcaauucuag

SEQ ID NO: 115124 - RNA, 46 nt, Mus musculus
aaguagcauguagcaacaggccuaauuauauaaugucaaaagagua

SEQ ID NO: 115125 - RNA, 42 nt, Mus musculus
acuaggguuaaucaaaggaaaccugucugucugccuccugau

SEQ ID NO: 115126 - RNA, 46 nt, Mus musculus
ugacaauucaaagugucuuucucauuuacuaauuuaagaacaagau

SEQ ID NO: 115127 - RNA, 46 nt, Mus musculus
caggcucaaagcuuaaaaaccaucuacauuuuuagccccuccccca

SEQ ID NO: 115128 - RNA, 46 nt, Mus musculus
cacaggagcgaugaguggugugaauagacaagaagcugagggaguu

SEQ ID NO: 115129 - RNA, 45 nt, Mus musculus
ccgccgaagaggaaggggcugugguggccaccgcggcgcagccag

SEQ ID NO: 115130 - RNA, 41 nt, Mus musculus
agccuagcaaucgccggaguaccgccgggauuccaccccca

SEQ ID NO: 115131 - RNA, 45 nt, Mus musculus
uuggguuuuaauaugaauuacguugguguguauugucauccauga

SEQ ID NO: 115132 - RNA, 45 nt, Mus musculus
ucaguuugccucauucuuagaagucucaucaaaauucuccaccag

SEQ ID NO: 115133 - RNA, 46 nt, Mus musculus
gccuugucucagcguggccuguaauggugaagguguucgcugccag

SEQ ID NO: 115134 - RNA, 46 nt, Mus musculus
uguuaaaauggaucacuguuccuugguuuguaaacguguucaccuc

SEQ ID NO: 115135 - RNA, 41 nt, Mus musculus
ugcgagcaguuccuuucccaccaaugcgcacuugugccugc

SEQ ID NO: 115136 - RNA, 46 nt, Mus musculus
uauagcuaucagguuuuuaguguuucuaguauauuccuuccuguag

SEQ ID NO: 115137 - RNA, 46 nt, Mus musculus
ucuuuugcauuuagaauggaaccccagacuacaaagcacuguguaa

SEQ ID NO: 115138 - RNA, 45 nt, Mus musculus
ugccuacaagccgaauccugauggcggccugauuuuuguccugag

SEQ ID NO: 115139 - RNA, 47 nt, Mus musculus
auacuguccuuucugaugggacaagauccaauaugaauguaagugau

SEQ ID NO: 115140 - RNA, 42 nt, Mus musculus
ucagauucuguacuccacagcugaggguauaaaaaggcagaa

SEQ ID NO: 115141 - RNA, 46 nt, Mus musculus
auuuccagcacccacauggcagcucacaacugucuguaacuucaag

SEQ ID NO: 115142 - RNA, 83 nt, Mus musculus
aguuguaggguuccauaugguauuccaaagggcuuucaguguuaguuuuuaauucccauauucucuuuuuuacccuggccucu

SEQ ID NO: 115143 - RNA, 47 nt, Mus musculus
cuuguuaacuaacuccuuacaacauuauauucuguuugcccuuacuu

SEQ ID NO: 115144 - RNA, 45 nt, Mus musculus
cuaaaugaaacauaugugucuaaaucuuaaaaguaguauccccau

SEQ ID NO: 115145 - RNA, 46 nt, Mus musculus
aaauugaagaccaagggaagggacguuagggggauggaacggggag

SEQ ID NO: 115146 - RNA, 46 nt, Mus musculus
uucuucuggaaaaacagcaaguuuucuuaaaugaucuuuccagccc

SEQ ID NO: 115147 - RNA, 45 nt, Mus musculus
uuucucuuauuuuaaaauuucuucauauguaacuguagccccaug

SEQ ID NO: 115148 - RNA, 41 nt, Mus musculus
gagagaguaguagaggcagagaaaggcagacaaaaggagag

SEQ ID NO: 115149 - RNA, 47 nt, Mus musculus
ugcauucuggaggguccuccaaacuccuuccuguguuugccuguuua

SEQ ID NO: 115150 - RNA, 46 nt, Mus musculus
acauauacacauccacucacacacccugcacacauacacagcaaau

SEQ ID NO: 115151 - RNA, 46 nt, Mus musculus
acauauacacauucacucacacacccugcacacauacacagcaaau

SEQ ID NO: 115152 - RNA, 42 nt, Mus musculus
auuauuuccuucuauauaucuagauuuuucaguagccccaac

SEQ ID NO: 115153 - RNA, 26 nt, Mus musculus
acagaacaagcuccagcacagccaau

SEQ ID NO: 115154 - RNA, 46 nt, Mus musculus
cuucaccuuuauuugugacagagcuucacuguguaacucugaccag

SEQ ID NO: 115155 - RNA, 46 nt, Mus musculus
aucuaugcaaugaaauaugauuacaucuacccuuuuucccccccuc

SEQ ID NO: 115156 - RNA, 46 nt, Mus musculus
gaacugugaaacuauuaaagcagauuuguguuuucaaggacagcag

SEQ ID NO: 115157 - RNA, 45 nt, Mus musculus
gcuuaccauuccagaaggguaagagaguccaucaugguagggaag

SEQ ID NO: 115158 - RNA, 46 nt, Mus musculus
aggugaaauuauauacucacuaaagaagcuagagcuauuccuggag

SEQ ID NO: 115159 - RNA, 45 nt, Mus musculus
auacauauacauauacauaaauacaguuuuaaaaagggauaguag

SEQ ID NO: 115160 - RNA, 46 nt, Mus musculus
ccaacacccaguccaccagaggagcuuagagauucugcagaggugc

SEQ ID NO: 115161 - RNA, 46 nt, Mus musculus
aaugguauaagaaaauguguaauguauguauauuuccuugucggaa

SEQ ID NO: 115162 - RNA, 47 nt, Mus musculus; identical to SEQ ID NO: 115149

SEQ ID NO: 115163 - RNA, 45 nt, Mus musculus
uaauccuguagagacuuguagcccuaggauagaggaugccuggga

SEQ ID NO: 115164 - RNA, 46 nt, Mus musculus
cccgaaaaaacccaagaacaccccuuucugaucuucaaggcaugaa

SEQ ID NO: 115165 - RNA, 45 nt, Mus musculus
ugugagacaguguaucauauuguauagucugucuuagagcuugcu

SEQ ID NO: 115166 - RNA, 46 nt, Mus musculus
cuugaacuuacagagauccaccugcaucuguuuuccacaugcugag

SEQ ID NO: 115167 - RNA, 46 nt, Mus musculus
ucaggccagcacucuacacugagcaauauucccaguuccagcccuc

SEQ ID NO: 115168 - RNA, 46 nt, Mus musculus
gcgccaccacgcccaguuaucacugugauaauuaaugagcugguag

SEQ ID NO: 115169 - RNA, 67 nt, Mus musculus
cacuuuaugcuguugaucaaauuuucauuuuuucuuucuugccauuuucuuuuauuuuguuugaaac

SEQ ID NO: 115170 - RNA, 45 nt, Mus musculus
guuucaccuaagcuuccaaaugcuaggauuuauagacguguacaa

SEQ ID NO: 115171 - RNA, 45 nt, Mus musculus
cuaauaucaaauaauaucaacuuuuaaccaaaaguuaucaaaaaa

SEQ ID NO: 115172 - RNA, 45 nt, Mus musculus
acaucuucauuugaaggcagcuaggagaagacuggcuuccaggca

SEQ ID NO: 115173 - RNA, 45 nt, Mus musculus
auucuguuuauaauagcaccauaaaauagaauacuuaauaguaaa

SEQ ID NO: 115174 - RNA, 46 nt, Mus musculus
gucuugcucucuaggcagcaguuccuucauuugagacaggcaucua

SEQ ID NO: 115175 - RNA, 46 nt, Mus musculus
agaccaaaccuggaccagccaaagcaucaacacaacucaguggcag

SEQ ID NO: 115176 - RNA, 42 nt, Mus musculus
aucagaaaaaaguaggucgggccaaaagagaaagucggagaa

SEQ ID NO: 115177 - RNA, 46 nt, Mus musculus
gaguaggaaucauaaguuuuuaauuuuaauuuuuauaaaggaccag

SEQ ID NO: 115178 - RNA, 33 nt, Mus musculus
guuaauuaauaaucauugauguuguaggagagu

SEQ ID NO: 115179 - RNA, 42 nt, Mus musculus
gaauacccaagguacaacaucuaaaacacaagaaaaucaaga

SEQ ID NO: 115180 - RNA, 46 nt, Mus musculus
aaaccugcuucccagucggagaucucaucauucuuuccuggcccag

SEQ ID NO: 115181 - RNA, 46 nt, Mus musculus
gaaauuucuucuaccauauuacuuagcccuuuaauucagccucacu

SEQ ID NO: 115182 - RNA, 46 nt, Mus musculus
cuaagaagcuaauuagaauaggauuuuccagagucuccaugcuaag

SEQ ID NO: 115183 - RNA, 23 nt, Mus musculus
agacucucagugagagcuauguc

SEQ ID NO: 115184 - RNA, 46 nt, Mus musculus
gagacgucauuuaucugcauuuaaagguaaggaaucaaacugacaa

SEQ ID NO: 115185 - RNA, 42 nt, Mus musculus
gaauaucugaugaucuuuaaauuauuuuagcuauguguacag

SEQ ID NO: 115186 - RNA, 46 nt, Mus musculus
uccagcuuagauuuuucuaguccauuauucuaggaagucaggagag

SEQ ID NO: 115187 - RNA, 46 nt, Mus musculus
acuuuaaaaaugaaaauaccacuuaaaagugaaauuugggccuaag

SEQ ID NO: 115188 - RNA, 46 nt, Mus musculus
cauauauaucauuaguuauuuuaaguguuuuauuuuauauguugag

SEQ ID NO: 115189 - RNA, 45 nt, Mus musculus
cugaugcccugaaacuggaguuacaaugguuguaagccaccaagu

SEQ ID NO: 115190 - RNA, 46 nt, Mus musculus
ggaugacauugcuuaccuacaaaaaauaacuuuauuuuucugacag

SEQ ID NO: 115191 - RNA, 41 nt, Mus musculus
agagagaaguuuagcccuuagcucccugaaagcagcuggca

SEQ ID NO: 115192 - RNA, 69 nt, Mus musculus
acuacuugaagcuauuuuuguuaauauucuuguuccugaaguuuacuguaaauacacauguauaauaug

SEQ ID NO: 115193 - RNA, 46 nt, Mus musculus
gccauuuugauuauaugaccauucuaggucauacacacaaacggag

SEQ ID NO: 115194 - RNA, 42 nt, Mus musculus
cgucauuugcugccaagccugaugcccugaguucaaccccca

SEQ ID NO: 115195 - RNA, 46 nt, Mus musculus
uaccuuugaucuuuaagauucugagacagccucuuacugcuucaag

SEQ ID NO: 115196 - RNA, 45 nt, Mus musculus
gaaagaaagaaagaaaaaaagaaagaaagaaagaaagagauagag

SEQ ID NO: 115197 - RNA, 42 nt, Mus musculus
ggaccacaaaggcagcugcugucaaucucucccaugcuccag

SEQ ID NO: 115198 - RNA, 46 nt, Mus musculus
aaggcuggugauuuaacauagauccuugggacccacauaaagguag

SEQ ID NO: 115199 - RNA, 46 nt, Mus musculus
aguuuucacuuauuucuaggugucacagauuuaaaagcacaucaag

SEQ ID NO: 115200 - RNA, 41 nt, Mus musculus
gugcccugacgugacccuugucugcgagcagaugggcccca

SEQ ID NO: 115201 - RNA, 53 nt, Mus musculus
agggugggagagggggcagaaacggauaaaagaaagagaaacucaguuuggag

SEQ ID NO: 115202 - RNA, 46 nt, Mus musculus
cccuagguuuuuaaaucauguaaauguuuacuuauccugaguauag

SEQ ID NO: 115203 - RNA, 46 nt, Mus musculus
ucugccugugaagugggauccacagcauguucgacgggugggagaa

SEQ ID NO: 115204 - RNA, 47 nt, Mus musculus
cugagccugugacagcacugucagugcuuggcuugucagacgugagg

SEQ ID NO: 115205 - RNA, 44 nt, Mus musculus
aauaauacauauguaaacuauaucagcaucaaaggagucaggaa

SEQ ID NO: 115206 - RNA, 43 nt, Mus musculus
guauucuuuaauugggcuguaugaccuaaaagaaacagcaggg

SEQ ID NO: 115207 - RNA, 47 nt, Mus musculus
guucagcuuuaagggcaacagccccauacaaguuuccgucagagcag

SEQ ID NO: 115208 - RNA, 46 nt, Mus musculus
agugaggaaccaggaugagaaagguggcuggccaauuauggugacc

SEQ ID NO: 115209 - RNA, 44 nt, Mus musculus
gaucuccuuuuguugucuaguugcucuagcuagaacguccaagu

SEQ ID NO: 115210 - RNA, 46 nt, Mus musculus
aguccauuacuuaaaaagacaaugaaauaaucuuagcaccucaggc

SEQ ID NO: 115211 - RNA, 45 nt, Mus musculus
uaucuacccagugggggccucaaggcuauuucuacccaauccaga

SEQ ID NO: 115212 - RNA, 46 nt, Mus musculus
caacucagcuguugugaggaccacugugaucaacaugcccagagag

SEQ ID NO: 115213 - RNA, 41 nt, Mus musculus
gacgguguguuuauguccuuugaaggcuacaauguggaagu

SEQ ID NO: 115214 - RNA, 101 nt, Mus musculus
uugacugucucauaaacgaugagcacaccauuaaagggagacgagaggggaaugaaguuuuccuuccauucacuuggguagagaaauacuuugauguuuau

SEQ ID NO: 115215 - RNA, 83 nt, Mus musculus
agccaaacagcagucagaagaggcauuuccucaggaacaacagaaggcacccccuguuguugggggcuucaauagcaacgggg

SEQ ID NO: 115216 - RNA, 75 nt, Mus musculus
gaguaguggauucagaguggauggauuagaaaaaagaucagcagcaucugaaaguaaccacuaugccaaccacau

SEQ ID NO: 115217 - RNA, 46 nt, Mus musculus
uauggcuagauuugagucccacuuccaauauagcauacaugcagaa

SEQ ID NO: 115218 - RNA, 46 nt, Mus musculus
uugucuuuaucacaacuuuuauuuauaagcaugaccuuugacagau

SEQ ID NO: 115219 - RNA, 42 nt, Mus musculus
gcacccaauauuucuguuuaauggucaaaaugucuggcaugg

SEQ ID NO: 115220 - RNA, 46 nt, Mus musculus
uguuuuuacaguuaaacuguauuuauaugacaugauuuggggacag

SEQ ID NO: 115221 - RNA, 46 nt, Mus musculus
guaaaaagauguaauauguagaauuuauauucuagagagaccagag

SEQ ID NO: 115222 - RNA, 46 nt, Mus musculus
ugcggaugcuugcagcuaaccgccaaacugagcauggggaugccaa

SEQ ID NO: 115223 - RNA, 45 nt, Mus musculus
uguguguugaguguugcagcugauucuuagcagcaauuuggggug

SEQ ID NO: 115224 - RNA, 45 nt, Mus musculus
uacauagugauuuggaaccagauaauaugauauuguggccuggug

SEQ ID NO: 115225 - RNA, 45 nt, Mus musculus
cuggcuuagacacuaaaaucugaaggggaaaaauaaggauuggga

SEQ ID NO: 115226 - RNA, 45 nt, Mus musculus
caaaagggacucagcacacagauuuuuauguucuuggguacuaga

SEQ ID NO: 115227 - RNA, 46 nt, Mus musculus
caugaucuuuauugcuauugcucccacagauagcugggcugaagau

SEQ ID NO: 115228 - RNA, 45 nt, Mus musculus
uugugagccaccaugugguugcugagauuugaacucagggcauuc

SEQ ID NO: 115229 - RNA, 45 nt, Mus musculus
ccauugcucuuucuuuuugagacaaaucucucacugcccccagag

SEQ ID NO: 115230 - RNA, 46 nt, Mus musculus
ugcuguacacacacacacacacacacacacacacacacagaguuac

SEQ ID NO: 115231 - RNA, 47 nt, Mus musculus
ccacagcaauucuacaaauaauuguuacuguauaaauuagcaaaguc

SEQ ID NO: 115232 - RNA, 85 nt, Mus musculus
aaagagagaaagagaguuagagaguaagaaaggugaaguccuagagagagagagagagagguaaaagcuuagagaguaagaaagc

SEQ ID NO: 115233 - RNA, 42 nt, Mus musculus
uuguuuugcauuuucugaaguuuuauauguauguagucaguc

SEQ ID NO: 115234 - RNA, 46 nt, Mus musculus
aagucuuuccauuaccuaaacaauaugggagguacauggacaagug

SEQ ID NO: 115235 - RNA, 46 nt, Mus musculus
cuggaauaccugacuguugagugaggguuuagaucugaggguaggg

SEQ ID NO: 115236 - RNA, 45 nt, Mus musculus
gagcgagcgaaagagacugcaaagggagggggcaggcgcgggagg

SEQ ID NO: 115237 - RNA, 24 nt, Mus musculus
acuuccccuugcagugggcucgcg

SEQ ID NO: 115238 - RNA, 46 nt, Mus musculus
aaacaccccagcccagacagcaugugguauucguacacauccacua

SEQ ID NO: 115239 - RNA, 46 nt, Mus musculus
gaugcuguacccagagaacagagaugacguacuguccgccccaguc

SEQ ID NO: 115240 - RNA, 42 nt, Mus musculus
ucaccuggaaaaggaagguuggugugagugaaggggucagag

SEQ ID NO: 115241 - RNA, 45 nt, Mus musculus
gaguuuguuuaacuuugguaaguuggaaauggaggugaggccuac

SEQ ID NO: 115242 - RNA, 46 nt, Mus musculus
uaagguucggacauuucucugccaauacuuccagguccccugagau

SEQ ID NO: 115243 - RNA, 115 nt, Mus musculus
cuaccauccucaucuuccucgucgucauccuccacguagcccucaacaucggagucgggggccuccuuguugucccugucauagccaucgagguacaugaccuggggcaggagcu

SEQ ID NO: 115244 - RNA, 44 nt, Mus musculus
ccuccucauccucuuccucuucaucuuccacuagcugggcauau

SEQ ID NO: 115245 - RNA, 45 nt, Mus musculus
agaaaaaaauaaguuucggggggcaggaauaggagggggagggga

SEQ ID NO: 115246 - RNA, 42 nt, Mus musculus
gggcaucauucaagcaucaacaccagguccaguucgggagcu

SEQ ID NO: 115247 - RNA, 42 nt, Mus musculus
uucugcccagagagucugcauuuccacgaguuuggggcagag

SEQ ID NO: 115248 - RNA, 67 nt, Mus musculus
uuguaguagucaaccaaucagcauugucacuauagaauuuguuccagaucccaggcuugagaaaggg

SEQ ID NO: 115249 - RNA, 46 nt, Mus musculus
gaaaucaaaacuccuuucagaaacuagcaaaaccaaagcauggcag

SEQ ID NO: 115250 - RNA, 42 nt, Mus musculus
ucuucuucaacaagaggauggauagauagcuuugcugcccag

SEQ ID NO: 115251 - RNA, 46 nt, Mus musculus
gguguuccacaaugcaaaucuggagugaugguacagacagaauuag

SEQ ID NO: 115252 - RNA, 46 nt, Mus musculus
uucucauauauaaauaaugucuuagaacaguguugguccuggguag

SEQ ID NO: 115253 - RNA, 46 nt, Mus musculus
cgguuccaugcacuagggguagcuuaggcagcauucauuuggcacu

SEQ ID NO: 115254 - RNA, 46 nt, Mus musculus
aucuucuucgcuacacugugucuugguggagaugcacacgagguac

SEQ ID NO: 115255 - RNA, 85 nt, Mus musculus
auugagguguaucaucugagagaagacuugagcaaaccgaagcagaucuuuguggguauuccuguuaccuuucugccucaggugu

SEQ ID NO: 115256 - RNA, 45 nt, Mus musculus
auguugucagcaccuaaaauccguucccgaacuauaaggcccucc

SEQ ID NO: 115257 - RNA, 45 nt, Mus musculus
acacucaguucuguucccauaagcauggaugggugggagaaccuc

SEQ ID NO: 115258 - RNA, 46 nt, Mus musculus
uucaugaugucauaguucucacgaucauuugcaaaggaggcaccca

SEQ ID NO: 115259 - RNA, 42 nt, Mus musculus
auucccagcaaccacaugauggcucacaacaucuguaaugag

SEQ ID NO: 115260 - RNA, 30 nt, Mus musculus
cuuugucccggggggggggggggggggggg

SEQ ID NO: 115261 - RNA, 37 nt, Mus musculus
cauaaaauaaauaaucuuuaaaaaaaaaaaaagaaua

SEQ ID NO: 115262 - RNA, 45 nt, Mus musculus
gaauagaacguaaaguaaauaaaccuguuggauuuugggggcugg

SEQ ID NO: 115263 - RNA, 41 nt, Mus musculus
uuccagcaaccacaugguggcucacaaccauacauaauggg

SEQ ID NO: 115264 - RNA, 46 nt, Mus musculus
gggcuaugcagcaagaccugguuuuggagaccagaaguagcaaaga

SEQ ID NO: 115265 - RNA, 46 nt, Mus musculus
aaugaaggaugagaggauccagggcuugggaggcccgcgcgcgucg

SEQ ID NO: 115266 - RNA, 44 nt, Mus musculus
gccgcguccaccagcacuucagacccgggcccucacagcccauu

SEQ ID NO: 115267 - RNA, 41 nt, Mus musculus
agucccuggcacuguuuggaauggugggggaaguucuggga

SEQ ID NO: 115268 - RNA, 46 nt, Mus musculus
aggaagugguccagugugcaguaaggaggugccugaccagacugag

SEQ ID NO: 115269 - RNA, 46 nt, Mus musculus
guccuggaacuccaucuguagaaccaggcuggccucaaacuuggag

SEQ ID NO: 115270 - RNA, 46 nt, Mus musculus
caccccaccccacaacccccagcaaaaggugccagcauauaugccc

SEQ ID NO: 115271 - RNA, 42 nt, Mus musculus
aucugguacccuagggagggaaugagaauggugugugugggu

SEQ ID NO: 115272 - RNA, 45 nt, Mus musculus
agaaagggagcccuccguguggagggggagaagccauacucucgg

SEQ ID NO: 115273 - RNA, 42 nt, Mus musculus
uucaaggccagcuuggucuacagaguuccaggacagccaggg

SEQ ID NO: 115274 - RNA, 42 nt, Mus musculus
ggguauguuucucccagccucuuguccaacuucacaccccau

SEQ ID NO: 115275 - RNA, 46 nt, Mus musculus
aacuuccaugucuuccagauaccuuguguaacgaacuggaccagga

SEQ ID NO: 115276 - RNA, 45 nt, Mus musculus
cccugaauugccuuuagagcagagauuagaagucucccuugaaau

SEQ ID NO: 115277 - RNA, 45 nt, Mus musculus
ucaagaaucaccccugcauuugcauuugggauccuguuguuagcu

SEQ ID NO: 115278 - RNA, 40 nt, Mus musculus
cagagacaguuaggcacccagaaagagagacaaagggucu

SEQ ID NO: 115279 - RNA, 42 nt, Mus musculus
gcagcccuacucgggauccagcgcccuuaaacccaaccaggu

SEQ ID NO: 115280 - RNA, 46 nt, Mus musculus
gauaauaaauagguugauacuugaacaagauacaagauagauggga

SEQ ID NO: 115281 - RNA, 46 nt, Mus musculus
auaacuugcuuauucugaacacuuagacaguuccuugcuagggcag

SEQ ID NO: 115282 - RNA, 44 nt, Mus musculus
ucuagguaggacccggguuucugauugacugggaugugccuuga

SEQ ID NO: 115283 - RNA, 42 nt, Mus musculus
gaagagcugagggcguccacauucaggauaaugacaggcaaa

SEQ ID NO: 115284 - RNA, 45 nt, Mus musculus
agguuuuaccccuggaccaucgauaacaaguacuauuccgcagag

SEQ ID NO: 115285 - RNA, 42 nt, Mus musculus
ggacaccguugcugucuucaggacacaccagaagagggccuc

SEQ ID NO: 115286 - RNA, 46 nt, Mus musculus
gagcaugccagaccuuuugacacccaagccaaaaauaaacccagag

SEQ ID NO: 115287 - RNA, 46 nt, Mus musculus
gcggauuguacaagcauugaaugccaaugucugguccaaugucgug

SEQ ID NO: 115288 - RNA, 42 nt, Mus musculus
uagcccgggagcucccauagguuucagaacaccaggcaggag

SEQ ID NO: 115289 - RNA, 46 nt, Mus musculus
ccaccuccuccuaggagaagcaagcgauauagccagggaugugcag

SEQ ID NO: 115290 - RNA, 46 nt, Mus musculus
agaacaugaaaagcguguuuuugacuuagugcugaucauugcagag

SEQ ID NO: 115291 - RNA, 46 nt, Mus musculus
cccuggcauuugaaggauagcuaggugcucccuaugacuacagagg

SEQ ID NO: 115292 - RNA, 46 nt, Mus musculus
guagucacaguugcaggaagggagggggcuuauguacuugugugug

SEQ ID NO: 115293 - RNA, 46 nt, Mus musculus
ccuggugucagcauuugugaccuuucuuaaagguuguauaacccag

SEQ ID NO: 115294 - RNA, 55 nt, Mus musculus
cuucggagugcuuggcugugguuagaaugaguggcccugguuaucacagcaugua

SEQ ID NO: 115295 - RNA, 46 nt, Mus musculus
ucaaaucccagcaaccacaugauggcucacagccauccguaaugag

SEQ ID NO: 115296 - RNA, 46 nt, Mus musculus
auuuucacaucuuuucuacuccuugacuuuaauacccuuguuacag

SEQ ID NO: 115297 - RNA, 46 nt, Mus musculus
auaaaaaugauucuuuuucaauacuguuuaucaaggucgucccaag

SEQ ID NO: 115298 - RNA, 41 nt, Mus musculus
agguugacagcauugucgguaagguccuccaugagcuccca

SEQ ID NO: 115299 - RNA, 45 nt, Mus musculus
gacagagcaaugcauggaagggaagggagagggauggacagaugg

SEQ ID NO: 115300 - RNA, 46 nt, Mus musculus
cuguaagaggcucugaugugcgcugugcccuggguauuacagccag

SEQ ID NO: 115301 - RNA, 42 nt, Mus musculus
ccccaagugcuucccuucucaacgggguucucuucugccaag

SEQ ID NO: 115302 - RNA, 77 nt, Mus musculus
ccaccugacugguuuuuggggucccuuaccugagcuuuuagaaaggcguuagggagaaaucuuuguuccugccgcau

SEQ ID NO: 115303 - RNA, 45 nt, Mus musculus
uaagaaccuggguaaaaugaggcucggaaauguguaauacaggag

SEQ ID NO: 115304 - RNA, 72 nt, Mus musculus
ccgccaagagcacagcucugaccuaaggugaaugcuggugacaagaaaggcagcuguagauguaggaugugc

SEQ ID NO: 115305 - RNA, 46 nt, Mus musculus
aguaaguucagugucugaguuccugccacaaagcagcaaaagccag

SEQ ID NO: 115306 - RNA, 49 nt, Mus musculus
uccauacuccagggcccagccccaggggagcacagagcaaaguucuaaa

SEQ ID NO: 115307 - RNA, 51 nt, Mus musculus
ucagggggacuaauacuuuaaugugagugcauucgcuacugguuaagaagg

SEQ ID NO: 115308 - RNA, 27 nt, Mus musculus
uagaaaauauauuaggucacaugauua

SEQ ID NO: 115309 - RNA, 46 nt, Mus musculus
cuuccuuccugucauccagugaaauccacgugugacaagcacugag

SEQ ID NO: 115310 - RNA, 42 nt, Mus musculus
ggucaugaaauccuaugguaacugggccaaacuggucuuaag

SEQ ID NO: 115311 - RNA, 46 nt, Mus musculus
ggaauuuguaugugaugugauagaaucacagggcccgucucaacag

SEQ ID NO: 115312 - RNA, 50 nt, Mus musculus
aagagguuuuacugggagagugagagagacaagguagcagcagaaaagga

SEQ ID NO: 115313 - RNA, 45 nt, Mus musculus
gaugcugggaauauggugucugcugccuuggcaaccagucugcag

SEQ ID NO: 115314 - RNA, 44 nt, Mus musculus
accaucuguaaugggaucugaugcccucuucuggugugcugaag

SEQ ID NO: 115315 - RNA, 45 nt, Mus musculus
auuuuagagcuuuauuguagaaaggcaggggaaaagagagaaagu

SEQ ID NO: 115316 - RNA, 46 nt, Mus musculus
ggugguggcggcacaugccuuuaaucccagcacuuggaaagcagag

SEQ ID NO: 115317 - RNA, 32 nt, Mus musculus
agagagaaagaaaaagugggguucagugguua

SEQ ID NO: 115318 - RNA, 46 nt, Mus musculus
gccaacagguaccuucaggaucugaaccgucacaucucacccaaag

SEQ ID NO: 115319 - RNA, 46 nt, Mus musculus
gcucucccaacagguaaggccaguggccuaauauuuucaccagcag

SEQ ID NO: 115320 - RNA, 42 nt, Mus musculus
gggauacauagugacacuuuuccucagaauaauucugggaag

SEQ ID NO: 115321 - RNA, 42 nt, Mus musculus
agaaugguaauuucuuccuagguuuguggugaagcccuggag

SEQ ID NO: 115322 - RNA, 42 nt, Mus musculus
cagcacucaugggcaagaucuuuaaauguaagugacaugagg

SEQ ID NO: 115323 - RNA, 46 nt, Mus musculus
aggacauccaucugugucuguggaaccagcugucuccuggggugag

SEQ ID NO: 115324 - RNA, 46 nt, Mus musculus
uuagcccuucaauccaugauaaauucucgaggaaggaccgagacac

SEQ ID NO: 115325 - RNA, 46 nt, Mus musculus
ugucacaugccuguaaccccagcacuggggauaggaagaacaacag

SEQ ID NO: 115326 - RNA, 41 nt, Mus musculus
guugagggcuguguuucgauggcgguugggguuacagggga

SEQ ID NO: 115327 - RNA, 46 nt, Mus musculus
auucguagggcaagccagagcgacagaaaagccgacguguaugcac

SEQ ID NO: 115328 - RNA, 83 nt, Mus musculus
ucauguggcgaggauguaucaucaggaguagacuguccaggagaaagaaaacccuugguuaucugaaacauuguaaaauggua

SEQ ID NO: 115329 - RNA, 46 nt, Mus musculus
ccacugcccaauaugaagcaaacucuuauugugauccuugcccuua

SEQ ID NO: 115330 - RNA, 42 nt, Mus musculus
agaagagugaauauguuuaacacauuguuuaaugagacagag

SEQ ID NO: 115331 - RNA, 46 nt, Mus musculus
aagagaaaagagagagaaagaaaagaguauaugaaaaaggcaccaa

SEQ ID NO: 115332 - RNA, 46 nt, Mus musculus
cugcaguggcuccauguuagcaucaagucaaagucgacagcaacag

SEQ ID NO: 115333 - RNA, 45 nt, Mus musculus
ggccacaaccaucuguaaugagaucugaugcccucuucuggauga

SEQ ID NO: 115334 - RNA, 46 nt, Mus musculus
cacacucaugugaauaaaggcaccauuaauuguacucaccguuaaa

SEQ ID NO: 115335 - RNA, 46 nt, Mus musculus
acuccccuucccuuucccaucuaaguuauaugucaugugcauggcg

SEQ ID NO: 115336 - RNA, 46 nt, Mus musculus
cuuaaauaauggugaagggcaaauuuuuacuauugauggcccccug

SEQ ID NO: 115337 - RNA, 46 nt, Mus musculus
uguugaugccauacuuagcugaauuugaaaacuuugaauuguggag

SEQ ID NO: 115338 - RNA, 42 nt, Mus musculus
cacucuccauaugugaccuuacugcccuugauuauacaggag

SEQ ID NO: 115339 - RNA, 42 nt, Mus musculus
uuccagccccccaguuuuguccaggcauuuggucuugcccau

SEQ ID NO: 115340 - RNA, 42 nt, Mus musculus
gaugaggagacugaagcuuugagagacaggaaauggcccaag

SEQ ID NO: 115341 - RNA, 45 nt, Mus musculus
uguggcauugggaacuuaaggcauagcuugucccaucuccaugaa

SEQ ID NO: 115342 - RNA, 24 nt, Mus musculus
gagcaauaacaaaaccagagggaa

SEQ ID NO: 115343 - RNA, 42 nt, Mus musculus
aagaucuuaagaaaugcaaggaagcucccugaaaaaacacag

SEQ ID NO: 115344 - RNA, 46 nt, Mus musculus
ggaaaggaaaggaaaggaaaggaaaggaaaggaaaggaaggcaggc

SEQ ID NO: 115345 - RNA, 46 nt, Mus musculus
ggcuagacucacuguuuuacccccuuggaguuuggcugaauuagau

SEQ ID NO: 115346 - RNA, 46 nt, Mus musculus
ucccauguucuaguugcuguuagcauccccuuuguugcugucugag

SEQ ID NO: 115347 - RNA, 42 nt, Mus musculus
cauuaaacuggcugcuuugacacaccucaucucacccaagag

SEQ ID NO: 115348 - RNA, 49 nt, Mus musculus
ggucagaagggaacagagaugcaggagacaggcaggaucaguuguggua

SEQ ID NO: 115349 - RNA, 46 nt, Mus musculus
cuacuucauuucuagcuaaaucagaacugccuucaacacuggagaa

SEQ ID NO: 115350 - RNA, 46 nt, Mus musculus
ugaggacaaguucauucuuguguauuuaauaacaaagguggcccuc

SEQ ID NO: 115351 - RNA, 45 nt, Mus musculus
gagguugccacccugaacagaagaugaacaguacaaauggccuga

SEQ ID NO: 115352 - RNA, 46 nt, Mus musculus
agguucaguuuuacuuugccauauccagugaagaugaaagucagau

SEQ ID NO: 115353 - RNA, 40 nt, Mus musculus
caaggcccauccauccagagggaaggaaauacuugaagag

SEQ ID NO: 115354 - RNA, 46 nt, Mus musculus
ugcuuucuguucuuccugucccuuccuguacuguaaaugcccgcag

SEQ ID NO: 115355 - RNA, 45 nt, Mus musculus
agagaaacccugccucggggcaaaaaggaaaacauuucaucaguu

SEQ ID NO: 115356 - RNA, 46 nt, Mus musculus
gcuggccuguuuuguuguuuaugacauuuucgugaaaugauaaaau

SEQ ID NO: 115357 - RNA, 45 nt, Mus musculus
uauuuguaugugcaaaugaaugcuaggugcccuuggaggccagag

SEQ ID NO: 115358 - RNA, 42 nt, Mus musculus
gguucuccuggaucuuugucaaccucacagugcgguucuuua

SEQ ID NO: 115359 - RNA, 44 nt, Mus musculus
acagagaaacccugucucgaaaaaaacaaaaacaaaaaaagcuu

SEQ ID NO: 115360 - RNA, 45 nt, Mus musculus
cucacuguaagguuuucaugagacucagucacugugccaauaagg

SEQ ID NO: 115361 - RNA, 46 nt, Mus musculus
cugaucaucacuaaaggaagucaggacuggaacucaagcaggucag

SEQ ID NO: 115362 - RNA, 46 nt, Mus musculus
aguuggagucuuuggaggaggcagcagucagggaggcaccauagac

SEQ ID NO: 115363 - RNA, 60 nt, Mus musculus
gaggaggccagaaaagggcaucaucagaucccuuggaaccagaguuauagugagucacca

SEQ ID NO: 115364 - RNA, 44 nt, Mus musculus
gauagggagagggagagagggacagagggagauggagggagaug

SEQ ID NO: 115365 - RNA, 96 nt, Mus musculus
uggcugcuucugcagaggacccagguuaaaaucccagcacugacaugcaaagugucccagucaggguuacuguugcugugaugaaccaccuugacc

SEQ ID NO: 115366 - RNA, 41 nt, Mus musculus
ucugagcagaacccugcauguuaauaagcaauacgaggggg

SEQ ID NO: 115367 - RNA, 46 nt, Mus musculus
ccuucauuacacacacaaagugggaaaaaggaacagacagagagag

SEQ ID NO: 115368 - RNA, 46 nt, Mus musculus
gauaagcagggcguaugagcacaugcuauucuuuccacacagaggu

SEQ ID NO: 115369 - RNA, 46 nt, Mus musculus
ucuucuagcagaaaaaaagaacagauaauaaugaauguccaagaug

SEQ ID NO: 115370 - RNA, 48 nt, Mus musculus
ggggcucacugcuguugauaaaacuguucugaaaaacuguaaggagag

SEQ ID NO: 115371 - RNA, 42 nt, Mus musculus
auuauagcaaaagaaacucagcugagccugaagcaagaaggu

SEQ ID NO: 115372 - RNA, 42 nt, Mus musculus
caacaagcucuacaucguggguggcguguguggugccagcaa

SEQ ID NO: 115373 - RNA, 46 nt, Mus musculus
gacuugcuugagcagcugaugcauaagggguuuccucugaguugga

SEQ ID NO: 115374 - RNA, 44 nt, Mus musculus
ggauggcaagcaugugguuuucggcaaaguucuagagggcaugg

SEQ ID NO: 115375 - RNA, 47 nt, Mus musculus
uaggaugugguacggaagguggagagcaccaagacagacagccggga

SEQ ID NO: 115376 - RNA, 45 nt, Mus musculus
uccaucugauggggugaccacaccccucacauuccacaggccuga

SEQ ID NO: 115377 - RNA, 45 nt, Mus musculus
agggccuugccacgugagcaggguuauccuuaccuccagcugcug

SEQ ID NO: 115378 - RNA, 46 nt, Mus musculus
ccagggcuauacagagaaacccugucucaaaaaaccaaaguaauaa

SEQ ID NO: 115379 - RNA, 45 nt, Mus musculus
gaugaaaugaggccggcaugguggcgcaugccuuuaaucccagca

SEQ ID NO: 115380 - RNA, 46 nt, Mus musculus
cuugucacacaagcaugaguaucugaguucaaucuucagcauccac

SEQ ID NO: 115381 - RNA, 45 nt, Mus musculus
uucaagucaaaguggaaaaauccaguaggugccccagaugucccc

SEQ ID NO: 115382 - RNA, 42 nt, Mus musculus
ccucccaugcaugguuagggcaucagcagccagaaggaggag

SEQ ID NO: 115383 - RNA, 45 nt, Mus musculus
uaacagaaagaucuguccagaggacaucucugcugacacccccuu

SEQ ID NO: 115384 - RNA, 45 nt, Mus musculus
uuuuguuuuguuuuguuuuguuuuguuucuguuuucuccgagcag

SEQ ID NO: 115385 - RNA, 53 nt, Mus musculus
ucugguuccaaaaccaaaaguucuucuaagagcgaggacugaagaagguagaa

SEQ ID NO: 115386 - RNA, 63 nt, Mus musculus
ugggcaagucgggguggcgguuuuaggucgcggagggcuggacccggagcagggaaguguuga

SEQ ID NO: 115387 - RNA, 44 nt, Mus musculus
gccauuugcacuucuguguuaaagugagggcacagagagagaga

SEQ ID NO: 115388 - RNA, 89 nt, Mus musculus
cucagccagaugucggccaggcuugacaaaaucgaagagagucagaagaggaaugcugaaggacagagaaagccggacgaggagaaggu

SEQ ID NO: 115389 - RNA, 46 nt, Mus musculus
uacaguuuagggagcugauggccagguguuagauaagggcuuaggc

SEQ ID NO: 115390 - RNA, 42 nt, Mus musculus
gguggugguggugaugauggugauggugguggugaugauggu

SEQ ID NO: 115391 - RNA, 45 nt, Mus musculus
uggcauuauuauuagacugcuuccugcugauuagaggcguggcgu

SEQ ID NO: 115392 - RNA, 68 nt, Mus musculus
uaugugugugugucugugugugugucugugugucuguguguguguguguguguguguguaggugugug

SEQ ID NO: 115393 - RNA, 72 nt, Mus musculus
ugugugucuguguguguguguguaugugugugugugugucugugugugugugugugucugugugugugugug

SEQ ID NO: 115394 - RNA, 42 nt, Mus musculus
gucgaccuacgagggacuccagcacuugaacaaggaacagca

SEQ ID NO: 115395 - RNA, 46 nt, Mus musculus
uugcugggaauugaacucaggaccucugggagagcagccagcgcuc

SEQ ID NO: 115396 - RNA, 45 nt, Mus musculus
gugucaucaggagugugaggugacuauucucaugggguucaaggu

SEQ ID NO: 115397 - RNA, 25 nt, Mus musculus
uuuagaguuuucugggucccaggaa

SEQ ID NO: 115398 - RNA, 82 nt, Mus musculus
agaaagcaugaguguuucuuccuauuuguuguuguuguugcuucuauuagggguagcuucccauugugcuuauugaggagag

SEQ ID NO: 115399 - RNA, 42 nt, Mus musculus
caaguacgaguccccagcuuuuguuucuauuaugguugagau

SEQ ID NO: 115400 - RNA, 45 nt, Mus musculus
uguguguguguguauauauauauauauauauagagagagagagag

SEQ ID NO: 115401 - RNA, 46 nt, Mus musculus
aaacuaggcuuggugcaugcugggaaagcacuccaucaguugagau

SEQ ID NO: 115402 - RNA, 46 nt, Mus musculus
gccucugucucagaaacgcuggaacuucaggccuuuggcaguagau

SEQ ID NO: 115403 - RNA, 46 nt, Mus musculus
ugagucugguggagcagcuggaagacaggauccucugucaugagaa

SEQ ID NO: 115404 - RNA, 46 nt, Mus musculus
uacagagaaguacaagauugaaaucuauuaaggagauugcuuuggg

SEQ ID NO: 115405 - RNA, 24 nt, Mus musculus
uggaguggggggguuguuugugaa

SEQ ID NO: 115406 - RNA, 38 nt, Mus musculus
gagauccugcgacuugaauguggcuuaauaaagagagu

SEQ ID NO: 115407 - RNA, 41 nt, Mus musculus
aaauccuccacgcugaccaagaagggaacugaugcccagag

SEQ ID NO: 115408 - RNA, 49 nt, Mus musculus
uggggaaccacauguaucuggggauauaaggagacauauuuagaaugaa

SEQ ID NO: 115409 - RNA, 48 nt, Mus musculus
gcaaagcguggguuugccugaggugcaccacaaaggccgugggggaau

SEQ ID NO: 115410 - RNA, 46 nt, Mus musculus
guuucaauggcggauccuuuaggguucgccaucagaggauuuagau

SEQ ID NO: 115411 - RNA, 45 nt, Mus musculus
ggcuuuugaggcucgccuuaagaagugaaguggcaaaggucggcc

SEQ ID NO: 115412 - RNA, 46 nt, Mus musculus
ggagauguuuucuccaaauaucgaagacuuuguuuauaucacagau

SEQ ID NO: 115413 - RNA, 45 nt, Mus musculus
aacugaguaauauuuuguguagauuuccaguaaugaaaaaagaag

SEQ ID NO: 115414 - RNA, 49 nt, Mus musculus
gcuacuguugcuaugguuauagacacccacuucagacauuaccaagagu

SEQ ID NO: 115415 - RNA, 53 nt, Mus musculus
gauucagucauuggcagguaucuaugcauucguagaacuucuaagggucccag

SEQ ID NO: 115416 - RNA, 58 nt, Mus musculus
aacagcguugaugaacacuaaauauuaaucugagauagcuggauuguauauacuugca

SEQ ID NO: 115417 - RNA, 46 nt, Mus musculus
caauaggaauuuucuugguguuccuuucuuccagcacagugcaaga

SEQ ID NO: 115418 - RNA, 42 nt, Mus musculus
gcacauauuaugggcuugugacccuaaacuugcaggcaagau

SEQ ID NO: 115419 - RNA, 47 nt, Mus musculus
acacagaggaaaaauguacuaucuguuugucuauuuuagaggaaggu

SEQ ID NO: 115420 - RNA, 46 nt, Mus musculus
cuuggucauguuguacaagucauccaagugguuuugaagacaugga

SEQ ID NO: 115421 - RNA, 45 nt, Mus musculus
uaaauuuauauggucaguagugucugaucagacaaaagaauaaag

SEQ ID NO: 115422 - RNA, 45 nt, Mus musculus
cugagauagcugugucaguaaaaaaaauuuuucugugggcuaaag

SEQ ID NO: 115423 - RNA, 46 nt, Mus musculus
uuaucucugggugauaagacccagaaagaaagcaaaguuuugaguu

SEQ ID NO: 115424 - RNA, 42 nt, Mus musculus
gguucuggaagcugcuggacauuuggugugaauuggagaggu

SEQ ID NO: 115425 - RNA, 46 nt, Mus musculus
accaaaccaaaacauaauaaaaguaaugggaaaggauugggacuga

SEQ ID NO: 115426 - RNA, 42 nt, Mus musculus
aagauggauuuaauggcacuuaucuguaauuguagcacuuaa

SEQ ID NO: 115427 - RNA, 67 nt, Mus musculus
caauuggguuuuacaugaaaugauggucugaguggauuucccagaucugaugaguuagcuuagugac

SEQ ID NO: 115428 - RNA, 46 nt, Mus musculus
uuuaagauguuuugcuucuuuucuguuaacaguucaggguauuaau

SEQ ID NO: 115429 - RNA, 46 nt, Mus musculus
aaauuuuucuggcugucucuuuggggaucuaacuucuuaacaguaa

SEQ ID NO: 115430 - RNA, 46 nt, Mus musculus
ucaggccugaccugaguucagucucaggaacccacauaaguuagaa

SEQ ID NO: 115431 - RNA, 46 nt, Mus musculus
auuauauguauaugugucgcuucagacacaccagaaaagggcagua

SEQ ID NO: 115432 - RNA, 45 nt, Mus musculus
aagaaacgguccauagaauguuagaaaauacauuuguaagucaug

SEQ ID NO: 115433 - RNA, 46 nt, Mus musculus
gaucucuacuguuauacagccccugaggcagaaugcagcagaaguu

SEQ ID NO: 115434 - RNA, 45 nt, Mus musculus
uuuaaguguuuuauaagauaagcuuguggaauuuuagagugacug

SEQ ID NO: 115435 - RNA, 38 nt, Mus musculus
uuaauuuauaaauuuauuuacuauuuguaggugggugg

SEQ ID NO: 115436 - RNA, 72 nt, Mus musculus
uucugaauuuuucuguacagacuuguacaccuauguaagcauaucugaaagugucguagcguauagacagua

SEQ ID NO: 115437 - RNA, 45 nt, Mus musculus
guuguuaggaaacccuccaacagaaaauaugaaagcauaugcaga

SEQ ID NO: 115438 - RNA, 52 nt, Mus musculus
aaagguguauaccaucacugccuggccagaguuuccauucuuauugcccaga

SEQ ID NO: 115439 - RNA, 45 nt, Mus musculus
uacaucaaaaugaaccuaacauauaacagucuaauguccacauga

SEQ ID NO: 115440 - RNA, 43 nt, Mus musculus
agcagaaggagaggaugcuagugcagaggaagaagcgggaggc

SEQ ID NO: 115441 - RNA, 30 nt, Mus musculus
cuuguguacuaguuagcugugucugugaga

SEQ ID NO: 115442 - RNA, 46 nt, Mus musculus
cucuauuugauucuguacuaugaaaacaacaaucuagugccuagag

SEQ ID NO: 115443 - RNA, 45 nt, Mus musculus
ugguuguuagccaccaugugguugcugggauuugaacucaugacu

SEQ ID NO: 115444 - RNA, 46 nt, Mus musculus
uuccauuuacaggaaggacucugaccaguuaaauucacacagagaa

SEQ ID NO: 115445 - RNA, 45 nt, Mus musculus
auagccggagugucuaccagaugaccagauauauaacaugucaca

SEQ ID NO: 115446 - RNA, 46 nt, Mus musculus
aaauuauuuauuuuauguauaugagaacacguuacuaucugcagac

SEQ ID NO: 115447 - RNA, 41 nt, Mus musculus
cugagugugguggcauauacuguuuaauucgagggcucagg

SEQ ID NO: 115448 - RNA, 42 nt, Mus musculus
uccaucaguuuguuucucccccacccccugccaccccccuuc

SEQ ID NO: 115449 - RNA, 46 nt, Mus musculus
aggauaugacugauauuuccagaacaguguuguauaucaguaagaa

SEQ ID NO: 115450 - RNA, 45 nt, Mus musculus
uuucccuuuagguauaauuacaugguuugcauaguugacauagau

SEQ ID NO: 115451 - RNA, 45 nt, Mus musculus
aaacaacucaauauauauucagguagucccugaaucuguccagau

SEQ ID NO: 115452 - RNA, 72 nt, Mus musculus
gguucuagaaagccuuuuuguuccuuuuaauuauaacgagaaugaugaugaugauguguguguucaugugug

SEQ ID NO: 115453 - RNA, 45 nt, Mus musculus
caagaggaucucugucucuaaauuaucuccuaccuuuucuacagc

SEQ ID NO: 115454 - RNA, 46 nt, Mus musculus
acagucagugcuccuaacugcugagccaucucuccagcccccauuu

SEQ ID NO: 115455 - RNA, 46 nt, Mus musculus
uuugucucuuuuacuucacuacacugagcaguaagugauagaagau

SEQ ID NO: 115456 - RNA, 46 nt, Mus musculus
ccccuuaaaaaggauaagaaaaacuggaggaaaaaagcuugcugac

SEQ ID NO: 115457 - RNA, 46 nt, Mus musculus
gacuaaaggcaugugaguuuuggccuuuuuuucuuuaggaaagauu

SEQ ID NO: 115458 - RNA, 45 nt, Mus musculus
auuaucuuuacauuuuuugguuacauuuauuuugugugugugugu

SEQ ID NO: 115459 - RNA, 42 nt, Mus musculus
cuaguagauaaaagcuauacauuaaaauugggauccucaggg

SEQ ID NO: 115460 - RNA, 46 nt, Mus musculus
uucuaugaccuuuauauaggcuucuaccagaaggugugccccagau

SEQ ID NO: 115461 - RNA, 42 nt, Mus musculus
caagggccugaguucagucuccagcacugaaaaggggggauu

SEQ ID NO: 115462 - RNA, 42 nt, Mus musculus
uaaugacaucugacgccucuacuggugugucugaagacagcu

SEQ ID NO: 115463 - RNA, 46 nt, Mus musculus
cuuacguaggaacaugucuagauuuuagagcuagagacugaagaau

SEQ ID NO: 115464 - RNA, 45 nt, Mus musculus
gguugcugccuggguuucuguagguagucagaaauugacaauaga

SEQ ID NO: 115465 - RNA, 41 nt, Mus musculus
guggggucuguacaugugagugcaggugccucugaggccgg

SEQ ID NO: 115466 - RNA, 43 nt, Mus musculus
cuugaccccguugauguccaaguugcggcgcuucagcucggac

SEQ ID NO: 115467 - RNA, 46 nt, Mus musculus
ggucgcggcucccucaggaucgaugcaccgcgguuaacccgugagg

SEQ ID NO: 115468 - RNA, 46 nt, Mus musculus
ugcauucaaacuuaguagauauuggcuguagugcauuggaaaguug

SEQ ID NO: 115469 - RNA, 46 nt, Mus musculus
auaauucucccaugaaauucuaaaaacuuggcuuggggccagaaag

SEQ ID NO: 115470 - RNA, 46 nt, Mus musculus
accuacuacaguucuagcuaaauagguguucagugagaaccaggga

SEQ ID NO: 115471 - RNA, 44 nt, Mus musculus
ugaaugagaagaaaaguaaaaaauacuaaauuuaucagagugga

SEQ ID NO: 115472 - RNA, 45 nt, Mus musculus
ucauucuagagaguuagaugauaguagucuauaaauuuggaacag

SEQ ID NO: 115473 - RNA, 46 nt, Mus musculus
cagacuauggaugaauugugacuaguugccugaccuuccugcacac

SEQ ID NO: 115474 - RNA, 46 nt, Mus musculus
ggaugacaaaaaaggugacagauagagauacugcacauagaaggag

SEQ ID NO: 115475 - RNA, 46 nt, Mus musculus
acauuggcacuggggaaaccaagagaacuuugccuaggaggacugg

SEQ ID NO: 115476 - RNA, 44 nt, Mus musculus
uugaauguacauauggaugacuuuggaaaucuggucuggacuua

SEQ ID NO: 115477 - RNA, 51 nt, Mus musculus
uuacaauguggauucauuacaccaaaaacaccagcgugccaaacgagcagu

SEQ ID NO: 115478 - RNA, 46 nt, Mus musculus
caagauccugucucaaaaaacaaauugaaauacuaguuaggcacau

SEQ ID NO: 115479 - RNA, 45 nt, Mus musculus
ccauguuugugaacaugaauauggaagugagaagacaaccuugga

SEQ ID NO: 115480 - RNA, 45 nt, Mus musculus
aggcaagcauaagacuggaccaaaucuccauggucuguucgggca

SEQ ID NO: 115481 - RNA, 46 nt, Mus musculus
uuuguuuguuuauauauugaguuauugugcuaucugguaccuucau

SEQ ID NO: 115482 - RNA, 46 nt, Mus musculus
uaggggaagaaugauugucuuuaauauuaaaacauauuagcaauau

SEQ ID NO: 115483 - RNA, 46 nt, Mus musculus
ugaguauacugccacugucuucagacacaccagaagagggcaucag

SEQ ID NO: 115484 - RNA, 45 nt, Mus musculus
auuuuguuuuuuaaguaaagaauaaguucauauauuucaagucua

SEQ ID NO: 115485 - RNA, 93 nt, Mus musculus
uuuagugaugaauuuaaaguagaaacaucaaauaaaguacuugauuaugauaccucucauauuuacacuggacauauuuaugguaaguuggac

SEQ ID NO: 115486 - RNA, 42 nt, Mus musculus
aaucaagcuuaccauuuuguuggccagggaccuuuccccuag

SEQ ID NO: 115487 - RNA, 48 nt, Mus musculus
uucaucaagacucgugguggcacguuuuacauugagccagcagagaga

SEQ ID NO: 115488 - RNA, 26 nt, Mus musculus
cauaaauaaguuggauauagaaaggc

SEQ ID NO: 115489 - RNA, 46 nt, Mus musculus
aaaaaaaaggaaaaaaggaaugagaaguucaaaaguagaguuguag

SEQ ID NO: 115490 - RNA, 42 nt, Mus musculus
uguguguguguguguguguguguguguguauaaagugagcua

SEQ ID NO: 115491 - RNA, 42 nt, Mus musculus
agagagagagagagagagagagagagagaggagcagguggau

SEQ ID NO: 115492 - RNA, 50 nt, Mus musculus
cccauaaauacggcccacaggggggcugugcagaucacuccguuuuugaa

SEQ ID NO: 115493 - RNA, 46 nt, Mus musculus
caacucuggcugaaagaaauacuugucagcucuauauccagacaga

SEQ ID NO: 115494 - RNA, 48 nt, Mus musculus
accgcgcccggcgucccacaguauuuuugaagagaaagugcucuagaa

SEQ ID NO: 115495 - RNA, 54 nt, Mus musculus
gguaaccuuaagugacccuuucaggagaagucuccaucugaggagauaggaaaa

SEQ ID NO: 115496 - RNA, 46 nt, Mus musculus
auucacauguauauaccacaugagcauguauacauaccacuacaag

SEQ ID NO: 115497 - RNA, 41 nt, Mus musculus
ggguuggagcaccuucagguagauuguguaacaaugucuua

SEQ ID NO: 115498 - RNA, 46 nt, Mus musculus
accaaacuauuuaugucucuaaugcucccucaccaaauaccuccag

SEQ ID NO: 115499 - RNA, 46 nt, Mus musculus
cauuuacagacuauuguucaucaaaaugucuguaauccuggcagaa

SEQ ID NO: 115500 - RNA, 46 nt, Mus musculus
agauggcaagaagaagucauugaacacaggcaucauuacuguucag

SEQ ID NO: 115501 - RNA, 46 nt, Mus musculus
guaguuuccagaggcugaaucuaggcucaggagaaaagcagggcag

SEQ ID NO: 115502 - RNA, 42 nt, Mus musculus
uuagacuuucaguuuuccucugugcugcaacaguggccccau

SEQ ID NO: 115503 - RNA, 75 nt, Mus musculus
gagagucuaagaacuuaggacaaaaagaaaauggcaauuacaucauguaugcaagagcaacaucuggggacaaac

SEQ ID NO: 115504 - RNA, 61 nt, Mus musculus
uuaacaacaacaaauuuucacucugcagcauuagaaacauaagccaagugcuugagaagaa

SEQ ID NO: 115505 - RNA, 41 nt, Mus musculus
uuuuuagcuucaggacuugagaaaguugaagaaacggcuau

SEQ ID NO: 115506 - RNA, 41 nt, Mus musculus
aagaaaauaucuaacaacaacaaaaaaagaaaucuggggga

SEQ ID NO: 115507 - RNA, 42 nt, Mus musculus
gcccaugcccacagugacacacuucuuccaacaaggccacac

SEQ ID NO: 115508 - RNA, 46 nt, Mus musculus
cagaaucuggccagccuaucuguggaaacgggaugguggaacaagg

SEQ ID NO: 115509 - RNA, 52 nt, Mus musculus
uacagugaccagugcaaagaugauugcugcuucgaugccaaccagccagagg

SEQ ID NO: 115510 - RNA, 45 nt, Mus musculus
guuccuaacugugaaaacaugacuguauuacuuuaaacuauuuag

SEQ ID NO: 115511 - RNA, 62 nt, Mus musculus
gcacagugugcauucaagucaaagucugaaaagugccgggaugauucugacugugcaaagga

SEQ ID NO: 115512 - RNA, 55 nt, Mus musculus
aaaaguaugacuuggaggagugcaccugugccagcucugauggcaaagaugauaa

SEQ ID NO: 115513 - RNA, 46 nt, Mus musculus
auauuaaugauaguuugaaucuugauguccuaucauuucuguggug

SEQ ID NO: 115514 - RNA, 46 nt, Mus musculus
uuuuauuuaaguuugccaaaaucuugugaugaugaagaugauggau

SEQ ID NO: 115515 - RNA, 46 nt, Mus musculus
uugggugauucuaagcaagguaggaauccauccaagguguguacag

SEQ ID NO: 115516 - RNA, 45 nt, Mus musculus
gagcggguucuacagugaguugccucucccauguagaaggcaagu

SEQ ID NO: 115517 - RNA, 45 nt, Mus musculus
gaacaagaugaaccuggaagcuuuugugucacaaaguaaguccuu

SEQ ID NO: 115518 - RNA, 46 nt, Mus musculus
uugcaguguucacacuccaaguaguaauccaaaguugccgccuccu

SEQ ID NO: 115519 - RNA, 23 nt, Mus musculus
ugagcagagccagagcugugggc

SEQ ID NO: 115520 - RNA, 29 nt, Mus musculus
guuccuugcauuuucccguguuaggacaa

SEQ ID NO: 115521 - RNA, 30 nt, Mus musculus
ccgagagaguuaucaaaugggacacaugcg

SEQ ID NO: 115522 - RNA, 45 nt, Mus musculus
uuacaguuaauaguugaagaaaaauggcaagagaucauguccuca

SEQ ID NO: 115523 - RNA, 46 nt, Mus musculus
cuguacuucucugugcaauuguaaacagaaauugcaauauggaugu

SEQ ID NO: 115524 - RNA, 45 nt, Mus musculus
uuucgacguuguuuuccccccaacauuuuagcaacaaugaaggua

SEQ ID NO: 115525 - RNA, 50 nt, Mus musculus
agcaaaagcauuuaauguauuaacaggcuuaucgcuaugcagaaaaugga

SEQ ID NO: 115526 - RNA, 46 nt, Mus musculus
cuuuuuguacaugauuuagagacaaauuuuguacaugaaaccccag

SEQ ID NO: 115527 - RNA, 87 nt, Mus musculus
cugugcaaagguuggaaguggauuugcauuucuaaaauggugacuuuuauucugcaagaguucuuaguaacuucuugagugugguag

SEQ ID NO: 115528 - RNA, 46 nt, Mus musculus
uggaaauuuuuacuaaaaccugcaaaaaauaaaguauugugcaaag

SEQ ID NO: 115529 - RNA, 46 nt, Mus musculus
auuucaccagaaaggguguaagcagcacuaucugauaagaguacag

SEQ ID NO: 115530 - RNA, 42 nt, Mus musculus
acaauacggccaaauacaagguucacauauuaaacugugcaa

SEQ ID NO: 115531 - RNA, 46 nt, Mus musculus
ggccagcgacucuucuauggaaagcagcugugcaggcagguggugg

SEQ ID NO: 115532 - RNA, 45 nt, Mus musculus
auuuuuugcaauuuagugaugaagagacugucgaugcugcuggag

SEQ ID NO: 115533 - RNA, 48 nt, Mus musculus
cucuucacguucugaaauggcagcuuucaguuuggcaacugugucuga

SEQ ID NO: 115534 - RNA, 41 nt, Mus musculus
gguucuuuuccuugguuauauaacaaacaggagaagggggc

SEQ ID NO: 115535 - RNA, 45 nt, Mus musculus
ggcgccucaaccucucccgcagcuccgccgaacucugccgcccca

SEQ ID NO: 115536 - RNA, 42 nt, Mus musculus
ucaucucugguaaaauagaauccauucuaggaaugacuggag

SEQ ID NO: 115537 - RNA, 46 nt, Mus musculus
cuuccagaggaccuggguucaauuccagcacccacauggcagcuca

SEQ ID NO: 115538 - RNA, 56 nt, Mus musculus
cuccaguuccagaggaucugaugcccucauacagacaaacaugcaggcaagacacc

SEQ ID NO: 115539 - RNA, 45 nt, Mus musculus
aaucaggacauaccagcacaaaaauaugucacucugaugucgaau

SEQ ID NO: 115540 - RNA, 88 nt, Mus musculus
aaaguuuauuauagauaagugggugagcauagccagaggcugggacaucuggaagaguccagaguggccaugacccugagccuuguga

SEQ ID NO: 115541 - RNA, 42 nt, Mus musculus
uuuucuauuaaaauaauacaugaauuuccaaauuuagccaau

SEQ ID NO: 115542 - RNA, 46 nt, Mus musculus
auaaaauauuuguucaacuuuuauauucauauucuuucgcacccua

SEQ ID NO: 115543 - RNA, 45 nt, Mus musculus
gaauacagauuuugaaggaaagcuauaacacugaaaaaauugacu

SEQ ID NO: 115544 - RNA, 42 nt, Mus musculus
guugugagccaugugguugcugggaauugaacucgggaccuc

SEQ ID NO: 115545 - RNA, 46 nt, Mus musculus
aagcccagcucucuuuucugaauggaaaguucuaaaucuagugcag

SEQ ID NO: 115546 - RNA, 50 nt, Mus musculus
ccugcccaacagucaaccuggauaaacuguggacauuggucagcgagcag

SEQ ID NO: 115547 - RNA, 46 nt, Mus musculus
uacaaaguucuggacaagggaaagcucccuaagcaaccugucaucg

SEQ ID NO: 115548 - RNA, 45 nt, Mus musculus
agaggugccuguguucugguggcuuaaaagccacaccggagguua

SEQ ID NO: 115549 - RNA, 46 nt, Mus musculus
gaguagcaggccaacauucuaccccuaagcuaucucucuagucuag

SEQ ID NO: 115550 - RNA, 43 nt, Mus musculus
aaucccagcaaccacauaauggcucacaaccauccguaaugag

SEQ ID NO: 115551 - RNA, 45 nt, Mus musculus
acucuuuauggaaugugaagaagaggagcuagagccauggcagaa

SEQ ID NO: 115552 - RNA, 46 nt, Mus musculus
gaaaacugauggaccacaguaaacugucuacucaaaaauauuucag

SEQ ID NO: 115553 - RNA, 46 nt, Mus musculus
uguguaauucauucaguucuccacaccuggaguaaggcaccugaag

SEQ ID NO: 115554 - RNA, 46 nt, Mus musculus
uuuccaaguaacauaaacauguguuaaugagauugcacuaccagag

SEQ ID NO: 115555 - RNA, 28 nt, Mus musculus
agaacgaacugacuggcaguugauggag

SEQ ID NO: 115556 - RNA, 42 nt, Mus musculus
ccugggagcagggaaguaggaacagggacaagaagggguaau

SEQ ID NO: 115557 - RNA, 46 nt, Mus musculus
aacuaucuuuuccugugauaaaaacauuauaaccaaagagguguag

SEQ ID NO: 115558 - RNA, 45 nt, Mus musculus
ugaguguuucaugaaugauaaugauccaaagagucacauguggca

SEQ ID NO: 115559 - RNA, 42 nt, Mus musculus
agaggaggugaaaaaaugagucugaacugaaaaagaaucaag

SEQ ID NO: 115560 - RNA, 42 nt, Mus musculus
uacacuguagcugucuucagacacuccagaagagagcgccag

SEQ ID NO: 115561 - RNA, 45 nt, Mus musculus
accucuucagucaggaucuucaguuacaccuucuaucagcccaag

SEQ ID NO: 115562 - RNA, 46 nt, Mus musculus
acagucacuuguggugauauauccuuuuaguuucagcuacucccag

SEQ ID NO: 115563 - RNA, 46 nt, Mus musculus
uggcccauguuuugagaccaguauauagagaucccauuuugagagg

SEQ ID NO: 115564 - RNA, 46 nt, Mus musculus
caguucuaggguacucuguugugguugggaagucagguagcaggag

SEQ ID NO: 115565 - RNA, 45 nt, Mus musculus
cgacacugaugcuaguuacccaccuucuguacacaaggcugccag

SEQ ID NO: 115566 - RNA, 45 nt, Mus musculus
aggacuggguaagacuuaguuucucuuucaacagaagcgcaagug

SEQ ID NO: 115567 - RNA, 46 nt, Mus musculus
agcuuaggaaagugacuacaucucaaauuauaacuauuucagcaag

SEQ ID NO: 115568 - RNA, 45 nt, Mus musculus
agcccugggaaaggcaggccauuaggauaguuuauugucuacuag

SEQ ID NO: 115569 - RNA, 23 nt, Mus musculus
gcacuuugaguagaucaaaguua

SEQ ID NO: 115570 - RNA, 42 nt, Mus musculus
aauuugugaguuaaauuccaaccucaguaaaacgucaggcau

SEQ ID NO: 115571 - RNA, 46 nt, Mus musculus
cuuuuuuaaggugguuuguuuuuaauccuuuaauuuuuuggccacu

SEQ ID NO: 115572 - RNA, 52 nt, Mus musculus
cacuaagugcagaauaauucacaaugagcauaaucugaaauuuuuaaagaug

SEQ ID NO: 115573 - RNA, 46 nt, Mus musculus
auuuuccucugaugcuccuuguugagucaugagagaagcuggcagg

SEQ ID NO: 115574 - RNA, 52 nt, Mus musculus
ucauuuaauuuacaaaucuuuguugaauuuuaauacaguuaguaaguguagg

SEQ ID NO: 115575 - RNA, 46 nt, Mus musculus
agcagugauuacagccauaugugagaugguucaaaacaggcagugu

SEQ ID NO: 115576 - RNA, 46 nt, Mus musculus
gggggaaaugaagaauacaaagaaaaagcaaaaaaagagcaugaag

SEQ ID NO: 115577 - RNA, 45 nt, Mus musculus
cccaauaccucucagucugugugcccuuugggugaugagcaucca

SEQ ID NO: 115578 - RNA, 90 nt, Mus musculus
acuuccuucucugggagggaugugcuagaacugaggucugcuugcucuuguugcuuauguaguuuuuugugucuccagcacuacagcuag

SEQ ID NO: 115579 - RNA, 105 nt, Mus musculus
ccaucuuucuuacuuaauucuuaauguuuugccucuuccucccuucagaguaaaaucuacuggucacuuacagagucacauguagauugcuucuaagaaccugcc

SEQ ID NO: 115580 - RNA, 58 nt, Mus musculus
uuuuuaaauucccacccccucccccagaaccugccuuuuguuuuguuuuugagacaag

SEQ ID NO: 115581 - RNA, 55 nt, Mus musculus
auccagacguccuguauuauauuuugaguagaucugugguaaaucaugugcugau

SEQ ID NO: 115582 - RNA, 45 nt, Mus musculus
caugauaugucaagcucacuuuaugaaauaucuacugaauaucaa

SEQ ID NO: 115583 - RNA, 46 nt, Mus musculus
auuuuaugauucauuuaauuauuucaguuuacauaccagggucaga

SEQ ID NO: 115584 - RNA, 59 nt, Mus musculus
auauacauuccuugcauauguuuucaaguauaugagguuauccaaaaucaggaaaaugu

SEQ ID NO: 115585 - RNA, 81 nt, Mus musculus
uugcaaaugcugauuugauuuuauauaggaaagauaaucuaagcauagaguauauaaaacauaaaagaaauuagacuuuuc

SEQ ID NO: 115586 - RNA, 46 nt, Mus musculus
caguuaacaucaggggauguuggcauugaucaauuucugaggcaag

SEQ ID NO: 115587 - RNA, 44 nt, Mus musculus
uagugacccaggcaguguucguuuggaaccuuugacgccaucag

SEQ ID NO: 115588 - RNA, 46 nt, Mus musculus
gguggcaguccuggaggaaguaacccuuguagagcagagacagcag

SEQ ID NO: 115589 - RNA, 42 nt, Mus musculus
agucaguguauaagcugugcagaaccccaccucagcccccau

SEQ ID NO: 115590 - RNA, 45 nt, Mus musculus
aaaccugucuuugaauaauuuuauauucagauuccuguuuggcua

SEQ ID NO: 115591 - RNA, 49 nt, Mus musculus
uauacuaccaagaauuaacuaagauagaaaaaccuggacacacccauag

SEQ ID NO: 115592 - RNA, 61 nt, Mus musculus
gggcuauguguguguucucuuguucagugguugugcacacaggagacaaaauagagaugga

SEQ ID NO: 115593 - RNA, 46 nt, Mus musculus
uuaugaccuacuagaccugggagaggacagagaagauggcagggca

SEQ ID NO: 115594 - RNA, 45 nt, Mus musculus
gaguuagauaaugaccuggugaaauaaacagaauguuugggagga

SEQ ID NO: 115595 - RNA, 48 nt, Mus musculus
aaaauugaaguguugaaaucagaaaacaaaaaacuagaaagacaaaaa

SEQ ID NO: 115596 - RNA, 46 nt, Mus musculus
accuuuaaucccagcacuugggacacugaagaugaaucccugugau

SEQ ID NO: 115597 - RNA, 45 nt, Mus musculus
ggggauaaccuagagccuuauacaagcuaaauaagugcucuaccc

SEQ ID NO: 115598 - RNA, 48 nt, Mus musculus
uguauaaggcucuagguuauccccagauacuugguaccccauuaaaag

SEQ ID NO: 115599 - RNA, 46 nt, Mus musculus
agugaccacuugcacauugaggggaagaacuuugccaucaggagaa

SEQ ID NO: 115600 - RNA, 52 nt, Mus musculus
ccaguccugguggggaccguucugccagacaccgcuacccucagaucuuacc

SEQ ID NO: 115601 - RNA, 47 nt, Mus musculus
ggagagcggauggugagcgcacugguguuugcuggcuuggguaagau

SEQ ID NO: 115602 - RNA, 46 nt, Mus musculus
cucacacccaguaacaguaaugcgccucuuaaacauucugccucag

SEQ ID NO: 115603 - RNA, 24 nt, Mus musculus
uccugauaacuguuggaggccuag

SEQ ID NO: 115604 - RNA, 44 nt, Mus musculus
uuccacugcggggcuaauuggguuauuaauauucacucagcaga

SEQ ID NO: 115605 - RNA, 77 nt, Mus musculus
auuuauuuauuuauuuucugguuuaucacagaaccaaauggcagcuuggaacacagcccaccccacacacacccaaa

SEQ ID NO: 115606 - RNA, 46 nt, Mus musculus
acacguacacaucacacacacauacauacauaccacaacacccccc

SEQ ID NO: 115607 - RNA, 46 nt, Mus musculus
ugccuagugugucugaagccaugguugaauauccugcauugcguac

SEQ ID NO: 115608 - RNA, 46 nt, Mus musculus
uaggacucacugggugaugugacggaggguauuaaagcaugcugaa

SEQ ID NO: 115609 - RNA, 42 nt, Mus musculus
ccacgcccggcuugaguuuuaguucuuuuauguauagccuau

SEQ ID NO: 115610 - RNA, 41 nt, Mus musculus
uugcugugagauuagaggugcuaggcauuguccccagagaa

SEQ ID NO: 115611 - RNA, 50 nt, Mus musculus
agaguugugagaaguagguuuccuauuaagaugcacucacugaagauggg

SEQ ID NO: 115612 - RNA, 42 nt, Mus musculus
auuuuuucuacaguuuugaugacugcagagaagccucaguag

SEQ ID NO: 115613 - RNA, 42 nt, Mus musculus
cagucgggugcucuuacccgcugagccaucucuccagcccga

SEQ ID NO: 115614 - RNA, 45 nt, Mus musculus
ggacucuagucauuuaauaagaccacaaaaauauaaggaguugga

SEQ ID NO: 115615 - RNA, 46 nt, Mus musculus
uacuguguagcaccggcuaccuuggaacucauuauauaguccagag

SEQ ID NO: 115616 - RNA, 42 nt, Mus musculus
ucuuauugucugagagacacuaugaccaacagugaggugggg

SEQ ID NO: 115617 - RNA, 46 nt, Mus musculus
caacaguguaguccacagcuuggagacauuaccuacauuugcacag

SEQ ID NO: 115618 - RNA, 46 nt, Mus musculus
uauggguaugggaguuuugccuggauaagacagaagaugguggcgg

SEQ ID NO: 115619 - RNA, 45 nt, Mus musculus
auaaaacaccuuuuuguauuuuaggaugacacacgaguugugaga

SEQ ID NO: 115620 - RNA, 45 nt, Mus musculus
cucagcuuacaauguccacgguacagcauguagucaccuggucug

SEQ ID NO: 115621 - RNA, 46 nt, Mus musculus
ugcauagcgagacucugucuccacgaaacaaaaacugggugggaaa

SEQ ID NO: 115622 - RNA, 46 nt, Mus musculus
guguuuugucuucauguauauguuugaacauuugauguccauagag

SEQ ID NO: 115623 - RNA, 46 nt, Mus musculus
ugauucaacaaccuugucuuacggauucauauuagauaaaagggau

SEQ ID NO: 115624 - RNA, 62 nt, Mus musculus
ggguaugaaauagaaaacauaaucauaucaacauuucaacaguaaugugaagaauuuuaggu

SEQ ID NO: 115625 - RNA, 46 nt, Mus musculus
ugugagcccccaugugguugccgggauuugaacucaggaccucugg

SEQ ID NO: 115626 - RNA, 61 nt, Mus musculus
cagcuacagagaguuuagggccagcgugggcuacugaugaccugucagggagagauggaga

SEQ ID NO: 115627 - RNA, 42 nt, Mus musculus
caaaccuuuuucagaguagaucugagaacagacagaaagcag

SEQ ID NO: 115628 - RNA, 46 nt, Mus musculus
agucauaaacaugaauaaaguaaacuaagccuuaaaaaaauggaag

SEQ ID NO: 115629 - RNA, 45 nt, Mus musculus
gugacauuguaugacccgaugaguggaauccuuaccagcgugcag

SEQ ID NO: 115630 - RNA, 46 nt, Mus musculus
aaguccucuuauauuuuccuuaaaaugguuuuuuugugccucgguu

SEQ ID NO: 115631 - RNA, 44 nt, Mus musculus
uagcucucagcuguuuguugucaaccaaacugcugguuccagga

SEQ ID NO: 115632 - RNA, 45 nt, Mus musculus
ucagggaaaaggaugcuacuugucugaguuguacauucaguguug

SEQ ID NO: 115633 - RNA, 38 nt, Mus musculus
agacagaaaaauuuagcauuugccaaaccagucaccag

SEQ ID NO: 115634 - RNA, 46 nt, Mus musculus
auauagauauuaaaauauauauuacuuaaaauauauuacugggaag

SEQ ID NO: 115635 - RNA, 45 nt, Mus musculus
caaaucccagcaaccacauuguggcuaacaaucauccauaaugag

SEQ ID NO: 115636 - RNA, 46 nt, Mus musculus
uguucuauaaauagagcugcagaguacucauggccaaguccagcac

SEQ ID NO: 115637 - RNA, 42 nt, Mus musculus
aaguucugggauuaaaggcgugugccaccacgcccggcccag

SEQ ID NO: 115638 - RNA, 59 nt, Mus musculus
caugaacuuacagggacucuccuauuucugucuuccaagugcugagauuacaggccuga

SEQ ID NO: 115639 - RNA, 45 nt, Mus musculus
ccaccagagaaaacaugugaccuaggagagagacccugccuuaaa

SEQ ID NO: 115640 - RNA, 45 nt, Mus musculus
cauuagggucucagcucucauuugucacauuagugguaaccccag

SEQ ID NO: 115641 - RNA, 87 nt, Mus musculus
augcugugaguaucugcugugacagucuucauguguccuggaauagagcuuucucugaaagugaauuugagcagccagcaggggucg

SEQ ID NO: 115642 - RNA, 62 nt, Mus musculus
cucccaacacuauaaacaucuauccuugaaaacauauccuagcagaccucuuuggaaagaga

SEQ ID NO: 115643 - RNA, 29 nt, Mus musculus
ucuuuagaaauaccuucaacaauguguag

SEQ ID NO: 115644 - RNA, 107 nt, Mus musculus
cauuucucuucagacucuggguuucgacaagacagcagaauacucccagaugagggcugccagcacuucucauuccucuggcuugaacuuggaguugauacuggccc

SEQ ID NO: 115645 - RNA, 45 nt, Mus musculus
cugaggucugagccuacaauuugggcuauucagcauuuugggauu

SEQ ID NO: 115646 - RNA, 50 nt, Mus musculus
auguggccaggcuuuccucaaacgcuccauacacugaccucugauccccc

SEQ ID NO: 115647 - RNA, 49 nt, Mus musculus
aacacacaaacaaauccaagcuugguccuugguccuugcuuuauguuca

SEQ ID NO: 115648 - RNA, 45 nt, Mus musculus
auuaaaucuuaccgaaaagcuguuuguugaggagaaaacauguca

SEQ ID NO: 115649 - RNA, 46 nt, Mus musculus
gacucucagcccugaacaugcuuggaaaugagaacaaauggcacag

SEQ ID NO: 115650 - RNA, 46 nt, Mus musculus
ccgugaaguuaugugcggaagucccaguagacuucccuuugcccag

SEQ ID NO: 115651 - RNA, 62 nt, Mus musculus
gagagacuugacaaaugaacugucugauguuuguaagguaagauuccucuggucuugaaaaa

SEQ ID NO: 115652 - RNA, 46 nt, Mus musculus
gcuggcuggcgugcucuauuucuuucuugugaagggaccuugcuuc

SEQ ID NO: 115653 - RNA, 61 nt, Mus musculus
ucaaaguuugaucuuuguuuuagaguuauucauuccacuugcaaaauuuuucuaaaacagu

SEQ ID NO: 115654 - RNA, 82 nt, Mus musculus
gaaauaguccagagacagucguuacuguggcagcacuaucauuugccacugaugcuuuccaaagagguacuuuaaauacacc

SEQ ID NO: 115655 - RNA, 42 nt, Mus musculus
guugugagccaucaugugguuguugggauuugaauccaggac

SEQ ID NO: 115656 - RNA, 46 nt, Mus musculus
caauucaguaauuuuaaaauaauucuuucugauaucaaaagcccag

SEQ ID NO: 115657 - RNA, 46 nt, Mus musculus
gcaucacaugaaacacaguggggaccacuaauuaugaggacagggu

SEQ ID NO: 115658 - RNA, 46 nt, Mus musculus
cuucuucaggcuuuucuugugggaagguugugacaggugcuucaag

SEQ ID NO: 115659 - RNA, 46 nt, Mus musculus
uuaagauuuaaaaggcuucugggauauaaucccaccuagcagcagg

SEQ ID NO: 115660 - RNA, 101 nt, Mus musculus
agagccaugagccauggugcuuucuagaauaaauacguugccaaacaaagaauuugcauuaagaauauuaauggugaaugaaaaugaggacaugagcauuc

SEQ ID NO: 115661 - RNA, 103 nt, Mus musculus
ccgagcaugguugaggauaggguuguauuguuggccugagggagagcaugccuagagacagccacaggguccagaauaaacuaggucaugaaaacagugggga

SEQ ID NO: 115662 - RNA, 46 nt, Mus musculus
aaaacaaaacaggguuucucagugcuuagcuucucuaauguaccag

SEQ ID NO: 115663 - RNA, 46 nt, Mus musculus
auucagauauuuagacccugaguauccacagcagagaggcugcauu

SEQ ID NO: 115664 - RNA, 45 nt, Mus musculus
uguuuuuguuuuuugagacagguuuucuuuguauagcccuggcug

SEQ ID NO: 115665 - RNA, 41 nt, Mus musculus
uuugggaugcuuaccaucauuaugucaaaaagacucagcua

SEQ ID NO: 115666 - RNA, 46 nt, Mus musculus
uuccucuacuccccucacugaaccuggaggucacccauuggaccag

SEQ ID NO: 115667 - RNA, 45 nt, Mus musculus
uuuuaaauauuuaguauucuuaguugaagaaaguguaaaauguuu

SEQ ID NO: 115668 - RNA, 46 nt, Mus musculus
gucaaugauguuuuuuuuuguuguuguuauuuuuguuuuugagauc

SEQ ID NO: 115669 - RNA, 45 nt, Mus musculus
caucuguuaaagauggagcugaggggcuggagauaugaaucagag

SEQ ID NO: 115670 - RNA, 82 nt, Mus musculus
gaugccuucuucuggccugcagucacauaugcagccagaaugcuauauacauaauaaauaaauaaaucuuuaaaaaaaaaaa

SEQ ID NO: 115671 - RNA, 46 nt, Mus musculus
auagaggaaagcacccuguuucaacaugucaaucuccagccucagc

SEQ ID NO: 115672 - RNA, 42 nt, Mus musculus
cuuaauuuauuuucaauuauuugucuguagguauggggcgag

SEQ ID NO: 115673 - RNA, 46 nt, Mus musculus
cauugcguaugguuccagauggagaggaaguaaauugugcaccuuu

SEQ ID NO: 115674 - RNA, 45 nt, Mus musculus
gaacuugggcucacauacuggaugugagagacuaagagaccgaag

SEQ ID NO: 115675 - RNA, 46 nt, Mus musculus
guagaaauuugaaaguuaaugugggcaguuaguagcagcauauaag

SEQ ID NO: 115676 - RNA, 48 nt, Mus musculus
uggcuuuauagugagaucuuucauguaaauaacuuucaaggcgcagag

SEQ ID NO: 115677 - RNA, 46 nt, Mus musculus
uccaaaguacucaacccccuuucucauuuuagacugaaaacccaag

SEQ ID NO: 115678 - RNA, 51 nt, Mus musculus
cugagauuaaaaaugacuuauuuaccuaaaaauggcucagaagaugaaaau

SEQ ID NO: 115679 - RNA, 46 nt, Mus musculus
uaccucacacuguauguguguucugugugugugugugugugagaga

SEQ ID NO: 115680 - RNA, 42 nt, Mus musculus
agagagagagagacagaggcagagagagagacagaggcagag

SEQ ID NO: 115681 - RNA, 45 nt, Mus musculus
cugggcuucaggccacuggugagucaccuggugugagugcuggag

SEQ ID NO: 115682 - RNA, 50 nt, Mus musculus
guuuuuuaaacauuugaauauuacucaauuuguuguauaucuugguauaa

SEQ ID NO: 115683 - RNA, 47 nt, Mus musculus
cccaacaaguaccuauucuccaaacaaucuucccauuucgccauaga

SEQ ID NO: 115684 - RNA, 50 nt, Mus musculus
ucuguaacauaauaauuguaucagaauuuugacagauuugcccucggaaa

SEQ ID NO: 115685 - RNA, 46 nt, Mus musculus
aagaacaguaugugcuugaucacugagcaaacucucaagccccugu

SEQ ID NO: 115686 - RNA, 46 nt, Mus musculus
uuguuugaguuuuaugacuuggccacaaugcuuguucuaggguuag

SEQ ID NO: 115687 - RNA, 52 nt, Mus musculus
uguccuuggaaggaccuacuacguaaaccaugaaucuagaagaacacagugg

SEQ ID NO: 115688 - RNA, 45 nt, Mus musculus
uuuuacaagccacaauagagaaugauuuucuuguggcuggggggu

SEQ ID NO: 115689 - RNA, 46 nt, Mus musculus
gguuuuugguuuuucgauaugggcuuacucuguauagcccugguug

SEQ ID NO: 115690 - RNA, 46 nt, Mus musculus
ccuaauugguguaauuaaagguguaucucauccacuauggcaaaaa

SEQ ID NO: 115691 - RNA, 46 nt, Mus musculus
uccugcaaguagguuucuggccuccacacucaugcccagggcacac

SEQ ID NO: 115692 - RNA, 47 nt, Mus musculus
gaugauaugcagcugcaagcgcagcgagcauucaccaccaggcggca

SEQ ID NO: 115693 - RNA, 78 nt, Mus musculus
uuuucagaauugggaaaucguacgagaagaugaaaacaccgaguauaguggucaggcuguccagucaccuccaucggg

SEQ ID NO: 115694 - RNA, 46 nt, Mus musculus
agagcagcaagcccucuuaacugcugagccauuuuuacaaccccua

SEQ ID NO: 115695 - RNA, 45 nt, Mus musculus
guguugcuguucuguguuuuuguggguugguugauuuggggugug

SEQ ID NO: 115696 - RNA, 50 nt, Mus musculus
guuuugaugccauuuaauaacaaaaauaagauauuucaguuagugguuaa

SEQ ID NO: 115697 - RNA, 45 nt, Mus musculus
aacauccaaguacucgaugaaauuuuguugaagguaguaggcaga

SEQ ID NO: 115698 - RNA, 24 nt, Mus musculus
ccgcagggaaaauccaaguccagu

SEQ ID NO: 115699 - RNA, 41 nt, Mus musculus
cccagugcccucuaucauuugguccaguauguggcagccag

SEQ ID NO: 115700 - RNA, 45 nt, Mus musculus
uucaucuggauugccaccagguugggaagaaaaacaagaugacag

SEQ ID NO: 115701 - RNA, 46 nt, Mus musculus
auugguguuuugccugcguguauguauaucuguuugaagaugucag

SEQ ID NO: 115702 - RNA, 46 nt, Mus musculus
uuaauauuauuuuauucaagguacauuuaugcuucuuuugacuuag

SEQ ID NO: 115703 - RNA, 46 nt, Mus musculus
uuucagagaacuuucaaguuucuaucucauuuauuaauacucccag

SEQ ID NO: 115704 - RNA, 46 nt, Mus musculus
uuguuuucagaauuuauuuacauuauuuugcauguaugacuaccua

SEQ ID NO: 115705 - RNA, 75 nt, Mus musculus
aaggaaaucagaugccucuucuggagugucugaagacagcaacaguguacuuacauauaguagauaaauauuaaa

SEQ ID NO: 115706 - RNA, 45 nt, Mus musculus
guggcguucucacccaucaguaggaccucccagcaguaucuucca

SEQ ID NO: 115707 - RNA, 42 nt, Mus musculus
uuagauauaaagaagacccagugggaagauccucgccugcag

SEQ ID NO: 115708 - RNA, 25 nt, Mus musculus
cuucagaaggaagcucaagaagcag

SEQ ID NO: 115709 - RNA, 65 nt, Mus musculus
acagaaaaugguggugugugugugugugagugugugugugugugugugagugugugugcgugugu

SEQ ID NO: 115710 - RNA, 41 nt, Mus musculus
uucaggagucuuuguaauuuagaaaaagaucaugggggcua

SEQ ID NO: 115711 - RNA, 67 nt, Mus musculus
ccgcgcaaacauucuggaggauucuuaccggaggauuaugggugugaagagagcugacuugcucaag

SEQ ID NO: 115712 - RNA, 63 nt, Mus musculus
gccagacucuggauugaguuugauggugaaaagggccuugacuauggagggguugccagagag

SEQ ID NO: 115713 - RNA, 46 nt, Mus musculus
ucuccccugcugcugcuuuaccucacccaggggaguggcuuuguag

SEQ ID NO: 115714 - RNA, 43 nt, Mus musculus
ugcaccauacgcauguaguacccucagaggccacaagggggca

SEQ ID NO: 115715 - RNA, 46 nt, Mus musculus
uacauaaauuauuuuguucuaugaacuauugagagggucacaugag

SEQ ID NO: 115716 - RNA, 53 nt, Mus musculus
acagauaaauccuaacucgggcuuguguaaugaagaucaccucucauacuuca

SEQ ID NO: 115717 - RNA, 42 nt, Mus musculus
uaagugcuccaccaguuuagugagccgcauccccagcaggag

SEQ ID NO: 115718 - RNA, 48 nt, Mus musculus
ugaauauuacaguucucugcgauggauucuugaaaaugacccgacgga

SEQ ID NO: 115719 - RNA, 45 nt, Mus musculus
gcacgaacugaaaaccggaggaucagagauuguugucaccaauaa

SEQ ID NO: 115720 - RNA, 48 nt, Mus musculus
auacaauggcgauuugugaaccguauccagaagcaaauggcagcuuuu

SEQ ID NO: 115721 - RNA, 46 nt, Mus musculus
guuugauuuuauguuuuuaaaauaauauacauaugcacucauggag

SEQ ID NO: 115722 - RNA, 45 nt, Mus musculus
uguacaaguugggucccaauucuuucuucuagucccaugcuccca

SEQ ID NO: 115723 - RNA, 45 nt, Mus musculus
ugcucugacugucuucaagaauucuuagaaucuuagugggaagug

SEQ ID NO: 115724 - RNA, 27 nt, Mus musculus
uacaaaugacugaauuuagcuuugcac

SEQ ID NO: 115725 - RNA, 45 nt, Mus musculus
acgcguuuccuuuccuucuagggauuuuuugaacugauaccacag

SEQ ID NO: 115726 - RNA, 46 nt, Mus musculus
auacauacaguuugauagauagauagauagauagauagauagauag

SEQ ID NO: 115727 - RNA, 46 nt, Mus musculus
augugaacgacuggcgggaacacacaaaauacaaaaauggcuacag

SEQ ID NO: 115728 - RNA, 45 nt, Mus musculus
acaucuaugcagugaguguagagaauacaccuuagaggauucgca

SEQ ID NO: 115729 - RNA, 46 nt, Mus musculus
aagaaaaaggcgguuucuaaaauguccguaaugagaaaaacuguag

SEQ ID NO: 115730 - RNA, 46 nt, Mus musculus
cauuacaguguaaaccacuagcaaaauuacaguuacgaaguaucag

SEQ ID NO: 115731 - RNA, 42 nt, Mus musculus
gcccucaggugaagggacagacugugcuggacgacucagcag

SEQ ID NO: 115732 - RNA, 59 nt, Mus musculus
gaacucugggauaaacuucagauggcaauugagaacacacagggcuuugauggcguuga

SEQ ID NO: 115733 - RNA, 45 nt, Mus musculus
caccgagaccagaggacaguuuauccaugauuuagccaccaccau

SEQ ID NO: 115734 - RNA, 49 nt, Mus musculus
ugggguucauguguacggcaggaugugaguccuguacgccugaguucug

SEQ ID NO: 115735 - RNA, 46 nt, Mus musculus
uagaccugccuaguguaccuuaucgccuagaaccuugaagccgcuu

SEQ ID NO: 115736 - RNA, 41 nt, Mus musculus
uuuuugccugugcauccuaaggcuagagucauuauguguua

SEQ ID NO: 115737 - RNA, 42 nt, Mus musculus
ugccgugaagaaccgaguuccauguaugacuugcccuuacca

SEQ ID NO: 115738 - RNA, 81 nt, Mus musculus
uaugaaaauuauguuuaaucaaaagucaagaacccuuggggcaaaaugcuacagguggagucccaccauagucaccuuuga

SEQ ID NO: 115739 - RNA, 45 nt, Mus musculus
cagucagugggaaguaagagcccgcagaauaacaaaggcagaagg

SEQ ID NO: 115740 - RNA, 56 nt, Mus musculus
auaucugccaaggcuccuucuagucagcuuacacuggugauuauacggaaaaugcu

SEQ ID NO: 115741 - RNA, 49 nt, Mus musculus
gcuuguguuauaaacuuuccgaaugcuuauaaguagccugugggagcug

SEQ ID NO: 115742 - RNA, 32 nt, Mus musculus
aaagacacccccaggccagugcaugcuuccag

SEQ ID NO: 115743 - RNA, 45 nt, Mus musculus
uguccccucccaguaagcauguucaccuaaagugauuuagccuag

SEQ ID NO: 115744 - RNA, 46 nt, Mus musculus
cucuagaaaaguguuuuagccuacuuuuucucuaauccccacccca

SEQ ID NO: 115745 - RNA, 45 nt, Mus musculus
gacauuguuuuuaaauuuuuucuuauaugguaaauguauauccag

SEQ ID NO: 115746 - RNA, 47 nt, Mus musculus
gccgggaggacuccagggaccgagaggaggacccggaggaucaggag

SEQ ID NO: 115747 - RNA, 45 nt, Mus musculus
ccucggggugaaaaagagacacccgcgaacaauacccaccccccc

SEQ ID NO: 115748 - RNA, 49 nt, Mus musculus
aaaggcaaacacauauucaguauauuuucuuuuaguugagagagaggaa

SEQ ID NO: 115749 - RNA, 46 nt, Mus musculus
gcaaaauaccaaagcagggaauggggguagaaaagacuuccaggga

SEQ ID NO: 115750 - RNA, 42 nt, Mus musculus
uagccuuggccauccuggaacugacuauguagaccgggcuag

SEQ ID NO: 115751 - RNA, 42 nt, Mus musculus
cuggacagccggggauauuaauggagagacccgucucaaaaa

SEQ ID NO: 115752 - RNA, 45 nt, Mus musculus
ggaugaauggaggguuaggauugagaguggagaaauauggcagaa

SEQ ID NO: 115753 - RNA, 44 nt, Mus musculus
aauacuaacauuugggagacagauggagaagacugaagcagagc

SEQ ID NO: 115754 - RNA, 46 nt, Mus musculus
ucaggaggcagaggcagguggaucuuuugaguuugaggccagccug

SEQ ID NO: 115755 - RNA, 42 nt, Mus musculus
caucccuguguguguguguguguguguguguguguguuguau

SEQ ID NO: 115756 - RNA, 46 nt, Mus musculus
ucaaaucccagcaaccacaugguggcucacaaucaucuguaacgag

SEQ ID NO: 115757 - RNA, 46 nt, Mus musculus
aacaaugcuucauuuuauuguuuuuuguuuguugucuugaaaugag

SEQ ID NO: 115758 - RNA, 46 nt, Mus musculus
cuucuggagugucugagggcagcuacaguguacuuacauaaaauaa

SEQ ID NO: 115759 - RNA, 44 nt, Mus musculus
gccucugccucccaagugcugggauuaaaggcgugugcccacug

SEQ ID NO: 115760 - RNA, 41 nt, Mus musculus
acccaauucaguuugagcauucaaaacaaauuuuggggaga

SEQ ID NO: 115761 - RNA, 46 nt, Mus musculus
gggcauagcugugcacgccuuuaaucccagcacucgggaggcagag

SEQ ID NO: 115762 - RNA, 42 nt, Mus musculus
gaagaacauaccucaugauugaugacaguccagccacaagau

SEQ ID NO: 115763 - RNA, 45 nt, Mus musculus
aguagaacaagaggagcugcccguucuuuauguagggcauggagg

SEQ ID NO: 115764 - RNA, 46 nt, Mus musculus
aucgucagugggagaaaccauguugucaucaaugagagaaaccaag

SEQ ID NO: 115765 - RNA, 42 nt, Mus musculus
uacacaugucuaucugugcagagccagaggagggcaccagau

SEQ ID NO: 115766 - RNA, 46 nt, Mus musculus
ucggauauuguuacacuugaaccaccuaagcuggaagaaaugggga

SEQ ID NO: 115767 - RNA, 45 nt, Mus musculus
uacggggugguuuguucauguauaugaaggcaauaugcauuguag

SEQ ID NO: 115768 - RNA, 44 nt, Mus musculus
uacuggaagguuguggaucacccucuaguaaauaugucugccug

SEQ ID NO: 115769 - RNA, 46 nt, Mus musculus
ggcaucagaugagccacuaugugguugcuaggaacuaacucaggac

SEQ ID NO: 115770 - RNA, 45 nt, Mus musculus
cuguauacuagugcugaagucaggccuugaggauuagggugaagg

SEQ ID NO: 115771 - RNA, 42 nt, Mus musculus
ucaaagcaaauguauuaggaagucugcaauagagcagggcag

SEQ ID NO: 115772 - RNA, 46 nt, Mus musculus
gcagaucugaguuugaggccaaccuggucuacagaauaagugauag

SEQ ID NO: 115773 - RNA, 46 nt, Mus musculus
aaauuuuguuuuaaugaaagagaagagaaauauuaagugcuuggaa

SEQ ID NO: 115774 - RNA, 54 nt, Mus musculus
aaccuugcugcagaaaaccaguauuuacgaauaucucuggagaaggaagaacaa

SEQ ID NO: 115775 - RNA, 51 nt, Mus musculus
ccacuucuaaguacugcuuaaggaccugguucucccuaacuaacugcgugc

SEQ ID NO: 115776 - RNA, 47 nt, Mus musculus
ggagaugcucuuggaggaggcaaggaugcugaaaagggaccuggaga

SEQ ID NO: 115777 - RNA, 57 nt, Mus musculus
ugcuguaacagccccacuuccuucucuucagucugcacacuaggagacuccgcacgg

SEQ ID NO: 115778 - RNA, 49 nt, Mus musculus
cccuggccaggcacagagccgugcggagucuccuagugugcagacugaa

SEQ ID NO: 115779 - RNA, 65 nt, Mus musculus
gucucucccacaaauccgagcgcugcugcucaaagaugagcuucugcuccagcucagccagccuc

SEQ ID NO: 115780 - RNA, 60 nt, Mus musculus
gggagagacuguacguugaggcaaaggaucaacauggaaagcaggagacagacgggagga

SEQ ID NO: 115781 - RNA, 46 nt, Mus musculus
guagaauucuucauagcaucaaauguuuccuuaacuguccccagaa

SEQ ID NO: 115782 - RNA, 46 nt, Mus musculus
auucuaccaaggaguuugugagacaucauaaagaaaaaaucaagca

SEQ ID NO: 115783 - RNA, 49 nt, Mus musculus
auuucaaagauacuaccaagaauaucuuugaugaaaagggcagcaagag

SEQ ID NO: 115784 - RNA, 48 nt, Mus musculus
gcacagagggauggagggagagaaaagcccagucacucugaagaaauu

SEQ ID NO: 115785 - RNA, 42 nt, Mus musculus
ggacucgccuuauuaacagggcuaauggcuuccuguccagca

SEQ ID NO: 115786 - RNA, 43 nt, Mus musculus
cuucaaacagcugauucacugguacuuacucaaugaacuggag

SEQ ID NO: 115787 - RNA, 46 nt, Mus musculus
cuccuuuaugcucuuaagguaaccuuucacaucaucaacaaagucg

SEQ ID NO: 115788 - RNA, 51 nt, Mus musculus
gaugugaaagguuaccuuaagagcauaaaggaguaucgaguagaggauggc

SEQ ID NO: 115789 - RNA, 46 nt, Mus musculus
acaugcccaaagugucuauauauacauccguccaacuucuccagau

SEQ ID NO: 115790 - RNA, 45 nt, Mus musculus
aauaauuucacuuaauuauauaaacuauacugaaaaaagcuagau

SEQ ID NO: 115791 - RNA, 46 nt, Mus musculus
cuuuaacuuaggaagcuagaaacaaagacuuuagugugaagcccgg

SEQ ID NO: 115792 - RNA, 46 nt, Mus musculus
aacagacauuuacaguuacagaauaaaaagcugaaggacaacagac

SEQ ID NO: 115793 - RNA, 46 nt, Mus musculus
aaaaucuucaugauugaagugaccuugcaucuaaacuugcuaugaa

SEQ ID NO: 115794 - RNA, 46 nt, Mus musculus
agagcagggccucccuggaacggaagguccuuugcagagguuggag

SEQ ID NO: 115795 - RNA, 46 nt, Mus musculus
uggugaggagcagacaagauacauugucaacaagucacauagccag

SEQ ID NO: 115796 - RNA, 46 nt, Mus musculus
aaaaagauaaaacagaaaauaacauccuacucuaauuccaggaaaa

SEQ ID NO: 115797 - RNA, 46 nt, Mus musculus
ugauaaaaagcaacguaugguaacuauugaaaacgccaggcaccga

SEQ ID NO: 115798 - RNA, 42 nt, Mus musculus
ucacaaaucaguacuuaggaucgaaagguaacugccccaguu

SEQ ID NO: 115799 - RNA, 42 nt, Mus musculus
guuaccuuucgauccuaaguacugauuugugauuaaguuagg

SEQ ID NO: 115800 - RNA, 46 nt, Mus musculus
uuagguuuguuaaaaacaaaaacuuuuuuuccugcugggggggggu

SEQ ID NO: 115801 - RNA, 61 nt, Mus musculus
cuggcuugucuugugaacucucuugcacaccugaaugcuauggaagaaacaauaaacugca

SEQ ID NO: 115802 - RNA, 46 nt, Mus musculus
ugugucuaaagacagcuacaguguacucacauaaaauaaauaagag

SEQ ID NO: 115803 - RNA, 46 nt, Mus musculus
uacuuccaugcugaccccagcacagcacaaaccaaaaccagaaguu

SEQ ID NO: 115804 - RNA, 42 nt, Mus musculus
cagacagacuaccccaugaccagagcauccccaggccaacag

SEQ ID NO: 115805 - RNA, 46 nt, Mus musculus
uuucaaggccuuuauucuagaacuugagauaggaguucaaggccag

SEQ ID NO: 115806 - RNA, 45 nt, Mus musculus
uguccaaagccucagcuggccuggaacuugcuauguuagccaggc

SEQ ID NO: 115807 - RNA, 48 nt, Mus musculus
acaccuuuauucuuucuagauaggaucuucuauaguuuuggagugggu

SEQ ID NO: 115808 - RNA, 45 nt, Mus musculus
cuguggaccagacgauauccagggagggagcauucaagggaagga

SEQ ID NO: 115809 - RNA, 45 nt, Mus musculus
ccauggccagcugaagguaccccagcuggcgacuacucagaccca

SEQ ID NO: 115810 - RNA, 42 nt, Mus musculus
cagguuuucccacaucucggucugcauuccccucagcccccc

SEQ ID NO: 115811 - RNA, 43 nt, Mus musculus
aaucccggcagccacaugguggcucacaaccaucuguaaugau

SEQ ID NO: 115812 - RNA, 42 nt, Mus musculus
acccucagcuugugcgcuaccugccgcugcaaugcucgggag

SEQ ID NO: 115813 - RNA, 48 nt, Mus musculus
aacaauauuccagagaucagaaggaauuaaaagaaaaggugaaguugu

SEQ ID NO: 115814 - RNA, 45 nt, Mus musculus
ggaaucuagcacugcagggacgcaacaccgcagggacagcaccgg

SEQ ID NO: 115815 - RNA, 46 nt, Mus musculus
gugugugugugugugugugguaguugaaacauggcuccguuaugua

SEQ ID NO: 115816 - RNA, 45 nt, Mus musculus
cucugcaugagaacauaaaguagacuaugggcuuucuuguuuguu

SEQ ID NO: 115817 - RNA, 46 nt, Mus musculus
gguugugagccaccauaugguugcugagauuugaacuccggaccuu

SEQ ID NO: 115818 - RNA, 42 nt, Mus musculus
uggugagggagacuaacacugcucccccacccccacccccaa

SEQ ID NO: 115819 - RNA, 45 nt, Mus musculus
aauguauugucacccaaaaccgggguguuggcagggauggguccu

SEQ ID NO: 115820 - RNA, 45 nt, Mus musculus
ugaauguuuugucuggugcccuuagaagccagaagagggugucag

SEQ ID NO: 115821 - RNA, 46 nt, Mus musculus
gaccucauggggagagagagagagagagagagagagagagagagag

SEQ ID NO: 115822 - RNA, 42 nt, Mus musculus
uuugaacccagagaucuggcugucucugccuuccaagugcug

SEQ ID NO: 115823 - RNA, 46 nt, Mus musculus
ugucggauggagauuacgauuaccucaucaaguucuuggccuuggg

SEQ ID NO: 115824 - RNA, 49 nt, Mus musculus
auggcaaguucaacuccaaauucaucaccacagugggcauugauuucag

SEQ ID NO: 115825 - RNA, 45 nt, Mus musculus
ggcauuauucugaccaacacaguugcaauaacuucaacccacaga

SEQ ID NO: 115826 - RNA, 42 nt, Mus musculus
aagaaaaaaaaaaaaaaagaaaagaaaagauaaugaagccaa

SEQ ID NO: 115827 - RNA, 42 nt, Mus musculus
uccugugguuaugcaugcacacgugugaugugggggcccaag

SEQ ID NO: 115828 - RNA, 46 nt, Mus musculus
ccccucaagaugagggcgugcaggggguuggguaguggaugaggag

SEQ ID NO: 115829 - RNA, 47 nt, Mus musculus
aacaguaggagauguucguaaccaugguaguagacguuggagguucu

SEQ ID NO: 115830 - RNA, 42 nt, Mus musculus
cuaggguagaagaggccugccuuguacaggaaacagggcaca

SEQ ID NO: 115831 - RNA, 31 nt, Mus musculus
aaaacccagauauagugcuguguggaaauaa

SEQ ID NO: 115832 - RNA, 46 nt, Mus musculus
uauuuuguuuguuuguuuguuuguuuguuuuguuuuguuuuuuaaa

SEQ ID NO: 115833 - RNA, 55 nt, Mus musculus
guauauuuauccucaauuucuccaaauccugaauggccaaaaaaauuacgaaggg

SEQ ID NO: 115834 - RNA, 46 nt, Mus musculus
ccaacgggacaaacauaagccacgcgauugagaugcuccuggaccu

SEQ ID NO: 115835 - RNA, 94 nt, Mus musculus
gugguacgguccaacggccauaccucugcggaucagcuaagugaggagaaggagaagggguuguguggcuguugagacgccaagcgagccccgu

SEQ ID NO: 115836 - RNA, 46 nt, Mus musculus
ggcauccaucuguaacgcgcugcagcuuuguaugauuuaguccaug

SEQ ID NO: 115837 - RNA, 45 nt, Mus musculus
caugagcauaaacagauggcggccauaccuauagacucugaauag

SEQ ID NO: 115838 - RNA, 48 nt, Mus musculus
acguuguaaaauauuugcucuuuucuuguaaacugggaagaccagaga

SEQ ID NO: 115839 - RNA, 82 nt, Mus musculus
aguucaucaagaagagggugggcacgcacauccgugccaagagaaagcgggaggagcugagcaacgugcuggcagccaugag

SEQ ID NO: 115840 - RNA, 46 nt, Mus musculus
gauaucccagaagaaacugaagaaacaaaaacucauggccugggaa

SEQ ID NO: 115841 - RNA, 45 nt, Mus musculus; identical to SEQ ID NO: 47799

SEQ ID NO: 115842 - RNA, 45 nt, Mus musculus
acccgagacugcugucucauagugaacuuucuguauaaucugcuc

SEQ ID NO: 115843 - RNA, 46 nt, Mus musculus
gcuggaggcucucggcggcugggugagaccacuggaggagggugac

SEQ ID NO: 115844 - RNA, 40 nt, Mus musculus
auacugggcaagaacuaagugagccacaucuccagcccag

SEQ ID NO: 115845 - RNA, 45 nt, Mus musculus
uauuuaugcucaccaccaccaccaccccgggggguccagccauua

SEQ ID NO: 115846 - RNA, 45 nt, Mus musculus
aaaggaguccacgauguuaaguguuuguggaaucuuaaaagagag

SEQ ID NO: 115847 - RNA, 54 nt, Mus musculus
ugacugggacugaguggugugacaguuuaggaugggaaagggaagaguuuugaa

SEQ ID NO: 115848 - RNA, 46 nt, Mus musculus
agcuugcagcuuuguccuacauuauagcaaaucaaaaugccaccag

SEQ ID NO: 115849 - RNA, 46 nt, Mus musculus
ugguggccauaggagacacaaauuagaaaucacauccuaggaacug

SEQ ID NO: 115850 - RNA, 46 nt, Mus musculus
caugcuaacccaaaguuucuaacagugauaacuuucuccccaggga

SEQ ID NO: 115851 - RNA, 45 nt, Mus musculus
aacuccccaacaauggucagcagcagcugugaaugggaguccaag

SEQ ID NO: 115852 - RNA, 45 nt, Mus musculus
ggaaucgggaguauaaagccaacaaaggcaacauacacagcagau

SEQ ID NO: 115853 - RNA, 45 nt, Mus musculus
gagaucugacgcccucuuguggagugucugaagacagcuacagug

SEQ ID NO: 115854 - RNA, 45 nt, Mus musculus
ggcucccaaccauccauaaugaaaucugaugcccucuucuggagu

SEQ ID NO: 115855 - RNA, 45 nt, Mus musculus
ucgagaaacacagcauccagggauacucugaauuacagcccgaga

SEQ ID NO: 115856 - RNA, 41 nt, Mus musculus
ugaacaagccacgaggagaaagccuguaagcaccacuccuc

SEQ ID NO: 115857 - RNA, 42 nt, Mus musculus
agaaagcaagccugugggauuccccuggagagacgcagccag

SEQ ID NO: 115858 - RNA, 45 nt, Mus musculus
gaaacugucugggaaagaaaaaggugugggguguggggugaagac

SEQ ID NO: 115859 - RNA, 45 nt, Mus musculus
uccuaacacccaugucaggaggcuuacaaaccugugacuccagcu

SEQ ID NO: 115860 - RNA, 45 nt, Mus musculus
gaaaugaaucuaggcaucaaaaacuccuguggaggggcuggagga

SEQ ID NO: 115861 - RNA, 46 nt, Mus musculus
uauggguggguaccaugacgccugaacucuccccuacaucuuagaa

SEQ ID NO: 115862 - RNA, 36 nt, Mus musculus
aaagcucuuagacaagguacagcaucagcccaaggu

SEQ ID NO: 115863 - RNA, 46 nt, Mus musculus
aagauagcuaaauacagagaacaacauucaaaugcaggccugagaa

SEQ ID NO: 115864 - RNA, 45 nt, Mus musculus
gcuaaaaacacuuguauuuaaaaucuaggcaauguuuccgggcua

SEQ ID NO: 115865 - RNA, 45 nt, Mus musculus
gauccuggagaauaaagggaauggggagagauacaggggaugaga

SEQ ID NO: 115866 - RNA, 46 nt, Mus musculus
aaaagauucuagggguauugagucucucauguugagaagggggugu

SEQ ID NO: 115867 - RNA, 46 nt, Mus musculus
ccugaacuaaacauaagaaacaaugugaggaagaacucagccggca

SEQ ID NO: 115868 - RNA, 41 nt, Mus musculus
agaucgugugugugugugugucugugugugucugugugugu

SEQ ID NO: 115869 - RNA, 47 nt, Mus musculus
gugucaguagaucgugugugugugugucugugugugugugugugugu

SEQ ID NO: 115870 - RNA, 51 nt, Mus musculus
ugugucuguguguguguguguaugugugugugucuguguaucugugugugu

SEQ ID NO: 115871 - RNA, 46 nt, Mus musculus
uccuccuuuuccaaaaaaaaaaagugugugugugugugugugugug

SEQ ID NO: 115872 - RNA, 30 nt, Mus musculus
ccucccaaauuugccucuucccaagaucca

SEQ ID NO: 115873 - RNA, 46 nt, Mus musculus
aucaaggcuggacaaggcaacccaguagggggaaaagagucccaag

SEQ ID NO: 115874 - RNA, 81 nt, Mus musculus
ggccuuagcucagaccguacggauccaugauuaucugaucaguuucugugagccccagugaguuccaccuaguucauucua

SEQ ID NO: 115875 - RNA, 45 nt, Mus musculus
agcauugcuuucuuuaguuuuaaaaccuucuugaucccggcagau

SEQ ID NO: 115876 - RNA, 45 nt, Mus musculus
aaauauuuuaaaauucauuucaguuuacuaauuuaaagauauaga

SEQ ID NO: 115877 - RNA, 42 nt, Mus musculus
uuugucuguuugagacuguguagccuuggguggccuggaaau

SEQ ID NO: 115878 - RNA, 46 nt, Mus musculus
aaucccaccacucaggcaaaagcaggaggauugcaaacuugaggug

SEQ ID NO: 115879 - RNA, 48 nt, Mus musculus
ugagaucugaugcccucuucuagggugucugaagacagcuacagugga

SEQ ID NO: 115880 - RNA, 64 nt, Mus musculus
aggaguuaggacuggaugugcauacaugaguucaaagggcgagaugaggagaggucacuugggg

SEQ ID NO: 115881 - RNA, 32 nt, Mus musculus
cacaauaggacaaugcuuggcuguuaggauga

SEQ ID NO: 115882 - RNA, 41 nt, Mus musculus
gaaggucgaggaagaagauuggaaauauuaagaggcgggca

SEQ ID NO: 115883 - RNA, 44 nt, Mus musculus
gaggcagaacaguccagguaagcugaguagaaaaguggguguca

SEQ ID NO: 115884 - RNA, 46 nt, Mus musculus
cuuguucugccacauggcacgcagcagggacaccauuuguaaacug

SEQ ID NO: 115885 - RNA, 45 nt, Mus musculus
acagaaacccucacuaauacugcaggaagcaaacccaagcaugga

SEQ ID NO: 115886 - RNA, 46 nt, Mus musculus
gguugacucucaaccucaccuaacuggcugcuauacuggcuguuag

SEQ ID NO: 115887 - RNA, 46 nt, Mus musculus
cuuaaaacaguccgacuuggugcguuuuuagacguuuaaauugcag

SEQ ID NO: 115888 - RNA, 46 nt, Mus musculus
aggaaaggcacccagguuccauaaggagcauccucuaugcccugag

SEQ ID NO: 115889 - RNA, 45 nt, Mus musculus
aaauacugaagguguccauuauuaaaugauaucgacuagccgccc

SEQ ID NO: 115890 - RNA, 74 nt, Mus musculus
uauggaguaccaggggacagucauggagacuuugaucagauuggaaagccaggaggaagcaggaagcagucggg

SEQ ID NO: 115891 - RNA, 46 nt, Mus musculus
uuucugccugggguugugugugugugugugugugugugugugugug

SEQ ID NO: 115892 - RNA, 46 nt, Mus musculus
uuaacuacugaauacagguguuaaagaaauuauucuuggggcuuaa

SEQ ID NO: 115893 - RNA, 46 nt, Mus musculus
aagaaagaaagagagagagagagagagagagagagagagaaaccag

SEQ ID NO: 115894 - RNA, 42 nt, Mus musculus
cccccccccccccaaccccacaaaaucuacuacucagccuag

SEQ ID NO: 115895 - RNA, 32 nt, Mus musculus
ugagcuucuuuguaacauggauagaacuggag

SEQ ID NO: 115896 - RNA, 44 nt, Mus musculus
ugugucagggugguguuugcagauagagugcuguucacuuggag

SEQ ID NO: 115897 - RNA, 45 nt, Mus musculus
cucuggagggcuccgggagcagggcuggcuaggaacuuguguuua

SEQ ID NO: 115898 - RNA, 46 nt, Mus musculus
ggaagggcucgcgugagagcacuguagauauugcuggggccuggag

SEQ ID NO: 115899 - RNA, 41 nt, Mus musculus
ccuugucacugucaguggaguugauaagaaauuagccagag

SEQ ID NO: 115900 - RNA, 46 nt, Mus musculus
uaagaauuaaugucuguggugguagaguuugguuucauuuggagag

SEQ ID NO: 115901 - RNA, 45 nt, Mus musculus
uauuguuuuuaaggaccagaaaagcccgugucuuuguucugagua

SEQ ID NO: 115902 - RNA, 45 nt, Mus musculus
ccucaaacgaacaaaccacacugcaacgcuaguaccacauaucac

SEQ ID NO: 115903 - RNA, 46 nt, Mus musculus
cuagcaugcgcuuggguuucuucccuuucuuuguccugccuaggag

SEQ ID NO: 115904 - RNA, 44 nt, Mus musculus
gccucagugugugccuucaguguugcauguuucacaagcccaga

SEQ ID NO: 115905 - RNA, 45 nt, Mus musculus
acaaaaauucucugaacugagccagaauaaacccuuccgccccuc

SEQ ID NO: 115906 - RNA, 42 nt, Mus musculus
cacauaacuuaucuaccucuuaugaccaaaaccagccagccc

SEQ ID NO: 115907 - RNA, 46 nt, Mus musculus
gcaugguggcuaucuuuuucuccccuuccucagucucuugcccagg

SEQ ID NO: 115908 - RNA, 46 nt, Mus musculus
uccauucuuaacucuagagccagagcuacauggcugaagcugccga

SEQ ID NO: 115909 - RNA, 46 nt, Mus musculus
uauauuaucacuagcuuuauguuuucuaaauccuucacugcccaag

SEQ ID NO: 115910 - RNA, 45 nt, Mus musculus
uggauuuaaucuagcuggguagaaucuugccccaaggucccacuc

SEQ ID NO: 115911 - RNA, 23 nt, Mus musculus
gucaggagcuuugaagacauuuc

SEQ ID NO: 115912 - RNA, 46 nt, Mus musculus
ccagaucaccgugcuccaugucuaccaccacgcuaccaugcucaac

SEQ ID NO: 115913 - RNA, 41 nt, Mus musculus
gucuggugagaggggaggaagagaucuuaagggagguagga

SEQ ID NO: 115914 - RNA, 45 nt, Mus musculus
auacgauuuucucacauuucugggcucucaucgacccccgcgcua

SEQ ID NO: 115915 - RNA, 44 nt, Mus musculus
agaaaaacacacaugccuuaagacuuaaaaaagcagggcccaga

SEQ ID NO: 115916 - RNA, 46 nt, Mus musculus
acagaucuuauuuuuuuauuuugagugccacuauuaauguguuuaa

SEQ ID NO: 115917 - RNA, 90 nt, Mus musculus
caggagauaaaaaggccauucgacuucccaccacuuggagagagagaacuaccuuucaggaaaggugacgagacauuuauuaucugacag

SEQ ID NO: 115918 - RNA, 46 nt, Mus musculus
uacuuugacauacacuuccuuuuaaaaugugccuaauuuaccaaga

SEQ ID NO: 115919 - RNA, 36 nt, Mus musculus
agcuggagcgcgcaggaacuggguguuugggagcaa

SEQ ID NO: 115920 - RNA, 46 nt, Mus musculus
ucuguuuggaaggaguugcggcaucuguuuacauuucccuugucag

SEQ ID NO: 115921 - RNA, 51 nt, Mus musculus
uguguguguguaacauuguuuaaauuacuagagggugugagaauccagaga

SEQ ID NO: 115922 - RNA, 46 nt, Mus musculus
gcaaccacauggugguucacaaccaucuguaaugugaugcccucuu

SEQ ID NO: 115923 - RNA, 46 nt, Mus musculus
uaugucucuuugguuuugguuuugguuuugguuuugguuuugguuu

SEQ ID NO: 115924 - RNA, 24 nt, Mus musculus
gucaccuacggauguugucaagag

SEQ ID NO: 115925 - RNA, 48 nt, Mus musculus
ccaccgggacuuaaaacccgagaaccuccucugcaugggaccagaacu

SEQ ID NO: 115926 - RNA, 45 nt, Mus musculus
gcuguggcucucaugggugcaacgaccaguuuucaguuggauuua

SEQ ID NO: 115927 - RNA, 45 nt, Mus musculus
cuggucacagcuaucugggaacacuuaauugcccuucucucauga

SEQ ID NO: 115928 - RNA, 45 nt, Mus musculus
gguaaaauaaaagaaaaaaaaaagugugcccucccuugacgagag

SEQ ID NO: 115929 - RNA, 46 nt, Mus musculus
cuugugaguuugaggcuagccuggucuacauaaugaguuccaggac

SEQ ID NO: 115930 - RNA, 45 nt, Mus musculus
cugccauuaaaguaguagagcuuagguuuggcugccaugacuccu

SEQ ID NO: 115931 - RNA, 45 nt, Mus musculus
gaaggaaacuuggcugggaagagaaagcauucaguggaaggaaga

SEQ ID NO: 115932 - RNA, 42 nt, Mus musculus
cagcauaagacugggccugucaauguucagucauggggagaa

SEQ ID NO: 115933 - RNA, 34 nt, Mus musculus
agaagcuagaaaagggaggggaggggacucaaga

SEQ ID NO: 115934 - RNA, 42 nt, Mus musculus
aagccaaacacgaugguccacacucaagaugcugaggcagga

SEQ ID NO: 115935 - RNA, 47 nt, Mus musculus
ccauacaaguuguacuuggcagcgagguagcugaggauggcccuggu

SEQ ID NO: 115936 - RNA, 41 nt, Mus musculus
uagaacugucugcaugucaugagaagguuagaacacccaga

SEQ ID NO: 115937 - RNA, 42 nt, Mus musculus
agaguggcccauuggaaaggaaccuuggacuguaagccagau

SEQ ID NO: 115938 - RNA, 46 nt, Mus musculus
uaucaaaucauagcucuccucuuuuuccuuggggguuuuaaaugga

SEQ ID NO: 115939 - RNA, 45 nt, Mus musculus
uuuugugugaggugugugugugugugugugugugugugugugugu

SEQ ID NO: 115940 - RNA, 46 nt, Mus musculus
caccuuaaagcacgcugcacuagaacuucaggacaguccugaccac

SEQ ID NO: 115941 - RNA, 46 nt, Mus musculus
gaagacgagaucaagcuuauccaccacgcacggcccacagcuccag

SEQ ID NO: 115942 - RNA, 44 nt, Mus musculus
ggaaucugggaagacuggugccuauggcugagcaggggggguua

SEQ ID NO: 115943 - RNA, 41 nt, Mus musculus
cgacgccgcggccugugcagcugagucuggaacgacgugcg

SEQ ID NO: 115944 - RNA, 46 nt, Mus musculus
uacuucccuuauaaaaaugcuugccaacucucccugacaccuagac

SEQ ID NO: 115945 - RNA, 24 nt, Mus musculus
caagcaugguggaaggcuaaaacu

SEQ ID NO: 115946 - RNA, 44 nt, Mus musculus
cacaaacacacacucacacacacacacacacacuuaccacaaau

SEQ ID NO: 115947 - RNA, 45 nt, Mus musculus
ggguauaguaacacacaucuauaaucccaggauuggagagggaga

SEQ ID NO: 115948 - RNA, 24 nt, Mus musculus
ucaauggcacuuccuggccaaggg

SEQ ID NO: 115949 - RNA, 46 nt, Mus musculus
guugugagccaucgugugguugcugggauuugaacucagaaccuuc

SEQ ID NO: 115950 - RNA, 45 nt, Mus musculus
ugcgugcguguguguguguguguguguguguguguaugugcgugu

SEQ ID NO: 115951 - RNA, 44 nt, Mus musculus
agagcaucagaaauucagauaaauguagauuuggggcccagaga

SEQ ID NO: 115952 - RNA, 46 nt, Mus musculus; identical to SEQ ID NO: 73891

SEQ ID NO: 115953 - RNA, 46 nt, Mus musculus
auuuaagggucaaguggaacuuuucaacuauaagcguucggagaau

SEQ ID NO: 115954 - RNA, 44 nt, Mus musculus
ucuucagcuugucaacaucaaauuaguguaucuuuggguuggau

SEQ ID NO: 115955 - RNA, 46 nt, Mus musculus
ugcacgcacgccugugagcccagcccuugggaggccaaggcaagag

SEQ ID NO: 115956 - RNA, 47 nt, Mus musculus
gauuuauuuacccuagaggggagggaauaagagacaaagacaggaga

SEQ ID NO: 115957 - RNA, 46 nt, Mus musculus
ccuggggcuaaucuacaaguggaugugagccaucugacguggaggc

SEQ ID NO: 115958 - RNA, 41 nt, Mus musculus
gugugugugugugugugugugucugagugugugugcuguug

SEQ ID NO: 115959 - RNA, 46 nt, Mus musculus
aucccuuugcugagcuauucucaugggguaguccuugucuguagau

SEQ ID NO: 115960 - RNA, 45 nt, Mus musculus
uuuaauguugauggaaauaagucaaugaaaaaccaacuugcagag

SEQ ID NO: 115961 - RNA, 55 nt, Mus musculus
cuguguccuuaaccacugagccaucuucuccagcccagaaaacaucuucuaacgg

SEQ ID NO: 115962 - RNA, 46 nt, Mus musculus
gaguuccaggauagcuagagcuacacagagaaaccccgccucagag

SEQ ID NO: 115963 - RNA, 46 nt, Mus musculus
gugauuaguucccaggugcugcugaaaacccuguuaccuagcagga

SEQ ID NO: 115964 - RNA, 23 nt, Mus musculus
aggauugugaauguacggggagu

SEQ ID NO: 115965 - RNA, 46 nt, Mus musculus
acuguacuuaaaugugccuaaagcaaacgguccuuccgggcggggu

SEQ ID NO: 115966 - RNA, 29 nt, Mus musculus
accugugcuaucuguagggccaggccaca

SEQ ID NO: 115967 - RNA, 41 nt, Mus musculus
gacaaaucggcuuggacacauucaaggauauaggugugaga

SEQ ID NO: 115968 - RNA, 23 nt, Mus musculus
gucaauaagcaaaggggccaaag

SEQ ID NO: 115969 - RNA, 36 nt, Mus musculus
caucaagugagauagaaguuuaugcaucucugugac

SEQ ID NO: 115970 - RNA, 42 nt, Mus musculus
ccacagauuuugugaaaguacauuaauuaguguaguguguag

SEQ ID NO: 115971 - RNA, 46 nt, Mus musculus
ugguggaaauagaaagcagauccuggaagaauuugggcuggguuac

SEQ ID NO: 115972 - RNA, 46 nt, Mus musculus
uugaaagauugggccaguucuagucucaaacacugaaugcauccag

SEQ ID NO: 115973 - RNA, 46 nt, Mus musculus
ggguccaugccauccuaucaggaagcauugugggucaaagugggag

SEQ ID NO: 115974 - RNA, 42 nt, Mus musculus
cucauucagacagacaaggcauucuacaagccgaagcaggaa

SEQ ID NO: 115975 - RNA, 45 nt, Mus musculus
acacaguuugcucuuaaguucuuuucauaauucauuuuaggcaag

SEQ ID NO: 115976 - RNA, 46 nt, Mus musculus
cacaguuccuuaaagaagauggagcaaagcaaaugauuaugcuaaa

SEQ ID NO: 115977 - RNA, 42 nt, Mus musculus
acaaugaggaaucaagcaagacaauagucaaggaacaagcaa

SEQ ID NO: 115978 - RNA, 46 nt, Mus musculus
aagggaagucugucacuuacauuuuuaccuuugucuuuuuggggaa

SEQ ID NO: 115979 - RNA, 48 nt, Mus musculus
uuugauaauuaugagaugaaaaagguaaugaauuugaaaccgcuaacg

SEQ ID NO: 115980 - RNA, 45 nt, Mus musculus
agauuuguaguguuuuaaauguuggagcacauuggugggagguag

SEQ ID NO: 115981 - RNA, 92 nt, Mus musculus
aggugugagccuaggaggcauccuguggugguggcaauggagguggagaggaagggcagagaaauauaggucuugguacucaaugaacuuag

SEQ ID NO: 115982 - RNA, 62 nt, Mus musculus
ggugaaggucagccgcucugauggcaaucaacuaacuccugaagaaauagaaaaugauuugg

SEQ ID NO: 115983 - RNA, 79 nt, Mus musculus
ucacaguagugacccagcggaaaaauaaccacccugagagucagagagaucaggaaauggauuauauccagaccguaaa

SEQ ID NO: 115984 - RNA, 45 nt, Mus musculus
uugaugguacaaguucugugacaguccacaguauguucaccucuc

SEQ ID NO: 115985 - RNA, 42 nt, Mus musculus
cuagguggggucaccuuuugauuugaugguuaguggcaacag

SEQ ID NO: 115986 - RNA, 49 nt, Mus musculus
uccugggcuccaaaggccuguauaaucgcauauuauauugcagaggaug

SEQ ID NO: 115987 - RNA, 46 nt, Mus musculus
ucuuagguaaagcuguuuuggaguaaaccuacagucaagccaucug

SEQ ID NO: 115988 - RNA, 42 nt, Mus musculus
augaacuggaacuuuauaacacagaauauuaucuaggcaugu

SEQ ID NO: 115989 - RNA, 41 nt, Mus musculus
gguccuaaggguagagccgcauuaacaggacacagggggug

SEQ ID NO: 115990 - RNA, 41 nt, Mus musculus
auuuccagcaaccacaugguggcucacaaccaucuguggga

SEQ ID NO: 115991 - RNA, 43 nt, Mus musculus
gcagaggaagagaggcagagaggcagagaggcagagaggcaga

SEQ ID NO: 115992 - RNA, 46 nt, Mus musculus
acagcuuugauauuuuaaugacuucaaaugacaccaauggcaccau

SEQ ID NO: 115993 - RNA, 70 nt, Mus musculus
cuugggagagauucccaucacagugacggcugccucacccacugccucugaugcugucacccagacaauu

SEQ ID NO: 115994 - RNA, 45 nt, Mus musculus
ugucuuauuggaucugacagauagcaacguagaaaguaagcagca

SEQ ID NO: 115995 - RNA, 61 nt, Mus musculus
uuuacauuuuggauuaucugacuaaacagaaacagcugacaguuaauuuaaaagaaaaggc

SEQ ID NO: 115996 - RNA, 49 nt, Mus musculus
gcgugugugugcgugcguauguauguguguguguguguguguguguaug

SEQ ID NO: 115997 - RNA, 43 nt, Mus musculus
uuaaugcacauaagaaauucaauggugaauuuugggagccagg

SEQ ID NO: 115998 - RNA, 45 nt, Mus musculus
gguuuagucccuggguacucugugugugucugugugugugugugu

SEQ ID NO: 115999 - RNA, 41 nt, Mus musculus
ucugucugugugugugucugugugugugugugugucugguu

SEQ ID NO: 116000 - RNA, 67 nt, Mus musculus
gauguacaagacucaaucaaguuuuuggaauuugaauucagcagaggaauuucggacaauuauaccu

SEQ ID NO: 116001 - RNA, 67 nt, Mus musculus
uagcaauuauauccuaugcccuguccacagucgggagcccuaaagcagaggaggcuuugaacuugcu

SEQ ID NO: 116002 - RNA, 24 nt, Mus musculus
auggguagguagauggguguuuug

SEQ ID NO: 116003 - RNA, 46 nt, Mus musculus
aaguacagauguuacucuuccaaagguucuuauaaaguagucagag

SEQ ID NO: 116004 - RNA, 42 nt, Mus musculus
aguguguguguguguguguguguauguagugugugugugugu

SEQ ID NO: 116005 - RNA, 44 nt, Mus musculus
ucugagggaaucccgguuaugagguggcucauccagcaaagaaa

SEQ ID NO: 116006 - RNA, 44 nt, Mus musculus
aaauacagauauccaacugaccgucacagggcccggcaucccca

SEQ ID NO: 116007 - RNA, 45 nt, Mus musculus
accaggaagagguaaagacagggguggucguuuaaaaccugcgua

SEQ ID NO: 116008 - RNA, 44 nt, Mus musculus
guuaauguuucugcgcauggcucgggauuugcuauuugccaggu

SEQ ID NO: 116009 - RNA, 43 nt, Mus musculus
guugacuauaacgugaaagguucagguucuucuaaaagacgga

SEQ ID NO: 116010 - RNA, 47 nt, Mus musculus
ggcuuuagugcaucuucagauucaauuccucugagugagacccugaa

SEQ ID NO: 116011 - RNA, 46 nt, Mus musculus
uuauuuagauucuguaaguaguaagauguuucauaagccuuuauug

SEQ ID NO: 116012 - RNA, 45 nt, Mus musculus
cacacagagagagagagagggagagagagagagagagaucuagag

SEQ ID NO: 116013 - RNA, 52 nt, Mus musculus
acaacacccaggugaagcuguccucauguuaccucaguccagacaccaacug

SEQ ID NO: 116014 - RNA, 46 nt, Mus musculus
gcacguaaaacaauucacccaaucuuuguguggaagaugaccagga

SEQ ID NO: 116015 - RNA, 42 nt, Mus musculus
uauccaguccuucagcaucugcccugguguuaucaucgcagc

SEQ ID NO: 116016 - RNA, 46 nt, Mus musculus
cugagcuugaagaccucagagagucaggacacaauucugcccgaag

SEQ ID NO: 116017 - RNA, 46 nt, Mus musculus
agucauuaagaagauucuuguguucucagucaaauuuauucuggag

SEQ ID NO: 116018 - RNA, 45 nt, Mus musculus
aaauaaccuaaaaaauguauuuuaaaagucauccagugaacagcg

SEQ ID NO: 116019 - RNA, 45 nt, Mus musculus
uucauuugguggaaauucuuaucacuauauacaaggggggaauau

SEQ ID NO: 116020 - RNA, 41 nt, Mus musculus
aaucuugguccucuacuauaccauuuugaaaaucuggcaaa

SEQ ID NO: 116021 - RNA, 46 nt, Mus musculus
uauaaacuuuaucccuggauccaucaguuuagcaauaaucggagau

SEQ ID NO: 116022 - RNA, 48 nt, Mus musculus
acauggauaaguuaaaaucuacacugaaacaguuuguaagagacugga

SEQ ID NO: 116023 - RNA, 45 nt, Mus musculus
ccagcagaaacugcuuccucaguuuccucuucacuuggacaagau

SEQ ID NO: 116024 - RNA, 46 nt, Mus musculus
aagacuaugaacauagaauugcugcuuuuauauuuuaacugcagau

SEQ ID NO: 116025 - RNA, 47 nt, Mus musculus
agaaugcucuuuagucuuuuaacaaccacagaccuuaagccucguag

SEQ ID NO: 116026 - RNA, 46 nt, Mus musculus
uucuuagaacaaaugcaguucaauugcaucccauuuccagucauuc

SEQ ID NO: 116027 - RNA, 65 nt, Mus musculus
gggcagugaaccugaaaucacggguucacugaggugggaggugcugggauucucaaucacagguc

SEQ ID NO: 116028 - RNA, 48 nt, Mus musculus
gcugugcguguauaccuuccaagucaugccauaacuguaauguugaau

SEQ ID NO: 116029 - RNA, 46 nt, Mus musculus
gcaaugcaaugcaucuauuuaugguugugagauuaaggguggagug

SEQ ID NO: 116030 - RNA, 45 nt, Mus musculus
ugauccuucccagguuuugugcaaugauuguguuuacugcuggau

SEQ ID NO: 116031 - RNA, 46 nt, Mus musculus
caguacucucuguguguauuuuuauuuggguuucuuaacugcaauu

SEQ ID NO: 116032 - RNA, 42 nt, Mus musculus
acagagucaugccauguugagacagacaauuaaccugguuga

SEQ ID NO: 116033 - RNA, 42 nt, Mus musculus
acguagaacaccaucuuuuaaaaaguucaaacauagccagga

SEQ ID NO: 116034 - RNA, 46 nt, Mus musculus
acgugcuuauuagaaaaugagucuguauggaaaucucgcggcagau

SEQ ID NO: 116035 - RNA, 45 nt, Mus musculus
gugugugugugugugugugugugugugugugugugagggauuggg

SEQ ID NO: 116036 - RNA, 87 nt, Mus musculus
cagauuccaaaugauuaccacucaagucgaaaccagccuggcccaccagggccuccagggcccccuggcagugcuggagccagagga

SEQ ID NO: 116037 - RNA, 46 nt, Mus musculus
augaugcgagcgguugcaagacaagucugcgaacaacugaucagug

SEQ ID NO: 116038 - RNA, 46 nt, Mus musculus
agggaaugaaaggugaugcaggagagccaggccuuccgggacggac

SEQ ID NO: 116039 - RNA, 69 nt, Mus musculus
cagagcuuugacauugucugcagcccaguguggaccaguagagacagaugcugugauauucccucuagg

SEQ ID NO: 116040 - RNA, 46 nt, Mus musculus
uggugcacaccguuaaucccagcacuuggaggcagaggcagaggca

SEQ ID NO: 116041 - RNA, 46 nt, Mus musculus
aacaacugauggcuacgaaauucuuggaaaacuucuuaaaggagag

SEQ ID NO: 116042 - RNA, 47 nt, Mus musculus
guguuaagauuuauauugacugcuaugaaauuauagaaaaagacauc

SEQ ID NO: 116043 - RNA, 47 nt, Mus musculus
aaggauacaagaggggagguacaaacuguuacauuugacacagauga

SEQ ID NO: 116044 - RNA, 45 nt, Mus musculus
ugagucuuggaagcagugaugcagauguuuugguuagggcugacu

SEQ ID NO: 116045 - RNA, 49 nt, Mus musculus
aaacuccuagugaccccuuugcaauuuggcaaauuacagacagagacua

SEQ ID NO: 116046 - RNA, 45 nt, Mus musculus
agccuacagacuucagaagaaugccuuuaucaaucagcccacagc

SEQ ID NO: 116047 - RNA, 79 nt, Mus musculus
ugccaacauugccagcaagcccagcgagaggcauguauucaucguggaugacuuugaaucuuuugagaagauugaggac

SEQ ID NO: 116048 - RNA, 39 nt, Mus musculus
uaucaaggagaaggucuugaccugggagagcggcaugag

SEQ ID NO: 116049 - RNA, 64 nt, Mus musculus
cauacaacgauaaagcucuagcccucggagcccuccagaacauucgcuacagaggaggaaacac

SEQ ID NO: 116050 - RNA, 43 nt, Mus musculus
aacaaaguuguaaaauuuaucuuuaauacugugggggccuuug

SEQ ID NO: 116051 - RNA, 46 nt, Mus musculus
gaggaucagagaccagucauugcuucacuggucucuccccggaggc

SEQ ID NO: 116052 - RNA, 48 nt, Mus musculus
ucaccgggcagccaccuccuacaggcuaaagcugaguccugcagaugg

SEQ ID NO: 116053 - RNA, 49 nt, Mus musculus
uuaugcacaguaugacucuggacucagcguuccccucacagaucaaggc

SEQ ID NO: 116054 - RNA, 46 nt, Mus musculus
ugaaucuuaaugcagaaacacagaagcaaaaugauaggcacccuuu

SEQ ID NO: 116055 - RNA, 64 nt, Mus musculus
gaagaaacaauguaauacugcagcccuugcaaccugacacuccauauaaaauuacugucauugc

SEQ ID NO: 116056 - RNA, 45 nt, Mus musculus
aguucagcaauacaggaucaucuacucuccuacugucggcgaucc

SEQ ID NO: 116057 - RNA, 44 nt, Mus musculus
aggaugaucuuguuggacaucaaugggaggagaggcccuugguc

SEQ ID NO: 116058 - RNA, 41 nt, Mus musculus
cgcauuguguacuccccuguugcugguacaagacccucaga

SEQ ID NO: 116059 - RNA, 44 nt, Mus musculus
gugguuccggucuauacagaaggugauggcgggcgcacaucaga

SEQ ID NO: 116060 - RNA, 46 nt, Mus musculus
ccgggaauaccaacuaugccauucuuaggaaccugcagccagauac

SEQ ID NO: 116061 - RNA, 46 nt, Mus musculus
caucacgguguauucccaguaucccgauggugaagguggccggaug

SEQ ID NO: 116062 - RNA, 42 nt, Mus musculus
uacuccguaugaagucuccaucaccgccaucuauccugauga

SEQ ID NO: 116063 - RNA, 45 nt, Mus musculus
agaugugucucucuacaggauaacuugggcaccuguugggaaccc

SEQ ID NO: 116064 - RNA, 46 nt, Mus musculus
gaugagggcacaucucccccagcaacugcauaugacacaacccgug

SEQ ID NO: 116065 - RNA, 45 nt, Mus musculus
cgucacagugucuguuuaguuucuguuucagugaccuguccagug

SEQ ID NO: 116066 - RNA, 42 nt, Mus musculus
cuguaugaccucacuagugaaccugccaaagcucgggaaguc

SEQ ID NO: 116067 - RNA, 42 nt, Mus musculus
cugaauauuuaugauguuggccccaccacuaugcaugugcaa

SEQ ID NO: 116068 - RNA, 96 nt, Mus musculus
cgacuagacacuagcacagugcugaaggaccugaagccugagacugacuauguggugaacguguacucugugguugaagaugaguacagugagccu

SEQ ID NO: 116069 - RNA, 47 nt, Mus musculus
uuuuagagugagcuggacacccccuucugacaguguggacagauaca

SEQ ID NO: 116070 - RNA, 75 nt, Mus musculus
gcagauuuugagucauuguccaagauuguggaugaccucaccaucaacuuguguaacagugucaagggcccuggu

SEQ ID NO: 116071 - RNA, 68 nt, Mus musculus
agaaugcugaugaaguugaguuaaagaugauugccacugauccagaugacacucacgcauacaaugug

SEQ ID NO: 116072 - RNA, 52 nt, Mus musculus
aucacaagaugauguggaggcuccauccaagaaacucaaggaugaaggcgug

SEQ ID NO: 116073 - RNA, 45 nt, Mus musculus
aauuucauucgccaacagagcuucaagacucaagcuggcaugagg

SEQ ID NO: 116074 - RNA, 48 nt, Mus musculus
acaguggagaccccagaacagaguggcaguuaaaugcucauagagaca

SEQ ID NO: 116075 - RNA, 32 nt, Mus musculus
auuguagaagucuuugaaauuggccccaaaag

SEQ ID NO: 116076 - RNA, 55 nt, Mus musculus
gcaggcaccaccuauagagucaauguuuuugggauguuugauggaggagaaaguu

SEQ ID NO: 116077 - RNA, 46 nt, Mus musculus
cuuggggaguugguccuuggaccauaugacaacacaguugucuugg

SEQ ID NO: 116078 - RNA, 50 nt, Mus musculus
caguucucccaauguacaagacaggagaaggaaagcucaggcaaggcuca

SEQ ID NO: 116079 - RNA, 80 nt, Mus musculus
aguaucucaagauuccaaaaucuuaagaguggaugaagaaacagaacacacgaugagaguuaccuggaaagcagcaccgg

SEQ ID NO: 116080 - RNA, 48 nt, Mus musculus
accaaguacaaaauuucaguuuucgcaacuuacagcaguggagaagga

SEQ ID NO: 116081 - RNA, 56 nt, Mus musculus
uggcucaccucagaaccuaguuaccaaagacaucacagacacaucaaucggagccu

SEQ ID NO: 116082 - RNA, 71 nt, Mus musculus
uaccauguugaggaaauugaaggaagggacacaguaugacuuaucugugacagcacuguaugcgucugggg

SEQ ID NO: 116083 - RNA, 103 nt, Mus musculus
cuuggaguagggcaccaggaaaggugaagcaauaucuugucacauacaccccagcagcaggaggugaaacucaggaggucacugugagaggagauacaaccac

SEQ ID NO: 116084 - RNA, 47 nt, Mus musculus
aauauuccucgggaccuggaucuccacugacaggaaaugcagccacu

SEQ ID NO: 116085 - RNA, 51 nt, Mus musculus
uuucugguggagaaagcaaagaagugaguaccccagccaaucagaggagga

SEQ ID NO: 116086 - RNA, 74 nt, Mus musculus
ccacgaaaccugaaggugacagaugagacuacggacaguuuuaaacuuaccuggucccaagcuccagggagagu

SEQ ID NO: 116087 - RNA, 52 nt, Mus musculus
gccgaguaugaggacggcuucaguguuccuauaacuggggaggagaccacug

SEQ ID NO: 116088 - RNA, 46 nt, Mus musculus
uggagacaaugucuuuucguaucacgucacauacaaggaugcuaau

SEQ ID NO: 116089 - RNA, 46 nt, Mus musculus
cucacacaguccaucugucuuagaauugagcaagaguuggcagcua

SEQ ID NO: 116090 - RNA, 45 nt, Mus musculus
uuucagggauccugcuauaaaacucaggaacuccgacguggagau

SEQ ID NO: 116091 - RNA, 49 nt, Mus musculus
acaggggaggauccacaaacacaggcaaagccaugacuuaugucagaga

SEQ ID NO: 116092 - RNA, 93 nt, Mus musculus
aaguuuugagauuucuccgaacagggugcagauaagccuuguacaguacagcagggacccucacaccgaguucacauugaaggaguucaacag

SEQ ID NO: 116093 - RNA, 56 nt, Mus musculus
auaaaagcugacaucguguuuuugguugaugguuccuauagcaucgggauugcaaa

SEQ ID NO: 116094 - RNA, 79 nt, Mus musculus
cuuacagcggacacggaguaccagaucagcguuuuugccaugaagggccugacguccagugaacccacuucggucaugg

SEQ ID NO: 116095 - RNA, 100 nt, Mus musculus
ugugaccggcuauaagauccuccucacaccaauggcagcgggaagccggcaucacgcuuugaguguggggccccagacgaccacgcucaauguucgugac

SEQ ID NO: 116096 - RNA, 42 nt, Mus musculus
ucaggaguugaugagcagcuuggugagcuggucaguggagaa

SEQ ID NO: 116097 - RNA, 41 nt, Mus musculus
ggcaagucucaggacgaaguggaaauuccagcgcgggagcu

SEQ ID NO: 116098 - RNA, 54 nt, Mus musculus
acagcucagauaccaggacugaauuuaacuuaaaucaguauuaccgaagagaag

SEQ ID NO: 116099 - RNA, 48 nt, Mus musculus
gugccuggaccgaccuaguguuucuuguggacggcuccuggagugugg

SEQ ID NO: 116100 - RNA, 47 nt, Mus musculus
aacaggugguccuacaaagccaggggagaagaaaccuggaaaaacag

SEQ ID NO: 116101 - RNA, 49 nt, Mus musculus
acuauaacuuccuauaaugaaguagaagaaagugugccaguaauagguc

SEQ ID NO: 116102 - RNA, 52 nt, Mus musculus
ggccuacuaaagaauuuacccuugcagcuaguaccacugaaacucuauuauc

SEQ ID NO: 116103 - RNA, 45 nt, Mus musculus
aaaaaacaacaaaaacaaacaaacaaaaagacauuauggccaaag

SEQ ID NO: 116104 - RNA, 59 nt, Mus musculus
uuccgacuugaauuuuaaaauuauagaugaaaauacuguucauaugucaugggagagac

SEQ ID NO: 116105 - RNA, 45 nt, Mus musculus
ucaaugaaguguugcuaagcacuccgauaaauguuuuggcuaaga

SEQ ID NO: 116106 - RNA, 34 nt, Mus musculus
uggcuuuggaagcgauugauuagugugcccgaga

SEQ ID NO: 116107 - RNA, 42 nt, Mus musculus
uggggaucaauauuuauugauguguauuaacugcugccaaua

SEQ ID NO: 116108 - RNA, 45 nt, Mus musculus
gucuucacgugguucaguuucaucaacgcucgauggaccaggaau

SEQ ID NO: 116109 - RNA, 46 nt, Mus musculus
aaucuuugggggaauaauugcauaaaccauaaaaaagaguccagaa

SEQ ID NO: 116110 - RNA, 50 nt, Mus musculus
ggaccaucagcaccacuucacgaaggcauuuugaaaacaagguuccagag

SEQ ID NO: 116111 - RNA, 47 nt, Mus musculus
aagauaaaauuuuaccugauucaaagaaguaagccaaagaacuaaau

SEQ ID NO: 116112 - RNA, 51 nt, Mus musculus
uggcuaugacuguagcucugacguaggcuccaguggggggaucuuggacac

SEQ ID NO: 116113 - RNA, 47 nt, Mus musculus
cugaccuuccguccacucgccccuggcuguuucuggguagucguaga

SEQ ID NO: 116114 - RNA, 45 nt, Mus musculus
cggaaucugcugguagguagcuuuggggguuuggcugguacugga

SEQ ID NO: 116115 - RNA, 45 nt, Mus musculus
guuccguuuccggucugguggcuuucgauuuuuggcguucaguag

SEQ ID NO: 116116 - RNA, 46 nt, Mus musculus
cuuuaugaacacuugaagaaaggcagaugauaccacagaaaccaag

SEQ ID NO: 116117 - RNA, 46 nt, Mus musculus
uggguaagucugggaauugaaaguccaauugauaauccagccacaa

SEQ ID NO: 116118 - RNA, 46 nt, Mus musculus
cuucccuguucuacccugcucugcucagcauccuuuuagccaccac

SEQ ID NO: 116119 - RNA, 42 nt, Mus musculus
cgugggguugucaaucugccaggaacuucuccccuucuguug

SEQ ID NO: 116120 - RNA, 45 nt, Mus musculus
cccucucucccucccucccucccuccuucuuuuccucccgcccag

SEQ ID NO: 116121 - RNA, 43 nt, Mus musculus
ggccauggcgcgagggagaugaccgggagacagagcccagugc

SEQ ID NO: 116122 - RNA, 45 nt, Mus musculus
uauguucaauugcuucuugcuguucuuuuucucccuucggcaggc

SEQ ID NO: 116123 - RNA, 45 nt, Mus musculus; identical to SEQ ID NO: 53113

SEQ ID NO: 116124 - RNA, 72 nt, Mus musculus
auggaggcugaagaguuaauuggcagcagugugacgauugauuccaucaugagcaaaaugagagauauuaaa

SEQ ID NO: 116125 - RNA, 42 nt, Mus musculus
gauuguacauuauaaaccgucacaucuuuauuguaggcacag

SEQ ID NO: 116126 - RNA, 41 nt, Mus musculus
gcaguauucaagagccugaugaugcccgugacuacuuccag

SEQ ID NO: 116127 - RNA, 46 nt, Mus musculus
cuuuugaguuagggccagaacaucuguuuuuuuuuuuuccccugag

SEQ ID NO: 116128 - RNA, 46 nt, Mus musculus
cuuuggcuagucaaguuaacauuuuucauguauuuauuggccacuu

SEQ ID NO: 116129 - RNA, 26 nt, Mus musculus
uucuccagcucacuuggaaauguaca

SEQ ID NO: 116130 - RNA, 76 nt, Mus musculus
guugguaacguaaucuuucaaaucguuucuagucaugccccuuuggaagagucccagucaaucuucuaaacagccc

SEQ ID NO: 116131 - RNA, 46 nt, Mus musculus
auccaguguagugcuuauuauagugugugaggaucuuuauagcagg

SEQ ID NO: 116132 - RNA, 46 nt, Mus musculus
ugaaguccuguucuauuuaggcuucgaauacauauugaugguuaag

SEQ ID NO: 116133 - RNA, 46 nt, Mus musculus
ggcagugauuccuaugaacugagagguuuaaagguauugcgacugu

SEQ ID NO: 116134 - RNA, 46 nt, Mus musculus
ugcugugccccugccuuugucagcuuuacacaggacaugacuaguu

SEQ ID NO: 116135 - RNA, 45 nt, Mus musculus
agagggggcuugggaauacaaaggguuucuguggaggaggaggga

SEQ ID NO: 116136 - RNA, 42 nt, Mus musculus
auacacaauccauauagcuuaagacaacagauaaugaccuaa

SEQ ID NO: 116137 - RNA, 46 nt, Mus musculus
gcuauuuuagacaagguuuaugggaguacccuaaacauauuuacag

SEQ ID NO: 116138 - RNA, 46 nt, Mus musculus
uauuaggucuuuuaucaguuaauauuuuuuauuuauuaaaaaccag

SEQ ID NO: 116139 - RNA, 45 nt, Mus musculus
gggaagaaagcuuaguaaaaugcugcacaagcgugaggaccugag

SEQ ID NO: 116140 - RNA, 45 nt, Mus musculus
augugcuuguaaucuuaaccaagaacagggggauagaggccguag

SEQ ID NO: 116141 - RNA, 41 nt, Mus musculus
uuacucuuaagagguguggccugguuggaguggguguggcu

SEQ ID NO: 116142 - RNA, 52 nt, Mus musculus
gaaacaaaguaugaaugugugcugagcagacacaaacuggaagaucaaacuc

SEQ ID NO: 116143 - RNA, 46 nt, Mus musculus
agaacgaucaccuguuaagaccaggugaugaacaauaauuggcaga

SEQ ID NO: 116144 - RNA, 46 nt, Mus musculus
aacuuugcaggcuuggaauuauauaagaagguacaaagugaaagga

SEQ ID NO: 116145 - RNA, 45 nt, Mus musculus
auggggguggggguaaagaaaugacaguggauguggaggugggag

SEQ ID NO: 116146 - RNA, 41 nt, Mus musculus
gaagcaguaacuaagcagaggauaggacucuuuggggguga

SEQ ID NO: 116147 - RNA, 49 nt, Mus musculus
agcuagcugguuccuuuuauucauguauuaauuuguugcuugguuuauu

SEQ ID NO: 116148 - RNA, 46 nt, Mus musculus
caugucuucuucaagagaaaauucgaaaaucaggaccaagguaccg

SEQ ID NO: 116149 - RNA, 45 nt, Mus musculus
auuuaauacccauaacaauauuccguguuuuguuuuugcuuugga

SEQ ID NO: 116150 - RNA, 42 nt, Mus musculus
uucauuauauuccuuuuauaggcagccaaauggcuaggggag

SEQ ID NO: 116151 - RNA, 45 nt, Mus musculus
cuguagcaauugguauauuucucaaugcacaucucacaccagcca

SEQ ID NO: 116152 - RNA, 46 nt, Mus musculus
acugcaaucucuuagugcggggcuucaggccugccuccgaggagau

SEQ ID NO: 116153 - RNA, 94 nt, Mus musculus
guggagccuuauaucccugucaaacaacaguggcaaaaauguggagcugaaguuuguggauucccugcggaggcaguuugaauucaguguagau

SEQ ID NO: 116154 - RNA, 47 nt, Mus musculus
gaggcuuaugugcagaaaaugguuaaagugugcaaugauucugaccg

SEQ ID NO: 116155 - RNA, 45 nt, Mus musculus
auuaaaguugucugaaggcaauuuaguuccucuuuggcuguaacu

SEQ ID NO: 116156 - RNA, 46 nt, Mus musculus
auugccuguuagacuucuugcccgaaggggugaacaaggagaagau

SEQ ID NO: 116157 - RNA, 45 nt, Mus musculus
gcugcaagugauggugccacagucugugucaccacaaggggagac

SEQ ID NO: 116158 - RNA, 45 nt, Mus musculus
cacccuuauuacauucauacaaaaauccucuuaacuccaauagau

SEQ ID NO: 116159 - RNA, 46 nt, Mus musculus
aagaagagcaggcugagccauugucaagccagcucaucagacagau

SEQ ID NO: 116160 - RNA, 46 nt, Mus musculus
gagucuacagaacucaaaaagguaaacaagcuaaagggcccaaaug

SEQ ID NO: 116161 - RNA, 42 nt, Mus musculus
agaguagguugcauuuacugaacuccaaucauagcugcugga

SEQ ID NO: 116162 - RNA, 45 nt, Mus musculus
ugguccuuaggauacaaaacccuacccucaguuaacucauuuggg

SEQ ID NO: 116163 - RNA, 45 nt, Mus musculus
acuuaccugcuuuucaugucuucccauuccaugucuaggccagau

SEQ ID NO: 116164 - RNA, 46 nt, Mus musculus
ucacaacccaggcguuugccgcggcggauguaaccugugcagcucc

SEQ ID NO: 116165 - RNA, 41 nt, Mus musculus
ugaauuccaagagguccaccagcgguuuuguuucuguccga

SEQ ID NO: 116166 - RNA, 44 nt, Mus musculus
ggcaccuccucaacuccuuuguuggcgccucucucagggcagga

SEQ ID NO: 116167 - RNA, 42 nt, Mus musculus
acccaccccagcugcggcgggaggaggagcgccaaggcccgu

SEQ ID NO: 116168 - RNA, 40 nt, Mus musculus
acacuuccuucaggugguugccgcugagguugagcgccuc

SEQ ID NO: 116169 - RNA, 42 nt, Mus musculus
gcccccuggaggagcugauccugaaucacaucgugcccccug

SEQ ID NO: 116170 - RNA, 46 nt, Mus musculus
uucuuuuccugccucgggacuuacuagcccaacugccgagucucag

SEQ ID NO: 116171 - RNA, 46 nt, Mus musculus
accugacacaccucgaaagccuccacuuggaggacaaugcccucaa

SEQ ID NO: 116172 - RNA, 47 nt, Mus musculus
ggauuguuguccaggaacaccuugacaugagccaggccgugccacuc

SEQ ID NO: 116173 - RNA, 44 nt, Mus musculus
uggcugacaugguggcuuggcuuaaagagacagagguggugcca

SEQ ID NO: 116174 - RNA, 46 nt, Mus musculus
gcucugaccuggacugugacgcuguccuuccccaaucccugcagac

SEQ ID NO: 116175 - RNA, 45 nt, Mus musculus
uaggaagucugcagggauuggggaaggacagcgucacaguccagg

SEQ ID NO: 116176 - RNA, 42 nt, Mus musculus
uccacuuuuuuaugccuuuacgguucaaauacaaaacgagga

SEQ ID NO: 116177 - RNA, 43 nt, Mus musculus
uggaaggguaucauuacagauacgaaaucaaugcggaccccag

SEQ ID NO: 116178 - RNA, 60 nt, Mus musculus
ucuuaguuccaacucggaugucugagaaaccggacccgucaaggaggacucugcaugagg

SEQ ID NO: 116179 - RNA, 62 nt, Mus musculus
gcauggacuuggauuaguucaguucaagguguagcacagauaacauucaacggaagcugccu

SEQ ID NO: 116180 - RNA, 46 nt, Mus musculus
cuaccuaaaugauggaggaaauauugcauccccaaacugccugcag

SEQ ID NO: 116181 - RNA, 29 nt, Mus musculus
aaagagcauugggagguugguaauaguga

SEQ ID NO: 116182 - RNA, 24 nt, Mus musculus
aaagcagauucucgaggcucucug

SEQ ID NO: 116183 - RNA, 42 nt, Mus musculus
agguuucugacuucugguuguguccucauagugguggggcca

SEQ ID NO: 116184 - RNA, 46 nt, Mus musculus
uuuacaaauaccuuggccuaauggcuaagcuuuacuuugacuagau

SEQ ID NO: 116185 - RNA, 42 nt, Mus musculus
uuuucauuagggacuucuacacuacaggucacuacaggccau

SEQ ID NO: 116186 - RNA, 46 nt, Mus musculus
uuggaauuugcguggaacugcacuuggcucucuacacugcagugcu

SEQ ID NO: 116187 - RNA, 45 nt, Mus musculus
cuguuaaggagcaacuuucuuugcaagaguacuaaguggcugcag

SEQ ID NO: 116188 - RNA, 46 nt, Mus musculus
cuuauuuggcucugguuguuauuucaagucaaauguccaucauaag

SEQ ID NO: 116189 - RNA, 46 nt, Mus musculus
auaaaaaacacuuuccuuuggggaauggguuguucugggccuggag

SEQ ID NO: 116190 - RNA, 46 nt, Mus musculus
ucaccuuacuaguauggaguuggacuagcauucuuccaugucguag

SEQ ID NO: 116191 - RNA, 46 nt, Mus musculus
aagaagaacacaauaguccuuugcaaugguccaucucagaagccag

SEQ ID NO: 116192 - RNA, 46 nt, Mus musculus; identical to SEQ ID NO: 116191

SEQ ID NO: 116193 - RNA, 42 nt, Mus musculus
ccuucagucaggccgcuuaguacgaaucucacuggggcccag

SEQ ID NO: 116194 - RNA, 45 nt, Mus musculus
auagucuccuuugugcgagaucgaggcugccccucccucugucac

SEQ ID NO: 116195 - RNA, 42 nt, Mus musculus
uugauucaaaaucaaauguauuuuuggauccaagccuuuucu

SEQ ID NO: 116196 - RNA, 45 nt, Mus musculus
auguauguguuucuuguagagacuucugauuuccagcugcuuaca

SEQ ID NO: 116197 - RNA, 46 nt, Mus musculus
cuccugccaacucuagauccucuuucuucucuuucuguggccauug

SEQ ID NO: 116198 - RNA, 46 nt, Mus musculus
auguauauuuuucucuugucaaaaugaaucaaaauggcacauuaaa

SEQ ID NO: 116199 - RNA, 67 nt, Mus musculus
uacucuuaacagcuguggaauagcuccauccuuucugucuucccuggccuucucacaucccuccauc

SEQ ID NO: 116200 - RNA, 87 nt, Mus musculus
accccacaccuaagcuuuaagucugagccuacccuugccugucagugggagggaauggaagaggagugggccuuguggacugcauga

SEQ ID NO: 116201 - RNA, 29 nt, Mus musculus
ugaugccagcacuauucuaucagaacauc

SEQ ID NO: 116202 - RNA, 42 nt, Mus musculus
ugugggaagucagcaggcaaggugaacauguacguggcagga

SEQ ID NO: 116203 - RNA, 87 nt, Mus musculus
cagaaguacuguuauggaaaugucaagagucccagauagguaaguagguaggguagguaagguugugcauguguaugugcguguaug

SEQ ID NO: 116204 - RNA, 59 nt, Mus musculus
uucucuuaauuuguauugcauuugugugugugugugugugugugugugugugugugugu

SEQ ID NO: 116205 - RNA, 46 nt, Mus musculus
gaagucauggucgccauuucuaccacuauacauauauggcccugau

SEQ ID NO: 116206 - RNA, 46 nt, Mus musculus
uccuuccuggggcagacucacaggaaggcacaggcauuacagagag

SEQ ID NO: 116207 - RNA, 46 nt, Mus musculus
aaucaagagucaacaaagaauaggcauuuuuucauauccauaagug

SEQ ID NO: 116208 - RNA, 46 nt, Mus musculus
auaaaucuaacaaaaacucaguauuuuuugaucauaaagaugagac

SEQ ID NO: 116209 - RNA, 46 nt, Mus musculus
guaguugaagaaucugaggccuuggagauggcucagugggaaagag

SEQ ID NO: 116210 - RNA, 46 nt, Mus musculus
gaaagugaccuuugaaaaccauucugugcuugcuuugaccauagag

SEQ ID NO: 116211 - RNA, 25 nt, Mus musculus
auacauuuaaacacuaguggugaaa

SEQ ID NO: 116212 - RNA, 41 nt, Mus musculus
ggcuuguaagugacgucaccuaaucgggcagcagccacagg

SEQ ID NO: 116213 - RNA, 46 nt, Mus musculus
acauuuuauucuaacaggaacagaaaucuugugaaauccaguuuga

SEQ ID NO: 116214 - RNA, 46 nt, Mus musculus
caggcuaaggaugcagagggccagggguccagugaggaggugggau

SEQ ID NO: 116215 - RNA, 46 nt, Mus musculus
aauucuuucuuugaauacauagaugaagaaauagaaaggcuaaggu

SEQ ID NO: 116216 - RNA, 46 nt, Mus musculus
ucauauaaauuauguuucuauauacuaugcauccagcagugcagua

SEQ ID NO: 116217 - RNA, 45 nt, Mus musculus
cuuucugugcccugggguacauugagaucauuguuaugccucaga

SEQ ID NO: 116218 - RNA, 46 nt, Mus musculus
cuugcccccuccccccauccccaguuccuucaugggaaaagcagaa

SEQ ID NO: 116219 - RNA, 45 nt, Mus musculus
uggcuuggaggccuuguguauuugugauggguauuguguuaaagg

SEQ ID NO: 116220 - RNA, 45 nt, Mus musculus
ccucuccggcuucuaccagauaucuuuaucuauuuuuuggucaga

SEQ ID NO: 116221 - RNA, 46 nt, Mus musculus
auuccaaaagaauuuccaucuuucugagcaugcaagaugaaguuga

SEQ ID NO: 116222 - RNA, 46 nt, Mus musculus
ucuuaaggaauuuccauagggucaagcauaggcauaguggagagau

SEQ ID NO: 116223 - RNA, 46 nt, Mus musculus
cugucugaugagcgauuccacucaauguggauucuugcaccaggag

SEQ ID NO: 116224 - RNA, 46 nt, Mus musculus
uuuuggaaucucaaagcucacuuugaugguuucugugaccacagag

SEQ ID NO: 116225 - RNA, 42 nt, Mus musculus
ggugggaagcuuggaagcaggcaggcaggcaggcaggcaggc

SEQ ID NO: 116226 - RNA, 41 nt, Mus musculus
gugugugugccuggugucuuagguuagaagugggugccaga

SEQ ID NO: 116227 - RNA, 45 nt, Mus musculus
agaugacaaacaugauugucgccccuaagggaucagggauguagc

SEQ ID NO: 116228 - RNA, 62 nt, Mus musculus
gacauucagaaguacuguuauggaaaugucaagagucccagauagguaaguagguaggguag

SEQ ID NO: 116229 - RNA, 42 nt, Mus musculus
agugugggaagucagcaggcaaggugaacauguacguggcag

SEQ ID NO: 116230 - RNA, 77 nt, Mus musculus
ucaccccacaccuaagcuuuaagucugagccuacccuugccugucagugggagggaauggaagaggagugggccuug

SEQ ID NO: 116231 - RNA, 77 nt, Mus musculus
uggacugcaugauacucuuaacagcuguggaauagcuccauccuuucugucuucccuggccuucucacaucccucca

SEQ ID NO: 116232 - RNA, 46 nt, Mus musculus
auauguauauuuuucucuugucaaaaugaaucaaaauggcacauua

SEQ ID NO: 116233 - RNA, 46 nt, Mus musculus
gaucuaugucuccuggaggcagaacugugcuaauaaaaaccaagac

SEQ ID NO: 116234 - RNA, 45 nt, Mus musculus
cuaaucuggaaacaguagggucagacauacaaccaggacccaagu

SEQ ID NO: 116235 - RNA, 53 nt, Mus musculus
cagguuccuacagggcugguggugugacacagagaagagggagagcagcaggg

SEQ ID NO: 116236 - RNA, 45 nt, Mus musculus
uguaacuauucacgaggcucugaagacugugaucgacucccagac

SEQ ID NO: 116237 - RNA, 42 nt, Mus musculus
caccaaauacuugucuuaugacugaucaccauggccugagga

SEQ ID NO: 116238 - RNA, 45 nt, Mus musculus
agacugugggucucugugugugucuuuguauaugcuuguguaugu

SEQ ID NO: 116239 - RNA, 45 nt, Mus musculus
guacauuguaacugucuucagacacuccagaagagggcaucagau

SEQ ID NO: 116240 - RNA, 46 nt, Mus musculus
gcuuucuagcacuugaguggcugaguccauuuuucaguaucuagac

SEQ ID NO: 116241 - RNA, 45 nt, Mus musculus
acucagacucaggagcggagcaagacaguuucgagaagcgcuuuu

SEQ ID NO: 116242 - RNA, 48 nt, Mus musculus
gcgcaucgcugaugggugacugucaugagaaagcauguuacacaguau

SEQ ID NO: 116243 - RNA, 45 nt, Mus musculus
caguagacccagcccugcauaagggaacauaggaaacucucagau

SEQ ID NO: 116244 - RNA, 49 nt, Mus musculus
guugaaaguccccaggaggaaaggugguggcccggagugggguguccug

SEQ ID NO: 116245 - RNA, 46 nt, Mus musculus
cugucagcaugaguuuguaagcuaggacaugcacaacaagggggug

SEQ ID NO: 116246 - RNA, 46 nt, Mus musculus
cuucuggugucucguuaccaucguggaagucuucaugccccgagac

SEQ ID NO: 116247 - RNA, 46 nt, Mus musculus
cacaguacacacaccuccguucuaaacuuugccaacucgcccagac

SEQ ID NO: 116248 - RNA, 45 nt, Mus musculus
uugagcagaucucccauaaggagauuguauguucccgagguuuga

SEQ ID NO: 116249 - RNA, 42 nt, Mus musculus
uccggacucugcccaacaacaagcacuacuccagccccacgu

SEQ ID NO: 116250 - RNA, 46 nt, Mus musculus
ugcuuauguguauaaagcaaaaaacaauacagugacuccuggaggu

SEQ ID NO: 116251 - RNA, 73 nt, Mus musculus; identical to SEQ ID NO: 42681

SEQ ID NO: 116252 - RNA, 96 nt, Mus musculus
agcuccugcaccagaaggacgagcagauccugggccucagcggccagcuggagagguucggccuggagaaggaaagccuccagcaggaagugagga

SEQ ID NO: 116253 - RNA, 87 nt, Mus musculus
ugcucgagggaacggcgacaucaucaggcagcagcggaggucccacuaagccaguccccgaaaugcagcugcagauucaaagccagc

SEQ ID NO: 116254 - RNA, 108 nt, Mus musculus
cuaguucaggauuccccuuugaauuuggacggaacccuuacaaaggaaagcgccccuugaaagauauaauugggucauacaaaaaccgccacagcaguagugauccuu

SEQ ID NO: 116255 - RNA, 45 nt, Mus musculus
gacccgccuccuaaggaccuggaggagucccugguaccagaagag

SEQ ID NO: 116256 - RNA, 46 nt, Mus musculus
ucuagcagaaagagagagagagagagagagagagagagagagagag

SEQ ID NO: 116257 - RNA, 46 nt, Mus musculus
cuuagacaaguguagccaccuguucuagggacacaaagucgcauuu

SEQ ID NO: 116258 - RNA, 71 nt, Mus musculus
gcucugggccgggaaaugucccuagcacugugggcgggcucacaggugcugcgaaugugcagggguagaug

SEQ ID NO: 116259 - RNA, 42 nt, Mus musculus
guagugcguuccacacaccauuguggagggaaagaacaagag

SEQ ID NO: 116260 - RNA, 42 nt, Mus musculus
guuguuguuguugucguuguuguuguuguuguugucguuguu

SEQ ID NO: 116261 - RNA, 45 nt, Mus musculus
cuccucugucauggcgcugcaugguguuagaggcagacucccagg

SEQ ID NO: 116262 - RNA, 24 nt, Mus musculus
uguguuguaugcagcucguauucc

SEQ ID NO: 116263 - RNA, 46 nt, Mus musculus
ccgccaugaugacagaagcaacuuuauucagcuuacaauuccaggu

SEQ ID NO: 116264 - RNA, 24 nt, Mus musculus
uguggucaagaggacauaguagag

SEQ ID NO: 116265 - RNA, 46 nt, Mus musculus
uaggagcccuugucauggagucuuaguauuccaguucuccucagag

SEQ ID NO: 116266 - RNA, 46 nt, Mus musculus
ggugguggugguagugguggugguggugguaguggugguguuuugu

SEQ ID NO: 116267 - RNA, 45 nt, Mus musculus
guguuuguuuuugagacaagguuucuuguuggccugaaguagguu

SEQ ID NO: 116268 - RNA, 46 nt, Mus musculus
gaguuccaggguagcaagggugagauccugucugagaaggggagag

SEQ ID NO: 116269 - RNA, 42 nt, Mus musculus
aucaaagccuucaacgaugauugugugugugugugugugugu

SEQ ID NO: 116270 - RNA, 42 nt, Mus musculus
uaaaagcaggugcucuuaagcuauuacacuucuggccccuga

SEQ ID NO: 116271 - RNA, 45 nt, Mus musculus
agaaggaagaagaagggaggaggaagaggaugagaaagaggagga

SEQ ID NO: 116272 - RNA, 41 nt, Mus musculus
uggugcacuaaggugagggauacccgagugauuccaccauc

SEQ ID NO: 116273 - RNA, 41 nt, Mus musculus
gauacucauagccaaauauuggcugaaggguggggccucuu

SEQ ID NO: 116274 - RNA, 45 nt, Mus musculus
ccuagagaucccggaauacuuuuuugguauuuaaauccccgguag

SEQ ID NO: 116275 - RNA, 46 nt, Mus musculus
cuaauuuuagaguuuggcuucagcuucugucuauuuuaugccaccu

SEQ ID NO: 116276 - RNA, 46 nt, Mus musculus
gggauggcagguuuuaguuguuuaaaagccauuuuucuucuagcag

SEQ ID NO: 116277 - RNA, 45 nt, Mus musculus
gaauaauuuucaaagcuauuaccauugcaguuaccccacccccca

SEQ ID NO: 116278 - RNA, 46 nt, Mus musculus
uucagacacuccagaagagggagucagaucuuguuacagaugauug

SEQ ID NO: 116279 - RNA, 46 nt, Mus musculus
auccugugcucggagauuuuuauuuuauucuauuuuagccagccag

SEQ ID NO: 116280 - RNA, 42 nt, Mus musculus
gaucucaucaggcuuuaacaagcuaagcuauaaaggcagcau

SEQ ID NO: 116281 - RNA, 45 nt, Mus musculus
uaagaagaaagaaugugugugugugugugugugugugugugugug

SEQ ID NO: 116282 - RNA, 86 nt, Mus musculus
gcuguggacagggugacccuguacuguacaagauguuggcagagcucacaacucucaggauuccuguuagaagcuggccgcauggg

SEQ ID NO: 116283 - RNA, 46 nt, Mus musculus
cuccuccuaugucuuguugcacguuauuguggauuuuugcuggcau

SEQ ID NO: 116284 - RNA, 45 nt, Mus musculus
guguagggguugcuucugagggacaaguuaaauauuuaucacuaa

SEQ ID NO: 116285 - RNA, 45 nt, Mus musculus
guauccuuuuaaccacugagucaucucuccagccccagccaccag

SEQ ID NO: 116286 - RNA, 45 nt, Mus musculus
agaauacauaaagaauauaaaugcaaugucuuuuaagacuuuuag

SEQ ID NO: 116287 - RNA, 45 nt, Mus musculus
uggagugaguagaacuuacuaaggaaauaacaugauuauaugccu

SEQ ID NO: 116288 - RNA, 46 nt, Mus musculus
caggaucgugggaggaaucucagcuggagcacugaucauucagcag

SEQ ID NO: 116289 - RNA, 51 nt, Mus musculus
gaguggagaggcggugauggaaugaacaguaucggagggggccagaaggug

SEQ ID NO: 116290 - RNA, 46 nt, Mus musculus
auguaaaauaaagugucuaugcgagaaaagucacaaucugcaccga

SEQ ID NO: 116291 - RNA, 42 nt, Mus musculus
cuggggaguuggcaguuugaggaucccaguuguuucugacag

SEQ ID NO: 116292 - RNA, 45 nt, Mus musculus
aagucagccugauucauuuggauuguauuuaagacucagcuugca

SEQ ID NO: 116293 - RNA, 45 nt, Mus musculus
agaccucucccacccaaggaccucaaacagaacugacaccugcua

SEQ ID NO: 116294 - RNA, 46 nt, Mus musculus
auuaaauccagguuuccuucaccugaggacaaggcuguacguggag

SEQ ID NO: 116295 - RNA, 45 nt, Mus musculus
ccuuuucauccauccgucuguccaucuauccaucuauccauccau

SEQ ID NO: 116296 - RNA, 46 nt, Mus musculus
ucuuaucucagaauaaauuaggaaauaccaaauuuguuuagccgag

SEQ ID NO: 116297 - RNA, 45 nt, Mus musculus
cucauauuuuuauuucguuugucaaauguaguuccugugauguga

SEQ ID NO: 116298 - RNA, 46 nt, Mus musculus
aacccagaugaaguuguuuuaaaguuugaaaaugguaaaagcagag

SEQ ID NO: 116299 - RNA, 45 nt, Mus musculus
ucacuuuaguguucauuuuuauuuuuuuaggaagagucaaggcca

SEQ ID NO: 116300 - RNA, 46 nt, Mus musculus
ggcugugcgcuuugugauguugacacaauugacuugucuacaguag

SEQ ID NO: 116301 - RNA, 46 nt, Mus musculus
gagcaguaaggucccccacgcagcacacuggaacucccaggaugaa

SEQ ID NO: 116302 - RNA, 47 nt, Mus musculus
aaagcuaagcaugacaucagcucuauaaaaauaguaggaccagagga

SEQ ID NO: 116303 - RNA, 59 nt, Mus musculus
ucaggaugaaaagugugauuacuacuuuaguguggaugcagauguuguuuugacaaacc

SEQ ID NO: 116304 - RNA, 46 nt, Mus musculus
gagguaggucacauucaacuuucuucuguacucuuuaaguucccug

SEQ ID NO: 116305 - RNA, 50 nt, Mus musculus
uuuggggagcacugaguccugauggguacuaugcucgcucugaagauuac

SEQ ID NO: 116306 - RNA, 45 nt, Mus musculus
guuguaugauaauacuugguugucauguguacacauccaguggua

SEQ ID NO: 116307 - RNA, 37 nt, Mus musculus
cuaauguguacuuaauucaaggaaagacacuccgauc

SEQ ID NO: 116308 - RNA, 46 nt, Mus musculus
ccgugauaaguuggaucccgauauggcucuuugccgcaaugcuaga

SEQ ID NO: 116309 - RNA, 45 nt, Mus musculus
uaggcuugucucauaagcagccuaagaagauuuaauaaaggcaga

SEQ ID NO: 116310 - RNA, 42 nt, Mus musculus
gacuccccuacuccggaaacauuccaaaugcucagcccccca

SEQ ID NO: 116311 - RNA, 62 nt, Mus musculus
acugcuaauuacaacacuucccaucuuaacaaugacuucuggcagauuuuugaaaaucccgu

SEQ ID NO: 116312 - RNA, 46 nt, Mus musculus
aaaggcuugauuucaugggguguacccauacacagaaccaggccag

SEQ ID NO: 116313 - RNA, 45 nt, Mus musculus
aaucgugauuauucaaagauuuucacugaaaauauagucgagcag

SEQ ID NO: 116314 - RNA, 76 nt, Mus musculus
ucuucugguuucccauauuuucugaacgagccugugaugaguugguagaagaaauggagcauuauggcaagugguc

SEQ ID NO: 116315 - RNA, 36 nt, Mus musculus
gggccuugagcuaauuguauuagccaucgagaaacg

SEQ ID NO: 116316 - RNA, 43 nt, Mus musculus
gguuaugaaaaugucccgacugacgauauucauaugaagcaga

SEQ ID NO: 116317 - RNA, 66 nt, Mus musculus
ccugaaagacagcgcucgcuccguccccaccacgaugccucaaccuuuaccaucaacauugcucug

SEQ ID NO: 116318 - RNA, 46 nt, Mus musculus
agaucccuaaguuauuuacguaacucaaacugaauggcucucugag

SEQ ID NO: 116319 - RNA, 52 nt, Mus musculus
ugucucuuuaugucugcucugagccuuaaaacacagguugaagaagaaaaga

SEQ ID NO: 116320 - RNA, 60 nt, Mus musculus
aagaagaaccugagaagguuuuauuuaucggugggggaaguauagcaaacgguucuaaau

SEQ ID NO: 116321 - RNA, 45 nt, Mus musculus
cccccauuauagaaaauaguaaggaaaaauaacaguuucauugag

SEQ ID NO: 116322 - RNA, 46 nt, Mus musculus
uaauuuaaagguuaaacuugaagaaagucuuuauucacggugccaa

SEQ ID NO: 116323 - RNA, 24 nt, Mus musculus
acagaaaagguuuagagacaaaga

SEQ ID NO: 116324 - RNA, 46 nt, Mus musculus
auacuuuaaaauuaaaugaacaaaauaaauauuaaugcugggugac

SEQ ID NO: 116325 - RNA, 45 nt, Mus musculus
auguucucuuuauuuccuuaaggcaaauuugccaagcgaugaaca

SEQ ID NO: 116326 - RNA, 42 nt, Mus musculus
cgaagcagagacugcugguuuuguucugauguugguucaggg

SEQ ID NO: 116327 - RNA, 50 nt, Mus musculus
cagagcagaaagcccccacugggcugguaaaucaaggaggcaggucuuca

SEQ ID NO: 116328 - RNA, 46 nt, Mus musculus
aauuuucgugguaucugugaauguguaagaguaauuuggauguggg

SEQ ID NO: 116329 - RNA, 47 nt, Mus musculus
aggccgccaaugccuggcggaccgcgcucaccuuccagcagaucaaa

SEQ ID NO: 116330 - RNA, 45 nt, Mus musculus
gagggugggcguuacucaggcggaggaggcaucuggaccggagac

SEQ ID NO: 116331 - RNA, 42 nt, Mus musculus
agauggccgacaaaacgccaggcggaucucagaaggccaguu

SEQ ID NO: 116332 - RNA, 46 nt, Mus musculus
cuucagaguugagaaaaaacagggaaauaggauaaaaacuguuuag

SEQ ID NO: 116333 - RNA, 45 nt, Mus musculus
uauuguuacugugcaguacaggcacgcccuagcaacuguggggag

SEQ ID NO: 116334 - RNA, 46 nt, Mus musculus
uaaugcuucccuggucgcucccccacccccuucacuauacccccau

SEQ ID NO: 116335 - RNA, 45 nt, Mus musculus
uuaccauacagaaguugaaguuuauuuuuugguugauggggguau

SEQ ID NO: 116336 - RNA, 46 nt, Mus musculus
aaagguucccugacaguuggggaaucccaaguccacuggccuuuag

SEQ ID NO: 116337 - RNA, 42 nt, Mus musculus
cgccuugggaggggaaagagaaagagagaaagcauucagaga

SEQ ID NO: 116338 - RNA, 46 nt, Mus musculus
ucuauagaaggauuagguaaucucaaauuucauugguaggugcuag

SEQ ID NO: 116339 - RNA, 45 nt, Mus musculus
ggcuauacuacuuaguaugguucauuacuauauuguggccuacau

SEQ ID NO: 116340 - RNA, 42 nt, Mus musculus
aguggugagaucucccuggugauggcacacuaugagcgcugg

SEQ ID NO: 116341 - RNA, 74 nt, Mus musculus
gcauugagaaggcucacaacaggaaaaacagaaggaagggagggaggaagagaggggaagaaggaaagaaggag

SEQ ID NO: 116342 - RNA, 46 nt, Mus musculus
ugaggcagacucaugaaggaacauuucacugaaacagacacaggag

SEQ ID NO: 116343 - RNA, 45 nt, Mus musculus
acuucugguggugugcugcaguuucuugccacuuccucggacuca

SEQ ID NO: 116344 - RNA, 41 nt, Mus musculus
agauuuuuaccuucuuuucucuuuguaacuugauuguugca

SEQ ID NO: 116345 - RNA, 42 nt, Mus musculus
ucacagaccuguuuucacauguggcggcauucuuaccggaga

SEQ ID NO: 116346 - RNA, 41 nt, Mus musculus
agaccugggggauguccugcaauagcgauuagagagggcuc

SEQ ID NO: 116347 - RNA, 62 nt, Mus musculus
cucgauugagucauuuugaauuccugauuaaggcuguuucuaguuagaggucugguguaaac

SEQ ID NO: 116348 - RNA, 46 nt, Mus musculus
ggaaauaaacgaucaaagcaguuuugacuacuucauacuccggaga

SEQ ID NO: 116349 - RNA, 70 nt, Mus musculus
ugugggcuguauuagccgcagucaaggcaggaaaccagauacagacauaauuaaugaaauaaaagucgcc

SEQ ID NO: 116350 - RNA, 45 nt, Mus musculus
gcugcuguaaauuuuguugcuaucuucauuuucuuguuccuggga

SEQ ID NO: 116351 - RNA, 45 nt, Mus musculus
augcuagauaagugcucuaucacugagcuacauacccagccccag

SEQ ID NO: 116352 - RNA, 46 nt, Mus musculus
ugugguggccuuaguugacuaggucuuaguaauuaauuuggcugag

SEQ ID NO: 116353 - RNA, 45 nt, Mus musculus
ggacauaggccagaaaccuuuccagcauccuccuagucaagccaa

SEQ ID NO: 116354 - RNA, 46 nt, Mus musculus
uacauuucucuuauaggaaccugaauaguaaucauuuagccaccuc

SEQ ID NO: 116355 - RNA, 42 nt, Mus musculus
cucuugaggguuaggugcaucuucugacugaguccagaccag

SEQ ID NO: 116356 - RNA, 42 nt, Mus musculus
gaaagguaagucuuggacauccggaauaagcaggaaacuuag

SEQ ID NO: 116357 - RNA, 45 nt, Mus musculus
uagaggugauguugaucuuuuaaaaccacuucuccggggcuguga

SEQ ID NO: 116358 - RNA, 46 nt, Mus musculus
auauugagguaguuuauauguucaaguauuuauagaagucugugau

SEQ ID NO: 116359 - RNA, 46 nt, Mus musculus
acauguauaugacuguacauacacauauguuguucugcugucauua

SEQ ID NO: 116360 - RNA, 46 nt, Mus musculus
cuuuacacuuuguuuuuaaaguucucaggagauaaugacuaggauc

SEQ ID NO: 116361 - RNA, 42 nt, Mus musculus
uguaaccggcgcuggaccaggacuucuagaguuggcccagau

SEQ ID NO: 116362 - RNA, 33 nt, Mus musculus
cuuuauuaaucuuuaauauggaugacuaggaga

SEQ ID NO: 116363 - RNA, 44 nt, Mus musculus
accuaaaaauauuccuuuuaaacauuuuaacaaacacgucacug

SEQ ID NO: 116364 - RNA, 46 nt, Mus musculus
cugaucuucuguuguagcuguaacgaggcagaguuuuggaguuaga

SEQ ID NO: 116365 - RNA, 48 nt, Mus musculus
uugcuuucaucuaaagaugaacgauuuguuuuuaaaacuggagaggaa

SEQ ID NO: 116366 - RNA, 46 nt, Mus musculus
uuccucacaaaacaguuuacaguucaauuugguuuucuccuaaguu

SEQ ID NO: 116367 - RNA, 46 nt, Mus musculus
uaucuucucccucuggucuccauguuaacaaaucuggugcaugagu

SEQ ID NO: 116368 - RNA, 62 nt, Mus musculus
cuuaacaagaugguguguguguguaugugugugugugugugugugagugaggugggggggag

SEQ ID NO: 116369 - RNA, 45 nt, Mus musculus
gugucacagggacagggaaaugaguaugggagauacucuagagau

SEQ ID NO: 116370 - RNA, 52 nt, Mus musculus
ggggagcauuagcuugcuuaggauuuggucaaagagaaaacuuuucgguggg

SEQ ID NO: 116371 - RNA, 45 nt, Mus musculus
ccgaauaucuguaugcucaaaauaguucuguauccagcaaugaag

SEQ ID NO: 116372 - RNA, 42 nt, Mus musculus
agcagggagaaagggaggcacugggcuugcugcgggcuuuug

SEQ ID NO: 116373 - RNA, 45 nt, Mus musculus
aauggagcccuaugacuagaaguucagugaguagguggggaaaug

SEQ ID NO: 116374 - RNA, 44 nt, Mus musculus
acacacacacacacacacacacacacacaccuacaacuguaauc

SEQ ID NO: 116375 - RNA, 45 nt, Mus musculus
caccuguuagccuaugcuaauggcaucacguagggaguuggacaa

SEQ ID NO: 116376 - RNA, 54 nt, Mus musculus
aaagaccugugugguuugagcagagagaacgagagaaguaagaggacaugggag

SEQ ID NO: 116377 - RNA, 46 nt, Mus musculus
uauagacaguaguggggugggucgguguccagacugagaacagugg

SEQ ID NO: 116378 - RNA, 44 nt, Mus musculus
ugaaugacauguggagguuauaaaacuaagggaaaugggcagau

SEQ ID NO: 116379 - RNA, 45 nt, Mus musculus
cccgacucuucccagaaauuuuauaaugagguauauacuuugaga

SEQ ID NO: 116380 - RNA, 41 nt, Mus musculus
caggguuguuuugugugugugugugugugugugugugugug

SEQ ID NO: 116381 - RNA, 26 nt, Mus musculus
ucugagccaucucgcuaguaccaagu

SEQ ID NO: 116382 - RNA, 42 nt, Mus musculus
ucauccaucuccagcgagggcacccagcauucguacucaggu

SEQ ID NO: 116383 - RNA, 71 nt, Mus musculus
ccuguaguccuggagaugcuggaucuuucaagcaaucagaaagaggguagagcugagggggugagcagugg

SEQ ID NO: 116384 - RNA, 44 nt, Mus musculus
uaaggaggcaagccuuccccuuccuggguacaaggugcgcgaga

SEQ ID NO: 116385 - RNA, 44 nt, Mus musculus
ucauaauguaaacgucuguauuuuaugauggucuccgguguccc

SEQ ID NO: 116386 - RNA, 46 nt, Mus musculus
uuuuugccagugagcuaugaucuuuggaaauagcaaaugauuggau

SEQ ID NO: 116387 - RNA, 46 nt, Mus musculus
auuuugaacagacaguccaccaauggaauaauuuugacaguaagau

SEQ ID NO: 116388 - RNA, 46 nt, Mus musculus
uauauauaacauugccacucucaguauuugaaaccuguguccagac

SEQ ID NO: 116389 - RNA, 45 nt, Mus musculus
uauccaguuacauuagggaggccugugugugugcaggcccagagg

SEQ ID NO: 116390 - RNA, 42 nt, Mus musculus
cagucuuagaacucggaaucugaggaggcagaggggugaaga

SEQ ID NO: 116391 - RNA, 41 nt, Mus musculus
aggaaugggugaauguaugugaacugaacaacacagaggau

SEQ ID NO: 116392 - RNA, 46 nt, Mus musculus
uugucuugugaaaucuagcuuaaaauuaaaagaugagaaaguagaa

SEQ ID NO: 116393 - RNA, 42 nt, Mus musculus
guuauaauuauuuuuuuauuguugagauucuagaguggagaa

SEQ ID NO: 116394 - RNA, 45 nt, Mus musculus
cgucugcuuacugauagggucauuacaccagugacucuugcugau

SEQ ID NO: 116395 - RNA, 46 nt, Mus musculus
aaacagaucuccguguguguguguguguguguguguguguguguga

SEQ ID NO: 116396 - RNA, 45 nt, Mus musculus
uuuaguaugcucuugugcuauuggcaaacacaauguacucccagu

SEQ ID NO: 116397 - RNA, 48 nt, Mus musculus
ugccuguuagcauccucuccucaucuccaaccauagcucccaccccca

SEQ ID NO: 116398 - RNA, 43 nt, Mus musculus
cauugcaccggccuucuuauuaaucacaugauuuaaaggagau

SEQ ID NO: 116399 - RNA, 46 nt, Mus musculus
ccauagcuggaacagauuaaaguguucaagcacaaggaaagcaggu

SEQ ID NO: 116400 - RNA, 76 nt, Mus musculus
agauagaugauuuaguaauguagaagcaaguguauauaucuguugaggguggggguuccuuuaugaccaaaagcua

SEQ ID NO: 116401 - RNA, 48 nt, Mus musculus
ccuacacacaugcacacacaucacaaacaggagaaacgagagagaucc

SEQ ID NO: 116402 - RNA, 46 nt, Mus musculus
ugugucuguguaagaacauagcaacuucugaccguguuugucagaa

SEQ ID NO: 116403 - RNA, 46 nt, Mus musculus
cucagcuuaguuaagguggaagaaaaaagcagguuagcccggaguc

SEQ ID NO: 116404 - RNA, 46 nt, Mus musculus
cagucauuacacuucauccucaaaugaggauacccaucguucagau

SEQ ID NO: 116405 - RNA, 45 nt, Mus musculus
acauagugaguuucaaccuguuucaaaaaaaaaagaaaagaaaag

SEQ ID NO: 116406 - RNA, 46 nt, Mus musculus
ucaaaucccagcaaccacaugguggcuuacaaacaucuguaaugag

SEQ ID NO: 116407 - RNA, 46 nt, Mus musculus
uuuauuauaaauaaguacacuguagcugucuucagacacgccagaa

SEQ ID NO: 116408 - RNA, 45 nt, Mus musculus
caccccagaaaaaaguuuuucugagaguuucaguauagcgccaug

SEQ ID NO: 116409 - RNA, 45 nt, Mus musculus
gcgauaguucagugguuaagaaccugaauggaguagugguagcag

SEQ ID NO: 116410 - RNA, 42 nt, Mus musculus
acccucucagaguugggaggagggcuuaaagaacuccgggag

SEQ ID NO: 116411 - RNA, 48 nt, Mus musculus
cugugugggacgacuucucgggucccucaucccaagcaaagcaacaga

SEQ ID NO: 116412 - RNA, 76 nt, Mus musculus
ugucuuggguuugugauacuuuuucaugcucccguuagcccccagacaggaccgaccccccuauugucuaaacgaa

SEQ ID NO: 116413 - RNA, 75 nt, Mus musculus
caaaacguuuagauggagcgcagggauggggcggggagguggggggaauggugcuuaaaggcuuuaguauggcag

SEQ ID NO: 116414 - RNA, 46 nt, Mus musculus
cuuaauaaauuauuugugauaaguagcacuguauuaauacuggaag

SEQ ID NO: 116415 - RNA, 45 nt, Mus musculus
cucgauguaucaaaguuaggccuuucacaaauauuuuauuuaaca

SEQ ID NO: 116416 - RNA, 46 nt, Mus musculus
acacccagagggagaggauggggagcgauguguuuuagaacgagag

SEQ ID NO: 116417 - RNA, 46 nt, Mus musculus
uaaaaauacacuaccauguuuuaaaacauuauugaaaaacugcaaa

SEQ ID NO: 116418 - RNA, 42 nt, Mus musculus
uucauauagaaacaaaaaacaacaaaaaaguauugcggccaa

SEQ ID NO: 116419 - RNA, 42 nt, Mus musculus
gagugagccaccauaugguugcugggauuugaacccuggacc

SEQ ID NO: 116420 - RNA, 42 nt, Mus musculus
agugcaaggcuaaccuuggauacauagagaauuuuaggccag

SEQ ID NO: 116421 - RNA, 42 nt, Mus musculus
aauuaaaugugacgaaugcaugaacagugguuaacugggcag

SEQ ID NO: 116422 - RNA, 46 nt, Mus musculus
ggugcucaccugguaggggauaccgacugccaacaagugccuuggu

SEQ ID NO: 116423 - RNA, 45 nt, Mus musculus
uaugcugguagaggguuuucuuaaauaugaacaaacauugacaga

SEQ ID NO: 116424 - RNA, 23 nt, Mus musculus
guccucagaaagccuggcccacc

SEQ ID NO: 116425 - RNA, 42 nt, Mus musculus
uucaccacauugauaggaguaaaagacuaauugaguaggguu

SEQ ID NO: 116426 - RNA, 46 nt, Mus musculus
gcguaugugucacaucgaccucaagaugucccaaaauuaacccuag

SEQ ID NO: 116427 - RNA, 46 nt, Mus musculus
cuacucuguacugcugugaucacacauagaaaaugaagcaauugga

SEQ ID NO: 116428 - RNA, 82 nt, Mus musculus
aaaaaaaggggugaaggagcaggaagaagaaaaaggagagggagaggaggaaggagagaaaggaagaaaagaaagugaaaaa

SEQ ID NO: 116429 - RNA, 46 nt, Mus musculus
caaguuuguuucccagugcccaugucaggcagcucacagccaccua

SEQ ID NO: 116430 - RNA, 42 nt, Mus musculus
agaauugccagcaccuagauuugaucccagcauuggcagcag

SEQ ID NO: 116431 - RNA, 46 nt, Mus musculus
ucagugcucuuaaccucugagccaucucuccagccccaaaauaacg

SEQ ID NO: 116432 - RNA, 25 nt, Mus musculus
agagaaagagagagagaaugcagua

SEQ ID NO: 116433 - RNA, 46 nt, Mus musculus
agaaauucugaaaauugauagcccugacacaagagacagcaagaau

SEQ ID NO: 116434 - RNA, 41 nt, Mus musculus
ccugugccugcguagaaaagagucucuaggguagaugggca

SEQ ID NO: 116435 - RNA, 46 nt, Mus musculus
aaucaagucuuccacauucggguaucuuagacacagggaugaaaca

SEQ ID NO: 116436 - RNA, 48 nt, Mus musculus
cuguuucuuacaaggugaacuagaccauaucugauuuugcugagagga

SEQ ID NO: 116437 - RNA, 102 nt, Mus musculus
guuuuagggauacaaugguaccuugccaacaucgagugacuuuagcuggaagaaaugucugagaagcucuguaugugaggagggaaaaggaaaauaaagugg

SEQ ID NO: 116438 - RNA, 42 nt, Mus musculus
ccagacagggaccagugagcucccgaccccaaacaugcagag

SEQ ID NO: 116439 - RNA, 46 nt, Mus musculus
aguggugugguacacacuugggugacaucauaacaugcuuccagau

SEQ ID NO: 116440 - RNA, 42 nt, Mus musculus
cuugggacguguuucguucaaagucacagcacgagccuagga

SEQ ID NO: 116441 - RNA, 61 nt, Mus musculus
auuugacucuggucuuaacaagaaagaaguaacaguugagugccauauugcuggaaccagg

SEQ ID NO: 116442 - RNA, 46 nt, Mus musculus
ucugagguauuaucuacugcuuucccauaccauuucaucuggauca

SEQ ID NO: 116443 - RNA, 45 nt, Mus musculus
uuaagucacauuagcaacauauuuaaaguaaaaauagguucagug

SEQ ID NO: 116444 - RNA, 45 nt, Mus musculus
cuguacggguucuaggcgucaaacucuaguuuagucagucuaggc

SEQ ID NO: 116445 - RNA, 56 nt, Mus musculus
uuuauguuuguguguguacacuuguguaauagcacacgugugagguuagggacgag

SEQ ID NO: 116446 - RNA, 46 nt, Mus musculus; identical to SEQ ID NO: 89151

SEQ ID NO: 116447 - RNA, 45 nt, Mus musculus
auuuaaucccagacggauauccacaaauaucguguuugccaaagg

SEQ ID NO: 116448 - RNA, 46 nt, Mus musculus
auagcugugaacguauuuucauaaugaauauuuuauuauagauggg

SEQ ID NO: 116449 - RNA, 42 nt, Mus musculus
auuccaaaggacagccuugcauccuugugaaaaugaacagag

SEQ ID NO: 116450 - RNA, 45 nt, Mus musculus
ccugacuauagggcaugucaguuuccagucuccuugcuugaagaa

SEQ ID NO: 116451 - RNA, 46 nt, Mus musculus
gguuuuuaaagggugcucugagaaugucuaaaaguuggugcgugag

SEQ ID NO: 116452 - RNA, 46 nt, Mus musculus
auucagcaugucugagccacagacuuacaaaaaguugguugaagac

SEQ ID NO: 116453 - RNA, 46 nt, Mus musculus
uguuacugauuguaauuuaguugguauaucagaaacauauuugggu

SEQ ID NO: 116454 - RNA, 46 nt, Mus musculus
aauuccaaaaaguaagaaugauugugaggggugaguaccuggucuu

SEQ ID NO: 116455 - RNA, 46 nt, Mus musculus
guuuuguuuuguuuuuccuucucuuuuuucuuuuucugcagcagga

SEQ ID NO: 116456 - RNA, 42 nt, Mus musculus
gguuuuguuuaaugauagugguauugaacuuagggcacauua

SEQ ID NO: 116457 - RNA, 45 nt, Mus musculus
cugagauagcuguuggcuccuuguaaggauuuguuagagagagag

SEQ ID NO: 116458 - RNA, 79 nt, Mus musculus
gaggcaggaggauaguaauccuuauaguaauaagugccaggccugccuaguuuacauuuugaguucauggacaguuaga

SEQ ID NO: 116459 - RNA, 46 nt, Mus musculus
ucccaaaaugguuuguuagaguuuucuuuuuccccuucccccaggg

SEQ ID NO: 116460 - RNA, 77 nt, Mus musculus
uaacuuaugugcagguuauaaguguaggacagugggggagggguggccccagagcagggcaugucacccagcaguag

SEQ ID NO: 116461 - RNA, 87 nt, Mus musculus
uuuaagaugguggguuuugcccaguaaguaggacaccugugaaacuuuacaaauaugagcgcuuuugaaaacguuucagacuugccu

SEQ ID NO: 116462 - RNA, 56 nt, Mus musculus
aaaaugcucuuuccaggagaauuguuucugucucaugguaguuguguagguguaga

SEQ ID NO: 116463 - RNA, 41 nt, Mus musculus
ccgagacgggcgcuuuuuacuuaaaaucgucaaggcccugg

SEQ ID NO: 116464 - RNA, 41 nt, Mus musculus
gcgggaggcagcggccgcggugcgcgccagcggcgcgggga

SEQ ID NO: 116465 - RNA, 44 nt, Mus musculus
cucacaaccauccguaacgagaucugacccccucuucuggagug

SEQ ID NO: 116466 - RNA, 46 nt, Mus musculus
agggucacagcauuaggaaggcugagaagcacugcucuuguugaau

SEQ ID NO: 116467 - RNA, 42 nt, Mus musculus
aggaaagaaagaccuguagacaggaagguugggggugugguc

SEQ ID NO: 116468 - RNA, 45 nt, Mus musculus
gccuacaguuuugguuuuugagacugagucucauguagcccagau

SEQ ID NO: 116469 - RNA, 45 nt, Mus musculus
uguguagcuagucuuuuguuuguuuguuuugagaugcuggggauu

SEQ ID NO: 116470 - RNA, 41 nt, Mus musculus
ggugguaugaaguggucaggggaggagguaguugggggagg

SEQ ID NO: 116471 - RNA, 45 nt, Mus musculus
ggguucacuguuuuacaauagggauaacaacaauacuguccuuag

SEQ ID NO: 116472 - RNA, 45 nt, Mus musculus
accccuggggugugugugugugugugugugugugugugugugugu

SEQ ID NO: 116473 - RNA, 27 nt, Mus musculus
ccugguugucauagugucugauagugg

SEQ ID NO: 116474 - RNA, 46 nt, Mus musculus
cuccuggguggguggucuugggacguauaaaauagccagcagagca

SEQ ID NO: 116475 - RNA, 42 nt, Mus musculus
ucgggagcuagaggcaggaggauuguaaauucaaggccaguc

SEQ ID NO: 116476 - RNA, 26 nt, Mus musculus
ucccuaugaggucacagaagccacgg

SEQ ID NO: 116477 - RNA, 41 nt, Mus musculus
uaccuagcauaggugaggcucugggcucaauuuccagcaug

SEQ ID NO: 116478 - RNA, 41 nt, Mus musculus
aaccagaguaggccuagaacucagacaucaaccagccccag

SEQ ID NO: 116479 - RNA, 45 nt, Mus musculus
cugaucucuuggcugcuccuuuaacuccuguggugacggaucgga

SEQ ID NO: 116480 - RNA, 46 nt, Mus musculus
cacacauguauguguauguauauauauauauaugaacagaagauga

SEQ ID NO: 116481 - RNA, 45 nt, Mus musculus
uuauacagagaaacccugucucaaaaaaccagagagagagagaga

SEQ ID NO: 116482 - RNA, 42 nt, Mus musculus
gaaacaauuuuugccuuuaaucccagcacuuaggaggcagag

SEQ ID NO: 116483 - RNA, 47 nt, Mus musculus
aaaauaguacaugagagcccugugccaguguuugcugcaaaucaaag

SEQ ID NO: 116484 - RNA, 47 nt, Mus musculus
uaaauauuuauauuugauuuuagguuagcucauuugucaaggucacc

SEQ ID NO: 116485 - RNA, 45 nt, Mus musculus
uugauuaucuuuguguguguccaugugucuuucugucugucuaua

SEQ ID NO: 116486 - RNA, 46 nt, Mus musculus
guucacaauuuuucauuugugauaaauacauuugaacacuccuaag

SEQ ID NO: 116487 - RNA, 46 nt, Mus musculus
aaaguauucaauacaaucguaggaucaagugugagcugccccacug

SEQ ID NO: 116488 - RNA, 43 nt, Mus musculus
aauuuaacuuaauaaauuaaccuuaauguugaucggccuuuaa

SEQ ID NO: 116489 - RNA, 45 nt, Mus musculus
aggugguuauaaaccauuaugugggugcuaaaaucaaacccaggu

SEQ ID NO: 116490 - RNA, 44 nt, Mus musculus
gugaagauuauaugccccaguauaggggaaugccagagccagaa

SEQ ID NO: 116491 - RNA, 46 nt, Mus musculus
uuuaccuccuuaaccuugauuguuuuuuaauuggugauaauuagau

SEQ ID NO: 116492 - RNA, 46 nt, Mus musculus
auucaggcauaguuauuucuaacguugauauugcaaagggucauaa

SEQ ID NO: 116493 - RNA, 45 nt, Mus musculus
cugacugagacagaugcagauacuuacaagccaacacuggacugu

SEQ ID NO: 116494 - RNA, 45 nt, Mus musculus
auccauuguccaucccaauuugggauccuucccaugugcacacac

SEQ ID NO: 116495 - RNA, 46 nt, Mus musculus
acauucauagaaauaaauagcuaaaguauaauaaauaggaugagaa

SEQ ID NO: 116496 - RNA, 45 nt, Mus musculus
aaauaauugaaaaauaaaagcauauaauuaaaauauaacugagau

SEQ ID NO: 116497 - RNA, 53 nt, Mus musculus
aggggaaggauugggagaaggaggauuguuuaauggguacagagcuauagcgu

SEQ ID NO: 116498 - RNA, 45 nt, Mus musculus
uuacaguauaauucuaauuaaugaauuuaggaagggugauggaga

SEQ ID NO: 116499 - RNA, 46 nt, Mus musculus
uaaagcuugaagaauaaauauucaugaaucacuacugauacaauac

SEQ ID NO: 116500 - RNA, 46 nt, Mus musculus
agucuaaugagguuggagacauugcagggcaguucauucuggaguc

SEQ ID NO: 116501 - RNA, 41 nt, Mus musculus
aaagccaggcgugguggcgcacgccuuuaaucccagcccuu

SEQ ID NO: 116502 - RNA, 46 nt, Mus musculus
agaaagagaggugacuuaagagagcagcauagagggguggggagaa

SEQ ID NO: 116503 - RNA, 46 nt, Mus musculus
ucugcacuauaaauuuggaccaggaagaaguuuaucgcacccaggu

SEQ ID NO: 116504 - RNA, 46 nt, Mus musculus
agggauggucuagaacagagcccugaggcaguuacagcauuucgau

SEQ ID NO: 116505 - RNA, 46 nt, Mus musculus
auaagauugguuuuggggacuugcuaaauaugagauaccugccaga

SEQ ID NO: 116506 - RNA, 45 nt, Mus musculus
aagaucuucuggaugugcuaaugagcuggauugugugagggagag

SEQ ID NO: 116507 - RNA, 46 nt, Mus musculus
aauggagaaaagugaaccaagggaagaacaaaagaaggagucagaa

SEQ ID NO: 116508 - RNA, 31 nt, Mus musculus
ugaaugauaagaaugucccagccguguaaag

SEQ ID NO: 116509 - RNA, 42 nt, Mus musculus
gcaaaggaaggucugaagcuaauuguagaaggcuaggguaug

SEQ ID NO: 116510 - RNA, 45 nt, Mus musculus
gugucugugugugugucugugugugugugugugucuguaugugug

SEQ ID NO: 116511 - RNA, 47 nt, Mus musculus
gagauuuaaaagggauuauucaugcuaauaauucauuauuaucagau

SEQ ID NO: 116512 - RNA, 46 nt, Mus musculus
ugucauugcuauccuuccucuuuaaaacgacccuuugauauuagau

SEQ ID NO: 116513 - RNA, 45 nt, Mus musculus
ucgauguccauucaaacccuccuauguaagguuauuggugcuaag

SEQ ID NO: 116514 - RNA, 50 nt, Mus musculus
aaacagcucgaaggagacgcggcccaagggcucgucaucggccgugaugu

SEQ ID NO: 116515 - RNA, 68 nt, Mus musculus
augcuuuaggaugaaguucucauccucaaauuucucuccguagauggaccugccgccagugccauuau

SEQ ID NO: 116516 - RNA, 45 nt, Mus musculus
cccaaaacgcuccauggcuuccacaauguucaugccuucuuucac

SEQ ID NO: 116517 - RNA, 44 nt, Mus musculus
gguaaaaugcccgcaagucaaaagaaauuagagcuguccacagu

SEQ ID NO: 116518 - RNA, 45 nt, Mus musculus
augcacagagcccuagguuccacucccagcacacagacaccccaa

SEQ ID NO: 116519 - RNA, 63 nt, Mus musculus
uuguuguucugcauagaggguuuaucgggcagcccaaaaccaauugggagagcgaguggagca

SEQ ID NO: 116520 - RNA, 26 nt, Mus musculus
ggugccaaagugaggaaacagacagg

SEQ ID NO: 116521 - RNA, 62 nt, Mus musculus
gaugaauggaaggauaagagauguucacaccaauuccuggaguagggagggagaggaaccag

SEQ ID NO: 116522 - RNA, 45 nt, Mus musculus
ggcugaccucaacgcaacgcccgaggcugggcgcaaaccaaccag

SEQ ID NO: 116523 - RNA, 42 nt, Mus musculus
cucaaccagcggcgcguccucucgacuuguauccggcggcag

SEQ ID NO: 116524 - RNA, 45 nt, Mus musculus
guugacauuagguccauuccauagucuuaacugaccucaccccuc

SEQ ID NO: 116525 - RNA, 42 nt, Mus musculus
gaaaaacaggccacagugaagaggaggaaaugagggugaaga

SEQ ID NO: 116526 - RNA, 42 nt, Mus musculus
gagggcccagcacugcuuauuguuaaguguguaacggggcag

SEQ ID NO: 116527 - RNA, 42 nt, Mus musculus
gugcuaggaugugugccaccacuccugauaagacuggggauu

SEQ ID NO: 116528 - RNA, 45 nt, Mus musculus
cccuggcuuuccuggaacucacuuugcagacccugaaacucagag

SEQ ID NO: 116529 - RNA, 42 nt, Mus musculus
uucauuuauccgcuagaaggauaagcuuacauuggggcaacu

SEQ ID NO: 116530 - RNA, 65 nt, Mus musculus
gucuauugggucaaaacuuuauaguaagcagcaagcgguggcagaguggggaaagaggaggagaa

SEQ ID NO: 116531 - RNA, 46 nt, Mus musculus
gaacccagacuuacuguuuugucgucaugaaagccaggggucugag

SEQ ID NO: 116532 - RNA, 46 nt, Mus musculus
gcuccuaguccgcagaccuuaagcuaagauacuauccggggcuacu

SEQ ID NO: 116533 - RNA, 46 nt, Mus musculus
cuauucugucacuguauaacaaauuacucccagacuucacucagau

SEQ ID NO: 116534 - RNA, 40 nt, Mus musculus
agcaggugcccgucaauaugauaaaugaaagccaagagaa

SEQ ID NO: 116535 - RNA, 46 nt, Mus musculus
auacagagccauuguggcaaaucuuauaauucaaauagacacuuac

SEQ ID NO: 116536 - RNA, 30 nt, Mus musculus
agcuaaggggagggcuggugagauggcuca

SEQ ID NO: 116537 - RNA, 46 nt, Mus musculus
aaauucaaaagucucugaaaugagucggcacagugcaucuccgauc

SEQ ID NO: 116538 - RNA, 47 nt, Mus musculus
cuagacaaugaauauggcguauucaagguagaccauauguuggauga

SEQ ID NO: 116539 - RNA, 46 nt, Mus musculus
uauaauaaguauguauuuagugaugagugugugugugugugugugu

SEQ ID NO: 116540 - RNA, 46 nt, Mus musculus
uaaauguuauuuaugccuuucacguuaaagucucaagugcacucag

SEQ ID NO: 116541 - RNA, 42 nt, Mus musculus
guuuguuuguuuuuaaagcgugugccaccaccaccggcuuaa

SEQ ID NO: 116542 - RNA, 46 nt, Mus musculus
aauacacuguagcuguuuucaggcacucuagaagagggugucagau

SEQ ID NO: 116543 - RNA, 64 nt, Mus musculus
cacaggcuuuugggggucugaggagaggccaagagagagaaggaagaagucaccauggaauaga

SEQ ID NO: 116544 - RNA, 109 nt, Mus musculus
uacaacaaaagcuggcaugagaauucgcucaccuugaagcaacagauacagaauuaagcauucaacauagcagcagaccaaaccuccacacuaaggccgagaaagcaua

SEQ ID NO: 116545 - RNA, 64 nt, Mus musculus
aacacacacccauaccccuuaacaugagacaugaacuaaaucauaccaaucucuauacaacagg

SEQ ID NO: 116546 - RNA, 45 nt, Mus musculus
aacaacuacuauuuaauguguuuuuaugugagaggucaaguguca

SEQ ID NO: 116547 - RNA, 46 nt, Mus musculus
cugccaagucugaccaccugagugggguucacauggugggaggaaa

SEQ ID NO: 116548 - RNA, 45 nt, Mus musculus
cuaauaauagauuucaagaaaguuaauauuuuuuuaaaccagaga

SEQ ID NO: 116549 - RNA, 46 nt, Mus musculus
ccuuuauuuucuaaaguggacagcauaaaaacccaggugcaauuag

SEQ ID NO: 116550 - RNA, 42 nt, Mus musculus
cgagcugugcaucagccgcaggggucccuaucagacgggcag

SEQ ID NO: 116551 - RNA, 46 nt, Mus musculus
cuuaagugguagauaucagugucccccuuccuccaaggcccuuccu

SEQ ID NO: 116552 - RNA, 45 nt, Mus musculus
guuaggucacacagccugguccuuuguccacuuuugguagccuua

SEQ ID NO: 116553 - RNA, 45 nt, Mus musculus
ucagugguuacuuguaaagcaaccgcuggaaaggagcaaggagau

SEQ ID NO: 116554 - RNA, 46 nt, Mus musculus
guaaaacucacauuagccucuagugcuuuuaaaguuagcgugugau

SEQ ID NO: 116555 - RNA, 46 nt, Mus musculus
gugccacugauacugccuaauacagcgccauuugcucugugaagau

SEQ ID NO: 116556 - RNA, 46 nt, Mus musculus
gcaguguucauaauauuuuucuggauuuuagguauguuuuggagau

SEQ ID NO: 116557 - RNA, 46 nt, Mus musculus
uuuauguuaucugacacccauaaucacuguauuuugacagccagug

SEQ ID NO: 116558 - RNA, 42 nt, Mus musculus
uaacaacucaucuggugaggcagauuccaaacacggccauua

SEQ ID NO: 116559 - RNA, 46 nt, Mus musculus
gugagaaugaugcuagcugcugccaccucaaaaaccugugccacaa

SEQ ID NO: 116560 - RNA, 39 nt, Mus musculus
uaucagagacuguuauccauuuuguuauuuaugaaagua

SEQ ID NO: 116561 - RNA, 46 nt, Mus musculus
ugcacacaacacagacaaugccgacccucauugucucaugucagua

SEQ ID NO: 116562 - RNA, 42 nt, Mus musculus
caaccaucuguaaugagaucugacucccucuucuuagugucu

SEQ ID NO: 116563 - RNA, 28 nt, Mus musculus
gucuuguggaggcuggauuuaccagugu

SEQ ID NO: 116564 - RNA, 46 nt, Mus musculus
aguacacauggagggcccuguggcuccagcagcauauguagcagag

SEQ ID NO: 116565 - RNA, 45 nt, Mus musculus
augcagauguucgcagccaacuaucagacugagcacagggacccc

SEQ ID NO: 116566 - RNA, 45 nt, Mus musculus
agcugagguauuccaucucagcuccuguuggccucaguggagaaa

SEQ ID NO: 116567 - RNA, 71 nt, Mus musculus
ccuuuucuccacugaggccaacaggagcugagauggaauaccucagcugcacugcugccucuagucugcuc

SEQ ID NO: 116568 - RNA, 42 nt, Mus musculus
aauaaaucucagagaaucuaaaauauaagacuugggggaugu

SEQ ID NO: 116569 - RNA, 46 nt, Mus musculus
agaagccauggguaagaguuuguuuuaaagaggguaggccccuuaa

SEQ ID NO: 116570 - RNA, 42 nt, Mus musculus
cucauagcagcacacacacgaaagacaaaaggagaaauggag

SEQ ID NO: 116571 - RNA, 46 nt, Mus musculus
agugaggucagucugcuccugacagaaucaucuagaaaggccagaa

SEQ ID NO: 116572 - RNA, 46 nt, Mus musculus
auucucuuugaauguaguguggcagguaauagauucacccccaggc

SEQ ID NO: 116573 - RNA, 46 nt, Mus musculus
auuaaacaaguauaaacucuuaaaaaguuuguccaaaaaguuacag

SEQ ID NO: 116574 - RNA, 46 nt, Mus musculus
aaauuaaagauaauacuuggucccagaagcacacugcuccagcgau

SEQ ID NO: 116575 - RNA, 46 nt, Mus musculus
cucugaguaauuuaaaauauuuuuuauauguggugaucuuaaagug

SEQ ID NO: 116576 - RNA, 46 nt, Mus musculus
aaugagaucugacgcccucuucuggagugucugaagacagguaccg

SEQ ID NO: 116577 - RNA, 46 nt, Mus musculus
ucuuauuaaaauguaacaaaacuaaagugcagaauuagaaacagau

SEQ ID NO: 116578 - RNA, 46 nt, Mus musculus
uuaagacaaaauugaucgucuuuuagguaaguauuuggacucugaa

SEQ ID NO: 116579 - RNA, 30 nt, Mus musculus
uugcaguauuauaaguggccacaccuaaaa

SEQ ID NO: 116580 - RNA, 46 nt, Mus musculus
gcauguaugcacagacauuguuacacuguguacuuacugugcaguc

SEQ ID NO: 116581 - RNA, 46 nt, Mus musculus
cuguuaaucauuuucuauuuagaauaguuuaauuugaaccacauau

SEQ ID NO: 116582 - RNA, 51 nt, Mus musculus
acacuggcuuauguguacacacuuguguaggaaugcucccaggaaauuaac

SEQ ID NO: 116583 - RNA, 48 nt, Mus musculus
uuaucaguugaaucuaugugucucaggguuuaagugacagacugcaga

SEQ ID NO: 116584 - RNA, 41 nt, Mus musculus
agcauuguuuugucuuaagaauaaugugggcaagggguaga

SEQ ID NO: 116585 - RNA, 45 nt, Mus musculus
aaugaguuuauuccccgucauguuuuggaauuauauauccuaagu

SEQ ID NO: 116586 - RNA, 46 nt, Mus musculus
uugugagccaccauaugguggccugagccauuucucuagcccucac

SEQ ID NO: 116587 - RNA, 46 nt, Mus musculus
aaauauuuuaugaauaugaguacacuguugcugucuuccaacacau

SEQ ID NO: 116588 - RNA, 80 nt, Mus musculus
ugccucugggauguucauuagugcugcaaagauauauuuuuuagaaugacuaccuaaguagaauuucuggauaaaaggaa

SEQ ID NO: 116589 - RNA, 55 nt, Mus musculus
uuuauuuauuuauuuauuuauuuauucguugagacaggguaguacuauauagcca

SEQ ID NO: 116590 - RNA, 45 nt, Mus musculus
aggauuguggaaaaacaccaugugcucuuaaccucuaacccaucu

SEQ ID NO: 116591 - RNA, 46 nt, Mus musculus
aacuuauuuuccuacaagccugaugacuuguauucagcacucagaa

SEQ ID NO: 116592 - RNA, 49 nt, Mus musculus
ucaaaaaacaaaacaauaucuuuaaagaaaauaaagggcuugguguaug

SEQ ID NO: 116593 - RNA, 52 nt, Mus musculus
uugugcugugaacagaaaggaaauguuucauguuguaaagagacaguguagu

SEQ ID NO: 116594 - RNA, 46 nt, Mus musculus
uguuuucuccccaucuuuaccugagcuucaggaauccaaaccagau

SEQ ID NO: 116595 - RNA, 46 nt, Mus musculus
gguuagccugaaacuuaggauaguccucuugucucagccucccagg

SEQ ID NO: 116596 - RNA, 57 nt, Mus musculus
aaaacaagcaaacaaaucuagagagauauugaaaguucuuaugaugaaguaaaaagc

SEQ ID NO: 116597 - RNA, 54 nt, Mus musculus
gggcuccagaauaaagccuugucucaagacaacaaaccaagaaaucuauauuua

SEQ ID NO: 116598 - RNA, 83 nt, Mus musculus
aucuuuuaauguaguuauaagcugcuuauacacuaaguucucaauauaguaaauugaccgaaacucaccaagcauuccaguga

SEQ ID NO: 116599 - RNA, 41 nt, Mus musculus
cucuuaaaggcagaugaauguaauaauuaaagguaugggca

SEQ ID NO: 116600 - RNA, 46 nt, Mus musculus
uuuuccuccucuccuuuaaucucuuuauaaauuagucaccaaagaa

SEQ ID NO: 116601 - RNA, 46 nt, Mus musculus
auuacuguugauuaggucuuaaaauucucccuuagucgccugagau

SEQ ID NO: 116602 - RNA, 46 nt, Mus musculus
aaauugcaucacacuuguucaacuugguuacccaagaacaugaaag

SEQ ID NO: 116603 - RNA, 42 nt, Mus musculus
agaucugacaccuucuucuggugugucugaagacagcaacag

SEQ ID NO: 116604 - RNA, 46 nt, Mus musculus
cucuguacaguucuccucagcuguacugucagacacgcaugucacu

SEQ ID NO: 116605 - RNA, 46 nt, Mus musculus
cauuucaggauuuggcuggcuugaccuuuuguagcuaaccccaguu

SEQ ID NO: 116606 - RNA, 46 nt, Mus musculus
gggucuucuucagcaaaaucuuucuggcauaugcaacaguguccag

SEQ ID NO: 116607 - RNA, 45 nt, Mus musculus
aaaagcuaugcuaguuagucuuuugucaaucugauacuagaguua

SEQ ID NO: 116608 - RNA, 46 nt, Mus musculus
ucauuaucaagaaaaugccucuacuugcccagacaugcccagaggg

SEQ ID NO: 116609 - RNA, 44 nt, Mus musculus
aaggguuuguuugacuuaaccuguccuaaucacaguagaucacu

SEQ ID NO: 116610 - RNA, 46 nt, Mus musculus
uaugccauccacaucuuacauucgcauaugagauaauacugcagau

SEQ ID NO: 116611 - RNA, 46 nt, Mus musculus
cgccaccacgccgggcucagccuucuuuuuaucuugagacaggauc

SEQ ID NO: 116612 - RNA, 45 nt, Mus musculus
auuccagaaacuuccucauuuugauucugcaaaguaaaccaagag

SEQ ID NO: 116613 - RNA, 46 nt, Mus musculus
guguguauuuguguguaugugugugugugugugugugugugugugu

SEQ ID NO: 116614 - RNA, 45 nt, Mus musculus
gcuguguuuccucagacuccauccccacucugaccucagauggua

SEQ ID NO: 116615 - RNA, 46 nt, Mus musculus
aucacuacaucuggucucuagaacuggaaaaaauaaaugcuaacuu

SEQ ID NO: 116616 - RNA, 44 nt, Mus musculus
ccugccuugaagaaaagaaggaaggaagaaagaaagggaagagg

SEQ ID NO: 116617 - RNA, 47 nt, Mus musculus
uguuuugaguuaagaaauagaagucuuuaaucacuucuccuguagag

SEQ ID NO: 116618 - RNA, 46 nt, Mus musculus
uuuuaccugcaagacuauaaaguugucacaaaaaaucgcuauggug

SEQ ID NO: 116619 - RNA, 46 nt, Mus musculus
aguuuguuccuccauucgauauguuccuucccaguuauuuagagaa

SEQ ID NO: 116620 - RNA, 41 nt, Mus musculus
gcccagaaccccuggcucagcccgaguuggaagcgcccgca

SEQ ID NO: 116621 - RNA, 46 nt, Mus musculus
guguguguauguguguguguauacacauauauauuugggcuugcag

SEQ ID NO: 116622 - RNA, 24 nt, Mus musculus
aacaugcauugagauggggcauca

SEQ ID NO: 116623 - RNA, 46 nt, Mus musculus
aacacacacacacacacacacacacacacacacacacaccucgggc

SEQ ID NO: 116624 - RNA, 45 nt, Mus musculus
aguauugaagaagugcuguuugucucuugagugugcucagggcgg

SEQ ID NO: 116625 - RNA, 42 nt, Mus musculus
cgagccccaaccagggcuuuucggcgaagcaaacacccgcag

SEQ ID NO: 116626 - RNA, 44 nt, Mus musculus
guauguacgugagugugaauguguguauauguauguguguguga

SEQ ID NO: 116627 - RNA, 58 nt, Mus musculus
agcugaguguuuagggggcuggugagagaauagugaggugagugugaaugugugugug

SEQ ID NO: 116628 - RNA, 45 nt, Mus musculus
gaugaaguaaagauuuaaauuccaaaaugcuacaugccugcacca

SEQ ID NO: 116629 - RNA, 46 nt, Mus musculus
cggaaagacuacagguccuagcguccgcccuacucugccgcacuug

SEQ ID NO: 116630 - RNA, 45 nt, Mus musculus
auauuguuguguguggggaacaagagaggaagccuggguuugaug

SEQ ID NO: 116631 - RNA, 47 nt, Mus musculus
ccuguuucagaaaauuuuaucccaaaacuaauauauuuaacaggaag

SEQ ID NO: 116632 - RNA, 46 nt, Mus musculus
acagcuggacagggacacgugccuguaaucucaggauucuggaggu

SEQ ID NO: 116633 - RNA, 46 nt, Mus musculus
gugugcacgugugucugugugugcacaugagugcaggcgcccaugg

SEQ ID NO: 116634 - RNA, 45 nt, Mus musculus
uagacuacagagagagauuuucugccucugccccugagcugagau

SEQ ID NO: 116635 - RNA, 46 nt, Mus musculus
uucguucuuuuagaagauuuauuugcuucguuucguuuuuggagau

SEQ ID NO: 116636 - RNA, 45 nt, Mus musculus
ucucguucuagaaucucccaugaagguuagagauugucuuagguc

SEQ ID NO: 116637 - RNA, 78 nt, Mus musculus
aaaacuaacauaccagaauugggcaaaacagacaaacagaaggaaaagaccccccucaccccaagagaagccccaaga

SEQ ID NO: 116638 - RNA, 41 nt, Mus musculus
gauaucucaauguguguucauguguucuguucagugccagu

SEQ ID NO: 116639 - RNA, 45 nt, Mus musculus
aguucucacguacacauacacacauaaauuaaaaguguccuuaaa

SEQ ID NO: 116640 - RNA, 98 nt, Mus musculus
cugaaugcggugaagcugagcagagcuaagggaaaggaggccaugcacacgugccugaaacagagugcuuaccgggaggcgcucucugaccugcaguc

SEQ ID NO: 116641 - RNA, 45 nt, Mus musculus
gcagucaguuuucuuaauugcugagccaucucuccagcccaagac

SEQ ID NO: 116642 - RNA, 46 nt, Mus musculus
cugaaacucacuauguagaccaggcuggccuugaacucacagaggu

SEQ ID NO: 116643 - RNA, 47 nt, Mus musculus
uuaaaaugugggaauauuaguuuucuuuaagaauugaccacuaagau

SEQ ID NO: 116644 - RNA, 45 nt, Mus musculus
agcagugccagcgcuuagccucccagccaccucuccugcccgugu

SEQ ID NO: 116645 - RNA, 45 nt, Mus musculus
uagugucagcuagcuaaggaggcuguguucuuucaaguagcaaag

SEQ ID NO: 116646 - RNA, 42 nt, Mus musculus
uccuuuccugcucucccgcucuccacucacuugcugccaucc

SEQ ID NO: 116647 - RNA, 42 nt, Mus musculus
gaagagcagucagugcucuuaaccaucucuccagccccuggu

SEQ ID NO: 116648 - RNA, 45 nt, Mus musculus
gcugaaucccauggggacugugcagacgaacccauaugcugagaa

SEQ ID NO: 116649 - RNA, 44 nt, Mus musculus
uucaaaggacagcugaggucuggagacgucauauugcauagcug

SEQ ID NO: 116650 - RNA, 42 nt, Mus musculus
agugagcuugagaccagccuggucuacaacagcccugaagau

SEQ ID NO: 116651 - RNA, 72 nt, Mus musculus
guuuuggauaaaguaaaaacgaagaaaucaacaaagacuauuaaucccucuaaguaucagaccaucaggaaa

SEQ ID NO: 116652 - RNA, 68 nt, Mus musculus
aacuggaauuugauauuaauauuugugacuuaccaagaauggcucgauuauguuuugcuguuuaugca

SEQ ID NO: 116653 - RNA, 46 nt, Mus musculus
uacauucaugcacacacaaaguaaauaagauauaaaaacaugagau

SEQ ID NO: 116654 - RNA, 45 nt, Mus musculus
uuauuucggaugguugugagccaccauuugguuacugggauuuga

SEQ ID NO: 116655 - RNA, 42 nt, Mus musculus
ggguguaguagagcaugacugugcucucagcacuugggagga

SEQ ID NO: 116656 - RNA, 41 nt, Mus musculus
uauggugggugcuugcuuuaauuucauagugaccgugcaga

SEQ ID NO: 116657 - RNA, 45 nt, Mus musculus
gaaugacuugucuggcgugugcagguacgaggauaaguggacaga

SEQ ID NO: 116658 - RNA, 46 nt, Mus musculus
agagagaagauguucauugucccuugucaccuucuugccaucagga

SEQ ID NO: 116659 - RNA, 47 nt, Mus musculus
acucauccaaccuuccucucccuuuaccaccaaagaaaacgcgaguu

SEQ ID NO: 116660 - RNA, 55 nt, Mus musculus
aauugugugaugaauagaacccugccccacuucauccuuguggaauguuguaaga

SEQ ID NO: 116661 - RNA, 46 nt, Mus musculus
guauagcugcuuauuaguuuuuuauaaacauauuugagaguuagau

SEQ ID NO: 116662 - RNA, 50 nt, Mus musculus
auaaaugaauuggcaauccagaaacgccucacuauucguggaaaggaaga

SEQ ID NO: 116663 - RNA, 90 nt, Mus musculus
aauugucuuuuaaaguuguuuaccuagcacacacaaggccauagguucaaacccuagcacuucucuuccccucccugcccccacaguugg

SEQ ID NO: 116664 - RNA, 46 nt, Mus musculus
auugggauaggcuuuguacagaaauucuugacguguuacaauagua

SEQ ID NO: 116665 - RNA, 45 nt, Mus musculus
gaggaaagcugguuguggcugugcacuuugaaaauagccagguau

SEQ ID NO: 116666 - RNA, 45 nt, Mus musculus
guugucuuggaucgacuggcuaaagcacacguauccgccugagca

SEQ ID NO: 116667 - RNA, 46 nt, Mus musculus
cuaaacaggcgcugaggaggaguuugcaaaugaagggguuauagga

SEQ ID NO: 116668 - RNA, 45 nt, Mus musculus
uccuccaugugaguuccaggaaucaacuuuagcuaucagccuugg

SEQ ID NO: 116669 - RNA, 45 nt, Mus musculus
agcaucggcuugaugugccaggcugcccugaguucagccccgagc

SEQ ID NO: 116670 - RNA, 30 nt, Mus musculus
ggccagccagggauacaaagugagaccccg

SEQ ID NO: 116671 - RNA, 62 nt, Mus musculus
auggauccugaaggaggaggggcacacguggcaggauuacaguugauaagggaaagucuaga

SEQ ID NO: 116672 - RNA, 52 nt, Mus musculus
gguuggaggguucuuuuaaugguggauaaugaaucuaaaaugagaugaccag

SEQ ID NO: 116673 - RNA, 46 nt, Mus musculus
uggagcuuucuauguagaguaggcuggcuuugaaugccacagagau

SEQ ID NO: 116674 - RNA, 47 nt, Mus musculus
gucgaucacccugacauacucaaccccauuacuuaaaaucagaaaga

SEQ ID NO: 116675 - RNA, 46 nt, Mus musculus
caggauaucuaauuuguucuucugucuucuuugugcaugacuaguu

SEQ ID NO: 116676 - RNA, 42 nt, Mus musculus
cuaguauuggaauucacaagauacagugcccuuguaauggga

SEQ ID NO: 116677 - RNA, 23 nt, Mus musculus
ccugcccucagcauagauggggu

SEQ ID NO: 116678 - RNA, 45 nt, Mus musculus
gacagucuuaaaaauaauaauaauaacuuauuagugugugaaagu

SEQ ID NO: 116679 - RNA, 46 nt, Mus musculus
gcauagcaugaccuuucaaaacuguuuuuuuuauguugccagaauc

SEQ ID NO: 116680 - RNA, 45 nt, Mus musculus
aggacaccugcuguggagugcagcuauuagacuuuccuuggaaaa

SEQ ID NO: 116681 - RNA, 71 nt, Mus musculus
ggcugacaggguuuugaagcaaucaaauuagggaaauuuugaagaaugaucagagugaguuagggagagua

SEQ ID NO: 116682 - RNA, 44 nt, Mus musculus
uggccccuggggaccgaauagaacauuucaacacaaucuaaaga

SEQ ID NO: 116683 - RNA, 45 nt, Mus musculus
ugcauuuggagcuucauuuuacaguagagaauagaggcgcagagg

SEQ ID NO: 116684 - RNA, 42 nt, Mus musculus
uaguggugguguuugcagauagccuugcuauaaccugcagau

SEQ ID NO: 116685 - RNA, 42 nt, Mus musculus
aggagagcuucuguuccuggaacaguccaaaacgucccugug

SEQ ID NO: 116686 - RNA, 45 nt, Mus musculus
ccucuggaucugaaacugcagagggcaaauuguagagguaaauuu

SEQ ID NO: 116687 - RNA, 44 nt, Mus musculus
ggcugagggucagaagugcucuagacuuugaccuaagucagagu

SEQ ID NO: 116688 - RNA, 46 nt, Mus musculus
cuaaagccaaaaggauuuaagaagcaucuuuaguuuacccucguga

SEQ ID NO: 116689 - RNA, 41 nt, Mus musculus
ggggcaugcgggugucggagccaggcgggcacggcugcggg

SEQ ID NO: 116690 - RNA, 57 nt, Mus musculus
acuuucaagguuccaaagccgugucuuguuaauagccuggauggggaaaagauuacu

SEQ ID NO: 116691 - RNA, 46 nt, Mus musculus
uucagaacucagagaaccuuggggguuacagggggugggggcuuga

SEQ ID NO: 116692 - RNA, 59 nt, Mus musculus
uagauuugaauauccugcacauguuucaauaaagcaauaggaggaaggacaagggggaa

SEQ ID NO: 116693 - RNA, 55 nt, Mus musculus
agcuucuuccuagagugauaguucuuuguaucacgccccuggcuuucagugauag

SEQ ID NO: 116694 - RNA, 58 nt, Mus musculus
ucaucuucgugcaaccaggguaacgaagccuacaaguaggcaagaggucauuugcgag

SEQ ID NO: 116695 - RNA, 90 nt, Mus musculus
agguuagcgcauaggagacaagcuccugaguaaccuggaaacgguggagagcggcuuccuguguggccagaagaggggacuguuggggca

SEQ ID NO: 116696 - RNA, 47 nt, Mus musculus
gagacuggcuucuggcaugucuguggggaacucucugaauuacgucg

SEQ ID NO: 116697 - RNA, 56 nt, Mus musculus
cugggguuacauaguaagacugucucaaaaccacaaaaccaauauuuaaaaagcag

SEQ ID NO: 116698 - RNA, 27 nt, Mus musculus
uuuucuuuucucucuuuuucuuucuuc

SEQ ID NO: 116699 - RNA, 46 nt, Mus musculus
uuggguuuuuuuguuuuuaccaguuauuuugcaaucacgccccgag

SEQ ID NO: 116700 - RNA, 41 nt, Mus musculus
uguauguguguauaugaaugcauguauguagaacugugggu

SEQ ID NO: 116701 - RNA, 42 nt, Mus musculus
cagagcuagcuacacuucuagcccacuucuuuucaaugacag

SEQ ID NO: 116702 - RNA, 46 nt, Mus musculus
guaaguagaauguaagcaugaggauuaagaaggaaacaggcacucg

SEQ ID NO: 116703 - RNA, 47 nt, Mus musculus
auaacaucacauguguacacauucauguuauacaauauacaggggca

SEQ ID NO: 116704 - RNA, 46 nt, Mus musculus
gauaauuuuaguccuuuaucuaccaaaguagucaagcugugugacc

SEQ ID NO: 116705 - RNA, 41 nt, Mus musculus
ggcggugguggcacacaccuuuaaucacagcacucgggagg

SEQ ID NO: 116706 - RNA, 41 nt, Mus musculus
uguguaguuaccuauggagccuagcuuggugucugggggug

SEQ ID NO: 116707 - RNA, 46 nt, Mus musculus
caaaaugguuggucagucaauagcagaaacacaucaaacaucacag

SEQ ID NO: 116708 - RNA, 42 nt, Mus musculus
cacucuccacaucuguaggcuuucuuuccuuuaaugccccau

SEQ ID NO: 116709 - RNA, 54 nt, Mus musculus
aucacaaaaaaugaggcagauuuugaaaacguugauggaagaaacaacacguca

SEQ ID NO: 116710 - RNA, 41 nt, Mus musculus
aauccuacuacaguguauacauaauaaugucauaacaccca

SEQ ID NO: 116711 - RNA, 46 nt, Mus musculus
agagccaagguaaagaauggauuacuguauauuucauggucacuag

SEQ ID NO: 116712 - RNA, 42 nt, Mus musculus
aaucguacuuuuacaauguucuuacagaugaaaugccagcaa

SEQ ID NO: 116713 - RNA, 46 nt, Mus musculus
gaccauugcuucuuugcaaaaggagauccacagacuugccaaagag

SEQ ID NO: 116714 - RNA, 31 nt, Mus musculus
uggcaaauggugaccgcaguaagaauccaua

SEQ ID NO: 116715 - RNA, 23 nt, Mus musculus
uaaguagugauggugcauccaua

SEQ ID NO: 116716 - RNA, 46 nt, Mus musculus
auucaugcauccaguuuugcuguucaugcugcuguaauaaggauag

SEQ ID NO: 116717 - RNA, 46 nt, Mus musculus
ggcaaagugaagcaucauugcuaacacacaguugugaauggugcag

SEQ ID NO: 116718 - RNA, 42 nt, Mus musculus
aaaaagacccuuuaauaccauacuuagcuuaaauaugagaag

SEQ ID NO: 116719 - RNA, 46 nt, Mus musculus
agauccaacucagcacaugaaguuggaugagccuucauauggagag

SEQ ID NO: 116720 - RNA, 63 nt, Mus musculus
auacagugaucuguuuuguaccacugugaaaagaugaaaaccaucaaacuguguacuuaguaa

SEQ ID NO: 116721 - RNA, 46 nt, Mus musculus
auugcuacaaaaauauuuaaaauguagacuagaaauauggcuccau

SEQ ID NO: 116722 - RNA, 46 nt, Mus musculus
auacuaauggugguuauuauauagcuauguguuuuuaggcccccau

SEQ ID NO: 116723 - RNA, 46 nt, Mus musculus
gcauagcuuaaagaaacuggaugaaaaggaaggugucaaagucgga

SEQ ID NO: 116724 - RNA, 45 nt, Mus musculus
aauucuuuaaaaauaucuuaugcuuucuuuucucuuuugcagaca

SEQ ID NO: 116725 - RNA, 45 nt, Mus musculus
aaggaaaaaauauauauauacgcauauucuagauauaauaccagg

SEQ ID NO: 116726 - RNA, 45 nt, Mus musculus
uuuguccaaaggggguacagucgagacuugcuuugggagagucgg

SEQ ID NO: 116727 - RNA, 42 nt, Mus musculus
caaaugggaagacagcacccucuacccccaccccgcccccaa

SEQ ID NO: 116728 - RNA, 42 nt, Mus musculus
aacuccugcuuagaucucaccugcuacacuaggggauuggag

SEQ ID NO: 116729 - RNA, 76 nt, Mus musculus
uaucucgucaagcauuugucuugauagugcucgucagcagugacuguuccacagcuuuaacuggucauguaacugg

SEQ ID NO: 116730 - RNA, 85 nt, Mus musculus
agcugaaagagacuguuuacugcauugggcagcggaaauucagcaccauggaggaacuuguagaacauuacaaaaaggcaccgau

SEQ ID NO: 116731 - RNA, 62 nt, Mus musculus
uuagccaaaugauuucucaguaucacuaaaagcacaagggaaaaacaagcauuuuaaagucc

SEQ ID NO: 116732 - RNA, 25 nt, Mus musculus
uccaugcauuaauaaauaagguugg

SEQ ID NO: 116733 - RNA, 53 nt, Mus musculus
agucaccaggcaccaggcagaaauggcauuaaaugaaagagggcaugaaggag

SEQ ID NO: 116734 - RNA, 80 nt, Mus musculus
accuuaacaugccugcuuuugugaaauuuaacuacauggcugagagagaggaugaguugucauugauaaaagggaccaag

SEQ ID NO: 116735 - RNA, 45 nt, Mus musculus
aacauggagagcuugccugugaucuuauuuuucauaugaaaagau

SEQ ID NO: 116736 - RNA, 45 nt, Mus musculus
guugauuuaaagguauagaaggauauuuuuuuuaaaggagggauc

SEQ ID NO: 116737 - RNA, 42 nt, Mus musculus
uccuuaguugccuguauguuguucuuuggcuagggucgaggc

SEQ ID NO: 116738 - RNA, 71 nt, Mus musculus
uuuguucugccugugguauguuauaguaguaguuggagaggaggaggcauguuguugaagacauguucaca

SEQ ID NO: 116739 - RNA, 46 nt, Mus musculus
ucagacucugacauuaaguuuauuaagggauaugaaagcaguuuau

SEQ ID NO: 116740 - RNA, 46 nt, Mus musculus
auucugucgagcauuuacuuagugauuaagugaaagaaagcuagua

SEQ ID NO: 116741 - RNA, 45 nt, Mus musculus
gagucagaaagccuaaggaaacagugaucuaaugagaguccaaga

SEQ ID NO: 116742 - RNA, 46 nt, Mus musculus
uggcuuaaggggagaaaacaguauuggaaaaagagaagccucaguu

SEQ ID NO: 116743 - RNA, 46 nt, Mus musculus
aaucuagguuuuguguucaaauaucuaaccuccccuuuccccagaa

SEQ ID NO: 116744 - RNA, 52 nt, Mus musculus
auugcuuaauaauucuuugccuguuuguaaaaaaagagggaaacaguuuuuu

SEQ ID NO: 116745 - RNA, 46 nt, Mus musculus
uuuuaauauuuuuaauuuauuugguguguguguguguaagagagag

SEQ ID NO: 116746 - RNA, 46 nt, Mus musculus
uuacuuaacaaaaggacaguacuccccuguaguaaaaguuccuguu

SEQ ID NO: 116747 - RNA, 23 nt, Mus musculus
agguguaggacccucuguguggg

SEQ ID NO: 116748 - RNA, 46 nt, Mus musculus
cuguuuauugcuguguuuguacauagauucaguuaaggacacuugg

SEQ ID NO: 116749 - RNA, 45 nt, Mus musculus
ucuuuaaauuuccuucaaucugagaaggaaguacauuugggagaa

SEQ ID NO: 116750 - RNA, 42 nt, Mus musculus
cccaacaucugucaaguauagacgugaggugggaucugagaa

SEQ ID NO: 116751 - RNA, 46 nt, Mus musculus
cuucaaacucagagauucaaguccucuaggagccaggaggaggagg

SEQ ID NO: 116752 - RNA, 46 nt, Mus musculus
ggccuugaacucaaaaauccaccugccucugccucccgagugcugg

SEQ ID NO: 116753 - RNA, 45 nt, Mus musculus
auggguugugagccaccaugugguugcugggauuugaacucugga

SEQ ID NO: 116754 - RNA, 45 nt, Mus musculus
uuuaacaacuuccucgggaauuccuuuuccauuugagcagacaga

SEQ ID NO: 116755 - RNA, 45 nt, Mus musculus
aaaacuuauaguuuaaauaguuuaaaauguaucuuugggggagaa

SEQ ID NO: 116756 - RNA, 46 nt, Mus musculus
guaccaagccaucucuucaguuccuauugugcauuuuaggcaggua

SEQ ID NO: 116757 - RNA, 46 nt, Mus musculus
ggggcuugugcuuucuuaucuaggcuagaagcaaacaaucagaguu

SEQ ID NO: 116758 - RNA, 46 nt, Mus musculus
auuuucuccaacaucuauaagaaauaagagagagaaggccauaaau

SEQ ID NO: 116759 - RNA, 46 nt, Mus musculus
cucuuauauguugaguuuagagguguuuaauagcucaugccuguau

SEQ ID NO: 116760 - RNA, 42 nt, Mus musculus
aauucagaaauccgccugccacugccucccgagugcugagau

SEQ ID NO: 116761 - RNA, 46 nt, Mus musculus
ugcugagcccucucuccagccccuuguguuccuuuucuugcuggac

SEQ ID NO: 116762 - RNA, 79 nt, Mus musculus
cuuucuaucuaagccagcuaacucccuacucagccaucuugauuaaaucaucuuaauguaaaaccuagagagccuaggg

SEQ ID NO: 116763 - RNA, 47 nt, Mus musculus
uaugcuucuugugucccuguguugguauuuugugcaucugguagguu

SEQ ID NO: 116764 - RNA, 46 nt, Mus musculus
uggagacaucuuuccagucccuagaaauuuaauugugauuugagug

SEQ ID NO: 116765 - RNA, 42 nt, Mus musculus
gguugguuucguacuguugucguacggguuuccgugcuaggu

SEQ ID NO: 116766 - RNA, 35 nt, Mus musculus
gucucaccuucccuccgccgagcccucggcuccag

SEQ ID NO: 116767 - RNA, 36 nt, Mus musculus
uauuauuucugugcuaaccauaucaacaguuguaug

SEQ ID NO: 116768 - RNA, 44 nt, Mus musculus
gaaaaaacccugucuugaaacaccaauuaaaaaaaaaggaggag

SEQ ID NO: 116769 - RNA, 42 nt, Mus musculus
uauaaucugcaccaguucuguaguaaauugaagaaggaagga

SEQ ID NO: 116770 - RNA, 46 nt, Mus musculus
ccccaaggucccacccuugccagaggagauucugguggucauugcu

SEQ ID NO: 116771 - RNA, 42 nt, Mus musculus
cccagagucuguccccagaaauugcaccuggcgcuguuaggu

SEQ ID NO: 116772 - RNA, 46 nt, Mus musculus
uuaagaucacacagaacaaugcuaugaagaucucuuuugccaagaa

SEQ ID NO: 116773 - RNA, 45 nt, Mus musculus
cuuuguggagagagaucgcaaacgagagaagaggaagcccaagag

SEQ ID NO: 116774 - RNA, 45 nt, Mus musculus
uaagagaggacaggaugggugucagugugugugugugugucagag

SEQ ID NO: 116775 - RNA, 42 nt, Mus musculus
cuggaccaggcuuugcacagcauccuguaucacuucccccag

SEQ ID NO: 116776 - RNA, 42 nt, Mus musculus
agacaaaagggggaugggucugggggagacaggaagugggaa

SEQ ID NO: 116777 - RNA, 42 nt, Mus musculus
uuacuuagugggagaaucaguacaucaaaaaagugacaagga

SEQ ID NO: 116778 - RNA, 46 nt, Mus musculus
cagcuagagugcuauggaacaauacaaacugaagauguccacugug

SEQ ID NO: 116779 - RNA, 42 nt, Mus musculus
augugagacugacccugcaguuugagaaagggcggugguggu

SEQ ID NO: 116780 - RNA, 42 nt, Mus musculus
aaguuucaaaaccaugaguuuuauaauacaguggggccauuc

SEQ ID NO: 116781 - RNA, 46 nt, Mus musculus
guaguauggaauauguguuaaagggauuauuagaauuauaaaagac

SEQ ID NO: 116782 - RNA, 83 nt, Mus musculus
gguguuguguugaaaguucuccucagaugucagucaugguucacguaugcuugcuuucuuucaauggacaggacagguuacau

SEQ ID NO: 116783 - RNA, 46 nt, Mus musculus
accagguccucaucgacagcauggcucugaagaacucaccguccuu

SEQ ID NO: 116784 - RNA, 46 nt, Mus musculus
ugauccagaacuccuccucuaagagaaugggugccaucgaugagac

SEQ ID NO: 116785 - RNA, 46 nt, Mus musculus
cugguaugggaugaaccuuggaguggccauuucuggggugcuagaa

SEQ ID NO: 116786 - RNA, 46 nt, Mus musculus
cuaacuggccaguacagagacacacagacuuccauuaccgauaguu

SEQ ID NO: 116787 - RNA, 45 nt, Mus musculus
guguacugaaccaucuguagugacaagguagguaacugacaggcu

SEQ ID NO: 116788 - RNA, 46 nt, Mus musculus
gauaguuaaauugaaauuacaacagaaaugcuacauuacugacuau

SEQ ID NO: 116789 - RNA, 32 nt, Mus musculus
agagucccccacaugugaggacagaacggaga

SEQ ID NO: 116790 - RNA, 45 nt, Mus musculus
cuuacuuccggcucucuacaugcuuggcaguggacugcagggaug

SEQ ID NO: 116791 - RNA, 45 nt, Mus musculus
uuucccacacuccugauccuauaacaacuguaggaaaggccaccc

SEQ ID NO: 116792 - RNA, 46 nt, Mus musculus
gauauuugugguccucugauaagaauuacuaagauauaauucuggu

SEQ ID NO: 116793 - RNA, 42 nt, Mus musculus
cgucgccucagccccgcggggucgccgaggcgcgggcggcag

SEQ ID NO: 116794 - RNA, 77 nt, Mus musculus
gggaaaaaagguuuauuuuaggcagaggcuaauauuaaguagagagaucuuggguuaagaacaugugguguuucugg

SEQ ID NO: 116795 - RNA, 45 nt, Mus musculus
ggugaggcccuagguucaauucccauauugcagcaaaacacagau

SEQ ID NO: 116796 - RNA, 42 nt, Mus musculus
gggugauguggcuacacuucuacauuguagucuaccguggaa

SEQ ID NO: 116797 - RNA, 42 nt, Mus musculus
uaaaacacgagaagaacugaaagaugcccuugagucugagau

SEQ ID NO: 116798 - RNA, 45 nt, Mus musculus
aggacuugaggaagagaacagcagcugccccuccuuucccaucaa

SEQ ID NO: 116799 - RNA, 46 nt, Mus musculus
aguugagucggggagaguugccgagagaagugggggacagggauag

SEQ ID NO: 116800 - RNA, 46 nt, Mus musculus
ccgcggcgcaggaacccgcggcgacaggccccggcggggaaaagga

SEQ ID NO: 116801 - RNA, 108 nt, Mus musculus
uuagcacgacugcauucaaacuacuacaagcacaaguacccucgccccagagccaccagcuucaguggccuguccguggaagaguaccagcugauccuguccacaggu

SEQ ID NO: 116802 - RNA, 47 nt, Mus musculus
gggagggagagaacacccagauuacagaacccgaggccugugaucag

SEQ ID NO: 116803 - RNA, 46 nt, Mus musculus
uuguuguuguuguuguuguuguuguuguuguugcugcuguuguuac

SEQ ID NO: 116804 - RNA, 60 nt, Mus musculus
gcauggugggccuugaugagcagagacagucuaugguuuuagagcuuuauuguaaaaagg

SEQ ID NO: 116805 - RNA, 43 nt, Mus musculus
ggacaauucuuggggcugaaggaagauuaggagucgccaagug

SEQ ID NO: 116806 - RNA, 57 nt, Mus musculus
aacgagaaagaggcauguggggacagacaugaguaaccucagauagcaaagaggcag

SEQ ID NO: 116807 - RNA, 46 nt, Mus musculus
uccuggcugccugcagaugugaguuucuuccuagcugccuucagau

SEQ ID NO: 116808 - RNA, 45 nt, Mus musculus
ggacuuauguggggaggaagguaucuaagggggagggaacaagag

SEQ ID NO: 116809 - RNA, 26 nt, Mus musculus
gcgaggucccgucguccgggcgagag

SEQ ID NO: 116810 - RNA, 46 nt, Mus musculus
guuuucgacauuauguuaaaguuaccuguuuuugaauccuuggcuu

SEQ ID NO: 116811 - RNA, 46 nt, Mus musculus
gucugaagucagcuacaaggguacuccuauaaauaacauaaagaag

SEQ ID NO: 116812 - RNA, 46 nt, Mus musculus
cuguuucuuuggaaguaacaucuuuauuagauaauaccaguaguag

SEQ ID NO: 116813 - RNA, 41 nt, Mus musculus
ugcacguguguguguguguguguguguguguguguucauag

SEQ ID NO: 116814 - RNA, 46 nt, Mus musculus
acacgugcacaugcgcacauauguuuaguuugccuuaagacaguag

SEQ ID NO: 116815 - RNA, 46 nt, Mus musculus
gcagcuggcuuuacuauuauuuucuuuauucauaucugccuccaga

SEQ ID NO: 116816 - RNA, 45 nt, Mus musculus
uaagaaguacgguguggaccucaucagauacacccaugcagccaa

SEQ ID NO: 116817 - RNA, 46 nt, Mus musculus
ucaccaggcuugccguuuacaaucuguauguggauuaaaccaggug

SEQ ID NO: 116818 - RNA, 46 nt, Mus musculus
uaacugagggagaauaaaacaaaauuugcagauguacuaaaugcag

SEQ ID NO: 116819 - RNA, 46 nt, Mus musculus
ugcucacaggcuaggugagcacaucaccguugaauuguacaccuag

SEQ ID NO: 116820 - RNA, 42 nt, Mus musculus
uacuauucguuacuuguccuugcaugacaauaaauacaucag

SEQ ID NO: 116821 - RNA, 46 nt, Mus musculus
ccguuaacaagaugaagaggagugcugagugcauuccuuagcagug

SEQ ID NO: 116822 - RNA, 46 nt, Mus musculus
gacaggguuucucuguguugaccaggcuuuccucaaacucacagau

SEQ ID NO: 116823 - RNA, 45 nt, Mus musculus
augugguuggcucuggauucaauuccccacacuaagaaagucaau

SEQ ID NO: 116824 - RNA, 46 nt, Mus musculus
ugaguucuaggacagacaaggauccugucucaaaaagguggaggga

SEQ ID NO: 116825 - RNA, 42 nt, Mus musculus
gggugaaaucauuucuuuggccuauugcugaagcccaaaggu

SEQ ID NO: 116826 - RNA, 48 nt, Mus musculus
cuuugggcuucagcaauaggccaaagaaaugauuucacccagaucuuc

SEQ ID NO: 116827 - RNA, 46 nt, Mus musculus
aaggaauuuguuucucuuggaacucuguaauguuguagauacggug

SEQ ID NO: 116828 - RNA, 42 nt, Mus musculus
caaugauggcaaauugauacucaucuccaccaacggcagcuu

SEQ ID NO: 116829 - RNA, 46 nt, Mus musculus
cacucgaagcuucauuuacuccagacucacaguuuauuaugaucgg

SEQ ID NO: 116830 - RNA, 45 nt, Mus musculus
uaugucagcaggcucaugguauuuagcccccuuucuagauaggag

SEQ ID NO: 116831 - RNA, 42 nt, Mus musculus
auagagauuucaaggcuacucuggacuauguaacagaaggaa

SEQ ID NO: 116832 - RNA, 50 nt, Mus musculus
uggauggcaaacacacuggucccauuaccuguuugcaauucaaccccaag

SEQ ID NO: 116833 - RNA, 94 nt, Mus musculus
gaagugguggcuuucuuguuacccugcaucauagauaucugacuaggcuguucuuuuuacuuuaaauccuuuuccaguaauaugggacuuacuc

SEQ ID NO: 116834 - RNA, 44 nt, Mus musculus
cccuggcuauccuggaacucccucuguagaccaggcugggagau

SEQ ID NO: 116835 - RNA, 48 nt, Mus musculus
gagagaggagaaaggagagggaaaaaagaaaaagcuguaagaugggau

SEQ ID NO: 116836 - RNA, 46 nt, Mus musculus
gugggugugggugugugguuuauuuauuuaucuauuucucauucaa

SEQ ID NO: 116837 - RNA, 42 nt, Mus musculus
aguacuacuguuuccuuaacacacugugugacuguggugggu

SEQ ID NO: 116838 - RNA, 47 nt, Mus musculus
gagggcggccaacaggaaaagccagaggugacugagaugacagugag

SEQ ID NO: 116839 - RNA, 45 nt, Mus musculus
uaaugaguuacuuugcugagcaccuucagaaggacuccuggugcu

SEQ ID NO: 116840 - RNA, 45 nt, Mus musculus
agcagcgaguacauucaaaauugaagggguucaagagccccacug

SEQ ID NO: 116841 - RNA, 46 nt, Mus musculus
gaggagccagugaaguccccacuuucugcacauccuucucacccca

SEQ ID NO: 116842 - RNA, 46 nt, Mus musculus
uuaauuguggcauuauuccacaaccaucauguuucuuaggugccaa

SEQ ID NO: 116843 - RNA, 46 nt, Mus musculus
agggguuucaucuguugacuauguacacaauuuguggugggcaggg

SEQ ID NO: 116844 - RNA, 46 nt, Mus musculus
aggccuguguuauauguuauauuuagccuuuuuauauaugacccuu

SEQ ID NO: 116845 - RNA, 41 nt, Mus musculus
gcacauuacauacguguauaugccugucucucaucuagauu

SEQ ID NO: 116846 - RNA, 80 nt, Mus musculus
cucuucccagcucggcagcuuuagaguagaacaaacggccaucaaacauugaugcaagcacuaucccugcagauccagaa

SEQ ID NO: 116847 - RNA, 45 nt, Mus musculus
ugcucagaccaucacugcuucuguucagucgcagauagccgucca

SEQ ID NO: 116848 - RNA, 26 nt, Mus musculus
aagcauuggugacuggacggcuaucu

SEQ ID NO: 116849 - RNA, 48 nt, Mus musculus
aaauuauucccuguuguaacugacaauuagugcuuaugaaggaaaauu

SEQ ID NO: 116850 - RNA, 42 nt, Mus musculus
ccaaguuugagguaaacugugugggacacaaggcaggcagug

SEQ ID NO: 116851 - RNA, 45 nt, Mus musculus
cugccugccuugugucccacacaguuuaccucaaacuuggaucag

SEQ ID NO: 116852 - RNA, 45 nt, Mus musculus
caaugcauuagccaagccauggcucagcagguccuacugccagau

SEQ ID NO: 116853 - RNA, 42 nt, Mus musculus
gccagcaggacucaagcucccucaaaagaugccacuuugaag

SEQ ID NO: 116854 - RNA, 45 nt, Mus musculus
gaacuuggagcacacugcacacagccuacgggcaacucaacaggu

SEQ ID NO: 116855 - RNA, 45 nt, Mus musculus
uggggucgcguuuugugaguguugccaggcuggcgggugucguaa

SEQ ID NO: 116856 - RNA, 46 nt, Mus musculus
aucuccugagaacagaacugcuucucuugcuccguggagccuugag

SEQ ID NO: 116857 - RNA, 41 nt, Mus musculus
aggaucuguuuccccugcccaguaauaaagccagcauugga

SEQ ID NO: 116858 - RNA, 45 nt, Mus musculus
gaaagcugggagacaacaggaaggagagguucugagaugugggcg

SEQ ID NO: 116859 - RNA, 42 nt, Mus musculus
ugggugucauucgaggcucuguaaacuucuggagaaggggag

SEQ ID NO: 116860 - RNA, 42 nt, Mus musculus
ggaacucaguauguagaccaggcuagcuucaaacucacaaga

SEQ ID NO: 116861 - RNA, 44 nt, Mus musculus
uccgcugccuuuaccucugccuuuccuucucccggaaugccaag

SEQ ID NO: 116862 - RNA, 41 nt, Mus musculus
caaggauuccgagggcuacaucuaugcuaggggcucccagg

SEQ ID NO: 116863 - RNA, 41 nt, Mus musculus
aggccucaaaggggucgugaugccaauguuccuggggggca

SEQ ID NO: 116864 - RNA, 25 nt, Mus musculus
auacaccuuuaaucacaacaccagg

SEQ ID NO: 116865 - RNA, 45 nt, Mus musculus
ucaccauagucuggauuggguugcacagugcagaugcgcagguac

SEQ ID NO: 116866 - RNA, 46 nt, Mus musculus
aagcacaggacugagacguggagagagcaagguuggaggaccuuag

SEQ ID NO: 116867 - RNA, 41 nt, Mus musculus
aacagaaucuacacacaaugacaaaaucacucagcggcgug

SEQ ID NO: 116868 - RNA, 42 nt, Mus musculus
auguuccugggcgagguggcccucggcaaagagcaccacauc

SEQ ID NO: 116869 - RNA, 46 nt, Mus musculus
gaggaggcugaagugggaggggccaggccaggaugugcuggaagau

SEQ ID NO: 116870 - RNA, 46 nt, Mus musculus
gcaaaaacaaauggggcucaaguucuuggcagacagacagauggaa

SEQ ID NO: 116871 - RNA, 42 nt, Mus musculus
gaggggcacauggccacgugguccagagggacaggcugagag

SEQ ID NO: 116872 - RNA, 46 nt, Mus musculus
aacaucuucagcaaagagauguucaagaaugcaaugacccucauga

SEQ ID NO: 116873 - RNA, 46 nt, Mus musculus
uggaagaugcaaagaaggacuuuaagaagaaauuuugggagaagac

SEQ ID NO: 116874 - RNA, 45 nt, Mus musculus
cagcaaccuagccagaugacugacaggaggaggaaauguucuaga

SEQ ID NO: 116875 - RNA, 46 nt, Mus musculus
acaccacuugguccuaagcucuagagagguagauccagcugcagaa

SEQ ID NO: 116876 - RNA, 46 nt, Mus musculus
ggggcaaguccaaggguggcggcaaaaugaaugaagagauuuccag

SEQ ID NO: 116877 - RNA, 42 nt, Mus musculus
guuuggcucgagauccugggucuacccuccaguuuccggcag

SEQ ID NO: 116878 - RNA, 47 nt, Mus musculus
uuagggucuuguuucacuguugcgaacacgggugagcaggcaagugg

SEQ ID NO: 116879 - RNA, 42 nt, Mus musculus
acagcuuggcuccaaggaaaacagaggaagaggaggaggaag

SEQ ID NO: 116880 - RNA, 46 nt, Mus musculus
aaaagaagcuacgcuuggccaaacucuaccuugaacaacucaggca

SEQ ID NO: 116881 - RNA, 42 nt, Mus musculus
ggcugaagcccgugcauucgaggaggaucagguggccgggcg

SEQ ID NO: 116882 - RNA, 46 nt, Mus musculus
acagaggccuguggguagugagugguguguguguaaaggccgcgag

SEQ ID NO: 116883 - RNA, 29 nt, Mus musculus
gaaugcagccgagaacuccuacguggaga

SEQ ID NO: 116884 - RNA, 41 nt, Mus musculus
acacucucccuuauuuaagugacuuccaggccccgccccug

SEQ ID NO: 116885 - RNA, 46 nt, Mus musculus
agauaacagucucuggcuccuucggcccugggagccaaaagggcag

SEQ ID NO: 116886 - RNA, 46 nt, Mus musculus
cgcccuccagguccagcuccucaaaggaugagccacuggcacccga

SEQ ID NO: 116887 - RNA, 64 nt, Mus musculus
ccuugccagugggcacaugaaauggaucuugucuugaugguagaucuccaggcgagggugagca

SEQ ID NO: 116888 - RNA, 46 nt, Mus musculus
aguugugauuaugcugcccaggaacuuccgucgacuucccucucca

SEQ ID NO: 116889 - RNA, 45 nt, Mus musculus
uuugugcuuucaguccuagggggguggaaaaggguaaacccagag

SEQ ID NO: 116890 - RNA, 46 nt, Mus musculus
ugauguagguauccaaggcaggauggacucggcgggcagccagcca

SEQ ID NO: 116891 - RNA, 46 nt, Mus musculus
cuaggugcugggaaggagaauaucuugaagccaaauuucugauaga

SEQ ID NO: 116892 - RNA, 46 nt, Mus musculus
aaguauguaugagcauacacaguagaacacacaggacagagcccag

SEQ ID NO: 116893 - RNA, 45 nt, Mus musculus
cucuggguucaauauucagccccucaaaaagaaaaagggcccaag

SEQ ID NO: 116894 - RNA, 41 nt, Mus musculus
cagcaccuagcugcaagggccucugugcgcgggccacagua

SEQ ID NO: 116895 - RNA, 46 nt, Mus musculus
agcugacucauguccagagugcaggugcagggcaggacccggccga

SEQ ID NO: 116896 - RNA, 41 nt, Mus musculus
cagccaaggaagaaguaaggcaaauuuccccacacccaaua

SEQ ID NO: 116897 - RNA, 46 nt, Mus musculus
cuaguucgagacagcacccaccccagcuaccuguucacacugucag

SEQ ID NO: 116898 - RNA, 24 nt, Mus musculus
cagugugaacagguagcuggggug

SEQ ID NO: 116899 - RNA, 25 nt, Mus musculus
ucagaguuggaagggguacugucgg

SEQ ID NO: 116900 - RNA, 46 nt, Mus musculus
uagagucugaccacaggaaaacuuuguuauguauuccuuuccaaga

SEQ ID NO: 116901 - RNA, 46 nt, Mus musculus
aaugcauccaggagcuauguggccguagauuacagagguaagcacc

SEQ ID NO: 116902 - RNA, 46 nt, Mus musculus
uuuuauuuguuuuuauuuuguuugguuuuaauuuuugccucaaucg

SEQ ID NO: 116903 - RNA, 55 nt, Mus musculus
gagccaaaacaguuaaguguaauguuagggaggacagggagagggaggagggaac

SEQ ID NO: 116904 - RNA, 47 nt, Mus musculus
uuuuccacauccuucuuuaggguagcagaaacaucugagaaacaaaa

SEQ ID NO: 116905 - RNA, 46 nt, Mus musculus
uaccuaugcuaaaaauaacaaaacguuacuggccaagacaagaagg

SEQ ID NO: 116906 - RNA, 53 nt, Mus musculus
uaccgugggcaaguugcuuuccucuucuggagcccugucugagaggauguggc

SEQ ID NO: 116907 - RNA, 42 nt, Mus musculus
gagacagggauggcccucucccucgcuuucagggguggagag

SEQ ID NO: 116908 - RNA, 49 nt, Mus musculus
gccguggauacgaauagugaacagguaaaccaaguugaaggaagccaug

SEQ ID NO: 116909 - RNA, 46 nt, Mus musculus
ucuucuggcauaucuuuacuuucaccaggaggccgugcaccaaguu

SEQ ID NO: 116910 - RNA, 46 nt, Mus musculus
ucuucgucaucauccaugcugggccaggcugacugauccuccacuc

SEQ ID NO: 116911 - RNA, 46 nt, Mus musculus
ggaaggcaugggaguagaagaacugcacucaaaguggucuagagua

SEQ ID NO: 116912 - RNA, 42 nt, Mus musculus
auuuuuggcaaacacaaauccuugccuuggcucggggcuguu

SEQ ID NO: 116913 - RNA, 42 nt, Mus musculus
ugccauuucucagcuuccuagcuggaggugagagaagccgcc

SEQ ID NO: 116914 - RNA, 45 nt, Mus musculus
uguucguccugggucaugaauaccguuuucaagccuuggauauuc

SEQ ID NO: 116915 - RNA, 46 nt, Mus musculus
cacauucuaccccuaaaagcuacccaaacccacuacuuacagccag

SEQ ID NO: 116916 - RNA, 45 nt, Mus musculus
cucugcuuuuccagacacuauucucggagguccaacuucacagug

SEQ ID NO: 116917 - RNA, 46 nt, Mus musculus
agaauucgugagccagaucuccaucuucaucguagaacauggagcu

SEQ ID NO: 116918 - RNA, 46 nt, Mus musculus
gauacaggaggaaucgagguagcaaacggcugaaaugcucugacua

SEQ ID NO: 116919 - RNA, 42 nt, Mus musculus
cuuggucaggccuggccugaagaggucaagagagacaggaag

SEQ ID NO: 116920 - RNA, 46 nt, Mus musculus
caucagugagagaacagagaccugcuaaaagccucuuucccccucc

SEQ ID NO: 116921 - RNA, 45 nt, Mus musculus
caauuugagcagagucuccucuugugugcgcagugugugagccaa

SEQ ID NO: 116922 - RNA, 45 nt, Mus musculus
ccaaacagcccuucgucaggguuugcccacuggcccgugccccac

SEQ ID NO: 116923 - RNA, 42 nt, Mus musculus
gcggccuagcagccguggcuucgaagacacggggcggccgcg

SEQ ID NO: 116924 - RNA, 42 nt, Mus musculus
ucuucgcuagacccagaguuggccgcuagcuuuagcccccgc

SEQ ID NO: 116925 - RNA, 42 nt, Mus musculus
uugggucuaggagauuaaauaacgggucaccagacuggacag

SEQ ID NO: 116926 - RNA, 46 nt, Mus musculus
ucccacccagagagccucaccagguggguaccuaguuacugccagu

SEQ ID NO: 116927 - RNA, 44 nt, Mus musculus
guugugagccaccaugugguugcugggauuugaacucgggugcu

SEQ ID NO: 116928 - RNA, 41 nt, Mus musculus
aaggaacauacccgaaaucacauagcuaaggccccgggcag

SEQ ID NO: 116929 - RNA, 42 nt, Mus musculus
uccucauggaugaugggacucagacucugccaaugcccccag

SEQ ID NO: 116930 - RNA, 46 nt, Mus musculus
agaccugggggguguuggugugccuuugucuuccuguuucuggcuu

SEQ ID NO: 116931 - RNA, 42 nt, Mus musculus
uacugaaagaacacgcagcccugguccugauuccuugcccgu

SEQ ID NO: 116932 - RNA, 45 nt, Mus musculus
ggagguugugggaucccugggaaauaguguagcuggcuucugccu

SEQ ID NO: 116933 - RNA, 45 nt, Mus musculus
cagaagcgugauggccgcaaggugcggaaggcagccaagaacgag

SEQ ID NO: 116934 - RNA, 41 nt, Mus musculus
agaauggccuuaucaaggagcccuguggaaccccggaguau

SEQ ID NO: 116935 - RNA, 58 nt, Mus musculus
cggcuucugauaagaacaucaaggauggcgucugugcccagauugagaagaacuuugc

SEQ ID NO: 116936 - RNA, 45 nt, Mus musculus
gcagucuggaacagcggcgacccagucugcuucagacgcugccac

SEQ ID NO: 116937 - RNA, 45 nt, Mus musculus
uggucacgugguagggagcaggcauugcauguuagcuguggggau

SEQ ID NO: 116938 - RNA, 63 nt, Mus musculus
uuuauugcgcuaagaaaugacuucaaaacuauuaguuugagcgaagaugagcuuuuacugcac

SEQ ID NO: 116939 - RNA, 55 nt, Mus musculus
uaacgagcuauuguauuuuauuugagagucaagagacagaccaacagccgggcgg

SEQ ID NO: 116940 - RNA, 46 nt, Mus musculus
cacuggagugggagaacagugccaucuacccagacaguuccagcag

SEQ ID NO: 116941 - RNA, 36 nt, Mus musculus
gaagcaucccuggagcugagcucaucucugcuguag

SEQ ID NO: 116942 - RNA, 46 nt, Mus musculus
acaggaccccagcaagggagccaaauuaaaacugucaacagcccag

SEQ ID NO: 116943 - RNA, 46 nt, Mus musculus
acuaggcagccccauauuauagaagaauccggucuggaacgcccag

SEQ ID NO: 116944 - RNA, 45 nt, Mus musculus
ucucgugggcccuaagggcuccuaaauucugaugagauagggcag

SEQ ID NO: 116945 - RNA, 47 nt, Mus musculus
gacaacggccgcacaaguaacaucugccuagggcuuuggcuuagaaa

SEQ ID NO: 116946 - RNA, 24 nt, Mus musculus
augaucccauaacccuaccaccua

SEQ ID NO: 116947 - RNA, 46 nt, Mus musculus
gacuccuuuuguuuuuauagaacagggucacauugacucuaagugg

SEQ ID NO: 116948 - RNA, 46 nt, Mus musculus
cugcgcuugaacuccugccugccuccagcuuauugcuugaaauuau

SEQ ID NO: 116949 - RNA, 45 nt, Mus musculus
aacauaccuccugcccaccguccgaggcccaaguccaccccagau

SEQ ID NO: 116950 - RNA, 44 nt, Mus musculus
ugggacucuggcuucuccgaggugucaggcaguacauggcgaga

SEQ ID NO: 116951 - RNA, 42 nt, Mus musculus
cugcaaccaaaacccagaacugaucaaaauguacagccaaag

SEQ ID NO: 116952 - RNA, 46 nt, Mus musculus
agagggcuccaucuugguaagagaagauuuccucugacauucccac

SEQ ID NO: 116953 - RNA, 46 nt, Mus musculus
uggacuaggccuaagguacccuccaccucuauauucagguuaccaa

SEQ ID NO: 116954 - RNA, 45 nt, Mus musculus
gcacagagguggcuugcucuguccuagguaggggagggugcauag

SEQ ID NO: 116955 - RNA, 54 nt, Mus musculus
guauucaggucaugugggaccaaacaccugggaggguugguaaguaauaggggg

SEQ ID NO: 116956 - RNA, 46 nt, Mus musculus
uggccaagacagcauccuuucccucccaggcaaugugggccaccag

SEQ ID NO: 116957 - RNA, 46 nt, Mus musculus
ccuugacuuugaagcaauccuccugcagcccagcaacucuccagau

SEQ ID NO: 116958 - RNA, 46 nt, Mus musculus
auccacuggggcauccgagugcugcacccaccuccagaccaagaga

SEQ ID NO: 116959 - RNA, 68 nt, Mus musculus
ggucagcgggaagcuggaagcugcuuacaauugaccgagaccuuaugguggcccaguucuccacaccc

SEQ ID NO: 116960 - RNA, 46 nt, Mus musculus
cauuggaguagguagaguacuuugguagcuuucugugucccuaggu

SEQ ID NO: 116961 - RNA, 46 nt, Mus musculus
gaccuuucuugccaggcuaguauagucauccaccuccugcccagac

SEQ ID NO: 116962 - RNA, 45 nt, Mus musculus
ugcuggucagcugacagccagagaguggucuucgacucgguccag

SEQ ID NO: 116963 - RNA, 112 nt, Mus musculus
aacuacucucggaugagucccuggcugucugcucuccucggcugagcccagaccagugucgcgucgucuaccugcaguacccaucucuagccccucaucaccagugcagcca

SEQ ID NO: 116964 - RNA, 45 nt, Mus musculus
gugugugugugugucuguguguaugugugucugucuaugugucug

SEQ ID NO: 116965 - RNA, 45 nt, Mus musculus
guguguguguauguaugugugucuguauguguaucugucugugug

SEQ ID NO: 116966 - RNA, 59 nt, Mus musculus
aggaggagaaggaggagaagaaggaggaggaggagaagaaggaaaaggagaaggagaag

SEQ ID NO: 116967 - RNA, 32 nt, Mus musculus; identical to SEQ ID NO: 49476

SEQ ID NO: 116968 - RNA, 46 nt, Mus musculus
cagccaaccaucuucauaacaggauuuguugacaagcccuggguuu

SEQ ID NO: 116969 - RNA, 41 nt, Mus musculus
cugaagucucacagagaucugccugccucugcucccacgcg

SEQ ID NO: 116970 - RNA, 48 nt, Mus musculus
gcaggcagcccccucccugagccggcgauggccaucagacucugagac

SEQ ID NO: 116971 - RNA, 25 nt, Mus musculus
ggguggguggacccaggcucccuuu

SEQ ID NO: 116972 - RNA, 47 nt, Mus musculus
gcucucaaagcuaauuuuuuacuaaaguuuuuauacagccucaaauu

SEQ ID NO: 116973 - RNA, 45 nt, Mus musculus
uuugucccaacaguccacagcccuaccccauauacccugccccuc

SEQ ID NO: 116974 - RNA, 42 nt, Mus musculus
uguucuuucccuucccucuuaaaaggaauaucacggucuuug

SEQ ID NO: 116975 - RNA, 64 nt, Mus musculus
guuaaguuuuuacauuuaaucugcuguuuaccuaaacuuguacguauaauuuuuggguggguau

SEQ ID NO: 116976 - RNA, 54 nt, Mus musculus
uggcucugaagcacuguuugaguagagguagaaggagggagcgaggaaccguga

SEQ ID NO: 116977 - RNA, 66 nt, Mus musculus
ucccgucccaagaacaugaccccauaccgaucacccccuccguauguucccccuuaacccacaagc

SEQ ID NO: 116978 - RNA, 42 nt, Mus musculus
aucaucuuugcggaugagcuggaugacucuaagcccccgccc

SEQ ID NO: 116979 - RNA, 65 nt, Mus musculus
caccacccucuccuggaagcucagcugcaccagccacagagguuccagacagggaccccgagaag

SEQ ID NO: 116980 - RNA, 45 nt, Mus musculus
aagaaaauugcuuugguaaagaagcuagcuuuugcuuuuggggau

SEQ ID NO: 116981 - RNA, 42 nt, Mus musculus
cuaccgacaagcucaagcugacccugaagcuucgagagcagc

SEQ ID NO: 116982 - RNA, 45 nt, Mus musculus
accaguggagugccccgugggggagaaccuaaccagcggccagag

SEQ ID NO: 116983 - RNA, 46 nt, Mus musculus
cggacaccccgaccagugccccgagucaccaccaaagcacccauca

SEQ ID NO: 116984 - RNA, 46 nt, Mus musculus
uauguagagcccacagccguuauuacuccuccaacaacuaccacaa

SEQ ID NO: 116985 - RNA, 45 nt, Mus musculus
uggacccccaaccacggccauucaggagccaccaucgcggauagu

SEQ ID NO: 116986 - RNA, 99 nt, Mus musculus
gcagagcuucucagaaguagaacuucacaacaugaaguuggugccuguagugaauaauagacuauuugacaugucggccuucauggcuggcccaggaaa

SEQ ID NO: 116987 - RNA, 51 nt, Mus musculus
uguccuuacagugauucuggaugcugaccucaccaagaugaccccaaagca

SEQ ID NO: 116988 - RNA, 45 nt, Mus musculus
ugagucuaugugcucauguguacaguugcuagaggaggccagagg

SEQ ID NO: 116989 - RNA, 76 nt, Mus musculus
agacaccccagaagagggcaucagaucuaauaacgggugguugugauucacugugugguugcugggauuugaacuc

SEQ ID NO: 116990 - RNA, 42 nt, Mus musculus
guagagaaguaaaaguggggagggggagcaagagggcaagag

SEQ ID NO: 116991 - RNA, 46 nt, Mus musculus
uagaaaacaaaggguuaugacugcuucauuugggagugcuucagag

SEQ ID NO: 116992 - RNA, 46 nt, Mus musculus
uggcaugugugcagucaccugcagaggccagaagaagacaucagau

SEQ ID NO: 116993 - RNA, 45 nt, Mus musculus
gaccccuugugagcauggcacaccgggaaguguggguugccaaag

SEQ ID NO: 116994 - RNA, 36 nt, Mus musculus
gccuccugauggcugggauuaaagacgugcaccgcc

SEQ ID NO: 116995 - RNA, 46 nt, Mus musculus
cuccauucucuguaaaucauagucuguuugcaggguggccuuacuu

SEQ ID NO: 116996 - RNA, 44 nt, Mus musculus
cgagugagcauuccaacggauuuaauugccuccaguggggagau

SEQ ID NO: 116997 - RNA, 46 nt, Mus musculus
aaucuaaggccucacaugcuaagcaggugaacauccaccccaguuc

SEQ ID NO: 116998 - RNA, 42 nt, Mus musculus
uuuuccagguaggugcuucccagaacuaaagcugccuucuac

SEQ ID NO: 116999 - RNA, 47 nt, Mus musculus
aacguguguguguguguguguuguguguguuuguguguguguuuguu

SEQ ID NO: 117000 - RNA, 41 nt, Mus musculus
ggaaguugccauaggggagggagauuuaggggagggguaga

SEQ ID NO: 117001 - RNA, 44 nt, Mus musculus
gcccaaccaaauauuucuugagcaacuacuuuauacuguugugu

SEQ ID NO: 117002 - RNA, 46 nt, Mus musculus
uuggacuuauaguuuccuuucuguuuccuuaagcaccuuaagggag

SEQ ID NO: 117003 - RNA, 61 nt, Mus musculus
gggugaugaguaggaagggccuaagguggauucggcuguaggcuuuaggcagaggagggaa

SEQ ID NO: 117004 - RNA, 54 nt, Mus musculus
uugguguguguaggcagcauguggacagggcugucugaguuaggacucuuggag

SEQ ID NO: 117005 - RNA, 46 nt, Mus musculus
agaugacuacugugauaauuucauagaaaaagaaaggaguuagauc

SEQ ID NO: 117006 - RNA, 54 nt, Mus musculus
uguuguugggaacuagagaaggugguauaaugucucuugaaauggcggagcaga

SEQ ID NO: 117007 - RNA, 45 nt, Mus musculus
auuaucagaaucagugagcugauuucuaaagauugaucugcaugu

SEQ ID NO: 117008 - RNA, 41 nt, Mus musculus
ucugguauaaggagguuuauuugggagaagggaggggagug

SEQ ID NO: 117009 - RNA, 45 nt, Mus musculus
cuuguggagcagugagcguacaguguggagaguagaugugugagc

SEQ ID NO: 117010 - RNA, 42 nt, Mus musculus
agucagucucugugggaugguagucagucucugugggguggu

SEQ ID NO: 117011 - RNA, 42 nt, Mus musculus
ggucagucucugugggaugguagucagucucugugggguggu

SEQ ID NO: 117012 - RNA, 42 nt, Mus musculus; identical to SEQ ID NO: 117011

SEQ ID NO: 117013 - RNA, 46 nt, Mus musculus
ggaugguggucagucucugcgggaugcugggcagucucugugggau

SEQ ID NO: 117014 - RNA, 47 nt, Mus musculus
ucucuaugggaugguagucagucucugugggaugguggucagucucu

SEQ ID NO: 117015 - RNA, 42 nt, Mus musculus; identical to SEQ ID NO: 117011

SEQ ID NO: 117016 - RNA, 79 nt, Mus musculus
cugugggaugguggucagucucugugggaugguggucagucucugugggaugguggucagucucugugggauggugguc

SEQ ID NO: 117017 - RNA, 42 nt, Mus musculus; identical to SEQ ID NO: 117010

SEQ ID NO: 117018 - RNA, 84 nt, Mus musculus
ggucagucucugugggaugguagucagucucuguggggugguggucagucucugugggaugguagucagucucugugggguggu

SEQ ID NO: 117019 - RNA, 45 nt, Mus musculus
uacuuauuguauauggauguguuugucacauaucccguggcaguu

SEQ ID NO: 117020 - RNA, 45 nt, Mus musculus
cugucuuggcaaacuaaaaaacuucuucugggcugugcuucaagu

SEQ ID NO: 117021 - RNA, 42 nt, Mus musculus
aaaaaaaaaaaaagacaugaauaaaguauccaggcaguuggu

SEQ ID NO: 117022 - RNA, 46 nt, Mus musculus
ggaggauaauuugagaugccuuggaaagagaugagagccagauuag

SEQ ID NO: 117023 - RNA, 45 nt, Mus musculus
ucucccugagagauacaguggcugagggccaggaacagaaaagau

SEQ ID NO: 117024 - RNA, 45 nt, Mus musculus
uugagcacuguguuguuucuuucucuguuuagaaagcaccauauc

SEQ ID NO: 117025 - RNA, 46 nt, Mus musculus
gcuguuucagacauaccagaagagggcaucagaucccauugcagau

SEQ ID NO: 117026 - RNA, 46 nt, Mus musculus
ccaucuaguucaccugagcuaauugcuagcauuucaggcccccccc

SEQ ID NO: 117027 - RNA, 23 nt, Mus musculus
cuccccauacaaguuauuaaaau

SEQ ID NO: 117028 - RNA, 46 nt, Mus musculus
aauuuauuuauuauuaucucuaaguaaaucguauuugucuucagau

SEQ ID NO: 117029 - RNA, 46 nt, Mus musculus
cuguaaccucagcacuguucaaagcuggucugggaaacaugagaaa

SEQ ID NO: 117030 - RNA, 71 nt, Mus musculus
uaaugagaucugaugccuucagaucuggugugucugaagagagcaauugugguaaacucauaggcauaaaa

SEQ ID NO: 117031 - RNA, 46 nt, Mus musculus
cccaaaaaggaagaaggaaaaagaaagugaaaaauauucagcagau

SEQ ID NO: 117032 - RNA, 46 nt, Mus musculus
gugugugugugugugucugucugucugucugucugucagucugucu

SEQ ID NO: 117033 - RNA, 45 nt, Mus musculus
ccagguugggcuacguacauggcauauacauccugaacaggagaa

SEQ ID NO: 117034 - RNA, 46 nt, Mus musculus
ccagggcuacacagagaaacccugucuggaaaaaaccaaaaaaaaa

SEQ ID NO: 117035 - RNA, 42 nt, Mus musculus
guuucuggaguuacagguacaugcaguccugccugcccagcu

SEQ ID NO: 117036 - RNA, 25 nt, Mus musculus
acuuccugggucaguaauggcaugg

SEQ ID NO: 117037 - RNA, 42 nt, Mus musculus
guucccugugcauccaaguucuaucugggcaaaaaucugcag

SEQ ID NO: 117038 - RNA, 56 nt, Mus musculus
gagcuccucuugcuuguccugccaacacgaacaccccagucugcuaccauuucccc

SEQ ID NO: 117039 - RNA, 45 nt, Mus musculus
gcuggggccagagcacgaguccucccuucggacuauuugucauca

SEQ ID NO: 117040 - RNA, 44 nt, Mus musculus
uacaggugggauaaaggaugcuggaauuuguuauuggucuugga

SEQ ID NO: 117041 - RNA, 52 nt, Mus musculus
ggagcugagucuggggagacccccugagaugggaggagugaggauguacuug

SEQ ID NO: 117042 - RNA, 42 nt, Mus musculus
cgccgcccgcgguccuccgucgguucucuccauagcccgccg

SEQ ID NO: 117043 - RNA, 46 nt, Mus musculus
auauugaagacucugagauguuguuuggaguauuucuccggagcag

SEQ ID NO: 117044 - RNA, 55 nt, Mus musculus
gaauaaaaaacaaaaacagaucuucaggcgcuucuuaguccaugggugggguuga

SEQ ID NO: 117045 - RNA, 47 nt, Mus musculus
aagagccaaaagaucaguuaacuucauugaaagacuaauuuaagauc

SEQ ID NO: 117046 - RNA, 42 nt, Mus musculus
gaaacuuguccuguagaccagacuggcuucuaacucacagag

SEQ ID NO: 117047 - RNA, 46 nt, Mus musculus
uuuauuaugugaagaaguccaugacaacaucaguggacaugcuaau

SEQ ID NO: 117048 - RNA, 42 nt, Mus musculus
agagugguuguaucuaaguauuugugcaguggaggggaggag

SEQ ID NO: 117049 - RNA, 46 nt, Mus musculus
gccucuuuggcaaaccugucucaaaauauuuacauuaugccugggc

SEQ ID NO: 117050 - RNA, 46 nt, Mus musculus
auucaugaccauaguaagaguacaguuaugaaguagcaaggaaggu

SEQ ID NO: 117051 - RNA, 45 nt, Mus musculus
guuucaucuucacccagauagaguaaauuauuaugauuaugacaa

SEQ ID NO: 117052 - RNA, 45 nt, Mus musculus
uuauauguaaguucacuguagcugucuucagacacaccggaagag

SEQ ID NO: 117053 - RNA, 44 nt, Mus musculus
ggagagccaggcuagguggugcaugcuucuaauuccacucuaga

SEQ ID NO: 117054 - RNA, 42 nt, Mus musculus
agaccuaugucagccucuacuccauagugaauucuaggccag

SEQ ID NO: 117055 - RNA, 46 nt, Mus musculus
ccagaaacagauuuuggaacaaaagggaauacuugagaugaacaag

SEQ ID NO: 117056 - RNA, 45 nt, Mus musculus
gccauaggaacaggguaacuuuuguacuuguggggaaaauaggga

SEQ ID NO: 117057 - RNA, 47 nt, Mus musculus
agaggucuaugugcccacgguguuugaaaacuauguggcggauaucg

SEQ ID NO: 117058 - RNA, 45 nt, Mus musculus
ggucuuauuacaguaaaguauaaagguauuccagacuagcauaag

SEQ ID NO: 117059 - RNA, 46 nt, Mus musculus
ccagacaccgauguuauauugauguguuuuuccauugacagcccug

SEQ ID NO: 117060 - RNA, 46 nt, Mus musculus
guuccuaacugugauaacaaaacaugguuacauuggugaauuagag

SEQ ID NO: 117061 - RNA, 45 nt, Mus musculus
ggguugggccuaucuguaaucccagcauuugggaggcagaggcag

SEQ ID NO: 117062 - RNA, 45 nt, Mus musculus
gcacucgggaggcagaggcaggcggauuucuaaguuccauuacag

SEQ ID NO: 117063 - RNA, 45 nt, Mus musculus
aaaaaaaaaaaaaacgaaaaaaagaagaaaaaaagaaaagaaaag

SEQ ID NO: 117064 - RNA, 42 nt, Mus musculus
cacaaccauccauaaugagauccgaugcccucuucugggaug

SEQ ID NO: 117065 - RNA, 46 nt, Mus musculus
gugauuuugaaaucaaugcacuuguuuucauuuuauagggccccaa

SEQ ID NO: 117066 - RNA, 42 nt, Mus musculus
uccucuaccacaugggucccagggcucaguccucaggcucag

SEQ ID NO: 117067 - RNA, 88 nt, Mus musculus
ccugguugggaacaagaaggaccuucggaaugacgagcacacgagacgggaguuggccaaaaugaagcagguguguugugggggcagg

SEQ ID NO: 117068 - RNA, 53 nt, Mus musculus
uauggcaaacaggauuggcgcuuuuggguacauggaguguucagcaaagacca

SEQ ID NO: 117069 - RNA, 46 nt, Mus musculus
auuugaagugcuguuuauuaaucuuaguguaugauuacuggccuuu

SEQ ID NO: 117070 - RNA, 46 nt, Mus musculus
uugugaauuaggcuguaacuacuuuauaacuaacauguccugccua

SEQ ID NO: 117071 - RNA, 47 nt, Mus musculus
gugccacuuaauguauguuaccaaaaaauaaauauaucuaccccaga

SEQ ID NO: 117072 - RNA, 32 nt, Mus musculus
uuuuaagaaaguguauuuggaaauaaagucag

SEQ ID NO: 117073 - RNA, 43 nt, Mus musculus
auaucccuuauucagcccuauauaucauucuaguaccccuuuc

SEQ ID NO: 117074 - RNA, 48 nt, Mus musculus
aaacauuuuucuguaccaguuaauuuuuccaacuaauagaauaaaggc

SEQ ID NO: 117075 - RNA, 46 nt, Mus musculus
cgcacuucucaaacaauguaaaauugggcucgaacccgccaccagg

SEQ ID NO: 117076 - RNA, 45 nt, Mus musculus
gcaaugucguugcggcacaccggagaccaaaugauguacuugggg

SEQ ID NO: 117077 - RNA, 42 nt, Mus musculus
aguugccagacugcugggacagcaggguuucuaugucagguu

SEQ ID NO: 117078 - RNA, 46 nt, Mus musculus
ccagaggcugcgcugccacccugggcaacuuugcuaaggccaccuu

SEQ ID NO: 117079 - RNA, 45 nt, Mus musculus
ccugugugacucccgacgucccuucucugcucgagacaacccaaa

SEQ ID NO: 117080 - RNA, 45 nt, Mus musculus
accagcuuugcgccacaacgccggacagccugguggcaaucggag

SEQ ID NO: 117081 - RNA, 44 nt, Mus musculus
ucagcacaacacagcugggcgccauugugaguucugccggcccu

SEQ ID NO: 117082 - RNA, 45 nt, Mus musculus
gucugcucacaguccgugcgggcaugugcugccuaaggaugaccg

SEQ ID NO: 117083 - RNA, 42 nt, Mus musculus
gaugcccagcaaggccccucuaucugagaccugugccccccu

SEQ ID NO: 117084 - RNA, 46 nt, Mus musculus
auucccuaauugccggccgugugucugcaaugggcgugcggaugag

SEQ ID NO: 117085 - RNA, 45 nt, Mus musculus
gaucagggucagguagcuaagcuaaguaaucaugguuuccucuug

SEQ ID NO: 117086 - RNA, 38 nt, Mus musculus
cuugucaccccugccacgcuugcuuuggagacugggau

SEQ ID NO: 117087 - RNA, 46 nt, Mus musculus
gcuugcgcuuaaucucacccugaggcagcuggaucagcaucuggag

SEQ ID NO: 117088 - RNA, 45 nt, Mus musculus
caacuuaggugccuaugacagcauccgacaugcccacagccaguc

SEQ ID NO: 117089 - RNA, 45 nt, Mus musculus
acgccuccaccuuugcaguacccagcccugugagcaacucagcag

SEQ ID NO: 117090 - RNA, 42 nt, Mus musculus
caccaggggacgcacccugugccaccagcccuugugggggug

SEQ ID NO: 117091 - RNA, 46 nt, Mus musculus
ccccguugugguggccucgguugcaguggggcagcagccacggcag

SEQ ID NO: 117092 - RNA, 40 nt, Mus musculus
gauccugacaguauugaaaugguagcgacucgggugcuag

SEQ ID NO: 117093 - RNA, 43 nt, Mus musculus
gcucagagggcacaaggagcugcucagggugccaucuggggag

SEQ ID NO: 117094 - RNA, 48 nt, Mus musculus
cccugaaacugaaacgggcaggaaauagccuggcagcaucuacagcgg

SEQ ID NO: 117095 - RNA, 45 nt, Mus musculus
cgggaacaaguaggugaccaauaccaaacagugagggcguuggca

SEQ ID NO: 117096 - RNA, 79 nt, Mus musculus
agggggccgccaggacuggaagaggccacuaguaagaagaaacagaaggaucgagcaaaccuggaaaguaaagauggag

SEQ ID NO: 117097 - RNA, 45 nt, Mus musculus
uguagaugcugcguucacagacacggacuguguggugaggcuucc

SEQ ID NO: 117098 - RNA, 26 nt, Mus musculus
auccgggcugugggccccacaccauc

SEQ ID NO: 117099 - RNA, 56 nt, Mus musculus
ccagagcaguguacguucuguuucacggccucucgaaucgauaucugccuccggaa

SEQ ID NO: 117100 - RNA, 52 nt, Mus musculus
agguggcccccacccccugacaggccaggaggaagccagggcuguggagaag

SEQ ID NO: 117101 - RNA, 46 nt, Mus musculus
gccgcacaguccaguuaguggggauaguguggaggaggacgaagag

SEQ ID NO: 117102 - RNA, 41 nt, Mus musculus
guguugcgaggauaagugagguccaccaauguuguggguaa

SEQ ID NO: 117103 - RNA, 45 nt, Mus musculus
agguacucugugaguguauuccaaccgcccuuccagccuggccgc

SEQ ID NO: 117104 - RNA, 45 nt, Mus musculus
auacccacacgccccaguucuucaucuauaaaauugaugcaucaa

SEQ ID NO: 117105 - RNA, 46 nt, Mus musculus
auugugcagcucaagcgcuucuccuuucguaguuucauuuggcgag

SEQ ID NO: 117106 - RNA, 45 nt, Mus musculus
uuuccuguauuuaaaguguuaauaaaaugaguauucaggcccaau

SEQ ID NO: 117107 - RNA, 87 nt, Mus musculus
auuaguaggccuuggccuuuccagcugccuucagugcugcguguuugguucucaguuguaccuucaauucuuucugaccugcauuac

SEQ ID NO: 117108 - RNA, 46 nt, Mus musculus
auaauuuuauucuaaaaauuguaauuuuuugcauuuuggaagugac

SEQ ID NO: 117109 - RNA, 45 nt, Mus musculus
ucggagucauccccaggaucccauugauaccaaggacuucgagca

SEQ ID NO: 117110 - RNA, 42 nt, Mus musculus
cugauuguuccuuucauuuugggcauucaugggaagggcgau

SEQ ID NO: 117111 - RNA, 49 nt, Mus musculus
gcuaugugaucacuccauauaccauggaucugcugaagcagcaccugga

SEQ ID NO: 117112 - RNA, 41 nt, Mus musculus
aaugguaucuguuuucugcgcuuugaugacaccaacccuga

SEQ ID NO: 117113 - RNA, 44 nt, Mus musculus
gcagaaggagaggccacacuucgaaugaaguuggugauggaaga

SEQ ID NO: 117114 - RNA, 53 nt, Mus musculus
cgagcacagaaguuguugauagccucugguggaaaaccccgucgucguagggc

SEQ ID NO: 117115 - RNA, 46 nt, Mus musculus
ucuagggcuccaguggcuguguggaacgcuuggaggugaccuguag

SEQ ID NO: 117116 - RNA, 46 nt, Mus musculus
cuuguagugacgccugcagacagagaauccaaguggcuguccagcu

SEQ ID NO: 117117 - RNA, 45 nt, Mus musculus
uauucaguucauauuuugccugggucuucuuuuagugugacaguu

SEQ ID NO: 117118 - RNA, 44 nt, Mus musculus
aagaagacccaggcaaaauaugaacugaauacauguggcccuac

SEQ ID NO: 117119 - RNA, 42 nt, Mus musculus
cgucccgggggaugcccccaccuucuauuguucuggggccca

SEQ ID NO: 117120 - RNA, 42 nt, Mus musculus
aggccaaaccggaacccgcccaucccuucccagugggcugag

SEQ ID NO: 117121 - RNA, 45 nt, Mus musculus
cugacugccaccaucagucugggggugcaccugagagauggagau

SEQ ID NO: 117122 - RNA, 46 nt, Mus musculus
ucacaucuuuguguuuaugucucuuuuuucuuuuucugccccauuu

SEQ ID NO: 117123 - RNA, 45 nt, Mus musculus
uggagguuagggcucaugaauacaggaaaggccaucgggagggag

SEQ ID NO: 117124 - RNA, 42 nt, Mus musculus
acagcgggccgcuguaguuggagcgauaaacccgcggguguc

SEQ ID NO: 117125 - RNA, 23 nt, Mus musculus
ccuguccgcacggagaugguaag

SEQ ID NO: 117126 - RNA, 42 nt, Mus musculus
uuucagcuccuacuauaaccgaguacauauucuaggggugag

SEQ ID NO: 117127 - RNA, 46 nt, Mus musculus
cagccaggcgcauccucauuucccgugugcucagccuugcccacau

SEQ ID NO: 117128 - RNA, 46 nt, Mus musculus
aggaaccucggccacaccucuuuggucagauguuugcucgccuaca

SEQ ID NO: 117129 - RNA, 46 nt, Mus musculus
cgcacugcccucaaaagcuguaggcgagcaaacaucugaccaaaga

SEQ ID NO: 117130 - RNA, 45 nt, Mus musculus
acccuacuggaauacuugcgagaacuaugguacugccucgccucc

SEQ ID NO: 117131 - RNA, 41 nt, Mus musculus
cucaccauccuucagguagguaaaggccauggcugccucag

SEQ ID NO: 117132 - RNA, 45 nt, Mus musculus
caggggugaggcuugcauucuggccccaccccuggacagcuguga

SEQ ID NO: 117133 - RNA, 42 nt, Mus musculus
accuucaagcgucucuguccacccuuuccaagcuggcugcaa

SEQ ID NO: 117134 - RNA, 45 nt, Mus musculus
aaugccaacuucauguuaaucgaccccaaaaguguuugcccaguu

SEQ ID NO: 117135 - RNA, 45 nt, Mus musculus
gcaugcauguguguuguaugcauguguguguguacuuugggugua

SEQ ID NO: 117136 - RNA, 41 nt, Mus musculus
cagugugggagccggugagccuaaggcaggugauaagggag

SEQ ID NO: 117137 - RNA, 46 nt, Mus musculus
gcagcugggcgcuguacgaggacgaggacgucauccgcugcuaucu

SEQ ID NO: 117138 - RNA, 42 nt, Mus musculus
cacacagacaugauggcgcuuauugacaucacugugcgccag

SEQ ID NO: 117139 - RNA, 45 nt, Mus musculus
aaucaggucugaaugggaaguuugagaaauuuuuaaguuucucca

SEQ ID NO: 117140 - RNA, 38 nt, Mus musculus
aagagaaggcacaagaccagcugcucaggccgcuuagg

SEQ ID NO: 117141 - RNA, 46 nt, Mus musculus
ugguuccuuccuaacgagcaugggacgcacuguaccuuagacauga

SEQ ID NO: 117142 - RNA, 41 nt, Mus musculus
uuguuucaggccauggguguaauuaagaucuucuggggcaa

SEQ ID NO: 117143 - RNA, 46 nt, Mus musculus
uccuauguacuacagcucaccuucagaaauaaauuacaggcaccag

SEQ ID NO: 117144 - RNA, 46 nt, Mus musculus
cggcacuaaagaaaguacuccguaggauuguaguuccugacuagag

SEQ ID NO: 117145 - RNA, 46 nt, Mus musculus
agggagucaagcuguuugcugugggugagaaccaaguugaggcgag

SEQ ID NO: 117146 - RNA, 45 nt, Mus musculus
ccgucugggccccgggaccuggugcucucugagccaaguagccaa

SEQ ID NO: 117147 - RNA, 46 nt, Mus musculus
augccaacagcaucggggaggccgugagugggacagcucggaccag

SEQ ID NO: 117148 - RNA, 45 nt, Mus musculus
ucccuguccucacacugaccuuucaccccuaucuuuaacccccag

SEQ ID NO: 117149 - RNA, 41 nt, Mus musculus
gggcuuuuggggaaggaucugugcugguguuggagagggau

SEQ ID NO: 117150 - RNA, 42 nt, Mus musculus
gagggccucugggcaaaguugcugaaaggagugggcagccag

SEQ ID NO: 117151 - RNA, 46 nt, Mus musculus
cuuccuggaagcccuggaccccaaggcccagcuggccgaccuggag

SEQ ID NO: 117152 - RNA, 45 nt, Mus musculus
aggagagccuggucgaccugguuccccaggaccuguuggcccccg

SEQ ID NO: 117153 - RNA, 45 nt, Mus musculus
caggcaaagcuggggacccggggagagauguaagucuggggagau

SEQ ID NO: 117154 - RNA, 24 nt, Mus musculus
ugggucauucucuuuccaggguga

SEQ ID NO: 117155 - RNA, 46 nt, Mus musculus
cgggcuggugguucaggggaagcaggaaggccaggagagaggguga

SEQ ID NO: 117156 - RNA, 42 nt, Mus musculus
agacagggaagccaggaccuccaggccgugacgguagcagug

SEQ ID NO: 117157 - RNA, 45 nt, Mus musculus
gagagaaggugccccaggucccuugggaccaccuggaccaccagg

SEQ ID NO: 117158 - RNA, 41 nt, Mus musculus
cuagggagacccgggagcaggacugccggggccccgaggug

SEQ ID NO: 117159 - RNA, 45 nt, Mus musculus
gguggguuuuccucauggggguccugcaggcuguuagugugugug

SEQ ID NO: 117160 - RNA, 43 nt, Mus musculus
agaaggacaaagcuuacugugcgcaguagugacuccaaggugg

SEQ ID NO: 117161 - RNA, 45 nt, Mus musculus
uccagggagaagcugguuuuccuggucgcccuggguuggcaggaa

SEQ ID NO: 117162 - RNA, 44 nt, Mus musculus
cuagagagccauccucacauuuuuuuuuuccucuagggggagcc

SEQ ID NO: 117163 - RNA, 41 nt, Mus musculus
gugguguuggucccaagggacccgaagggcuucagggucag

SEQ ID NO: 117164 - RNA, 45 nt, Mus musculus
ucgggacuuugugcgucaggagaugagucagcacuguggugagug

SEQ ID NO: 117165 - RNA, 46 nt, Mus musculus
ggaggacuaccaggagccugaaguuccaugggauggugaagccgag

SEQ ID NO: 117166 - RNA, 45 nt, Mus musculus
ggcucucugaccaggguucaugugcuggcucaggacugcuuccag

SEQ ID NO: 117167 - RNA, 46 nt, Mus musculus
acgccuagccuagggauaagugcuuuauggagucuuguguggggag

SEQ ID NO: 117168 - RNA, 46 nt, Mus musculus
gcuucaccugcuccugcugcugucuguauaagaugugcugccccca

SEQ ID NO: 117169 - RNA, 42 nt, Mus musculus
ugccccuuacccucagccucaaccucaaccuguggcccccag

SEQ ID NO: 117170 - RNA, 32 nt, Mus musculus
cugcccccagccucuuuggcugccauuuaugu

SEQ ID NO: 117171 - RNA, 46 nt, Mus musculus
aauuguacuuucugaaauuucaagcaaauuaaaaacaauaagguag

SEQ ID NO: 117172 - RNA, 63 nt, Mus musculus
cacucugguuucucccugcacugucuuuuuacuguuagccaaacauuuugccuguuuucuguc

SEQ ID NO: 117173 - RNA, 46 nt, Mus musculus
agguugaaaucccugguuccuggaggacagacaaccugaccuccga

SEQ ID NO: 117174 - RNA, 48 nt, Mus musculus
gcauucagacuccgcacccucauuucuaauaaaugcaacauuggaccc

SEQ ID NO: 117175 - RNA, 42 nt, Mus musculus
agccacucuguauggacucuuccuggccucaccugggcagua

SEQ ID NO: 117176 - RNA, 25 nt, Mus musculus
ugguucugacugucacugcaaugua

SEQ ID NO: 117177 - RNA, 45 nt, Mus musculus
uauucugcccccagaagcaucauaacagaguuuaguagcuuagac

SEQ ID NO: 117178 - RNA, 42 nt, Mus musculus
ugccuauuugcuauuugagaccuuugucuuacagccccucuu

SEQ ID NO: 117179 - RNA, 44 nt, Mus musculus
uucuaaaaccagagaugauaagucucauuuaagucacagucaga

SEQ ID NO: 117180 - RNA, 46 nt, Mus musculus
cugggcuauauaguaagauccuuuuucaaaaagccaaaugaaagau

SEQ ID NO: 117181 - RNA, 23 nt, Mus musculus
aggagcagccaaggccaggcaug

SEQ ID NO: 117182 - RNA, 42 nt, Mus musculus
cugucucgauccauugagaacccuccgagcaagcgggcccgg

SEQ ID NO: 117183 - RNA, 41 nt, Mus musculus
gaugguagagcagccuggcaucagcccuuagugaaguggca

SEQ ID NO: 117184 - RNA, 73 nt, Mus musculus
gggcagggccaggugagaagaggagaagcuggcgucuaggagaccaggugaagaaaguuggggggagaggaug

SEQ ID NO: 117185 - RNA, 42 nt, Mus musculus
guggggucuuugucccguggagcggcggagggaggaggguug

SEQ ID NO: 117186 - RNA, 45 nt, Mus musculus
uggguucugacucuacaaccugcaggcgagaacauuccgggagau

SEQ ID NO: 117187 - RNA, 41 nt, Mus musculus
guauguggcugcaaaugacccugcagucaguacaguggggc

SEQ ID NO: 117188 - RNA, 46 nt, Mus musculus
guacaggcaugggcuugagucagggugcuaaagaagugacuuggug

SEQ ID NO: 117189 - RNA, 45 nt, Mus musculus
aacugggcugucuucgagugguggccgugagcccugccaauauca

SEQ ID NO: 117190 - RNA, 46 nt, Mus musculus
cuugggcuuuucuaguagaacagcauguguaugcuggagaggucag

SEQ ID NO: 117191 - RNA, 45 nt, Mus musculus
aagcaggcccugagggacuauaagaaagugcagauccagcuggag

SEQ ID NO: 117192 - RNA, 46 nt, Mus musculus
acugcggacucugcucagugaccugguagcucaguauguugccaag

SEQ ID NO: 117193 - RNA, 46 nt, Mus musculus
gguucucccauucacccccugagcauuugcaucaaguggaaggcag

SEQ ID NO: 117194 - RNA, 45 nt, Mus musculus
gcucugcaugaacucuacaaguauaucaacaaguacuaugaccag

SEQ ID NO: 117195 - RNA, 47 nt, Mus musculus
aggauggcacugcccagaagaugcagcugggcuaccggcuccagcag

SEQ ID NO: 117196 - RNA, 42 nt, Mus musculus
accuccugggcagcccuggaaucucaagggagaggccaccac

SEQ ID NO: 117197 - RNA, 46 nt, Mus musculus
ccagcucauagccucagccccauuggaccugccuuguaggccuggg

SEQ ID NO: 117198 - RNA, 56 nt, Mus musculus
acuguucuugagcacugaccuaugucccauugggaaucacagaggaaggaagagaa

SEQ ID NO: 117199 - RNA, 42 nt, Mus musculus
acaagccagggcuguagugaugcaugccuuuggucucaggac

SEQ ID NO: 117200 - RNA, 42 nt, Mus musculus
aucuuuuauugagguuaaggauccaacugcgugucccaaagg

SEQ ID NO: 117201 - RNA, 41 nt, Mus musculus
cccugaacccggccgcugauucuuuugacaucagcuguaac

SEQ ID NO: 117202 - RNA, 46 nt, Mus musculus
gcgggcgccugcaaccucaagauuaaauccaaacaaacuccgugga

SEQ ID NO: 117203 - RNA, 64 nt, Mus musculus
gcaucuuccccgugggcugcggcgcaggcguggggcugcaagcgaagaacaggcggcggcggug

SEQ ID NO: 117204 - RNA, 45 nt, Mus musculus
auggaaaaguuagguaaaaagugauagcuuaaaaaagguaguaga

SEQ ID NO: 117205 - RNA, 82 nt, Mus musculus
uuuauuuucauccuggucgaugaggugaaaggugucguggucuagagaaucagaguggcuccucuucagggcugggcuacau

SEQ ID NO: 117206 - RNA, 50 nt, Mus musculus
gccuguguguaaagggaucuuuacucuccucguagaugugacgagaugca

SEQ ID NO: 117207 - RNA, 44 nt, Mus musculus
gagugcuggagccgcacggggaaggggagucaaacagcccgcaa

SEQ ID NO: 117208 - RNA, 46 nt, Mus musculus
gacucugccucaaaagccaaagcaaaauaaaaaccuagcaacagau

SEQ ID NO: 117209 - RNA, 46 nt, Mus musculus
ggagaucaggugugacucaggaauauaauaacagcauuugggagga

SEQ ID NO: 117210 - RNA, 45 nt, Mus musculus
aggaagaccuuucuuugaugugaaggguauuuaagacagcaugga

SEQ ID NO: 117211 - RNA, 45 nt, Mus musculus
ugggauuuuuguuuuaaaaaccacagguuauacaaagaacaagua

SEQ ID NO: 117212 - RNA, 46 nt, Mus musculus
cacuaaacauuuucucuaaaguaucugcaucagaaucagccaacaa

SEQ ID NO: 117213 - RNA, 37 nt, Mus musculus
ucaccgauaggccgggcgaugggccgagcuuccaccc

SEQ ID NO: 117214 - RNA, 26 nt, Mus musculus
acugaagaagcugaagaggaaggauc

SEQ ID NO: 117215 - RNA, 30 nt, Mus musculus
agcucaagaauucaaagccagccuggguuc

SEQ ID NO: 117216 - RNA, 42 nt, Mus musculus
cacaaccaucgguaacgaaaccugaugcccucuucuggagug

SEQ ID NO: 117217 - RNA, 45 nt, Mus musculus
caccacacaccuuuaacacucaaacucgaaaggugggaugcaggg

SEQ ID NO: 117218 - RNA, 29 nt, Mus musculus
acugaagacuaucuacauagaagggaaaa

SEQ ID NO: 117219 - RNA, 46 nt, Mus musculus
gucuaucaucgacucugcuaagacugcugguaacuguguuguagga

SEQ ID NO: 117220 - RNA, 42 nt, Mus musculus
uaggggacccugacagggaccagaggcguggugacagcaacg

SEQ ID NO: 117221 - RNA, 42 nt, Mus musculus
agguaggcauuccuugucccagauccuagguagcgggcagau

SEQ ID NO: 117222 - RNA, 46 nt, Mus musculus
ggcuccaagcuccgucaacucaguucucuacacaacuccccuucac

SEQ ID NO: 117223 - RNA, 45 nt, Mus musculus
aaagauacauggacugugacccuaucucaggcugaaacaucccua

SEQ ID NO: 117224 - RNA, 46 nt, Mus musculus
cugcugagaccacucccugcagucuacggaggaggagaggcuccag

SEQ ID NO: 117225 - RNA, 38 nt, Mus musculus
ucugcggccaccccuccgagggugccaggauccacuca

SEQ ID NO: 117226 - RNA, 42 nt, Mus musculus
cuggaaaugugucaaaucuccuuuugcagauuuguggggcag

SEQ ID NO: 117227 - RNA, 46 nt, Mus musculus
aguccaaagacaugaacugaagauccucuugugauauuguuuuuag

SEQ ID NO: 117228 - RNA, 46 nt, Mus musculus
cagcacucacgaguuugaaguaggaagaucaaaagcucaaggucag

SEQ ID NO: 117229 - RNA, 46 nt, Mus musculus
cuuguuugaccuucccaaugcccuuucuucaaaucccuugccccag

SEQ ID NO: 117230 - RNA, 42 nt, Mus musculus
cucaccaauuucguucuguuggccccagccagucacccagca

SEQ ID NO: 117231 - RNA, 46 nt, Mus musculus
uaaacugacccaacaaagacucuguccugagucuugcagaccgcag

SEQ ID NO: 117232 - RNA, 45 nt, Mus musculus
ccagaaucucccuggaaaacaagaggaagaaaccaauggcuggga

SEQ ID NO: 117233 - RNA, 45 nt, Mus musculus
cugaggaagggggccaggcaggacugccuucuugugaagccuaug

SEQ ID NO: 117234 - RNA, 46 nt, Mus musculus
uguugucuccaggaggcuacagcacgacacagcaguggccugagga

SEQ ID NO: 117235 - RNA, 45 nt, Mus musculus
gcagagaagggcaaugucgcuucugaugaaguuccggccccagua

SEQ ID NO: 117236 - RNA, 42 nt, Mus musculus
ugggagcugcagcagccagggcaggagaagaagccaggaggu

SEQ ID NO: 117237 - RNA, 46 nt, Mus musculus
agacagggguucgcuacauagaccaggcuggccuugaacucuugag

SEQ ID NO: 117238 - RNA, 46 nt, Mus musculus
cugccuuugccugauuuaagguagacaccaccaccucccugcuuaa

SEQ ID NO: 117239 - RNA, 51 nt, Mus musculus
aacucgcuguuacagugcuuggcacacacgccauaguuuuccagaaagagg

SEQ ID NO: 117240 - RNA, 26 nt, Mus musculus
aaauccuuccagcucccugcugccuu

SEQ ID NO: 117241 - RNA, 45 nt, Mus musculus
agucaguuacgugguaagaccuugucugaaaaggucaccaguggg

SEQ ID NO: 117242 - RNA, 46 nt, Mus musculus
ggcugggguacaagguccuuaaagugcacacaugcaggcuggugag

SEQ ID NO: 117243 - RNA, 42 nt, Mus musculus
aaucccagcaaccauaugguggcucacaccaucuguaacgaa

SEQ ID NO: 117244 - RNA, 42 nt, Mus musculus
acaaaacgccugaaccccaaacaaaagaaaacucaccagcaa

SEQ ID NO: 117245 - RNA, 46 nt, Mus musculus
uguucauuuagggcaauaugaauccuuguucccaagccacggccac

SEQ ID NO: 117246 - RNA, 41 nt, Mus musculus
cacaaaaugaaaacaguagauuaaaaagaaagauaugccaa

SEQ ID NO: 117247 - RNA, 42 nt, Mus musculus
uaagguguugaguaggacccucaggugggcggggagacgggg

SEQ ID NO: 117248 - RNA, 45 nt, Mus musculus
aggucacugucaccuguagcaacauuuccuccucgcggcccuccu

SEQ ID NO: 117249 - RNA, 45 nt, Mus musculus; identical to SEQ ID NO: 117248

SEQ ID NO: 117250 - RNA, 46 nt, Mus musculus
agcaucauaccugauuuuaugcugggaauggcacccaagguuacag

SEQ ID NO: 117251 - RNA, 24 nt, Mus musculus
cuuuucuuuguagaguccugauua

SEQ ID NO: 117252 - RNA, 46 nt, Mus musculus
aaagaaauagguaaauagacacuugggaagaaaugacauccauaga

SEQ ID NO: 117253 - RNA, 42 nt, Mus musculus
aguaaacauuaggucauuauuagucuuuuguauacagcgcua

SEQ ID NO: 117254 - RNA, 45 nt, Mus musculus
cuguggcagugauacuuacacagugguguggguacuagcaaagag

SEQ ID NO: 117255 - RNA, 46 nt, Mus musculus
uauuaaaaauugcauaauuuucuguuuauauauugcuuccacccau

SEQ ID NO: 117256 - RNA, 43 nt, Mus musculus
uguuaguuuuuuugcauuauauggcuucaguuuuuuuccugga

SEQ ID NO: 117257 - RNA, 42 nt, Mus musculus
aagauggggacuccugguucuggaaggaaaagaacgccggua

SEQ ID NO: 117258 - RNA, 42 nt, Mus musculus
cuacaaaagaaauguguguccacacaggauucagaagaggga

SEQ ID NO: 117259 - RNA, 46 nt, Mus musculus
uuuuuuaagaugggacagaacuuguucccaauuuugaugagccaau

SEQ ID NO: 117260 - RNA, 48 nt, Mus musculus
ggaaaagcauuggagcaaguggagaaauaccucauguaggaaggagaa

SEQ ID NO: 117261 - RNA, 31 nt, Mus musculus
ugaauccucauugguugagagcugaaacuau

SEQ ID NO: 117262 - RNA, 45 nt, Mus musculus
cugcugcuuuggacucggccuuggcuucucagucuuagagcagug

SEQ ID NO: 117263 - RNA, 45 nt, Mus musculus
gcagaagcaagagacauccgcaugcgggaacuggaacgacagcag

SEQ ID NO: 117264 - RNA, 44 nt, Mus musculus
guuuagugaccaacacuggcagagucagggucagaaugugaaga

SEQ ID NO: 117265 - RNA, 44 nt, Mus musculus
ccuuagaaggcaguuugcuguaaucuguuucauuguuacuggug

SEQ ID NO: 117266 - RNA, 64 nt, Mus musculus
acgccuggcuuauauucuguaauuuuuaaagcuagcugaaucccacguuauauuuugaaaaaag

SEQ ID NO: 117267 - RNA, 64 nt, Mus musculus
aaaaaauuggaauaaauacucuugcuccugcauguugaaauacccugucaucuacagagaccgu

SEQ ID NO: 117268 - RNA, 48 nt, Mus musculus
aauauuuuaauaggaaaaauaaauaaauaaaacuuuuauagagaaggg

SEQ ID NO: 117269 - RNA, 46 nt, Mus musculus
uucugucauagucuaagauugagucgucuuaccauuacuacuucag

SEQ ID NO: 117270 - RNA, 46 nt, Mus musculus
aggacucugaugucuucaccgaccugucaguauaguccugacccag

SEQ ID NO: 117271 - RNA, 94 nt, Mus musculus
aauaccagcuacuccuuuuucuaaggaaaauuacauuguggugugacggguuaaaaguuuaagcaauuuaaaauauauaauucuaugaugugau

SEQ ID NO: 117272 - RNA, 49 nt, Mus musculus
aagggaagagggagaaagaauguagcugaaaacagauuauagagaccuu

SEQ ID NO: 117273 - RNA, 64 nt, Mus musculus
uagaggcagugucagcaguagagaagggagguucuaggcagugagaagggagguucuaggcagu

SEQ ID NO: 117274 - RNA, 58 nt, Mus musculus
guucuaggaagugagaagggagguucuaggcagugagaagggagguucuaggcaguag

SEQ ID NO: 117275 - RNA, 95 nt, Mus musculus
ggagguucuaggcaguagagaagggagguucuaggcagugagaagggagguucuaggcaguagagaagggagguucuaggcaguagagaagggag

SEQ ID NO: 117276 - RNA, 85 nt, Mus musculus
guucuaggcaguagagaagggagguucuaggcaguagagaagggagguucuaggaagugagaagggagguucuaggcaguagaga

SEQ ID NO: 117277 - RNA, 32 nt, Mus musculus
ucugaucgugccagucgugggcgaagggagag

SEQ ID NO: 117278 - RNA, 46 nt, Mus musculus
auccucugaguuuuuuucccuuagcuaaguuagaauuuuggaguag

SEQ ID NO: 117279 - RNA, 42 nt, Mus musculus
acaagcagaugaguguaauagugugggaaucagacauucuau

SEQ ID NO: 117280 - RNA, 45 nt, Mus musculus
gagacuuggguugauuguccuuuguagagcagggcuuggugugga

SEQ ID NO: 117281 - RNA, 45 nt, Mus musculus
uugcuggugaaagaaagcaggaggagaguggggggagagggguga

SEQ ID NO: 117282 - RNA, 41 nt, Mus musculus
ggacacaaaacauuauauuuuccuuuuaaaaauuggcccau

SEQ ID NO: 117283 - RNA, 46 nt, Mus musculus
acaucuaugaccugaaggaccagauucaugauguagaagggcggua

SEQ ID NO: 117284 - RNA, 46 nt, Mus musculus
auguuccaauguuacuguggguugggggaagguauucugagcagag

SEQ ID NO: 117285 - RNA, 42 nt, Mus musculus
aguucguauuuaauacuucuggaaacaacuagggggggugag

SEQ ID NO: 117286 - RNA, 52 nt, Mus musculus
aggccagcauugucucaaauacaaacaaacugaggucaagggggagggagag

SEQ ID NO: 117287 - RNA, 46 nt, Mus musculus
uaaaauauaaauugcuagucucuaccuccaguuugggaaucagugg

SEQ ID NO: 117288 - RNA, 42 nt, Mus musculus
uuuauguuuauauacgugggugguuucccacagaggccaaaa

SEQ ID NO: 117289 - RNA, 42 nt, Mus musculus
aguuuuuuuaauaaaggucuccuuuuucucuuuggcugauag

SEQ ID NO: 117290 - RNA, 55 nt, Mus musculus
uuuggggcccuagcauuuauauaccuucugaaaaguccccagaauuccaaauguc

SEQ ID NO: 117291 - RNA, 79 nt, Mus musculus
ucugaucuaccagguggacacccucaaggaugucauugaagagcaggaggagcagauggcagaguuuuauagagagaac

SEQ ID NO: 117292 - RNA, 46 nt, Mus musculus
gagacuuaagccucagccacuacacuugaauaucugacacccacag

SEQ ID NO: 117293 - RNA, 44 nt, Mus musculus
cuccacgucacucagaaaagcaaggucacaguaacacuggugua

SEQ ID NO: 117294 - RNA, 67 nt, Mus musculus
cuucuuacguuuagugaucggucuuuccuuuuauaagccaagaagauaugcuagccaauuuugauua

SEQ ID NO: 117295 - RNA, 50 nt, Mus musculus
ugcagcacacaaagcuuggcugauuucucugcugcaguuacucccuugug

SEQ ID NO: 117296 - RNA, 85 nt, Mus musculus
ucuuguuuccuggacuuuagccugguuuuccuuuuucucggugggguuuuguuguugucacuguuguuauuuuaggaguucucca

SEQ ID NO: 117297 - RNA, 46 nt, Mus musculus
uugcuauucuaacaauuuuaacuauucucuugcuccacuugcccgu

SEQ ID NO: 117298 - RNA, 46 nt, Mus musculus
cacucauuuaaaaccucuccacucugcuuucuguuuuggugccuuu

SEQ ID NO: 117299 - RNA, 45 nt, Mus musculus
uaugcuuacauuagauaugcuuacauuauaaaauaugaauugaaa

SEQ ID NO: 117300 - RNA, 45 nt, Mus musculus
agucacauaccuaguucuguaggguagacauuuaaagaacggaag

SEQ ID NO: 117301 - RNA, 45 nt, Mus musculus
aagugaugugagugggugcgcagaguagggagaguaaggugaugu

SEQ ID NO: 117302 - RNA, 46 nt, Mus musculus
gggugcgcagaguagggagaguaaggugaugugugggugcagaguc

SEQ ID NO: 117303 - RNA, 46 nt, Mus musculus
ccagagcaccgcucaucucuagcuucauuuccaagacuacaaucua

SEQ ID NO: 117304 - RNA, 46 nt, Mus musculus
aggcuucagaaucuagagucucacaucacuuuacagauaacugcag

SEQ ID NO: 117305 - RNA, 46 nt, Mus musculus
cuaugcuguucuugcccuugcuacccugccuaaaaccaggcccuag

SEQ ID NO: 117306 - RNA, 41 nt, Mus musculus
agucaguuauauggccaaaggaaaaagagguagauggcagg

SEQ ID NO: 117307 - RNA, 46 nt, Mus musculus
acugcugcugagaaugcagagaaaauugaagaugagcugaaagcag

SEQ ID NO: 117308 - RNA, 110 nt, Mus musculus
cccuucuaccugggugcugcugaggaccuugccgggagaugcugacucuuuuguacauugacacaagccccuucaaguacuguuuugagucuugucauuaaacagccacc

SEQ ID NO: 117309 - RNA, 46 nt, Mus musculus
ccacaguuugauagcgaaggaaaagaaucauuucauauggccaugu

SEQ ID NO: 117310 - RNA, 46 nt, Mus musculus
gggagagcugcucucugaucucaucucuguguuugggguuggaggu

SEQ ID NO: 117311 - RNA, 45 nt, Mus musculus
ugugguuccaaccauuauuaauaaugaugaucauggucauuaggc

SEQ ID NO: 117312 - RNA, 50 nt, Mus musculus
cuggagugcucucccuugcccaacagcaagcuggcaccaaacuacuuguu

SEQ ID NO: 117313 - RNA, 42 nt, Mus musculus
agacagaggcagagaggcagaggcagagaggcagaggcagag

SEQ ID NO: 117314 - RNA, 43 nt, Mus musculus
ucugccgaagggaccuuggaggacagaacuacaccggugaaac

SEQ ID NO: 117315 - RNA, 41 nt, Mus musculus
cuuuccgcgcaggucccuuuauaguuuagggugcagucaga

SEQ ID NO: 117316 - RNA, 46 nt, Mus musculus
uaaaacguaaacauauugaauaaauaaaauaaaaaaugggucagag

SEQ ID NO: 117317 - RNA, 46 nt, Mus musculus
ccugguugucaccuugacuauauguggaaugaacugcaauccagaa

SEQ ID NO: 117318 - RNA, 47 nt, Mus musculus
ccuuugauguuaaccacccgcccuguccucacagcuuggagucugca

SEQ ID NO: 117319 - RNA, 45 nt, Mus musculus
cuggucugggagcugcaacagaauacuugacacaagcgacuucgg

SEQ ID NO: 117320 - RNA, 46 nt, Mus musculus
uaccucacagccuuuucuucuuaaaguaagaaggaagccaccaucu

SEQ ID NO: 117321 - RNA, 41 nt, Mus musculus
uugugcccuguggccugccuaacugaggugucugccaucuc

SEQ ID NO: 117322 - RNA, 46 nt, Mus musculus
cauggucagggaaguguucaccguccugguccgcauggccacugag

SEQ ID NO: 117323 - RNA, 46 nt, Mus musculus
gcaucagauugugugugugugugugugugugugugugugugagaga

SEQ ID NO: 117324 - RNA, 51 nt, Mus musculus
ucaguaccaccgggacaaguggggccucucggaugagcacuuccagcccag

SEQ ID NO: 117325 - RNA, 42 nt, Mus musculus
gaccauguaccacuauuuacaguuugcguauuacaaguguaa

SEQ ID NO: 117326 - RNA, 45 nt, Mus musculus
guucuggaguguaagauucguugugaggagacccucaccccaguc

SEQ ID NO: 117327 - RNA, 40 nt, Mus musculus
uguauccuguuaucccagcccuugggaucacaagguagcg

SEQ ID NO: 117328 - RNA, 42 nt, Mus musculus
uguucacucacuggcucgccucuucaguugcuggucauuuuu

SEQ ID NO: 117329 - RNA, 47 nt, Mus musculus
cgcgggagaucaaggacuucaaggacuucuaccuguccauagcaggu

SEQ ID NO: 117330 - RNA, 42 nt, Mus musculus
ggcuucauggaacgcuccggaaggagaaaaaauggggucagg

SEQ ID NO: 117331 - RNA, 31 nt, Mus musculus
gagaaacccugucucaaaaaaaagggagggg

SEQ ID NO: 117332 - RNA, 42 nt, Mus musculus
ccggccccuacauaaugagaauguaaagauuucugcccccgg

SEQ ID NO: 117333 - RNA, 46 nt, Mus musculus
agcagacauccuucacuacucugggcauggcauggaccuugacaag

SEQ ID NO: 117334 - RNA, 46 nt, Mus musculus
gccagauauaaacuugauccuuucuggacacacucacgcagggcag

SEQ ID NO: 117335 - RNA, 42 nt, Mus musculus
agcauagggucauucauaggacuucagacccacaaggaaaac

SEQ ID NO: 117336 - RNA, 45 nt, Mus musculus
cgcacggaugcggugccaugugggcccacauuuacacacaacgca

SEQ ID NO: 117337 - RNA, 46 nt, Mus musculus
uggggacuccaggggaccugaacauccauuauggcugugcuugcaa

SEQ ID NO: 117338 - RNA, 41 nt, Mus musculus
gagcuggcguucuagguggcugugagcugccuaacaugggu

SEQ ID NO: 117339 - RNA, 41 nt, Mus musculus
gaucucauuacgguugguugugggccaccaugugguugcug

SEQ ID NO: 117340 - RNA, 56 nt, Mus musculus
uuugggggccgguggcucgagaauccaaaugagcacaggaagcaggagcaugggga

SEQ ID NO: 117341 - RNA, 57 nt, Mus musculus
gcaguccuagguccggacgccucugucuucagccccguggagcuugugaccaguucc

SEQ ID NO: 117342 - RNA, 46 nt, Mus musculus
ccuaagucguaaucgauucgaccuuagggauaccaagaggaagcag

SEQ ID NO: 117343 - RNA, 44 nt, Mus musculus
agccaaacgugagggguauggaguguggcugcuuuugguaugga

SEQ ID NO: 117344 - RNA, 42 nt, Mus musculus
cauccagcuggcucaugagcugggacuccuggugauccugag

SEQ ID NO: 117345 - RNA, 45 nt, Mus musculus
aacacccacauacaaaaaguaaauaaauaaauauuuaaagagaaa

SEQ ID NO: 117346 - RNA, 46 nt, Mus musculus
agacauuauuuuagcuguaagaccuuaaacagucauucaguugcau

SEQ ID NO: 117347 - RNA, 45 nt, Mus musculus
gaagccccugcucuaccagaacggaggaccgaucauaaccgugca

SEQ ID NO: 117348 - RNA, 44 nt, Mus musculus
ccuggucucccuccucuccagucacucaaaccucaggagccaga

SEQ ID NO: 117349 - RNA, 42 nt, Mus musculus
ccaccucauuucccugucaaaggccuugucacaugcguacag

SEQ ID NO: 117350 - RNA, 46 nt, Mus musculus
aagcaagcacucuaccaacggagcuacuucccaaaucccaccccac

SEQ ID NO: 117351 - RNA, 46 nt, Mus musculus
cuaugcugagcuauagugugaaagcacugucucaaaccaacagcaa

SEQ ID NO: 117352 - RNA, 27 nt, Mus musculus
gguuccuugggucuuuuucagaaaccg

SEQ ID NO: 117353 - RNA, 45 nt, Mus musculus
guggaucaaggaaagguuuaugauauacaugccuagaaauuacga

SEQ ID NO: 117354 - RNA, 46 nt, Mus musculus
cacacaaaaagggugaauugugcguaauggauaaauguggggcuag

SEQ ID NO: 117355 - RNA, 45 nt, Mus musculus
uauacagagaaacccugucucgaaaaaccaaaaaaaaaaagagua

SEQ ID NO: 117356 - RNA, 45 nt, Mus musculus
aacuccuuaggugaggaugugguuuuuaaucucgcuguaucucau

SEQ ID NO: 117357 - RNA, 42 nt, Mus musculus
gguuuggugauacauagcugugaccccagauacacacccaua

SEQ ID NO: 117358 - RNA, 46 nt, Mus musculus
aaaaacaacaggguguagaagacaaggugauguaacugugaaugag

SEQ ID NO: 117359 - RNA, 30 nt, Mus musculus
ggcuggggaccucacuaagaaguauuuugc

SEQ ID NO: 117360 - RNA, 46 nt, Mus musculus
cagcaaaggcucuaggcucugcacccuucaucugugaggcugggau

SEQ ID NO: 117361 - RNA, 44 nt, Mus musculus
agccagaagauacgucccugugguggcucgaauguauagggagg

SEQ ID NO: 117362 - RNA, 74 nt, Mus musculus
aauuauaugauggcucgaggccucagcuacauagaugaaagcagagaggggaggaggggggaagaaagagaaau

SEQ ID NO: 117363 - RNA, 42 nt, Mus musculus
agaagaacaaacaaggcucccaaggcuacuguguaugggaag

SEQ ID NO: 117364 - RNA, 43 nt, Mus musculus
cccugaguuuguuuucugagggccggguggaagaguuggcauu

SEQ ID NO: 117365 - RNA, 45 nt, Mus musculus
caguaacccgaaacccauuuucucuucacccuucaaugguguccg

SEQ ID NO: 117366 - RNA, 46 nt, Mus musculus
gcuggacauccugguggagaacauggggcgugugaacuauggcaga

SEQ ID NO: 117367 - RNA, 45 nt, Mus musculus
acacacacacacacacacacacacacacacaccuacaccuguaau

SEQ ID NO: 117368 - RNA, 46 nt, Mus musculus
aguaaguggacccuguaucaccccaucuuacuccaccccaccccag

SEQ ID NO: 117369 - RNA, 46 nt, Mus musculus
uucucugccccguuuuccuugacaacuuuucuucagugaauggcag

SEQ ID NO: 117370 - RNA, 50 nt, Mus musculus
cucuagaaggaaggcuccguucugccuucuuccccaaaaccaaccccucu

SEQ ID NO: 117371 - RNA, 41 nt, Mus musculus
gcucccaagccaggccuuucucccaguucucaugccauggg

SEQ ID NO: 117372 - RNA, 42 nt, Mus musculus
acuaucacaccaagcugugcgugguguaaucccagcacucag

SEQ ID NO: 117373 - RNA, 78 nt, Mus musculus
ccacugggccaucuucccagccuauuuauguacacuggcacauagguaaaaauuagucaaaacuaauucagggcaacu

SEQ ID NO: 117374 - RNA, 84 nt, Mus musculus
aagcccaggugaaacuauuaugguuuaugccuuucaggacggagagagauaacagaucccgaguaaaaacaagaguuaaaguag

SEQ ID NO: 117375 - RNA, 46 nt, Mus musculus
gggggaaaauuaaauggagaccugccugaguucagacagcuagcag

SEQ ID NO: 117376 - RNA, 44 nt, Mus musculus
cacagcucuacucugguuacacggaucaccuuuguugugcuaga

SEQ ID NO: 117377 - RNA, 42 nt, Mus musculus
cugaagggaguggacaccacaggaagacacagguuggagcaa

SEQ ID NO: 117378 - RNA, 44 nt, Mus musculus
uuccuucuuaaguuuggugagaaaggcaccaagaacgggcaguu

SEQ ID NO: 117379 - RNA, 45 nt, Mus musculus
cugaggucaaggccgucacagcucgccacaagaaggcccuggagg

SEQ ID NO: 117380 - RNA, 46 nt, Mus musculus
ccgugcaagcucagagcuacuuuacagcugaccgucauucccagua

SEQ ID NO: 117381 - RNA, 42 nt, Mus musculus
gggagagauggcuggaaaaugaugcacacguggcggagagac

SEQ ID NO: 117382 - RNA, 33 nt, Mus musculus
gccagcaaggccacgccucccagucccugaagu

SEQ ID NO: 117383 - RNA, 41 nt, Mus musculus
caguucauuaucuucauuucagggaacauuguggcaggaag

SEQ ID NO: 117384 - RNA, 46 nt, Mus musculus
aucuggguuuuuaguuuuuuuaauuuagguuuuggauaaggaacag

SEQ ID NO: 117385 - RNA, 45 nt, Mus musculus
agcagagaugacuccaaaaauauacucagacugaaaugcagguag

SEQ ID NO: 117386 - RNA, 42 nt, Mus musculus
acauugguucacuuuuccagucugaucguuuauggggcacug

SEQ ID NO: 117387 - RNA, 24 nt, Mus musculus
ucagucucccuugucuuucucaac

SEQ ID NO: 117388 - RNA, 54 nt, Mus musculus
uuuacaguuccaugcagagaaguuaugaccaugagggaaauaaagcuuauucaa

SEQ ID NO: 117389 - RNA, 60 nt, Mus musculus
aguauaacuaaaucuggauuucugauaccuugucauuugggggauuuuaucuuacuuugc

SEQ ID NO: 117390 - RNA, 158 nt, Mus musculus
acacaacaccccacugcuuuagugggacaguugagagcagugugucccuuuuaugaagaacccgucauuuacagcgcuccgggagagagaauguuacugcagaucccuuuuccacgguguagauacucugauuuauagaauucauucuugauccagau

SEQ ID NO: 117391 - RNA, 46 nt, Mus musculus
acagacuugaaaucuuuauccaguuguuuaguaaagugagagagag

SEQ ID NO: 117392 - RNA, 45 nt, Mus musculus
guuaccucaguacugaggucggcuccauguucccacgcagaagau

SEQ ID NO: 117393 - RNA, 48 nt, Mus musculus
auccggaugcacugcgguuagcgggcauccucaccagguacucacaga

SEQ ID NO: 117394 - RNA, 56 nt, Mus musculus
uguaagcagccgcugcugacggugggccucccuccgcguaguuagcugacuagaug

SEQ ID NO: 117395 - RNA, 52 nt, Mus musculus
gaugugaugagagcuucuugaccaguaaacaaacuagcccaggucugagaga

SEQ ID NO: 117396 - RNA, 45 nt, Mus musculus
gcuguuucugauguguaacgugaagcaagacagagcccugcugug

SEQ ID NO: 117397 - RNA, 44 nt, Mus musculus
auguccuguuucacagcaccaaggguacagaacaucgcugggcc

SEQ ID NO: 117398 - RNA, 42 nt, Mus musculus
cagacugucacugucucaaaaacaagauggagaacaguagag

SEQ ID NO: 117399 - RNA, 50 nt, Mus musculus
caggauauauaaagugaaagcaccugacaacagggagacacuaggucaca

SEQ ID NO: 117400 - RNA, 46 nt, Mus musculus
gauuuucgcacucccccaggcuuugaccgaacacguaaugcugaga

SEQ ID NO: 117401 - RNA, 46 nt, Mus musculus
aauuucugaauguuuuugugacauguuaaaaaaaauuagaccagug

SEQ ID NO: 117402 - RNA, 45 nt, Mus musculus
ggggacgauaucaacaaguuccucuggauggucaggauagcugaa

SEQ ID NO: 117403 - RNA, 46 nt, Mus musculus
auaaaaucaugaggucccuugaugucgauuauguguugguuauuuu

SEQ ID NO: 117404 - RNA, 46 nt, Mus musculus
acaggaccacucugguggauaacaacaccuggaacaacagccacau

SEQ ID NO: 117405 - RNA, 46 nt, Mus musculus
cuccaguccaagugugguccuugccuccuacaaucaugauggguaa

SEQ ID NO: 117406 - RNA, 86 nt, Mus musculus
gucggccaucgccuucuccaauguuuuugagcacuauuugggggaugacaugaaaagggaaaacccaccuguggaggacagcagug

SEQ ID NO: 117407 - RNA, 44 nt, Mus musculus
agcacaggaguuagagggucaagugcuuucugccaccaagaaga

SEQ ID NO: 117408 - RNA, 46 nt, Mus musculus
auaaacugucuauggcuaaaacauuugcugacuuuuauccagagau

SEQ ID NO: 117409 - RNA, 47 nt, Mus musculus
cagagagaaacagagacauaauuuacaaaauaauaaaaaggcagaua

SEQ ID NO: 117410 - RNA, 46 nt, Mus musculus
acucaguucucacagaccucagaaugggaugucagagccccuagaa

SEQ ID NO: 117411 - RNA, 42 nt, Mus musculus
agacccuuuucuuuuugggugucucacuagcugcaggcgcug

SEQ ID NO: 117412 - RNA, 42 nt, Mus musculus
cacagauugccacugcgcuacagcagcggugugcucuaggau

SEQ ID NO: 117413 - RNA, 46 nt, Mus musculus
guggcugcguagaaaguugggcuggcugggguugugguuugguaau

SEQ ID NO: 117414 - RNA, 45 nt, Mus musculus
guccucugaccuccacaucaugcccugacacuccagaauaaaaga

SEQ ID NO: 117415 - RNA, 45 nt, Mus musculus
cuucuuacaaacuuuaauauuguuugauagcagucagguggaacu

SEQ ID NO: 117416 - RNA, 44 nt, Mus musculus
aguguauaccugugccugugcgcacacccagcuguccugcuagu

SEQ ID NO: 117417 - RNA, 45 nt, Mus musculus
aucuuccugccuuuacaaauguggaccuuguaaaaugucuguguc

SEQ ID NO: 117418 - RNA, 47 nt, Mus musculus
ucugggugcauuuccucuagguucucauccuccagauucucacccuu

SEQ ID NO: 117419 - RNA, 41 nt, Mus musculus
ucauguggguguuaggaauugaacccaggucaucuggaaga

SEQ ID NO: 117420 - RNA, 42 nt, Mus musculus
ugugugcaccacgugcaugcaugccuuugugccugcugaggu

SEQ ID NO: 117421 - RNA, 46 nt, Mus musculus
cuuuacagagugacuuaaaauaauuauuucuuggggcuggagagag

SEQ ID NO: 117422 - RNA, 46 nt, Mus musculus
uuauuuaaggcuccaguuuauugacauuaaccauuucauggcagaa

SEQ ID NO: 117423 - RNA, 46 nt, Mus musculus
ucuaauauagguuacugaggauuuacuuauguauuaggcccucugg

SEQ ID NO: 117424 - RNA, 46 nt, Mus musculus
uauucguuuucauauuuuguaccaaagucuagauaucaccuggagu

SEQ ID NO: 117425 - RNA, 45 nt, Mus musculus
aggcuggcuuuucaauagccaucauuuuaauaacugucccccugu

SEQ ID NO: 117426 - RNA, 45 nt, Mus musculus
caagucugccugucuuaacuauucauguaacuuuagguggcagag

SEQ ID NO: 117427 - RNA, 46 nt, Mus musculus
ucuccuucuccccccugucucucccucccucucuuucucucccucu

SEQ ID NO: 117428 - RNA, 46 nt, Mus musculus
uaucucucucucucucucucucccuucccccucuccccccuccccc

SEQ ID NO: 117429 - RNA, 46 nt, Mus musculus
ugagguuggagugcuggaauuacaggccuauauaccacaccgagcg

SEQ ID NO: 117430 - RNA, 45 nt, Mus musculus
aucaucauauauguguauguaucacucuccuaaaaaaguccagau

SEQ ID NO: 117431 - RNA, 46 nt, Mus musculus
guguauagugguuccugugcaucuugaguacagucugccucaagcu

SEQ ID NO: 117432 - RNA, 74 nt, Mus musculus
ucaucucuaaagacuaaaguuguacuuugcucaucuguccuaaccaagucugccuuuuguuuggugaacucaca

SEQ ID NO: 117433 - RNA, 66 nt, Mus musculus
aagguuuaucuaucuagcuucugggcuaauucccucccccaauuacauugauuucuucucauucgg

SEQ ID NO: 117434 - RNA, 46 nt, Mus musculus
auaucaauugugugcuuuguuggcacaaguuaauuccuguguaguc

SEQ ID NO: 117435 - RNA, 46 nt, Mus musculus
cgugcucugacuuaaguggaagcacagagaagcacccgcccaugcg

SEQ ID NO: 117436 - RNA, 46 nt, Mus musculus
aaucacuuuaaaauauccaucccuuuuaaaauccaaacucguuuua

SEQ ID NO: 117437 - RNA, 46 nt, Mus musculus
ucagucuaaaaguugugcuuggaccucaacccugcccucgucagua

SEQ ID NO: 117438 - RNA, 46 nt, Mus musculus
auaauacauguaaaugugaguagaucuuguuaauaugaugccagug

SEQ ID NO: 117439 - RNA, 43 nt, Mus musculus
agauguguguguauuccuugcaccaacuuuuagcggccuuaca

SEQ ID NO: 117440 - RNA, 45 nt, Mus musculus
cacaaccauccguaacaagaucugacccccucuucugaagugucu

SEQ ID NO: 117441 - RNA, 46 nt, Mus musculus
auaaaguguguucaaugcuaguaaauguaauaaaugucagggagag

SEQ ID NO: 117442 - RNA, 46 nt, Mus musculus
gaucaagaaguuacacugaaaaguguaucugauuuuguuuauagag

SEQ ID NO: 117443 - RNA, 46 nt, Mus musculus
cagauagucuagaagccgaccuauagguagauccagaccgugagau

SEQ ID NO: 117444 - RNA, 44 nt, Mus musculus
gcugagcuggggcauuugcgagagaaggacaagcgcggugagga

SEQ ID NO: 117445 - RNA, 46 nt, Mus musculus
caugcuccugcuuugugaaacauguuuauaaucauuacuugaagua

SEQ ID NO: 117446 - RNA, 42 nt, Mus musculus
guuccugaccauuuuaaguagaagaugcuuaccugcagagag

SEQ ID NO: 117447 - RNA, 48 nt, Mus musculus
agagaggaaauauagcuaaagauagagaaggcugguuuagaaaugaga

SEQ ID NO: 117448 - RNA, 46 nt, Mus musculus
cauauaccauauaaugcuaaaacaauggugggaucauagcucagug

SEQ ID NO: 117449 - RNA, 45 nt, Mus musculus
cacaaagaguaauuagaauacgaacuauuuacaggcccuugacaa

SEQ ID NO: 117450 - RNA, 46 nt, Mus musculus
ucccaucucuaaucugcuuuguguuuauuguauuuaagccccagaa

SEQ ID NO: 117451 - RNA, 42 nt, Mus musculus
caaauguuuuaucacaacauuaccccagcauuugcaguagaa

SEQ ID NO: 117452 - RNA, 45 nt, Mus musculus
caucucauuccgagguuuuguuuguguuugugaaugugugccaga

SEQ ID NO: 117453 - RNA, 45 nt, Mus musculus
auuuuuggguuguuuuguuuuggaaaguaggaauuccugccaauc

SEQ ID NO: 117454 - RNA, 46 nt, Mus musculus
uaaauaagcuguagagauugagggagaagccuggcauaaaucagau

SEQ ID NO: 117455 - RNA, 46 nt, Mus musculus
ugauaaaaucucuuccauaaagacaguguuuuguauaaggauaggu

SEQ ID NO: 117456 - RNA, 42 nt, Mus musculus
caguuuuuuuuuuuguuuuuuuuuuuuuuguuuuuuuuuuuu

SEQ ID NO: 117457 - RNA, 45 nt, Mus musculus
agaaggucugguauuauagaggcccaccugccaguggguggaggu

SEQ ID NO: 117458 - RNA, 46 nt, Mus musculus
auguaguuuaaaaagagucuguuaguacauguucauagccccaagu

SEQ ID NO: 117459 - RNA, 46 nt, Mus musculus
ugacuccuaacaguagcaaaaugacagcugugaagaagcaacagaa

SEQ ID NO: 117460 - RNA, 42 nt, Mus musculus
gugggcguaguggcaagugggugucuaugacuccugccccuc

SEQ ID NO: 117461 - RNA, 46 nt, Mus musculus
gggcagagggugagcaucaccucugugccaccccacagcagacagu

SEQ ID NO: 117462 - RNA, 71 nt, Mus musculus
caugugaggugcaaggccugcuuucccaagugaagugcaaaauagcuccccugagcacaugacccuguggg

SEQ ID NO: 117463 - RNA, 25 nt, Mus musculus
agccgagcuguaacguuaucccgcu

SEQ ID NO: 117464 - RNA, 46 nt, Mus musculus
ugagguguuguuuuuggggggcuuuuuuaaaguuauaacuucagaa

SEQ ID NO: 117465 - RNA, 84 nt, Mus musculus
aaaaguugauaaagguuuugcuuuuugguugaagaugaguaaugaauuuucagaagugggccuuuuacaaaguagcccauugag

SEQ ID NO: 117466 - RNA, 129 nt, Mus musculus
uuagucauccguucuaagucuuuacucauuggcccaucaaaaaugcuuggucccagcccucucuaaugaaguuagcuugcuaguuggaugauagcuaguuauuugcuuguuuuaauguaggggaagaug

SEQ ID NO: 117467 - RNA, 45 nt, Mus musculus
uuuuucuuaacucuucaaugucucuggcugugcuuacacccuucu

SEQ ID NO: 117468 - RNA, 45 nt, Mus musculus
aacauucacaucacuacugccuauguucucugauugaugguuugu

SEQ ID NO: 117469 - RNA, 47 nt, Mus musculus
gaagugcuugaguggcugcaucugaugauggcuuugaauccgugccc

SEQ ID NO: 117470 - RNA, 46 nt, Mus musculus
ucuauugaacaccagaggggccuacucaaggaaaaccuguuuagag

SEQ ID NO: 117471 - RNA, 42 nt, Mus musculus
cacgggaagauugcuuuucacuuucuuccuccuggcccaacc

SEQ ID NO: 117472 - RNA, 42 nt, Mus musculus
accaagagccuuuaacugcagaaccaagcucuccgccccuau

SEQ ID NO: 117473 - RNA, 46 nt, Mus musculus
aacauugacauacugagacugaaauugaccucuaauccuuaaguac

SEQ ID NO: 117474 - RNA, 46 nt, Mus musculus
acaauccaacucugucauacauagguauaaaaauuaagauccuaag

SEQ ID NO: 117475 - RNA, 46 nt, Mus musculus
uuuccagggaaaugguuggccuuuuggagauggagagaugaaggag

SEQ ID NO: 117476 - RNA, 51 nt, Mus musculus
aauguacacauuaaaacacaccaacaaauuucuuaggggaguagauguguc

SEQ ID NO: 117477 - RNA, 45 nt, Mus musculus
aagaagcaggaagucuuuaagaguuuuaugugagauaaagggagg

SEQ ID NO: 117478 - RNA, 49 nt, Mus musculus
ugccaaaccccaacucaaacucuguuaucacugaagaaaaugagaacaa

SEQ ID NO: 117479 - RNA, 23 nt, Mus musculus
ugguguguguagccgacagagug

SEQ ID NO: 117480 - RNA, 75 nt, Mus musculus
aggaagggaagggaagggaaacgggaagggaaacagagaaaaggaaaagggaaaaggaaagaaaagaaaaagaaa

SEQ ID NO: 117481 - RNA, 42 nt, Mus musculus
ccacaugguggcucacaaccaucuguaaugagaucugugccc

SEQ ID NO: 117482 - RNA, 46 nt, Mus musculus
accaucaguaacuagaauguacuucccuggacaggguuaggcacag

SEQ ID NO: 117483 - RNA, 45 nt, Mus musculus
ucaacagaaucagaacugccuuuacaaaaguuaauuucacuugug

SEQ ID NO: 117484 - RNA, 42 nt, Mus musculus
ccuuuauuguauugagccaacgccaaaauagaacugccccau

SEQ ID NO: 117485 - RNA, 45 nt, Mus musculus
cuugguaggaacuccaguuuuucugaauucuucccuuuccuugag

SEQ ID NO: 117486 - RNA, 46 nt, Mus musculus
ugaagccaaaggccagagaccagagcaggauuuaaaaagcagggag

SEQ ID NO: 117487 - RNA, 47 nt, Mus musculus
gaccggagcaacuuaaggaagggaaugugaaaagcuaugcugacagg

SEQ ID NO: 117488 - RNA, 46 nt, Mus musculus
agagugaccugaaccucaaggauaaccuuaaacaucugacccgcag

SEQ ID NO: 117489 - RNA, 46 nt, Mus musculus
uaggagggccucuggggucaugagaacaggaugauacaagcaagaa

SEQ ID NO: 117490 - RNA, 44 nt, Mus musculus
aggauggaugcucugucugacuuucuuaugaugcuccuggaaga

SEQ ID NO: 117491 - RNA, 46 nt, Mus musculus
ugcauguugcuauuuugaaguagcuguuugucagagccagagagau

SEQ ID NO: 117492 - RNA, 46 nt, Mus musculus
agcucaugccucugucacccaaggccugcuuuaaauacggccagug

SEQ ID NO: 117493 - RNA, 42 nt, Mus musculus
aggcuuuaagugcuuuuauuugggaaccaaaugaucucaggu

SEQ ID NO: 117494 - RNA, 42 nt, Mus musculus
gagcauggcaagugauaucucuggguuaucgacagggaagua

SEQ ID NO: 117495 - RNA, 42 nt, Mus musculus
guuagacaaggagggaaggaagaaaagaaggaaggaaggaag

SEQ ID NO: 117496 - RNA, 42 nt, Mus musculus
gcuaaauugggcgcgcgcugaagccgccccgcagguccgcag

SEQ ID NO: 117497 - RNA, 42 nt, Mus musculus
gcgcgcacuucuacucgcuggagagugcucgcggaggaggag

SEQ ID NO: 117498 - RNA, 41 nt, Mus musculus
caccggcaccaaacugagaugaucaucaccaaacagggcag

SEQ ID NO: 117499 - RNA, 50 nt, Mus musculus
gaguggauauugggagacagggacccaaagagggcucguugagagagaga

SEQ ID NO: 117500 - RNA, 51 nt, Mus musculus
guuuauuuagggcauggggagggagguuaagaggguaguagaggcagagag

SEQ ID NO: 117501 - RNA, 45 nt, Mus musculus
caucucccacggauuccccuagaucccaucagauugucccuggag

SEQ ID NO: 117502 - RNA, 46 nt, Mus musculus
uucugaauuuuuauguacagucauaagucauuuuuaauaaaugugg

SEQ ID NO: 117503 - RNA, 26 nt, Mus musculus
cugcgcccaauuaagguugccagaag

SEQ ID NO: 117504 - RNA, 46 nt, Mus musculus
acuuuuacuaguuaccgguuaccagagggauaaguaagggggggag

SEQ ID NO: 117505 - RNA, 45 nt, Mus musculus; identical to SEQ ID NO: 26955

SEQ ID NO: 117506 - RNA, 24 nt, Mus musculus
gcucagggccauccgggacuacgc

SEQ ID NO: 117507 - RNA, 41 nt, Mus musculus
cagaggaggugacaccccaccuuuggggauuuuagacuagg

SEQ ID NO: 117508 - RNA, 47 nt, Mus musculus
uccaguacaacucacuuuguagaccaggcuggccucgaacucagaaa

SEQ ID NO: 117509 - RNA, 46 nt, Mus musculus
cccacaaccccaccauuaguggcucuuucauauuucccccuaaguc

SEQ ID NO: 117510 - RNA, 45 nt, Mus musculus
guagaaacucggguggcugguuacaucgucaggaagcacagagaa

SEQ ID NO: 117511 - RNA, 41 nt, Mus musculus
ucagccaggcugugggggauacauugggauggcagcauaga

SEQ ID NO: 117512 - RNA, 45 nt, Mus musculus
gcuuccugaaagagagagagagagagagagagagagagagagaga

SEQ ID NO: 117513 - RNA, 46 nt, Mus musculus
auguuguagacaagucacagugucuaaguaugggcuuggggcagag

SEQ ID NO: 117514 - RNA, 42 nt, Mus musculus
gauaauguguugaaggccauaggggcacggcgugguggauua

SEQ ID NO: 117515 - RNA, 45 nt, Mus musculus
aggagaagaagaagaagaagaagaagaagaagaagaagaacaaga

SEQ ID NO: 117516 - RNA, 42 nt, Mus musculus
gggagaaggagggggaggaggaggggaaaaggagggggaaaa

SEQ ID NO: 117517 - RNA, 45 nt, Mus musculus
cacgguuucacaguauuuuucacuuaacucgaguaucccugagau

SEQ ID NO: 117518 - RNA, 45 nt, Mus musculus
gggaaagcgcaggcuccuggcugccugucuuagaagcguccaggg

SEQ ID NO: 117519 - RNA, 46 nt, Mus musculus
agaagaccgacaccucugacaagacguugcagcugaucaaggacua

SEQ ID NO: 117520 - RNA, 79 nt, Mus musculus
aauccagagaguaaggucuucuaucugaacaugaagggagauuauuuccgguaucuugcugaaguagcuuguggcgaug

SEQ ID NO: 117521 - RNA, 111 nt, Mus musculus
cucuuaacuuuucuguauuuuacuaugagauccuuaauaauccagagcuugccugcacacuggcuaaaacggcuuuugaugaggccaucacagagcuugauacacugaacg

SEQ ID NO: 117522 - RNA, 78 nt, Mus musculus
aagacuccuacaaagacagcacccucaucaugcaguugcuuagagacaacuuaacauuauggacaucagacagugcag

SEQ ID NO: 117523 - RNA, 86 nt, Mus musculus
auucguguguaugggaucaacuguuuauauagucuuuucacacugcagcuuugggaaaacuccaucccuugguuuguguuaucucc

SEQ ID NO: 117524 - RNA, 53 nt, Mus musculus
uaaucugaaccgguucuacaagugacuguguuuuguauuacugcgaagauaug

SEQ ID NO: 117525 - RNA, 46 nt, Mus musculus
uaauaauaacgucuugauuucuacauuccuuuucugaaccuucuug

SEQ ID NO: 117526 - RNA, 46 nt, Mus musculus
ugugucacauauucuggagguuacaucugucugugacaacagggag

SEQ ID NO: 117527 - RNA, 45 nt, Mus musculus
uuuauaauaaaaaguauucuauuuugagaaaguguacuugugacu

SEQ ID NO: 117528 - RNA, 46 nt, Mus musculus
aaaccuccuccaccuguguuagagguuucaugggaaugucaauaaa

SEQ ID NO: 117529 - RNA, 46 nt, Mus musculus
cauuuauuuauuauuauacauaaguacacuguagcugccugcagac

SEQ ID NO: 117530 - RNA, 42 nt, Mus musculus
gcauauuaaucuuguucauuuuuuucuggggugcgcuaggga

SEQ ID NO: 117531 - RNA, 46 nt, Mus musculus
cacuuuauuucuuaggaugggaaauucuagggauuuaccuucagag

SEQ ID NO: 117532 - RNA, 41 nt, Mus musculus
aagguugagaacuaaaggaacccugaagcagggaccccuga

SEQ ID NO: 117533 - RNA, 46 nt, Mus musculus
aggaaaacucagacauuuacauuaugauucagcacaguagcaagau

SEQ ID NO: 117534 - RNA, 33 nt, Mus musculus
uguaucucucuguccaaccuccugaccccaucu

SEQ ID NO: 117535 - RNA, 45 nt, Mus musculus
cacacucaugcaugugugaaauggcaugcguguguagaggucagu

SEQ ID NO: 117536 - RNA, 46 nt, Mus musculus
uguaaguggaggggugacauguuuuacacacacacacacacacaca

SEQ ID NO: 117537 - RNA, 46 nt, Mus musculus
agguauguauguauguauguacacugugucuggugucuacagaggu

SEQ ID NO: 117538 - RNA, 41 nt, Mus musculus
agcgcguccaagauccgaggccccuucucuaaggagcauug

SEQ ID NO: 117539 - RNA, 46 nt, Mus musculus
cugugaagauguaauuuauaucuguaauuuauuuggggauggagac

SEQ ID NO: 117540 - RNA, 45 nt, Mus musculus
agcuccgccgccguuuaaaggaggagaagcuggagaugcugaggu

SEQ ID NO: 117541 - RNA, 45 nt, Mus musculus
acauuccaccaugacugggcuacugaagaggaaguuugaccagcu

SEQ ID NO: 117542 - RNA, 46 nt, Mus musculus
auuggggcuggggacccuacuggagacacuaccaugaaccugcucu

SEQ ID NO: 117543 - RNA, 50 nt, Mus musculus
uugggaggccaaagugucuggaacuuggauuugcguguuaagacucauuu

SEQ ID NO: 117544 - RNA, 46 nt, Mus musculus
aggaguccccagcugugggcauucaacccugaaugagugaguaagg

SEQ ID NO: 117545 - RNA, 46 nt, Mus musculus
uaggugaacuuccaggacugagacugccugggugugggugcaagaa

SEQ ID NO: 117546 - RNA, 41 nt, Mus musculus
gggcaugugucuccucauuagauuagcuuucagggccagga

SEQ ID NO: 117547 - RNA, 42 nt, Mus musculus
gccaacaucccuccuucagaggagccugccucguccccaguu

SEQ ID NO: 117548 - RNA, 45 nt, Mus musculus
gcgugcccgcgggugaguuuccuuuugaccuaguugccugagaac

SEQ ID NO: 117549 - RNA, 44 nt, Mus musculus
ccgcugaucucccuuggguccuccggaggggacgccgggauccg

SEQ ID NO: 117550 - RNA, 61 nt, Mus musculus
caggcaaacacccauacauacaaaauaaguaaaaaagaaaaagaaaggaaggaauggagag

SEQ ID NO: 117551 - RNA, 46 nt, Mus musculus
caagaggagaccuauuccuacagcaucccccaacaugugccuagau

SEQ ID NO: 117552 - RNA, 26 nt, Mus musculus
uaaauaaaucuuuguaaaaauuauaa

SEQ ID NO: 117553 - RNA, 45 nt, Mus musculus
acauacacacauacacacacauacacacacacacacacagaaaga

SEQ ID NO: 117554 - RNA, 46 nt, Mus musculus
uacgcugagagacaugaaaggucaucagcaauauaggccaggcuau

SEQ ID NO: 117555 - RNA, 45 nt, Mus musculus
uucagggcaaacugcccugaggguggaaucucccugaacucugaa

SEQ ID NO: 117556 - RNA, 42 nt, Mus musculus
ccaaggcaguuccacguggaagagguuuuauuggggaaagag

SEQ ID NO: 117557 - RNA, 41 nt, Mus musculus
cacacugugaucacagcacccuggagguaaaaggcgggagg

SEQ ID NO: 117558 - RNA, 46 nt, Mus musculus
gcucgaaaacaaaaaguuuagcagaaaugaauaaggacacggaguc

SEQ ID NO: 117559 - RNA, 42 nt, Mus musculus
cacauggguagauggccggauggugagaugaauaagauggau

SEQ ID NO: 117560 - RNA, 45 nt, Mus musculus
ucguggugugugugugugugugugugugugugugugugugagaau

SEQ ID NO: 117561 - RNA, 45 nt, Mus musculus
ugguacagaucuguaauaccuccacugagaaggcugaggcaggag

SEQ ID NO: 117562 - RNA, 47 nt, Mus musculus
ggaaagaccuuggauuuucauguuuggauaccuuuguuguuggagag

SEQ ID NO: 117563 - RNA, 62 nt, Mus musculus
gagagauguugucuuuagucauguaaccauguagcacugcuaagaugcccgcacaccuggca

SEQ ID NO: 117564 - RNA, 89 nt, Mus musculus
aaacucaccagaucuuaaccucccccaaacccauggaaacagagggaaggccaauuaggaagugggggaauccuaggagcaggaaaaga

SEQ ID NO: 117565 - RNA, 46 nt, Mus musculus
gcgcuguucacacugcucccagauccccuucacccaauuaccucag

SEQ ID NO: 117566 - RNA, 45 nt, Mus musculus
uucuucucucugucucucugucucugucucucucugucucugucu

SEQ ID NO: 117567 - RNA, 46 nt, Mus musculus
gaggauugcugauuuauggcucccucucaagcucacgcuuggcuag

SEQ ID NO: 117568 - RNA, 46 nt, Mus musculus
gcuggucaggcaagugucucagaguccguuauuuuugaggcagaga

SEQ ID NO: 117569 - RNA, 46 nt, Mus musculus
ccuggagaaaacucacaccccuuuagagaaggagaaaugcgcagau

SEQ ID NO: 117570 - RNA, 41 nt, Mus musculus
ccagucccaguucuugaagucuuccauggaagguauuggga

SEQ ID NO: 117571 - RNA, 25 nt, Mus musculus
aguugggugagugucucuagaguag

SEQ ID NO: 117572 - RNA, 42 nt, Mus musculus
ucagaauucgucuugacuuugauuugauggaaaugcccgcag

SEQ ID NO: 117573 - RNA, 30 nt, Mus musculus
gcucaaggcuacccuuggucacacagagag

SEQ ID NO: 117574 - RNA, 42 nt, Mus musculus
aagagggcaucagaucucauuauggugguugugagccaccau

SEQ ID NO: 117575 - RNA, 45 nt, Mus musculus
agaacaugggagacuccguggagcaguuccuggaggaggcugaag

SEQ ID NO: 117576 - RNA, 45 nt, Mus musculus
uucagaguuuuuuggcccaugaguccaggcuggcucugggccugc

SEQ ID NO: 117577 - RNA, 46 nt, Mus musculus
gaggauauuuuaccugacgguggauuauugacaugcacgccccgaa

SEQ ID NO: 117578 - RNA, 45 nt, Mus musculus
ugugugugaauguaugaguaugugcaugcauguguaugucugugu

SEQ ID NO: 117579 - RNA, 41 nt, Mus musculus
cagccucggcucccuuucucucucucuccuuuccccacccc

SEQ ID NO: 117580 - RNA, 46 nt, Mus musculus
gagaaagagaggaggcauuuauucccaccaucaacauguuugccag

SEQ ID NO: 117581 - RNA, 46 nt, Mus musculus
aaaguaaccagcacagaugguuacuggucuaaaagaaccuagacag

SEQ ID NO: 117582 - RNA, 32 nt, Mus musculus
uaggagauaucugugcgcgucugugagggauu

SEQ ID NO: 117583 - RNA, 46 nt, Mus musculus
guguguguguguguguguguguguguguguguguguggcgguggug

SEQ ID NO: 117584 - RNA, 45 nt, Mus musculus
ucagcuggcucacaugugacaccuggagccuuacaaucauuggcu

SEQ ID NO: 117585 - RNA, 46 nt, Mus musculus
ggauggauggauggguggauggauggauggauggauggaugggugg

SEQ ID NO: 117586 - RNA, 46 nt, Mus musculus
ggauggauggauggauggguggauggauggauggauggguggaugg

SEQ ID NO: 117587 - RNA, 42 nt, Mus musculus
acagagauagagacaaagagaggcaaaggcagaaagagccag

SEQ ID NO: 117588 - RNA, 25 nt, Mus musculus
cagagacagagggaugagggagaga

SEQ ID NO: 117589 - RNA, 23 nt, Mus musculus
ggcuagguugaggaagaccgacu

SEQ ID NO: 117590 - RNA, 46 nt, Mus musculus
uuccaugaucuaaaacuuccuuuuuggggguggagagguggcucag

SEQ ID NO: 117591 - RNA, 45 nt, Mus musculus
auagauagauagauagacagacagauagagagagauagggaggag

SEQ ID NO: 117592 - RNA, 56 nt, Mus musculus
guguguguguauguguguguaugaguguguguguguauguguguguaugagugugu

SEQ ID NO: 117593 - RNA, 66 nt, Mus musculus
gugugugucugaguguguguguuauguguguguguguguaugaguguguguguguguguguguauu

SEQ ID NO: 117594 - RNA, 46 nt, Mus musculus
gccaccagaguuuuucuuacugacccaggaguaaaacagaaaccag

SEQ ID NO: 117595 - RNA, 44 nt, Mus musculus
uuaugaguauggcccaacacaauggugugugugugugugugaga

SEQ ID NO: 117596 - RNA, 24 nt, Mus musculus
guccgaggccgcagcagcgccgcc

SEQ ID NO: 117597 - RNA, 45 nt, Mus musculus
gaccagcuuuccagcauggggcccgaaggaaauguaggccacccg

SEQ ID NO: 117598 - RNA, 45 nt, Mus musculus
gaugaagucagugagcugcaugcauuugaagggcauggccugccu

SEQ ID NO: 117599 - RNA, 48 nt, Mus musculus
auuuucuuggcccaucuuguggcugcccauuucguauugauauccgcc

SEQ ID NO: 117600 - RNA, 41 nt, Mus musculus
uggggcccaaugcgucccugggcacggaggggggggcaaca

SEQ ID NO: 117601 - RNA, 47 nt, Mus musculus
uaaugucugacguuuugaguaucuauuuauuaaguccccaaugugaa

SEQ ID NO: 117602 - RNA, 65 nt, Mus musculus
cgcauguccguucuuaagaaccugcagagccuggaccccagccauagaauaagugaccgggacua

SEQ ID NO: 117603 - RNA, 44 nt, Mus musculus
cauccagcccauguagucccggucacuuauucuauggcuggggu

SEQ ID NO: 117604 - RNA, 45 nt, Mus musculus
ugaagcgacuugaugugccagggugugugugugugugugugugug

SEQ ID NO: 117605 - RNA, 45 nt, Mus musculus
cuucagagggaggagucuugucaccacaccccuccuugcccagau

SEQ ID NO: 117606 - RNA, 42 nt, Mus musculus
agcgcgccugggcgcacugcuagcgcgauacauccagcaggu

SEQ ID NO: 117607 - RNA, 42 nt, Mus musculus
accgcucgaggugagacucgcacgugggccuggggaccugcg

SEQ ID NO: 117608 - RNA, 46 nt, Mus musculus
auccagcugcuagguuggcacccacuguaggcuucuccgcagagau

SEQ ID NO: 117609 - RNA, 37 nt, Mus musculus
aguuucuacuucauauuuaauucacgagcaguuaaag

SEQ ID NO: 117610 - RNA, 44 nt, Mus musculus
gacuauguuauaacaagucugccuaauugugcuguuauuaauac

SEQ ID NO: 117611 - RNA, 46 nt, Mus musculus
aacuccauuuccuccuucagucuacaaaacccuuucccuuuuagac

SEQ ID NO: 117612 - RNA, 46 nt, Mus musculus
guauuuccuguguuaagcaugagggacccuaguuugauagccagca

SEQ ID NO: 117613 - RNA, 42 nt, Mus musculus
cucagacauuaauuuuucucccacagucuuucccacccccau

SEQ ID NO: 117614 - RNA, 42 nt, Mus musculus
gucuaucuggcugcagcaacacauacucagaucaccagagga

SEQ ID NO: 117615 - RNA, 45 nt, Mus musculus
cagcuguuuacugucugcguguguucuuccuuucuccggccuugu

SEQ ID NO: 117616 - RNA, 41 nt, Mus musculus
gcaugagaggucuuaucagcugacagcuggguaguagcagg

SEQ ID NO: 117617 - RNA, 33 nt, Mus musculus
ggacucugaagaggaagaggaacgggaagaaga

SEQ ID NO: 117618 - RNA, 46 nt, Mus musculus
aggagggguuucacugcugucaucaucuuuggacucagagugggau

SEQ ID NO: 117619 - RNA, 47 nt, Mus musculus
cacuguacuuauuuggugagugagaccuagaugauggagaccuagag

SEQ ID NO: 117620 - RNA, 46 nt, Mus musculus
ucugcuauaccagucccugcuccggcuucuagaguagcuucuugau

SEQ ID NO: 117621 - RNA, 45 nt, Mus musculus
ggcuggcauucccugugaagugugggugcucacagcugggacaca

SEQ ID NO: 117622 - RNA, 45 nt, Mus musculus
gagucccgcagagagagaaaacauguagacgcugugcugggaggu

SEQ ID NO: 117623 - RNA, 45 nt, Mus musculus
cgcgugggaggccggagcagcuacagaccccagacucacccccaa

SEQ ID NO: 117624 - RNA, 46 nt, Mus musculus
cgcagcaagaccucggccuuucgcguuugcaccccccaccccagga

SEQ ID NO: 117625 - RNA, 46 nt, Mus musculus
ucgcaccuccuggagagcccccuagggaccuuagugacugacagau

SEQ ID NO: 117626 - RNA, 42 nt, Mus musculus
auugggugaagaccugaaaauaauccuugagcagagggggag

SEQ ID NO: 117627 - RNA, 84 nt, Mus musculus
caaaagguggggcuccucagaagaaaggccaugcucaggaugaaggucugugggugaagggcuaugggaagguccugggauggg

SEQ ID NO: 117628 - RNA, 41 nt, Mus musculus
gugggaccuaguugugggucauuuguugagcuuaguugugg

SEQ ID NO: 117629 - RNA, 42 nt, Mus musculus
cagccugagccaggguccagcaauaccaggucacagguguag

SEQ ID NO: 117630 - RNA, 44 nt, Mus musculus
cuuaggcccagagucuguucuccccauuuucugaggugcuuugu

SEQ ID NO: 117631 - RNA, 44 nt, Mus musculus
ccacaguccguugcgcugcugacuuggugcagggcugggucaga

SEQ ID NO: 117632 - RNA, 47 nt, Mus musculus
uugucuagcauauuugaagccuuggguucgauguccagcaccagaaa

SEQ ID NO: 117633 - RNA, 46 nt, Mus musculus
uugaaauccauguccaacccaaacuaauauuccauagagacaaggu

SEQ ID NO: 117634 - RNA, 46 nt, Mus musculus
aacaucuuaaacuauagguuuuuguuucuuuuuugugguacuaggc

SEQ ID NO: 117635 - RNA, 46 nt, Mus musculus
aauauaacuagcuuauaaauccccuauaacuaaguaggagggagag

SEQ ID NO: 117636 - RNA, 42 nt, Mus musculus
acacccuugugaugaaagucauuguaagaagggcagcugaca

SEQ ID NO: 117637 - RNA, 45 nt, Mus musculus
caggaauggcgggcuuugcagcgauuguugccuauggguuguaca

SEQ ID NO: 117638 - RNA, 41 nt, Mus musculus
augaaggucaggggucuaaguuuauucggaaagcuaaggag

SEQ ID NO: 117639 - RNA, 41 nt, Mus musculus
agcgaagaucaaacuuguccccaaggaacuugacaccccua

SEQ ID NO: 117640 - RNA, 46 nt, Mus musculus
aguguguuaaaagaaaaauuguuacaugagagaaaaggcaaaguga

SEQ ID NO: 117641 - RNA, 26 nt, Mus musculus
gacgcugaucccugaaccuggacaag

SEQ ID NO: 117642 - RNA, 46 nt, Mus musculus
uuguuuuucguuguuuguacugauguuaacacugauaaccucagau

SEQ ID NO: 117643 - RNA, 46 nt, Mus musculus
uaauuucuuacacuuaaguuaugauuugagcuuauugaccgugagu

SEQ ID NO: 117644 - RNA, 41 nt, Mus musculus
guucuacuuucugacagauauaggucagucauugggugagu

SEQ ID NO: 117645 - RNA, 46 nt, Mus musculus
uggcggccagaaaccggcaggacuggaagggaccccgcgucucggu

SEQ ID NO: 117646 - RNA, 91 nt, Mus musculus
ugccgguuucuggccgccacccgagugcgagaacaccggcuucgccugcugcggccacugcucgccccagccaaucagaagccagcagccg

SEQ ID NO: 117647 - RNA, 42 nt, Mus musculus
ggucacuuguagcgcggcgcccauuggcuggggggccggccc

SEQ ID NO: 117648 - RNA, 46 nt, Mus musculus
auguucuuaaacaguggggucagcuacaaccuaggagcuucgcugu

SEQ ID NO: 117649 - RNA, 94 nt, Mus musculus
uggguuucguagcaagugcaaacauaguaagaccuuuccucaaaauacaacaaaguccugcuguucaggaugcagguacuccccauuaugugca

SEQ ID NO: 117650 - RNA, 88 nt, Mus musculus
augaauuccuagaguuuuuaucuguuuggaagguuccaggguagaaggguagcaguaggagaaagcagaaaccaguuucugcccuuag

SEQ ID NO: 117651 - RNA, 100 nt, Mus musculus
guucuuggaagcaagcuauuguggaacacuaagguaaacuagcagaaggauugcuuuugacaggaauagagcaggaggcagugaacgaacaguagggggu

SEQ ID NO: 117652 - RNA, 63 nt, Mus musculus
gcuacucacugaaggccagucucaaaggcuagcauuccaggcagggaguugagggagcaggag

SEQ ID NO: 117653 - RNA, 46 nt, Mus musculus
auguguguauguaucaggaacagagaaagagagcuauuaauuugag

SEQ ID NO: 117654 - RNA, 35 nt, Mus musculus
ucuuggacacugcagaaaagcucagaaugaagugg

SEQ ID NO: 117655 - RNA, 46 nt, Mus musculus
gugaacagagaugguccaugguuuuacuguguuuauuguagaaagg

SEQ ID NO: 117656 - RNA, 43 nt, Mus musculus
gaggggagaggagaggaggagaaggaggcuaaaggugacagug

SEQ ID NO: 117657 - RNA, 46 nt, Mus musculus
uaccucuuaauuuuaaugccacagugagucuguccagugagugcag

SEQ ID NO: 117658 - RNA, 46 nt, Mus musculus
aucaaguaguucuccuauuugugugugugugugucugcgugugcgu

SEQ ID NO: 117659 - RNA, 44 nt, Mus musculus
cacugagggucguccuguaaaucugagugugugagacugggaga

SEQ ID NO: 117660 - RNA, 45 nt, Mus musculus
uugcugaaaauaaaggagggcuaguggagagguugaauaaagaga

SEQ ID NO: 117661 - RNA, 46 nt, Mus musculus
cgggugucuuugcacaggucgaguguugguugcuaguaagugccau

SEQ ID NO: 117662 - RNA, 24 nt, Mus musculus
auacagaagaaagagaaggugagu

SEQ ID NO: 117663 - RNA, 46 nt, Mus musculus
acagaagaggcucuguguguggugcucgugcugguggcaauuuggg

SEQ ID NO: 117664 - RNA, 45 nt, Mus musculus
ucuccaugcacacugcugcuucuccacaguggucuccugcccaua

SEQ ID NO: 117665 - RNA, 45 nt, Mus musculus; identical to SEQ ID NO: 117664

SEQ ID NO: 117666 - RNA, 45 nt, Mus musculus; identical to SEQ ID NO: 117664

SEQ ID NO: 117667 - RNA, 45 nt, Mus musculus; identical to SEQ ID NO: 117664

SEQ ID NO: 117668 - RNA, 45 nt, Mus musculus; identical to SEQ ID NO: 117664

SEQ ID NO: 117669 - RNA, 45 nt, Mus musculus
ugaagaaaguguguguguguguguguguguguguguaugugugug

SEQ ID NO: 117670 - RNA, 46 nt, Mus musculus
cauguauguaagguaugcauguguguauguauucagguauguauau

SEQ ID NO: 117671 - RNA, 45 nt, Mus musculus
cuggcaaugcacuaaauaaagauagaauauuaaaagcaguaagga

SEQ ID NO: 117672 - RNA, 46 nt, Mus musculus
cucgagccaaaauuuuucacaggcuuauauaggaaaaacucaaggg

SEQ ID NO: 117673 - RNA, 41 nt, Mus musculus
gaucccaaaagagaagcugguuccagcuacagcaggcacac

SEQ ID NO: 117674 - RNA, 41 nt, Mus musculus
guaaaauacucaaacuuuagcaggauuuaacugccagcaga

SEQ ID NO: 117675 - RNA, 45 nt, Mus musculus
cauccccuagagucacuuucuuucaucagcccaacuugcacugaa

SEQ ID NO: 117676 - RNA, 45 nt, Mus musculus
guacaugcaugcacagcuagaggcuagacaaaagggucgcuaagg

SEQ ID NO: 117677 - RNA, 42 nt, Mus musculus
gagaggggggcuugacccacugaguucaccuuucacccccag

SEQ ID NO: 117678 - RNA, 46 nt, Mus musculus
ucgcuugacacauccucagagggacucuuuggaguggcacuggugg

SEQ ID NO: 117679 - RNA, 62 nt, Mus musculus
ucagaugaagaaggcagcggacuagaaagugauuucuuggagaaggaagauaaaaauucuac

SEQ ID NO: 117680 - RNA, 45 nt, Mus musculus
ucucucuccaacguggauucucugauguccaaggaagcgagagcu

SEQ ID NO: 117681 - RNA, 45 nt, Mus musculus
ggauuuugaaccuagaaucaaguguuuacugaaagguuuuauuaa

SEQ ID NO: 117682 - RNA, 26 nt, Mus musculus
agaaucuaagaaaagcagguugagga

SEQ ID NO: 117683 - RNA, 46 nt, Mus musculus
acuagaaauugguaagagauacugauauauuuacaguuuggccaag

SEQ ID NO: 117684 - RNA, 45 nt, Mus musculus
cacuaucuucagaaacaccagaagagggcaucagaucccauuaca

SEQ ID NO: 117685 - RNA, 46 nt, Mus musculus
ucuaucuauaguauaucuauaucuauagauagauagauacccccaa

SEQ ID NO: 117686 - RNA, 46 nt, Mus musculus
ucaccccuuccccacagagcccccccuuucccauuuuccuggucag

SEQ ID NO: 117687 - RNA, 42 nt, Mus musculus
aaauaacacaaaauuuucuuuuuacagugggcagacuggcuc

SEQ ID NO: 117688 - RNA, 24 nt, Mus musculus
agggagauugagaaccauuguuau

SEQ ID NO: 117689 - RNA, 42 nt, Mus musculus
uuuguugggguguagcuuguuuugggaaugaauguaaagcag

SEQ ID NO: 117690 - RNA, 46 nt, Mus musculus
ccuaucauucaaacaugcgagcccagucucauucaaaccaucacag

SEQ ID NO: 117691 - RNA, 45 nt, Mus musculus
caauccacuugcaaacacuucacuuccuggacaucagcaggccag

SEQ ID NO: 117692 - RNA, 46 nt, Mus musculus
cuugcaaacuuuauauacaccaguacaggggaacgccagggccaag

SEQ ID NO: 117693 - RNA, 44 nt, Mus musculus
guauguaagaagaucauauguacauaugcacauuguagaugcca

SEQ ID NO: 117694 - RNA, 45 nt, Mus musculus
augguguuguuagcuccuaugugggggcugaaaaccaaggccaag

SEQ ID NO: 117695 - RNA, 47 nt, Mus musculus
aacaguaaauaaauguuaaaagucaaagcuuuaugaggcaguacaau

SEQ ID NO: 117696 - RNA, 42 nt, Mus musculus
uguuagccaccaugugguugcugggaauugaacucgggccuu

SEQ ID NO: 117697 - RNA, 46 nt, Mus musculus
uuguucucagcuuucuauucccuggaaaacauuuaaaaguuuggag

SEQ ID NO: 117698 - RNA, 46 nt, Mus musculus
agaaaggagagcuaucauguauagugggaaggcacauagccugagc

SEQ ID NO: 117699 - RNA, 33 nt, Mus musculus
gaaggcucauggcucugucaagagagaaacgug

SEQ ID NO: 117700 - RNA, 34 nt, Mus musculus
cuuguuuuuaaggcaauuuuccuuuuguuguugg

SEQ ID NO: 117701 - RNA, 45 nt, Mus musculus
ggcauucuucccuguaaaagguauuucaucccugguucacccuga

SEQ ID NO: 117702 - RNA, 69 nt, Mus musculus
ccaggagucagccauccccuuccugccuaacguguaggcgaagcacagaccccugcccccuuucucaac

SEQ ID NO: 117703 - RNA, 67 nt, Mus musculus
ucccugaggucccuaguggugucuggguacacaggagauuguaaaccauggcauuugucccagauug

SEQ ID NO: 117704 - RNA, 70 nt, Mus musculus
uuuaagccagaguuuuucaccaaaggcugauggacagaggggaaauagccuuguugagguguuuguuuga

SEQ ID NO: 117705 - RNA, 83 nt, Mus musculus
aagaggauacaugguucuuaaaucaggaugauacacucagaucugaaggugaccuggccuaagauaggacugauugaguggag

SEQ ID NO: 117706 - RNA, 46 nt, Mus musculus
cauucccucagggaagagaauagaagacugaaguuacuagcacccg

SEQ ID NO: 117707 - RNA, 46 nt, Mus musculus
accuaugcacaaaggacaaaaauaaaucuaaagaauuaaucuguag

SEQ ID NO: 117708 - RNA, 46 nt, Mus musculus
gcuccaacacuacugaucuuuuggggcaccugcacucacaugcaua

SEQ ID NO: 117709 - RNA, 45 nt, Mus musculus
ccauuucuuucuuauccucgugucucagauuguaccuggaggaga

SEQ ID NO: 117710 - RNA, 45 nt, Mus musculus
gauaacuuggcauguuacuuuaaauaugaaccuuucuagcaacua

SEQ ID NO: 117711 - RNA, 45 nt, Mus musculus
gauaggucuuaagccaaggauaguggugcaguccuuuagagucag

SEQ ID NO: 117712 - RNA, 45 nt, Mus musculus
uucagcugccuuucuaggggaccuagguucaauucccagcaccca

SEQ ID NO: 117713 - RNA, 42 nt, Mus musculus
gugagugagugagugagugagugagugagugagugagugcau

SEQ ID NO: 117714 - RNA, 46 nt, Mus musculus
uuuuguuuagagacagugucuuacuaugugauccuggaugaccuag

SEQ ID NO: 117715 - RNA, 41 nt, Mus musculus
ccucaaacucagaauaccugucuuugccccccuagcacuga

SEQ ID NO: 117716 - RNA, 46 nt, Mus musculus
ugcucugacggggcuugcuucaauccauauuuaucuucacaggcag

SEQ ID NO: 117717 - RNA, 39 nt, Mus musculus
guuuguuuguuuguuuauguggauuuuguuuugcuguuu

SEQ ID NO: 117718 - RNA, 41 nt, Mus musculus
cacacacacacacacacacacacacacaaagagagaggcau

SEQ ID NO: 117719 - RNA, 45 nt, Mus musculus
ugagccaccaugugguugcugggaauugaacucaggaugucuaga

SEQ ID NO: 117720 - RNA, 45 nt, Mus musculus
cucauuuggcaaaacucuuggaaacacaagaacaagagauagaag

SEQ ID NO: 117721 - RNA, 46 nt, Mus musculus
gaaaggccuccaccuggacuggucugccugcauggccuucauugag

SEQ ID NO: 117722 - RNA, 46 nt, Mus musculus
augguuguaauguuauauggcuaccaagcucuaaaauaaugucuag

SEQ ID NO: 117723 - RNA, 47 nt, Mus musculus
cuuuggagucuagagcauuucaggaaaaggagcaacugcggucaaag

SEQ ID NO: 117724 - RNA, 41 nt, Mus musculus
gugguuuuguggaugaaauaaaaggauggauuacugggguu

SEQ ID NO: 117725 - RNA, 45 nt, Mus musculus
uagaauuacugaguuugaggccagccugaccaacagagagguacu

SEQ ID NO: 117726 - RNA, 45 nt, Mus musculus
cggcugcacuggugcugugcgccuggcuagagagaaguggaguag

SEQ ID NO: 117727 - RNA, 42 nt, Mus musculus
aaucuuuuccaagucgaucuauucagugacauggccuggugg

SEQ ID NO: 117728 - RNA, 44 nt, Mus musculus
uaguuguauuugaagcuucuuguuuguuuuuuuaaaggggggga

SEQ ID NO: 117729 - RNA, 45 nt, Mus musculus
auguguagauagguagagauccacgucucgucgucaggacuuaga

SEQ ID NO: 117730 - RNA, 48 nt, Mus musculus
aaagauggcccuggcggcaaagaagcuaccugggugguggaugugaag

SEQ ID NO: 117731 - RNA, 51 nt, Mus musculus
aaaccucgucuuuaaggagauugagaagaagcuugaagaggaaggggaaca

SEQ ID NO: 117732 - RNA, 23 nt, Mus musculus
cuaguuucaauuauugaugcuug

SEQ ID NO: 117733 - RNA, 44 nt, Mus musculus
uguaagccaccauguggguacaggaaauugaaccuagguccuuu

SEQ ID NO: 117734 - RNA, 92 nt, Mus musculus
uccgugguuuagcaaaguacuggccuccaccaccauaagggccagagcuccugccuccaaaguuuccucccuucaucggcccaaaauuggaa

SEQ ID NO: 117735 - RNA, 46 nt, Mus musculus
uuaauaccaccaacaaagaucuuuuucacaguuaagugggcaccug

SEQ ID NO: 117736 - RNA, 46 nt, Mus musculus; identical to SEQ ID NO: 48788

SEQ ID NO: 117737 - RNA, 46 nt, Mus musculus
auggcuccucagacucucgucgguuguuucgaagcucagcccuccg

SEQ ID NO: 117738 - RNA, 45 nt, Mus musculus
augacgguagaguuacgagagccuucagcgaugcuuccucggcag

SEQ ID NO: 117739 - RNA, 45 nt, Mus musculus
cgcuggagucagacucggaacuggagucgccaccgacguccggau

SEQ ID NO: 117740 - RNA, 42 nt, Mus musculus
cgucgguggcgacuccaguuccgagucugacuccagcgauga

SEQ ID NO: 117741 - RNA, 42 nt, Mus musculus
gaaagcagaaacaaauacacucagauuguaggggguccagag

SEQ ID NO: 117742 - RNA, 45 nt, Mus musculus
ucugugaaaucugaaaucuccauccuuugcugaggaacuggucag

SEQ ID NO: 117743 - RNA, 45 nt, Mus musculus
ugacaaugagcuguuccuaggacucauggagcaauugaugugugu

SEQ ID NO: 117744 - RNA, 47 nt, Mus musculus
caagaagcaagaggaaaacgagagagaaagagagagagagagagaga

SEQ ID NO: 117745 - RNA, 41 nt, Mus musculus
aaggguggcagaaaaaagaacccaauaaaguagccaaaagu

SEQ ID NO: 117746 - RNA, 54 nt, Mus musculus
auugcugauugccagucggcgaaauccuggcgaugaagauccaacuugccccaa

SEQ ID NO: 117747 - RNA, 46 nt, Mus musculus
guucgaaaauauuugguacaaauacauggcugauaagaggcuagaa

SEQ ID NO: 117748 - RNA, 42 nt, Mus musculus
ggggaagaaggggaccaaaaggagggggcaggcaagcaggag

SEQ ID NO: 117749 - RNA, 46 nt, Mus musculus
auuuggaagucauuuauuugaaaaagaaggguagcguaucugagau

SEQ ID NO: 117750 - RNA, 45 nt, Mus musculus
aaugagaucaagauuuaaaucuggagaaaaucagaggcugcaggu

SEQ ID NO: 117751 - RNA, 30 nt, Mus musculus
agccaggcuguuggagaaaugauguggaca

SEQ ID NO: 117752 - RNA, 38 nt, Mus musculus
gcauauccauauguauggaaagaaagaugggugcuaug

SEQ ID NO: 117753 - RNA, 103 nt, Mus musculus
uacaggcccaaagaaacuggguaauaaggagguccugagggaggaugugcgagucuuacucagaaggggaaacuaaauagguggauggagagagggaacuggg

SEQ ID NO: 117754 - RNA, 45 nt, Mus musculus
ggaagaaaaaaaaucacuguugcuuagcaacaagaaagccaauca

SEQ ID NO: 117755 - RNA, 45 nt, Mus musculus
uagcagggagaccccugaaaccccuaaauggggaaggccccagaa

SEQ ID NO: 117756 - RNA, 46 nt, Mus musculus
gggagaguggucaugagcuggucuuggggcacaauuacccagagau

SEQ ID NO: 117757 - RNA, 48 nt, Mus musculus
cucuccagccagaagcaggcuuccugcaguaguauuuguggaguggaa

SEQ ID NO: 117758 - RNA, 44 nt, Mus musculus
guggagugagggacuuugauuuugagagugcuugacuggagaga

SEQ ID NO: 117759 - RNA, 49 nt, Mus musculus
gaguccccaaagaggucucccaugccagcggccccugcagaaugugcgu

SEQ ID NO: 117760 - RNA, 41 nt, Mus musculus
gagcugaagaugaaugcuuaggcaaaauggagggagggaga

SEQ ID NO: 117761 - RNA, 46 nt, Mus musculus
ugauauuugguuuguaacuauaaaggaaagaagcuagcuacucagu

SEQ ID NO: 117762 - RNA, 45 nt, Mus musculus
cggguugagucagauuacgggcaagcuugcauaggcugucucugg

SEQ ID NO: 117763 - RNA, 46 nt, Mus musculus
auagaaaccauaagaauggaaugccugcuccuuagagcccccacgu

SEQ ID NO: 117764 - RNA, 45 nt, Mus musculus
gagccuucccccaaguuaaggaccaucuuccauccugccccauug

SEQ ID NO: 117765 - RNA, 45 nt, Mus musculus
augacgugcgaagguguggacuaagggucucccggcguggggagu

SEQ ID NO: 117766 - RNA, 48 nt, Mus musculus
auuuaaacuugaguccagagugguacggagcagugaugcacauacagg

SEQ ID NO: 117767 - RNA, 41 nt, Mus musculus
acaagcagauaagauaaauagggcuaagguuagugcugaga

SEQ ID NO: 117768 - RNA, 99 nt, Mus musculus
gugccaucucagagggagaauggaaagaauucacuagaugaaagaaacagaugggacagcacucuaagcagaggagauugggaaaguggggggggggga

SEQ ID NO: 117769 - RNA, 47 nt, Mus musculus
aagagcaggcauagaugaagaagagagugauggggagaucugcagau

SEQ ID NO: 117770 - RNA, 42 nt, Mus musculus
agaaucaagaguuuaagguugcuuggggcuauauagccagau

SEQ ID NO: 117771 - RNA, 42 nt, Mus musculus
agaagcagggggagacaggagaagaaauggaagacagcagga

SEQ ID NO: 117772 - RNA, 45 nt, Mus musculus
gacagagaaagaaugaacaagacagagacauauacagacagacag

SEQ ID NO: 117773 - RNA, 45 nt, Mus musculus
auauagagagaaacaugagauggaauaggaaucaagcucauagag

SEQ ID NO: 117774 - RNA, 46 nt, Mus musculus
acaacuuuccccaaauuauaacauucuuccagauacagggacaaga

SEQ ID NO: 117775 - RNA, 27 nt, Mus musculus
agcagcuacaacaggagcauuacugga

SEQ ID NO: 117776 - RNA, 46 nt, Mus musculus
acaugcgagguaaacugggccuagagacccauaacuugcccaagau

SEQ ID NO: 117777 - RNA, 43 nt, Mus musculus
gcugccuguguucauauucaagauucaucacuuagguccugug

SEQ ID NO: 117778 - RNA, 45 nt, Mus musculus
acuagcaagauacagaaggggagggacagcagauagagagcagag

SEQ ID NO: 117779 - RNA, 46 nt, Mus musculus
gacuggaaaguucaucuuggggcuagguuggaacuaggggcuaggc

SEQ ID NO: 117780 - RNA, 46 nt, Mus musculus
gauugagacagagaugggcaagaagacuuugagcaaccuggagaag

SEQ ID NO: 117781 - RNA, 47 nt, Mus musculus
ccagaccauugaggacacaggcacuaucaugagggaaguucgagauc

SEQ ID NO: 117782 - RNA, 45 nt, Mus musculus
guugcuuggggccuagcuuugcucuguggaggaugaaggcaaagu

SEQ ID NO: 117783 - RNA, 32 nt, Mus musculus
cucucugggaagcucgaccggacauuugcagu

SEQ ID NO: 117784 - RNA, 44 nt, Mus musculus
agggcuugggcucacgccugccauguucccaccuaggugucaga

SEQ ID NO: 117785 - RNA, 42 nt, Mus musculus
ggguccagauggucaggugguuauagugucaugguaguugua

SEQ ID NO: 117786 - RNA, 42 nt, Mus musculus
acugugccacuuggaccauuuucacuuuugcagaucccagag

SEQ ID NO: 117787 - RNA, 42 nt, Mus musculus
ggaggaggcugaccgaauccucauccauuccuugcgccaggc

SEQ ID NO: 117788 - RNA, 41 nt, Mus musculus
agagcgcacuccuuuucuccaccucccccuuuccccuugcc

SEQ ID NO: 117789 - RNA, 45 nt, Mus musculus
ggugagucagauuggagaaaagguugaguggaagaagaugggguu

SEQ ID NO: 117790 - RNA, 44 nt, Mus musculus
agaggagagagagagagagaggagagaggagagagagagagaga

SEQ ID NO: 117791 - RNA, 45 nt, Mus musculus
gcauaaaaacacacagauacugagagacagagauauagugaucau

SEQ ID NO: 117792 - RNA, 42 nt, Mus musculus
accaaggauuaaacggaggcccagaaugucgcacacuaggga

SEQ ID NO: 117793 - RNA, 42 nt, Mus musculus
uaugucccccaugauucuaugaugcccaguguggauggaguc

SEQ ID NO: 117794 - RNA, 46 nt, Mus musculus
guccgaugugaagauggccacugacccagagaacauuaucaaggag

SEQ ID NO: 117795 - RNA, 42 nt, Mus musculus
cgggcuggaagagaaaagcugggagacacagucuggcauggg

SEQ ID NO: 117796 - RNA, 49 nt, Mus musculus
accaaaaaaaaaaaaaggugaacuugguaaaacuagccaaugagaggaa

SEQ ID NO: 117797 - RNA, 44 nt, Mus musculus
agcuucuuaaguucaggcgaugcuggaggaaccaaggcuagagu

SEQ ID NO: 117798 - RNA, 46 nt, Mus musculus
ucugccccauuacagaaugggcuuccucuucugagagcaccacaca

SEQ ID NO: 117799 - RNA, 47 nt, Mus musculus
uggaguuugagcaguggguguaggaggccaugguugggagcugugag

SEQ ID NO: 117800 - RNA, 47 nt, Mus musculus
ggcuccagagccagccucccagugcuccgggacagacgggagugugg

SEQ ID NO: 117801 - RNA, 50 nt, Mus musculus
cagacccccuacuuuccugugcccuucgguauuguuugaagaccccccuc

SEQ ID NO: 117802 - RNA, 23 nt, Mus musculus
ccccacuuucacucuacaguccu

SEQ ID NO: 117803 - RNA, 25 nt, Mus musculus
acuccucugaggcacagccugaguc

SEQ ID NO: 117804 - RNA, 45 nt, Mus musculus
cucacaaccauccuuaaugacaucugacucccucuccuggcgugu

SEQ ID NO: 117805 - RNA, 41 nt, Mus musculus
gggaggacgugaaagggugagagaaaacaauuacaguuagg

SEQ ID NO: 117806 - RNA, 28 nt, Mus musculus
cuugcuccagcucacccuccagccccag

SEQ ID NO: 117807 - RNA, 54 nt, Mus musculus
uaagcuacaaaaugagugacccacuacaaauaaccuuuuucucuguguggggug

SEQ ID NO: 117808 - RNA, 49 nt, Mus musculus
ccuuuaugggugugccuagauuccccuuugcucugcaguaccagcagcc

SEQ ID NO: 117809 - RNA, 44 nt, Mus musculus; identical to SEQ ID NO: 45323

SEQ ID NO: 117810 - RNA, 46 nt, Mus musculus; identical to SEQ ID NO: 45324

SEQ ID NO: 117811 - RNA, 42 nt, Mus musculus
ggacuucuucagaucccucauagcaaccauccuguaccugau

SEQ ID NO: 117812 - RNA, 56 nt, Mus musculus
auaacauaugcaaggcccuagguugcacccacgcuccagagacgguaggggaggau

SEQ ID NO: 117813 - RNA, 41 nt, Mus musculus
uggcagggcguggccggccugggcacuagcuggcgggcugg

SEQ ID NO: 117814 - RNA, 23 nt, Mus musculus
uggggaugugugggugcgugugu

SEQ ID NO: 117815 - RNA, 30 nt, Mus musculus
cgucccagggacuccaguacaccaccaugg

SEQ ID NO: 117816 - RNA, 25 nt, Mus musculus
gcggcggacucucacggcccgccau

SEQ ID NO: 117817 - RNA, 42 nt, Mus musculus
gugacgcaugacuuuaauuccagcagcacucaggaggcagaa

SEQ ID NO: 117818 - RNA, 24 nt, Mus musculus
gaagcacagcucauuccaggacaa

SEQ ID NO: 117819 - RNA, 24 nt, Mus musculus
caaggauuggcuccaaggauuuua

SEQ ID NO: 117820 - RNA, 45 nt, Mus musculus
uuuccaucccaugccccgcaacauggccagcccauaggccuccac

SEQ ID NO: 117821 - RNA, 45 nt, Mus musculus
ucgauccccaucuggucuugguggguggugagagccuacggaggc

SEQ ID NO: 117822 - RNA, 46 nt, Mus musculus
cugcagugguaggauuacaggcauguaccaugacaccuggcagccu

SEQ ID NO: 117823 - RNA, 42 nt, Mus musculus
uuccaugagcuaucucccagccccuuguuuuuuugggcacaa

SEQ ID NO: 117824 - RNA, 45 nt, Mus musculus
aggggcugcuuucucagucuugggcacagguccauccugucugug

SEQ ID NO: 117825 - RNA, 46 nt, Mus musculus
ccggggcccauguacuggcagauggcguuauaguggagcuccacca

SEQ ID NO: 117826 - RNA, 45 nt, Mus musculus
cuaauuuuuauuuauuuuuauuuuaacuuguuuugguagggaggu

SEQ ID NO: 117827 - RNA, 41 nt, Mus musculus
ggcggccaucuugggacguuccacuugcugaagggggcaga

SEQ ID NO: 117828 - RNA, 45 nt, Mus musculus
guggguaaaggguucaaauaccacgucagucuguaaaauuagucg

SEQ ID NO: 117829 - RNA, 46 nt, Mus musculus
aggagccaaauuagaggucagauugcccaaaacacauuggcauguc

SEQ ID NO: 117830 - RNA, 26 nt, Mus musculus
ugcaugugugccuacacacacaugca

SEQ ID NO: 117831 - RNA, 45 nt, Mus musculus
aaucauauaaagggauaacaggggaaacuacaacagaaggauuaa

SEQ ID NO: 117832 - RNA, 41 nt, Mus musculus
ggggugaucaagucggcagaggugacgcgcaucuggagcaa

SEQ ID NO: 117833 - RNA, 81 nt, Mus musculus
gaggucuugacaggugauggauggcuggggauaugggggcuugagucggugcugucuuggaaaggaucauggcuuuuggga

SEQ ID NO: 117834 - RNA, 45 nt, Mus musculus
gucagaguaaugccucgggugugggguaggguguggauuggucuu

SEQ ID NO: 117835 - RNA, 45 nt, Mus musculus
cccuggaggcgaauaagccuccagguaaaguuagaagggcuugag

SEQ ID NO: 117836 - RNA, 64 nt, Mus musculus
gcuacauagggaguaccaggacagccagggauacauagcaagacccuaucucaaaacaaaauag

SEQ ID NO: 117837 - RNA, 45 nt, Mus musculus
uccuucaccugcccauccccacuucauccucaccacuuagggcug

SEQ ID NO: 117838 - RNA, 41 nt, Mus musculus
gucugcaacuuguggugagccagcuagcgggcaagggugga

SEQ ID NO: 117839 - RNA, 46 nt, Mus musculus
aucccucuggccgcgugacaugccuggacuuaccaaacgcugccaa

SEQ ID NO: 117840 - RNA, 42 nt, Mus musculus
gauccacaacgauggugucaccgcgucaucaacaaccuccuc

SEQ ID NO: 117841 - RNA, 42 nt, Mus musculus
cuagcgggacgcagggugggcuugcgggucuuugagaaggag

SEQ ID NO: 117842 - RNA, 45 nt, Mus musculus
gaaggguuaauccagagguggagguguaguaaagucagggcuugg

SEQ ID NO: 117843 - RNA, 41 nt, Mus musculus
ggguggcgccuucaccuuccugcucagcaucacagcgccug

SEQ ID NO: 117844 - RNA, 45 nt, Mus musculus
ugcuucacugcgucugagaaaccuuaaaaacaagauugagaacaa

SEQ ID NO: 117845 - RNA, 51 nt, Mus musculus
cuuggcaucuacacccuggacguagaggacccccaccccauacccaagacc

SEQ ID NO: 117846 - RNA, 47 nt, Mus musculus; identical to SEQ ID NO: 42613

SEQ ID NO: 117847 - RNA, 45 nt, Mus musculus
cagucaccuacuuccagucuugaaacuggacuuuuaagccagagc

SEQ ID NO: 117848 - RNA, 87 nt, Mus musculus
gccaaaucuugagccuaaugaguccacacugagcccuuaaccccagacgacccuagcccucagcagucccaauagccucccuccaac

SEQ ID NO: 117849 - RNA, 42 nt, Mus musculus
cguuuaagugaccugacgcuagagggggagccgucuuccagu

SEQ ID NO: 117850 - RNA, 42 nt, Mus musculus
acccgugccauccguuccaagcccaguggcuuacccccagaa

SEQ ID NO: 117851 - RNA, 45 nt, Mus musculus
gcugcugccugcuccugaggucccaggaccccuuucccgcagaga

SEQ ID NO: 117852 - RNA, 42 nt, Mus musculus
caaccagucccuuccuucucuucccguaccacuggcccccca

SEQ ID NO: 117853 - RNA, 42 nt, Mus musculus
gggcggggacaagccagggcacaauggcgguuagggccagga

SEQ ID NO: 117854 - RNA, 41 nt, Mus musculus
gucguggggcagcaggauggaauuaggaagauagaugcaga

SEQ ID NO: 117855 - RNA, 50 nt, Mus musculus
gguuuucugggucugcucuaccacaucaugacaagcuguggauuucaagg

SEQ ID NO: 117856 - RNA, 45 nt, Mus musculus
gaagcaaagguuccugagucagguauggagguguggggcguugau

SEQ ID NO: 117857 - RNA, 42 nt, Mus musculus
aggacccugagaauauaggguagcgauaggaggggugguguu

SEQ ID NO: 117858 - RNA, 27 nt, Mus musculus
cccuggaagcgggcagguaaggguuaa

SEQ ID NO: 117859 - RNA, 46 nt, Mus musculus
guguguguguguguguguggugcaugugcacagguaccugagagau

SEQ ID NO: 117860 - RNA, 29 nt, Mus musculus
agggaggaagggagagagagagagcggga

SEQ ID NO: 117861 - RNA, 46 nt, Mus musculus
guguauguguauguguguguguguaugugugugugugugcgcgugc

SEQ ID NO: 117862 - RNA, 46 nt, Mus musculus
guuuacucaccaucccaaucuauuugguaguuaaguuaugagagag

SEQ ID NO: 117863 - RNA, 45 nt, Mus musculus
aaaaaccuaaaaaugaagcugaaagcugucccauauagaugcaga

SEQ ID NO: 117864 - RNA, 47 nt, Mus musculus
ugaaguuggauaauguaaaccaacagaaggaaaagaccccaagacaa

SEQ ID NO: 117865 - RNA, 42 nt, Mus musculus
gcgcgcccacuacaucccuuucggccucuacggaccccaccu

SEQ ID NO: 117866 - RNA, 42 nt, Mus musculus
ucgggguuagguuggggggugucgguccguucagggcgggug

SEQ ID NO: 117867 - RNA, 45 nt, Mus musculus
aagccauggagcuagcacugcgugggcgggcggcgucgggaagau

SEQ ID NO: 117868 - RNA, 44 nt, Mus musculus
agugcuagcuccauggcuuaacggaggaggcagcggcaaacagg

SEQ ID NO: 117869 - RNA, 42 nt, Mus musculus
guagaggccagcgcggagggcccucgagccguguuccugcua

SEQ ID NO: 117870 - RNA, 44 nt, Mus musculus
gcagagucauauuugggggggugucuuugcugggucuagcgggg

SEQ ID NO: 117871 - RNA, 45 nt, Mus musculus
cagcaaguugcuucgcucaauuauucacacacacucccggcagau

SEQ ID NO: 117872 - RNA, 46 nt, Mus musculus
cucuucccgacuuccuggguggcuuuagagccccaucugcgcaagg

SEQ ID NO: 117873 - RNA, 42 nt, Mus musculus
gauugcuuauaacagccuugaucaucgcaguaaugggcacag

SEQ ID NO: 117874 - RNA, 41 nt, Mus musculus
aaagugaaccuggaagcccaggucucuuugugaugcauuca

SEQ ID NO: 117875 - RNA, 48 nt, Mus musculus
aguagggggugugggggcugggagaacucugaaugcaaagcagccggg

SEQ ID NO: 117876 - RNA, 46 nt, Mus musculus
uuggggucccggccuuucuauuguuccgacccuucaagggccugug

SEQ ID NO: 117877 - RNA, 33 nt, Mus musculus
gcucaaaagccaaccccuaucccuccgcuccag

SEQ ID NO: 117878 - RNA, 44 nt, Mus musculus
cuacagccucccaauaucacugcaggccacaccgaccaccccag

SEQ ID NO: 117879 - RNA, 45 nt, Mus musculus
agaguguagcugggguggucgguguggccugcagugauauuggga

SEQ ID NO: 117880 - RNA, 45 nt, Mus musculus
gcagggggcucccggaccccugccaugucaucuucuucaucacgg

SEQ ID NO: 117881 - RNA, 45 nt, Mus musculus
gagguaagaggcuguagauaaccucccuuuaugcccuucguccag

SEQ ID NO: 117882 - RNA, 47 nt, Mus musculus
ccgggugcacuuccggaugaauguauugcaccaagacugugucuaag

SEQ ID NO: 117883 - RNA, 29 nt, Mus musculus
cugcagguagaggcaggcaaagcacugac

SEQ ID NO: 117884 - RNA, 46 nt, Mus musculus
auggugcuucucugcuaugccuuucauccuaccauucaggagccag

SEQ ID NO: 117885 - RNA, 44 nt, Mus musculus
ucugccagucccucccaacccaggacugcucucccuaaccacga

SEQ ID NO: 117886 - RNA, 44 nt, Mus musculus
cuauuacaggguuggggccugauugcaacuccucuucccccaga

SEQ ID NO: 117887 - RNA, 49 nt, Mus musculus
aucugggggaagaggaguugcaaucaggccccaacccuguaauaggcaa

SEQ ID NO: 117888 - RNA, 86 nt, Mus musculus
ccugcccccuuuccauucguggggaagaaggcaggagagagcugggaaaucacaguucaucacuugagcaucauagccuuaccccu

SEQ ID NO: 117889 - RNA, 91 nt, Mus musculus
acuuguucuggcaaggaacagaaguaagggugugauccagcccgucccccugggacccaucccuucucuauaggaaaagcucagcgcaggu

SEQ ID NO: 117890 - RNA, 46 nt, Mus musculus
ggccccaguccuaacccugacccuuagcaggacaccgugcaagcau

SEQ ID NO: 117891 - RNA, 46 nt, Mus musculus
accugugaggacucugugcugaccuuauucuuggggaagggaacag

SEQ ID NO: 117892 - RNA, 45 nt, Mus musculus
aacccacccacucagaugcuaagucaacccugaccucugccccau

SEQ ID NO: 117893 - RNA, 42 nt, Mus musculus
ggcgaccuucugucgaagacuggaaaguucuggugcggggaa

SEQ ID NO: 117894 - RNA, 42 nt, Mus musculus
auguccuuuucaagacaaaguuaaugaaugagggcugcagau

SEQ ID NO: 117895 - RNA, 45 nt, Mus musculus
gacaaacacagggaacaaagagagacagagaaacacacagcagug

SEQ ID NO: 117896 - RNA, 42 nt, Mus musculus
guggggaagagacaaaaggaaaguugaagagaagcagcagag

SEQ ID NO: 117897 - RNA, 94 nt, Mus musculus
aaugagggaaaagagaaauaaugauggagagauauggaaggggagaaaagcgcaagaugagagguugaucaggaaagagaaaaggcaagaagag

SEQ ID NO: 117898 - RNA, 46 nt, Mus musculus
agaaggagagagaaggaaauaauggcauuggguaggaagcauauag

SEQ ID NO: 117899 - RNA, 45 nt, Mus musculus
accagaagggauuaauuaaagaagcagugggcucagaucuagagg

SEQ ID NO: 117900 - RNA, 46 nt, Mus musculus
ugcccagcugauagcgcagcuuuuaaagguuucagcaucaccagac

SEQ ID NO: 117901 - RNA, 46 nt, Mus musculus
ucauggacuaggccaucucguuccuuccucucaugaugccccaccu

SEQ ID NO: 117902 - RNA, 46 nt, Mus musculus
cauccuugcccugcaaaggcaacagcagcucaggccacggcaugag

SEQ ID NO: 117903 - RNA, 42 nt, Mus musculus
agcggcaaaaguauucaaaccuccaugcagagaaagggagac

SEQ ID NO: 117904 - RNA, 45 nt, Mus musculus
cuuaguuggagagagacauagacaaacagacacauacauauagaa

SEQ ID NO: 117905 - RNA, 41 nt, Mus musculus
gcaucagucucaggcugauggguuuggggagaaggugacaa

SEQ ID NO: 117906 - RNA, 45 nt, Mus musculus
gugucugaagacagcgacaguguacucacauacauuaaauaaaua

SEQ ID NO: 117907 - RNA, 46 nt, Mus musculus
auccaauaucaaaagugggggaaaacaaucaaauaggggcuggaga

SEQ ID NO: 117908 - RNA, 46 nt, Mus musculus
cucaauuauuuuuuaaaauauacauaguuacuuuuacuuuacauau

SEQ ID NO: 117909 - RNA, 29 nt, Mus musculus
uacugaauagggaguaaaagcauggaggu

SEQ ID NO: 117910 - RNA, 41 nt, Mus musculus
agcaggcaagaagggagaaaggccauguucuguuugggggc

SEQ ID NO: 117911 - RNA, 41 nt, Mus musculus
gcuaugacucccuuagugaggagggaguauuuggguggagg

SEQ ID NO: 117912 - RNA, 46 nt, Mus musculus
ugggagcagcagcaauaacagcagcaguagcagcaggaggaggagg

SEQ ID NO: 117913 - RNA, 45 nt, Mus musculus
ccuggucuucucuaccagcauccugcaagguucagccgccccucu

SEQ ID NO: 117914 - RNA, 57 nt, Mus musculus
gccagucccauauagcacuuuagcgauccugagcccuaauccucacgucuccuaccu

SEQ ID NO: 117915 - RNA, 127 nt, Mus musculus
ucccuagaacuccuguagauuguaguuaauacccuccaggcucuccuugguagugccagucacuccugagauacuuuuuagcaucuuuuacaaccuccuggcucuagagcuacccuugagaugcucc

SEQ ID NO: 117916 - RNA, 46 nt, Mus musculus
uuccaaacagcucugguuccaucuccaccgcucugaaugccccuac

SEQ ID NO: 117917 - RNA, 43 nt, Mus musculus
cccucaguuggguuggagaggagacagguaggggcauucagag

SEQ ID NO: 117918 - RNA, 45 nt, Mus musculus
gucaaagccuucucagucccuuagaaagcucccccaagcccccua

SEQ ID NO: 117919 - RNA, 42 nt, Mus musculus
cuuucuuguucuugggguaaggagccaguuccucucugcgau

SEQ ID NO: 117920 - RNA, 46 nt, Mus musculus
ugauuucuguccaccuuuucaagauuccgguccgacuuguccucag

SEQ ID NO: 117921 - RNA, 45 nt, Mus musculus
cuuggcggauuugguaacgacaaaguuaggaucauguggugagag

SEQ ID NO: 117922 - RNA, 46 nt, Mus musculus
cuuugugagccaaaagagaaacgcugggcagauccauuccggcggu

SEQ ID NO: 117923 - RNA, 42 nt, Mus musculus
aaaaaagugaaaggauuuugaugauaauaacuacagccccaa

SEQ ID NO: 117924 - RNA, 43 nt, Mus musculus
uccggcuacggggcaaagaagaccccuggaauuccaucagcag

SEQ ID NO: 117925 - RNA, 42 nt, Mus musculus
ggaucuccggccccagguuaucccaacuaccagcaguaccac

SEQ ID NO: 117926 - RNA, 41 nt, Mus musculus
gcaucccagcuucauacguguaacaauucucucacccccag

SEQ ID NO: 117927 - RNA, 41 nt, Mus musculus
agcagaagauaaaaugaaguggauagggaugaagagaagau

SEQ ID NO: 117928 - RNA, 56 nt, Mus musculus
caucuuggaccugagcuccggcaccccaugcaccagaucuccagaggaaagucacg

SEQ ID NO: 117929 - RNA, 45 nt, Mus musculus
ccuccagucuugcuuuaccuuuuguguaucuccaugucccugcuc

SEQ ID NO: 117930 - RNA, 46 nt, Mus musculus
uacccaauuuugagaacuuguuaucuggugccaaacaaugugagau

SEQ ID NO: 117931 - RNA, 45 nt, Mus musculus
aaagagagacaauaaauaugauaaguaagcaaauuaucuugcaua

SEQ ID NO: 117932 - RNA, 46 nt, Mus musculus
cuccgagagugcuugcccgcacaagggugaggagagaagcggccag

SEQ ID NO: 117933 - RNA, 46 nt, Mus musculus
agagucuguggaggcucgaucagagaaagaacugggaugaccucag

SEQ ID NO: 117934 - RNA, 45 nt, Mus musculus
agcuuucugcucgaguuacagaaccccuauguggagcacccccaa

SEQ ID NO: 117935 - RNA, 42 nt, Mus musculus
gcagaccauaugggcauugacauagcgacugcaguacaccug

SEQ ID NO: 117936 - RNA, 47 nt, Mus musculus
aaauccuugugucagcaucaagcuguucauguccugaccuccagcgg

SEQ ID NO: 117937 - RNA, 24 nt, Mus musculus
ccgcgugguguccuggagggcgca

SEQ ID NO: 117938 - RNA, 43 nt, Mus musculus
gcgccuguggcaagcuuugcgcaggcaaaggugcuggggcaga

SEQ ID NO: 117939 - RNA, 61 nt, Mus musculus
accuguggcagguaaggagcucagaguccagggcaggccgagcagguaggaugagacagcg

SEQ ID NO: 117940 - RNA, 45 nt, Mus musculus
ggguguggagugaagcacugacucccuuagccagggcacggaggu

SEQ ID NO: 117941 - RNA, 41 nt, Mus musculus
gcucagcuucuucauuuugccuuucuucuuuaccuccgcua

SEQ ID NO: 117942 - RNA, 46 nt, Mus musculus
acccaaugcacuaacugucaaacgaccacuacaacacucuggcgga

SEQ ID NO: 117943 - RNA, 46 nt, Mus musculus
gcuaugcaagacuucuucuaucucuaguuuuagacuuugaccacau

SEQ ID NO: 117944 - RNA, 46 nt, Mus musculus
aaacaaaaaacaaaccaaaucuaucaaucaauaaaucagacaacaa

SEQ ID NO: 117945 - RNA, 46 nt, Mus musculus
ggguuccugcaugggaaagggauggauggucccuauggggaaagga

SEQ ID NO: 117946 - RNA, 42 nt, Mus musculus
agccuugcuuccuuuucucuccaucuaccagaggccagagag

SEQ ID NO: 117947 - RNA, 52 nt, Mus musculus
auggaguaguagagguaugacagacaagaggcaacaggaggauggggagaga

SEQ ID NO: 117948 - RNA, 41 nt, Mus musculus
gaagaaaagagggaagaaggaagaccuggagagaccuggag

SEQ ID NO: 117949 - RNA, 41 nt, Mus musculus
aaagaggaagagaaauaugguacaugaaaaggagggacagg

SEQ ID NO: 117950 - RNA, 44 nt, Mus musculus
ggccuugaagaaugggagaaagagaagcaaaggcuugccggagg

SEQ ID NO: 117951 - RNA, 46 nt, Mus musculus
ucugcagucaaucagucagucagucagucagucagucagucaguca

SEQ ID NO: 117952 - RNA, 46 nt, Mus musculus
gcaagcugagaaagacacaaagacauaaacaaauauaaagaaagau

SEQ ID NO: 117953 - RNA, 48 nt, Mus musculus
uauccaggaauacauagucuagaagaaauacauagucuaggagaaagc

SEQ ID NO: 117954 - RNA, 46 nt, Mus musculus
acuuguagggggaugggagaauaccaucuucucuacccauggguag

SEQ ID NO: 117955 - RNA, 40 nt, Mus musculus
ggaaaaauagacaggaagaaugaaucauggaaagagagac

SEQ ID NO: 117956 - RNA, 46 nt, Mus musculus
aagaaagaaagaaagaaagcaagcaagcaagcugaucacaugagaa

SEQ ID NO: 117957 - RNA, 83 nt, Mus musculus
uuggagcagaggcaggaccuggggagcagaugugguaguuaggagguuagagguagaguuugagagucagaagucuggguaua

SEQ ID NO: 117958 - RNA, 46 nt, Mus musculus
acaugguaaaaugcgagagaguauuuuuuuuuccugggcagcaugg

SEQ ID NO: 117959 - RNA, 24 nt, Mus musculus
gacaaguuucaaucaguaaaaauu

SEQ ID NO: 117960 - RNA, 42 nt, Mus musculus
aguuuuggcaaggagagauggagguuggaacagaagucuggg

SEQ ID NO: 117961 - RNA, 46 nt, Mus musculus
agguugccccuaaaacgggggucgucccccgauucucccacggauc

SEQ ID NO: 117962 - RNA, 41 nt, Mus musculus
caagacugaccugggcuuguugaugcagaggauucagccac

SEQ ID NO: 117963 - RNA, 44 nt, Mus musculus
uuagucaagaucuaaguuucauguuuuacuacuaguuucuuuca

SEQ ID NO: 117964 - RNA, 31 nt, Mus musculus
aacaggcugucuuggggcuggggggcagggu

SEQ ID NO: 117965 - RNA, 45 nt, Mus musculus
caaagacggagaaguggaaggaggcagagggauggugccugggag

SEQ ID NO: 117966 - RNA, 41 nt, Mus musculus
gagggguugaagggagagggagggagagagagagagagaga

SEQ ID NO: 117967 - RNA, 25 nt, Mus musculus
acauaaaaggaagacagaaaugaug

SEQ ID NO: 117968 - RNA, 41 nt, Mus musculus
gcgugguggcgcacgccuuuaauccuagcacuugagaggca

SEQ ID NO: 117969 - RNA, 46 nt, Mus musculus
aaauuagauagcaaugaaugagaagucgcuguucacagccugagag

SEQ ID NO: 117970 - RNA, 46 nt, Mus musculus
aacacugaguucaagucuaagacuacuauuauuuuugucgugcuag

SEQ ID NO: 117971 - RNA, 42 nt, Mus musculus
caauagccugauaguagaagaacaggaacaaguggcccucag

SEQ ID NO: 117972 - RNA, 46 nt, Mus musculus
aauucccaccaaccacaugguggcucacaaccaucuauaaugggau

SEQ ID NO: 117973 - RNA, 27 nt, Mus musculus
acaaguaugaaguugguuugagguaug

SEQ ID NO: 117974 - RNA, 45 nt, Mus musculus
agcacagcgccgugccuacuaagagagcuacugcaaauacucugg

SEQ ID NO: 117975 - RNA, 46 nt, Mus musculus
aaaauaaaauggugaaggaagacauguaguggguugaggcacagca

SEQ ID NO: 117976 - RNA, 41 nt, Mus musculus
uuuuacugacuguguggaugugguauucacuguaggaaugg

SEQ ID NO: 117977 - RNA, 45 nt, Mus musculus
uaaaagaagcugcauauugccugauucccauaauauaagcaagaa

SEQ ID NO: 117978 - RNA, 50 nt, Mus musculus
agacagaagauguagaaacagagaaacacacaaagacagagagaaaggag

SEQ ID NO: 117979 - RNA, 75 nt, Mus musculus
gaaaacaucuaugcuacuuuugcaaggacagaaaagagagguggagagugagacaaagagagacagacacagaga

SEQ ID NO: 117980 - RNA, 46 nt, Mus musculus
caagaaauacauacauugaaauagaaugguccccaagaagaaaauc

SEQ ID NO: 117981 - RNA, 48 nt, Mus musculus
cucaacauuaaaucaauaaauagaaaguagggagcaacagaguaagau

SEQ ID NO: 117982 - RNA, 46 nt, Mus musculus
auuuuucuugaaggaguuuuccccuuggaauaaggaugaggaggau

SEQ ID NO: 117983 - RNA, 46 nt, Mus musculus
gguugugagccaccaugugguugcugagaauugaacucagauccuc

SEQ ID NO: 117984 - RNA, 45 nt, Mus musculus
gugugucggugugccuccuguaugcaguauccuaagcggccagga

SEQ ID NO: 117985 - RNA, 38 nt, Mus musculus
cguaacucucuuugcuguuggcgacaacacgcagccag

SEQ ID NO: 117986 - RNA, 46 nt, Mus musculus
cagcuuucccauucaccuugauucucuccuggaggaacugcucaaa

SEQ ID NO: 117987 - RNA, 42 nt, Mus musculus
cccccuucgccacaagcuuuuucacaggcgccauggcggcag

SEQ ID NO: 117988 - RNA, 46 nt, Mus musculus
uugcucucgucuccagacgaugaccaugccacuggcaucacuggag

SEQ ID NO: 117989 - RNA, 42 nt, Mus musculus
cagguccucagagccuaaguacuuacccacacaggcccccug

SEQ ID NO: 117990 - RNA, 46 nt, Mus musculus
guggaacccacagccuuauacaugcuaggcgagugcucuaccacug

SEQ ID NO: 117991 - RNA, 60 nt, Mus musculus
ucuagcgacaauauagucaauuugcagcucuguuggggucagucugggccagcuguaaua

SEQ ID NO: 117992 - RNA, 61 nt, Mus musculus
ucagucuagcaugaugacauacgucagauugguaauguacaacaauggagguuagggucag

SEQ ID NO: 117993 - RNA, 46 nt, Mus musculus
ugauaucgagaaaaguuggggaagaggauaagcaaugagggacuag

SEQ ID NO: 117994 - RNA, 46 nt, Mus musculus
cugccuuuccugggcagcacuccggugacucacagcagcaguucag

SEQ ID NO: 117995 - RNA, 65 nt, Mus musculus
ggucucauguguaggcccucauggcaaagaauggaguaccauugggguuggagcguuggagggag

SEQ ID NO: 117996 - RNA, 70 nt, Mus musculus
uauaaucaagauggagcuguggccucagcccccuccucagagucccacacuucagacuguagguaaucag

SEQ ID NO: 117997 - RNA, 45 nt, Mus musculus
ccauugcgcaugauguggucacgaugcuccagcaggauagccaag

SEQ ID NO: 117998 - RNA, 49 nt, Mus musculus
ccuccuggguagauggaggagaugacgaagauggggaaucgggccgaga

SEQ ID NO: 117999 - RNA, 46 nt, Mus musculus
cuagaugcagcuaaguggacaacagcaucuucaaaagcaccgccuc

SEQ ID NO: 118000 - RNA, 46 nt, Mus musculus
aagcaggugccgaugaccucuuuuucuguuaccgcuggcugcugcu

SEQ ID NO: 118001 - RNA, 113 nt, Mus musculus
guaugcuucuguggcaucaugaagcgcuuagcugccaacuuccacccugauggccgugccauggccaccaaguuugcccaccucaagcugcuauugagacaugcugacccaga

SEQ ID NO: 118002 - RNA, 59 nt, Mus musculus
gcuucaugaugccacagaagcauacaaaggcauggccuucaugguccaugacagcaaga

SEQ ID NO: 118003 - RNA, 46 nt, Mus musculus
cacagguaucauacugccaggggaugagugaccuggccucaccaau

SEQ ID NO: 118004 - RNA, 59 nt, Mus musculus
auuggugaggccaggucacucauccccuggcaguaugauaccuguggauggguaacggc

SEQ ID NO: 118005 - RNA, 62 nt, Mus musculus
gagcagcucaaaagugagugggcccagcgagugaacccugaggaccuggaauucauccgcag

SEQ ID NO: 118006 - RNA, 64 nt, Mus musculus
guacccagaugggcugacuggccgugagcggauggacuacaugaaacguaagagccgagaguac

SEQ ID NO: 118007 - RNA, 44 nt, Mus musculus
ucccagggaaggagggucucugucggguaugucccaguggcagg

SEQ ID NO: 118008 - RNA, 50 nt, Mus musculus
aaggcuccacaccgccgugguagauccucaaacgcaacuccucaggccgg

SEQ ID NO: 118009 - RNA, 24 nt, Mus musculus
ggugauuucaggagacuugggggu

SEQ ID NO: 118010 - RNA, 45 nt, Mus musculus
agugauaauggaauacauguggcuuaaaacagaaggggaccagug

SEQ ID NO: 118011 - RNA, 46 nt, Mus musculus
gggaaaugaacucuggaagaacauccagugcuuuuaacugcugagc

SEQ ID NO: 118012 - RNA, 45 nt, Mus musculus
ggcucacaaccaucuguaaugggaucugaugccuucuucuguguu

SEQ ID NO: 118013 - RNA, 43 nt, Mus musculus
gagccaccaugugguugcugggauuugaacucaggaaccucaa

SEQ ID NO: 118014 - RNA, 45 nt, Mus musculus
uuucucaaacaagauuuucaaccguauaguuagguuaauggagua

SEQ ID NO: 118015 - RNA, 46 nt, Mus musculus
acccugucucaaaaaaacaaaaacaaaaacaaaacaaaacaaaaca

SEQ ID NO: 118016 - RNA, 85 nt, Mus musculus
guuuguggucauacuguugcuggagcuuucuauuuaugugugccagguuuaucuuaaaguuucuuuucuuuucaacuccacccca

SEQ ID NO: 118017 - RNA, 45 nt, Mus musculus
gcugguacuuggggggcagagaaggaaggauuguaugagaccaag

SEQ ID NO: 118018 - RNA, 46 nt, Mus musculus
cuuccucucuuggucucauacaauccuuccuucucugccccccaag

SEQ ID NO: 118019 - RNA, 53 nt, Mus musculus
cuacuguuuaucaguauuucauaaaugguuucucuuuccccguugacuccuuu

SEQ ID NO: 118020 - RNA, 47 nt, Mus musculus
uaagguuuggcaaguuugacaacuuuaugaugaaaauguaguaugua

SEQ ID NO: 118021 - RNA, 42 nt, Mus musculus
uguguguguguauauauguguguguguguguaugugugugug

SEQ ID NO: 118022 - RNA, 66 nt, Mus musculus
gauaguuucucauugaacccagaucucaccauuuggcuagauuggcuggucagcaagcccauggau

SEQ ID NO: 118023 - RNA, 46 nt, Mus musculus
gaaggcagagggcagguggauuucugugaguuccaaagcagccuag

SEQ ID NO: 118024 - RNA, 45 nt, Mus musculus
ucguacccuuagagaacuuuuguaccuacuuggaaugacugaggc

SEQ ID NO: 118025 - RNA, 28 nt, Mus musculus
ugggaaucaaacucuggucuucuugaag

SEQ ID NO: 118026 - RNA, 42 nt, Mus musculus
cguguagacauucggcccucagaggacagugaguacccagaa

SEQ ID NO: 118027 - RNA, 42 nt, Mus musculus
ccuacggguagagagguggguuguaggguuaccggaggggcc

SEQ ID NO: 118028 - RNA, 81 nt, Mus musculus
agaccugaaauuuggggcgugacuuggagacugggggcgaggcuggagagcggaauugauagaaugaaggcguggguuuug

SEQ ID NO: 118029 - RNA, 137 nt, Mus musculus
uugucccacucaaacaugaugagugagcacacaaagggccagagucagaaaaggaagggaacaaguugagcuacugcuaggaaccugagggaaaagauggaugagaagguggcaaguccgugacgguggcaacuucc

SEQ ID NO: 118030 - RNA, 29 nt, Mus musculus
ccugugcgaggaggaagaagauuugaguc

SEQ ID NO: 118031 - RNA, 83 nt, Mus musculus
uccuugugcuugaugccauaaagcaucucacuagugcccagagcgugcuggacagcaaagucaugaaaauuaagagcaagcau

SEQ ID NO: 118032 - RNA, 38 nt, Mus musculus
auacggggaugugcuguacuuccugacagagcuacacg

SEQ ID NO: 118033 - RNA, 46 nt, Mus musculus
guagcucugucaggaaguacagcacauccccguauaucuggccugu

SEQ ID NO: 118034 - RNA, 51 nt, Mus musculus
gaccacucagccuauggguagugauugccuuucuccgccaacagcccuucc

SEQ ID NO: 118035 - RNA, 45 nt, Mus musculus
agcaguugugcucuuaaccacugagccaucucuccagcccaaauu

SEQ ID NO: 118036 - RNA, 46 nt, Mus musculus
uagucaggguuucuauuccugcacaaacauugucaagaagcaaguu

SEQ ID NO: 118037 - RNA, 54 nt, Mus musculus
ucaccuugugaucgagggcugguucucucucuacaauggcauccuuuuagaaga

SEQ ID NO: 118038 - RNA, 45 nt, Mus musculus
agcucggcuagacaacagccacgugaucacaauuaggcccccaga

SEQ ID NO: 118039 - RNA, 48 nt, Mus musculus
uucgcauauccugguuggccucuucuccaucucugggggccuaauugu

SEQ ID NO: 118040 - RNA, 48 nt, Mus musculus
cgggccauagaaacaugaccaccaauacgguccccuugcacccguacu

SEQ ID NO: 118041 - RNA, 45 nt, Mus musculus
ugugagccaccaugugguugcugggaguugaacucaguaccucug

SEQ ID NO: 118042 - RNA, 42 nt, Mus musculus
cagcagaaacucucuaacuuugcuucauugugauacccccua

SEQ ID NO: 118043 - RNA, 46 nt, Mus musculus
cucugugacuagcaaccagaaguacaacucgaugaugcuggcagua

SEQ ID NO: 118044 - RNA, 46 nt, Mus musculus
ccccgacuacauuccugugucuuuccaacaaacugagccccaaagu

SEQ ID NO: 118045 - RNA, 45 nt, Mus musculus
cccugcgcuugcgcgggacccgggcccuaaaucgguuguccagac

SEQ ID NO: 118046 - RNA, 41 nt, Mus musculus
gacaaagaaauggugaagaaguccucagaacugcaggaagg

SEQ ID NO: 118047 - RNA, 48 nt, Mus musculus
cuacaauuuuuaauaaaaagauaaacuuuuuaaaaagauagaacaggu

SEQ ID NO: 118048 - RNA, 44 nt, Mus musculus
cuaauuaguuuauuaauguuguuauuaguuguuguauguguguu

SEQ ID NO: 118049 - RNA, 46 nt, Mus musculus
gaauggcuggcgggcccgaagcgcuuucaagcuccugcaacuggau

SEQ ID NO: 118050 - RNA, 37 nt, Mus musculus
gcaggacagcaucagcacacacugucugccagcagac

SEQ ID NO: 118051 - RNA, 46 nt, Mus musculus
uaaugacuggaagcuuaaucuaugauggaauugguggacugcagag

SEQ ID NO: 118052 - RNA, 42 nt, Mus musculus
gaggcaugccugcccugucuccaacucgggaugaggggauuc

SEQ ID NO: 118053 - RNA, 45 nt, Mus musculus
cuaucuacaaaggauauauuuuguaaagaacuuugaaguuuagaa

SEQ ID NO: 118054 - RNA, 44 nt, Mus musculus
auaaggagagccaccucaccaaggugucucugaagauugaaaaa

SEQ ID NO: 118055 - RNA, 63 nt, Mus musculus
ugucccugaggagugcccaggcuguguucccagcuauugcucaggagauuggucgggaggagc

SEQ ID NO: 118056 - RNA, 48 nt, Mus musculus
ggaauuuucugaaggaguacaucugugggaagaaagcuggcagucucu

SEQ ID NO: 118057 - RNA, 46 nt, Mus musculus; identical to SEQ ID NO: 105862

SEQ ID NO: 118058 - RNA, 45 nt, Mus musculus; identical to SEQ ID NO: 86316

SEQ ID NO: 118059 - RNA, 45 nt, Mus musculus; identical to SEQ ID NO: 86317

SEQ ID NO: 118060 - RNA, 46 nt, Mus musculus
uugagggugugugugccugugguccggcugauccgccgcccgaguc

SEQ ID NO: 118061 - RNA, 46 nt, Mus musculus
cacaggcaguuggccagcccaagacagagucguuuucuuaccagau

SEQ ID NO: 118062 - RNA, 46 nt, Mus musculus; identical to SEQ ID NO: 105868

SEQ ID NO: 118063 - RNA, 41 nt, Mus musculus
cagagcggcggguccuguccucgccaugaggccgcagcagg

SEQ ID NO: 118064 - RNA, 45 nt, Mus musculus
gcaccuucagccucacccugccccaguguccuacuagcuggggga

SEQ ID NO: 118065 - RNA, 42 nt, Mus musculus
ugugcuacaaauggcauggcugaagaagugacccaagcccuu

SEQ ID NO: 118066 - RNA, 46 nt, Mus musculus
caguuaagagacuuuuaauuguaaaagacuuuggauuuuaaaagau

SEQ ID NO: 118067 - RNA, 42 nt, Mus musculus
ggagaaaggccccuugugggugggacuaucucuggguggcag

SEQ ID NO: 118068 - RNA, 46 nt, Mus musculus
agauauagacuucugaaauucuaagauuagaauuacuuagugggag

SEQ ID NO: 118069 - RNA, 45 nt, Mus musculus
gauccuguucugaagcuggccuuuauuuccccuccacugcaccua

SEQ ID NO: 118070 - RNA, 46 nt, Mus musculus
guggcugaugaaauuagaagcuacagccacacucaugcacucagaa

SEQ ID NO: 118071 - RNA, 46 nt, Mus musculus
guauauauguguguauaugugugugucucuguguguguauguggug

SEQ ID NO: 118072 - RNA, 46 nt, Mus musculus
uguauguguguguauauaugcaugucuguguguauggguguaguau

SEQ ID NO: 118073 - RNA, 46 nt, Mus musculus
guauauguguguguauaugugugugucucuguguguguauguggug

SEQ ID NO: 118074 - RNA, 46 nt, Mus musculus; identical to SEQ ID NO: 118072

SEQ ID NO: 118075 - RNA, 45 nt, Mus musculus
auguguaugcaugaauguguaucuguguacauauauauguguguc

SEQ ID NO: 118076 - RNA, 42 nt, Mus musculus
guauguguguguguguguguguguggugugguauguguuugu

SEQ ID NO: 118077 - RNA, 23 nt, Mus musculus
ggcuaugguauuuuggaucuaga

SEQ ID NO: 118078 - RNA, 45 nt, Mus musculus
gaaugccagggccaggaagcaggaguggguagguuggggaguagg

SEQ ID NO: 118079 - RNA, 26 nt, Mus musculus
ccaauccaaucuggcuugguccggca

SEQ ID NO: 118080 - RNA, 46 nt, Mus musculus
cucuuucuggguuuaucugaauuuacauuugcuaucuaaggaucuu

SEQ ID NO: 118081 - RNA, 42 nt, Mus musculus
guguccugggaaagcccagagggaagagauacagcggauggg

SEQ ID NO: 118082 - RNA, 46 nt, Mus musculus
cuugugcugccuguacuggacacccuuugucaacacuugaccagau

SEQ ID NO: 118083 - RNA, 45 nt, Mus musculus
augucaggguccugucagcaaaaucuuucuggcauaugcaccagu

SEQ ID NO: 118084 - RNA, 42 nt, Mus musculus
uaugcaaggagcauucuaaaagcuggugggauuggccaaagu

SEQ ID NO: 118085 - RNA, 38 nt, Mus musculus
guuggaaguaauagcuaaaguugguagauuguaacgug

SEQ ID NO: 118086 - RNA, 41 nt, Mus musculus
cucggagucucuaggaggaacagaaauauuacagccucaga

SEQ ID NO: 118087 - RNA, 46 nt, Mus musculus
agaaacccccaggaagggagcuggguagauguagguaggguggcuu

SEQ ID NO: 118088 - RNA, 24 nt, Mus musculus
uagauugcuuuuggcagguagcca

SEQ ID NO: 118089 - RNA, 46 nt, Mus musculus
guucagagguucaguccauuaucaucaagguagaaacaugacagca

SEQ ID NO: 118090 - RNA, 46 nt, Mus musculus
uucauaacauggggaugggaguuaagaggguaguagaggcagagaa

SEQ ID NO: 118091 - RNA, 46 nt, Mus musculus
uccagggucuguggagccaucugaggacaggucagaaggaccaggu

SEQ ID NO: 118092 - RNA, 45 nt, Mus musculus
gcaaggggcaaaagagagagauaagagaggcaaaagaguaagaga

SEQ ID NO: 118093 - RNA, 46 nt, Mus musculus
uucagggcauggggaggggaguuaagaggguaguagaggcaaagaa

SEQ ID NO: 118094 - RNA, 45 nt, Mus musculus
gguacuggguaguucauauuguuguuccgccuauaggguugcaga

SEQ ID NO: 118095 - RNA, 46 nt, Mus musculus
caauucuauaaaugcauguuuauguuucaauggucaccgagcacau

SEQ ID NO: 118096 - RNA, 56 nt, Mus musculus
agaaacugaugcagaauacuaaugauccacucccagagauaaagccaauaggagau

SEQ ID NO: 118097 - RNA, 46 nt, Mus musculus
uucaaugcuaucccaaaggucccccauacccacccccccacccccc

SEQ ID NO: 118098 - RNA, 104 nt, Mus musculus
ugcuuugcuaucccuucuuucccguuuuacaaauugcugugcccauuguuuuaauuuuauugaugucaugaaccaaguuguuacuugucucugauaccauacgc

SEQ ID NO: 118099 - RNA, 47 nt, Mus musculus
uggauuuugacuuugcauguuuuaugugcauaccuaaugcccagaac

SEQ ID NO: 118100 - RNA, 46 nt, Mus musculus
uuuuuaauaagcuagcuuucuucuguuaucauuugccugguagaga

SEQ ID NO: 118101 - RNA, 45 nt, Mus musculus
uacuuuuccuguuagucccuuauaguaacuguauaaccccaaagu

SEQ ID NO: 118102 - RNA, 46 nt, Mus musculus
gaagagacagagauagagacagagacauggagagacacagagagac

SEQ ID NO: 118103 - RNA, 46 nt, Mus musculus
acacacacacagagagagagagagacagagagagagacagagagac

SEQ ID NO: 118104 - RNA, 46 nt, Mus musculus
gcccuucgugaguacaaugaaaauccaaaagguauaagcucauuug

SEQ ID NO: 118105 - RNA, 42 nt, Mus musculus
agacacuguagaagaagaaaggaaggaaggagagaaggagau

SEQ ID NO: 118106 - RNA, 46 nt, Mus musculus
gaagaaacuucuuaauuucuuucaagcuuaagaucacucuuuagag

SEQ ID NO: 118107 - RNA, 42 nt, Mus musculus
cacuagguuagaguaagagaauaguaacaaaguugaggaaca

SEQ ID NO: 118108 - RNA, 45 nt, Mus musculus
uugugguuaugaaauagcaaagaaacaauuuuaugucugggaggc

SEQ ID NO: 118109 - RNA, 46 nt, Mus musculus
gaguuuacaugcgugugugcucucuccaaccaaugcuucaguaagg

SEQ ID NO: 118110 - RNA, 44 nt, Mus musculus
acacggaaguugugaggaugauguggaggaagauaaaacauaug

SEQ ID NO: 118111 - RNA, 41 nt, Mus musculus
gggagaggaagaaggggagggagaggaagaagguggggaag

SEQ ID NO: 118112 - RNA, 57 nt, Mus musculus
augggagagaaggguggaaggaaggagaggagcaagaacaggaggaggaaauagagg

SEQ ID NO: 118113 - RNA, 65 nt, Mus musculus
ugaaggaaaccaagagaaaaggaagaaagagauggaagaaagagaugcaggagaugaaagaagug

SEQ ID NO: 118114 - RNA, 93 nt, Mus musculus
uaaaagagcaaggugcauccuggauaugaaagagagagaagaggauaaaggaugggagaaagggagugaaggaggagacaaaaugaagaggga

SEQ ID NO: 118115 - RNA, 42 nt, Mus musculus
agagagucagggggggagagagaggacggaucugagggugac

SEQ ID NO: 118116 - RNA, 47 nt, Mus musculus
gcucaaaccaaaagcggauaagcggaggugagccagugguacaggag

SEQ ID NO: 118117 - RNA, 43 nt, Mus musculus
acuguguuucuguuuaguuuguguuuccaugaucuguccauug

SEQ ID NO: 118118 - RNA, 46 nt, Mus musculus
cagcuccuucagucccuucuccaacuucugaaucgguggcccccac

SEQ ID NO: 118119 - RNA, 46 nt, Mus musculus
guacaguauuagcaugaaagaugcaguguacuauuauacagcagau

SEQ ID NO: 118120 - RNA, 46 nt, Mus musculus
gaauagaucuuuaucagcacgucugcggcgaagagagcggguacag

SEQ ID NO: 118121 - RNA, 46 nt, Mus musculus
aauaugaaaaccaaauaguugucuccaaauuuguuaagcaucagau

SEQ ID NO: 118122 - RNA, 45 nt, Mus musculus
ggcagguacccagcccuaaaucacugccucaaaagcuuaggaaga

SEQ ID NO: 118123 - RNA, 33 nt, Mus musculus
uuaagccugagaaggugaaacuugcugccugug

SEQ ID NO: 118124 - RNA, 45 nt, Mus musculus
aaauaauaaauuguacauguucggcaguaacaacuggggucaguu

SEQ ID NO: 118125 - RNA, 44 nt, Mus musculus
cuuucucuggaaauuucccccaaacugggucugacuuucuauuu

SEQ ID NO: 118126 - RNA, 46 nt, Mus musculus
cauguucuuuuaaacaugaaauaauguuuguuaucugccccgugga

SEQ ID NO: 118127 - RNA, 41 nt, Mus musculus
cccuuuuggcuaucaaaaagacuaggagaagguggcagaag

SEQ ID NO: 118128 - RNA, 42 nt, Mus musculus
acucgcggucagggcugggaccuuuuaucugugcugcuggag

SEQ ID NO: 118129 - RNA, 46 nt, Mus musculus
uaacgccaugaaucgcuucauuggcgcggugaacaacauggaccag

SEQ ID NO: 118130 - RNA, 46 nt, Mus musculus
agcguggagguaggcggcaguggcggcugccuggaggagcgcacga

SEQ ID NO: 118131 - RNA, 39 nt, Mus musculus
uguaucuauuggugaggauguuggcuuuucgggugaguu

SEQ ID NO: 118132 - RNA, 44 nt, Mus musculus
auauucuaaaaaauaaaaacgcagauguguuaacaaaacuggac

SEQ ID NO: 118133 - RNA, 46 nt, Mus musculus
auuccguagcaauuuucccaaucuggaaauugucaccauugcagag

SEQ ID NO: 118134 - RNA, 46 nt, Mus musculus
uggguggcuccuuagcugucggcaaacuuuggcuuaggguccagau

SEQ ID NO: 118135 - RNA, 46 nt, Mus musculus
uaauaagacauggaauaaauuacugccgugcuuacugggagugguu

SEQ ID NO: 118136 - RNA, 72 nt, Mus musculus
ccauguguuaggccacccccacacuuacccccauucuuagaaguuaggacugaucuacuuggcaugacuuag

SEQ ID NO: 118137 - RNA, 45 nt, Mus musculus
gauuuuuuucacaacccaccucaugucuaugaguggccagcagga

SEQ ID NO: 118138 - RNA, 44 nt, Mus musculus
agccgccguggugaccugaagcagcacggcacagauggucagau

SEQ ID NO: 118139 - RNA, 45 nt, Mus musculus
aauucuccucaagagaccacccagucucgccccaugccgccagaa

SEQ ID NO: 118140 - RNA, 46 nt, Mus musculus
cgaccugagcccaguucggacuacgauuugucaccaccagccaagc

SEQ ID NO: 118141 - RNA, 46 nt, Mus musculus
aaaccaagcacuugauaccucaggaguccaggaggagcuugcagau

SEQ ID NO: 118142 - RNA, 46 nt, Mus musculus
ccucaaggcugccugccaaacagcagaaaauuaaagaaagccagaa

SEQ ID NO: 118143 - RNA, 75 nt, Mus musculus
cccaggcuguucagccugaggucaccucccaggggacuaacaucacugaagagaagccuggcaggaaaaaggcag

SEQ ID NO: 118144 - RNA, 83 nt, Mus musculus
gguggacacgccacacagccccacccuccggcuagacaggaaacgcaaacugucaggugacagcacccacacugagaccgcug

SEQ ID NO: 118145 - RNA, 45 nt, Mus musculus
guauagcacuggaaacaaacaugaucucuuugaagccccagagga

SEQ ID NO: 118146 - RNA, 44 nt, Mus musculus
accugacagugcaugggaaggacuucgccaggacauuuuagaga

SEQ ID NO: 118147 - RNA, 46 nt, Mus musculus
ucacccuggaagaggccauugccgaccagaaugacagugagagaug

SEQ ID NO: 118148 - RNA, 46 nt, Mus musculus
gugugcaaauucagcccagccgacugggaaagguugaaaggaaauc

SEQ ID NO: 118149 - RNA, 45 nt, Mus musculus
uguccagcucaggacgcccagccucugcaucaccagcccccaacg

SEQ ID NO: 118150 - RNA, 42 nt, Mus musculus
gggcgacugugcucaauccaugccugggcacacccggaagac

SEQ ID NO: 118151 - RNA, 46 nt, Mus musculus
cugcccugggucaacccuuacauggagggggccacuccagccauau

SEQ ID NO: 118152 - RNA, 46 nt, Mus musculus
aacccccaaauggcuucagugcuauauacaaaacaccgccugggau

SEQ ID NO: 118153 - RNA, 46 nt, Mus musculus
gcucucucaguggccuuggguuuucuucggaaagaaauccagagau

SEQ ID NO: 118154 - RNA, 47 nt, Mus musculus
uggaaacaucguuuauucuggcuuguguggauugggcucagaaaaag

SEQ ID NO: 118155 - RNA, 28 nt, Mus musculus
uaggaaaauuccugugaaugauggcgac

SEQ ID NO: 118156 - RNA, 46 nt, Mus musculus
ucuauaugcugcuuuaacucuaaaugucaggagugugggcccaggu

SEQ ID NO: 118157 - RNA, 45 nt, Mus musculus
uggaugaacagcgagaggguccgcauguguggaacaagugaagac

SEQ ID NO: 118158 - RNA, 46 nt, Mus musculus
ccugguuggggaaaggaaagucuuccagcuugccucggugguuggc

SEQ ID NO: 118159 - RNA, 44 nt, Mus musculus
guggccgaugucgaaguagaggaggauggguggauuggacugga

SEQ ID NO: 118160 - RNA, 45 nt, Mus musculus
cucucccgaccccgcacacauucacccagccagccgcccccggau

SEQ ID NO: 118161 - RNA, 43 nt, Mus musculus
uuggccaacacacucgcucacacacacucacacacacacccag

SEQ ID NO: 118162 - RNA, 45 nt, Mus musculus
gaccgagagcgggagcgaggcgggcggcgguggcggagggggagc

SEQ ID NO: 118163 - RNA, 26 nt, Mus musculus
ggagccugagcucccagcggcaaggu

SEQ ID NO: 118164 - RNA, 34 nt, Mus musculus
ucagaaacaccccccccacacacacacacacauu

SEQ ID NO: 118165 - RNA, 49 nt, Mus musculus
acugguguguuaaacgggcaggaaggaggucucuggauugucagcagaa

SEQ ID NO: 118166 - RNA, 42 nt, Mus musculus
aaggggaacucgggcugacuaaugggacgcuugugggccucc

SEQ ID NO: 118167 - RNA, 42 nt, Mus musculus
gggaaaggcguguugguggcgguaacugggaggggggggacg

SEQ ID NO: 118168 - RNA, 41 nt, Mus musculus
aaaagaagaguucuuagaauuugagccgggaggcagcuagg

SEQ ID NO: 118169 - RNA, 26 nt, Mus musculus
gcgagcacuaagaggagguuuugugu

SEQ ID NO: 118170 - RNA, 45 nt, Mus musculus
uguuuuguuuuggaaacagggucucauguggcccaggcugucuuu

SEQ ID NO: 118171 - RNA, 55 nt, Mus musculus
agagagggggagagggagagggggggagagagggagagagggagagagggagaga

SEQ ID NO: 118172 - RNA, 70 nt, Mus musculus
agagggagacagggagugaggaagagagggagagagggagacagggagugagggagagagggagagaggg

SEQ ID NO: 118173 - RNA, 46 nt, Mus musculus
ccuagcaacacaccacacacacacacacacacacacacacacagau

SEQ ID NO: 118174 - RNA, 46 nt, Mus musculus
uuaggguuuguucuuggaggccaguggagggcuggaaaaagcagau

SEQ ID NO: 118175 - RNA, 44 nt, Mus musculus
cagcagcuagaucaagggguaucugaggccuagcagcuaaggaa

SEQ ID NO: 118176 - RNA, 44 nt, Mus musculus
cccacuuggugacucacaacugccuuagguacacacauuuaauu

SEQ ID NO: 118177 - RNA, 46 nt, Mus musculus
gccagagugggcaggaaaagcagagcagcagaggaaggagccauuc

SEQ ID NO: 118178 - RNA, 45 nt, Mus musculus
gggacucucccagggaggaaaggaugacuaguuucuaggggauac

SEQ ID NO: 118179 - RNA, 45 nt, Mus musculus
ggccauucgcauauuaagggacuccgggaccuacuggugcuagaa

SEQ ID NO: 118180 - RNA, 44 nt, Mus musculus
cucacuucccagucaucucuagucacuuuggauauaguucaagg

SEQ ID NO: 118181 - RNA, 46 nt, Mus musculus
gucccaccuuuccacugcuggguguuggugucaggcgcccauagaa

SEQ ID NO: 118182 - RNA, 46 nt, Mus musculus
gacccuguauuggaaacaaacaaaaaagcacagcugaggaucagau

SEQ ID NO: 118183 - RNA, 23 nt, Mus musculus
gcgggggaaaggucggggcgcag

SEQ ID NO: 118184 - RNA, 42 nt, Mus musculus
gcgguaauggcuuucgcaguuggaaugugugcuagggaaaga

SEQ ID NO: 118185 - RNA, 42 nt, Mus musculus
gucaauuuuucuucuauuucuauagcugggauggggagagau

SEQ ID NO: 118186 - RNA, 45 nt, Mus musculus
uguuugguguggugugugagguguguguguguggugugugugugu

SEQ ID NO: 118187 - RNA, 42 nt, Mus musculus
cugcagccgcacggaaacccagugcccagaaagccggcagau

SEQ ID NO: 118188 - RNA, 44 nt, Mus musculus
gggugucgucccauccccaccccccauacacauuugcucugaca

SEQ ID NO: 118189 - RNA, 42 nt, Mus musculus
uaucuccuuaaaaccuuuacuuuuaaugaaauggggccagag

SEQ ID NO: 118190 - RNA, 46 nt, Mus musculus
aauaaucccacagccccauauacagagaucuuuaugguccaaagcu

SEQ ID NO: 118191 - RNA, 45 nt, Mus musculus
ugugagccaccaugugguugcuaggauuugaacucagggccucug

SEQ ID NO: 118192 - RNA, 42 nt, Mus musculus
uguuucugggaaugccgcuugcuagagccagggccuggguca

SEQ ID NO: 118193 - RNA, 46 nt, Mus musculus
cugaccucuuuuuggguucagaguccucucugcccaucccgcaccc

SEQ ID NO: 118194 - RNA, 41 nt, Mus musculus
ucaguggcgcgcacgaauucacacccuuccccggggggggg

SEQ ID NO: 118195 - RNA, 46 nt, Mus musculus
gcuacacagagaaacccugucucaaaaaaaaaaaaaucaacuggag

SEQ ID NO: 118196 - RNA, 44 nt, Mus musculus
guugauugauuuuguuccaucauucauagaagcucacugcacaa

SEQ ID NO: 118197 - RNA, 45 nt, Mus musculus
gaauucaaauggaacagugugugcaugugagcacaggguaaugag

SEQ ID NO: 118198 - RNA, 45 nt, Mus musculus
agccgaagggugaauaaacagauuuguauuuuggaaauaugaaga

SEQ ID NO: 118199 - RNA, 45 nt, Mus musculus
aagagcagcugaaaccaguggaugguugguuguggaguggcagaa

SEQ ID NO: 118200 - RNA, 46 nt, Mus musculus
uggguuuauaucaugauuacauugggaagaacauuguagagguuaa

SEQ ID NO: 118201 - RNA, 49 nt, Mus musculus
gagaacugguauccgaagcccagcaccauagcucugacggguggaacag

SEQ ID NO: 118202 - RNA, 45 nt, Mus musculus
auuggaaagaaaaccaggggccuugucuucaugaaggccaaagug

SEQ ID NO: 118203 - RNA, 46 nt, Mus musculus
agucacuuaacucuugcugugucgucuaucuaaaaacuggaucaau

SEQ ID NO: 118204 - RNA, 46 nt, Mus musculus
agagucuguaggcuuucucugugaagcugggggcagguuaucugga

SEQ ID NO: 118205 - RNA, 42 nt, Mus musculus
agucagucccuucgcuucucguccuucacuuuuuagcggcag

SEQ ID NO: 118206 - RNA, 46 nt, Mus musculus
ggaagcuucacccuuuccaggguuuauaggcaguuaacgggagcug

SEQ ID NO: 118207 - RNA, 41 nt, Mus musculus
gguucacuaccccccccaaaaaaagacgugaaaauagaggg

SEQ ID NO: 118208 - RNA, 46 nt, Mus musculus
caccuauacuaugaagacuugcgugccaucccuagaaucccaccag

SEQ ID NO: 118209 - RNA, 49 nt, Mus musculus
ccagugaagaauggggaaauguacuauguuuaauaaacuucaaggugga

SEQ ID NO: 118210 - RNA, 46 nt, Mus musculus
guuguaacugcuuuuaaaacauuuuuuuauugauuucuuccuguag

SEQ ID NO: 118211 - RNA, 42 nt, Mus musculus
agggcuugccguggguaaccuauuccaccggccacgggcuac

SEQ ID NO: 118212 - RNA, 47 nt, Mus musculus
gcucacaaccauuccuaaaaagauaugacucccucuucugguguguc

SEQ ID NO: 118213 - RNA, 42 nt, Mus musculus
uguacaccaggcaaguacugucccauugaccaauacccccag

SEQ ID NO: 118214 - RNA, 49 nt, Mus musculus
cucuucccagaugacaauggcuuguaucaaaucgccagaacgcuaacca

SEQ ID NO: 118215 - RNA, 47 nt, Mus musculus
caacaggaaaagagacaaccgaaaaauaauagagggcguagagaaaa

SEQ ID NO: 118216 - RNA, 45 nt, Mus musculus
ugcaguuuuacucuugcauuucaggcaguuccuuuuagucuagac

SEQ ID NO: 118217 - RNA, 46 nt, Mus musculus
uauuuucggaggaaacaccuguaguuuugcaguuggcucccagcga

SEQ ID NO: 118218 - RNA, 45 nt, Mus musculus
aaagcaaacucgguguuugaagaccuuucagucacauugcggcag

SEQ ID NO: 118219 - RNA, 42 nt, Mus musculus
ggaccauucacccgacuuguauucauuggagcuggcagguuu

SEQ ID NO: 118220 - RNA, 46 nt, Mus musculus
guuugcagaugacauguacagucucuauggugggaacgcaguggua

SEQ ID NO: 118221 - RNA, 46 nt, Mus musculus
cuggucugacaguucacaccuguaaucccagcaucugggaguccag

SEQ ID NO: 118222 - RNA, 46 nt, Mus musculus
gccaaaggaaacagaaagacacucagugguccgccucugcacuggg

SEQ ID NO: 118223 - RNA, 42 nt, Mus musculus
cccagaaugccuccugcugcaaugcaggaggaauacugccag

SEQ ID NO: 118224 - RNA, 46 nt, Mus musculus
auguuccagguggcccuuuccaagucaucugcugcacugucaccag

SEQ ID NO: 118225 - RNA, 49 nt, Mus musculus
cucugccugaaaucagucaguggugucucccugcauauaggcucaaguc

SEQ ID NO: 118226 - RNA, 45 nt, Mus musculus
ccuccucuccugccaucguccuacuuuugaaauuuucuagccaga

SEQ ID NO: 118227 - RNA, 46 nt, Mus musculus
cucuaucgggagagaaggcuugcucgugaucuuaucccucugcaag

SEQ ID NO: 118228 - RNA, 46 nt, Mus musculus
auuggcuguuuuguuaaaguauaucuuuuaguguuguuuaaaguag

SEQ ID NO: 118229 - RNA, 80 nt, Mus musculus
aauguaauuucauuccauuuaauacauguggaaauacgcacugagagaacuguaaaccacuuagucauguuacucgcgcu

SEQ ID NO: 118230 - RNA, 49 nt, Mus musculus
uguaaauaucucugagacaggaggaaauauguuaacuaagagcagccca

SEQ ID NO: 118231 - RNA, 61 nt, Mus musculus
gugugugguauggcuucaaucuguagacuauuauauggaaguggaugauugcuacuguuca

SEQ ID NO: 118232 - RNA, 45 nt, Mus musculus
gccauauacaggcccagcagcacaucacaugaacaacccucagag

SEQ ID NO: 118233 - RNA, 46 nt, Mus musculus
cugugcacccaggccuuacaguccaacuuuuuucugugucuggcua

SEQ ID NO: 118234 - RNA, 45 nt, Mus musculus
uugucuuaucugcagaaauuugcugucaauauauaacccgccugc

SEQ ID NO: 118235 - RNA, 45 nt, Mus musculus
guuaauucuuaagcaagaauuuuuuuuucuucaugagacucacag

SEQ ID NO: 118236 - RNA, 42 nt, Mus musculus
acaaaaacaaaaaguaaaucaacaucaacaaaacagcccauu

SEQ ID NO: 118237 - RNA, 94 nt, Mus musculus
cugacaugacaccugcauugcucggagcuuuccuucuuaaacccuagauuauaaaauacagacugagggagaacuguggcaaggaagcgguucu

SEQ ID NO: 118238 - RNA, 46 nt, Mus musculus
ccacaguucucccucagucuguauuuuauaaucuaggguuuaagaa

SEQ ID NO: 118239 - RNA, 42 nt, Mus musculus
cagaaagaugggggucuuuggcucuuuacuaaagacuuggag

SEQ ID NO: 118240 - RNA, 85 nt, Mus musculus
aggaaaauguuuuaaggcuauaguuggcauugaucaaagcagaagcaaaauugagcauuguuauuuugugauuuaaaaggggcag

SEQ ID NO: 118241 - RNA, 45 nt, Mus musculus
aguaguaaaguagguuagcuuuguuuggaugaguaacugguacua

SEQ ID NO: 118242 - RNA, 47 nt, Mus musculus
aaggcugugaauuuuucuuggagggauucuacccccggcccccagua

SEQ ID NO: 118243 - RNA, 47 nt, Mus musculus
uggugggcuuauacacuuaaagcaacuacugggggccggggguagaa

SEQ ID NO: 118244 - RNA, 46 nt, Mus musculus
acucuguucaccuucccucacuccuggucacaacacaggcccacuc

SEQ ID NO: 118245 - RNA, 45 nt, Mus musculus
aaauuauuuucuauauuaacucuuuaagcauuaauguauaaccgg

SEQ ID NO: 118246 - RNA, 45 nt, Mus musculus
uugcucuauugaagacaguagaaucuguuaacguaagacugaaga

SEQ ID NO: 118247 - RNA, 46 nt, Mus musculus
aaacccuccaccuaccgaauucucauguucagcaucgcagaggcag

SEQ ID NO: 118248 - RNA, 46 nt, Mus musculus
aaaagaaagcaacagucugaauauucaggugacuacuuuggcauag

SEQ ID NO: 118249 - RNA, 46 nt, Mus musculus
cuuauuuagaauuuuagaaaauugccuuuuugcgauaagugcccag

SEQ ID NO: 118250 - RNA, 42 nt, Mus musculus
auguccucguaccuucaaacuagaaauaaaaacugggcacuu

SEQ ID NO: 118251 - RNA, 45 nt, Mus musculus
uaaaucacuacagaagugcugaauguauuaagaccucgcugccga

SEQ ID NO: 118252 - RNA, 75 nt, Mus musculus
accgcccaaaucucacauacuucuuagccuuuuacaagccaacagauugacauaaagauuguccgcaguucguaa

SEQ ID NO: 118253 - RNA, 46 nt, Mus musculus
augcuagguuuacagcugauuuuccuguucauccuucuugccccac

SEQ ID NO: 118254 - RNA, 45 nt, Mus musculus; identical to SEQ ID NO: 118232

SEQ ID NO: 118255 - RNA, 46 nt, Mus musculus; identical to SEQ ID NO: 118233

SEQ ID NO: 118256 - RNA, 45 nt, Mus musculus; identical to SEQ ID NO: 118234

SEQ ID NO: 118257 - RNA, 45 nt, Mus musculus; identical to SEQ ID NO: 118235

SEQ ID NO: 118258 - RNA, 42 nt, Mus musculus; identical to SEQ ID NO: 118236

SEQ ID NO: 118259 - RNA, 94 nt, Mus musculus; identical to SEQ ID NO: 118237

SEQ ID NO: 118260 - RNA, 46 nt, Mus musculus; identical to SEQ ID NO: 118238

SEQ ID NO: 118261 - RNA, 42 nt, Mus musculus; identical to SEQ ID NO: 118239

SEQ ID NO: 118262 - RNA, 85 nt, Mus musculus; identical to SEQ ID NO: 118240

SEQ ID NO: 118263 - RNA, 45 nt, Mus musculus; identical to SEQ ID NO: 118241

SEQ ID NO: 118264 - RNA, 47 nt, Mus musculus; identical to SEQ ID NO: 118242

SEQ ID NO: 118265 - RNA, 47 nt, Mus musculus; identical to SEQ ID NO: 118243

SEQ ID NO: 118266 - RNA, 46 nt, Mus musculus; identical to SEQ ID NO: 118244

SEQ ID NO: 118267 - RNA, 45 nt, Mus musculus; identical to SEQ ID NO: 118245

SEQ ID NO: 118268 - RNA, 45 nt, Mus musculus; identical to SEQ ID NO: 118246

SEQ ID NO: 118269 - RNA, 46 nt, Mus musculus; identical to SEQ ID NO: 118247

SEQ ID NO: 118270 - RNA, 46 nt, Mus musculus; identical to SEQ ID NO: 118248

SEQ ID NO: 118271 - RNA, 46 nt, Mus musculus; identical to SEQ ID NO: 118249

SEQ ID NO: 118272 - RNA, 42 nt, Mus musculus; identical to SEQ ID NO: 118250

SEQ ID NO: 118273 - RNA, 45 nt, Mus musculus; identical to SEQ ID NO: 118251

SEQ ID NO: 118274 - RNA, 75 nt, Mus musculus; identical to SEQ ID NO: 118252

SEQ ID NO: 118275 - RNA, 46 nt, Mus musculus; identical to SEQ ID NO: 118253

SEQ ID NO: 118276 - RNA, 50 nt, Mus musculus; identical to SEQ ID NO: 81499

SEQ ID NO: 118277 - RNA, 45 nt, Mus musculus; identical to SEQ ID NO: 81500

SEQ ID NO: 118278 - RNA, 42 nt, Mus musculus
ucauccacacuggguacuggccaugcuggucuagaagagucu

SEQ ID NO: 118279 - RNA, 46 nt, Mus musculus
caggcuuuuagccaugcuucaccugagagacaacaccgcgcaccac

SEQ ID NO: 118280 - RNA, 46 nt, Mus musculus
gccaauuucagcaccaccauaaaccacgcaaggacggacucuagau

SEQ ID NO: 118281 - RNA, 46 nt, Mus musculus
ccuacagccagaaauauguacucaucuaagaaaucacgggccagca

SEQ ID NO: 118282 - RNA, 97 nt, Mus musculus
agauggggacuuccaagaacuaaugaaauuagcacuuaaucagggaaaaguccaccaugaaaugcaggcuuuagagaaagaaguagagaagagagac

SEQ ID NO: 118283 - RNA, 47 nt, Mus musculus
uagaaaugcuugcaauuucaagaaaucagaagcuguuacagcuggaa

SEQ ID NO: 118284 - RNA, 45 nt, Mus musculus
ggguuaacaauuuagaagaccaguuugugaggauacauccuauuu

SEQ ID NO: 118285 - RNA, 45 nt, Mus musculus
ccagcugcuucaggaaaaccacucuauugccccuguggcacccaa

SEQ ID NO: 118286 - RNA, 52 nt, Mus musculus
gggcuuggcagccgaguauuucccuuuguacaaggccuuccuggaguacaua

SEQ ID NO: 118287 - RNA, 85 nt, Mus musculus
cuuaaagcaucaaggucagagggauacucagggguccccaccauuucagaggaaaaggggagaugugauugggaaaaaacucugu

SEQ ID NO: 118288 - RNA, 44 nt, Mus musculus
gaaggugaaugcauuguucuaacacagccuucugucauguaggu

SEQ ID NO: 118289 - RNA, 46 nt, Mus musculus
cagcaggcacaaaaccugugcaagcucaaacuagacaaaaucguag

SEQ ID NO: 118290 - RNA, 45 nt, Mus musculus
accuguaacauuaaauaguaugugccacacagcauuuucugcuag

SEQ ID NO: 118291 - RNA, 45 nt, Mus musculus
agagagagagagagagagagagagagagagagaaagaugggcuga

SEQ ID NO: 118292 - RNA, 45 nt, Mus musculus
ccucuuaaagaugggguagaaguaauggggagaaggcuuuauaag

SEQ ID NO: 118293 - RNA, 30 nt, Mus musculus
cugggcaggaagauaugcaggucagaauaa

SEQ ID NO: 118294 - RNA, 41 nt, Mus musculus
agaaauagaaaggggaaggaagcacacacaugaaguuggga

SEQ ID NO: 118295 - RNA, 42 nt, Mus musculus
guaaucuuuaaacuuggugggugaggggcaugaggcagaaag

SEQ ID NO: 118296 - RNA, 46 nt, Mus musculus
gggguacuguuuaauucauauuguuguuccuccuauaggguugcag

SEQ ID NO: 118297 - RNA, 42 nt, Mus musculus
gaacuauuuuuguauaaauuguuuaaaaauuauuuaugggag

SEQ ID NO: 118298 - RNA, 41 nt, Mus musculus
guucuuugaaaguucuaugccccaguauaggggaaugcaug

SEQ ID NO: 118299 - RNA, 46 nt, Mus musculus
agggacaaagggagaggaaguuggugggaggaauggaaaaaaagag

SEQ ID NO: 118300 - RNA, 46 nt, Mus musculus
uuauccagcagauagccaucugcucgccauucugacaagccuccau

SEQ ID NO: 118301 - RNA, 25 nt, Mus musculus
acaaaagagagagaggaggaaagcu

SEQ ID NO: 118302 - RNA, 45 nt, Mus musculus
ccagagcaaguaaagccaggugucuuuccaggcucagauggccca

SEQ ID NO: 118303 - RNA, 46 nt, Mus musculus
aaagaaagaaagaaagaaagaaagaaagaaagaaagaaauuaggua

SEQ ID NO: 118304 - RNA, 45 nt, Mus musculus
gagaaacccugucucgaaaaaccaaaaaaaaaaaaaagagagaga

SEQ ID NO: 118305 - RNA, 46 nt, Mus musculus
ggaauccugaucucuaguuuuuccagagcacuuugaaaguacggcg

SEQ ID NO: 118306 - RNA, 46 nt, Mus musculus
ccagggcagagccucuaaagcugggaggaaagccuccaguacccag

SEQ ID NO: 118307 - RNA, 46 nt, Mus musculus
aacagcuagugaggaguuauuuggugacaaaaaugcaaucagcuau

SEQ ID NO: 118308 - RNA, 46 nt, Mus musculus
cuaauguuaaggccuccagagcuagauucauucaggaugcaucauu

SEQ ID NO: 118309 - RNA, 46 nt, Mus musculus
agaugauauuaggagaauaauagagaauaagacauuaugccccucu

SEQ ID NO: 118310 - RNA, 46 nt, Mus musculus
uaaccaacauugauuuuuuuuucuaauuuaaaaauaggggcuugag

SEQ ID NO: 118311 - RNA, 46 nt, Mus musculus
ugguaaauauagguucuaagcugucuuagagucaagaagggccaag

SEQ ID NO: 118312 - RNA, 103 nt, Mus musculus
aacaaaggaagauaacucugauaauauuauugauagugaugauggcuaauguuaaaaaaaaagcagccagcaacuccaaggcugcaaacaggaaaacgaagua

SEQ ID NO: 118313 - RNA, 120 nt, Mus musculus
gggaaaaggaaggauuuaggauuuucaugguuaggagauggaaagggauggaaauaaauguuaauagaaugaauaaaaagaguccauuaaaugagaaaagaaaauagaagcauggccaga

SEQ ID NO: 118314 - RNA, 48 nt, Mus musculus
caaaacaacaaaaaacaaaaauaacaacaaaaaacaaggagauggagc

SEQ ID NO: 118315 - RNA, 70 nt, Mus musculus
ggaagggguccaugaagaauggaaaugaaggcuuacagcauggggcaaggaagguaauacaugguaugca

SEQ ID NO: 118316 - RNA, 46 nt, Mus musculus
uaggggugagagaauauacagcagaaaacaaaauagaauuggagaa

SEQ ID NO: 118317 - RNA, 41 nt, Mus musculus
aaacauuauaugccccaguacaggggaauaccagggccaaa

SEQ ID NO: 118318 - RNA, 24 nt, Mus musculus
uuuucaaucacaugcaaacaggaa

SEQ ID NO: 118319 - RNA, 46 nt, Mus musculus
uguguguacaggcaguugccuaagaaggccagaagcagugcaucag

SEQ ID NO: 118320 - RNA, 42 nt, Mus musculus
auaguggagacagaaaaagcuguuacauguacuguccaauga

SEQ ID NO: 118321 - RNA, 46 nt, Mus musculus
gcucuaugguaguggauccaacaaugagaggaagacuguggcagca

SEQ ID NO: 118322 - RNA, 49 nt, Mus musculus
uguuuuaagaaagcaaagcagcccccccccccaaaaaaaaggaagaaag

SEQ ID NO: 118323 - RNA, 46 nt, Mus musculus
agccaagcacgguagcucauaccuaccauucuagcacuuaggagac

SEQ ID NO: 118324 - RNA, 44 nt, Mus musculus
cuggaagagaguugaaaaagauguaaacaaagcaaagagacaga

SEQ ID NO: 118325 - RNA, 25 nt, Mus musculus
augcagccccagccccuugucuaag

SEQ ID NO: 118326 - RNA, 41 nt, Mus musculus
gaaucccaacauuacauuccaaagguaacgaugccccuaag

SEQ ID NO: 118327 - RNA, 41 nt, Mus musculus
aagauucucagcucuguacauagaagcauuaauggucugua

SEQ ID NO: 118328 - RNA, 46 nt, Mus musculus
ccuaaccaaggcuagacccugcccugcccugcccccaccucgagcc

SEQ ID NO: 118329 - RNA, 42 nt, Mus musculus
gcuccggccauucccgccgacccugccuguggcugcccccuu

SEQ ID NO: 118330 - RNA, 42 nt, Mus musculus
gaggaggcagaaauaaaguuggugugccggucuugugcggag

SEQ ID NO: 118331 - RNA, 111 nt, Mus musculus
gcacguaguuuagguccguaaagaguuugcaugggguuauugacuuguaucaucaucggugugugcuuuaccugaaguuaggugauuuguuuacuuuuuggaucuuucugc

SEQ ID NO: 118332 - RNA, 85 nt, Mus musculus
gagcuugguuuccugugagucugucaggagcaguuggggaggauucuggguguagucucuuguuuauuugugugcaaaguuguug

SEQ ID NO: 118333 - RNA, 47 nt, Mus musculus
ggagguuugggggagggaggagagguaaacagggaaauaaauaguau

SEQ ID NO: 118334 - RNA, 40 nt, Mus musculus
cucuggaauuauauaaauauaaauaguuguuagcccccuc

SEQ ID NO: 118335 - RNA, 46 nt, Mus musculus
guguguacacacaccuguauauaguguuuaaauuuaagggccauuu

SEQ ID NO: 118336 - RNA, 46 nt, Mus musculus
uaauucauuuggaaauuuaggcuaaauuuauuccuuuugguuacag

SEQ ID NO: 118337 - RNA, 45 nt, Mus musculus
aaaaaaucuucauugauucuggcuucuuagggucuagcuacuuag

SEQ ID NO: 118338 - RNA, 46 nt, Mus musculus
gaguguuaaauuauuaaguuuuauccauccucuaacuguccugaga

SEQ ID NO: 118339 - RNA, 46 nt, Mus musculus
agaugauuuuuuuuucuggacucugcauacuuuuguaaggcucgau

SEQ ID NO: 118340 - RNA, 45 nt, Mus musculus
ugaaaacuuuugggguauauaguuuuuaauuagguaaggauuuga

SEQ ID NO: 118341 - RNA, 46 nt, Mus musculus
auugacucucuucuucacaugguuguuaaaaacugguucagaggua

SEQ ID NO: 118342 - RNA, 53 nt, Mus musculus
uauugguuuguaaguuaugacaguaauauuugaauucacaucaagcucagcug

SEQ ID NO: 118343 - RNA, 45 nt, Mus musculus
gacuauuucugaacuuggugguggucuuuugguggagaaauggua

SEQ ID NO: 118344 - RNA, 47 nt, Mus musculus
caacuuuucuuauguucuccuucccaccuuugaguuucauggccagu

SEQ ID NO: 118345 - RNA, 45 nt, Mus musculus
uugcuucagugauuugugaaccauuuguuguauuguugggaggau

SEQ ID NO: 118346 - RNA, 46 nt, Mus musculus
agagggaaaauaguguuuucaugucauggaagguacucaguacaag

SEQ ID NO: 118347 - RNA, 42 nt, Mus musculus
uucugaguuccaggccagccugguguacaaagugagugccag

SEQ ID NO: 118348 - RNA, 104 nt, Mus musculus
guaaaacaaucuuguuuaggggaaugaaaacauguggcuuguuauuucucauacaugauagccucuaacauuucaggaaguaucuguccuuggacaaggggcuu

SEQ ID NO: 118349 - RNA, 94 nt, Mus musculus
ucucaauuuuaggauuuauugcauccuuuccuuauagggccccuaguuuucaucugcuagaagaaacaacaacaaaguguguguuguuuugaag

SEQ ID NO: 118350 - RNA, 48 nt, Mus musculus
auuaauaggacuuugccaugguagccagccaauuguaccaucuguuaa

SEQ ID NO: 118351 - RNA, 46 nt, Mus musculus
ugguuuacaaaguaaauuucuggacuacacagagaaaccggccguc

SEQ ID NO: 118352 - RNA, 46 nt, Mus musculus
auauauauauauauauauauauauaugccauaguguacguguggag

SEQ ID NO: 118353 - RNA, 41 nt, Mus musculus
acuauucaccaugaaugugcuuggugcccaagaaggccaga

SEQ ID NO: 118354 - RNA, 45 nt, Mus musculus
uuuuaaaguuuuuugcacacucccccaccccccgggcuuuaugug

SEQ ID NO: 118355 - RNA, 46 nt, Mus musculus
uuucuaagaaacaacaacaaaauguaacaaaauaaaauacaguaag

SEQ ID NO: 118356 - RNA, 45 nt, Mus musculus
gguguccuccauccccucuguaauuuuuaaaaaauggguuguaac

SEQ ID NO: 118357 - RNA, 46 nt, Mus musculus
acuggcucucugauaacaguaucacuuuucaguccuuuagccccuu

SEQ ID NO: 118358 - RNA, 46 nt, Mus musculus
cuuagcugcuuagacugucaaagcugguuaagugauuuacuuguag

SEQ ID NO: 118359 - RNA, 46 nt, Mus musculus
gugcacaugcccaugaaugugccauaggacaugugaaagaccagaa

SEQ ID NO: 118360 - RNA, 46 nt, Mus musculus
uccacuggcuggcuuuugcacuaauuuuucuuagcaguaaaucuag

SEQ ID NO: 118361 - RNA, 40 nt, Mus musculus
aucuuuugauuuucuaaaugguaugaacaguguuagaaga

SEQ ID NO: 118362 - RNA, 45 nt, Mus musculus
uauuuucuuuuuuucuccuuaauuccucuggauccuuagggugug

SEQ ID NO: 118363 - RNA, 45 nt, Mus musculus
cauaacagguaccccguauguaguuguuauauuauugguaacuug

SEQ ID NO: 118364 - RNA, 42 nt, Mus musculus
cuagacacaagugaaggcaaaaugagccagagaaggagccag

SEQ ID NO: 118365 - RNA, 41 nt, Mus musculus
aagcaguacagaaccauuuguaguuuaaguuacaggugggc

SEQ ID NO: 118366 - RNA, 48 nt, Mus musculus
gaugguuuucaagaguaagauggaggcaggcugguuuagcaaaaggaa

SEQ ID NO: 118367 - RNA, 92 nt, Mus musculus
uaaguaaguguuguguuuguuuggacagaucacacaguuccacgggagagacuuauuguaggguaaaaaggacaaaagggggcgaagaaaau

SEQ ID NO: 118368 - RNA, 42 nt, Mus musculus
ucucuguggacagcgacugguaguccuguaacaggaacugau

SEQ ID NO: 118369 - RNA, 78 nt, Mus musculus
aauauuuacauauuuacuauauuuccuuuguuucuuuauuguguagaucucaauuuccaucuuguauuaucuucuguc

SEQ ID NO: 118370 - RNA, 46 nt, Mus musculus
uaaaagguuuuugcuugguauacaguuauugauuguuaugcccaag

SEQ ID NO: 118371 - RNA, 42 nt, Mus musculus
cucgggagcaagguuucucaaagucccagcaagucagaguga

SEQ ID NO: 118372 - RNA, 45 nt, Mus musculus
aucagguuaucucuugauccugcuauuguagccuagcuauugcug

SEQ ID NO: 118373 - RNA, 46 nt, Mus musculus
aucaugcuugugcuuuuauucaauuaacaaucucucuagccccuuc

SEQ ID NO: 118374 - RNA, 41 nt, Mus musculus
gcucuuggccuauccacauuucuagcucccuuuucagccag

SEQ ID NO: 118375 - RNA, 46 nt, Mus musculus
gguuucuauugcuggcuaaaacacugaccuaaaacaguguggggag

SEQ ID NO: 118376 - RNA, 46 nt, Mus musculus
aauaaagacaagaguuauuaccauugcaagugcuaugagaagccag

SEQ ID NO: 118377 - RNA, 45 nt, Mus musculus
uaauuucaaccauguuggucccaaggguugaucuuagguugccag

SEQ ID NO: 118378 - RNA, 46 nt, Mus musculus
aaaacgucuguugcuucuguauaaaacaauuaacuagcaugcugac

SEQ ID NO: 118379 - RNA, 46 nt, Mus musculus
uuuccuggagagagagagagagagagagagagagagagagagaaug

SEQ ID NO: 118380 - RNA, 42 nt, Mus musculus
uguaacaucaguugaagcuggcaacuuauuuaaagcagacua

SEQ ID NO: 118381 - RNA, 40 nt, Mus musculus
gacucucugucauuuagugaccuuaguuaccacuaaaccg

SEQ ID NO: 118382 - RNA, 45 nt, Mus musculus
uguguuugcacauaugugcaugcacauguuaugacauggguguga

SEQ ID NO: 118383 - RNA, 46 nt, Mus musculus
uagcugcaccacuugggaggcagaggcaggagaauugcuguaagag

SEQ ID NO: 118384 - RNA, 45 nt, Mus musculus
aaaaccaacaaaacaaaacaaaacagaaaaaaguuggucugugaa

SEQ ID NO: 118385 - RNA, 46 nt, Mus musculus
acaaaggaaagagaaagagagaggaagaaaaagaaaucaguggcau

SEQ ID NO: 118386 - RNA, 46 nt, Mus musculus
uucaccuucucucuuuucccccucuuguuccuccuuagaccccaag

SEQ ID NO: 118387 - RNA, 46 nt, Mus musculus
cucuuccuagauaguaaucucuacccaggucgagagaugaacacag

SEQ ID NO: 118388 - RNA, 45 nt, Mus musculus
agaaccccaacaggcuaggcuaggucuuaauccauuaguuaccag

SEQ ID NO: 118389 - RNA, 45 nt, Mus musculus
gucugucuuucugacaugaagcuaagguugcacuagagggcaaga

SEQ ID NO: 118390 - RNA, 46 nt, Mus musculus
gaggaaaccaaucugcuaucuacaacaugauuaguuuagcaaggau

SEQ ID NO: 118391 - RNA, 46 nt, Mus musculus
uuauucuguaauaguuuuccaaauuuuauuuuucuagagcauccua

SEQ ID NO: 118392 - RNA, 46 nt, Mus musculus
uuguugacauuuuauugaccagagaugaucugaucgcaugugaaau

SEQ ID NO: 118393 - RNA, 46 nt, Mus musculus
uuaacauacucucuuguaugagauggggagggagagagauacugag

SEQ ID NO: 118394 - RNA, 51 nt, Mus musculus
ugcucuguauuaagugaacagcauagaaagcaucacauggagaagaagaca

SEQ ID NO: 118395 - RNA, 46 nt, Mus musculus
uacaggugguugugugccaccaugugguugcugggaauugaacuca

SEQ ID NO: 118396 - RNA, 45 nt, Mus musculus
gcagcucagugguauagugcuuagcugguauuuaugaagccccaa

SEQ ID NO: 118397 - RNA, 46 nt, Mus musculus
aaccaucuugucuaaucaaaaugucuugccauuuucaagccuggag

SEQ ID NO: 118398 - RNA, 46 nt, Mus musculus
aaauggauuuuuauaguauauauuuaaauuguuucauaguguugcg

SEQ ID NO: 118399 - RNA, 46 nt, Mus musculus
gaguaccuuuucugcuaugucauauauuacauuuuuuauuugagag

SEQ ID NO: 118400 - RNA, 44 nt, Mus musculus
uagagcaagaugacuuggaggaauguucuacacuguugccagag

SEQ ID NO: 118401 - RNA, 46 nt, Mus musculus
gcuggcuucacaucaccauaccuuccuuuacaucaauccacccuga

SEQ ID NO: 118402 - RNA, 46 nt, Mus musculus
uauaauaguggauuuagaaggaagcuaaaaaaugaagauauucuag

SEQ ID NO: 118403 - RNA, 41 nt, Mus musculus
uagcaagggcugaccuugaauuucuauuuauccugccccua

SEQ ID NO: 118404 - RNA, 46 nt, Mus musculus
uuuccgcagaauucucaguccuacuuucuaaccuugaugccucuac

SEQ ID NO: 118405 - RNA, 46 nt, Mus musculus
cuauaauguuugcuaaguuuuguugcauacuauuaugauuccuaag

SEQ ID NO: 118406 - RNA, 46 nt, Mus musculus
gcuaauuagauauguuaccuuauguauuuuaaaauuuccuccuggg

SEQ ID NO: 118407 - RNA, 46 nt, Mus musculus
gacucacagcuucucagcuaggcuggaaacuacuaagcugcagcag

SEQ ID NO: 118408 - RNA, 46 nt, Mus musculus
acauggcacuuuaccagguauugguaugacuuaaaugauuagauag

SEQ ID NO: 118409 - RNA, 46 nt, Mus musculus
uaugaugccauugcugacugcuuucuauauguucccccgcccccau

SEQ ID NO: 118410 - RNA, 46 nt, Mus musculus
ucuacauuucucuucagaauuguaguuuuuaacuaauggaccauug

SEQ ID NO: 118411 - RNA, 45 nt, Mus musculus
caguuagcuuugguugacuguaaucccugcacuuuguccaaugcu

SEQ ID NO: 118412 - RNA, 46 nt, Mus musculus
uuuuaaagagaaaagggaagggagagauggaggggaaagacagagg

SEQ ID NO: 118413 - RNA, 48 nt, Mus musculus
ccaguuuuuauucuugguuugcuuucauacaugggugauagaauauca

SEQ ID NO: 118414 - RNA, 46 nt, Mus musculus
uugcccacuuauaugaaacccaggugaguguuuuaauuuacccaag

SEQ ID NO: 118415 - RNA, 46 nt, Mus musculus
caggaacaacugagagcacacaucuccaaacauaaagaggauccag

SEQ ID NO: 118416 - RNA, 46 nt, Mus musculus
uuacaggguguuuugaucauauuuacccuucucucaacgccucagg

SEQ ID NO: 118417 - RNA, 42 nt, Mus musculus
cuuuuauaaggggguugcacuaaauuaaugguucuugggaga

SEQ ID NO: 118418 - RNA, 46 nt, Mus musculus
uuuauaucuuacaggcaaucuauugauaaaucagaagcaagugcag

SEQ ID NO: 118419 - RNA, 44 nt, Mus musculus
auuuaauauggaaucuaguggacaguaugguauauaggcuagca

SEQ ID NO: 118420 - RNA, 42 nt, Mus musculus
aauaaauaguuucuuguguuugaaguuggcaucagaucagag

SEQ ID NO: 118421 - RNA, 42 nt, Mus musculus
uguauauacuuucuguccuggauaauuuccgcagauagacaa

SEQ ID NO: 118422 - RNA, 42 nt, Mus musculus
uuuuuaaaccccaagacgauuucuaacuuauacuggccccag

SEQ ID NO: 118423 - RNA, 46 nt, Mus musculus
acuaacaagacaagaguaaaggauuaaggugugagguauugggcau

SEQ ID NO: 118424 - RNA, 46 nt, Mus musculus
caggaagaauucaaguucaggguauccaugacuaugacauagccag

SEQ ID NO: 118425 - RNA, 45 nt, Mus musculus
caaaauuaaucacagagugaaguguuugacgauuugucugaucaa

SEQ ID NO: 118426 - RNA, 45 nt, Mus musculus
ucaaggccuagaaaagccuauuugcuugauuuugaacaaagucug

SEQ ID NO: 118427 - RNA, 45 nt, Mus musculus
auaugaaauuaaacuuuauuuuauagaguuugcuacuuauuugga

SEQ ID NO: 118428 - RNA, 40 nt, Mus musculus
agcuauauuaugucccaaaaguuauaagcaauguggaaag

SEQ ID NO: 118429 - RNA, 46 nt, Mus musculus
ggccugucuaauaguagcauucuguuggauaaauguccgccuccaa

SEQ ID NO: 118430 - RNA, 41 nt, Mus musculus
ugggagcugugucugggagugcagggaggccuguggcagga

SEQ ID NO: 118431 - RNA, 128 nt, Mus musculus
ccaccugcuccauugcuccagcaaugaugagaagagacaggccaugguuuuaagguguuuauuguagaaaggcagagagagggagauaguacggaaguagagcccggcuauggcuagauggggaagag

SEQ ID NO: 118432 - RNA, 47 nt, Mus musculus
aggcaggaccaagagaguaagagaaacaagagaauaagaaagagaug

SEQ ID NO: 118433 - RNA, 46 nt, Mus musculus
ucacucuguuuuguacacaugcuaaaagaaauaccuucaauggcag

SEQ ID NO: 118434 - RNA, 46 nt, Mus musculus
uguagauauuuacguaccuacaggaauaauguugcaucaagaacau

SEQ ID NO: 118435 - RNA, 42 nt, Mus musculus
uuuggucaagaggacucacucugucacucuagcuagccugaa

SEQ ID NO: 118436 - RNA, 46 nt, Mus musculus
ggucauacuauacugggcaugaacacaguucaacuauacaugaaag

SEQ ID NO: 118437 - RNA, 46 nt, Mus musculus
cauaacaauuucaaaagauauuuuucauauacuauauuauccuuag

SEQ ID NO: 118438 - RNA, 46 nt, Mus musculus
cauaugaggggaggauccccuauuuugccuuuucuuucccucuuga

SEQ ID NO: 118439 - RNA, 48 nt, Mus musculus
ggaaaaaaaccaaaaaccaaacaacaaccaacaacaaacaaaaaccca

SEQ ID NO: 118440 - RNA, 41 nt, Mus musculus
aaauaacaacuucuguucaguuaauauaaauauuggcccag

SEQ ID NO: 118441 - RNA, 46 nt, Mus musculus
uucauccucugucauuuagugauuucaagguacugcaagaauagaa

SEQ ID NO: 118442 - RNA, 46 nt, Mus musculus
uauaaaaguuaaauguuagcuaacuauugaaaguccaaagcccuag

SEQ ID NO: 118443 - RNA, 45 nt, Mus musculus
acucuaaauauauacauguauauccuuacucucugacaacuguuu

SEQ ID NO: 118444 - RNA, 69 nt, Mus musculus
acgcugaagcaaugucagacauugagggaagcucuaauugcugcaggaaaagagaucauauggcacggg

SEQ ID NO: 118445 - RNA, 43 nt, Mus musculus
cuaucuuugaagaaguuuaaggauaaauuacagaugggggcau

SEQ ID NO: 118446 - RNA, 46 nt, Mus musculus
uauaucugacaaaacuggcaacaucauaaagacuacugacuugaag

SEQ ID NO: 118447 - RNA, 46 nt, Mus musculus
aauaaaacauuuaaaaaaaauaauuaacagcaacgucacaaagaua

SEQ ID NO: 118448 - RNA, 41 nt, Mus musculus
ucccaggauucugcgcggugccguucuuccugucccagcca

SEQ ID NO: 118449 - RNA, 46 nt, Mus musculus
cagguugacauaagaggccucugugaguggcugcuggucagcccug

SEQ ID NO: 118450 - RNA, 45 nt, Mus musculus
accagcagccacucacagaggccucuuaugucaaccugcccacca

SEQ ID NO: 118451 - RNA, 45 nt, Mus musculus; identical to SEQ ID NO: 26610

SEQ ID NO: 118452 - RNA, 43 nt, Mus musculus
uagaaguaaagaucgggcaugaccucccaggggugcucacggg

SEQ ID NO: 118453 - RNA, 61 nt, Mus musculus
uaucucccgugagcaccccugggaggucaugcccgaucuuuacuucuacagagacccagag

SEQ ID NO: 118454 - RNA, 60 nt, Mus musculus
gcugcucagccugagguggccgacuggucugagggugugcagguucccucugugcccauc

SEQ ID NO: 118455 - RNA, 46 nt, Mus musculus
ugagugaguugaagccaccacugagugguccugagcugcugugcag

SEQ ID NO: 118456 - RNA, 45 nt, Mus musculus
ccaagacccuuaggccgcaccaugggcugcugcuucacuaagagg

SEQ ID NO: 118457 - RNA, 46 nt, Mus musculus
auuuguuugaguguagacccacacaugccuugcuccucuugcccau

SEQ ID NO: 118458 - RNA, 45 nt, Mus musculus
auuauuuuagcauuuaauugcaauacaguuaacauuccauggcag

SEQ ID NO: 118459 - RNA, 45 nt, Mus musculus
acacacacacacuuacagucuuuugagacaagcaaguguccuggg

SEQ ID NO: 118460 - RNA, 48 nt, Mus musculus
ugagaucugacgcccucuucugaugcgucugaagacagcuacagugua

SEQ ID NO: 118461 - RNA, 42 nt, Mus musculus
ccauugaugacugcacuaacuguguaauuuuuuugggaccag

SEQ ID NO: 118462 - RNA, 45 nt, Mus musculus
uccacagaagccaauagaagcauuguuccugugucccggggucag

SEQ ID NO: 118463 - RNA, 46 nt, Mus musculus
auuuuauucuccacagaugguugguaaaggcuucucccuagugcag

SEQ ID NO: 118464 - RNA, 34 nt, Mus musculus
gacgcccaaaggguuuuccaggaaaaggcaucag

SEQ ID NO: 118465 - RNA, 46 nt, Mus musculus
acuucucaugaaaaaguagaauguuuuaguaagugaaugccaccag

SEQ ID NO: 118466 - RNA, 45 nt, Mus musculus
aggccagcugcuucagguggucagagcagccaauggugcccagug

SEQ ID NO: 118467 - RNA, 46 nt, Mus musculus
gaguggaggaacagguccugauggaacuaaaaacuuugugagagaa

SEQ ID NO: 118468 - RNA, 49 nt, Mus musculus
guauuuguguuugccgaguuugcaauuuccacacacaacacaaacaagg

SEQ ID NO: 118469 - RNA, 42 nt, Mus musculus
uucaggaaauaaacaucauacaaaccagucuuuaaaggagag

SEQ ID NO: 118470 - RNA, 45 nt, Mus musculus
uguggaagaggcgaggcuugagugaagugguacucugugugcuug

SEQ ID NO: 118471 - RNA, 45 nt, Mus musculus
gagagagagagagagagggagagagagagagagagagagacauuu

SEQ ID NO: 118472 - RNA, 46 nt, Mus musculus
uggcagguaauguauaguccucaaggccuaaaauauuuuuuaucug

SEQ ID NO: 118473 - RNA, 44 nt, Mus musculus
gaaggaggagaaagaaaaaggaggagaaagagaaaacggagaag

SEQ ID NO: 118474 - RNA, 46 nt, Mus musculus
ggaggagaaggaggaggaggagcaggaggaggaggaggaggagaag

SEQ ID NO: 118475 - RNA, 41 nt, Mus musculus
agcaguucucgccggagcuuggaagucucucuguggagguc

SEQ ID NO: 118476 - RNA, 73 nt, Mus musculus
ccaagaaaugcuccgagaaauggaagaccaugucugcaaaggaaaaguccaaguuugaagauuuggccaagag

SEQ ID NO: 118477 - RNA, 46 nt, Mus musculus
uaugacagggagaugaagaacuauguuccucccaaaggugauaaga

SEQ ID NO: 118478 - RNA, 44 nt, Mus musculus
agaaacaaccgugugagcagaaagcagcuaaacuaaaggagaag

SEQ ID NO: 118479 - RNA, 79 nt, Mus musculus
gauccugguaggccaacagacucaaagaagaagaaugaaccagaagaugaggaagaagaggagaaggaagagaggagaa

SEQ ID NO: 118480 - RNA, 46 nt, Mus musculus
aauaaguggcugucugaaaguguggaguauaugugcucaggcaauu

SEQ ID NO: 118481 - RNA, 46 nt, Mus musculus
auuuuaaaaaggcucuuaaaaaauuaacugaagcaaacaacuuaag

SEQ ID NO: 118482 - RNA, 46 nt, Mus musculus
uuuaaguuuuagaaccuuuuuuuccacauuuacauuuggcuuugag

SEQ ID NO: 118483 - RNA, 46 nt, Mus musculus
auggauauggaucuacucguagguguugaaagggugaugugguggg

SEQ ID NO: 118484 - RNA, 46 nt, Mus musculus
aaguagagaaaggauuuuaaucagggauaagagauugguuagagau

SEQ ID NO: 118485 - RNA, 59 nt, Mus musculus
ucauuuggaaagaaagucaaaaucuuggauggggagauggugaugaauucaguggugau

SEQ ID NO: 118486 - RNA, 58 nt, Mus musculus
guaaucgccccauccgguguggagaaaaagcggcaacgagaaccgaccaugcaguggc

SEQ ID NO: 118487 - RNA, 45 nt, Mus musculus
aguccgcaccucgccgaacucguaaacaaacuuaggccggggauc

SEQ ID NO: 118488 - RNA, 46 nt, Mus musculus
cgaagaaaaugaacagaccucucaaaaacaacucucucccagacua

SEQ ID NO: 118489 - RNA, 46 nt, Mus musculus
aaaucccagccaccacaugguggcucacaaccaccuguaaugagau

SEQ ID NO: 118490 - RNA, 46 nt, Mus musculus
cgcagauuuauaccccuuggaagcagggcuuaggggggacuugggg

SEQ ID NO: 118491 - RNA, 42 nt, Mus musculus
agaggagaggagaggagaggagaggagaggagagggcgcgca

SEQ ID NO: 118492 - RNA, 46 nt, Mus musculus
gaauguucuuuaauacauccaagaagaaagaaagaaagagagagaa

SEQ ID NO: 118493 - RNA, 42 nt, Mus musculus
ggggaggggaggggaggggagaggagaggggaggggagagga

SEQ ID NO: 118494 - RNA, 42 nt, Mus musculus
gagaucugacgcccucuucuggugugucugaagccagcuaca

SEQ ID NO: 118495 - RNA, 42 nt, Mus musculus
gagcccaaggccggaacaaaacccugagccccacccccagaa

SEQ ID NO: 118496 - RNA, 56 nt, Mus musculus
ggaggguggcagggaagaccacaaccaccgcggucggggaaggagaaggcgacagu

SEQ ID NO: 118497 - RNA, 42 nt, Mus musculus
ugucgccuucuccuuccccgaccgcggugguuguggucuucc

SEQ ID NO: 118498 - RNA, 46 nt, Mus musculus
ccccuaucucagcuucuggagacuucuggcucagcacuauuaccag

SEQ ID NO: 118499 - RNA, 45 nt, Mus musculus
augaaagccguccauacuugugugcuauuugaagaccugccccaa

SEQ ID NO: 118500 - RNA, 46 nt, Mus musculus
acugggguuacgauggcugauggagaagacaacaaugcuucaagaa

SEQ ID NO: 118501 - RNA, 46 nt, Mus musculus
uugcguagaucuaaacagguaccacagcugcugacaggguagagaa

SEQ ID NO: 118502 - RNA, 45 nt, Mus musculus
cuuugcuuuuuuguauuuuguuuuuauggauuuauuuuuggaugg

SEQ ID NO: 118503 - RNA, 44 nt, Mus musculus
acaugguggcucacaaccaucuguaacaaucugaugcucucuuc

SEQ ID NO: 118504 - RNA, 41 nt, Mus musculus
uugugccaccaugugguugcugggauuugaacucacuaccu

SEQ ID NO: 118505 - RNA, 46 nt, Mus musculus
gaggaggacauugguaaaaaucgagcggagguaucccagccccgac

SEQ ID NO: 118506 - RNA, 45 nt, Mus musculus
ugucuuuggcaucaagcauuaugcgugagagcagagaagaugcag

SEQ ID NO: 118507 - RNA, 27 nt, Mus musculus
accauuuugagaacuacuaacaguagu

SEQ ID NO: 118508 - RNA, 42 nt, Mus musculus
uggugguccucaccaacagcccccuggaagcccagcugcgag

SEQ ID NO: 118509 - RNA, 45 nt, Mus musculus
gaaguacagggcaugauccaacucaauggaugucagcccauggag

SEQ ID NO: 118510 - RNA, 67 nt, Mus musculus
uccguggaggcaucgucagucaggucaaaguaccgaaaaagauuaguuuugugaguauugggggcag

SEQ ID NO: 118511 - RNA, 43 nt, Mus musculus
cuuugugaugacugacuuugccaaguauucucgcccugcccaa

SEQ ID NO: 118512 - RNA, 41 nt, Mus musculus
gugcucugcacaaccaaccaccucgaccacgaaaugaggua

SEQ ID NO: 118513 - RNA, 46 nt, Mus musculus
gguccccaccuucaguaaaacagaacagcuuggaugaagaccuuau

SEQ ID NO: 118514 - RNA, 54 nt, Mus musculus
gggccauuggcugugaauugcucaagaacuuugccaugauugggcuggguugug

SEQ ID NO: 118515 - RNA, 42 nt, Mus musculus
cccagcaaccacauguuggcucacaaccacccauaaugagau

SEQ ID NO: 118516 - RNA, 44 nt, Mus musculus
cccuaaguggcgauaagagccagggaaagguucuaagcauagga

SEQ ID NO: 118517 - RNA, 42 nt, Mus musculus
cagaugaauccuuacauccaggugacaagccaccagaaccgu

SEQ ID NO: 118518 - RNA, 73 nt, Mus musculus
gcgcaucuaugaugaugauuucuuccaaaauuuggaugguguggccaaugcucuggacaacauagaugcccgu

SEQ ID NO: 118519 - RNA, 72 nt, Mus musculus
cuaucggaagccacugcuagagucuggcacacugggcacaaagggcaacgugcaggugguaauccccuuccu

SEQ ID NO: 118520 - RNA, 82 nt, Mus musculus
gacagaauccuacagcucuagccaggauccaccagagaaauccauccccauuuguacccugaaaaacuuucccaaugccauc

SEQ ID NO: 118521 - RNA, 42 nt, Mus musculus
uggcaugcaccuuuaaucucaguacugaaguggcagaggcag

SEQ ID NO: 118522 - RNA, 42 nt, Mus musculus
uccucagaaguuccuagagacuuagauaggaauuacuauugg

SEQ ID NO: 118523 - RNA, 32 nt, Mus musculus
ugaaaaggccuucaaauucaucccgggcccac

SEQ ID NO: 118524 - RNA, 73 nt, Mus musculus
gccugcagugggcccgggaugaauuugaaggccuuuucaagcagccagcagaaaauguuaaucaguaccucac

SEQ ID NO: 118525 - RNA, 46 nt, Mus musculus
gucuguggucgcugcaacaccaggcugcgcugcacagccuccagca

SEQ ID NO: 118526 - RNA, 46 nt, Mus musculus
ggcugugcagcgcagccugguguugcagcgaccacagacuugggga

SEQ ID NO: 118527 - RNA, 45 nt, Mus musculus
ggguguggacagcguuuggguccagaccagaaaggggccccugag

SEQ ID NO: 118528 - RNA, 46 nt, Mus musculus
ucaggggccccuuucuggucuggacccaaacgcuguccacacccac

SEQ ID NO: 118529 - RNA, 58 nt, Mus musculus
uugcaucuggauuaugugauggcugcugccaaccuuuuugcccagaccuauggguuga

SEQ ID NO: 118530 - RNA, 48 nt, Mus musculus
gacuuguacugacugcaggagugaggccacagcagcucggucuuggga

SEQ ID NO: 118531 - RNA, 75 nt, Mus musculus
cuggaucccaagaccgagcugcuguggccucacuccugcagucaguacaagucccagaguucacccccaagucug

SEQ ID NO: 118532 - RNA, 45 nt, Mus musculus
guauauguguuuacucuaauguuguccaucauaauuuaguccccc

SEQ ID NO: 118533 - RNA, 46 nt, Mus musculus
agaggaacaugaaaaggcagguauuucagaaaaaaagauggggaug

SEQ ID NO: 118534 - RNA, 46 nt, Mus musculus
aagaggagauagagaagauaugaaacgagacaagaugaggacgaga

SEQ ID NO: 118535 - RNA, 46 nt, Mus musculus
gagacacuaggagcagaaaccuuaagaggaaguagagugaucagau

SEQ ID NO: 118536 - RNA, 45 nt, Mus musculus
cgacaaaggguuagucagauaagauuuuggagagauauccuagaa

SEQ ID NO: 118537 - RNA, 46 nt, Mus musculus
ucaucuguacaaaaagaaaaacacagcccuuuagaugcaaacagug

SEQ ID NO: 118538 - RNA, 58 nt, Mus musculus
cuugaggagcucaaagccacauugcccagcccagacaaguuacccggauuuaagaugu

SEQ ID NO: 118539 - RNA, 46 nt, Mus musculus
gcugcauccaaucuucgggccgaaaacuaugauauuuccccugcag

SEQ ID NO: 118540 - RNA, 45 nt, Mus musculus
ugugucggucugcaggggaaauaucauaguuuucggcccgaagau

SEQ ID NO: 118541 - RNA, 46 nt, Mus musculus
cagagcaagcugauugcagggaagaucaucccagccauugccacaa

SEQ ID NO: 118542 - RNA, 46 nt, Mus musculus
gcccuucuuuggguuuucugaaccucuugcugcaccucgucaccag

SEQ ID NO: 118543 - RNA, 46 nt, Mus musculus
cccugccuucccugcccugaugcauucagacccaguuaaguuagau

SEQ ID NO: 118544 - RNA, 41 nt, Mus musculus
gaauagagcauggacacgcccugggacagcauggugaucuc

SEQ ID NO: 118545 - RNA, 28 nt, Mus musculus
uuggcccucuucccuuacccucaccccu

SEQ ID NO: 118546 - RNA, 47 nt, Mus musculus
acguccucgccgcuuucaucguugcagcacagcucaagcaccagugc

SEQ ID NO: 118547 - RNA, 47 nt, Mus musculus
uguccgauauaccauucgcugaucuccgugcauuccccuaagcccca

SEQ ID NO: 118548 - RNA, 47 nt, Mus musculus
aaaggaucugaggagggaggacuggggcuuaggggaaugcacggaga

SEQ ID NO: 118549 - RNA, 50 nt, Mus musculus
uauccuuuuauugggauuuagguuccaaacaagguacaaagcagcgguga

SEQ ID NO: 118550 - RNA, 46 nt, Mus musculus
agggaauguggcguuggcccuggaacggcgccagggggauuuagag

SEQ ID NO: 118551 - RNA, 45 nt, Mus musculus
ucaucugaggauguggcugaagccuggucacucuccccaucagau

SEQ ID NO: 118552 - RNA, 46 nt, Mus musculus
ccaaacugacucggcggaggcgccggcuaagaggcuuaucaaagau

SEQ ID NO: 118553 - RNA, 46 nt, Mus musculus
ugagcuugcuuuugccuuuguagacaguggcauagguacccuggag

SEQ ID NO: 118554 - RNA, 45 nt, Mus musculus
cauguagugugacgauguuggcaugcuugagguccuuaagcaggg

SEQ ID NO: 118555 - RNA, 48 nt, Mus musculus
agcuguuucugggagaacugugcagugagugggugaauggggggcccc

SEQ ID NO: 118556 - RNA, 45 nt, Mus musculus
uagggaauuggguuagagaauaaugcugaggagucaaugggaaga

SEQ ID NO: 118557 - RNA, 42 nt, Mus musculus
acagccagggcuacacagagaaacccugucuugggguggggg

SEQ ID NO: 118558 - RNA, 46 nt, Mus musculus
ccgaauguuggccuccuuuuguagcuguaccuccuuuagugcaaau

SEQ ID NO: 118559 - RNA, 45 nt, Mus musculus
ugcagaugggggcugcccuguaagggguguggcaucccuccagcc

SEQ ID NO: 118560 - RNA, 46 nt, Mus musculus
aaucccuggcuggccaugggguagugguccugggagagagugugau

SEQ ID NO: 118561 - RNA, 59 nt, Mus musculus
gccgggugggggguucggggggagcagaggaaaagaggaggaggggucauaguuucgga

SEQ ID NO: 118562 - RNA, 28 nt, Mus musculus
gcaucagaugcuauuacagaugacugug

SEQ ID NO: 118563 - RNA, 44 nt, Mus musculus
ccugucucaaaagaauagaaaauaaaaauaaacaauggcguugg

SEQ ID NO: 118564 - RNA, 45 nt, Mus musculus
agcaaggcuugcaugcaauaaaccagagguuuaaaggguuaaaau

SEQ ID NO: 118565 - RNA, 46 nt, Mus musculus
aauucagauguaguucaacuuacugauaagaauuugccugagccag

SEQ ID NO: 118566 - RNA, 44 nt, Mus musculus
uauggauaugagaccuauagauuuggaggaccauauuaaaaaug

SEQ ID NO: 118567 - RNA, 41 nt, Mus musculus
cuuaggaaaucccuggaagugguuggugcuuguuuaguugg

SEQ ID NO: 118568 - RNA, 120 nt, Mus musculus
gcacacacacgcacacacacacaaauaugucuucucacaguuuuacuugauacaguguuacuggggaaaugcggacucccauuuggauucuuaauaaaaagaauuucagccaaggcuaca

SEQ ID NO: 118569 - RNA, 46 nt, Mus musculus
aaacaaacaaacacaacaaacaacaacaaaaagaauuuuaaaucag

SEQ ID NO: 118570 - RNA, 46 nt, Mus musculus
ccaccacugccuagcuaugaugucuuuguuuuuaauagcugaauag

SEQ ID NO: 118571 - RNA, 46 nt, Mus musculus
uaggcuaggcuacauagugaggcgcaccccccauuucaaaaaagag

SEQ ID NO: 118572 - RNA, 45 nt, Mus musculus
ggcuguagaaucaggcucuaagaaaauuaaaaaaaaaggaaauga

SEQ ID NO: 118573 - RNA, 46 nt, Mus musculus
gcuguuuguuuggugguccaguguuugagagaucuuggggguccag

SEQ ID NO: 118574 - RNA, 46 nt, Mus musculus
ucauaggucuaggugcugauuucuggauuugucuuuguuugguggg

SEQ ID NO: 118575 - RNA, 42 nt, Mus musculus
gaauggggugggagacagugaagcucugcuauagcacugggg

SEQ ID NO: 118576 - RNA, 45 nt, Mus musculus
gaauugggggcugagauaaaguaacaaguggggagaaagaaauua

SEQ ID NO: 118577 - RNA, 105 nt, Mus musculus
uguaggcagcauauaugguuuucugacaggcauggcuauggguuagcagaggauaucugcuggaguuggaggcucuggucagcaacaagugagggaagggagguc

SEQ ID NO: 118578 - RNA, 69 nt, Mus musculus
gcacaugggguccgugaaggaaagcgugccagaggugugugccagaggaggggaugagacuagggauua

SEQ ID NO: 118579 - RNA, 49 nt, Mus musculus
uagguuagcagugggugccugcuggauuugccugggcaaagugaguugg

SEQ ID NO: 118580 - RNA, 44 nt, Mus musculus
ugcuauagaucucgggaugagacuggaggacugaaccugguggg

SEQ ID NO: 118581 - RNA, 76 nt, Mus musculus
ugccugcugguguuggaggcugggauagugggacaaauuaggggaaggaaguuugggagacaaagucccugugauu

SEQ ID NO: 118582 - RNA, 92 nt, Mus musculus
agcuggggagugggucagaaaggaaagggagaccacaacagguucucugccacagagcugagggugauauugggagucauaucuagaggaac

SEQ ID NO: 118583 - RNA, 45 nt, Mus musculus
agugcugggauuaaaggcgugcgccaccacgcccggcgugagcug

SEQ ID NO: 118584 - RNA, 41 nt, Mus musculus
aaacuacaaagagaaaccuuguuucaaaaaaagaaggaugg

SEQ ID NO: 118585 - RNA, 24 nt, Mus musculus
cugguucauaaaaagugggauuua

SEQ ID NO: 118586 - RNA, 41 nt, Mus musculus
cagcccaucuugaaaacaaucuuaggcaacauggaaccacc

SEQ ID NO: 118587 - RNA, 45 nt, Mus musculus
gucucaaccaggacugcuguguggucuacaggcucaucaaagggu

SEQ ID NO: 118588 - RNA, 46 nt, Mus musculus
ucagucugucaccuuccagaguucaucuguuuuguucuuucaccau

SEQ ID NO: 118589 - RNA, 45 nt, Mus musculus
auuugccucucaccacaugcuuaagaucauggauuaaaucuggga

SEQ ID NO: 118590 - RNA, 32 nt, Mus musculus
uuuuuuucaucugggaagaggggaugagauuu

SEQ ID NO: 118591 - RNA, 46 nt, Mus musculus
aagaauguuuuucuguaagguauaauucaugggagguggaggcaag

SEQ ID NO: 118592 - RNA, 31 nt, Mus musculus
cugccucugcuaaaaacucuacaagggcaag

SEQ ID NO: 118593 - RNA, 45 nt, Mus musculus
uacagcuguugaagaggaucgggacaggcucuuuuggcacugugu

SEQ ID NO: 118594 - RNA, 46 nt, Mus musculus
guguggcagcacaggcuuacaagcucagcacuggagaaacacagau

SEQ ID NO: 118595 - RNA, 42 nt, Mus musculus
agauuuugcugagguccggagacagauagccacggcccacca

SEQ ID NO: 118596 - RNA, 46 nt, Mus musculus
cuggacaccccucuucaucuccacccgcucccagauucuggccacg

SEQ ID NO: 118597 - RNA, 44 nt, Mus musculus
ucccccacuauucaaggacucuccucuuuaccaagaagcacaga

SEQ ID NO: 118598 - RNA, 42 nt, Mus musculus
cucuuggggguucagagccgcugagggguggggcaaguccag

SEQ ID NO: 118599 - RNA, 57 nt, Mus musculus
gaacuuagggguccuagaaguggaaggaacuuccaguauauugaaugggauggagag

SEQ ID NO: 118600 - RNA, 46 nt, Mus musculus
cuugguggaugguagguggcauuugaagauguggaucuccagagag

SEQ ID NO: 118601 - RNA, 41 nt, Mus musculus
gauuuggagguuccaaaagugagaaauggacucaggaccca

SEQ ID NO: 118602 - RNA, 42 nt, Mus musculus
cuuucgccagccucuucuccgacugacaucccacucugagaa

SEQ ID NO: 118603 - RNA, 44 nt, Mus musculus
gccuucaaccuuccagagccagccccucccaggcccagccuuag

SEQ ID NO: 118604 - RNA, 46 nt, Mus musculus
ggucagagacugggauuugcuagagagagacaagguggaggcaugg

SEQ ID NO: 118605 - RNA, 46 nt, Mus musculus
ugaagcugagacugaggcgaauguggggucagcugagaggacuuag

SEQ ID NO: 118606 - RNA, 46 nt, Mus musculus
ucccuaagacuccuuucugguccauugccagauacuccugccacuu

SEQ ID NO: 118607 - RNA, 79 nt, Mus musculus
aguuugaaguggcaggaguaucuggcaauggaccagaaaggagucuuagggaagguuugaggaaaggcugaaaagggaa

SEQ ID NO: 118608 - RNA, 102 nt, Mus musculus
augauggaaggcuugcugcaaauuggccugagggaguucagggcugucugggaggagggugauaauaagagaucagauggacagggaaguacuggaaguagg

SEQ ID NO: 118609 - RNA, 44 nt, Mus musculus
caucugaucucuuauuaucacccuccucccagacagcccugaac

SEQ ID NO: 118610 - RNA, 102 nt, Mus musculus
ucagccaggcuacugggaugggccaaaggucuggaagggggacuuucccagggcuuguaggggaggaaucugaacuggaaguggagaugcugggauucuccc

SEQ ID NO: 118611 - RNA, 45 nt, Mus musculus
cacuguccccaguagggcauccccagaucccaaggaaaaccagau

SEQ ID NO: 118612 - RNA, 47 nt, Mus musculus
aaagguccccuuacuugagcugggggugcgggggucccccggcagcg

SEQ ID NO: 118613 - RNA, 62 nt, Mus musculus
uggccugacgagugggaccagcagggccuggggguuuuuggggagggcccuggcgcugcugc

SEQ ID NO: 118614 - RNA, 42 nt, Mus musculus
gaccagagauagaugccugacggguagccugcggggcccccg

SEQ ID NO: 118615 - RNA, 46 nt, Mus musculus
cacugguguggccugagaggcagacugcugaggugcugcgguggga

SEQ ID NO: 118616 - RNA, 46 nt, Mus musculus
agccgcagcgggaugcuuccccuggcaggggcucccacagccaggu

SEQ ID NO: 118617 - RNA, 45 nt, Mus musculus
uuugggggacuugacaucugcgcaguggaagcgcugcauggcaag

SEQ ID NO: 118618 - RNA, 46 nt, Mus musculus
agagcaguuauuguucuuaaccacugagccaucucuccagccugag

SEQ ID NO: 118619 - RNA, 46 nt, Mus musculus
cgaugauggcggcaggggcugcacaguggagaauaaauguccaugc

SEQ ID NO: 118620 - RNA, 36 nt, Mus musculus
gaacuguugaaguuccaugaaccagacauggcaaag

SEQ ID NO: 118621 - RNA, 48 nt, Mus musculus
cuggaagcuaucagugauagcaacaagaggaugccagaugccagagau

SEQ ID NO: 118622 - RNA, 42 nt, Mus musculus
ggcaucuggcauccucuuguugcuaucacugauagcuuccag

SEQ ID NO: 118623 - RNA, 44 nt, Mus musculus
cguugauuucuggggaacccaugaauuuagcccuuaugacuaga

SEQ ID NO: 118624 - RNA, 71 nt, Mus musculus
aagggcuaaauucauggguuccccagaaaucaacgagaccaccuuauaccagcguuauaagaucaagauga

SEQ ID NO: 118625 - RNA, 62 nt, Mus musculus
ccacaccaacgaaagguuagaugcuucuauuuugaggagaaggaauagguuagguacagcca

SEQ ID NO: 118626 - RNA, 46 nt, Mus musculus
guguggauguuuucuguaaacuugugauuuagauauauugccauca

SEQ ID NO: 118627 - RNA, 45 nt, Mus musculus
acugggguguaggcguaccggauaucugcggcauuucccacagcc

SEQ ID NO: 118628 - RNA, 76 nt, Mus musculus
ugugggaaaugccgcagauauccgguacgccuacaccccagucauggaaagccucuguggauaugcccacaagucc

SEQ ID NO: 118629 - RNA, 46 nt, Mus musculus
gcugagcagggcucagaguacgccagggaaccaagaagcugcaggc

SEQ ID NO: 118630 - RNA, 45 nt, Mus musculus
gccugcagcuucuugguucccuggcguacucugagcccugcucag

SEQ ID NO: 118631 - RNA, 46 nt, Mus musculus
gugauuggguuugggcagcaacuacaacugcauacaauagccagag

SEQ ID NO: 118632 - RNA, 70 nt, Mus musculus
agcgaagguucagggaacaggcaguccagagauaacaaaacaaccaaaauuuccaaaagaacaggcccag

SEQ ID NO: 118633 - RNA, 46 nt, Mus musculus
uccuuugaauucuugcagcuuaugccuggggaagcaaaauccaauc

SEQ ID NO: 118634 - RNA, 39 nt, Mus musculus
uuucccuguuuaucuaucccuugcaaacuggagagugac

SEQ ID NO: 118635 - RNA, 42 nt, Mus musculus
ucugguaguccucagagcccacgaggaccugauccguccaca

SEQ ID NO: 118636 - RNA, 52 nt, Mus musculus
gagaucccuuggggcccgaugaccugaagccuucccccaggaaaaacugaag

SEQ ID NO: 118637 - RNA, 42 nt, Mus musculus
ucuuucucuuagauggugaaauaaagaacuaucagacagcag

SEQ ID NO: 118638 - RNA, 46 nt, Mus musculus
agcuagcuugacuuacaugcagugauccuuucucaaacacacacac

SEQ ID NO: 118639 - RNA, 42 nt, Mus musculus
agccaggugugguggugcaugccuuuaaucccagcaccaggc

SEQ ID NO: 118640 - RNA, 23 nt, Mus musculus
gcuuccacuggaaccaggagcua

SEQ ID NO: 118641 - RNA, 42 nt, Mus musculus
aauaaagggucacagcaggggguugagaguagggacugugaa

SEQ ID NO: 118642 - RNA, 42 nt, Mus musculus
cuuccuuguucacagucccuacucucaacccccugcugugac

SEQ ID NO: 118643 - RNA, 45 nt, Mus musculus
uggcaucuggguuuggugacuguauauaggauggaucccuaggug

SEQ ID NO: 118644 - RNA, 42 nt, Mus musculus
caaaaagaagcagagacagugaacaccuuugccuugcuccug

SEQ ID NO: 118645 - RNA, 46 nt, Mus musculus
uccuucuuucuaucuuuuguuguuguuuuguuuguagagacagagu

SEQ ID NO: 118646 - RNA, 44 nt, Mus musculus
acagcuacaguguacuuacauauaauaaauaaauaaagcuuaac

SEQ ID NO: 118647 - RNA, 46 nt, Mus musculus
cuuacucaggaugauauuuucuaguuccauccauuugccugaaaaa

SEQ ID NO: 118648 - RNA, 44 nt, Mus musculus
aagacucucaggacucaucaauuccuuagaugaaaugcuggaca

SEQ ID NO: 118649 - RNA, 46 nt, Mus musculus
gucagaugcugauauuugcacccaggcaauggacagaagccccaaa

SEQ ID NO: 118650 - RNA, 46 nt, Mus musculus
gguaucaacuguaguuccccucccucugcucccaccagccccuccu

SEQ ID NO: 118651 - RNA, 46 nt, Mus musculus
ccugagugcugagguuacagguauaugguaacacaucuggcuagau

SEQ ID NO: 118652 - RNA, 46 nt, Mus musculus
aagccaucagagugggcacacaagagagagagagagagaacaagac

SEQ ID NO: 118653 - RNA, 42 nt, Mus musculus
gugugugugugugugugugugugugugugugugucugguacu

SEQ ID NO: 118654 - RNA, 45 nt, Mus musculus
ugcaaagauuauaugccacaauacaggggaaugccaggaccagga

SEQ ID NO: 118655 - RNA, 46 nt, Mus musculus
aaauacccauggaaggaguuacagagauaaaguucagagcugagcc

SEQ ID NO: 118656 - RNA, 42 nt, Mus musculus
ucucucucucucucucucucucucuuuuugugaguugggcau

SEQ ID NO: 118657 - RNA, 42 nt, Mus musculus
guggugcauaccuguuaucccaacacuaaggaggcagcagca

SEQ ID NO: 118658 - RNA, 46 nt, Mus musculus
ggcugguagaccuggguucuauaagaaagcaagcugagcaagccag

SEQ ID NO: 118659 - RNA, 86 nt, Mus musculus
uacacaagaagcuuggaacagaggaauucccucugauugaucagacuuucuauccuaaucacaaagagaugguaagucugggagaa

SEQ ID NO: 118660 - RNA, 41 nt, Mus musculus
gaaaagaaggagggaugaaagaggagggaaggaggaggagg

SEQ ID NO: 118661 - RNA, 42 nt, Mus musculus
uacuaaugcagauagaguuacaggaagaguacuaaugcagau

SEQ ID NO: 118662 - RNA, 41 nt, Mus musculus
cagacucacguggacagaguugcaagcugacguccaggaga

SEQ ID NO: 118663 - RNA, 46 nt, Mus musculus
agauacccugaggcugcagucuauucugagcaacacacuuggagga

SEQ ID NO: 118664 - RNA, 30 nt, Mus musculus
uuucuccagccccuguuguuguuguuguuu

SEQ ID NO: 118665 - RNA, 46 nt, Mus musculus
accccccaaaaaaauaaagcucucugcccuuguuauuugagcagau

SEQ ID NO: 118666 - RNA, 46 nt, Mus musculus
aaaaccuuaggugcagggagagccaaagagccuagcagaccacaag

SEQ ID NO: 118667 - RNA, 45 nt, Mus musculus
ggaagaagauccauggagaaauugacauuaaaguagagcaaguaa

SEQ ID NO: 118668 - RNA, 45 nt, Mus musculus
cagagacagagacagagacagagagagaaacagaugcagagagag

SEQ ID NO: 118669 - RNA, 46 nt, Mus musculus
gugcugaauaguuuuaugucaacuuaacaguaacugaagucaucag

SEQ ID NO: 118670 - RNA, 64 nt, Mus musculus
ggaagggaagggaacggaagggaagggaagggaaggaagaggaaggggaaggggaagaggaaga

SEQ ID NO: 118671 - RNA, 47 nt, Mus musculus
aagucagggcaggaauucaaagaggcaagugcugaugcagaggccau

SEQ ID NO: 118672 - RNA, 47 nt, Mus musculus
acugggucuaccuuuggggucaacacuguagugaguaaagaguagag

SEQ ID NO: 118673 - RNA, 41 nt, Mus musculus
ccccagcgacaacaugguggcucacaaccaucuguaaugag

SEQ ID NO: 118674 - RNA, 42 nt, Mus musculus
cuccucggauacaguuuccugcagugaauguagccagcaccu

SEQ ID NO: 118675 - RNA, 46 nt, Mus musculus
gcaagcauaaacacacaaaucuccauaaaugcucaugggggucacu

SEQ ID NO: 118676 - RNA, 46 nt, Mus musculus
ggaugagaaauuaguguucacugaauuuauucacaaaugaccuuug

SEQ ID NO: 118677 - RNA, 45 nt, Mus musculus
gaagaggcaacagauaauugcuccuuguacccauuuuaguuuggg

SEQ ID NO: 118678 - RNA, 42 nt, Mus musculus
cuuuuaaugauuugugcucagcucucccuuuaagccccacuu

SEQ ID NO: 118679 - RNA, 78 nt, Mus musculus
ccagaagagaagaaacccuaaaaucccuugcuuccauucugacccccugacuuucuagaccacaauaaaccagccuuu

SEQ ID NO: 118680 - RNA, 29 nt, Mus musculus
agcuggugguggaagagaaacggucaugu

SEQ ID NO: 118681 - RNA, 44 nt, Mus musculus
cagugccaucuccuagcuuagagaagaggagagaaagaaaagag

SEQ ID NO: 118682 - RNA, 46 nt, Mus musculus
gccuaacccccugcccaagcccuaugcccaucacugcugcccacuu

SEQ ID NO: 118683 - RNA, 45 nt, Mus musculus
ccacucggaaccaaauguguaacaaagccguaccuugcccugguu

SEQ ID NO: 118684 - RNA, 44 nt, Mus musculus
caagucacagagcaggggcucaaagggcuccauggcccccagcc

SEQ ID NO: 118685 - RNA, 41 nt, Mus musculus
auaauguuggguuacagcaagaaacugugagggagaaaaaa

SEQ ID NO: 118686 - RNA, 42 nt, Mus musculus
cugggggccuugcucugucacaugcuccaaaggaacccagau

SEQ ID NO: 118687 - RNA, 47 nt, Mus musculus
cuggguuccuuuggagcaugugacagagcaaggcccccagggucccc

SEQ ID NO: 118688 - RNA, 48 nt, Mus musculus
ggggaaugccagggccaggaagaaggaguggguggguuggugagcagg

SEQ ID NO: 118689 - RNA, 46 nt, Mus musculus
ucagagcacugaccaccucugcccacacagcgccugugucgcagcu

SEQ ID NO: 118690 - RNA, 46 nt, Mus musculus
uuacuauguauuucagauaacauuguaaagaugauaggcuugaaga

SEQ ID NO: 118691 - RNA, 51 nt, Mus musculus
gcaauuuggauauuuucuaugguagcucuauucuccuaacuuacaauagau

SEQ ID NO: 118692 - RNA, 45 nt, Mus musculus
aaagaaacgaggggaaaggaaacuauaguuaggcugucuuguaug

SEQ ID NO: 118693 - RNA, 46 nt, Mus musculus
gccuugguuuugucuggacugaccugcuccagaaagaggaacccag

SEQ ID NO: 118694 - RNA, 45 nt, Mus musculus
caaagcagcaucaagggugacaaagcagcuacaaggaaauggaga

SEQ ID NO: 118695 - RNA, 42 nt, Mus musculus
aucccagcaaacacauggugacucaaccaucuguaaugggau

SEQ ID NO: 118696 - RNA, 46 nt, Mus musculus
ugugaaacuaaaauguuucauagaaaccauaggaaagauggagaaa

SEQ ID NO: 118697 - RNA, 85 nt, Mus musculus
acagagaaacccugucucaaaaaaagaagagggaaaugaaggaggaagaacaagaaguuacugauugugugaaagaaaaugauca

SEQ ID NO: 118698 - RNA, 42 nt, Mus musculus
ggaaggagaagcaaguaggucucagaguucaaggucagccug

SEQ ID NO: 118699 - RNA, 45 nt, Mus musculus
ggccccuccagcuaguacuccaggucucugucucccacccccuuc

SEQ ID NO: 118700 - RNA, 45 nt, Mus musculus
agagguuaugggugaaccgugcuaguaacucuuaagcuuccaaca

SEQ ID NO: 118701 - RNA, 42 nt, Mus musculus
cagaccccggugcugcugacacccagcucgcugcccccuagc

SEQ ID NO: 118702 - RNA, 44 nt, Mus musculus
gaacacagcccagguguguggccucuccacuuccaccacugaga

SEQ ID NO: 118703 - RNA, 42 nt, Mus musculus
gcugagacuucugguucagcuuugacagcuucugaacugaag

SEQ ID NO: 118704 - RNA, 45 nt, Mus musculus
uuggguccagacucaacucuucggauuucugguuuggggccucug

SEQ ID NO: 118705 - RNA, 42 nt, Mus musculus
ccagguuauccuaaccccaccagaggccccaaaccagaaauc

SEQ ID NO: 118706 - RNA, 46 nt, Mus musculus
gaacucauagaauagagauagguguccugguauaggacauagaggc

SEQ ID NO: 118707 - RNA, 46 nt, Mus musculus
uuccuaaauuuccaaguuccaguacucaccugcaggggcagaccag

SEQ ID NO: 118708 - RNA, 46 nt, Mus musculus
cccgagcgcauguauucauuccggcugcuucgugcuaagccaccuu

SEQ ID NO: 118709 - RNA, 45 nt, Mus musculus
cagagaaggaguugaaacugcagagggaugcagagaguggggaag

SEQ ID NO: 118710 - RNA, 45 nt, Mus musculus
acacuguuaaaguauaauuguuaacuuuguauuuauccccaagau

SEQ ID NO: 118711 - RNA, 45 nt, Mus musculus
aaauaugaaauaauuagugcacauauuggugggaauacaaugcag

SEQ ID NO: 118712 - RNA, 46 nt, Mus musculus
uuuaucuucucuuacuaccgaaaaauccauguucuuauuccuagac

SEQ ID NO: 118713 - RNA, 46 nt, Mus musculus
gauucugaaaaacacaccuauuaucuccaggcaugcagggaacuag

SEQ ID NO: 118714 - RNA, 45 nt, Mus musculus
ggucuuugaggccauaccuuaucauaguaguaccgcaaggcccgg

SEQ ID NO: 118715 - RNA, 46 nt, Mus musculus
uugguggaugcagaggagguggcccggcuauggggacugcgcaaga

SEQ ID NO: 118716 - RNA, 46 nt, Mus musculus
gcuuaaaccguacaggaacaaucccagguuagaaaaauugggggau

SEQ ID NO: 118717 - RNA, 46 nt, Mus musculus
uucauuggaucacaaaaaagucauaauauacaaagaagccuaguug

SEQ ID NO: 118718 - RNA, 46 nt, Mus musculus
ggaacauggacccugcaucacugaaguaaccauuaaaggccuuuag

SEQ ID NO: 118719 - RNA, 34 nt, Mus musculus
cugagauuacacacaccccagcaaacaaggcagc

SEQ ID NO: 118720 - RNA, 45 nt, Mus musculus
gggcuccugucuguuguguccuaagcuguuuuaaggcacccagag

SEQ ID NO: 118721 - RNA, 42 nt, Mus musculus
ccagauggugaagucguacagaaaguuaagggggagggagaa

SEQ ID NO: 118722 - RNA, 46 nt, Mus musculus
uuacgacuuuuuaaauauuuaacagcuauuuacuaagcaccuagug

SEQ ID NO: 118723 - RNA, 47 nt, Mus musculus
gggaacacacuaaagauauuuguaagaaugucauuugauuugugaau

SEQ ID NO: 118724 - RNA, 54 nt, Mus musculus
acugaccuuaucucuuucaucuccacauuucagauccaugcuauagccaugcua

SEQ ID NO: 118725 - RNA, 42 nt, Mus musculus
ucaacagugaguccaccuaaguuuacauuauugccccccuug

SEQ ID NO: 118726 - RNA, 45 nt, Mus musculus
cacgccgauugggucaaggaggacugccaagugccaagguuugag

SEQ ID NO: 118727 - RNA, 46 nt, Mus musculus
ccccauugacugcaucuucccagccuccaauauuaaagcaccugaa

SEQ ID NO: 118728 - RNA, 45 nt, Mus musculus
agccauuguggcuaaagaauaagaagugaagucaagagaggugag

SEQ ID NO: 118729 - RNA, 46 nt, Mus musculus
uuuugacugauuguguacauaaagauucucuuagaugagaccugau

SEQ ID NO: 118730 - RNA, 30 nt, Mus musculus
agaugguguuccuucuaucugagauggaag

SEQ ID NO: 118731 - RNA, 81 nt, Mus musculus
uuucagucauccuugguauuuuuuauaccuccugucccucuuccucaguguuucuuuuccucuccacuccccagauaaaag

SEQ ID NO: 118732 - RNA, 46 nt, Mus musculus
guuaaauagucuauagcuuuuggagagagcauuaucaccccaaaua

SEQ ID NO: 118733 - RNA, 46 nt, Mus musculus
ucgccuguacgguuccaguaguucuucucuuaagcuuuccagagau

SEQ ID NO: 118734 - RNA, 46 nt, Mus musculus
uagauaaauaaccacucacaaguaugagcaccugcaaugaucauuc

SEQ ID NO: 118735 - RNA, 46 nt, Mus musculus
cuugaaauauagauagugcuguaguuaaagagauggcucagcagug

SEQ ID NO: 118736 - RNA, 45 nt, Mus musculus
uaucuauguggguaguggugaguagagaaaaugugggcuccaagu

SEQ ID NO: 118737 - RNA, 45 nt, Mus musculus
augcucccaaaggugggaaaugcuuaaagcauguguuagggcuag

SEQ ID NO: 118738 - RNA, 59 nt, Mus musculus
ccgcggucugccagcaggcggaucgucgcgagcuggcgggagacugguuugggugacgu

SEQ ID NO: 118739 - RNA, 54 nt, Mus musculus
ucaaugagauuuggcggguucugagggaggguggacuuacaggaagguagggag

SEQ ID NO: 118740 - RNA, 42 nt, Mus musculus
cacugagaccacuuaagcauuuaauaauuuuaaaagcacaag

SEQ ID NO: 118741 - RNA, 46 nt, Mus musculus
uagaaaggauaugccuaaagggcuauuuguuaaaguuaagguccag

SEQ ID NO: 118742 - RNA, 46 nt, Mus musculus
ggccuguugauacuguugcuuccuccuuggggcugcaaacccccuc

SEQ ID NO: 118743 - RNA, 45 nt, Mus musculus
auacuuugucuccauauuuccuccugugaauauuuuguucccccu

SEQ ID NO: 118744 - RNA, 45 nt, Mus musculus
augucucuagcugcauauguaguagaagaugacuuagucgaccau

SEQ ID NO: 118745 - RNA, 46 nt, Mus musculus
cggcuaugauaauugagaguuuugcuggguauaguagucuggguug

SEQ ID NO: 118746 - RNA, 45 nt, Mus musculus
ucauuguguccuggauuuccuggauguuuuggguuuaggagcuuu

SEQ ID NO: 118747 - RNA, 45 nt, Mus musculus
gguugugguuagguauuggggaagagggugccucugggggcccau

SEQ ID NO: 118748 - RNA, 46 nt, Mus musculus
gggagagaguagagaaguagaggccagcuaugaucaucgcauggag

SEQ ID NO: 118749 - RNA, 32 nt, Mus musculus
caagagagaagcaagugggaagcaggaguaag

SEQ ID NO: 118750 - RNA, 46 nt, Mus musculus
auuugagcauggagagcuguggcacagggucagcucuggggugcag

SEQ ID NO: 118751 - RNA, 45 nt, Mus musculus
guagaguuuuuggauccaagucacaccaauguugugaucauaaaa

SEQ ID NO: 118752 - RNA, 41 nt, Mus musculus
gaguuaagagaguaguagagacagagaaagaggcaagagag

SEQ ID NO: 118753 - RNA, 46 nt, Mus musculus
gagccuccauguagguguuggaaacugaacccagguccucgacaag

SEQ ID NO: 118754 - RNA, 46 nt, Mus musculus
uauuuucaucuuuuuuguuuuuucucauugugucuucccugucuag

SEQ ID NO: 118755 - RNA, 46 nt, Mus musculus
acauucagcaugucugagccacagacuuacgaaaaguugguugaag

SEQ ID NO: 118756 - RNA, 45 nt, Mus musculus
guccugacuauagggcaugucaguuuccagucuccuugcuugaag

SEQ ID NO: 118757 - RNA, 48 nt, Mus musculus
aaucgauuuaaucccagacggauauccacaaauaucguguuugccaaa

SEQ ID NO: 118758 - RNA, 26 nt, Mus musculus
gcauguuggauaucgacagccccuag

SEQ ID NO: 118759 - RNA, 136 nt, Mus musculus
aucuauagcuucuggcucaaguccaccaaagccccaacggugaaauuacagucaaauagaccagugaccaagaagguuaagaaagagacuucuuccagugacagcagugaggauagcagugaggaagaggacaaag

SEQ ID NO: 118760 - RNA, 46 nt, Mus musculus
uggucacuggucuauuugacuguaauuucaccguuggggcuuuggu

SEQ ID NO: 118761 - RNA, 53 nt, Mus musculus
ggcagcagccaaagcuucagagagcagcaguagugaagaguccagugaugacg

SEQ ID NO: 118762 - RNA, 27 nt, Mus musculus
cauccucugagcuugagucagacucgg

SEQ ID NO: 118763 - RNA, 46 nt, Mus musculus
cugacucaagcucagaggaugaagcaccacagacucagaagccaaa

SEQ ID NO: 118764 - RNA, 46 nt, Mus musculus
caccagcgaaagcacagccuaaaguagccaaugacaaagcagccag

SEQ ID NO: 118765 - RNA, 72 nt, Mus musculus
acugcaccuaaaaagcaagucguggccaaggcaccagugaaaguagcugccgccccuacccagaagaguucu

SEQ ID NO: 118766 - RNA, 45 nt, Mus musculus
cagauucugacaguucugaggaugaagcuccugccaagccagcca

SEQ ID NO: 118767 - RNA, 46 nt, Mus musculus
cucaggcugcuggggacagcagcucugacucagacaguuccagcag

SEQ ID NO: 118768 - RNA, 46 nt, Mus musculus
ccucuucacugcuggaacugucugagucagagcugcuguccccagc

SEQ ID NO: 118769 - RNA, 46 nt, Mus musculus
caaggccggugucacuccagcuucucagaauagaaaagcaggcaag

SEQ ID NO: 118770 - RNA, 46 nt, Mus musculus
auuccgucaaguuugacagugagugaccuguggucaucuuuggcag

SEQ ID NO: 118771 - RNA, 46 nt, Mus musculus
ugcucccuuggcauucauagaccaagugugaucuccaucacggcag

SEQ ID NO: 118772 - RNA, 27 nt, Mus musculus
gcucagauagagugagggaagggguag

SEQ ID NO: 118773 - RNA, 42 nt, Mus musculus
guucaauaugaaggacaacuucaguuuugcugccaccagcag

SEQ ID NO: 118774 - RNA, 46 nt, Mus musculus
acuggcaccaaugaguccgccuuuaauugcucacacaaaccaucag

SEQ ID NO: 118775 - RNA, 48 nt, Mus musculus
ugacucugaacauguuugcaagcauuuuuuuuauuaccugcaugagug

SEQ ID NO: 118776 - RNA, 42 nt, Mus musculus
auggcuugucuauccucauugccaacauuuuauuuccgggau

SEQ ID NO: 118777 - RNA, 55 nt, Mus musculus
uaauauucauagcaacguguuacuuuggaaucagaaaacaucugcugaagacuaa

SEQ ID NO: 118778 - RNA, 45 nt, Mus musculus
cagaagcuccgcaguguguuuagaguucccauuacuuggcuccaa

SEQ ID NO: 118779 - RNA, 41 nt, Mus musculus
uuuugcugguccuuuggcaugagauugucauaugugagcua

SEQ ID NO: 118780 - RNA, 46 nt, Mus musculus
uuuuguccauuuucaucagauuucuuuuuucuugaacaaaggccaa

SEQ ID NO: 118781 - RNA, 46 nt, Mus musculus
ugcauauauuucaaaccauacugaauuuagguggauaagggcuaga

SEQ ID NO: 118782 - RNA, 46 nt, Mus musculus
aaguugaagguggauuauaguaaauguacaacugugcucacuaggu

SEQ ID NO: 118783 - RNA, 45 nt, Mus musculus
ccuaucuuugcaaugugucaugauuaucuucuuuuccccccuuaa

SEQ ID NO: 118784 - RNA, 46 nt, Mus musculus
ccacaccaucaccuucuagagaguccccucuuucuggacccuaaga

SEQ ID NO: 118785 - RNA, 45 nt, Mus musculus
ugugguugguggcuauucauggaauaaucgcuguaugguagagau

SEQ ID NO: 118786 - RNA, 46 nt, Mus musculus
augauguccugagcugugaauacuacucaccuauccuugaccagug

SEQ ID NO: 118787 - RNA, 46 nt, Mus musculus
auauacaaagaacucaagaaguugggcuccagaaaaacaagcaacc

SEQ ID NO: 118788 - RNA, 59 nt, Mus musculus
acuccacauaaaagcagagacacugaaacuuacagaggagaaauugugugaaggccucg

SEQ ID NO: 118789 - RNA, 46 nt, Mus musculus
gcaugguacugaaacagcuacagacagguauaucaaacgaacagaa

SEQ ID NO: 118790 - RNA, 46 nt, Mus musculus
aauuauuccacaaaauaauuauggaacuccacguaaaaccagagac

SEQ ID NO: 118791 - RNA, 46 nt, Mus musculus
augcuucuucuccuacugaaugagaucuuuccauauagugccagua

SEQ ID NO: 118792 - RNA, 46 nt, Mus musculus
uuuuuuguaugugaguacacuauagcugucuucacacacaccagau

SEQ ID NO: 118793 - RNA, 45 nt, Mus musculus
acaaccacaugugcacaaaaacuuugucucaaaaaaacagauaga

SEQ ID NO: 118794 - RNA, 46 nt, Mus musculus
caaaggauuucuguaugcaguugguggacgaaaugcagcuggagaa

SEQ ID NO: 118795 - RNA, 45 nt, Mus musculus
ugggcagaguaauuaugacacaaaaggaaaaaccgccgucgauac

SEQ ID NO: 118796 - RNA, 44 nt, Mus musculus
agacccacgaguggaaaucucuagcccccauggaugccccaaga

SEQ ID NO: 118797 - RNA, 46 nt, Mus musculus
cucauuaauuaugugcaaaccguggauuucaugagaacugacaaua

SEQ ID NO: 118798 - RNA, 83 nt, Mus musculus
agcacuggggaguuccugaagcuucccuucgagcgccuugccuuuguccuguccagcaacagccuuaagcgcugcaccgaacu

SEQ ID NO: 118799 - RNA, 46 nt, Mus musculus
cuguguugaaguuggacggauugccaacaccuaccaucugacagaa

SEQ ID NO: 118800 - RNA, 42 nt, Mus musculus
ggaauaaugcuuuuagcuuuuguuuucaauagugggggugga

SEQ ID NO: 118801 - RNA, 46 nt, Mus musculus
uugcaaguauaaaagcaggcauuuguuuguuuaaucuguuccagga

SEQ ID NO: 118802 - RNA, 46 nt, Mus musculus
auuacguuagggcuuuugagccuacuccugucccaggccucuagca

SEQ ID NO: 118803 - RNA, 45 nt, Mus musculus
ugaagaaugguggcuaguaaaaugugaauuggcaaaacgagaucc

SEQ ID NO: 118804 - RNA, 46 nt, Mus musculus
cuuugaacuuauauauuagaaaauuaguagauuguuagucccagga

SEQ ID NO: 118805 - RNA, 41 nt, Mus musculus
gcugaugugcauuaagcuucauggcgugagcagaguggguc

SEQ ID NO: 118806 - RNA, 45 nt, Mus musculus
augaugcuuacccugugcacagagucaugauggcaucugcuagug

SEQ ID NO: 118807 - RNA, 46 nt, Mus musculus
uacagcacuacuauccaugugauuauggaaagcaauucuggaaggu

SEQ ID NO: 118808 - RNA, 46 nt, Mus musculus
ugcaugaccaccccuaaaaggcucagggaaaaauaacaaaagagag

SEQ ID NO: 118809 - RNA, 46 nt, Mus musculus
uagagggaaaccuaaguucauagaaauuauauaaaggaaaugagua

SEQ ID NO: 118810 - RNA, 46 nt, Mus musculus
accaagacccagcagaaaugcacuaacagagaagagaagugcugag

SEQ ID NO: 118811 - RNA, 46 nt, Mus musculus
uuaucugauaaaugguuugccaacauuucucacaauagcuucaguc

SEQ ID NO: 118812 - RNA, 42 nt, Mus musculus
acaguagugagaauauccugcuucguagagugcagcccaaac

SEQ ID NO: 118813 - RNA, 52 nt, Mus musculus
ccuuuuucuaucuaauuuuggaugggugguugucaagggaauaagccagaga

SEQ ID NO: 118814 - RNA, 64 nt, Mus musculus
uuaauuaaauauuuuugaguauguucccacaaacagauuuuuaagaccaagcacuaacagggaa

SEQ ID NO: 118815 - RNA, 45 nt, Mus musculus
agcagaggcagcaaaguugggugcuuagagagguaugugcauaga

SEQ ID NO: 118816 - RNA, 46 nt, Mus musculus
auaguauuaaaacaacuccuaaugaccuguugcucuacccacagau

SEQ ID NO: 118817 - RNA, 46 nt, Mus musculus
ugaaauaaggaggauuaaaugguauggugaauaggaggucaaagug

SEQ ID NO: 118818 - RNA, 46 nt, Mus musculus
uuauuuugcaauacucacagaaauuaaauaguaaggagccauaugg

SEQ ID NO: 118819 - RNA, 71 nt, Mus musculus
gucuuuggagugauucaccgaaaugagauuccauauucaguugcaggacauaaauuaagccucucaugcca

SEQ ID NO: 118820 - RNA, 85 nt, Mus musculus
cucagcacuauuaucuacugaucuguuguaaacacuugaguuuucaaaauguuaggacugaggagagaugaaguauucuguuaga

SEQ ID NO: 118821 - RNA, 46 nt, Mus musculus
ugcaaauaugucugauuuaucauucaguuuuuguuugggauggaug

SEQ ID NO: 118822 - RNA, 46 nt, Mus musculus
guguuuugaacuuccccauguggaugcugggaaucaaacucagguu

SEQ ID NO: 118823 - RNA, 46 nt, Mus musculus
gaaaccucaaagcucacccugaggacauacuuuuuuucagcaagac

SEQ ID NO: 118824 - RNA, 46 nt, Mus musculus
cuguuaguguuucuauugcugugaagagauauccagaccacaagaa

SEQ ID NO: 118825 - RNA, 46 nt, Mus musculus
ccaaagucaaugcugcagguauacugaggcuucucgauagccaggu

SEQ ID NO: 118826 - RNA, 46 nt, Mus musculus
acccaucaccccucacugauccccuccgauauccuauggccuauuc

SEQ ID NO: 118827 - RNA, 45 nt, Mus musculus
agaaauaucauuuuaaaauugaucauuauauguuaaauaugaagg

SEQ ID NO: 118828 - RNA, 40 nt, Mus musculus
gacauguggaugccaugcuucaaauucagguugucaggac

SEQ ID NO: 118829 - RNA, 45 nt, Mus musculus
gaacaauuuuguguuccaauucuuguaaauagauauugacgacau

SEQ ID NO: 118830 - RNA, 46 nt, Mus musculus
caaaaaaaacuuuugcuaauuuuuauuucauauuuuaauuagagau

SEQ ID NO: 118831 - RNA, 46 nt, Mus musculus
cuuaaaaguuuaccaugcauaucauacucuaaauuucauaugagaa

SEQ ID NO: 118832 - RNA, 41 nt, Mus musculus
uuuauucuuuuagcuauuuaagauacuuuagucgggcaugu

SEQ ID NO: 118833 - RNA, 46 nt, Mus musculus
acuaauuugaaccagaaugagucucauccuccuuuagccccuacga

SEQ ID NO: 118834 - RNA, 46 nt, Mus musculus
uuauguagcauacauuucaauuaugauguaaugcauuagggaagau

SEQ ID NO: 118835 - RNA, 26 nt, Mus musculus
cuuguacgugugccuguguaacacaa

SEQ ID NO: 118836 - RNA, 42 nt, Mus musculus
aauacuauuuacugguaauaugcauagguaggauggaaagau

SEQ ID NO: 118837 - RNA, 46 nt, Mus musculus
uacaaaaagcaacuuaacuauaaacaaaacaaaacccugcaaagau

SEQ ID NO: 118838 - RNA, 45 nt, Mus musculus
uauuuuaaauauauaaaauaauagcauuaaaaauaaaaucucgga

SEQ ID NO: 118839 - RNA, 49 nt, Mus musculus
auuuagguggcauguuacuucucugggcaauuacuuauauauucagagg

SEQ ID NO: 118840 - RNA, 55 nt, Mus musculus
auuagcuuaaaaucugcugauucuugauguucaugauaugcuaaauauggggaug

SEQ ID NO: 118841 - RNA, 52 nt, Mus musculus
uuaaaguguugaaugcaaaucuagucauuacuaugaagauauagccaaagga

SEQ ID NO: 118842 - RNA, 83 nt, Mus musculus
aucugccguguggcaaacugugggagggggaucucaaauaggaacaucccccgacugacaagaucgagaaacaaacaaacagc

SEQ ID NO: 118843 - RNA, 85 nt, Mus musculus
uuaaaacauccaggucaacuccacuuucuccagcauacauguaagugagagaaaauaggauauuaaagugggguuucauucauga

SEQ ID NO: 118844 - RNA, 51 nt, Mus musculus
uuggaaggauagaaucaucuuauugcuuuaggggacaggacgauuuaaagg

SEQ ID NO: 118845 - RNA, 62 nt, Mus musculus
gggaggaguaagggggugaacgggaggagaaaaggggaagaaggggagggcaguauugaauu

SEQ ID NO: 118846 - RNA, 46 nt, Mus musculus
guauuugcauuuuaugucuuuaaggaugcuaaauaugggauguaag

SEQ ID NO: 118847 - RNA, 46 nt, Mus musculus
ggugacagauaauuacaaagcauauagcaguuuauuaagcccaaaa

SEQ ID NO: 118848 - RNA, 45 nt, Mus musculus
ugucucagaaaacaacaacaacaacaaaaagaaaaagugcaaggc

SEQ ID NO: 118849 - RNA, 50 nt, Mus musculus
cccuccagaucuaucuauuugccuaagaauuuggcgcacgcuuuuagucc

SEQ ID NO: 118850 - RNA, 45 nt, Mus musculus
uccuuccuucugucucaucuccaaacuuugucucuguauguaacu

SEQ ID NO: 118851 - RNA, 61 nt, Mus musculus
aaaaucuugcuagcauaugcaauugugucugugcacgguguuaggugguugauuaugguau

SEQ ID NO: 118852 - RNA, 43 nt, Mus musculus
gaauaauuguuuaaaaugcagaguaugcaucccacccccagac

SEQ ID NO: 118853 - RNA, 46 nt, Mus musculus
ugguggugagcagccaaugcugaugugcuaaggaaggccagugacu

SEQ ID NO: 118854 - RNA, 42 nt, Mus musculus
aaacaagccgauuucaaggauauauucaaaaaggcagcugca

SEQ ID NO: 118855 - RNA, 46 nt, Mus musculus
agaaaacuucacaaaaauaauuccacaaauuuucuguaaaggagau

SEQ ID NO: 118856 - RNA, 46 nt, Mus musculus
gcacuagugcuugugaaaugacccauaaaaagaucugagcugguuu

SEQ ID NO: 118857 - RNA, 46 nt, Mus musculus
cauuuaagagauguuaucuugaauauauaauuuucacacagaaauc

SEQ ID NO: 118858 - RNA, 46 nt, Mus musculus
agaaauauguauuuuauaaaguuaaaauaaagaauagugacuugug

SEQ ID NO: 118859 - RNA, 47 nt, Mus musculus
cuuaaaaagccucuaaggaauuuuuauuguaguucaggcuguggaau

SEQ ID NO: 118860 - RNA, 97 nt, Mus musculus
uguuacuuauucauuaaaauagcaagccuguuguuuugagauguggcugugaagcgguauauaaaaaucaauuuuauauguauuguagaauucagga

SEQ ID NO: 118861 - RNA, 52 nt, Mus musculus
acuuuaaaacuccagagaauuugaugagagagggauccacaagaacaugaca

SEQ ID NO: 118862 - RNA, 42 nt, Mus musculus
ugaaguagcauauguguuuagcugaaccauuaggagguagau

SEQ ID NO: 118863 - RNA, 46 nt, Mus musculus
cagccacucucucaacaaauguuuacucauaacacaaagggugaaa

SEQ ID NO: 118864 - RNA, 45 nt, Mus musculus
uacagcagaaagcuaaaaaagcccugucagccacgguguagugga

SEQ ID NO: 118865 - RNA, 46 nt, Mus musculus
ugcacaguuccucuuaagaaaaacgagaugauaccauagaaaagag

SEQ ID NO: 118866 - RNA, 46 nt, Mus musculus
ccaaacucaacuauguucugagcuaacuuaaauauuaucagcagau

SEQ ID NO: 118867 - RNA, 45 nt, Mus musculus
gagagguuuaguccauuaucaucaugggguaaagcauggagguau

SEQ ID NO: 118868 - RNA, 46 nt, Mus musculus
cagcaagugcccuuaaccacugagccauuucuacugcccugaagua

SEQ ID NO: 118869 - RNA, 63 nt, Mus musculus
uggcuguugccagaugacuguggggugaaucauaccuggcuguugacaggaaacuguggggug

SEQ ID NO: 118870 - RNA, 52 nt, Mus musculus
ggggagagaggggaagggaugagaggacagagugggagcaggaagacaagaa

SEQ ID NO: 118871 - RNA, 70 nt, Mus musculus
ccuaguauagaaaagaguuuauuuagggccuugggaggggaguugagaggauaguagaaacagagaaaag

SEQ ID NO: 118872 - RNA, 45 nt, Mus musculus
accuaguaucuguauaggaaaaucaggcugacagguauugacaga

SEQ ID NO: 118873 - RNA, 45 nt, Mus musculus
gguauacuauucaguaggcuagaacccagcaucuugucugguaag

SEQ ID NO: 118874 - RNA, 45 nt, Mus musculus
uguguguguguguguguguguguguguguguagaaagauggggau

SEQ ID NO: 118875 - RNA, 46 nt, Mus musculus
acuauaagcagcaaguugugucauuuuuuuuuccuaauagcuagau

SEQ ID NO: 118876 - RNA, 46 nt, Mus musculus
aaaaggagagagcauauaugcaagguaacaaccuagccuaagauaa

SEQ ID NO: 118877 - RNA, 46 nt, Mus musculus
ccugucucaaaucuuaaaacuuuuucauggaucauaggcuaaaggu

SEQ ID NO: 118878 - RNA, 46 nt, Mus musculus
uuuuacuuauacauuucucaaaaauuuuagucuauuagugaaauuu

SEQ ID NO: 118879 - RNA, 42 nt, Mus musculus
uuuucaguucuuuuucacauauuuuuccuuuguggcucagau

SEQ ID NO: 118880 - RNA, 45 nt, Mus musculus
auaguuuuugagaccagguaccuauuguagcagucaaagugagau

SEQ ID NO: 118881 - RNA, 61 nt, Mus musculus
ccaaaaccuguaggacuuacugacacuuucaaaaggagagaugauagcugugugaaauauu

SEQ ID NO: 118882 - RNA, 60 nt, Mus musculus
aaaguuaaugauuuaugcugucaagggaaaaauaaagaggauuggaagaagugggagaag

SEQ ID NO: 118883 - RNA, 47 nt, Mus musculus
caugauauauaccuuaaauguauaccauaaaugauauaaauagauga

SEQ ID NO: 118884 - RNA, 46 nt, Mus musculus
gaccaaagcaucucuuuaaaaguaaaacauuuaauuggggcugggu

SEQ ID NO: 118885 - RNA, 45 nt, Mus musculus
auaaacaaacucagagauguagaaugguaaugauggacagggagu

SEQ ID NO: 118886 - RNA, 46 nt, Mus musculus
auggaaagacagauugacagaaagucuuagaaaaacaaaggauaug

SEQ ID NO: 118887 - RNA, 46 nt, Mus musculus
guuuacauauuuacuguguuagccugugucuuuuuauuggugaauu

SEQ ID NO: 118888 - RNA, 46 nt, Mus musculus
agaucuucaccucucuccugucuccuucaaauucaaugccccaguc

SEQ ID NO: 118889 - RNA, 42 nt, Mus musculus
caaaguaauuggaauguacacuaucauauuuggaagggugug

SEQ ID NO: 118890 - RNA, 46 nt, Mus musculus
caucugcuguccuauaauauuauaaugcaaguaaaaagcccuauga

SEQ ID NO: 118891 - RNA, 47 nt, Mus musculus
agaguuagcagguugggcaaauaguaaaugcuguacaagugcuagua

SEQ ID NO: 118892 - RNA, 46 nt, Mus musculus
auaugcuugcgaaggaauuaaugugagccauuuagaggucccugag

SEQ ID NO: 118893 - RNA, 46 nt, Mus musculus
accuagguaaaaauagaaauuauuucuuaaguaaauaagagaagaa

SEQ ID NO: 118894 - RNA, 45 nt, Mus musculus
uucacagaggagaauugguugcugcaauacuccgcaaccgguauu

SEQ ID NO: 118895 - RNA, 46 nt, Mus musculus
auuaacaaggaacauuaaaauaaaauaugcauuuuggaucccaaca

SEQ ID NO: 118896 - RNA, 44 nt, Mus musculus
uugccugccagugcauggccguccagccacauagggcagagaau

SEQ ID NO: 118897 - RNA, 46 nt, Mus musculus
guguguguguguguguuguguugugugugugugugugugugugugu

SEQ ID NO: 118898 - RNA, 46 nt, Mus musculus
auuuaauauggcuuacaagauuagguuuuagauguugcacccagug

SEQ ID NO: 118899 - RNA, 62 nt, Mus musculus
aggguuagaggcuuugggaauagggauagcauauagggauagcauaaaagcaagauguaguu

SEQ ID NO: 118900 - RNA, 60 nt, Mus musculus
caaccacuggccaaguaggcaggacauagaagagaagaggacuuaguagagaaugaggag

SEQ ID NO: 118901 - RNA, 46 nt, Mus musculus
uaaaagaaaauuagccccuuuaauaauagaagaauagccccaauaa

SEQ ID NO: 118902 - RNA, 46 nt, Mus musculus
gaaugcugaccuuucuuuuuuuaggcuaaacaaacagaacgaagaa

SEQ ID NO: 118903 - RNA, 45 nt, Mus musculus
gacacuauuguaaaugugugguaacaauuucaccauaucuggaac

SEQ ID NO: 118904 - RNA, 46 nt, Mus musculus
ucuccacucgaauuuuugaucuuagccauucugauuagugugaggu

SEQ ID NO: 118905 - RNA, 45 nt, Mus musculus
ucuggauauaugcccaggagagauauuccuggauccuccaguagu

SEQ ID NO: 118906 - RNA, 44 nt, Mus musculus
ggguauuuuguucccaauucuaaggaaggaugaaauauccacac

SEQ ID NO: 118907 - RNA, 44 nt, Mus musculus
aucaggguccuuucagcaacaucuugcuggcauaugcaauagug

SEQ ID NO: 118908 - RNA, 46 nt, Mus musculus
aguaaauauaugacaagacuaagaauuggucucccuuucccaaauu

SEQ ID NO: 118909 - RNA, 46 nt, Mus musculus
caaagauuucagaccuugugauggaugagggagugagaaauuagag

SEQ ID NO: 118910 - RNA, 46 nt, Mus musculus
aagaagccuugaggcuagggguuuagcagacuaauacaaauuaaga

SEQ ID NO: 118911 - RNA, 41 nt, Mus musculus
auuggauuggaacagaaguuguguuccacucacuggcgguu

SEQ ID NO: 118912 - RNA, 42 nt, Mus musculus
uaguugugugccaucaugcaugguuuguguggugcgggaggu

SEQ ID NO: 118913 - RNA, 45 nt, Mus musculus
cagucuagagguacaauugcugcagcauacagaugggcaguugga

SEQ ID NO: 118914 - RNA, 45 nt, Mus musculus
uagacugcugaauuaucaugcacgaacccuaagaggccuguggau

SEQ ID NO: 118915 - RNA, 41 nt, Mus musculus
agucugguagaauucugugcugaaaccaucuggcccugggg

SEQ ID NO: 118916 - RNA, 46 nt, Mus musculus
uuuauuuuauaagucuuuacuugauugguuagaauuacucccagac

SEQ ID NO: 118917 - RNA, 46 nt, Mus musculus
cuucauuagcauggagaacucuagguucuaugcuacaugaccaguu

SEQ ID NO: 118918 - RNA, 44 nt, Mus musculus
aaacagccccuguuuguccaaacuguuuuguuuaugguagauga

SEQ ID NO: 118919 - RNA, 46 nt, Mus musculus
cuguacagaagcuuuucaguuucaugaauucucauuuaguguagau

SEQ ID NO: 118920 - RNA, 45 nt, Mus musculus
uggcugaacaaggcagucauccuauuuuucuuucugccucugaga

SEQ ID NO: 118921 - RNA, 44 nt, Mus musculus
ucccaagaugucucauucucuacaaagugucuggccgcagcuuu

SEQ ID NO: 118922 - RNA, 46 nt, Mus musculus
ccaauagaagcaaaagagccuaagaaaagcaacaagaaucggagac

SEQ ID NO: 118923 - RNA, 46 nt, Mus musculus
uuugggugugugugcuuagcacaugcaugugcccacagagccagaa

SEQ ID NO: 118924 - RNA, 46 nt, Mus musculus
gcugcugcaucagccugugauaguuaaccucucaucuagaauagac

SEQ ID NO: 118925 - RNA, 53 nt, Mus musculus
guacagagaauuggagaacauguuuaucugauugguuuagaguuguaagagga

SEQ ID NO: 118926 - RNA, 46 nt, Mus musculus
uauuuauaaucaugaaaaacacaauuaaaaauuaggugccaaggga

SEQ ID NO: 118927 - RNA, 46 nt, Mus musculus
aaagucaccagauuuucucaacaggauuugcuguaaaugucaaggg

SEQ ID NO: 118928 - RNA, 45 nt, Mus musculus
uuaaauuuuuuuggcuacuugcuuuucagccauucagccuuuaga

SEQ ID NO: 118929 - RNA, 48 nt, Mus musculus
uggagguuuccuuucaauguaucucagaagcuacaaccccccaccccc

SEQ ID NO: 118930 - RNA, 45 nt, Mus musculus
uuguaagcugccaucuaaguuuugagacuugaaaauggauccuuu

SEQ ID NO: 118931 - RNA, 46 nt, Mus musculus
gauagauagaaagcauauaaaauauauuuuguaaaaauguugagaa

SEQ ID NO: 118932 - RNA, 67 nt, Mus musculus
cagauuuuuccaagugcuuuuuggcaucacacgggugcaguauccauuuaaacauuaaugaacaggc

SEQ ID NO: 118933 - RNA, 46 nt, Mus musculus
gcuggaguuacgggaaguucugacuuuuccaauuugggugcuaggc

SEQ ID NO: 118934 - RNA, 46 nt, Mus musculus
auacuuggauuuuaugauauauuaaaucuaagccucaucugagaca

SEQ ID NO: 118935 - RNA, 46 nt, Mus musculus
uuuugucuuuuagucuuucauugauauuuuuauuaagcuugcaaaa

SEQ ID NO: 118936 - RNA, 45 nt, Mus musculus
agaacaaacagggcauuggagaagccaaaagagggcuuuggaaga

SEQ ID NO: 118937 - RNA, 45 nt, Mus musculus
cuucauauaagauguuuacauuaugauucauaacaguggccagau

SEQ ID NO: 118938 - RNA, 46 nt, Mus musculus
accucacucaggaugauauucucacauuccauucauuugcccacaa

SEQ ID NO: 118939 - RNA, 39 nt, Mus musculus
gcuccugucugcaagcauaauagauuaucauuaauagcg

SEQ ID NO: 118940 - RNA, 45 nt, Mus musculus
accccuuuuucucugagaaggugaguaucccuucaacccccaccc

SEQ ID NO: 118941 - RNA, 46 nt, Mus musculus
agauguaaaaugaauaaaaauaaauuauugggaaaaaacucaagug

SEQ ID NO: 118942 - RNA, 46 nt, Mus musculus
gaaacauaaucucuagcccagaacuauggcuacauaggaccaugag

SEQ ID NO: 118943 - RNA, 46 nt, Mus musculus
uaaauaucccauagauuuuuaaaacaagggagucuuguuuggguga

SEQ ID NO: 118944 - RNA, 46 nt, Mus musculus
acucacgcaacucucaacagagaggacugucucucugccccuuaga

SEQ ID NO: 118945 - RNA, 46 nt, Mus musculus
gaaaggcuggacauuucugaauugggguucuaucuggcacugaggu

SEQ ID NO: 118946 - RNA, 46 nt, Mus musculus
uugcuuugccuuuuacauaucucucugguauucuaaagcaguggaa

SEQ ID NO: 118947 - RNA, 46 nt, Mus musculus
cucaucuguuugcccauugugguaucccaagcaccaagcccaugau

SEQ ID NO: 118948 - RNA, 44 nt, Mus musculus
acuuuaaauaucagguaaguagcagucaucaacuugcccuauug

SEQ ID NO: 118949 - RNA, 45 nt, Mus musculus
ggggaauggguugagaaaggacagagauggagguagauaagaagg

SEQ ID NO: 118950 - RNA, 86 nt, Mus musculus
ggcaucaggaggggaguugagggguagagauagagaaaaucagaaaaagaggagagggagggagagagagagagagagagagagag

SEQ ID NO: 118951 - RNA, 46 nt, Mus musculus
aggacugagcuguuaguuucuuagaaauauauuuauuuuggaaggc

SEQ ID NO: 118952 - RNA, 46 nt, Mus musculus
aggauuuggaaguccucagaaaggauuugaauuugauggucggaac

SEQ ID NO: 118953 - RNA, 44 nt, Mus musculus
cucgaaucuccuauucuguaucucucucuggaagacuggcaacu

SEQ ID NO: 118954 - RNA, 46 nt, Mus musculus
auagacucuugaaugaagaggacuucagcagcugacuucggcaccu

SEQ ID NO: 118955 - RNA, 28 nt, Mus musculus
uuuucgaccuggccuuguucgucuucgu

SEQ ID NO: 118956 - RNA, 26 nt, Mus musculus
gaacaaggccaggucgaaaaggauga

SEQ ID NO: 118957 - RNA, 46 nt, Mus musculus
uacagaugagggaacugauauaucuagaucuaugagcagaggggug

SEQ ID NO: 118958 - RNA, 26 nt, Mus musculus
ggggaggccgcggccguggcccccga

SEQ ID NO: 118959 - RNA, 42 nt, Mus musculus
aguuagacagccaguuccccgacaucgaacccuuugaccccu

SEQ ID NO: 118960 - RNA, 32 nt, Mus musculus
cuuaaugacuaagcaaucuuucuuucccccug

SEQ ID NO: 118961 - RNA, 46 nt, Mus musculus
ccaucccucccccugcaccuuagucuagcaccuguagaaacuugag

SEQ ID NO: 118962 - RNA, 46 nt, Mus musculus
uaggagaacuucucuaaacaaggacaacaggcacauggaaggacaa

SEQ ID NO: 118963 - RNA, 46 nt, Mus musculus
auggggaagcuccagauucuccuaggugaagcaaaaacccagagau

SEQ ID NO: 118964 - RNA, 49 nt, Mus musculus
gcaaauuccgcucaaggaaaggugaguaguaaagaagacagaaagaaag

SEQ ID NO: 118965 - RNA, 41 nt, Mus musculus
ucuuucuuucugucuucuuuacuacucaccuuuccuugagc

SEQ ID NO: 118966 - RNA, 89 nt, Mus musculus
gagaggaccgggaugcugccuccgucaggaccggcaaaugccaggaaaagaagagaaaucguugccaaaucgaaacccaagaagacaca

SEQ ID NO: 118967 - RNA, 46 nt, Mus musculus
augccagagcuaggccauauacucugaacuagagggguccccagag

SEQ ID NO: 118968 - RNA, 42 nt, Mus musculus
cauagucaggacaucuggucaagcacccgaucaaucaaggga

SEQ ID NO: 118969 - RNA, 46 nt, Mus musculus
gcagccacuaaauuaaacucugggggagauugagauugaaaaccag

SEQ ID NO: 118970 - RNA, 46 nt, Mus musculus
ugcauuagauucucaaaugugcugauuuuucuccaaaagcauuaag

SEQ ID NO: 118971 - RNA, 46 nt, Mus musculus
gugugagacuuuuauaugcuugugaacaaauuuugcuacuacagau

SEQ ID NO: 118972 - RNA, 45 nt, Mus musculus
ucucauaccuuggcuuuagcaugaugcgcuugccacucuguagug

SEQ ID NO: 118973 - RNA, 46 nt, Mus musculus
uuugaguucuaucagaucccagcccaugacauggugcagcccacag

SEQ ID NO: 118974 - RNA, 45 nt, Mus musculus
acuuuucucacauguguaaggcuuuggguuugauuuaacacacac

SEQ ID NO: 118975 - RNA, 46 nt, Mus musculus
gagaggagugauucuuccuaacucaguagucacuaguugccuguag

SEQ ID NO: 118976 - RNA, 46 nt, Mus musculus
uacaugugagcaauggccuugaagucuacuacuaagauucuggcau

SEQ ID NO: 118977 - RNA, 45 nt, Mus musculus
cauauugguacaccaggugcuggguguuccauaucuuacacaaga

SEQ ID NO: 118978 - RNA, 46 nt, Mus musculus
ccuucggugucagagaaaccugaaaaauggagugugggaguguuau

SEQ ID NO: 118979 - RNA, 46 nt, Mus musculus
ucacguguaggcucuccauucuguuaacaagagaggggguucgaag

SEQ ID NO: 118980 - RNA, 44 nt, Mus musculus
guguugucagagcauugccaggucuguuuggaauaaucugggcu

SEQ ID NO: 118981 - RNA, 46 nt, Mus musculus
uagggaauguaaauaaagaaguagauacuauccaaguuaagucuag

SEQ ID NO: 118982 - RNA, 69 nt, Mus musculus
gcuucuugauacaauuccuuugauaagagaauacccaagaacagauggagaucuuugcuaggcuaaaua

SEQ ID NO: 118983 - RNA, 62 nt, Mus musculus
gcacuuuccucugagccuggaucuagauuggguuguucuccagcaauuauaguaacggcagg

SEQ ID NO: 118984 - RNA, 75 nt, Mus musculus
gaguuggaaggauaagaguccuccuuguagacagugccacuuuauuggguuagucuuucuuucuaucuugaauuc

SEQ ID NO: 118985 - RNA, 26 nt, Mus musculus
gcuuuguaccguacuauugcugcuag

SEQ ID NO: 118986 - RNA, 78 nt, Mus musculus
gacuggcgccgacccgagcgagcuagagggcggcgggcugcugcacgagauuuucacgucuccucucaaccugcuccu

SEQ ID NO: 118987 - RNA, 42 nt, Mus musculus
gaacgaucuuguagagcaggaagaugcagaggcccaggagga

SEQ ID NO: 118988 - RNA, 86 nt, Mus musculus
ccugggccucugcaucuuccugcucuacaagaucguucgcggggaccagcccggugccaguggcgacaacgacgacgacgaaccac

SEQ ID NO: 118989 - RNA, 60 nt, Mus musculus
agcggcgcgacuucaccccugccgagcugaggcguuucgauggcguccaggacccgcgca

SEQ ID NO: 118990 - RNA, 54 nt, Mus musculus
aagacguggaggccgaugacgccggaggagccaugguggaauguaagggugugu

SEQ ID NO: 118991 - RNA, 46 nt, Mus musculus
agcauuguuccuggcggagaaugugugugugugugugugugugugu

SEQ ID NO: 118992 - RNA, 45 nt, Mus musculus
guggacucaggcuggaugaugaauaagcgaccaagcuugguugga

SEQ ID NO: 118993 - RNA, 52 nt, Mus musculus
uggugagauggucagaaacaccauauuuaguguaugauagaguggggagacu

SEQ ID NO: 118994 - RNA, 46 nt, Mus musculus
auccauagccacacuuagaucucuggggcaggggagagggcuaaaa

SEQ ID NO: 118995 - RNA, 42 nt, Mus musculus
cggggcugggggguggguauguucacaugcucauuggucuga

SEQ ID NO: 118996 - RNA, 46 nt, Mus musculus
auucuaaccagguagguuacaguuugcagagucauccugccggaua

SEQ ID NO: 118997 - RNA, 46 nt, Mus musculus
cuuaauaauaguaccaaaacugaucucccuuguugugaguucugau

SEQ ID NO: 118998 - RNA, 25 nt, Mus musculus
uggcaaggccccuggaugcaucucu

SEQ ID NO: 118999 - RNA, 47 nt, Mus musculus
gaugcauccaggggccuugccacauuuugccuggacaaagaagcacu

SEQ ID NO: 119000 - RNA, 46 nt, Mus musculus
ugagagucccagucacucagggucuccugcugugcaggggugaggu

SEQ ID NO: 119001 - RNA, 46 nt, Mus musculus
ugggacucucaguucacuuguaagcauugcuuuauauuuugccuag

SEQ ID NO: 119002 - RNA, 45 nt, Mus musculus
ugcguccugccuugaaagcuauacuuguacuuggucuguucaaga

SEQ ID NO: 119003 - RNA, 46 nt, Mus musculus
ucugaguguagcuagggugucagaacaggcuggguuaggccuaggu

SEQ ID NO: 119004 - RNA, 46 nt, Mus musculus
gugggaaaaggcuauggguaauuaaaggaauggcaagggucuagga

SEQ ID NO: 119005 - RNA, 45 nt, Mus musculus
gccgggccagaauugagaaauuaguaccagaaaagaaucaggagg

SEQ ID NO: 119006 - RNA, 45 nt, Mus musculus
gcaaagguacugaaaguuuguaagagaaagaaugacacagcaaaa

SEQ ID NO: 119007 - RNA, 45 nt, Mus musculus
aguaagaacaugucggcaggaguagaauuggcauuuggaaauagu

SEQ ID NO: 119008 - RNA, 42 nt, Mus musculus
uaucuccuacuauuuccaaaugccaauucuacuccugccgac

SEQ ID NO: 119009 - RNA, 70 nt, Mus musculus
ggaaaacugcugaaggaaggggaggagccuacuguguacucagaugaugaagaaccaaaagacgagacag

SEQ ID NO: 119010 - RNA, 46 nt, Mus musculus
caacucgucuuagaaugcaugauguguuuguaugucacaaauccag

SEQ ID NO: 119011 - RNA, 46 nt, Mus musculus
aucuguaguuagaacaaacugaauuacaauuugauuuuccugagag

SEQ ID NO: 119012 - RNA, 46 nt, Mus musculus
augguuuuaccucaaaucagaaaaaaaaaugaagugcuugggucag

SEQ ID NO: 119013 - RNA, 45 nt, Mus musculus; identical to SEQ ID NO: 83893

SEQ ID NO: 119014 - RNA, 45 nt, Mus musculus
cucaucuaugagaaggcaaagcgcuaucacaaggaguacaggcag

SEQ ID NO: 119015 - RNA, 70 nt, Mus musculus
cuucgacagaucuucaauggcaccuuuguuaagcucaacaaggcuucaauuaacaugcugcagauugugg

SEQ ID NO: 119016 - RNA, 48 nt, Mus musculus
auugcucggucucuugguaaguuuggcaucaucugcauggaggaucua

SEQ ID NO: 119017 - RNA, 46 nt, Mus musculus
ugaagaaaaagacaacucgcuuuguagaagguggagaugcuggcaa

SEQ ID NO: 119018 - RNA, 49 nt, Mus musculus
augggugcuaccgcugucuuggagauggcugcggccacuccaccggcca

SEQ ID NO: 119019 - RNA, 45 nt, Mus musculus
gcuuaucugccgugauuugcuugcuggcaugcugcaccugaugga

SEQ ID NO: 119020 - RNA, 46 nt, Mus musculus
guacgggcaaaaucaagaggguacacaaagcacaaggauguagccc

SEQ ID NO: 119021 - RNA, 46 nt, Mus musculus
aaacuuacccuuugcagugucauagauaccaaaguaggcagcucgg

SEQ ID NO: 119022 - RNA, 45 nt, Mus musculus
cuggguucuaggcuagccagggauacacagugagacccuguccca

SEQ ID NO: 119023 - RNA, 45 nt, Mus musculus
ccuaguguuguguuuuauaaaaaaagaaaaggaagccagggaugu

SEQ ID NO: 119024 - RNA, 42 nt, Mus musculus
uaaaaugcugcauguuuguuuaugcauggauggccuccaagg

SEQ ID NO: 119025 - RNA, 47 nt, Mus musculus
cuguguaauacacaggauggaaagugaccagggugaggacacagaua

SEQ ID NO: 119026 - RNA, 44 nt, Mus musculus
ggugccaauaauuuuucucucauccuuucucuacugcccacccc

SEQ ID NO: 119027 - RNA, 45 nt, Mus musculus
caucugguucauaaaaaccuguuuaugagagagagagagagagag

SEQ ID NO: 119028 - RNA, 45 nt, Mus musculus
ucucucucucucucucucucauaaacagguuuuuaugaaccagau

SEQ ID NO: 119029 - RNA, 46 nt, Mus musculus
ggguuggcagucccuuucugacuagguggaacacacuugcccugau

SEQ ID NO: 119030 - RNA, 41 nt, Mus musculus
auguagaccaggcuagccuugaacucauagguguguguaug

SEQ ID NO: 119031 - RNA, 46 nt, Mus musculus
ccagggcuacacagagaaacccugucucaaaaaaccacaaaaagaa

SEQ ID NO: 119032 - RNA, 46 nt, Mus musculus
uuaucacauucugcguaagcagaccgaaguucagaaacgcacagca

SEQ ID NO: 119033 - RNA, 45 nt, Mus musculus
acgugagaacguaagagaaaaaaaagucacacuguggggucagag

SEQ ID NO: 119034 - RNA, 46 nt, Mus musculus
uuggccaggaggugauagugcacagcuuugaccccaacacucagga

SEQ ID NO: 119035 - RNA, 46 nt, Mus musculus
ucaaguggacgugaccuuuaggcccaguagcugacacauagcaaau

SEQ ID NO: 119036 - RNA, 45 nt, Mus musculus
gagaaggaaggggggagggagggaacaagggcugugaugagagac

SEQ ID NO: 119037 - RNA, 46 nt, Mus musculus
uucagucuaacagucugaaugccuccgccucagaccaacaccagug

SEQ ID NO: 119038 - RNA, 41 nt, Mus musculus
aaacaaucuuccugcugaaaggcucaggguugaggggcgcu

SEQ ID NO: 119039 - RNA, 42 nt, Mus musculus
ggaucaaccccaaggccuugugccugcugggcaagcaugcua

SEQ ID NO: 119040 - RNA, 46 nt, Mus musculus
caugccaggcccuguuuggcuucuuugaucuaucuagugcccaaga

SEQ ID NO: 119041 - RNA, 63 nt, Mus musculus
cacacacacacacacacacacgggugggggggcauggauucucaaguaggccagacuggugug

SEQ ID NO: 119042 - RNA, 46 nt, Mus musculus
caaaguccucagagaaaaaaaugauauuuuugcaaagacagugaag

SEQ ID NO: 119043 - RNA, 50 nt, Mus musculus; identical to SEQ ID NO: 103303

SEQ ID NO: 119044 - RNA, 41 nt, Mus musculus
agaagacauggcgagaagccgaaucaggaggagugcgcacg

SEQ ID NO: 119045 - RNA, 45 nt, Mus musculus
ugggcccauggagggguccaacuauccaguggaaaccacagaggc

SEQ ID NO: 119046 - RNA, 46 nt, Mus musculus
cuaaaguuggaguauggaugaucagggacuacuaaauacaacagaa

SEQ ID NO: 119047 - RNA, 42 nt, Mus musculus
aagauuuauuauuauauguaaauacacuguagcugccuucag

SEQ ID NO: 119048 - RNA, 46 nt, Mus musculus
guuuuuaaaagcugucuuauauuucucucucagugagggugcggug

SEQ ID NO: 119049 - RNA, 42 nt, Mus musculus
guggcuugguagggggaugcuaccgaggcuagcugcuggaug

SEQ ID NO: 119050 - RNA, 46 nt, Mus musculus
uugucuuuuccaauauuuuaaaaucagcuuguugauagguucagua

SEQ ID NO: 119051 - RNA, 46 nt, Mus musculus
uuauuuauuauauguaaggacacauaauaauaaagacacaccagaa

SEQ ID NO: 119052 - RNA, 45 nt, Mus musculus
uaccaagcaaaacucucuucaaaaugaaauaaaauaaauaacaga

SEQ ID NO: 119053 - RNA, 42 nt, Mus musculus
acaagauguacuuucucuauucuuuauuaacuuccagugauu

SEQ ID NO: 119054 - RNA, 46 nt, Mus musculus
aaaaaaaaaaaccacugaauugcaauguaaaaauauuaagcuagag

SEQ ID NO: 119055 - RNA, 42 nt, Mus musculus
gucaaauauguccaggcaaugaccucuaccuuuccgccacuu

SEQ ID NO: 119056 - RNA, 45 nt, Mus musculus
aguugagcuagcaaugacuggacugauguggguuagcgauccugg

SEQ ID NO: 119057 - RNA, 42 nt, Mus musculus
cccagcaccaaaacaaaaaacaaacaaacaggaaagccagau

SEQ ID NO: 119058 - RNA, 42 nt, Mus musculus
cacaugccuagcaugcauuccacuacugagcuacacccccag

SEQ ID NO: 119059 - RNA, 46 nt, Mus musculus
auugacuauggucuaugguuugaaucuuucuccuaucaguagagau

SEQ ID NO: 119060 - RNA, 38 nt, Mus musculus
uuguuguuuuuuuuuuuaaauaugguaugagaggaagg

SEQ ID NO: 119061 - RNA, 55 nt, Mus musculus
uacagaagccaggugugguggugugguccuggaacuucagcagagagagagagag

SEQ ID NO: 119062 - RNA, 45 nt, Mus musculus
guaaaaucucuguauauauguuuucugucuuucuugucuuugaga

SEQ ID NO: 119063 - RNA, 44 nt, Mus musculus
auaaucaagaucuuucuggguucagacuggaggcagcaguuaga

SEQ ID NO: 119064 - RNA, 45 nt, Mus musculus
uaaggauucuaaaaccauuuuuggcauguacacugagcaggaagg

SEQ ID NO: 119065 - RNA, 46 nt, Mus musculus
aaggacuaauggaauacaugugaugagaaagcaaaagaggaagcag

SEQ ID NO: 119066 - RNA, 48 nt, Mus musculus
aaagcagaggagacaauguggaagaaggagaccaaccagagugggcaa

SEQ ID NO: 119067 - RNA, 46 nt, Mus musculus
aaaauguuauccaaaaaaaaucaaauaaauuaguaauggacaggag

SEQ ID NO: 119068 - RNA, 45 nt, Mus musculus
gcuuuucaaucacuuuggcauucugcgcguaagagucagcaacuu

SEQ ID NO: 119069 - RNA, 46 nt, Mus musculus
caugggcaaguucagcucuguuacugugucuaccauugaugaagaa

SEQ ID NO: 119070 - RNA, 46 nt, Mus musculus
uugugagccuagccuuuaauggcugagccaucucuccagcccacua

SEQ ID NO: 119071 - RNA, 45 nt, Mus musculus
cugcuccauccacaaugaaggucacaggagcauucuucggcuggg

SEQ ID NO: 119072 - RNA, 45 nt, Mus musculus
auuucccaaacuuuguuuaaugucaguauauacaugugaugcaga

SEQ ID NO: 119073 - RNA, 45 nt, Mus musculus
ucagagcaggagcacugaaugaggcagaggaaaauaaguugaaga

SEQ ID NO: 119074 - RNA, 25 nt, Mus musculus
aaaugauugaucagaagcuccagcc

SEQ ID NO: 119075 - RNA, 44 nt, Mus musculus
gccugagggcauugaacgucaguacaggaagaagugugcaaagu

SEQ ID NO: 119076 - RNA, 42 nt, Mus musculus
uuaauaaaugcuuagccagccaguagaucuacacaaugaaga

SEQ ID NO: 119077 - RNA, 46 nt, Mus musculus
aaauguauagcuucaguuuaaaaccaagaaaugcaaacugggaggu

SEQ ID NO: 119078 - RNA, 46 nt, Mus musculus
aagacagaucacaaacuaagaaagaaauacuugugaagcccauuaa

SEQ ID NO: 119079 - RNA, 84 nt, Mus musculus
ugccucguuuuccauagugauuugggagaagaaacuaaugggagcagauuuuagaauaugagguuggaaguuuuuauuucagau

SEQ ID NO: 119080 - RNA, 63 nt, Mus musculus
cugccggaaagcacauguucuuuucaaaggaccgagacagaaggaagacugauuuggccagug

SEQ ID NO: 119081 - RNA, 48 nt, Mus musculus
aggccucugauuaaguuauguaugcaguagcaucaaaguagaugaaga

SEQ ID NO: 119082 - RNA, 61 nt, Mus musculus
aaaaaucaaggacugaugauuauuagaagccauaugaaugaaacaaagauuugguagagaa

SEQ ID NO: 119083 - RNA, 57 nt, Mus musculus
uaugcaaucuucaucauccauuccccuuagaagagacagagucugccuuaucccgcg

SEQ ID NO: 119084 - RNA, 45 nt, Mus musculus
gauaguuguuaacuaccauguggguucugggaauuaaaccuagau

SEQ ID NO: 119085 - RNA, 45 nt, Mus musculus
cauguauauuuguuuaccacaugugcaccuuguaccugagagaca

SEQ ID NO: 119086 - RNA, 42 nt, Mus musculus
auccugggcugcauaggcaaacuccagaucuuccuaggggac

SEQ ID NO: 119087 - RNA, 46 nt, Mus musculus
guccuuggaaaagcugcucaguacuagagcaugaacuaugucaaag

SEQ ID NO: 119088 - RNA, 46 nt, Mus musculus
guacagaaaguaauuucauacaacuacgcuucaguuuccuguauca

SEQ ID NO: 119089 - RNA, 45 nt, Mus musculus
aaaaugacacauguaaugugagcacuugggaaguauaagcaggag

SEQ ID NO: 119090 - RNA, 42 nt, Mus musculus
uggguugccaugugguugcugggaauugaacuugggaccucu

SEQ ID NO: 119091 - RNA, 46 nt, Mus musculus
aaugcuggugcugugaacaaaggcuaugggaaaacaggugggagaa

SEQ ID NO: 119092 - RNA, 46 nt, Mus musculus
auuacccuaugcuaguguuaagcagcucauacaguuaggccugaua

SEQ ID NO: 119093 - RNA, 50 nt, Mus musculus
agaaauugcccaugaggccccgggaccggucucgcgugaucgaugcugcc

SEQ ID NO: 119094 - RNA, 60 nt, Mus musculus
uacuguuuauguggccagaugguccuggugcugggugaguggcgggaaguggcggcugca

SEQ ID NO: 119095 - RNA, 46 nt, Mus musculus
cuucucgccaucaucauauuccucgcggucccgggugucugagcag

SEQ ID NO: 119096 - RNA, 57 nt, Mus musculus
ucagacacccgggaccgcgaggaauaugaugauggcgagaagccccuccaugucuac

SEQ ID NO: 119097 - RNA, 46 nt, Mus musculus
auuuguauguguuuauauguguguguauuuguguguguguguauga

SEQ ID NO: 119098 - RNA, 41 nt, Mus musculus
gugcaaguucaaagccaaccuggguugcauagugagguugg

SEQ ID NO: 119099 - RNA, 46 nt, Mus musculus
ugagaucugaugcccuuuucugguguaucugaagacagcuacagua

SEQ ID NO: 119100 - RNA, 46 nt, Mus musculus
uaacggauucauauguugggguuaauggggggguaacaauuguuag

SEQ ID NO: 119101 - RNA, 43 nt, Mus musculus
ccugugucggaaaaaaaaaaaaagaaagaaaagaaaagaaaga

SEQ ID NO: 119102 - RNA, 46 nt, Mus musculus
ucaucucaaagaagauggacccaaaguccauuuucauacucaagag

SEQ ID NO: 119103 - RNA, 45 nt, Mus musculus
aucuuuuuucccccucuguugagacagagucuccuauaggccaga

SEQ ID NO: 119104 - RNA, 85 nt, Mus musculus
ugaauugucaucaaucaguccuaccagauggauuucaacauuuaaaccuggagacucuucgugucuugaauuaggauguuugucc

SEQ ID NO: 119105 - RNA, 73 nt, Mus musculus
aagagaagacacuggaggagaacgaagcugggucuguaaggauucacacaauggcaagacugaggauuuauac

SEQ ID NO: 119106 - RNA, 42 nt, Mus musculus; identical to SEQ ID NO: 33872

SEQ ID NO: 119107 - RNA, 46 nt, Mus musculus
uuccuccagagaagugaugaggauaaaggacuuggugguucgaggu

SEQ ID NO: 119108 - RNA, 45 nt, Mus musculus
uccuacuccagcuauuccguguuucaucgcuggagcccagcagac

SEQ ID NO: 119109 - RNA, 46 nt, Mus musculus
uugcacagcgagauguccacaguaaggguuaacagaacuuugagau

SEQ ID NO: 119110 - RNA, 46 nt, Mus musculus
cugcuacuugacugacuuaaggaagugauuuuugucuucuugagac

SEQ ID NO: 119111 - RNA, 46 nt, Mus musculus
ucacugggauuaggauuacagaugugcaauacuauguccacuuuag

SEQ ID NO: 119112 - RNA, 49 nt, Mus musculus
uugugcucguuuucuagauaggaaaacauggauagagcauggggcucag

SEQ ID NO: 119113 - RNA, 42 nt, Mus musculus
uguccacugcguacauccacaaauucaccaacgggggcaagg

SEQ ID NO: 119114 - RNA, 45 nt, Mus musculus
aggagccggugacggguuggcgugcgaguaacggugcggagaugu

SEQ ID NO: 119115 - RNA, 46 nt, Mus musculus
ggacgucgcggcaguuucagaacuuggggaucucuaaauggcggag

SEQ ID NO: 119116 - RNA, 94 nt, Mus musculus
ccggaagaguaucaaaucugaaaccggagguaaaggucguugggagccaucauguacguucuggaguuugaaucuggauccucuugacuguuga

SEQ ID NO: 119117 - RNA, 46 nt, Mus musculus
augcccacaaguguugaacccgaagcugaauccguugggcacagug

SEQ ID NO: 119118 - RNA, 45 nt, Mus musculus
augaugguggugaccaauuuuggccuaaaucugacuugggaagag

SEQ ID NO: 119119 - RNA, 49 nt, Mus musculus
ccgccaaagcauccaaaagccuccgaguccggcagccgaggaggacaag

SEQ ID NO: 119120 - RNA, 47 nt, Mus musculus
uacugaacuggcucgcucagggugaguuugaucagggcgaaggcgcu

SEQ ID NO: 119121 - RNA, 65 nt, Mus musculus
gccugcuccauugaguccagcucaggaagccacuggaggagaagaggagggagaaaacaaggaag

SEQ ID NO: 119122 - RNA, 45 nt, Mus musculus
gcaauuagaaccgucugccugcaauuagauccugugguaguggua

SEQ ID NO: 119123 - RNA, 48 nt, Mus musculus
guuguaaaugaguuuccagaaguacgggugagaagucuggggcguggc

SEQ ID NO: 119124 - RNA, 46 nt, Mus musculus
gagggaucuugcacgauggauggguguggaugaaugugaugugcag

SEQ ID NO: 119125 - RNA, 45 nt, Mus musculus
aauugguuucggaugaggagagcccuuuuccagagaaacaggaga

SEQ ID NO: 119126 - RNA, 46 nt, Mus musculus
gccaggacaaccuuuacuucucuauaauuauuucaacaauaaagau

SEQ ID NO: 119127 - RNA, 48 nt, Mus musculus
uguaaaugaguuuccagaaguacgggugagaagucuggggcguggcua

SEQ ID NO: 119128 - RNA, 48 nt, Mus musculus
aacaagaggcagccauuccugagggcaugagaaauccacaggcuggga

SEQ ID NO: 119129 - RNA, 65 nt, Mus musculus
cugcuccauugaguccagcucaggaagccacuggaggagaagaggagggagaaaacaaggaagga

SEQ ID NO: 119130 - RNA, 48 nt, Mus musculus
uuguuaugagcgggcuugcucagggugggcuugaucagggcgaaggcg

SEQ ID NO: 119131 - RNA, 46 nt, Mus musculus
ccaaagcauccaaaagccuccgaguccgggagccgaggaggacaag

SEQ ID NO: 119132 - RNA, 44 nt, Mus musculus
agcucucuuucgacauuugucucaccuaauaugaaaaggucuua

SEQ ID NO: 119133 - RNA, 46 nt, Mus musculus
cucugcuuugauuuggguuuuuggucuugauaguuuuccuguuuug

SEQ ID NO: 119134 - RNA, 44 nt, Mus musculus
ccaguuuuagcacuuugaaugguuuuuuuuuucacacucugaau

SEQ ID NO: 119135 - RNA, 45 nt, Mus musculus
gcuuccuuauaauugcuguguuuauaucuuacaugauuggaagac

SEQ ID NO: 119136 - RNA, 45 nt, Mus musculus
gugacccagguucuuuaaaacauauugaauucucaaguacuauau

SEQ ID NO: 119137 - RNA, 47 nt, Mus musculus
uggagaaagaggcuguuggcauccaaaugagcuaggcagauagucca

SEQ ID NO: 119138 - RNA, 116 nt, Mus musculus
uuagcacugaaggauagaggauucuaugaacuaauuaggacagauuguguuguguuucucuaccucaucuuguugaucucuggagcauuaaaaucuauuuaguguugucaucagac

SEQ ID NO: 119139 - RNA, 44 nt, Mus musculus
ucccgggcuuuuaagaaaaugguuuuuuuuuucagcacuacaga

SEQ ID NO: 119140 - RNA, 43 nt, Mus musculus
ucuaguguugcuggcuuauuuuauuggucucaagcgccaucau

SEQ ID NO: 119141 - RNA, 46 nt, Mus musculus
ccccuuuagguauguacucacgaaugguauagcuaaggacacagac

SEQ ID NO: 119142 - RNA, 46 nt, Mus musculus
guuuccuacugugaauuaguuuacuacuauguacaaugcagcagua

SEQ ID NO: 119143 - RNA, 56 nt, Mus musculus
uuucccacacacucauucuugcugcugcuuuccccucccccucuccugcuuucacg

SEQ ID NO: 119144 - RNA, 45 nt, Mus musculus
uuguuuguuuguuuaacaguguuuuuauuggaacucacucugaua

SEQ ID NO: 119145 - RNA, 44 nt, Mus musculus
gggacccaagauggcucccuccccugcuccgaaagagcccuccc

SEQ ID NO: 119146 - RNA, 41 nt, Mus musculus
gcacagauauguggcauucagacccgccucuuggcugaaga

SEQ ID NO: 119147 - RNA, 46 nt, Mus musculus
uagguuuguuaaaggauuucuuucuugcuuuuucuagggugcaguu

SEQ ID NO: 119148 - RNA, 46 nt, Mus musculus
aaguuucuuuaaucaauguggcugcccuugcauuuggagcauagau

SEQ ID NO: 119149 - RNA, 46 nt, Mus musculus
uguuacuguccacuugucuguuuaguuucuguuuccaggaucuguc

SEQ ID NO: 119150 - RNA, 44 nt, Mus musculus
uaucagguuuaggaguuaucugguagaauuuuuggggccacuua

SEQ ID NO: 119151 - RNA, 41 nt, Mus musculus
gagagagagacagagacagagacagagacagagugagugag

SEQ ID NO: 119152 - RNA, 52 nt, Mus musculus
uuguucauuuacuaugcaccaccuacugcuuauauaagagaacuaauaacuc

SEQ ID NO: 119153 - RNA, 55 nt, Mus musculus
uguucguucauugugguacuuuuguauucaguucuguacucagagauggcaccaa

SEQ ID NO: 119154 - RNA, 81 nt, Mus musculus
guuggugguaaugugcuuuguucuuuccuuuuuuuccucaagaagaaauguuaguaugucuuagaaccuagguaacgaagu

SEQ ID NO: 119155 - RNA, 48 nt, Mus musculus
gcuaggcagugccaaaugaaggcauuagugcuuuguacccagaaauug

SEQ ID NO: 119156 - RNA, 42 nt, Mus musculus
cuuuuaaauugcaagacacaaggcaauuccaacugggcauuu

SEQ ID NO: 119157 - RNA, 46 nt, Mus musculus
ucaguagauuugaacagagcccagagguaccaugcucuugccagua

SEQ ID NO: 119158 - RNA, 42 nt, Mus musculus
caauagucuuugccuaauuugaaagcuugggugccagaaaga

SEQ ID NO: 119159 - RNA, 46 nt, Mus musculus
cuuuggcugaaaagucacuuccaggcuaaccuggaguguaugagau

SEQ ID NO: 119160 - RNA, 35 nt, Mus musculus
gugcaacaaagagcaggugcuuucugugucuagag

SEQ ID NO: 119161 - RNA, 49 nt, Mus musculus
aaaacgguucuaucugaaggaagugaaugucuacauguauuuggcuaau

SEQ ID NO: 119162 - RNA, 46 nt, Mus musculus
caugguggcucacaaccaucuguaacaaaaucugacgcccucuucu

SEQ ID NO: 119163 - RNA, 77 nt, Mus musculus
aaugacuaguucaaaauacccuauguuguauuuuaugaagaucuagaaaaggggacuucagugcuucaaauacaaac

SEQ ID NO: 119164 - RNA, 46 nt, Mus musculus
uugccaucuugaacauauccuugauccacuucuuuccuaaccagau

SEQ ID NO: 119165 - RNA, 42 nt, Mus musculus
agugucaggaugcuuguccagugccugcaaaacgcuaggguc

SEQ ID NO: 119166 - RNA, 42 nt, Mus musculus
uugggagguugagggaagaagauugcaaauucagggucaguu

SEQ ID NO: 119167 - RNA, 38 nt, Mus musculus
gcuguguguccagcugagaauaugaagggaguuagaac

SEQ ID NO: 119168 - RNA, 45 nt, Mus musculus
ugagggcauucagggauaggucagaucuguacauacagaggugag

SEQ ID NO: 119169 - RNA, 45 nt, Mus musculus
accuggcuauaugccuagugccaggccagauguuaacacaaagag

SEQ ID NO: 119170 - RNA, 23 nt, Mus musculus
gagugaaggcgccggaugccaug

SEQ ID NO: 119171 - RNA, 45 nt, Mus musculus
caacccugccacaaccaacuucaccggcagcugucaaccucaaag

SEQ ID NO: 119172 - RNA, 46 nt, Mus musculus
ccccgucgacuacaacuacacucacuccaacuucaacacccacucc

SEQ ID NO: 119173 - RNA, 42 nt, Mus musculus
gacuccugucguucagaaauauugggguauucaccugcaagc

SEQ ID NO: 119174 - RNA, 30 nt, Mus musculus
caggcgcugagaucuggaguuaauaccacu

SEQ ID NO: 119175 - RNA, 55 nt, Mus musculus
auaaccauugcaguaccugacaaggcgacacacgauggaagcaguuguggggaug

SEQ ID NO: 119176 - RNA, 45 nt, Mus musculus
cauugagucuucggaguuuuccuuggagaugguuauaugcaaaug

SEQ ID NO: 119177 - RNA, 47 nt, Mus musculus
guuaauuugacagauucaaaggguacuugccuuuaugcagaauggga

SEQ ID NO: 119178 - RNA, 46 nt, Mus musculus
ggggucuguaguaauauaaggauagagugguagauugggaauagaa

SEQ ID NO: 119179 - RNA, 48 nt, Mus musculus
cucuacagguuccguaugcacagauuaaaccagguguggaucaaagga

SEQ ID NO: 119180 - RNA, 73 nt, Mus musculus
aaucucacagguugaguggaaggaaacagaccuaaaagagagcauaguauguuauucugccuauaccacgcca

SEQ ID NO: 119181 - RNA, 77 nt, Mus musculus
aguuugggaucuuucuagcuguccaucaacaauaccacagaucuauagcaaagguucacccugacaucagaagcagu

SEQ ID NO: 119182 - RNA, 46 nt, Mus musculus
caacuccuucccccgaguagcaauaacaauaaaaccggaaaacugu

SEQ ID NO: 119183 - RNA, 46 nt, Mus musculus
acuguucugugagugcuuuuauauuccagggaacuuuguggagaag

SEQ ID NO: 119184 - RNA, 46 nt, Mus musculus
agagcugcugauguugaauacuuuuaaauguauuuacugaccaguu

SEQ ID NO: 119185 - RNA, 52 nt, Mus musculus
uugcuuacuuuacaucaguugccacagcauacuaguuugcugugaaguggca

SEQ ID NO: 119186 - RNA, 41 nt, Mus musculus
agugcugggacuaaacauuuaccccccaccaugccccacuu

SEQ ID NO: 119187 - RNA, 45 nt, Mus musculus
ggacagaaauaccccuagaugcuaaagccggggagcuuccaagau

SEQ ID NO: 119188 - RNA, 131 nt, Mus musculus
gagagugaagggauacacacacacguacauacauauacauauagugacuggggcuggaguaacuuccggaaagaaaaguuauauccaaccucuggagacuaaagggaugaguugauaacuuuggugggggg

SEQ ID NO: 119189 - RNA, 65 nt, Mus musculus
ggcccaagggacagagacaccguuuugggagcuuuguagguaggacuugaggcugggagaagcag

SEQ ID NO: 119190 - RNA, 110 nt, Mus musculus
agaguuuuaaagauggugaaaaaaaaguguagagcgagaaaugaauuuggaacggaaggcgcuguacccucgugaaauuauuggggagggggagggcauagggggguagg

SEQ ID NO: 119191 - RNA, 45 nt, Mus musculus
gcggggcaaguaaggggacgagggaggacgacgucaagggauuag

SEQ ID NO: 119192 - RNA, 55 nt, Mus musculus
uagauggagauagcaaggaagaaauaaaaaacauggaaaaugugaaaaaggagau

SEQ ID NO: 119193 - RNA, 45 nt, Mus musculus
uuuagauuuggcuacagauaccucuuuuacacuauccccaaaagu

SEQ ID NO: 119194 - RNA, 44 nt, Mus musculus
aguuauuuauaacugggcuacacagcauagggugaucccauaag

SEQ ID NO: 119195 - RNA, 47 nt, Mus musculus
gaaagauguucaaccaccaaagcagcagccaaugauauauauuugug

SEQ ID NO: 119196 - RNA, 44 nt, Mus musculus
ggacuaaaagauuggugguuuuugaugcucgaugaaauguggga

SEQ ID NO: 119197 - RNA, 46 nt, Mus musculus; identical to SEQ ID NO: 51030

SEQ ID NO: 119198 - RNA, 44 nt, Mus musculus
uuugugaaaaggggcagagguacaugggaaauuuauagcaggcc

SEQ ID NO: 119199 - RNA, 59 nt, Mus musculus
uagaagggaauaaaaaauuaauuguguuuuaauuuuacagcuaccagagcuuuguauug

SEQ ID NO: 119200 - RNA, 42 nt, Mus musculus
gaauguaccuguuacucuuuaaccuuuuucucuaccccagaa

SEQ ID NO: 119201 - RNA, 46 nt, Mus musculus
guauaaguucaguguuaaugacaauaaaauuguaaauguauggagg

SEQ ID NO: 119202 - RNA, 49 nt, Mus musculus
aagaauacaguugauagcuucaaaagaguauaugugugagagggauagc

SEQ ID NO: 119203 - RNA, 42 nt, Mus musculus
guucauuguauuucuagccugccauucccacaagccccaauu

SEQ ID NO: 119204 - RNA, 46 nt, Mus musculus
ugcuucucuuguuccccuguuaacuuguuuccuaaucuguagaaag

SEQ ID NO: 119205 - RNA, 49 nt, Mus musculus
uacauuggccauggaguauccauugggaacaaaaggugaggggcaguag

SEQ ID NO: 119206 - RNA, 46 nt, Mus musculus
aguauauucuccccuccuuuucauuuagagauacaccuaaaggaga

SEQ ID NO: 119207 - RNA, 46 nt, Mus musculus
auaaagaaaagauagaaaagaaagaaaaacgggauaguucaggagg

SEQ ID NO: 119208 - RNA, 90 nt, Mus musculus
ucaaaacacaaaagugagaguccaugugagucucaauauccaaaugagaaagacaaagagaaaaauaagucaaaaucuucaggcaaagaa

SEQ ID NO: 119209 - RNA, 45 nt, Mus musculus
aacaaugaccgcgaagugccaccggacauaacaaagaggcggaaa

SEQ ID NO: 119210 - RNA, 56 nt, Mus musculus
aagucaagggaaagauccagagaaagagagaaaaaagaugaaaaggacaggaaaga

SEQ ID NO: 119211 - RNA, 46 nt, Mus musculus
cuccuuuagugugcuuguauuacuuuuuaaaugugguguuucaggu

SEQ ID NO: 119212 - RNA, 46 nt, Mus musculus
agcaaagguuugagucuuuuaaaaucaugccuaaguacaccagaaa

SEQ ID NO: 119213 - RNA, 46 nt, Mus musculus
gaauauuuuuucuucuaaugccacugaauuuucuagccagaauaaa

SEQ ID NO: 119214 - RNA, 44 nt, Mus musculus
uucaaggaccuagcacuaauuuuauuguguuucaaagugcaaga

SEQ ID NO: 119215 - RNA, 45 nt, Mus musculus
uucuccaucacauuccuccacaguaaagguuaguauagccugagg

SEQ ID NO: 119216 - RNA, 45 nt, Mus musculus
gguccuugaagucaccuguuccccgaucagauaucucggagccug

SEQ ID NO: 119217 - RNA, 49 nt, Mus musculus
acuaccguccccaucguagaaucaaaaucgacucaagaaagggaaagag

SEQ ID NO: 119218 - RNA, 50 nt, Mus musculus
uacaacuccagaggccagggcacuugguaaagauaguaaagaaaaaccga

SEQ ID NO: 119219 - RNA, 46 nt, Mus musculus
aagcaacaaagcuguuaaggaaaaugacaaagaaaaaguaaaagag

SEQ ID NO: 119220 - RNA, 42 nt, Mus musculus
gagguccauccaccugcuucuaccucccaagugcugggauua

SEQ ID NO: 119221 - RNA, 45 nt, Mus musculus
uacagaugaggucuauugugcuuguuuuuagguggguucugaguu

SEQ ID NO: 119222 - RNA, 45 nt, Mus musculus
aauaaggcuucuaguaccacaccaaaggggaauucaagcaaugga

SEQ ID NO: 119223 - RNA, 46 nt, Mus musculus
auauacugaaaagugguacuuuauuuucuagaaccaaguggcagag

SEQ ID NO: 119224 - RNA, 58 nt, Mus musculus
uuuacuucaggagauuaugggagauuaugcgaucauguucccacaggcuggugagagu

SEQ ID NO: 119225 - RNA, 51 nt, Mus musculus
ggagagaagagugaauaaaauaugccaagaagaaaaagagaagaggccaga

SEQ ID NO: 119226 - RNA, 45 nt, Mus musculus
cacugcccuucaggacaagcuccuugaagaagaaaagaagcagau

SEQ ID NO: 119227 - RNA, 42 nt, Mus musculus
auaauacaguuagaaaacugacuuuacuuuguagccuccaaa

SEQ ID NO: 119228 - RNA, 46 nt, Mus musculus
gugaaauaacagguguaaaaauggaacuuuaaagagauuaugagag

SEQ ID NO: 119229 - RNA, 46 nt, Mus musculus
agucagguugguaaaaaauuaggcagguauugaaaguuggauagaa

SEQ ID NO: 119230 - RNA, 54 nt, Mus musculus
cauugacaauguaugaccuugcaguuccacauaccagcuaugaaagagaaguca

SEQ ID NO: 119231 - RNA, 46 nt, Mus musculus
ugagcuaaauaccuaauaaaaaauggaaaaaaauauagcauuggaa

SEQ ID NO: 119232 - RNA, 46 nt, Mus musculus
guuugcuuauggcacaacagagaaaugggguaauuuuucaggaggg

SEQ ID NO: 119233 - RNA, 46 nt, Mus musculus
aauaauuuuugucuucuuuuaugcagggugguuauuucggccagau

SEQ ID NO: 119234 - RNA, 83 nt, Mus musculus
aagaagugguacaaaaaauggcaggaauugaaauuacagaggagaugacgauggagcaguuagaagccaugacugguggggag

SEQ ID NO: 119235 - RNA, 46 nt, Mus musculus
guagauugauuauaaucaaauauuuuaggugugcugugagguagau

SEQ ID NO: 119236 - RNA, 27 nt, Mus musculus
cuacauaaauguucauauaggcaagac

SEQ ID NO: 119237 - RNA, 48 nt, Mus musculus
gucuggguuaguauguaaauaggagaauuuggggaaacauuuggaagc

SEQ ID NO: 119238 - RNA, 42 nt, Mus musculus
cuguaguccuuguacuugggaagcugaggcaggcggugauga

SEQ ID NO: 119239 - RNA, 45 nt, Mus musculus
uuaaagugaaaaaggacacuaguaggagaauuauuggggaaaaga

SEQ ID NO: 119240 - RNA, 40 nt, Mus musculus
uuaaagcacacuggacgaucauaguuagcacuuggcagac

SEQ ID NO: 119241 - RNA, 46 nt, Mus musculus
uguuuuauuuuuauaauuuuuagguuuauauaaguguaugggggau

SEQ ID NO: 119242 - RNA, 46 nt, Mus musculus
auuuacugucuuucagcuauuuuguuuagacugccaguuuugagaa

SEQ ID NO: 119243 - RNA, 41 nt, Mus musculus
aguuucagucugauggaagcaaacaggaagauaaagagaaa

SEQ ID NO: 119244 - RNA, 46 nt, Mus musculus
aguuagguauaucuuuuaguauagaauaaaauuuauuuaggagcau

SEQ ID NO: 119245 - RNA, 42 nt, Mus musculus
ccauacuuucgacccacccacucccacuucuuggcccuggua

SEQ ID NO: 119246 - RNA, 44 nt, Mus musculus
aaccaaacuuuauguaccauuuuuguucagcauuaagguuauug

SEQ ID NO: 119247 - RNA, 45 nt, Mus musculus
augacaaacaccucuaccuaauaagccacuucaccagcccaagaa

SEQ ID NO: 119248 - RNA, 42 nt, Mus musculus
uauaaguaaaguuuuuauuggaauuaauuaugugacagaaaa

SEQ ID NO: 119249 - RNA, 46 nt, Mus musculus
cuuugugucucaauggugauuaugucuauguaucaaaaccccagau

SEQ ID NO: 119250 - RNA, 24 nt, Mus musculus
uugguccucaccucucacaugauc

SEQ ID NO: 119251 - RNA, 45 nt, Mus musculus
guuagcgcuuugcaaaacaagagagcaccgaagcaaguagagagc

SEQ ID NO: 119252 - RNA, 36 nt, Mus musculus
uucugaaaaacuugaugaacgagacaaagaaaagga

SEQ ID NO: 119253 - RNA, 46 nt, Mus musculus
acuuacuagugaguauauaccaugcauauccuuuugggucagaguu

SEQ ID NO: 119254 - RNA, 42 nt, Mus musculus
ugcaugugggagaaagcucuggugcccauaucaacagcagau

SEQ ID NO: 119255 - RNA, 46 nt, Mus musculus
aaagguagagaaaauuuaacuugguccaagauuaauacuuucagau

SEQ ID NO: 119256 - RNA, 46 nt, Mus musculus
uagaguuuuggaugucauuuuagaaguguuugaaugcaggccagaa

SEQ ID NO: 119257 - RNA, 41 nt, Mus musculus
ccaguuacuuucaguacaauuucuucaaugaaaggcaugga

SEQ ID NO: 119258 - RNA, 46 nt, Mus musculus
agaauaaugauacuuuuaaguauaucuucugaaucuugauccagug

SEQ ID NO: 119259 - RNA, 45 nt, Mus musculus
ccugacuguccuggaacuagcucuguagacuaggcuggccuugaa

SEQ ID NO: 119260 - RNA, 46 nt, Mus musculus
ucugggaguuauuuuuuucaguuguggcuuuucuuuucugggaggu

SEQ ID NO: 119261 - RNA, 45 nt, Mus musculus
uaagaaauagguccuuucaagggaauuuuaaaucaagguggcaga

SEQ ID NO: 119262 - RNA, 43 nt, Mus musculus
aaaugaagguuaugccaagcugauugcugaacugggacaagau

SEQ ID NO: 119263 - RNA, 46 nt, Mus musculus
augagaccuuggaggugggccaguuggcugaugauguagaagacag

SEQ ID NO: 119264 - RNA, 46 nt, Mus musculus
gccugucuguacugggauuaaaggccuguacacaugcagcccaagu

SEQ ID NO: 119265 - RNA, 46 nt, Mus musculus
guagauugcuaaugacucaggcuguuugauaauuugaacuggaaga

SEQ ID NO: 119266 - RNA, 46 nt, Mus musculus
uagaauacccaagauacaacuucuaaaacacaagagaaucaagaag

SEQ ID NO: 119267 - RNA, 46 nt, Mus musculus
gaagaaagggagucucaugucucacauauucuuagcuucaagagua

SEQ ID NO: 119268 - RNA, 46 nt, Mus musculus
auuucauugauuuuucuuuuucuguuucuuccaaguugugccagua

SEQ ID NO: 119269 - RNA, 46 nt, Mus musculus
guuacaguaggacuguguauaauguauaaaccuucauaucauaguu

SEQ ID NO: 119270 - RNA, 46 nt, Mus musculus
augacuuucaagugugugugugugugugugugugugugugugugug

SEQ ID NO: 119271 - RNA, 46 nt, Mus musculus
aguauuaccuuaauuuaagagaauauauuuauuagauggaacauuu

SEQ ID NO: 119272 - RNA, 46 nt, Mus musculus
ugucauggaaaauauaagcaaaggaguguuugcugaauucacagau

SEQ ID NO: 119273 - RNA, 48 nt, Mus musculus
uaggucuuguuuguguuuccuuuuugcugaaaauagggauaaguaaga

SEQ ID NO: 119274 - RNA, 42 nt, Mus musculus
uuauucaguaauuuguaaguauuguucaagcuggccuagaau

SEQ ID NO: 119275 - RNA, 46 nt, Mus musculus
uuaaaagguuguaaaacuuguaucaugaguuuuuuccacaagaggu

SEQ ID NO: 119276 - RNA, 46 nt, Mus musculus
aauggcucaggguaagaacauguacugcuuuuccuuaggaacagag

SEQ ID NO: 119277 - RNA, 42 nt, Mus musculus
aguauaucugauguaaugaaaagacagugcuaaggcagagac

SEQ ID NO: 119278 - RNA, 46 nt, Mus musculus
acauauuaagcaacuacuacuacgaaacuauaucuucagcccuuua

SEQ ID NO: 119279 - RNA, 49 nt, Mus musculus
uuauggucuccuguaacucuaguuccaagggauaaaaccucuggucuca

SEQ ID NO: 119280 - RNA, 44 nt, Mus musculus
cgcggcuguggugguucccgcagaguggauaaagaacugggaga

SEQ ID NO: 119281 - RNA, 45 nt, Mus musculus
ggaaagaauggcuaaaagguaaauaacuaaaauaauuaauaagag

SEQ ID NO: 119282 - RNA, 45 nt, Mus musculus
cuuaaaucucacucagaaagggaaacaaaauaaucaucagaggug

SEQ ID NO: 119283 - RNA, 54 nt, Mus musculus
gcguugagugugguggcagugccugggacuuggccgagggcgggaagugcugcc

SEQ ID NO: 119284 - RNA, 42 nt, Mus musculus
cagucugaguggggguugggaagaagcagaggggaugggcgc

SEQ ID NO: 119285 - RNA, 45 nt, Mus musculus
uauccagugugcuucucagaagaaaaagagauggaacccccagaa

SEQ ID NO: 119286 - RNA, 60 nt, Mus musculus
gaacuucuugguccucuuuuugacgaucuugggcuucaccagaggccggagggcagccau

SEQ ID NO: 119287 - RNA, 46 nt, Mus musculus
uugucuacuagcagagaguaagguacuacguugucuacuagcagaa

SEQ ID NO: 119288 - RNA, 41 nt, Mus musculus
uguuguuuuuuguuuguuugguuuugguuuuucgagacagg

SEQ ID NO: 119289 - RNA, 87 nt, Mus musculus
uaaugaaaaacaggcuaucaauuugagagugggggacauggaggaagcugggaaggagggaccuuuagaggggcugagguggcagga

SEQ ID NO: 119290 - RNA, 36 nt, Mus musculus
aaggcggagcagugagaagaagggggcaggucagaa

SEQ ID NO: 119291 - RNA, 42 nt, Mus musculus
gaugaagaagguggagggggugguucccgaugacucccugau

SEQ ID NO: 119292 - RNA, 42 nt, Mus musculus
aggugggaguggguugguaggugaaggagcacccucauagag

SEQ ID NO: 119293 - RNA, 46 nt, Mus musculus
ucacagucgagccaagguucuaagcugcugucuggagacuggccgu

SEQ ID NO: 119294 - RNA, 46 nt, Mus musculus
cacugaucuuuucuggcaaauauaagaagcaucauccccacaaggc

SEQ ID NO: 119295 - RNA, 25 nt, Mus musculus
augcagaaagugguguuguggaaua

SEQ ID NO: 119296 - RNA, 46 nt, Mus musculus
ggauucugguguguucucaggaccaagaguaacugugcuagaagaa

SEQ ID NO: 119297 - RNA, 46 nt, Mus musculus
cccuguguuggauuccuagcaccacaucaaaaccaacugcagagaa

SEQ ID NO: 119298 - RNA, 45 nt, Mus musculus
ugauuagagaacaagaaguuaauuuaagccaggguugugggaggc

SEQ ID NO: 119299 - RNA, 42 nt, Mus musculus
ccaugucuuaagauucuauuaccaguggugaauggggcaggg

SEQ ID NO: 119300 - RNA, 46 nt, Mus musculus
gauauggugggcuauaccugugaucccacacuggggagguggaggc

SEQ ID NO: 119301 - RNA, 45 nt, Mus musculus
aaguaacugauucuguuuggcuggccagggaguaccaggggccug

SEQ ID NO: 119302 - RNA, 45 nt, Mus musculus
gauacuuuaggcuugauccaaguuucuaaucauaagccccaagau

SEQ ID NO: 119303 - RNA, 46 nt, Mus musculus
cccuucaauuuggucaaagaaaguucuauuuuuaaaaagaggaaug

SEQ ID NO: 119304 - RNA, 46 nt, Mus musculus
uuguagucagagaauuuuaagaguucacgaaggaaugccaucaagu

SEQ ID NO: 119305 - RNA, 41 nt, Mus musculus
cuagaggguggaagaaagaaaaggggaagcccacugucaga

SEQ ID NO: 119306 - RNA, 42 nt, Mus musculus
uccgcaugucaaguguggauaguagccgggcacggggacugg

SEQ ID NO: 119307 - RNA, 41 nt, Mus musculus
agugagcccuguugagagaggccaguaacuuuccccgacac

SEQ ID NO: 119308 - RNA, 25 nt, Mus musculus
gcagcauggcugaccaacugacuga

SEQ ID NO: 119309 - RNA, 44 nt, Mus musculus
cuucugugggguucugccccagggaccucaucacuguccccagc

SEQ ID NO: 119310 - RNA, 46 nt, Mus musculus
uaauggcacaauugauuucccugaauuuaugacaaugauggcaaga

SEQ ID NO: 119311 - RNA, 67 nt, Mus musculus
cuucgccaugugaugacaaaccuuggagagaaguuaacagaugaagaggucgaugagaugaucaggg

SEQ ID NO: 119312 - RNA, 42 nt, Mus musculus
uaagcccgucugcacaucuaaacuuagauggaguugguccaa

SEQ ID NO: 119313 - RNA, 41 nt, Mus musculus
ucuuuuucuccuagggccaaucuugucccugugcccacaga

SEQ ID NO: 119314 - RNA, 41 nt, Mus musculus
gcaccuccugccuuaucagccugccauggccagccccacag

SEQ ID NO: 119315 - RNA, 45 nt, Mus musculus
aaaauaaucccaaccaaucaaccaaccaaccaaauaacccacaga

SEQ ID NO: 119316 - RNA, 45 nt, Mus musculus
uugaccuguuccaugcgguagucccuaucuuucagccguagccuu

SEQ ID NO: 119317 - RNA, 25 nt, Mus musculus
ccucugccucuuccccagaaccguu

SEQ ID NO: 119318 - RNA, 35 nt, Mus musculus
aggucaaggaccaaggggucaaggaaugagcuaga

SEQ ID NO: 119319 - RNA, 45 nt, Mus musculus
ggacaguuacuagugccagggcuggagucacagggaggugagagu

SEQ ID NO: 119320 - RNA, 42 nt, Mus musculus
uuuuuaaauaaaccuucuguauuuaagaccuuggccucaaga

SEQ ID NO: 119321 - RNA, 45 nt, Mus musculus
uucucaauaagcauugaugagaugccaacaacacagccccucaca

SEQ ID NO: 119322 - RNA, 76 nt, Mus musculus
guaccuuccacuuguauuuauuucuguagcuucucuuuucuccccccccaucuacucucuaacauccaaaucccac

SEQ ID NO: 119323 - RNA, 49 nt, Mus musculus
uuucauuagggcuaugagagauuucaggggagacaaccaccugagacag

SEQ ID NO: 119324 - RNA, 41 nt, Mus musculus
uuuuguucucucucucucugaaugugugugugugugguagg

SEQ ID NO: 119325 - RNA, 46 nt, Mus musculus
uagaggccaaacuacggacagagagaggaacguguuagaucuaggu

SEQ ID NO: 119326 - RNA, 45 nt, Mus musculus
auuguuaacuaaaaggcagacagcuuuguucggagcucuagaaca

SEQ ID NO: 119327 - RNA, 45 nt, Mus musculus
gaacauauccuccccuggcaguucguccgugugaagccgucugaa

SEQ ID NO: 119328 - RNA, 62 nt, Mus musculus
caauuuacccuugccccagugggaccuucucucuugccaggguauauagcacaggacaggga

SEQ ID NO: 119329 - RNA, 45 nt, Mus musculus
cacaauuuaugucuucgccuuuaacaucgucuauguggcccucag

SEQ ID NO: 119330 - RNA, 45 nt, Mus musculus
ccugggugggaaacuguguuggaaagaggaacuaccgcuacuucu

SEQ ID NO: 119331 - RNA, 46 nt, Mus musculus
gguuucaucgcauuacuauaucuguucuuugucauuauugggagau

SEQ ID NO: 119332 - RNA, 65 nt, Mus musculus
ugugcuaagccuuguguguagaggucaaaggacaacuuuguggauugauucauuccugccuugau

SEQ ID NO: 119333 - RNA, 97 nt, Mus musculus
gguuguuuuuuuucucuuuaauuguuuucuuuuaucguguagagagugagagagagaaugcguuguuuguguguuuguuugauguggguggggcuug

SEQ ID NO: 119334 - RNA, 64 nt, Mus musculus
acccucuucuuaaauccuagugaauuaaggccccacccuaugacuaauuacugagacagucuaa

SEQ ID NO: 119335 - RNA, 41 nt, Mus musculus
ucaggugugguuuuauauauacuuguaauacuagcccuugg

SEQ ID NO: 119336 - RNA, 45 nt, Mus musculus
uauaaaaauguaaauuaaacccacuuuguuuauaaaaagggagau

SEQ ID NO: 119337 - RNA, 45 nt, Mus musculus
cccuugcacaccccuccaaacaaaacaaaacaaaaaccacgaguc

SEQ ID NO: 119338 - RNA, 45 nt, Mus musculus
caagguauauuuagauaggaaggaaucuccuacgcagcagcagau

SEQ ID NO: 119339 - RNA, 53 nt, Mus musculus
gcaagaucuuccggccucccagggccucccauuguagcaucugugacaacugu

SEQ ID NO: 119340 - RNA, 56 nt, Mus musculus
uauuaagaauuuccagauaaacaaccagauugugaaacugaaauacuguuauacau

SEQ ID NO: 119341 - RNA, 45 nt, Mus musculus
uuauaguagguagaaauagugauugugugugugugugugugugug

SEQ ID NO: 119342 - RNA, 85 nt, Mus musculus
cgcuaugcucuuucuuuucuccauggccacgcuguugaggacaaguuucagugacccuggagugauuccucgagcacuaccagau

SEQ ID NO: 119343 - RNA, 46 nt, Mus musculus
gaggaauggaaaggagucuacaaacuaguaauaugcaugacccuua

SEQ ID NO: 119344 - RNA, 46 nt, Mus musculus
uuuguuuugaagauugaucuuauagaugaucaaugacuagggagau

SEQ ID NO: 119345 - RNA, 46 nt, Mus musculus
caggacgauuucuccugcucuuagcauuccuuaguugccugcaguu

SEQ ID NO: 119346 - RNA, 46 nt, Mus musculus
gauugugcugauaaaagaacaaacaaaacauuaaaaauguaggaag

SEQ ID NO: 119347 - RNA, 52 nt, Mus musculus
uccuuaaagccacccuuaacagcugcuauuggaaccguuucaucagccacca

SEQ ID NO: 119348 - RNA, 26 nt, Mus musculus
gagaacgauugagcaagaucugcucc

SEQ ID NO: 119349 - RNA, 46 nt, Mus musculus
cuacucaaaagcuuuugugauauuugguuuaacucagugucccgag

SEQ ID NO: 119350 - RNA, 41 nt, Mus musculus
cucagugugugugugugugugugugugugugugcaugcacc

SEQ ID NO: 119351 - RNA, 45 nt, Mus musculus
cuuugggguuacuuuuuuaugcaauguuguaccuaguacuagaga

SEQ ID NO: 119352 - RNA, 46 nt, Mus musculus
ccugacaaaguuugucauaaaaauucacguccuuucacugacagua

SEQ ID NO: 119353 - RNA, 45 nt, Mus musculus
cuuugugguuauaguagaauaugcacuuccuaaaaaggccaagaa

SEQ ID NO: 119354 - RNA, 45 nt, Mus musculus
guuuguuuguuuguuuguuuuccuccuuagagaccaaacagagau

SEQ ID NO: 119355 - RNA, 54 nt, Mus musculus
uucagauucuaccagccaggagguauuaucugaauugagggcauuaucuaagaa

SEQ ID NO: 119356 - RNA, 72 nt, Mus musculus
acucaguaaggaaaaccaucuaucuaagaaacaaaaaaagaguccagcaaaggcuguugaccuggucuggga

SEQ ID NO: 119357 - RNA, 49 nt, Mus musculus
aaagaggacagccuuccaaauaaggagcgcccuagaccuucaguagaag

SEQ ID NO: 119358 - RNA, 46 nt, Mus musculus
agcuuuugcuggggaugaugucaucaaagaguuccuaaaagagaag

SEQ ID NO: 119359 - RNA, 66 nt, Mus musculus
cccucuucccaaguucuugaauuaagugauccccaacauccccaacguucuuuuuaauuaauuagc

SEQ ID NO: 119360 - RNA, 65 nt, Mus musculus
accauccagaauccuauaggauccacauggaacacccagagagcauuccaaaagcugacugcucc

SEQ ID NO: 119361 - RNA, 45 nt, Mus musculus
guugaaauaucugaggaguguccucugcauggucuaugcugcaag

SEQ ID NO: 119362 - RNA, 42 nt, Mus musculus
gggggcucugcccaggugaagggggcgcugugacgggggcgg

SEQ ID NO: 119363 - RNA, 42 nt, Mus musculus
ggcagcgcggcggcagcggcggcggcggcggcggcggcggcg

SEQ ID NO: 119364 - RNA, 26 nt, Mus musculus
uagagguggguagucgcccccaggac

SEQ ID NO: 119365 - RNA, 41 nt, Mus musculus
ggguuccggggaaggagauggaggguggcgacugggggggg

SEQ ID NO: 119366 - RNA, 45 nt, Mus musculus
gggccaggcgaggcggggagggugcucaaauugaagaaggaugag

SEQ ID NO: 119367 - RNA, 44 nt, Mus musculus
agcggaucguggccagggagugggggggcuuagugguggucuuc

SEQ ID NO: 119368 - RNA, 25 nt, Mus musculus
gguugaggggaaaggcgggagggaa

SEQ ID NO: 119369 - RNA, 45 nt, Mus musculus
cagaguuuuaggauacucgaaugugaugucaccuggugguacuga

SEQ ID NO: 119370 - RNA, 47 nt, Mus musculus
ggacuuuguuaauggauuuucauguacacuugagugcaggcauuagu

SEQ ID NO: 119371 - RNA, 46 nt, Mus musculus
uagcuuugcagaaacaguauguagguuccuuuccauucugacccag

SEQ ID NO: 119372 - RNA, 45 nt, Mus musculus
uucugaaugggaaaggggagucuuggucccaucuugaguggagaa

SEQ ID NO: 119373 - RNA, 45 nt, Mus musculus
gggucagcuagccucuuaagaagccaugcaagaauucugugcuga

SEQ ID NO: 119374 - RNA, 46 nt, Mus musculus
aguguugaggugguguuuuccucuuuguugguagauaaauugugau

SEQ ID NO: 119375 - RNA, 46 nt, Mus musculus
uuuuucugaguucugugaaauguauaacacacagauaugaucccag

SEQ ID NO: 119376 - RNA, 32 nt, Mus musculus
augaauauuuucuguuuuuuuuuuuuuuuuaa

SEQ ID NO: 119377 - RNA, 62 nt, Mus musculus
ugcugggauuaaagucaucugcugucuccuuaugcagcccagucuggccuugaacucucagu

SEQ ID NO: 119378 - RNA, 44 nt, Mus musculus
cagagggaagaaggaagaaaagagaagaaagaggagaaaaaagg

SEQ ID NO: 119379 - RNA, 50 nt, Mus musculus
auaugagagugaccaguccaucuaggggugaacugaauuugugaaagcug

SEQ ID NO: 119380 - RNA, 46 nt, Mus musculus
acagaaagagacccagaagcaagaagaggagacgggcagaaagaug

SEQ ID NO: 119381 - RNA, 42 nt, Mus musculus
aaugagacugagagacuaaagaggagccagggaagugaggag

SEQ ID NO: 119382 - RNA, 67 nt, Mus musculus
cuccugcuuugagaacuuuucuuucccuccacacauguagaucacucauuccuucacauccuguagg

SEQ ID NO: 119383 - RNA, 53 nt, Mus musculus
cuauguugauugccugauugugacucauagccccuccacucacucccccgaua

SEQ ID NO: 119384 - RNA, 46 nt, Mus musculus
uauguugaguaugaacaaucugugaacauugaaaggcuaaauggag

SEQ ID NO: 119385 - RNA, 41 nt, Mus musculus
accaguucugaccggauucgcauguguggcaucaacgagga

SEQ ID NO: 119386 - RNA, 46 nt, Mus musculus
cccagggagggguuggaccuggggacaagauucugguuuguuucug

SEQ ID NO: 119387 - RNA, 45 nt, Mus musculus
aauagauccagaguuucucaaguaauucuaaaaaguauuuguaug

SEQ ID NO: 119388 - RNA, 42 nt, Mus musculus
uaaaacaaggcuaaccugagaaauuaaaaagcacuggacaaa

SEQ ID NO: 119389 - RNA, 46 nt, Mus musculus
cccaaacaaagagcaggcagagcagcccugugcuuugcccacccag

SEQ ID NO: 119390 - RNA, 45 nt, Mus musculus
gguauggagccaccacuuguccuucgacuuuacuuuagcguguga

SEQ ID NO: 119391 - RNA, 42 nt, Mus musculus
uuaggauucuuaccugaaguuuagagaauucuucuugagcag

SEQ ID NO: 119392 - RNA, 46 nt, Mus musculus
aguggcagcaaugcccgggggacaaacccagauggcaauaccacag

SEQ ID NO: 119393 - RNA, 46 nt, Mus musculus
cucgagugaaacgggaaagcauuggggucuuuacuugcaagaacag

SEQ ID NO: 119394 - RNA, 48 nt, Mus musculus
ggagacagaaucucugccacccaagaaggucaaguguaacaaagaaaa

SEQ ID NO: 119395 - RNA, 45 nt, Mus musculus
cccaggaacccaccaagaaaagccccagaggggcuuuagauucag

SEQ ID NO: 119396 - RNA, 42 nt, Mus musculus
aacuugaggaacacacaccaaccuuuguguuguguaggcaga

SEQ ID NO: 119397 - RNA, 46 nt, Mus musculus
aauuuaggguugugcuuuuacuguuagccaaguuaaggguaaguag

SEQ ID NO: 119398 - RNA, 45 nt, Mus musculus
agguuauuaggaccuaaguugucaccccagacuuccuuacucauu

SEQ ID NO: 119399 - RNA, 45 nt, Mus musculus
cuaguacuucaugguauuuuggacucuauaaaguacguacuuaag

SEQ ID NO: 119400 - RNA, 45 nt, Mus musculus
gauaaguguaccccuaauaacugacagagccugaccuugaacuca

SEQ ID NO: 119401 - RNA, 29 nt, Mus musculus
agacagugacaugggaagccaggagguuu

SEQ ID NO: 119402 - RNA, 42 nt, Mus musculus
gcaaagaggagaaaagucagaaagacccaaagggauacccag

SEQ ID NO: 119403 - RNA, 38 nt, Mus musculus
ugcccggcaaaugugggacaccaaugaagaggaggaag

SEQ ID NO: 119404 - RNA, 26 nt, Mus musculus
accggggaguaccugauugaacaaga

SEQ ID NO: 119405 - RNA, 49 nt, Mus musculus
ucagagcacugccucaggaacaggaaccuucucuuguccagcaaagccc

SEQ ID NO: 119406 - RNA, 59 nt, Mus musculus
cuuccagauaaccuggaggagccagccugccuugaaaacccagaaaagccgucaggaaa

SEQ ID NO: 119407 - RNA, 45 nt, Mus musculus
agccaaugaaagguggguuguaaaccccuuucauugugggaguag

SEQ ID NO: 119408 - RNA, 45 nt, Mus musculus
agagcuacaccucagcuaucaacuugaugcauuuccaggccccca

SEQ ID NO: 119409 - RNA, 45 nt, Mus musculus
uggugaagaccagagaaagccagaguuuauguugacuuuguagcc

SEQ ID NO: 119410 - RNA, 46 nt, Mus musculus
caagaagcauacagacagugguggcgcacgccuuuaaucccagcac

SEQ ID NO: 119411 - RNA, 60 nt, Mus musculus
uaggccuuucuccacagcuccaccuccaccagggaagaucuagaacaagugagcaggagu

SEQ ID NO: 119412 - RNA, 42 nt, Mus musculus
guugccuagagugggggucaggaagauguggccccagcagau

SEQ ID NO: 119413 - RNA, 45 nt, Mus musculus
gaagcuggggcagguauugugcucuaucccagccucaguccagag

SEQ ID NO: 119414 - RNA, 42 nt, Mus musculus
uuacaguuaguucucaucucccuguuguuguugugguuggug

SEQ ID NO: 119415 - RNA, 46 nt, Mus musculus
uuguuuuucuuuuuuguuuugcauuucgguguguauucuggcugcc

SEQ ID NO: 119416 - RNA, 45 nt, Mus musculus
aagcagaauggccaagccccacaaauaauaaaucagaccaggaaa

SEQ ID NO: 119417 - RNA, 58 nt, Mus musculus
auggguggauagaacauuuuuuuuauucagcauacauuuucuuuauguaggagcagga

SEQ ID NO: 119418 - RNA, 49 nt, Mus musculus
auggaacgucuuuaaccgaaugccaauugcaaggaagguaggugugcuu

SEQ ID NO: 119419 - RNA, 58 nt, Mus musculus
uuuguauuugugaaaucggccacaggaacugguauccguucggagagugagacagagu

SEQ ID NO: 119420 - RNA, 51 nt, Mus musculus
uggguccugaugucggcuaugaagcuauuggucugguggauaguaguuugc

SEQ ID NO: 119421 - RNA, 44 nt, Mus musculus
cuaaaaauauggaaauaugggguacagaaauaaaagccuuaaga

SEQ ID NO: 119422 - RNA, 63 nt, Mus musculus
uggcuggagaaaacaugacuggagccgcuaagccauacuggcaucagucaauguucugguaaa

SEQ ID NO: 119423 - RNA, 83 nt, Mus musculus
aggggaugcugcaugcuucuaugauauaaaguugggucgaaggcgaguagagcaucaugaucaugcuguugugaguggaagac

SEQ ID NO: 119424 - RNA, 46 nt, Mus musculus
uagguugcuuugggggagucugaauagcucuaaaaaaugaacaaga

SEQ ID NO: 119425 - RNA, 43 nt, Mus musculus
acuuucagacagaccuccuguucccacagcucagcguccagag

SEQ ID NO: 119426 - RNA, 46 nt, Mus musculus
agaacagcuuaaccaaauagagucaccguguuugauggccgcagag

SEQ ID NO: 119427 - RNA, 45 nt, Mus musculus
cuuccggguaaaugcagaacuccaagcacguucuaacaucugggu

SEQ ID NO: 119428 - RNA, 45 nt, Mus musculus
auagugacagcugugggccuagagcccaauguugaguuggccaag

SEQ ID NO: 119429 - RNA, 50 nt, Mus musculus
guacaaucaguuggagucagcgguggcagguuacucauuaagcugaaaga

SEQ ID NO: 119430 - RNA, 51 nt, Mus musculus
ggaagauccuuccucaauaccucagcaacuggaccauggaaaaagucaaac

SEQ ID NO: 119431 - RNA, 72 nt, Mus musculus
ucucgggaggucaagucaauuacaguuaucggcgggggcuuccuugggagugagcuggccugugcucuuggc

SEQ ID NO: 119432 - RNA, 74 nt, Mus musculus
gccccuuugggaaaucaguggacuaaacugguaugauccugcagauuggagauuuuagagccuuggagaagauc

SEQ ID NO: 119433 - RNA, 89 nt, Mus musculus
uuggaugaagucuguauguucuugauuauuaacgcugaauaauuugugugggagaucgccuccuuuugcuuuguagaauguuggcaaca

SEQ ID NO: 119434 - RNA, 46 nt, Mus musculus
cucuaguguuugauccaccagaacucuuugugguuucuuggcauuu

SEQ ID NO: 119435 - RNA, 46 nt, Mus musculus
aaguacucccuccaauugagagccaaguucucuuuauagcucuucc

SEQ ID NO: 119436 - RNA, 64 nt, Mus musculus
cacuccaagaagucugucugccaucgauagggcuggagcagaggugaagaguagaacaacacuu

SEQ ID NO: 119437 - RNA, 47 nt, Mus musculus
gauggcucucagauuaccuuugaaaagugcuugauugcaacggguga

SEQ ID NO: 119438 - RNA, 46 nt, Mus musculus
ggccuccaauaugagaccugguuucuaaaaaaagagguggacaggg

SEQ ID NO: 119439 - RNA, 45 nt, Mus musculus
uacucauguugacauugugugugcacaugcauguagaggccagag

SEQ ID NO: 119440 - RNA, 46 nt, Mus musculus
gcauacugucacugucuucagacacaccagaagagggcguuguauc

SEQ ID NO: 119441 - RNA, 46 nt, Mus musculus
aaccacuuccucuauaacagagcugcagaaugugguuaagcuggua

SEQ ID NO: 119442 - RNA, 45 nt, Mus musculus
uguuucaauggaggggaugguagaaaggggguggaaagcacagaa

SEQ ID NO: 119443 - RNA, 45 nt, Mus musculus
agcacguagucugcuuucccauuucaauucauguuuccucuccca

SEQ ID NO: 119444 - RNA, 46 nt, Mus musculus
gccuaauauugagaacggugguguggcuguccucacugggaaaaag

SEQ ID NO: 119445 - RNA, 42 nt, Mus musculus
guguguguguguguguguguguguguguguguggaagccaga

SEQ ID NO: 119446 - RNA, 50 nt, Mus musculus
gauccaaaugucacaaagacacugcaauucagacaguggaauggaaaaga

SEQ ID NO: 119447 - RNA, 46 nt, Mus musculus
acaacagcuacagugcacuuacauauaauaaauaaauaaaucuuaa

SEQ ID NO: 119448 - RNA, 46 nt, Mus musculus
uaaggcugaggugcuaugacuuguuaauaucuuguugacgugagug

SEQ ID NO: 119449 - RNA, 43 nt, Mus musculus
cuacaaaacuauaaaagaagaccaaaaaagauacaaugaaaga

SEQ ID NO: 119450 - RNA, 41 nt, Mus musculus
auuagucauaggagaaacuuaguuuaaaaucagugcccaga

SEQ ID NO: 119451 - RNA, 42 nt, Mus musculus
ugaaauuauacuagaucaauccaaacccauaaauuuagagcc

SEQ ID NO: 119452 - RNA, 45 nt, Mus musculus
aagugcacaaaaggaguagcuagcuccugccaguuguaaguuaga

SEQ ID NO: 119453 - RNA, 45 nt, Mus musculus
uguguuaguccuuauugugggcuuaucaacaauaggagcuggugc

SEQ ID NO: 119454 - RNA, 48 nt, Mus musculus
gauuauauuuuucuuggucauagaacagugaacaucaugcagcccaag

SEQ ID NO: 119455 - RNA, 48 nt, Mus musculus
uugagaacucuaacagcuaagcuggguaugguaguuuaggcuuaguag

SEQ ID NO: 119456 - RNA, 46 nt, Mus musculus
guuuacuaaauagguuaucucaguguuuacuuacugcauggaaaga

SEQ ID NO: 119457 - RNA, 42 nt, Mus musculus
gggagagagagagaaaggagagagagagagagagggagggag

SEQ ID NO: 119458 - RNA, 45 nt, Mus musculus
aaauaaauaaauaaauaaauaaaucuaaaaaaaaagaauauggaa

SEQ ID NO: 119459 - RNA, 46 nt, Mus musculus
aaaucccagcaaccacaugguggcucacaaccauccgaaacgagau

SEQ ID NO: 119460 - RNA, 42 nt, Mus musculus
aaaccauuuuauuucaugacaacgaagaguucugaggcagau

SEQ ID NO: 119461 - RNA, 45 nt, Mus musculus
ugguugugagccaccaugugguugcugggacuugaccucaggacc

SEQ ID NO: 119462 - RNA, 45 nt, Mus musculus
acacuucuuuguccauguaccagcggaugacaucaccugcuuuaa

SEQ ID NO: 119463 - RNA, 46 nt, Mus musculus
caucuuuucuaccuauacagauuugugggaaugaaugcccccccuc

SEQ ID NO: 119464 - RNA, 42 nt, Mus musculus
uagguagagcuaaagcuacucugcuagucucuaggccccuga

SEQ ID NO: 119465 - RNA, 46 nt, Mus musculus
cccccucuauuuguucucugggaaguugucucaucaaacuuuagag

SEQ ID NO: 119466 - RNA, 86 nt, Mus musculus
uacgacguggcaaugguguaucaccaguagaaacuguaugucagauaucaagagaauuagcucagauugccuugagauggccagau

SEQ ID NO: 119467 - RNA, 46 nt, Mus musculus
ucacaaguuucuccuggaacucagauuaucugcuuuaccucccaaa

SEQ ID NO: 119468 - RNA, 44 nt, Mus musculus
acccgagcccgugguauucgacccguucgacggugcguggaagg

SEQ ID NO: 119469 - RNA, 42 nt, Mus musculus
ugggauuaaaauuccucuacaggaaaauaaaacagcccagga

SEQ ID NO: 119470 - RNA, 46 nt, Mus musculus
uuagaaugcaguuuauacuugugaguagagcugacuugagauggag

SEQ ID NO: 119471 - RNA, 45 nt, Mus musculus
aaacuuguucuuugggggcagucccucccagaugcuugcugcuuu

SEQ ID NO: 119472 - RNA, 46 nt, Mus musculus
gcuucuuccuugacggugccuaguuucuuuaauauauggcuauaag

SEQ ID NO: 119473 - RNA, 46 nt, Mus musculus
ucagaaucauguuuaauguuaucauuuacuuaaaaucagcuauuac

SEQ ID NO: 119474 - RNA, 49 nt, Mus musculus
ccucugaaguuugagugguggggaaacagaagugcaugggagucuagga

SEQ ID NO: 119475 - RNA, 46 nt, Mus musculus
ccgugauuuagacaucuggggguucugguaucuguccugggcagug

SEQ ID NO: 119476 - RNA, 45 nt, Mus musculus
ugcacaguacccuacuggcccucugagaaugaugaggaucugaga

SEQ ID NO: 119477 - RNA, 46 nt, Mus musculus
agggcuuccuuaugaauugacagaaggcgacaucaucuguguguuc

SEQ ID NO: 119478 - RNA, 46 nt, Mus musculus
gucagccugcacaacuaagugagauccugcgucaaaaagccaccaa

SEQ ID NO: 119479 - RNA, 48 nt, Mus musculus
agacccuagaucagucccagagaguuaccccaugggagaucccagagc

SEQ ID NO: 119480 - RNA, 112 nt, Mus musculus
cuugugagagacaagaagacugggaaauccaaaggauucuguuuccugugcuaugaagaccagaggagcacaguucuggcuguugacaauuucaauggaauuaagguaaaug

SEQ ID NO: 119481 - RNA, 60 nt, Mus musculus
guguggaccaugugucaaacuaccgggcuccucaggaaucagaagauguggaugauguga

SEQ ID NO: 119482 - RNA, 46 nt, Mus musculus
aagucucugaagaugaagaugccaagcucacaaaaaagcacaaaaa

SEQ ID NO: 119483 - RNA, 48 nt, Mus musculus
gcaggcccaggcagagcagccguccugcuccagaagcgcgacagugaa

SEQ ID NO: 119484 - RNA, 65 nt, Mus musculus
ggaagcacaguagcaagacuuccgagagagcacagaagucagaacacagagagagcaagaagagu

SEQ ID NO: 119485 - RNA, 44 nt, Mus musculus
gaaacccaagcaugagcacaaguccgccagcaggagggaggccg

SEQ ID NO: 119486 - RNA, 46 nt, Mus musculus
cggggacucauuccggcaggcacagggggcauucugaugggcggag

SEQ ID NO: 119487 - RNA, 46 nt, Mus musculus
auaaugucaguuucucuugguugcuguuauuucuguauauaaagau

SEQ ID NO: 119488 - RNA, 46 nt, Mus musculus
cugugucucagaauacucucucagaggaaaaagaauggauuaggau

SEQ ID NO: 119489 - RNA, 73 nt, Mus musculus
ggagaaaccacauggagagaacaaggaguuuucuaugaggucgugaugagaggagagcagcuaugaggacaua

SEQ ID NO: 119490 - RNA, 46 nt, Mus musculus
guccuuuggccucccucuuuauuggacacuacuacuuagccccaag

SEQ ID NO: 119491 - RNA, 45 nt, Mus musculus
ucccucuguaauucagacaguggucucucccuccccggcccccuc

SEQ ID NO: 119492 - RNA, 46 nt, Mus musculus
ccccccaucagcccuagacaguggacccuuccuuuggugccccugg

SEQ ID NO: 119493 - RNA, 45 nt, Mus musculus; identical to SEQ ID NO: 79137

SEQ ID NO: 119494 - RNA, 48 nt, Mus musculus; identical to SEQ ID NO: 79138

SEQ ID NO: 119495 - RNA, 46 nt, Mus musculus
acaccucaauauacuggugucccaugcuuucccugucuuuuuucag

SEQ ID NO: 119496 - RNA, 45 nt, Mus musculus
uuuaaaugaaaugaacaccugcgaccccaucaugaauucugcagu

SEQ ID NO: 119497 - RNA, 47 nt, Mus musculus
uagccaccuuuugguucuaaacuauugauuuucugcaucugucucga

SEQ ID NO: 119498 - RNA, 52 nt, Mus musculus
ugccagggacagcccaggcaugggaucuuucuuguugguucuucuuuaggca

SEQ ID NO: 119499 - RNA, 46 nt, Mus musculus
auaauaauaagguuacuuguguaaguaaaguaauaugcuacuauag

SEQ ID NO: 119500 - RNA, 45 nt, Mus musculus
cuuccuuagugagaaucacaccaagguauuuuauauuauuugugu

SEQ ID NO: 119501 - RNA, 46 nt, Mus musculus
aggcgaaggggaaggaggauggggggcucauagaagggguaccaag

SEQ ID NO: 119502 - RNA, 42 nt, Mus musculus
auucuuguuccaugagacuggaacggggaaccagagccccag

SEQ ID NO: 119503 - RNA, 71 nt, Mus musculus
ucucacaagagacagcuauauuuacuuugaauugccacaccuggagagaagugaagccuaaagccagcauu

SEQ ID NO: 119504 - RNA, 45 nt, Mus musculus
ugcuguaagguguguuugugcacauagcauggcauuuguggcgag

SEQ ID NO: 119505 - RNA, 44 nt, Mus musculus
aagacagcuauaucaguguccuuucagcaaaaucuuucuggcau

SEQ ID NO: 119506 - RNA, 46 nt, Mus musculus
uguguuuuguaaauugaaucuuggguauucuaaguuucagggcuag

SEQ ID NO: 119507 - RNA, 46 nt, Mus musculus
uggccagcugcauguacuuaagccagcaaaaaguauacucaaaggu

SEQ ID NO: 119508 - RNA, 45 nt, Mus musculus
ucuuguaacccuuuaauucaguucaucaugugguaagccccaacc

SEQ ID NO: 119509 - RNA, 44 nt, Mus musculus
cauuacagaugguuguaagccaccaugugguugcugggaacuga

SEQ ID NO: 119510 - RNA, 44 nt, Mus musculus
accuaguaaacaggacccgaaccaaguguauaguuguccugagg

SEQ ID NO: 119511 - RNA, 46 nt, Mus musculus
aaaguuuguuaaauagagaagcacuugauagaaggcaccuggauaa

SEQ ID NO: 119512 - RNA, 46 nt, Mus musculus
cugggaagacaaugagcuucaggucaaaguccagcccuccuccuag

SEQ ID NO: 119513 - RNA, 42 nt, Mus musculus
caggcuucagagggaauuuaucuagacaaaagagaggcaucc

SEQ ID NO: 119514 - RNA, 46 nt, Mus musculus
ucauuuguucauccuugaugugaagauuggaaagguaauugaagaa

SEQ ID NO: 119515 - RNA, 45 nt, Mus musculus
aaacacugcagucccaguuucuuucggggcuugaagagaagucaa

SEQ ID NO: 119516 - RNA, 46 nt, Mus musculus
gugcgcagcugugcugagguccagggacagaaagcagaugggcaga

SEQ ID NO: 119517 - RNA, 46 nt, Mus musculus
uguauuucucuccuacugugggcagacuggcaucacccgacccuuc

SEQ ID NO: 119518 - RNA, 42 nt, Mus musculus
cuccauccugcuucuccucagccauuuugaagcagggaggau

SEQ ID NO: 119519 - RNA, 46 nt, Mus musculus
gaagcuaaauucuaggaauacagcauugcaagcuucugacacagac

SEQ ID NO: 119520 - RNA, 42 nt, Mus musculus
gaccauggccugcacacacuucuucccaggagaaggggaaug

SEQ ID NO: 119521 - RNA, 93 nt, Mus musculus
ucccuagaaccggccccugggauuugcugcucaggacccgaguucacugagacaucaggagcaagcacuggaggccgggugcugcuggaccca

SEQ ID NO: 119522 - RNA, 45 nt, Mus musculus
augcuacacauuuuaagauaugucuucuuacuaagaccuagagaa

SEQ ID NO: 119523 - RNA, 30 nt, Mus musculus
agugugggcaccaguaauggcuuggagcug

SEQ ID NO: 119524 - RNA, 46 nt, Mus musculus
gacugagguccaguaccaagugcacagcugugcugagguccaggaa

SEQ ID NO: 119525 - RNA, 56 nt, Mus musculus
gcacacaccccuccuccuucauccugcuucuccucagccauuuugaagcagggaag

SEQ ID NO: 119526 - RNA, 47 nt, Mus musculus
agaagcuaaauucuaggaguacagcacugcaugcuucugacacagac

SEQ ID NO: 119527 - RNA, 46 nt, Mus musculus
aaaucccagcaaccacaugguggcucacaacuauauguaaugagau

SEQ ID NO: 119528 - RNA, 59 nt, Mus musculus
ggagccaugcgggacuugaccauggccugcacacacuucuucccaggagaaggggagug

SEQ ID NO: 119529 - RNA, 82 nt, Mus musculus
cccugggauuugcugcucagaaccugaguucacugagacaucaggagcaaguacuggaggccggugcugcuggacccagaug

SEQ ID NO: 119530 - RNA, 28 nt, Mus musculus
guccugccacacauuauauagcccaugc

SEQ ID NO: 119531 - RNA, 45 nt, Mus musculus
uuccuuuagagcaggcgaaguguuggcaccaguaauggcuuugag

SEQ ID NO: 119532 - RNA, 46 nt, Mus musculus
gcuuaauuuuguguagguuuuucucaauaauguuaugcuaagagau

SEQ ID NO: 119533 - RNA, 46 nt, Mus musculus
ucauuggaaggacaacagcggagcugugaguuuugaaaccgcgucc

SEQ ID NO: 119534 - RNA, 51 nt, Mus musculus
cuccuccuacauccagcuucuccucagccauuuugaagcagggaagaucag

SEQ ID NO: 119535 - RNA, 46 nt, Mus musculus
ggaagcuaaauucuaggaguacagcauugcaugcuucugacagaga

SEQ ID NO: 119536 - RNA, 42 nt, Mus musculus; identical to SEQ ID NO: 119520

SEQ ID NO: 119537 - RNA, 45 nt, Mus musculus
agacaucaggagcaagcacuggaggccggugcugcuggacccaga

SEQ ID NO: 119538 - RNA, 46 nt, Mus musculus
guguuucuccaaguaggcauguucauagcauucaguguugacaggu

SEQ ID NO: 119539 - RNA, 47 nt, Mus musculus
guuccagugugaacuaaugaaagccccauugaaaaucagugacagau

SEQ ID NO: 119540 - RNA, 58 nt, Mus musculus
uuaaguaguccaagcuccucucagugaugcaugucuuaguugccaagggaaaguacaa

SEQ ID NO: 119541 - RNA, 47 nt, Mus musculus
caugcuacacauuuuaagcuaugucuucuugcuaagaccagagacuc

SEQ ID NO: 119542 - RNA, 46 nt, Mus musculus
gaaguugugggccaggccuuugguucuuccuaucuggggcaugaca

SEQ ID NO: 119543 - RNA, 45 nt, Mus musculus
cuucuguguuugcuagguuaugguauuuauuuucaggcuugaggg

SEQ ID NO: 119544 - RNA, 46 nt, Mus musculus
ugggacuuccagaauaucuagguccauguuaccaugcccagcagac

SEQ ID NO: 119545 - RNA, 46 nt, Mus musculus
gacugagguccaauaccaaguacacagcugugcugagguccaggga

SEQ ID NO: 119546 - RNA, 46 nt, Mus musculus
gaaaugugcccgauuuacugucuauuuucuccuuaaguacccagac

SEQ ID NO: 119547 - RNA, 46 nt, Mus musculus
gcucuggggcagcacugccaucaugcggaaaauguuuccuguagag

SEQ ID NO: 119548 - RNA, 46 nt, Mus musculus
guuuauucuucuggauuuggugguggauucuggugaagauacagau

SEQ ID NO: 119549 - RNA, 46 nt, Mus musculus
ggugccucaaagcuccuccauccuucucuuuccuuccugcuuagau

SEQ ID NO: 119550 - RNA, 46 nt, Mus musculus
ggacagagagcugcagucaggauacuuucccugcucuggggcaaca

SEQ ID NO: 119551 - RNA, 46 nt, Mus musculus
gaagcuaaauucuaggaguacagcauugcaagcuucugacacagac

SEQ ID NO: 119552 - RNA, 42 nt, Mus musculus; identical to SEQ ID NO: 119520

SEQ ID NO: 119553 - RNA, 97 nt, Mus musculus
cucccuagaaccggccccugggauuugcugcucaggacccgaguucagugagacaucaggagcaagcacuggaggccggugcugcuggacccagaug

SEQ ID NO: 119554 - RNA, 53 nt, Mus musculus
cuugugucucugcuccagugugaacuaaugaaacccaauuugaaaaucaguga

SEQ ID NO: 119555 - RNA, 51 nt, Mus musculus
ccaagcugcccugccacacauuauauagcccaggcuccucucagagauucu

SEQ ID NO: 119556 - RNA, 42 nt, Mus musculus
augacaagaagacaccacagggaagaaaaugcaggcucuugu

SEQ ID NO: 119557 - RNA, 45 nt, Mus musculus
ugucucuagauauugguuaugguauuuauuuucaggcuugagggu

SEQ ID NO: 119558 - RNA, 46 nt, Mus musculus
ccaccauguuuacccuuugagggcaaguuaguccaagggaaguaua

SEQ ID NO: 119559 - RNA, 45 nt, Mus musculus
ccgaaauuuuaucuucaguaauccauagucacugugccccaagau

SEQ ID NO: 119560 - RNA, 46 nt, Mus musculus
auauaguaaaguaauuuauugaugacuuacagucugcagcccaauu

SEQ ID NO: 119561 - RNA, 45 nt, Mus musculus
caggcacacaccuccuccuccauccugcaucuccucagccauuuu

SEQ ID NO: 119562 - RNA, 42 nt, Mus musculus; identical to SEQ ID NO: 119520

SEQ ID NO: 119563 - RNA, 49 nt, Mus musculus
ucccuagaaccggccccugggauuugcugcucaggacccgaguucacug

SEQ ID NO: 119564 - RNA, 53 nt, Mus musculus
ugugucucugcuccagugugaacuaaugaaacccccauugaaaaucagugaca

SEQ ID NO: 119565 - RNA, 52 nt, Mus musculus
gccaagcugcccugccacacauuauauagcccaggcuccucucagagauucu

SEQ ID NO: 119566 - RNA, 56 nt, Mus musculus
aaguugugggccaggccuuugggucuuccuaucuggggcaugacaagaagacacca

SEQ ID NO: 119567 - RNA, 45 nt, Mus musculus; identical to SEQ ID NO: 119557

SEQ ID NO: 119568 - RNA, 46 nt, Mus musculus
ccaccauguuuacccuuugaggacaaguuaguccaagggaaguaua

SEQ ID NO: 119569 - RNA, 45 nt, Mus musculus
gcuguuacuugugguucccgggucuucagagaggaugcacaagaa

SEQ ID NO: 119570 - RNA, 46 nt, Mus musculus
agguaccgugagcaaucacuggagcuggaacacugcugccugagga

SEQ ID NO: 119571 - RNA, 45 nt, Mus musculus
auugagugaauagaagaaucuucuguagaggcucugagcugagau

SEQ ID NO: 119572 - RNA, 45 nt, Mus musculus
uagugucggaucugaguacaacauuucagacaagaucugccagaa

SEQ ID NO: 119573 - RNA, 41 nt, Mus musculus
guuccaagucaggaggaguuguaguuggucuggcauacaug

SEQ ID NO: 119574 - RNA, 46 nt, Mus musculus
aaaugcagaauuucgucauugccuggaugcugacuuuauccaaaga

SEQ ID NO: 119575 - RNA, 46 nt, Mus musculus
gcucuggggcagcacugccaucaugcggaaaauguuuccuguagac

SEQ ID NO: 119576 - RNA, 47 nt, Mus musculus
ggaagcuaaauucuaggaguacagcacugcaugcuucugacacagac

SEQ ID NO: 119577 - RNA, 42 nt, Mus musculus; identical to SEQ ID NO: 119520

SEQ ID NO: 119578 - RNA, 58 nt, Mus musculus
cugaguucacugagacaucaggagcaagcacuggaggccgggugcugcuggacccaga

SEQ ID NO: 119579 - RNA, 42 nt, Mus musculus
gagccacuaaagugagccugccacaggacacacaaggccuuu

SEQ ID NO: 119580 - RNA, 45 nt, Mus musculus
ucuugugucccugcuccugugugaacuaaugaaagccccauugag

SEQ ID NO: 119581 - RNA, 50 nt, Mus musculus
ugucuuaguugccaagggaaaguauaagacuguaaguaaaguauaaagac

SEQ ID NO: 119582 - RNA, 45 nt, Mus musculus
cacaugguacacauuucaagcuaugucuuuuugcuaagaccagag

SEQ ID NO: 119583 - RNA, 45 nt, Mus musculus
gaaguugugggccaggccuuugggucuuccuaucuggggcaugac

SEQ ID NO: 119584 - RNA, 45 nt, Mus musculus
ugucucuagauauugguuaugguauuuauuuucaggcuugaaggu

SEQ ID NO: 119585 - RNA, 42 nt, Mus musculus
uccuuuguguagguucuacaugaugacaauaugcuaggagau

SEQ ID NO: 119586 - RNA, 42 nt, Mus musculus
uuuuucugucuuuauaacuguugauauuuacccuguacagau

SEQ ID NO: 119587 - RNA, 46 nt, Mus musculus
aaggaggagaguggcgcugugaguuuugaaaccguggccugagggu

SEQ ID NO: 119588 - RNA, 58 nt, Mus musculus
ccucacucuccagguucugaggagaaaacacugcagucccaguuucuguuggggucug

SEQ ID NO: 119589 - RNA, 42 nt, Mus musculus; identical to SEQ ID NO: 119518

SEQ ID NO: 119590 - RNA, 46 nt, Mus musculus
agaagcuaaauucuaggaguacagcauugcaugcuucugacagaga

SEQ ID NO: 119591 - RNA, 42 nt, Mus musculus; identical to SEQ ID NO: 119520

SEQ ID NO: 119592 - RNA, 60 nt, Mus musculus
cccugggauuugcugcucaggaccugaguucacugagacaucaggagcaagcacuggagg

SEQ ID NO: 119593 - RNA, 53 nt, Mus musculus
auaauaaaguauaaagacaauaacacgugcauguagugaagccacgggaaccg

SEQ ID NO: 119594 - RNA, 48 nt, Mus musculus
caugcuacacauuucaagcuuugucuucuugcuaagaccagagacucc

SEQ ID NO: 119595 - RNA, 46 nt, Mus musculus
uugugggccaggccuuugguucuuccuaucugggacaugacaagaa

SEQ ID NO: 119596 - RNA, 46 nt, Mus musculus
agguuuuacaagauaauuuuaugcuaggagauucagaagcaaagga

SEQ ID NO: 119597 - RNA, 60 nt, Mus musculus
ggcacugauauaaaguauaaaauggaagcuaaauucuaggaguacagcacugcaugcuuc

SEQ ID NO: 119598 - RNA, 42 nt, Mus musculus; identical to SEQ ID NO: 119520

SEQ ID NO: 119599 - RNA, 49 nt, Mus musculus
ugagacaucaggagcaagcacuggaggccaggugcugcuggacccagau

SEQ ID NO: 119600 - RNA, 42 nt, Mus musculus; identical to SEQ ID NO: 119579

SEQ ID NO: 119601 - RNA, 46 nt, Mus musculus
gcuccagugugaacuauugaaaaccccauugagaaucagugacaga

SEQ ID NO: 119602 - RNA, 67 nt, Mus musculus
uguagcccaggcuccucucagagguguaugucuuaguggccaagggaaaguagaagacugaaaguau

SEQ ID NO: 119603 - RNA, 82 nt, Mus musculus
guguaggcaggauuuuaagccaugccuucuuucuaagacacagagacucccuaauuaguccacgcuguucaagcacacauua

SEQ ID NO: 119604 - RNA, 35 nt, Mus musculus
agugugggcaccaguaauggcuucgagcugaaaag

SEQ ID NO: 119605 - RNA, 45 nt, Mus musculus
uccauuaucaagugcgcagcugugcugagguacagggacaggagg

SEQ ID NO: 119606 - RNA, 47 nt, Mus musculus; identical to SEQ ID NO: 119526

SEQ ID NO: 119607 - RNA, 103 nt, Mus musculus
aggcacugagguggcaguguguucuuuaucucccuagaaccggccccugggauuugcugcucagaaccugaguucacugagacaucaggagcaagcacuggag

SEQ ID NO: 119608 - RNA, 49 nt, Mus musculus
gaccuauguuucuucaaguaggcauguucauagcauucaguguugacag

SEQ ID NO: 119609 - RNA, 85 nt, Mus musculus
cuguucaagcacacauuauguagcccaggcuccucucagagguguaugucuuaguggccaagggaaaguagaagacugaaaguau

SEQ ID NO: 119610 - RNA, 97 nt, Mus musculus
gaggagaauucggucuccugcuccuuguagcauguguaggcaggauuuuaagccaugccuucuuucuaagacacagagacucccuaauuaguccaag

SEQ ID NO: 119611 - RNA, 34 nt, Mus musculus
agaagugugggcaccaguaauggcuucgagcuga

SEQ ID NO: 119612 - RNA, 46 nt, Mus musculus
gauugacuuuuuguaaguuuuaaaugaugaagauaugaugggagau

SEQ ID NO: 119613 - RNA, 59 nt, Mus musculus
gcacugauauaaaguauaaaauggaagcuaaauucuaggaguacagcacugcaugcuuc

SEQ ID NO: 119614 - RNA, 42 nt, Mus musculus
gaccauggccugcacacacuucuucccaggagaaggggagug

SEQ ID NO: 119615 - RNA, 48 nt, Mus musculus
acugaggugacaguguguucuuuaucucccuagaaccggccccugaga

SEQ ID NO: 119616 - RNA, 48 nt, Mus musculus
ugcuccagugugaacuauugaaaaccccauugagaaucagugacagau

SEQ ID NO: 119617 - RNA, 67 nt, Mus musculus; identical to SEQ ID NO: 119602

SEQ ID NO: 119618 - RNA, 81 nt, Mus musculus
uguaggcaggauuuuaagccaugccuucuuucuaagacacagagacucccuaauuaguccaagcuguucaagcacacauaa

SEQ ID NO: 119619 - RNA, 46 nt, Mus musculus
aggaaguugugggccaggccuuugguucuuccuaucugggguauga

SEQ ID NO: 119620 - RNA, 45 nt, Mus musculus; identical to SEQ ID NO: 119584

SEQ ID NO: 119621 - RNA, 46 nt, Mus musculus
ucuguuuuguagguuauuuccuuuuucugucuuuagaacuguagau

SEQ ID NO: 119622 - RNA, 52 nt, Mus musculus
auuacuaggaaucaugggaaggaggacaguggcacugugaguuuugaaacca

SEQ ID NO: 119623 - RNA, 44 nt, Mus musculus
ugagguccaguaccaaguacacagcugugcugagguccagggac

SEQ ID NO: 119624 - RNA, 46 nt, Mus musculus
gaaaugugcccguuuuacugucuauuuucuccuuaaguacccagac

SEQ ID NO: 119625 - RNA, 46 nt, Mus musculus; identical to SEQ ID NO: 119548

SEQ ID NO: 119626 - RNA, 45 nt, Mus musculus
uaaccuccacaccacaagcacugggguagaagacugcugcugggu

SEQ ID NO: 119627 - RNA, 46 nt, Mus musculus
auguauuagauuucuacaaguaucacccccaaaaggacccccaauu

SEQ ID NO: 119628 - RNA, 42 nt, Mus musculus
aagagggagggagggagggaaagagggagagagagugcaaga

SEQ ID NO: 119629 - RNA, 46 nt, Mus musculus
agccuggauuggcccaaucuccauuugaaguaauucacccccagua

SEQ ID NO: 119630 - RNA, 47 nt, Mus musculus
cuacuauauauuuucuccuucuguaggcagacuggcaucacaggaca

SEQ ID NO: 119631 - RNA, 44 nt, Mus musculus
gacaucaggagcaagcacuggaggccggugcugcuggacccaga

SEQ ID NO: 119632 - RNA, 46 nt, Mus musculus
guguuucuccaaguaggcauguucauagcauucaguguugacagcu

SEQ ID NO: 119633 - RNA, 60 nt, Mus musculus
cugaaaguauaauaaaguauaaagacaauaacaggugcauguagugaagccacgggaacc

SEQ ID NO: 119634 - RNA, 50 nt, Mus musculus
ugcuacacauuuuaagcuaugucuucuugcuaagaccagagacucccaau

SEQ ID NO: 119635 - RNA, 45 nt, Mus musculus; identical to SEQ ID NO: 119583

SEQ ID NO: 119636 - RNA, 46 nt, Mus musculus; identical to SEQ ID NO: 119596

SEQ ID NO: 119637 - RNA, 47 nt, Mus musculus; identical to SEQ ID NO: 119576

SEQ ID NO: 119638 - RNA, 42 nt, Mus musculus; identical to SEQ ID NO: 119520

SEQ ID NO: 119639 - RNA, 61 nt, Mus musculus
cccugggauuugcugcucagaaccugaguucacugagacaucaggagcaagcacuggaggc

SEQ ID NO: 119640 - RNA, 49 nt, Mus musculus; identical to SEQ ID NO: 119608

SEQ ID NO: 119641 - RNA, 72 nt, Mus musculus
uguagcucaggcuccucucagagguguaugucuuaguggccaagggaaaguagaagacugaaaguauaaaga

SEQ ID NO: 119642 - RNA, 82 nt, Mus musculus; identical to SEQ ID NO: 119603

SEQ ID NO: 119643 - RNA, 32 nt, Mus musculus
aagugugggcaccaguaauggcuucgagcuga

SEQ ID NO: 119644 - RNA, 45 nt, Mus musculus
cucagcugugcugaggugcagggacaggaagcagaugggcgguuu

SEQ ID NO: 119645 - RNA, 45 nt, Mus musculus
ggcacacaccuccuccuccauccugcuucuccucagccauuuuga

SEQ ID NO: 119646 - RNA, 46 nt, Mus musculus
acuguuggaacuauauacgauguugagagaauugaaguugacagug

SEQ ID NO: 119647 - RNA, 42 nt, Mus musculus
aaggcagaaaagggaagacauuucguaagucagugcacaagu

SEQ ID NO: 119648 - RNA, 46 nt, Mus musculus
cucuccagcuccaggaucugcacaacggaaguuuuaggcuucagau

SEQ ID NO: 119649 - RNA, 51 nt, Mus musculus
aaagccuaguauuacugcaggaaagcuaauucuugguccacaggacgagac

SEQ ID NO: 119650 - RNA, 46 nt, Mus musculus
cucccuccaccuuuggcuggcuggccaagacauucauucacagauc

SEQ ID NO: 119651 - RNA, 41 nt, Mus musculus
uuucucucucaauauuauaucuuguuuucaguaguggcaga

SEQ ID NO: 119652 - RNA, 46 nt, Mus musculus
aagaaugcaaaucccuauaagaaaaaaaaaaaucuccggucacacu

SEQ ID NO: 119653 - RNA, 86 nt, Mus musculus
ucauccaguguugaaggcaggagcugcccgccacuuuccggaagcugggaggcgggacuuuggcugcggaagccuugagccuagag

SEQ ID NO: 119654 - RNA, 46 nt, Mus musculus
ggaacucacaaagaccugccuuccucugccuccugcgaucaaagga

SEQ ID NO: 119655 - RNA, 46 nt, Mus musculus
aaauagauauccuuuagauuggugaaagcuaguggucugcuaagaa

SEQ ID NO: 119656 - RNA, 45 nt, Mus musculus
gguauaugugaguguauguaagcaugcacaaauuccuguggaguu

SEQ ID NO: 119657 - RNA, 45 nt, Mus musculus
uuaaaaggccagagaaaagaaauaaaggugguguggugugcugug

SEQ ID NO: 119658 - RNA, 45 nt, Mus musculus
augccuuuccuaucauuauuaauauuauauaauacuuggacauua

SEQ ID NO: 119659 - RNA, 37 nt, Mus musculus
auuuuuguuucuuucagaugaagcuauuuugguuaga

SEQ ID NO: 119660 - RNA, 45 nt, Mus musculus
aauuuuguagucacauacauuaagagauuacaucuagccagaagg

SEQ ID NO: 119661 - RNA, 46 nt, Mus musculus
ugaagauagugcauuguucuucaaguuagaauugugggccacagau

SEQ ID NO: 119662 - RNA, 27 nt, Mus musculus
accugcccuucauucagccaagagucc

SEQ ID NO: 119663 - RNA, 43 nt, Mus musculus
gaucaaaaccaggacuggaggacugaagaugaagccggcaaaa

SEQ ID NO: 119664 - RNA, 41 nt, Mus musculus
cacucaaacaguacacugucgauugaaauaacagccgccag

SEQ ID NO: 119665 - RNA, 46 nt, Mus musculus
caagagggcuuaagggaaagugguuuaaagacaaggggaaaaggag

SEQ ID NO: 119666 - RNA, 45 nt, Mus musculus
gcaaggccaggcggaaggugggcggaaaugugcgaacuggggagg

SEQ ID NO: 119667 - RNA, 43 nt, Mus musculus
uggguggggaugggaugcugaugcccuuccuauaggaacccag

SEQ ID NO: 119668 - RNA, 42 nt, Mus musculus
gccaaggccauggccaccgggccgcccgggcccugcugcuag

SEQ ID NO: 119669 - RNA, 47 nt, Mus musculus
uccucaggggccacacgaagcucauuguagaagguguggugccagau

SEQ ID NO: 119670 - RNA, 46 nt, Mus musculus
uuaacacugaacaauguucuuacuguucucugauuuaggccuuggu

SEQ ID NO: 119671 - RNA, 45 nt, Mus musculus
uugggucagaacuuacaaaggagacugagaaacucaagaaacaug

SEQ ID NO: 119672 - RNA, 46 nt, Mus musculus
gugggaaaagagucucugaaguguugaguggaaaagugcagcagga

SEQ ID NO: 119673 - RNA, 46 nt, Mus musculus
ccgcccccaccccuucgcccaggugaacauguuaagaaucuugacu

SEQ ID NO: 119674 - RNA, 45 nt, Mus musculus
uucaguugaaggagacuuuccaaagaguaaccaugauguggcagu

SEQ ID NO: 119675 - RNA, 41 nt, Mus musculus
uuucucuacucaucaggagauauccauccauccgcaguuga

SEQ ID NO: 119676 - RNA, 45 nt, Mus musculus
gcuccuaauuguuuuuuugaauaucgagaguagaaaugccaagag

SEQ ID NO: 119677 - RNA, 46 nt, Mus musculus
cacugcugaguugggaagcugcuucauuugcauuuagcauccagug

SEQ ID NO: 119678 - RNA, 30 nt, Mus musculus
uaauuugugcauauguguaguaaaaugauu

SEQ ID NO: 119679 - RNA, 42 nt, Mus musculus
uguacucugcaccauggaagagguguuagacaugugggagau

SEQ ID NO: 119680 - RNA, 46 nt, Mus musculus
uaugguuaaaugaagucauaaugcugaguuuauaauucuuuaagau

SEQ ID NO: 119681 - RNA, 46 nt, Mus musculus
caguuuacucuucuaaauguaaaacauuccuucgcucaugccaguu

SEQ ID NO: 119682 - RNA, 87 nt, Mus musculus
acauucauaugagaaacuuauauaauucacaucaagcaugucagaucaacuggaaaauuagaguaauuaaauguucaaggggaagga

SEQ ID NO: 119683 - RNA, 42 nt, Mus musculus
aaguugucuugauuugcauuucuauaauuguuaggggcaaug

SEQ ID NO: 119684 - RNA, 45 nt, Mus musculus
uuuuagggauuucccaugcugacuuuuaaaguaucugaaucuguc

SEQ ID NO: 119685 - RNA, 46 nt, Mus musculus
uuuucugguccagucuauuuggaguucuuuaggcuucuuguuuguu

SEQ ID NO: 119686 - RNA, 45 nt, Mus musculus
aacaacacugacauuccaucucacuccagucagaauggcuaagau

SEQ ID NO: 119687 - RNA, 45 nt, Mus musculus
auuaccaguuggaacaucuucuggauauaugcccaggaauguuau

SEQ ID NO: 119688 - RNA, 41 nt, Mus musculus
gguugugagccaccaugugguugcugagaauugugcucagg

SEQ ID NO: 119689 - RNA, 45 nt, Mus musculus
uuuucagagaugggucaggguuaggcuugagguauaagagguaga

SEQ ID NO: 119690 - RNA, 46 nt, Mus musculus
ccuccccucccccacccaguucuaucaucccucuaccuccugugau

SEQ ID NO: 119691 - RNA, 45 nt, Mus musculus
ccacccccagaagugcauguuuccauucauucuccuguccccugg

SEQ ID NO: 119692 - RNA, 46 nt, Mus musculus
acuugguaucugggguuagagugagcugccugcugacagcuuagac

SEQ ID NO: 119693 - RNA, 57 nt, Mus musculus
agggacaaagggcagggaauaucaacaaagacaggagacagaagaugagggagaagg

SEQ ID NO: 119694 - RNA, 46 nt, Mus musculus
uaaucaaucuaauuccuccaaauguuuugucuuaggaguuugguuu

SEQ ID NO: 119695 - RNA, 44 nt, Mus musculus
auucucauucaagugucuucauuucuuauuucuaaacuuuaaua

SEQ ID NO: 119696 - RNA, 46 nt, Mus musculus
uuuuaauguuacuccaacuaauguuuuugugaaaauauccauauua

SEQ ID NO: 119697 - RNA, 45 nt, Mus musculus
ggaaaagaaaaaucagguaugugggauuuuuccaguuucucagau

SEQ ID NO: 119698 - RNA, 45 nt, Mus musculus
uuuuauaugaguaccagagagaguuuagauugcaaaggucauuuu

SEQ ID NO: 119699 - RNA, 46 nt, Mus musculus
ucaguuaguuguuuaaauugaaaagugugagucauuuacgugagua

SEQ ID NO: 119700 - RNA, 42 nt, Mus musculus
ugauagcuacuugucuuucugugaauuuuucaggcccccccu

SEQ ID NO: 119701 - RNA, 46 nt, Mus musculus
gugcuuguuuaaaucuuaaauuguuucuguuauuuucugaccagga

SEQ ID NO: 119702 - RNA, 46 nt, Mus musculus
aaaagugaggaaauucagugauauauuuauauuccuaguuacuaag

SEQ ID NO: 119703 - RNA, 91 nt, Mus musculus
auauacagacuaauauacuuccauaaugguacaaauuuauguaggggaacaguaauguguauacauacacacacauacacauuaccuaaga

SEQ ID NO: 119704 - RNA, 46 nt, Mus musculus
aaacccugucucgaaagaaaaaaaaaaaaaagauuuguuuugaguu

SEQ ID NO: 119705 - RNA, 46 nt, Mus musculus
guugguggcgcacgcuuauuaaucccagcacuuggggggaggcaga

SEQ ID NO: 119706 - RNA, 49 nt, Mus musculus
agcagcggcagcuguggccucgaccgggaacuuuagcgguaagcaugua

SEQ ID NO: 119707 - RNA, 47 nt, Mus musculus
cugggaggguccacauugacugguaguuuugaacaggggugugaacc

SEQ ID NO: 119708 - RNA, 45 nt, Mus musculus
gaggcuuuugauccuguaaaggcucuaugccccaggguagcagaa

SEQ ID NO: 119709 - RNA, 46 nt, Mus musculus
ccauccaccuauaguaguggccacagaccccagcucccccugagac

SEQ ID NO: 119710 - RNA, 45 nt, Mus musculus
caggacuaagcacauccucucccacugaggcccaaccaggcaguc

SEQ ID NO: 119711 - RNA, 42 nt, Mus musculus
gcaggguggggggaguguggaggaaaauccucaugcccagga

SEQ ID NO: 119712 - RNA, 65 nt, Mus musculus
uggccuaugaucuggauguggacgaugcuccggggaacaagcagcauggaaaucagaaggacaac

SEQ ID NO: 119713 - RNA, 45 nt, Mus musculus
gacuuuuguuucagaccaaaucacagacauuuuaggguuuuuuug

SEQ ID NO: 119714 - RNA, 46 nt, Mus musculus
cucacauggugcacacacacacacacacacacacacacacacuaga

SEQ ID NO: 119715 - RNA, 41 nt, Mus musculus
agcagaggaaaagcagccagcaggcagacuuacaggggaga

SEQ ID NO: 119716 - RNA, 46 nt, Mus musculus
auuucuagcugucacaaaagauaacauuccuuccuggagcgaaaag

SEQ ID NO: 119717 - RNA, 46 nt, Mus musculus
guauguguauguuaaagcuuggaagauguaauuguggauagaagag

SEQ ID NO: 119718 - RNA, 46 nt, Mus musculus
caaaugguguuugaggaguaaacaguaagacaguggaaaugcugau

SEQ ID NO: 119719 - RNA, 41 nt, Mus musculus
uagaggggcuccauuuacuuccucuaaucucuugguggaga

SEQ ID NO: 119720 - RNA, 45 nt, Mus musculus
gggagagaaacugugcggacaaggagaaaaagcaggacgguaaag

SEQ ID NO: 119721 - RNA, 63 nt, Mus musculus
uucaaacaaaaaaaaaugagagaggaaaaggaaaggaaaggaaaggaaaggaaaggaaaggaa

SEQ ID NO: 119722 - RNA, 50 nt, Mus musculus
uucuacauagcugcuuccaagcuagucagagcuagaucaugagaccuuau

SEQ ID NO: 119723 - RNA, 41 nt, Mus musculus
accaaguagccugaccugucucaaaagaaaagagccaguau

SEQ ID NO: 119724 - RNA, 45 nt, Mus musculus
aaacaagucugcccugagaaacaaaugaaaagggcaagguuagga

SEQ ID NO: 119725 - RNA, 46 nt, Mus musculus
gauggagccaacuaggucaccagguacccaaccaugaagggguuua

SEQ ID NO: 119726 - RNA, 50 nt, Mus musculus
aguauacaaagaaguguagcauauugaaaaacaagcacaaucaaggacac

SEQ ID NO: 119727 - RNA, 87 nt, Mus musculus
aucugguaagcaccuuuacacaaugagcuaucuugccagccuaguagcucacauuuuggaauacuuacugcaugauuuuaagcaacu

SEQ ID NO: 119728 - RNA, 44 nt, Mus musculus
guuguggugaccccaaccauaacauuguuuuguuuuguugcuac

SEQ ID NO: 119729 - RNA, 45 nt, Mus musculus
cccugucucggaaaaaaaaaaagaaaagaaaagaaaaggaaagga

SEQ ID NO: 119730 - RNA, 46 nt, Mus musculus
gcugguaucauaugguugggacugagggaagaaaagaaagcaacag

SEQ ID NO: 119731 - RNA, 45 nt, Mus musculus
uuaauauucuuccuggcagcuugaggucagguaacucccagggcc

SEQ ID NO: 119732 - RNA, 41 nt, Mus musculus
aaccaucucuagccccagcucccauuaaccccuaccccauc

SEQ ID NO: 119733 - RNA, 46 nt, Mus musculus
cuucaggaugguuuucugaguaaagugauuuguccaaguacccaug

SEQ ID NO: 119734 - RNA, 46 nt, Mus musculus
aauugcuuuccucugugugugugugugugugugugugugugugugu

SEQ ID NO: 119735 - RNA, 34 nt, Mus musculus
ucaguccccaguacuccaacacucaaacccagau

SEQ ID NO: 119736 - RNA, 45 nt, Mus musculus
acuagcagguucucuguucucgucugugauauauugccccuauuc

SEQ ID NO: 119737 - RNA, 46 nt, Mus musculus
caaaauguuaacuaguuccaacauugguccucagcucacaacacug

SEQ ID NO: 119738 - RNA, 52 nt, Mus musculus
cugcggugaugaugaagaugaaugcauuggaagcucuggugacgggauggug

SEQ ID NO: 119739 - RNA, 69 nt, Mus musculus
aaccaugucugugcccaaggguaaaguucuggauaaaagccuggaugaagaaggacuugaaaguggaga

SEQ ID NO: 119740 - RNA, 46 nt, Mus musculus
gucccacaaaacaaagccacaugacuaaaaagcuaugccccaaaga

SEQ ID NO: 119741 - RNA, 24 nt, Mus musculus
gcaggaagagauagaggccaggaa

SEQ ID NO: 119742 - RNA, 58 nt, Mus musculus
uauccugaaaauggauuuauaauuacccauuugccccagagccauguauuaaauauca

SEQ ID NO: 119743 - RNA, 46 nt, Mus musculus
agcagugcaccugcccuguauuggaaaggaaauaagugucaaagug

SEQ ID NO: 119744 - RNA, 46 nt, Mus musculus
auagagcagaaaggauugacagacgauucaucuuuagucuggagaa

SEQ ID NO: 119745 - RNA, 45 nt, Mus musculus
uguggaggaagugauauuugagaugauucuuugagaaugaacagu

SEQ ID NO: 119746 - RNA, 42 nt, Mus musculus
agaaguauugcuggaugcuauugggcagccuucuuggaaaca

SEQ ID NO: 119747 - RNA, 24 nt, Mus musculus
uaggugagaagguggggguuagag

SEQ ID NO: 119748 - RNA, 41 nt, Mus musculus
agaggcaguucguuauugcugcguauggauucuugaaggag

SEQ ID NO: 119749 - RNA, 50 nt, Mus musculus
aauuggagcuacuaucuccuuucauauuauuauaguaugaaguguccgca

SEQ ID NO: 119750 - RNA, 46 nt, Mus musculus
auuauuguaaaacuuuauugguacaguauuaaaauuacagugagaa

SEQ ID NO: 119751 - RNA, 46 nt, Mus musculus
caggcccacccccaacccuugugaccaccacaaaagaaaaggagga

SEQ ID NO: 119752 - RNA, 49 nt, Mus musculus
uaagauauuauuuuuguuaauuauuuggaacuuucacauaguacacucc

SEQ ID NO: 119753 - RNA, 46 nt, Mus musculus
agguuuaaaaagauucuuugaugacugcaaggucacugcucuaccu

SEQ ID NO: 119754 - RNA, 46 nt, Mus musculus
ggcauacucuuauguacauuagauaaacaaaugcauuggcucugag

SEQ ID NO: 119755 - RNA, 46 nt, Mus musculus
uuuuuguccucaaggaaauacuaguaauuuaucguguugcccauuu

SEQ ID NO: 119756 - RNA, 46 nt, Mus musculus
ccacucuugguucucaguauuaguucuggaauuuacuaggcuauau

SEQ ID NO: 119757 - RNA, 61 nt, Mus musculus
uacucccucuuccucauaagccacauaguucauguguaagauucccacgauugaaaauaag

SEQ ID NO: 119758 - RNA, 74 nt, Mus musculus
ucucccagaguaacucaacuucucuuccacagacauucucagcugccuccuuucagauuaugguucuguugaua

SEQ ID NO: 119759 - RNA, 59 nt, Mus musculus
agaugucuuccuaucugggcuuguguguccauccuguugaauuagagcauuuaugagca

SEQ ID NO: 119760 - RNA, 46 nt, Mus musculus
ccaugagcugaaaaugaagggcccugagccggugguuagccagauc

SEQ ID NO: 119761 - RNA, 23 nt, Mus musculus
uggugggcuguaccauuuccccu

SEQ ID NO: 119762 - RNA, 46 nt, Mus musculus
aagcacaaccauuggcaccacccuuaccauucauagcauaguagag

SEQ ID NO: 119763 - RNA, 30 nt, Mus musculus
ugguagguccccaucauauauguguccucg

SEQ ID NO: 119764 - RNA, 44 nt, Mus musculus
uuuuucuggucacagcuuuugugucagacuaucuaggaacaaaa

SEQ ID NO: 119765 - RNA, 46 nt, Mus musculus
cgaaaaugauacccugugcuggaacggacaagaacuuguggagagg

SEQ ID NO: 119766 - RNA, 44 nt, Mus musculus
uggaaggcccuggcauggguuccauuuuuauugcccuguuccau

SEQ ID NO: 119767 - RNA, 42 nt, Mus musculus
guguuugugugugugugugugugugucugucugucugucugu

SEQ ID NO: 119768 - RNA, 64 nt, Mus musculus
guguacucaaauaaauaaaaugaaucuuuaaaaagaagaaagagagagagagagagagagagag

SEQ ID NO: 119769 - RNA, 83 nt, Mus musculus
aauucccagaagccacaugguggcucacaaccaucuguaaugagaucugacgccauucugguaugcaugaagacagcuauaua

SEQ ID NO: 119770 - RNA, 46 nt, Mus musculus
ugauaaaggacagaagggguguuucaggcaaagggaaugggaagag

SEQ ID NO: 119771 - RNA, 41 nt, Mus musculus
cuaucagcuucaacacccauacccaagaucuaucaggcuuu

SEQ ID NO: 119772 - RNA, 49 nt, Mus musculus
cacucccagcaacgccaauauagaucugcuuauuacccugaagaucugu

SEQ ID NO: 119773 - RNA, 46 nt, Mus musculus
acacaaauaaauacucauguauaucugacuucaacaaagagaagga

SEQ ID NO: 119774 - RNA, 46 nt, Mus musculus
uuagggaaaaaauagccuuaugcaacccauuaaaauaaaaccaagu

SEQ ID NO: 119775 - RNA, 46 nt, Mus musculus
acuagaauaguggucuacuguggaccuacaucacucacccccauaa

SEQ ID NO: 119776 - RNA, 46 nt, Mus musculus
accccaacacgcacaugaagauuucauauaauagaccuuggaagau

SEQ ID NO: 119777 - RNA, 45 nt, Mus musculus
uacccuccuccccuuaguugccaucgauaaggaaauagugccaga

SEQ ID NO: 119778 - RNA, 46 nt, Mus musculus
guauacauuuuagcuaugaaggcaauaaauacagagaucaggagau

SEQ ID NO: 119779 - RNA, 46 nt, Mus musculus
aguauaaucccauuguuucaacaacaaggaaaugagaaguucagau

SEQ ID NO: 119780 - RNA, 46 nt, Mus musculus
uagauugcuauuaguggaguguagaacucauuaagagaccugagca

SEQ ID NO: 119781 - RNA, 43 nt, Mus musculus
ugcuuggcuaauuggacaaaugagaaaucaacuuacaggggau

SEQ ID NO: 119782 - RNA, 45 nt, Mus musculus
agcagcuaguggauaaaaagaaaacaaaucuaucaguccggcagc

SEQ ID NO: 119783 - RNA, 46 nt, Mus musculus
uguguuccuuugcaugguggaauauucuucuuuuggguccccauag

SEQ ID NO: 119784 - RNA, 46 nt, Mus musculus
uaaccagaauguugagagcagcaugggcuaguuagccuugucuuua

SEQ ID NO: 119785 - RNA, 46 nt, Mus musculus
gccucuuuucuaccauccaugauuccauccaguaugugcagaagaa

SEQ ID NO: 119786 - RNA, 52 nt, Mus musculus
gucaugcaaggcuguauggcuggugugguggagaucgacaaguacuggagag

SEQ ID NO: 119787 - RNA, 46 nt, Mus musculus
aagucacugcaagucacucgaaucuuccuucaagcccugaaucucg

SEQ ID NO: 119788 - RNA, 46 nt, Mus musculus
gccaagaacuacaccaacgccauguucaagaauaacuaccccagcc

SEQ ID NO: 119789 - RNA, 46 nt, Mus musculus
aaaauaaaacaugugcggccaugucacaguuaaaaggaggguagau

SEQ ID NO: 119790 - RNA, 46 nt, Mus musculus
cugcuuagacaguugcuaaagccucugauaauuacuaaagccaaua

SEQ ID NO: 119791 - RNA, 46 nt, Mus musculus
uaacccccaaguguugggauuauaggcacaaaccauucugccuggc

SEQ ID NO: 119792 - RNA, 46 nt, Mus musculus
acucugguggagaggcacaacagccagagaauguggacacagagau

SEQ ID NO: 119793 - RNA, 46 nt, Mus musculus
auacuguguccauauucugcccuaauuuaaacauauuuuaggagug

SEQ ID NO: 119794 - RNA, 46 nt, Mus musculus
agaaagaaggaugucaauauggggaacaaaagauguauggagaaga

SEQ ID NO: 119795 - RNA, 45 nt, Mus musculus
gaggggauaaggaagaggaaaugcaggaaaugaaaagcaugagag

SEQ ID NO: 119796 - RNA, 46 nt, Mus musculus
gauucucucagaaaaaagaucuuaugaaauuaacaaaaagagagca

SEQ ID NO: 119797 - RNA, 45 nt, Mus musculus
aauguuuuaggcuuugaaugcugggaaugacuuuaaucuuaagau

SEQ ID NO: 119798 - RNA, 46 nt, Mus musculus
agcugccgaaggcuggaguucugcauucuaggaacccaggggagaa

SEQ ID NO: 119799 - RNA, 41 nt, Mus musculus
guuuauuuuuauuuugcaugaggcauaggaagagggauaga

SEQ ID NO: 119800 - RNA, 42 nt, Mus musculus
ugaauacaagaaauuuuguauugugaggcagaggaggcagga

SEQ ID NO: 119801 - RNA, 46 nt, Mus musculus
aauggaaauguggauugugauugauacaaggcccuuaacguuaaga

SEQ ID NO: 119802 - RNA, 45 nt, Mus musculus
acagaaaauaagggaaaguaacugaguauuucaauccacauagau

SEQ ID NO: 119803 - RNA, 46 nt, Mus musculus
aggcugggaacugauaagagaaugcuguuuccuuuaaacccccuug

SEQ ID NO: 119804 - RNA, 46 nt, Mus musculus
aggagggcuuuauuuucccuuaauccaucucuaaaaguagccagac

SEQ ID NO: 119805 - RNA, 46 nt, Mus musculus
accauagaaagaccaauagaaagacagacagaugcacacaggaaga

SEQ ID NO: 119806 - RNA, 57 nt, Mus musculus
cugacauguuuguguuauguugaggaugauaccggugugagagaagagacuaucagg

SEQ ID NO: 119807 - RNA, 46 nt, Mus musculus
gagaguagaaauaucacccuaauauuguuaugagaagcaaauauga

SEQ ID NO: 119808 - RNA, 46 nt, Mus musculus
uagauauaucuccauccauuuaaugugucuagcugcuuaucaagau

SEQ ID NO: 119809 - RNA, 46 nt, Mus musculus
auucuucucacagagguagcaggagcaggagaaacuugggccagau

SEQ ID NO: 119810 - RNA, 71 nt, Mus musculus
uuugacuuaagauuuauguaguuccaaaucagaggcuuaaaucauugaagggaaagaccauucuuuuggaa

SEQ ID NO: 119811 - RNA, 46 nt, Mus musculus
acaaaacucuuggaaaagagaugaaggaacauuuauggggauagca

SEQ ID NO: 119812 - RNA, 45 nt, Mus musculus
agcaccguuuucccuuuaaugaaaccuguauuucaguucggccag

SEQ ID NO: 119813 - RNA, 45 nt, Mus musculus
agucaucuugauguauauuaauccuagcuccuucccaccagcauu

SEQ ID NO: 119814 - RNA, 74 nt, Mus musculus
aaaaagggacuuuguaucucugcuccuucuacuguuaccuacagacuccugcuucgugaagugaaccccucagg

SEQ ID NO: 119815 - RNA, 46 nt, Mus musculus
uuagcuuauauuucuuagcuuaucucuuccaaauuaguauauauaa

SEQ ID NO: 119816 - RNA, 45 nt, Mus musculus
agggaggaaagaccuagaaaguuuguagucagcagauaaugagaa

SEQ ID NO: 119817 - RNA, 46 nt, Mus musculus
caacaaaguuuuguuugauaaaaugaguucaaagcuagugauagug

SEQ ID NO: 119818 - RNA, 46 nt, Mus musculus
cuugguuuccuuauucaucugugaauguacacuguugcaccugaaa

SEQ ID NO: 119819 - RNA, 46 nt, Mus musculus
ugauauaaugaugaauuauaaaaauuauuguuuuauuuugacagau

SEQ ID NO: 119820 - RNA, 47 nt, Mus musculus
ugagauuuuucuuuuccuuuuuuuuuuccagauggaaaagauuugaa

SEQ ID NO: 119821 - RNA, 90 nt, Mus musculus
aauagaaaaauggauagcugauuucaucauggauuugcaugcaaauaagaaugaagcaguguacagggagagagaaugaacagcuaagaa

SEQ ID NO: 119822 - RNA, 44 nt, Mus musculus
aaguagaggcugagggauacagaauauuagggagcaccgcgagg

SEQ ID NO: 119823 - RNA, 45 nt, Mus musculus
agccaagacaauacaaaucauagaagaauagaguuaggacugaga

SEQ ID NO: 119824 - RNA, 46 nt, Mus musculus
gguagagggagaagaauuuagaggacagaaguauuguauguaauaa

SEQ ID NO: 119825 - RNA, 46 nt, Mus musculus
uuuauccuuuuaucuauaaguacuuuaaaaacaaggccugacagcu

SEQ ID NO: 119826 - RNA, 36 nt, Mus musculus
uccaguuauaacgcuacacauauaacuggcucucgu

SEQ ID NO: 119827 - RNA, 46 nt, Mus musculus
uaguuauaagagauugugucaaagcaacacaauuuggauucaagau

SEQ ID NO: 119828 - RNA, 47 nt, Mus musculus
acugugucuccguaggaguggaaugcuuuucuguuaacuagggguau

SEQ ID NO: 119829 - RNA, 42 nt, Mus musculus
gccuacuuuccuaauucuauuaugggaaauuuuuucgaaguc

SEQ ID NO: 119830 - RNA, 46 nt, Mus musculus
ggguagaaggcugcugcugaugugagcauuacauauugaaagagau

SEQ ID NO: 119831 - RNA, 46 nt, Mus musculus
auaguugccaugauaggacugaauuugaaacauauagagggaaaag

SEQ ID NO: 119832 - RNA, 46 nt, Mus musculus
ccugcugaaguaagggaaggggaccacuuucuaugaacacagagau

SEQ ID NO: 119833 - RNA, 46 nt, Mus musculus
uuuaucuugcucuauucuuucuguaucccuuuaaagggcucuaguc

SEQ ID NO: 119834 - RNA, 42 nt, Mus musculus
cagcagaggcgaggcagggggguuggcagggggaguggagaa

SEQ ID NO: 119835 - RNA, 45 nt, Mus musculus
cuaagguuggggaggccaggauugcauuugggacuugggauauuu

SEQ ID NO: 119836 - RNA, 45 nt, Mus musculus
gacagcaaagacacacaggaagaagcaguguagacguucgcagag

SEQ ID NO: 119837 - RNA, 89 nt, Mus musculus
guugagacuuaccauuggaaguagaaaagguugccaaacagaaguuuuuagggguuaaggaggaauccauaaaaggaauguucagaaga

SEQ ID NO: 119838 - RNA, 44 nt, Mus musculus
augagaaaaugguggucaugaagagaaucaacagggcguggaga

SEQ ID NO: 119839 - RNA, 46 nt, Mus musculus
auaauauguacugaucacacauacuaaaggauaguugacugccauc

SEQ ID NO: 119840 - RNA, 45 nt, Mus musculus
uaaucucauguuccaaaaccaaacaaguccauacugccagcagac

SEQ ID NO: 119841 - RNA, 46 nt, Mus musculus
ugcgugauccucucuaccauccuuuaucaaagcugagcagguaggc

SEQ ID NO: 119842 - RNA, 53 nt, Mus musculus
auuauaugccaugucaauauacacugaacucaaaagcaaagugacuuuaaaag

SEQ ID NO: 119843 - RNA, 68 nt, Mus musculus
agaacagggaaggucccuugcaauacugugagggauucaggaagguauuuuagaauuuggaggggcuu

SEQ ID NO: 119844 - RNA, 61 nt, Mus musculus
ugccagcgacaaauggugcaugagcacaugaugcugauggggguuguguaugcaccgcaug

SEQ ID NO: 119845 - RNA, 46 nt, Mus musculus
agagaauggauugcuagauuguuaucacuggagugauuguggagga

SEQ ID NO: 119846 - RNA, 42 nt, Mus musculus
uucugucuacacuugcagaaaguggaaggaaacgguuuagca

SEQ ID NO: 119847 - RNA, 46 nt, Mus musculus
gacgauuugggaugagguuagugguuauuauuuuugugagauagau

SEQ ID NO: 119848 - RNA, 46 nt, Mus musculus
uacaaauggccaacagauguaugaaagaugcugaacagcacuaacu

SEQ ID NO: 119849 - RNA, 46 nt, Mus musculus
cuaggaauuaguuuuguggacaagagaaacuaaaaacaggagaaaa

SEQ ID NO: 119850 - RNA, 44 nt, Mus musculus
uccuucccaauuaggugcuacauuggccuuauacaccacugaga

SEQ ID NO: 119851 - RNA, 45 nt, Mus musculus
gguaagaucaaugggcugagauauaggggaaguacgggggaaggc

SEQ ID NO: 119852 - RNA, 46 nt, Mus musculus
auagauuaaucaaccuguuuauccaucugacaugaaauuaugagau

SEQ ID NO: 119853 - RNA, 45 nt, Mus musculus
ucagucacaaaaaaaaguuugcagggaaacuaguggagcuggaga

SEQ ID NO: 119854 - RNA, 41 nt, Mus musculus
ccuaacuugcacaaggccccaggguccauauuuggggugag

SEQ ID NO: 119855 - RNA, 57 nt, Mus musculus
cugaagaauacuguuaaugacgcuuuaggggggcggcuuuaauggaagaaaugagug

SEQ ID NO: 119856 - RNA, 46 nt, Mus musculus
ugcuauaaagaauaccaccaaugaaccccuccuuauaaaugcaggu

SEQ ID NO: 119857 - RNA, 53 nt, Mus musculus
gcuacagugacaacuugguugucauauaguuuguggccagaggaagaaaugac

SEQ ID NO: 119858 - RNA, 46 nt, Mus musculus
uguuaucacuucccagucuuuguguucuccuuuucccuuagcagac

SEQ ID NO: 119859 - RNA, 46 nt, Mus musculus
augccauuauauaaugugaaggaggacuacccaaacacauucagag

SEQ ID NO: 119860 - RNA, 45 nt, Mus musculus
uuuauccucuuuucuuuuuuuaguuuagauguuucaagucccagu

SEQ ID NO: 119861 - RNA, 47 nt, Mus musculus
auaaaauacuaugaagaagugguauauacaucuacucuuuucaagau

SEQ ID NO: 119862 - RNA, 46 nt, Mus musculus
gccuuauuugcauaaugcuacaacacuuacaaguugaugcuauaaa

SEQ ID NO: 119863 - RNA, 80 nt, Mus musculus
ucauuagugcaguagaggguaggucuguucucauaaacacaaacagcaaacaagagcaaauaauuaacauuggccaugga

SEQ ID NO: 119864 - RNA, 46 nt, Mus musculus
uaaacucaaaagauccuaaugccuaacaucacaucaugcuccagaa

SEQ ID NO: 119865 - RNA, 53 nt, Mus musculus
gggacaggaggcuagggaccagggaauaaaagcauuauagauacacugggggc

SEQ ID NO: 119866 - RNA, 46 nt, Mus musculus
aaaucacucauucauuaccuuugaagaaacucuuaaggacagagua

SEQ ID NO: 119867 - RNA, 94 nt, Mus musculus
ucaaagaugagcacaauacaauguaucuggguacauagguuuaguaagaagggauaaaagguaauuucacaggaagaugaagucaggccuagga

SEQ ID NO: 119868 - RNA, 46 nt, Mus musculus
agcaauugcuuucuagagucauuuaaaauuggcaguugggguguau

SEQ ID NO: 119869 - RNA, 46 nt, Mus musculus
ucauuagcccuuuucugucacuauaauaaaauacuuuaaaccagau

SEQ ID NO: 119870 - RNA, 42 nt, Mus musculus
gggauggaggguugugauacguucuucacuuuauggguagag

SEQ ID NO: 119871 - RNA, 45 nt, Mus musculus
gaacaggcugcugacacugugugugggcucaucuuggucuuuagg

SEQ ID NO: 119872 - RNA, 74 nt, Mus musculus
accacagcaaaacacaaaagaaggcagauuagaaaauggagaaguguggagggagagcacauuugagcagagca

SEQ ID NO: 119873 - RNA, 42 nt, Mus musculus
cgcacgcucguuauucuuugcccagacaucuuuaauacagac

SEQ ID NO: 119874 - RNA, 46 nt, Mus musculus
aguucccuguagggcccuacuauggugaauuaauuguaccccaagu

SEQ ID NO: 119875 - RNA, 44 nt, Mus musculus
guaauauuaccauuaggcauuucccccauucuauagauguagaa

SEQ ID NO: 119876 - RNA, 42 nt, Mus musculus
augauucucccuauccaaaaacaaaaacagaaacaaacaaac

SEQ ID NO: 119877 - RNA, 45 nt, Mus musculus
uuugagccauuaaauaagaagggcugugaggugaaagguaugagg

SEQ ID NO: 119878 - RNA, 46 nt, Mus musculus
agauugucagugugaguucucuccacagauguggcuuuuaacugaa

SEQ ID NO: 119879 - RNA, 37 nt, Mus musculus
uuuucauuagcuucuuaggaaaucugccuccauaggg

SEQ ID NO: 119880 - RNA, 46 nt, Mus musculus
aggaaguggaggcuuagggaaauuacaaguccaaaguagccuagcc

SEQ ID NO: 119881 - RNA, 24 nt, Mus musculus
caaaggaaggcagagccccagggc

SEQ ID NO: 119882 - RNA, 45 nt, Mus musculus
gaaugcugaauuuaugccagugagguggcucagacgcugugggug

SEQ ID NO: 119883 - RNA, 46 nt, Mus musculus
aucaaagaucaaguggagaugaugguagugauaagacuguacagag

SEQ ID NO: 119884 - RNA, 41 nt, Mus musculus
aaguaugucuccccaagggcccaacaugcugcucaagaaag

SEQ ID NO: 119885 - RNA, 45 nt, Mus musculus
gaaacuuguuguuuuguccuguuuaauuuugugugugugagugug

SEQ ID NO: 119886 - RNA, 45 nt, Mus musculus
aacacauggugaugaauuucauucuuaacuuaagaaaaccuuaga

SEQ ID NO: 119887 - RNA, 45 nt, Mus musculus
agauugagguuuauaggagauaaaucugaacuccaugucuucaga

SEQ ID NO: 119888 - RNA, 45 nt, Mus musculus
uugugucuguuugugacuauaaucauaaaaccuuuaagcauagac

SEQ ID NO: 119889 - RNA, 46 nt, Mus musculus
uugggugcuggcaauugaaccugggucuucaggaagggcagcuagu

SEQ ID NO: 119890 - RNA, 23 nt, Mus musculus
uuuuucaacagguggucagauug

SEQ ID NO: 119891 - RNA, 45 nt, Mus musculus
gaaacauuuagacaacauuagguugacauuuuccuuuaggugagg

SEQ ID NO: 119892 - RNA, 46 nt, Mus musculus
gaaagaaagaaagaaagaaagaaagaagaaaagaaaagacccaggu

SEQ ID NO: 119893 - RNA, 46 nt, Mus musculus
acagagaaagaaagaaagagagaaagagagaaagagagaaagagag

SEQ ID NO: 119894 - RNA, 42 nt, Mus musculus
uagauaauugagucucuucuuaauuauuucaggcaugcaggu

SEQ ID NO: 119895 - RNA, 45 nt, Mus musculus
caccccauggcuaagggagacaagggacuuuacacaccuccagau

SEQ ID NO: 119896 - RNA, 46 nt, Mus musculus
ugguggaguugaaacacuggcccugggaguccuguuggccuaagaa

SEQ ID NO: 119897 - RNA, 46 nt, Mus musculus
gaucucuagcuuuuuuucugcauaugguuauuuguauguuuuagau

SEQ ID NO: 119898 - RNA, 65 nt, Mus musculus
uuaagaaggauuuuauuacucauuucuaagaaaauugaagauaaucacuuauaacuugugcacac

SEQ ID NO: 119899 - RNA, 92 nt, Mus musculus
aggaguaagaugcaguccccuuugucaaggagcuugcaguagagugggggagcacacgaguaaacaagcuucccaggaaacuuguaggauua

SEQ ID NO: 119900 - RNA, 46 nt, Mus musculus
ugaaugccauacaccacuuuugugggggguggaaguugcagggguc

SEQ ID NO: 119901 - RNA, 42 nt, Mus musculus
caaauucaucugccuugacaggcuggaccccgaagaggagaa

SEQ ID NO: 119902 - RNA, 42 nt, Mus musculus
ggcgcagcccccgccgccuccagacgccaccugucaccaggu

SEQ ID NO: 119903 - RNA, 70 nt, Mus musculus
cuggggccaugagacaaucugugccugugccuuaggccucagauccccaaacuuuugagucggaugagag

SEQ ID NO: 119904 - RNA, 45 nt, Mus musculus
ggcaugacgggaccggucggcucgcggcaaaaagcggucugagga

SEQ ID NO: 119905 - RNA, 42 nt, Mus musculus
aaccauugcccuaaguagaccaggccuugaacuuucagccau

SEQ ID NO: 119906 - RNA, 46 nt, Mus musculus
agcuccuaacaagucuacugguuaaggguagaaucuggggccagau

SEQ ID NO: 119907 - RNA, 46 nt, Mus musculus
guaauguagcuuauauuuacuuccucuaccuuguaucaccccaguc

SEQ ID NO: 119908 - RNA, 57 nt, Mus musculus
acagacuauugugagccuccacguggguuuggggaacuaaaucuagauccccugcaa

SEQ ID NO: 119909 - RNA, 53 nt, Mus musculus
gagcaaguacuuuuauaaaauuaauucuuuuuaauucacuuuauguccugauc

SEQ ID NO: 119910 - RNA, 41 nt, Mus musculus
ucugagggagggggagggauuuguaaggaugguaggguagg

SEQ ID NO: 119911 - RNA, 46 nt, Mus musculus
gggcaucuagucccagcaggucucccacggaggccuaaccaggcag

SEQ ID NO: 119912 - RNA, 46 nt, Mus musculus
uaccucuguuauaugucuaucuuauuuggauaaaaauaaucuggau

SEQ ID NO: 119913 - RNA, 48 nt, Mus musculus
caaaccuggaauccuccugccuuagucuccugacuaacuugccuuagu

SEQ ID NO: 119914 - RNA, 46 nt, Mus musculus
ggcuguguugcccaggcuagcccugccuuaauuuuccagguacuua

SEQ ID NO: 119915 - RNA, 46 nt, Mus musculus
uggaauguguuuuauuccauaauuaauuagauuaaacaauggucca

SEQ ID NO: 119916 - RNA, 47 nt, Mus musculus
cuuucuguaauuuuauguuagguggauuuacuaacauugauagauca

SEQ ID NO: 119917 - RNA, 53 nt, Mus musculus
uuucaguuuuuucuugcuguuuagugucaaaauaucuaugauucuacuaugca

SEQ ID NO: 119918 - RNA, 46 nt, Mus musculus
uaaauggaagugaguccuaaaaugacuacuugggagacagggggag

SEQ ID NO: 119919 - RNA, 47 nt, Mus musculus
augcaugaccacauaaauacacacacacacacacacacacacacaca

SEQ ID NO: 119920 - RNA, 41 nt, Mus musculus
acuugggugcacaucuguaaucccagcacucagaggcagag

SEQ ID NO: 119921 - RNA, 42 nt, Mus musculus
caaucaucuggaaugagaucugaugcccccuucugguguguc

SEQ ID NO: 119922 - RNA, 46 nt, Mus musculus
gauugugagccaccgugagguugcugggauuugaacucaggaccuu

SEQ ID NO: 119923 - RNA, 29 nt, Mus musculus
cauaaccugguucaucaucgcuaaucugc

SEQ ID NO: 119924 - RNA, 41 nt, Mus musculus
gagggaggggagagagaaagaggaggcgagaggggggaaag

SEQ ID NO: 119925 - RNA, 46 nt, Mus musculus
cagaguaaguauuagaucccuuagggcuacauaacaagauccugcu

SEQ ID NO: 119926 - RNA, 47 nt, Mus musculus
aauagaaauagugauagauccauuccuaugacuguagauuuuaucag

SEQ ID NO: 119927 - RNA, 46 nt, Mus musculus
ucuuaaccacugauccauuucaccagcccauauaacaacuauuaaa

SEQ ID NO: 119928 - RNA, 45 nt, Mus musculus
gccagcauauauguauuuacaccauauggaugccugauacauuug

SEQ ID NO: 119929 - RNA, 46 nt, Mus musculus
acuuucacaguaaucuagugaaggcaguuauauuuccauuuugcag

SEQ ID NO: 119930 - RNA, 29 nt, Mus musculus
agaauaccagcauuuuauguuaaaguucc

SEQ ID NO: 119931 - RNA, 46 nt, Mus musculus
ucucgcucucugccucucugcuguccauuugguguacaacugccag

SEQ ID NO: 119932 - RNA, 42 nt, Mus musculus
gggaaagaggucuggcaguuguacaccaaauggacagcagag

SEQ ID NO: 119933 - RNA, 42 nt, Mus musculus
uggucaacuccauuugcucggucccugcucacucaggcccag

SEQ ID NO: 119934 - RNA, 46 nt, Mus musculus
caccuauuaacccuucucaaaaacaguuccaccaacaagggaucaa

SEQ ID NO: 119935 - RNA, 41 nt, Mus musculus
uaacuuaguguguaugguaauaaagguaagucgggggcgcu

SEQ ID NO: 119936 - RNA, 45 nt, Mus musculus
agaaaaugugagccucagguucagggagagacccugccucauaga

SEQ ID NO: 119937 - RNA, 58 nt, Mus musculus
gaguccugcaaugcaaacuccagcuacuauaguuaaccacugagcuaccucuccagcc

SEQ ID NO: 119938 - RNA, 46 nt, Mus musculus
ugacuugagagguacaggcaggugggauggagggaguaagagucua

SEQ ID NO: 119939 - RNA, 46 nt, Mus musculus
uccuuucuucuuuucuucuuuucucccuucagcaugaucuugucau

SEQ ID NO: 119940 - RNA, 67 nt, Mus musculus
gaaaaacacucaucuugaguuguaugacaagaucaugcugaagggagaaaagaagaaaagaagaaag

SEQ ID NO: 119941 - RNA, 46 nt, Mus musculus
acaggcagcacagguuacacaguagguucaaagccagcuuggaggg

SEQ ID NO: 119942 - RNA, 55 nt, Mus musculus
ccaaccaaugguggcacacaccuauaauuccaucaugugaaaagcugaggcagag

SEQ ID NO: 119943 - RNA, 47 nt, Mus musculus
caauuaguuuuagucuacugcauuuugauuauguuugcgcccucucu

SEQ ID NO: 119944 - RNA, 49 nt, Mus musculus
guuuuaaauaaagaaacacaaaguuggguagguagggaagggaagagag

SEQ ID NO: 119945 - RNA, 45 nt, Mus musculus
accuuugugcuugcaugaguaagcaugacacagaaugcacaugga

SEQ ID NO: 119946 - RNA, 45 nt, Mus musculus
aaagaaauaagaaaugauggcgaaggauacugauugcucuguagg

SEQ ID NO: 119947 - RNA, 42 nt, Mus musculus
ggcuguccuugaaccauggcagguuuauaaacacacacacac

SEQ ID NO: 119948 - RNA, 46 nt, Mus musculus
cagggucuugcuauguaguucagguugguggccuuaaacucaagau

SEQ ID NO: 119949 - RNA, 92 nt, Mus musculus
uuaaaugucucuuuucuuuuuaaaaggauauaauugacacugguaaaacaaugcaaacuuugcuuucccugguuaagcaguacagccccaaa

SEQ ID NO: 119950 - RNA, 46 nt, Mus musculus
ugugcuugcagaccaaauagucuuauccauggagccaccuccccag

SEQ ID NO: 119951 - RNA, 25 nt, Mus musculus
uuauagauaaggauacugaagccua

SEQ ID NO: 119952 - RNA, 45 nt, Mus musculus
ucauuuuuacuuuaauaucuuugacugcucugugcuuuuugugua

SEQ ID NO: 119953 - RNA, 45 nt, Mus musculus
ggaugguugugagccaccauaugguugcugggauuugaacccagg

SEQ ID NO: 119954 - RNA, 46 nt, Mus musculus
uggucagaggacagccuaagauucuuucuaccuuguugguccuggg

SEQ ID NO: 119955 - RNA, 45 nt, Mus musculus
ugucugcugaccaauuaaacuagcuuuauaaaaucguuuuaaaag

SEQ ID NO: 119956 - RNA, 46 nt, Mus musculus
gaugauguaguuguccuacgcaaguguguuuuggucuuuccccaaa

SEQ ID NO: 119957 - RNA, 46 nt, Mus musculus
uuucuguuuaaaugcuuaccugucucccaguuuugauaugcccaag

SEQ ID NO: 119958 - RNA, 46 nt, Mus musculus
auaaaacuguaugauucuacuuauauaaccccguuugaaaugacag

SEQ ID NO: 119959 - RNA, 49 nt, Mus musculus
uuugugucauuagugaaacuggaaaagccaaauacaaagccuaagauga

SEQ ID NO: 119960 - RNA, 42 nt, Mus musculus
acauucauagaagguucaugcaaaaagcuuuacuaggcagau

SEQ ID NO: 119961 - RNA, 52 nt, Mus musculus
ccuucuaugaauguuacuguuuuauuuuuagaaaugucaguugcugcguccc

SEQ ID NO: 119962 - RNA, 73 nt, Mus musculus
aacaaaucucuuaaauuaccacuuuuaaauaauaauacugagauuguaucuguaagaaggauuuaaagagaag

SEQ ID NO: 119963 - RNA, 45 nt, Mus musculus
aaaaaaaagcacuuccuggucaucaaguaguauaccacccacaag

SEQ ID NO: 119964 - RNA, 45 nt, Mus musculus
guaagaacggaggaaacuacuagacaagucuauuccaugccuaua

SEQ ID NO: 119965 - RNA, 46 nt, Mus musculus
gcuuuauuuaucaugaccuaagcaaugcauauguuagcacuggauc

SEQ ID NO: 119966 - RNA, 47 nt, Mus musculus
aaguuaagcccaaggggaaauacacaaacccagggagugagauggcu

SEQ ID NO: 119967 - RNA, 45 nt, Mus musculus
ggcaucugcaacauuaaaagacaaaacguucucaacugggaagag

SEQ ID NO: 119968 - RNA, 42 nt, Mus musculus
agaggugacuuagaaucuaaaaaagaaaaaaacgagggggaa

SEQ ID NO: 119969 - RNA, 63 nt, Mus musculus
aaaaggcgggcggggaggcggacagacagacggacagcgagagagaaagggcggaggggugug

SEQ ID NO: 119970 - RNA, 42 nt, Mus musculus
ucgggcuggaaccgggcuggaaucgggcuggaauccggcugg

SEQ ID NO: 119971 - RNA, 46 nt, Mus musculus
ucaccuccaagugcaaguuaucuuaaauaaaauaauacacaugcaa

SEQ ID NO: 119972 - RNA, 44 nt, Mus musculus
uaggagaggaggaugcagaugaggaaggauguggagggcgggcg

SEQ ID NO: 119973 - RNA, 46 nt, Mus musculus
cacagggguugauaaaggauagauggaaaugcagggcauagcacua

SEQ ID NO: 119974 - RNA, 46 nt, Mus musculus
uguggaagcacaggagaagaaaggggaggaaacuaggcaguggcag

SEQ ID NO: 119975 - RNA, 98 nt, Mus musculus
acauauaccauacagagaacacaaaagccuuaccggaaccgccagauacaugagcauaaacacacaucuaggaaaagagcagaguagaagagaugauu

SEQ ID NO: 119976 - RNA, 45 nt, Mus musculus
aagccagacuaugauuaccuaagaaagcuuuuuacugacuuguuu

SEQ ID NO: 119977 - RNA, 42 nt, Mus musculus
aggagguaaugaaaugcucuggcggcgagugaucugcccacu

SEQ ID NO: 119978 - RNA, 44 nt, Mus musculus
caugggccgugggcagcccagguaccucccaggugaguccgggu

SEQ ID NO: 119979 - RNA, 33 nt, Mus musculus
caacgugaggaaaaggcuucuguacagguagag

SEQ ID NO: 119980 - RNA, 33 nt, Mus musculus
uucaacgugaggaaaaggcuucuguacagguag

SEQ ID NO: 119981 - RNA, 45 nt, Mus musculus
guccaugggccuugggcagcccagguaccucccaggugaguccag

SEQ ID NO: 119982 - RNA, 42 nt, Mus musculus
ggcgcgcgcaugcgagaucuccaggcagggcgggcgcgggag

SEQ ID NO: 119983 - RNA, 45 nt, Mus musculus
ggagacaacugccagacagucuuuugagggaguugagcagaaaau

SEQ ID NO: 119984 - RNA, 42 nt, Mus musculus
aaugcuauaccaaaagucucccauacucacccacccccacuc

SEQ ID NO: 119985 - RNA, 42 nt, Mus musculus
cguggaagaagggacccugaagaauuuaaaagcaccccagag

SEQ ID NO: 119986 - RNA, 45 nt, Mus musculus
gagagauggaguaagaagaacccagagagcaacaacaggcuagau

SEQ ID NO: 119987 - RNA, 24 nt, Mus musculus
gaacuacaggggaaaacuaagaag

SEQ ID NO: 119988 - RNA, 46 nt, Mus musculus
gcaccuagaaacaaggaggaacuagggugaggagaagcuaaggguu

SEQ ID NO: 119989 - RNA, 109 nt, Mus musculus
aggagguguggaggaaauaaggaauaagguaacaaggaggaaauagaguugggaugggcuuauagucggggucuagggaggucuuagggauuagaagaugcuggguagu

SEQ ID NO: 119990 - RNA, 76 nt, Mus musculus
caagggagcagcuacuggugaagaugagcuagaagguuagaaggagauggggagaaguuaagaguaagggggagcu

SEQ ID NO: 119991 - RNA, 52 nt, Mus musculus
aagagacccagagcuacuggagcuaagaauggggaggagcuggguaugaauu

SEQ ID NO: 119992 - RNA, 50 nt, Mus musculus
ggaggaucuggcuagaaauauuggauuaagaagaguuggggagagguaag

SEQ ID NO: 119993 - RNA, 56 nt, Mus musculus
ggaauaacuauagagggguagguguuugcuagaugugggaaguacuggggaagagu

SEQ ID NO: 119994 - RNA, 58 nt, Mus musculus
gaauaggagcuggggcuuaugaaaaggaaagguuaggggugaugcagagccaaagggu

SEQ ID NO: 119995 - RNA, 48 nt, Mus musculus
agguggggaaaaguuaggggcucaggagcugaggaaggauugggauga

SEQ ID NO: 119996 - RNA, 48 nt, Mus musculus
aucugggaagaagcuagggaugaggaaaaccugagaggggaugagaaa

SEQ ID NO: 119997 - RNA, 53 nt, Mus musculus
gacgauggagaugaugggggagaguagaagcuggggaaagacuaggugucaga

SEQ ID NO: 119998 - RNA, 99 nt, Mus musculus
gauggggauggaaagaacuugggagagucuacagauaaggaaggccuguccagggguaaggagcaaggaaaaaaugggcaaagaguaguuggauaggga

SEQ ID NO: 119999 - RNA, 81 nt, Mus musculus
gguggcauguccaaacuggggaggagcuaagggugagaagaugggaaggggcuaaagaggaggcuguagaguugaggcagu

SEQ ID NO: 120000 - RNA, 83 nt, Mus musculus
aggggaagauggaagcaguggugagcccugcugaaguugcagagcagaaaauggugaccccugaggacgucaccgaggggaaa

SEQ ID NO: 120001 - RNA, 45 nt, Mus musculus
cuaagguuucgagggagaagauggaggcgauagugguagcugagg

SEQ ID NO: 120002 - RNA, 48 nt, Mus musculus
gaggggaagguagaggcagugauaagcacugcagugguugucgaggag

SEQ ID NO: 120003 - RNA, 45 nt, Mus musculus
ccgaagggaagauggaggcgguggggagcccugccaagguugucg

SEQ ID NO: 120004 - RNA, 45 nt, Mus musculus; identical to SEQ ID NO: 120003

SEQ ID NO: 120005 - RNA, 46 nt, Mus musculus
cgaggggaagguagaggcaguggugagcccugccgagguuucgagg

SEQ ID NO: 120006 - RNA, 49 nt, Mus musculus
ccguuaguucaggcgggaagaggggaugaaugugaugacggaguguaga

SEQ ID NO: 120007 - RNA, 45 nt, Mus musculus
ugaguuuuuagcaguuaguuugguuggacucgauugguuuggaga

SEQ ID NO: 120008 - RNA, 46 nt, Mus musculus
ggacuuuaaagcuuaaaaauuagguggauuucuuuuuaguggaguu

SEQ ID NO: 120009 - RNA, 44 nt, Mus musculus
acaacugaugaaaaacagagaagcugcccgagagugccgccgga

SEQ ID NO: 120010 - RNA, 46 nt, Mus musculus
aggugguuguacagacugcaucaggagauaugcagaccuaccagau

SEQ ID NO: 120011 - RNA, 44 nt, Mus musculus
aagcacggauggcgugcaggcacugcagacauuaaccaugacaa

SEQ ID NO: 120012 - RNA, 46 nt, Mus musculus
ucccagcauuucugccaucacgucuaugucuguuccagcccccauc

SEQ ID NO: 120013 - RNA, 46 nt, Mus musculus
caaaccauggcuugaaauggacuagccaucaagacucaguccccaa

SEQ ID NO: 120014 - RNA, 51 nt, Mus musculus
cucaagucuuucucaagcacuuuagcaguaagaacaagagacccaagagga

SEQ ID NO: 120015 - RNA, 45 nt, Mus musculus
cgaugggaugguguaguauagaauagaauuuauucaaggcauggg

SEQ ID NO: 120016 - RNA, 47 nt, Mus musculus
agggggagguagauaaguagaugaauagaggucugcgaggcaguggg

SEQ ID NO: 120017 - RNA, 74 nt, Mus musculus
gagcacagaaaggccuucuggagggagguuagauguggcucguuaggggaaagccuauccaucaucguucaagc

SEQ ID NO: 120018 - RNA, 65 nt, Mus musculus
acugcaggccuugaugagcagagacaguuuaugguuuuaggacuuuauuguggaaaggcaggggg

SEQ ID NO: 120019 - RNA, 78 nt, Mus musculus
uggggcgagcgcucuagugagcguggacggaugcuuaggcaguaguccuggcagcggcagcggcggcgggcaguagug

SEQ ID NO: 120020 - RNA, 93 nt, Mus musculus
guggcagaagaggggaagagagacggcccggagaccgacacacucacacuuucaaguucccuuggagggagaggaguuggggcugcagaaaga

SEQ ID NO: 120021 - RNA, 46 nt, Mus musculus
agggaaaagggacugggagaguggggaccagaaccagggguguagu

SEQ ID NO: 120022 - RNA, 66 nt, Mus musculus
acugaccugggcaccuccuauuuggacauugcuaaaggcgcuguggaguuauucuugaagguaaaa

SEQ ID NO: 120023 - RNA, 44 nt, Mus musculus
gccagccaggguucuauagugagacacuuucucaaaaaaagaaa

SEQ ID NO: 120024 - RNA, 45 nt, Mus musculus
caagcuacaguuuguguauuucuuuaauggaggugucugaagugg

SEQ ID NO: 120025 - RNA, 45 nt, Mus musculus
guuugguuaugauuuuacagcauucguccaagugggccagggugg

SEQ ID NO: 120026 - RNA, 46 nt, Mus musculus
agaacagucagugcucuuaaccgcugagccauuucuucagcccccu

SEQ ID NO: 120027 - RNA, 46 nt, Mus musculus
aucaaccaaaaagagguucauguaccuuuuagaugcacacuucaua

SEQ ID NO: 120028 - RNA, 45 nt, Mus musculus
ugcuaaacuaucuuuaugaaugcaaucuguguuaauaagcacccc

SEQ ID NO: 120029 - RNA, 46 nt, Mus musculus
uuaaaggccacaaaaauggauuguaaagugagaggucauccuaugg

SEQ ID NO: 120030 - RNA, 42 nt, Mus musculus
ugguccgccucgucuggccucagugggagaggaagugccuag

SEQ ID NO: 120031 - RNA, 45 nt, Mus musculus
auguguguauuuagguuucuaaaauaauuguauucaacuauuaaa

SEQ ID NO: 120032 - RNA, 45 nt, Mus musculus
ggacuuaguuacaguguuaucucuuaccuuaaaaaacucagccaa

SEQ ID NO: 120033 - RNA, 42 nt, Mus musculus
uguuuauguugggccuuuaaggcuuugucaagguauggccag

SEQ ID NO: 120034 - RNA, 46 nt, Mus musculus
aucuaugaauguguauuaguauauugguuucugcauucauacuggg

SEQ ID NO: 120035 - RNA, 82 nt, Mus musculus
agaggaggagaguagagaaguagggggaaagggaauguggagagaaggagagcaagagggcaagagagaggcaggaguaaag

SEQ ID NO: 120036 - RNA, 37 nt, Mus musculus
gaaaauuuuggguggggaggcaguaucaaaagaaaac

SEQ ID NO: 120037 - RNA, 45 nt, Mus musculus
guaugaaaggauuuucauuuugcuugaagaagugcagggaccucu

SEQ ID NO: 120038 - RNA, 46 nt, Mus musculus
auguauauuuucuuugaaguuuauacagaaguuuauauggagcagu

SEQ ID NO: 120039 - RNA, 88 nt, Mus musculus
ucagcugcagggaauaaagauugugaauugguggcaaguaugcacaauaacucccuaauaauugcuuccuaagcacuuguggcauacu

SEQ ID NO: 120040 - RNA, 46 nt, Mus musculus
aaauauuuggaguucaucuauuugaauucucuuagaaaauucaggu

SEQ ID NO: 120041 - RNA, 45 nt, Mus musculus
agcauucauaugcuauauguuaaucugcaucuuuauacucacaga

SEQ ID NO: 120042 - RNA, 46 nt, Mus musculus
gaacucuuuaaauuauucacauuaucuugcuuuaauuuugguagau

SEQ ID NO: 120043 - RNA, 45 nt, Mus musculus
aauguuuguuagaagucauccagagagcuucuuuuaguugggaga

SEQ ID NO: 120044 - RNA, 47 nt, Mus musculus
aggaagaacaaggaauggauuacugguauaguaguuaacuuugagaa

SEQ ID NO: 120045 - RNA, 46 nt, Mus musculus
aggggcugugggggcgcuccccuaagggacuguugaacccagugca

SEQ ID NO: 120046 - RNA, 45 nt, Mus musculus
aggaaggcagcacugccauccguccuacucaaagugccagcagca

SEQ ID NO: 120047 - RNA, 45 nt, Mus musculus
ccccacuuuaagcuccagguagacaucgcuguuaccagcccucac

SEQ ID NO: 120048 - RNA, 43 nt, Mus musculus
uuuacauuugguuacaagcugcucuuuauaccuaguccuaguu

SEQ ID NO: 120049 - RNA, 24 nt, Mus musculus
cccuguucacugaguauacaaaau

SEQ ID NO: 120050 - RNA, 60 nt, Mus musculus
uauagugugauaaaaaaagggaaaagaaagagagaaaggaaggaaggaaggaaagagaga

SEQ ID NO: 120051 - RNA, 46 nt, Mus musculus
cuugaccaauaggaaauggcacuauuagaagguguggccuccuugg

SEQ ID NO: 120052 - RNA, 46 nt, Mus musculus
agaacccagaaauagacaaaagaaacauaaaccuuaccaccaagaa

SEQ ID NO: 120053 - RNA, 26 nt, Mus musculus
gaaaaaagaaaacagaagcaggcaga

SEQ ID NO: 120054 - RNA, 46 nt, Mus musculus
gugcuuggaacauuucagccaacaaggaaaaacaacugcuugagaa

SEQ ID NO: 120055 - RNA, 45 nt, Mus musculus
auuuuauauauaugaguacaguaugcuguugcuguuuccagauac

SEQ ID NO: 120056 - RNA, 46 nt, Mus musculus
agcagcuagccaaagaacgcagagaacaacagaaacgucagcaaga

SEQ ID NO: 120057 - RNA, 45 nt, Mus musculus
ugagaaccaugaguggcaacaacuugagcgggaacgaugaguuug

SEQ ID NO: 120058 - RNA, 43 nt, Mus musculus
aacuacggcuuuucuagugauggugcauccagcucuacugcga

SEQ ID NO: 120059 - RNA, 46 nt, Mus musculus
uaacugauauuuuuuaguguauaaaauacagucuucacauuuauag

SEQ ID NO: 120060 - RNA, 46 nt, Mus musculus
uuuaaaguuaaacuguacaaagaugaucaagggaaucuuaaaggag

SEQ ID NO: 120061 - RNA, 46 nt, Mus musculus
gacuagaaaggagauggugaauuauacuuacugcuucaaacaccag

SEQ ID NO: 120062 - RNA, 42 nt, Mus musculus
gauaaugugguaguauaacuaucauagguguguaguuagugg

SEQ ID NO: 120063 - RNA, 46 nt, Mus musculus
agcuugcauuaaaacuuuuggaugaagaugaaauuagaggcuacaa

SEQ ID NO: 120064 - RNA, 49 nt, Mus musculus
uccagcucaagggugaauacgaugccucaaagaagaagaagaagugcaa

SEQ ID NO: 120065 - RNA, 42 nt, Mus musculus
ggucaugguaggauaggaaaauggaacaaagaaucagcccgu

SEQ ID NO: 120066 - RNA, 46 nt, Mus musculus
cagggaaagaaacccuuguuaguguaugcucucuuuguuugcccag

SEQ ID NO: 120067 - RNA, 45 nt, Mus musculus
uaaguaaugaaggacaguuuuguaauguaaguucuaaugggucaa

SEQ ID NO: 120068 - RNA, 41 nt, Mus musculus
gggucagcagugcuucacauuucuguagcacauucacagca

SEQ ID NO: 120069 - RNA, 45 nt, Mus musculus
uucagagagccagaggaggcugaccauuguauucagacucuggau

SEQ ID NO: 120070 - RNA, 45 nt, Mus musculus
acuagcuccuguuugugcacagguagaggagaccucaagagaaag

SEQ ID NO: 120071 - RNA, 93 nt, Mus musculus
uucugaaaaagaugccaaagaaggugggucugauggggaccacccugagagagaggguggagaaggcugcuccaagaaagagaaugaagaggg

SEQ ID NO: 120072 - RNA, 76 nt, Mus musculus
aaagggaagcuaggaagaaaagcaaaauggauuaugagaagaauggcuuuucaaaagagucugaagacaaugaccu

SEQ ID NO: 120073 - RNA, 46 nt, Mus musculus
caaucucaagauggcucugacaaagaaauagaagaaaaugguguua

SEQ ID NO: 120074 - RNA, 47 nt, Mus musculus
gagagaauuugaggaagacucagaugaaaaggaggaagaaggugaug

SEQ ID NO: 120075 - RNA, 67 nt, Mus musculus
gaaaggguuuuugaugaugauucugaugacauugaggaggaagaagaagcagaugaaaaggagugug

SEQ ID NO: 120076 - RNA, 120 nt, Mus musculus
gaaaagcucuuugaugacuccgaugagaaggaagaugaagaagacacagauggaaagaaagaugaugaugccagugacaagguauucgaagacaauuccaaugagaaguuguuugaugag

SEQ ID NO: 120077 - RNA, 52 nt, Mus musculus
ggaagaugggucucaguccacagacagcagcuuugcccucaguaguagugau

SEQ ID NO: 120078 - RNA, 52 nt, Mus musculus
ucuccauuugcccaugcuucagggucaauaguaguguuacagcaacaugugc

SEQ ID NO: 120079 - RNA, 46 nt, Mus musculus
ggaguuugugauauucagaaauaaagauuaaauugguaauaugcag

SEQ ID NO: 120080 - RNA, 45 nt, Mus musculus
aaugaugaauuuauagagacagaauucucuuagucuugaggaagu

SEQ ID NO: 120081 - RNA, 45 nt, Mus musculus
agacucugaccuagccagaguggagucagcuuaacacccagacau

SEQ ID NO: 120082 - RNA, 46 nt, Mus musculus
aauucuagcugcuguggaguugaacaagaagagaaauccuagaggu

SEQ ID NO: 120083 - RNA, 46 nt, Mus musculus
uaaguguugcuggaccuggggcagaggucagaacuggaguuucaga

SEQ ID NO: 120084 - RNA, 45 nt, Mus musculus
agacucuacuucccugugagaugcuaucagcaaaugugucccuag

SEQ ID NO: 120085 - RNA, 42 nt, Mus musculus
aauauagucuacagcuauguagaaguaucucuccaagaguug

SEQ ID NO: 120086 - RNA, 48 nt, Mus musculus
uggcucacaaccacccguaacaagauuugaugcccucuuguggagugu

SEQ ID NO: 120087 - RNA, 46 nt, Mus musculus
ucugucucaaugaaaacgaauucugagccuuugccagcuggcccag

SEQ ID NO: 120088 - RNA, 46 nt, Mus musculus
ggauucaaagauucauuuauugaaauaaaucaggaagcauuggcag

SEQ ID NO: 120089 - RNA, 42 nt, Mus musculus
gaaagagcaaaaacuucccccauacagaagcuagggccagag

SEQ ID NO: 120090 - RNA, 46 nt, Mus musculus
uaaguauauuuguauauuucucuaaaacuccccacuccacccgcaa

SEQ ID NO: 120091 - RNA, 42 nt, Mus musculus
ucaccccaaucucacuccacauuuagagcccacuccccagau

SEQ ID NO: 120092 - RNA, 45 nt, Mus musculus
uaaauguggagugagauuggggugaauuggcugugaaggggugac

SEQ ID NO: 120093 - RNA, 47 nt, Mus musculus
cuccgcaaacuaucuuagaaggugagguguuggccagaucagucaga

SEQ ID NO: 120094 - RNA, 23 nt, Mus musculus
acucacuuucuuccacccuuugc

SEQ ID NO: 120095 - RNA, 55 nt, Mus musculus
aauguugaguauucaaagcuuguugcuccagccacacgaaaagcacagucacugu

SEQ ID NO: 120096 - RNA, 42 nt, Mus musculus
ucacugcucgcuucgcgaguccaagccucuucaccuccagag

SEQ ID NO: 120097 - RNA, 93 nt, Mus musculus
cuuuccuaggcugcgagagucuccugcagagggacgggagggaggaggggaagaaaaaggauuggggggagggcgaugggagaggaggaggga

SEQ ID NO: 120098 - RNA, 46 nt, Mus musculus
uguucuggacacagaagauccggccgaagugagcaagggugcaggc

SEQ ID NO: 120099 - RNA, 44 nt, Mus musculus
cgcucugagaaccucaagauccacaagaggacccauacagguaa

SEQ ID NO: 120100 - RNA, 86 nt, Mus musculus
uuguuuuaucugaagcggaggagcaaacgaaugacacuaccccggguucggagcgcccacuccggauucccauccuggguugagau

SEQ ID NO: 120101 - RNA, 45 nt, Mus musculus
cuauaccugcuuucccaggccgaauucugaaagugaaaucuggag

SEQ ID NO: 120102 - RNA, 45 nt, Mus musculus
gaggacaaccaaaaugcauuuaaaaaagaaaacugagacaaauca

SEQ ID NO: 120103 - RNA, 46 nt, Mus musculus
agaaacaggacaguguuaauuaaaaugauuugaaggaguuccagaa

SEQ ID NO: 120104 - RNA, 46 nt, Mus musculus
ccguugaugccauauuuaucguuuguaauuuaauuauugcugcaag

SEQ ID NO: 120105 - RNA, 47 nt, Mus musculus
ugugaguaaauugaauuuuguuuguugguauuuauaacucacucaga

SEQ ID NO: 120106 - RNA, 75 nt, Mus musculus
cucuagcucagaugguuguuuaacugggaguuuaaauguguuuguccuggauuuucggcaugcaaaucaaauaau

SEQ ID NO: 120107 - RNA, 71 nt, Mus musculus
acugaucaauucacuuaguggccaugacaucucaaucuuguacuucaaagacugagaggcuggguuuaauc

SEQ ID NO: 120108 - RNA, 46 nt, Mus musculus
uuuacauaaaaaugaaaauuauggcaggaugcaugucuguugagag

SEQ ID NO: 120109 - RNA, 46 nt, Mus musculus
aucuaugacguaccuaaucugccuaucaaaucuauuuagcuucaaa

SEQ ID NO: 120110 - RNA, 45 nt, Mus musculus
auuugcaaaauacuuuauuuuuaaaguucauuacuuguaggcaaa

SEQ ID NO: 120111 - RNA, 45 nt, Mus musculus
guggaaaagaaacugaucaguauuuugggggguugaaguggguag

SEQ ID NO: 120112 - RNA, 46 nt, Mus musculus
caccucuuucgcuuuaaggggcaaugcucucaguuuuugguggcag

SEQ ID NO: 120113 - RNA, 46 nt, Mus musculus
aagcuagguuaggacuggggucagcagggaggggacucauggagaa

SEQ ID NO: 120114 - RNA, 25 nt, Mus musculus
ucaagaugaggggaaaggggguggg

SEQ ID NO: 120115 - RNA, 42 nt, Mus musculus
ccgcgaaggaagaacacuugcgacauccgcaucacucggcaa

SEQ ID NO: 120116 - RNA, 34 nt, Mus musculus
gcucggccggggccuuagcugggacccgcaggga

SEQ ID NO: 120117 - RNA, 44 nt, Mus musculus
caggggguugcgggggagguugaaagcagccuagcggggagggc

SEQ ID NO: 120118 - RNA, 45 nt, Mus musculus
acuacggggcugccgugcuguguuguccuugagauuucccugguu

SEQ ID NO: 120119 - RNA, 48 nt, Mus musculus
aauguaggucguggcaguuggacgcaguuuaaaaacaaacagacaaaa

SEQ ID NO: 120120 - RNA, 45 nt, Mus musculus
uuggagggaaacagaggcuugucgacccaguuguaccuuugagag

SEQ ID NO: 120121 - RNA, 54 nt, Mus musculus
ggagacucuucagcaguuugaaaacuuuuuugaaauugccaccaaguuaauuuu

SEQ ID NO: 120122 - RNA, 66 nt, Mus musculus
ccccccucuuuccugugggugaaguuuccuucccaggcuuggccacccuauaugaccaagguggaa

SEQ ID NO: 120123 - RNA, 45 nt, Mus musculus
ugguagaugcugacaagaagauggccguggcaacccuggccucug

SEQ ID NO: 120124 - RNA, 42 nt, Mus musculus
ggaucaaucgagcugcccgcugugugcgcugggcccccagug

SEQ ID NO: 120125 - RNA, 42 nt, Mus musculus
agcacaacgggcaggugacaggcaucgacugggccccugagc

SEQ ID NO: 120126 - RNA, 46 nt, Mus musculus
uuccagguuuuuucaaaguuuuguucuuaauugcuaagugagagau

SEQ ID NO: 120127 - RNA, 46 nt, Mus musculus
ccuggccgcgggacagcucuguccagugcgcguuuaggcuguugag

SEQ ID NO: 120128 - RNA, 57 nt, Mus musculus
guuggaagacauagaggaugaggaagaaauggaggaggaggaggaagaggaagagga

SEQ ID NO: 120129 - RNA, 45 nt, Mus musculus
cagaaggugauuaccacaggcagacaccaggaugggcaugggaag

SEQ ID NO: 120130 - RNA, 42 nt, Mus musculus
cccucccaugauuugugcccagagacgucucaggagagccag

SEQ ID NO: 120131 - RNA, 45 nt, Mus musculus
cugccucuaauacaggcacuucaauggauuauaacagugacgggu

SEQ ID NO: 120132 - RNA, 41 nt, Mus musculus
aaaagcaccaaauuuuaauaucuaagucaauuuggggguga

SEQ ID NO: 120133 - RNA, 45 nt, Mus musculus
ccugcuccugaaaaauggacugaaggccuuucagaauggccucac

SEQ ID NO: 120134 - RNA, 70 nt, Mus musculus
agguauggggauccccucuugugugugugccggccgguguaucuguuuugagugucuguuuucugaaacg

SEQ ID NO: 120135 - RNA, 46 nt, Mus musculus; identical to SEQ ID NO: 44834

SEQ ID NO: 120136 - RNA, 78 nt, Mus musculus
aaaauaaacaguauuaauuggucuuuggaacccugcaccuguaguuaggaaucuaguguggcuagagaagcccugcua

SEQ ID NO: 120137 - RNA, 70 nt, Mus musculus
ggcacugauuauaaaugcuguucuuauagggaccagcagcuucucaaaguucuaugguaagggaacagau

SEQ ID NO: 120138 - RNA, 45 nt, Mus musculus; identical to SEQ ID NO: 44838

SEQ ID NO: 120139 - RNA, 42 nt, Mus musculus
ucucugagaggcucagaagccagcaccuccuagguaccaguc

SEQ ID NO: 120140 - RNA, 23 nt, Mus musculus
aggagagauagggaauuuggagg

SEQ ID NO: 120141 - RNA, 44 nt, Mus musculus
uuagccagauaaugagucuuaaacgugugcuuuuuugccuggag

SEQ ID NO: 120142 - RNA, 46 nt, Mus musculus
gugcagagaaagcucuggcuggggguuacucacacaucaggagaag

SEQ ID NO: 120143 - RNA, 46 nt, Mus musculus
aaucucccccacaaaaacaguaaugguguccagccaugccuugaga

SEQ ID NO: 120144 - RNA, 82 nt, Mus musculus
gacauagcugagaaugagaugccaggauugaugcgcaugcgggagauguacucagccuccaagccacugaauggugcucgca

SEQ ID NO: 120145 - RNA, 41 nt, Mus musculus
ccaaggcuggcauuccaguguuugccuggaagggcgaggca

SEQ ID NO: 120146 - RNA, 45 nt, Mus musculus
ccuucaguaucccauugggcaucaucuuguagagguuguggaccc

SEQ ID NO: 120147 - RNA, 49 nt, Mus musculus
ucuauggcugccaggagucccucauagauggcaucaaacgggccacaga

SEQ ID NO: 120148 - RNA, 46 nt, Mus musculus
aucacaucuguggcccguuugaugccaucuaugagggacuccuggc

SEQ ID NO: 120149 - RNA, 46 nt, Mus musculus
aaggaugauauccacacagccugugguggugacaaagauguugccc

SEQ ID NO: 120150 - RNA, 45 nt, Mus musculus
caccacaggcuguguggauaucauccuuggccggcacuuucagca

SEQ ID NO: 120151 - RNA, 45 nt, Mus musculus
ccugggcaugcccaucaacggccccuucaagccugaucaccacca

SEQ ID NO: 120152 - RNA, 42 nt, Mus musculus
cugggcgaggggugugcagggaguaguaagaagcgggcggca

SEQ ID NO: 120153 - RNA, 66 nt, Mus musculus
cucuugaguggccucuuugugaauuuccaaggaggguuuuagaucuaaaaguuucggaaagaccau

SEQ ID NO: 120154 - RNA, 116 nt, Mus musculus
uaaauuucccuuuguguuuaaguucucgaggacccgaauuugugccacagaacuucaggaaauuaacggggacuguacgauugcuacugaauuuuuaccaggacgguuuggaaugu

SEQ ID NO: 120155 - RNA, 48 nt, Mus musculus
cagugagcuauauuugagguuuuaaaugggcauucauggaacuacuga

SEQ ID NO: 120156 - RNA, 48 nt, Mus musculus
ucuaaggccccaccucacuagaauauuuuaguaacagaaggugcacgu

SEQ ID NO: 120157 - RNA, 58 nt, Mus musculus
cuaaacucgggaaagugacuuuaguaaauuaugcuuuugccaaguuuauggagacauu

SEQ ID NO: 120158 - RNA, 85 nt, Mus musculus
aauacuaauuuauacuaaaaauacccuuuuguuguaauauaggagacagaaagaacacaacauuuauguuacuaauuuuaccagu

SEQ ID NO: 120159 - RNA, 46 nt, Mus musculus
uccugaaagagguucaaauuuuacaacacuuagaauauugacugug

SEQ ID NO: 120160 - RNA, 46 nt, Mus musculus
aagauuucaaaaucacaaaucaugcuacuagcaugauaacagccaa

SEQ ID NO: 120161 - RNA, 45 nt, Mus musculus
cucccacuguuuuaauuuauauaagggauauagauauauagggag

SEQ ID NO: 120162 - RNA, 45 nt, Mus musculus
gaaaaggguaucagaucuccuugggauacagaugguugugagcug

SEQ ID NO: 120163 - RNA, 46 nt, Mus musculus
aaucugagguucccaaauccugcagcuauuauaugauagagccaag

SEQ ID NO: 120164 - RNA, 46 nt, Mus musculus
agacuuuagaacugacaggaugucuuguccuauccuuaguaugugu

SEQ ID NO: 120165 - RNA, 46 nt, Mus musculus
cuauauaaucuugauccuuaaguccauuugauuaugaaaacaaaag

SEQ ID NO: 120166 - RNA, 46 nt, Mus musculus
aauugcuaaugugcugacugccauuuugcuuuggaaaguagaggau

SEQ ID NO: 120167 - RNA, 50 nt, Mus musculus
caaccagagagacagauuccauuccaugaugugagauucccaccaccugu

SEQ ID NO: 120168 - RNA, 46 nt, Mus musculus
cuaaugaaccacaccccagccucacauugacaaggaaaugcagcau

SEQ ID NO: 120169 - RNA, 52 nt, Mus musculus
ugauauucagaagauugcuggaauagauuugucuuuuuucauggagaggagg

SEQ ID NO: 120170 - RNA, 45 nt, Mus musculus
ccuugcuguuggugguuagcuaaagugaggaugauaaagggugag

SEQ ID NO: 120171 - RNA, 46 nt, Mus musculus
uggguuuagcuauugguacucauggugcuaauauucagcaagcuag

SEQ ID NO: 120172 - RNA, 46 nt, Mus musculus
uuaguggcaugaguuuuguuuucuaccacugaccaaagagcucaag

SEQ ID NO: 120173 - RNA, 73 nt, Mus musculus
uaauaggaaaaaauggaaagcugauucaagagaucguggacaagucaggaguugugagggugaggauugaggc

SEQ ID NO: 120174 - RNA, 46 nt, Mus musculus
acuaaaagcaaaaaugccauuuuauaccaagaacuaaaacugcaag

SEQ ID NO: 120175 - RNA, 46 nt, Mus musculus
aauauugguauucuauauuuucaauuuauucagaucuucugauuag

SEQ ID NO: 120176 - RNA, 42 nt, Mus musculus
ugaaguagcuauguguacuuuuucaauuucccuuuggcccaa

SEQ ID NO: 120177 - RNA, 46 nt, Mus musculus
ugagaugcucauggauaugcuagaaaggcaaggauuaacgugaaag

SEQ ID NO: 120178 - RNA, 46 nt, Mus musculus
auuauaucuaaaaauacuacaugcucuuuaaaaaauauaccccaag

SEQ ID NO: 120179 - RNA, 88 nt, Mus musculus
guagaccaguugcguuuggagagauuacaaauugaugagcaguugcgacaaauuggagcuaguucuagaccaccaccaaaucguacag

SEQ ID NO: 120180 - RNA, 46 nt, Mus musculus
auuuuccucaguuacuuuaucuguuccuagacuuaauagcugcuaa

SEQ ID NO: 120181 - RNA, 79 nt, Mus musculus
cuauaucauuaacccccucagauguaaacaguuguuuuauagugaucuuuuguuuagcccuucccacugggagugggag

SEQ ID NO: 120182 - RNA, 45 nt, Mus musculus
acaaucaugguggccuuuauuggcugcuuuuagaguuggccaaau

SEQ ID NO: 120183 - RNA, 47 nt, Mus musculus
aauuuuuccucuauugaucacagcuauuuaaaaauauggcacauuca

SEQ ID NO: 120184 - RNA, 59 nt, Mus musculus
ccuuuuuaaaagaugucuaacaaaaauuacuucaaauauggcaagccuuuuacuuugaa

SEQ ID NO: 120185 - RNA, 66 nt, Mus musculus
cuucaucucuggaagcuucuguuaaccuuuuuuuuaaagucagacaaugguauauaacuuuuaacu

SEQ ID NO: 120186 - RNA, 51 nt, Mus musculus
gucauuagcuccaacagaggaagagagggagagcuuccugcgcagaggaga

SEQ ID NO: 120187 - RNA, 46 nt, Mus musculus
auuuccguaauucuuacuccauuuuagaaaacuuuguuaggccaaa

SEQ ID NO: 120188 - RNA, 46 nt, Mus musculus
cagggcaggauuuuacuuuuauuuuuuaaaaauacuaagcagugau

SEQ ID NO: 120189 - RNA, 46 nt, Mus musculus
uuuaaagucuucaugaaaugcugugccauuucauguccugugucag

SEQ ID NO: 120190 - RNA, 55 nt, Mus musculus
guuauuuucauuagcaaaaaaaagaguuguaugaucugugccuuuuuuauaucuu

SEQ ID NO: 120191 - RNA, 46 nt, Mus musculus
uuuguugcacugaaguaugacaaauaguguuauuggaagggaugug

SEQ ID NO: 120192 - RNA, 46 nt, Mus musculus
guaacugcucuugggcaauauucucuguacauauuagcgacaacag

SEQ ID NO: 120193 - RNA, 46 nt, Mus musculus
uaaagucauguuuuuaaaaucuuauuaaaguuucaaaaaucugaag

SEQ ID NO: 120194 - RNA, 47 nt, Mus musculus
agaccuccaacaugccuucggaucgaaggccaagucagagaaggaau

SEQ ID NO: 120195 - RNA, 50 nt, Mus musculus
gugauuggggugcuagucagcaaggguaagggggccaaagguggcagggc

SEQ ID NO: 120196 - RNA, 46 nt, Mus musculus
uaauaauugagccauauaaaggaauaacugaggcauaauuaaagag

SEQ ID NO: 120197 - RNA, 46 nt, Mus musculus
uacauuucuuccuuuuacuauuuuugacaaggaccgacauagccaa

SEQ ID NO: 120198 - RNA, 50 nt, Mus musculus
cuuccaucuuccaaauucuauaauuagagccacaugucaucaagccuggg

SEQ ID NO: 120199 - RNA, 44 nt, Mus musculus
cacauguauauuaggcaggcacuuuaucaacuaagccacauucc

SEQ ID NO: 120200 - RNA, 46 nt, Mus musculus
uuaugaacuaugcaauggaaaggauuggaguauuuucagcacaaag

SEQ ID NO: 120201 - RNA, 46 nt, Mus musculus
auaaagauuaaauuauaggaugugugugugagagaugacacagaua

SEQ ID NO: 120202 - RNA, 44 nt, Mus musculus
ugggcaugugguauacaucuguaauccuagguugaggcaggaga

SEQ ID NO: 120203 - RNA, 42 nt, Mus musculus
cuuuauauauuucccagcuuaacauuucuaaggaaccgccaa

SEQ ID NO: 120204 - RNA, 46 nt, Mus musculus
acuuggcauguaguaguagaugugauuguuuccuguuaggugccuu

SEQ ID NO: 120205 - RNA, 46 nt, Mus musculus
ucuaguccugggauuucugccuaugugcugcugcuccaugugcugg

SEQ ID NO: 120206 - RNA, 46 nt, Mus musculus
uaccuuaugaauaaaagugaaaucuuuguuagaauucaauggauag

SEQ ID NO: 120207 - RNA, 46 nt, Mus musculus
uuuacauaguacaaacuauuugagagacucugucacugagaauaag

SEQ ID NO: 120208 - RNA, 46 nt, Mus musculus
aguuuugcuaauccuaaaucugauaggggacuaauauccaauauau

SEQ ID NO: 120209 - RNA, 42 nt, Mus musculus
gauucgggacaauucuuaagguucugcggcaagauugugcag

SEQ ID NO: 120210 - RNA, 45 nt, Mus musculus
ggugagcuguaagccacguuguguuugcagaggggaggaggcuug

SEQ ID NO: 120211 - RNA, 45 nt, Mus musculus
aaucaguacgacaccuaccacggugcccccuacgauggcagccac

SEQ ID NO: 120212 - RNA, 46 nt, Mus musculus
aaaauaugucaguguggaugaaaugaaacucuuguaacacuauggu

SEQ ID NO: 120213 - RNA, 46 nt, Mus musculus
uguagaaugcaguggccuuuccccaaacuccauguuuccugaccuu

SEQ ID NO: 120214 - RNA, 42 nt, Mus musculus
ucaccagguauuaacaauauccacuccuggccaucugagcag

SEQ ID NO: 120215 - RNA, 73 nt, Mus musculus
guggcaguauaguccaaaucuugacugcucucuugucauaagcagauaguuucagaagaguaaaagggaggca

SEQ ID NO: 120216 - RNA, 42 nt, Mus musculus
caucuaaaggcuaaaaccaggauugauucccagagagggcau

SEQ ID NO: 120217 - RNA, 45 nt, Mus musculus
guguguacauucagaauagcaguaccgcgccagucaagccaccag

SEQ ID NO: 120218 - RNA, 46 nt, Mus musculus
uuauuagucauuuuauucauuuacauuucaaaugauaugccccugg

SEQ ID NO: 120219 - RNA, 45 nt, Mus musculus
uuuuaagaaggaacgaaauauccacacuuuggucuucuuucuuuu

SEQ ID NO: 120220 - RNA, 45 nt, Mus musculus
cuuuugaauaugaagugccccuccuugucuuuuuugagaacuugg

SEQ ID NO: 120221 - RNA, 87 nt, Mus musculus
ggaaguuuuugucuauaauuuuguuaaagacauuuacuggcccuuuaaguugaaaaucuucauucucauuuauacauauuauccuua

SEQ ID NO: 120222 - RNA, 45 nt, Mus musculus
gcaucuaugguuccugauuucuuuccuagauuucuaucuccagag

SEQ ID NO: 120223 - RNA, 45 nt, Mus musculus
uuccauuuuuagauucuggauaauuuuguucaauucuuuccccuu

SEQ ID NO: 120224 - RNA, 42 nt, Mus musculus
gaggauggauccuaagucuacugggcuccuuggggggggggg

SEQ ID NO: 120225 - RNA, 46 nt, Mus musculus
guuaguuagucuugaacucacagagauccacuugucuuugccccua

SEQ ID NO: 120226 - RNA, 46 nt, Mus musculus
augguaauugugcuggaauuguuucuuagcuugcaagaggcuccaa

SEQ ID NO: 120227 - RNA, 46 nt, Mus musculus
accuauuggagcucagugacagcccaguaauguaguuuuagcaaag

SEQ ID NO: 120228 - RNA, 46 nt, Mus musculus
cugagguaauguucuauucuaaaggaauuacaugcccagaggggag

SEQ ID NO: 120229 - RNA, 25 nt, Mus musculus
gagcuuuggaggaaagaaaggggag

SEQ ID NO: 120230 - RNA, 49 nt, Mus musculus
guugaagguuuugaagaaacagaaaucaaaagggaagaagccuaaagga

SEQ ID NO: 120231 - RNA, 45 nt, Mus musculus
uuauuguaguuucaaaucaaauuaaaguuccauugcaugcaucaa

SEQ ID NO: 120232 - RNA, 35 nt, Mus musculus
uaugcaaauuauaugaguuaugccauguuucugaa

SEQ ID NO: 120233 - RNA, 46 nt, Mus musculus
uauccuucucuccuuucuuuacaaugaccaaguugagaacacugag

SEQ ID NO: 120234 - RNA, 45 nt, Mus musculus; identical to SEQ ID NO: 68454

SEQ ID NO: 120235 - RNA, 45 nt, Mus musculus
ggagcaaagaagaggggacaaaggcuugaaggaccagggagguaa

SEQ ID NO: 120236 - RNA, 45 nt, Mus musculus
uagccagacauaauacuguacuuaagaaaucauuugcuuguugaa

SEQ ID NO: 120237 - RNA, 46 nt, Mus musculus
caaauucuaacuuaagaaggacuacauaaaaagggccaucugccac

SEQ ID NO: 120238 - RNA, 48 nt, Mus musculus
cccucaguggaauucugacaagccaagcuuaaaugauauaaaggucau

SEQ ID NO: 120239 - RNA, 26 nt, Mus musculus
agcagaaggcugguggaagggaaacu

SEQ ID NO: 120240 - RNA, 43 nt, Mus musculus
cuuagcaucucccaugcucuagguugggaguacauggcagaac

SEQ ID NO: 120241 - RNA, 46 nt, Mus musculus
ggccaaguacagcaacuuugauguugcuacccgugugccccugaug

SEQ ID NO: 120242 - RNA, 46 nt, Mus musculus
auucauuuuaugugcacugguguuuugccugugugugugucuuugu

SEQ ID NO: 120243 - RNA, 42 nt, Mus musculus
cuauuguccugauaagaaaggagucagguagggaggauagug

SEQ ID NO: 120244 - RNA, 65 nt, Mus musculus
guccagaaagauguguucagagaacaggggagaccuaagaggaacacggagacaucaaucaggug

SEQ ID NO: 120245 - RNA, 46 nt, Mus musculus
agagaaauaguucuuggaucaaucuaacaagaggcuaacuagggag

SEQ ID NO: 120246 - RNA, 51 nt, Mus musculus
acuacugcaaaaaaauaaagcaagaagaaaacagggagggagagagaggaa

SEQ ID NO: 120247 - RNA, 46 nt, Mus musculus
cccauguuccugauagccuaccaccuguagccuacaaccccuggau

SEQ ID NO: 120248 - RNA, 46 nt, Mus musculus
acagaagaagccaucagguuguuggaaaagaugaagacaucagcua

SEQ ID NO: 120249 - RNA, 55 nt, Mus musculus
uauagcuggucuuuuccaccuuaucauccauccucagagaaauaugaaaacacua

SEQ ID NO: 120250 - RNA, 46 nt, Mus musculus
gaugauaagguggaaaagaccagcuauauggauaaucaucacugug

SEQ ID NO: 120251 - RNA, 46 nt, Mus musculus
ucuugccguucugauuuuauaggugaggaaacugaaccccaaagag

SEQ ID NO: 120252 - RNA, 46 nt, Mus musculus
uuauggcucaggagcuuucuucuagaaccuaccaggcaguccagau

SEQ ID NO: 120253 - RNA, 48 nt, Mus musculus
cuggaaugcuggggcuguaguuuucuugaugccuaacgaagggaacau

SEQ ID NO: 120254 - RNA, 51 nt, Mus musculus
guaugggcuucagcguggugaaaggcacugcuuucucugugaggaauguua

SEQ ID NO: 120255 - RNA, 46 nt, Mus musculus
ucuggucugggccuugcaggaugccugucuguaaaguuugggggug

SEQ ID NO: 120256 - RNA, 51 nt, Mus musculus
aaagaauagaaagaaacagauuuccuuuuagaaguuggagguaaugucguc

SEQ ID NO: 120257 - RNA, 48 nt, Mus musculus
aaagucuuucacccugguacuguucaauuacuaaaaccugggccuuuu

SEQ ID NO: 120258 - RNA, 52 nt, Mus musculus
auucuggaaauuuuuccaccaucccccaauacuucaaggagaauggcuacgu

SEQ ID NO: 120259 - RNA, 55 nt, Mus musculus
cagaaugccuuugcucagguauguccaaggaccuuuagguauggauauaugccuc

SEQ ID NO: 120260 - RNA, 43 nt, Mus musculus
ggaaggaugguaaaauaaaaggguggauagaagacaguagcag

SEQ ID NO: 120261 - RNA, 44 nt, Mus musculus
ucaaaauuaauuuuuaaaaagagaagaaaaaacaugaagggaug

SEQ ID NO: 120262 - RNA, 43 nt, Mus musculus
ccugcccucccgcaaauuguggcuguaaauguuccuccugaag

SEQ ID NO: 120263 - RNA, 45 nt, Mus musculus
ccaccagcagcaacaccgagacugcuuuugccucuguccggccag

SEQ ID NO: 120264 - RNA, 45 nt, Mus musculus
gccugugugagaacuuacucgaaguucacagucuaggaguggagg

SEQ ID NO: 120265 - RNA, 46 nt, Mus musculus
agguucagaaguucaguccauuaucaucaaggagggagcauggcag

SEQ ID NO: 120266 - RNA, 42 nt, Mus musculus
gauguuggauggcaauuuccagugcacuagaauggggcccag

SEQ ID NO: 120267 - RNA, 46 nt, Mus musculus
gcauauucucuguuaaaguauuuuuuuacaagcuugugcuggagau

SEQ ID NO: 120268 - RNA, 60 nt, Mus musculus
acccagagcccuggcaaguauguccuuccuccacccaaacuaaauauugaaaugccagac

SEQ ID NO: 120269 - RNA, 46 nt, Mus musculus
uuugagagaguauggaaacauuucauaugaucuccaccaugaagau

SEQ ID NO: 120270 - RNA, 42 nt, Mus musculus
auccagcuucuacucuaaaaggauguuggacuacccgguuuu

SEQ ID NO: 120271 - RNA, 42 nt, Mus musculus
acaugaguaugugaggggcagugaggacaugagugagcaggu

SEQ ID NO: 120272 - RNA, 91 nt, Mus musculus
ucugaguaaaggauaugagagcauaugugagcaacugaaugagagggaggagggcgucuacaagggaaugccagaauagggcugugggagg

SEQ ID NO: 120273 - RNA, 23 nt, Mus musculus
caugugugcaauuccccucauca

SEQ ID NO: 120274 - RNA, 45 nt, Mus musculus
uaaacuaagaaccagauguuaaaaaccaagguagagcuuugggag

SEQ ID NO: 120275 - RNA, 46 nt, Mus musculus
aauggagcuacugggcugucuuugcuccaauaugguuguggaaguu

SEQ ID NO: 120276 - RNA, 46 nt, Mus musculus
aggcuaaacccauagcuuuuauugucaaaauuuauauccaugagau

SEQ ID NO: 120277 - RNA, 45 nt, Mus musculus
cauuuaauaggacagcuccuucucuccuugauucaggucccauuu

SEQ ID NO: 120278 - RNA, 41 nt, Mus musculus
cugccuuuggcagcaugaacccgcugugaggcgcaggcuuc

SEQ ID NO: 120279 - RNA, 45 nt, Mus musculus
gauucuucuacauuuagugcuucuaacaguuuuguacucaguaag

SEQ ID NO: 120280 - RNA, 42 nt, Mus musculus
auaguggaucaauagaaaagucugaauguaguuuugggagag

SEQ ID NO: 120281 - RNA, 52 nt, Mus musculus
ggugcccacagaggccagaagagggcaucagauacccugaaacuggaguuac

SEQ ID NO: 120282 - RNA, 46 nt, Mus musculus
uugagucaggaggaucaugaauuuaaguuuagacagugaugcacag

SEQ ID NO: 120283 - RNA, 43 nt, Mus musculus
uagaaaaagaaguuauuuacauauguccuuucaauggccccau

SEQ ID NO: 120284 - RNA, 46 nt, Mus musculus
uaauguguggcugagaugugagaagcaacagauaagccaaugucua

SEQ ID NO: 120285 - RNA, 45 nt, Mus musculus
cuugggagggagggauggauggauggauggauggauggaugauug

SEQ ID NO: 120286 - RNA, 45 nt, Mus musculus
uaucuuggagguccagauuaauugagacugcuggucuuccuacag

SEQ ID NO: 120287 - RNA, 51 nt, Mus musculus
guuguaaagugaauacauaaauugaaugaaugaaugaaugaaugagaaagg

SEQ ID NO: 120288 - RNA, 46 nt, Mus musculus
acacauggcagguuagccauaagccccaagagguuaaagaugccag

SEQ ID NO: 120289 - RNA, 46 nt, Mus musculus
aucuaugggacuuuguaaagguucccucaccuccaacagcugcagg

SEQ ID NO: 120290 - RNA, 42 nt, Mus musculus
ucucaucacaugacacaacugagucuuccaaaaagccaaaaa

SEQ ID NO: 120291 - RNA, 45 nt, Mus musculus
agugaccuagaggaguuuuuggcagaguuggaaagauguugagag

SEQ ID NO: 120292 - RNA, 45 nt, Mus musculus
guucugcuugaucuaguugaaaaaacaaggcuuguggagccauag

SEQ ID NO: 120293 - RNA, 46 nt, Mus musculus
aaaaugggaggcgcgacaaguagaggagaaaauuccuauggucuag

SEQ ID NO: 120294 - RNA, 45 nt, Mus musculus
uauuuuacauaugauugcucaauuccagaagugcaucccugcuag

SEQ ID NO: 120295 - RNA, 115 nt, Mus musculus
ugccuaggcuaaccugaaacucaugauccuguuaccucgaccuccugaaugacaaaugcauguugccaggccuuguggacauccucauaccccuagcucucaacaaacauagagg

SEQ ID NO: 120296 - RNA, 65 nt, Mus musculus
accauuguugaaaaauguauaaaugguuuugaaacagcucaggcuggccuaaaacucacuaugua

SEQ ID NO: 120297 - RNA, 46 nt, Mus musculus
uuccaaaugagcuacaucccaaaauggcuacagacggaacagacgg

SEQ ID NO: 120298 - RNA, 46 nt, Mus musculus
uuuuguuuguuuuuguuugguuuuuuuuuuucuuuacugucucugg

SEQ ID NO: 120299 - RNA, 45 nt, Mus musculus
uuaagugugugugugugugugugugugugugugugugugaagcuc

SEQ ID NO: 120300 - RNA, 46 nt, Mus musculus
cuccugaaaagaugaaguuuguuuuuaguaggccaggaaaauggag

SEQ ID NO: 120301 - RNA, 46 nt, Mus musculus
ucaagguguuugagauggaucugggaccagcucugaaaucuaagag

SEQ ID NO: 120302 - RNA, 45 nt, Mus musculus
guugacgguugaaagagagagugguuuguaaaagaaagaaaaagg

SEQ ID NO: 120303 - RNA, 42 nt, Mus musculus
gacagagaucauugaacucauggccuaugcuagcaguagcac

SEQ ID NO: 120304 - RNA, 46 nt, Mus musculus
gacaggcauuggucacuaccuuugguuuucauaguaucuguggccu

SEQ ID NO: 120305 - RNA, 45 nt, Mus musculus
gauuauuauaguucaaagucucuggauuuuuuuuacaaaagggca

SEQ ID NO: 120306 - RNA, 46 nt, Mus musculus
aaguggaugcugacaguaaucaauuggauggaacaaagggccccua

SEQ ID NO: 120307 - RNA, 45 nt, Mus musculus
accaguacccccagagcugugucuuuaguugcauauguagcagag

SEQ ID NO: 120308 - RNA, 49 nt, Mus musculus
gcuaagggaaaagaaucaauaugauuaaaacucauuguauagaauucuc

SEQ ID NO: 120309 - RNA, 66 nt, Mus musculus
aaaaugaggugacuauauauccuaauaugguagaucaguaguuuuuacaaaggucaucaguucaga

SEQ ID NO: 120310 - RNA, 46 nt, Mus musculus
ggacacugucauucaguguaguaacagaaggaacuagauaaggaga

SEQ ID NO: 120311 - RNA, 32 nt, Mus musculus
ucugugagacauacccugcucuuuuggugguu

SEQ ID NO: 120312 - RNA, 45 nt, Mus musculus
uauagggcaaaagaugcugucaauaagacaaaaaggccaccaaca

SEQ ID NO: 120313 - RNA, 41 nt, Mus musculus
uguuuuauucaggaacaaaucacaauuuugaaaguguagua

SEQ ID NO: 120314 - RNA, 46 nt, Mus musculus
uuuuucuuuuagagaaauaggggaaauagaaagggagaagaaagag

SEQ ID NO: 120315 - RNA, 46 nt, Mus musculus
uucuuaaaauauacaaggcccuguuuauaauuccacacacugccaa

SEQ ID NO: 120316 - RNA, 41 nt, Mus musculus
gccccaguacaggggaaugccagggccaagaagcaggugug

SEQ ID NO: 120317 - RNA, 42 nt, Mus musculus
aauaaagaaaauaucuaauaaagaaaaagaaaagggccacua

SEQ ID NO: 120318 - RNA, 87 nt, Mus musculus
aagucagccaccaacucuggcucuuacagacuaucucucuaggagauguagaaguauuaugcaguuauacacuguuaagggaaugga

SEQ ID NO: 120319 - RNA, 48 nt, Mus musculus
uuucauuucuuaguuauguauauauauauuuuuuaaacaaugaaggga

SEQ ID NO: 120320 - RNA, 46 nt, Mus musculus
aaggcacgaguaucacaaguuucaggccagauaaguuacagccaga

SEQ ID NO: 120321 - RNA, 45 nt, Mus musculus
uggauugggaauguguggcagaaaaaaaaaaucaagucuguccau

SEQ ID NO: 120322 - RNA, 46 nt, Mus musculus
aagccaagagagagaaucuggagucaccuuaaauacacaugggugg

SEQ ID NO: 120323 - RNA, 45 nt, Mus musculus
aguaugggcacagaaaaguaagauacaccacauuauagcccucga

SEQ ID NO: 120324 - RNA, 46 nt, Mus musculus
uguaauacauaucacaagaaaucgaugguguccguguggcaaucau

SEQ ID NO: 120325 - RNA, 42 nt, Mus musculus
uaaaauuaauccaaaugugaaagauggguauuacugccaaag

SEQ ID NO: 120326 - RNA, 46 nt, Mus musculus
agcuucagaauauuaaacucugccugucacuucucuagcccuaugu

SEQ ID NO: 120327 - RNA, 42 nt, Mus musculus
gagguugugaaaacaccagguaaaagggauagaggaggagga

SEQ ID NO: 120328 - RNA, 44 nt, Mus musculus
ugcucacgggggccaccagucucuaagggagguacuuugggagu

SEQ ID NO: 120329 - RNA, 45 nt, Mus musculus
aaagagaaagccccaugauacaaugauaguacagaugacugugag

SEQ ID NO: 120330 - RNA, 45 nt, Mus musculus
cucaugugucucacaacccuauuagucuuaaaacaugagcuucug

SEQ ID NO: 120331 - RNA, 41 nt, Mus musculus
ucucucacucucucucucucugugugugugugugugcgcgc

SEQ ID NO: 120332 - RNA, 64 nt, Mus musculus
accauugagcgggagugcauggaagagaucugcaguuaugaagaggucaaggaaguauuugaga

SEQ ID NO: 120333 - RNA, 45 nt, Mus musculus
cccgugucaugguguacagagguacugugcacagccagggagagu

SEQ ID NO: 120334 - RNA, 45 nt, Mus musculus
gggaagagggaagacacaaggaaugaaagcaggaaggaacagagg

SEQ ID NO: 120335 - RNA, 45 nt, Mus musculus
ugagguuuuucuguugagcucccugacagcuagaggcuagggaug

SEQ ID NO: 120336 - RNA, 45 nt, Mus musculus
cuguguguguaugugugugggagagagacagagacagagacagag

SEQ ID NO: 120337 - RNA, 45 nt, Mus musculus
cacacacacagagacagagacagacagaggcauagaaugugugug

SEQ ID NO: 120338 - RNA, 41 nt, Mus musculus
aaugugugugucucugugugcuugugugcaugugugugugu

SEQ ID NO: 120339 - RNA, 46 nt, Mus musculus
aaaaaaaauccaauauugccacuagauugucuuuuaauucaagugg

SEQ ID NO: 120340 - RNA, 46 nt, Mus musculus
uagcuaauuauacugauuaguauuaggagauuucaguggggaagau

SEQ ID NO: 120341 - RNA, 46 nt, Mus musculus
uaguuuuuuugcuuucagaacuuguggauuuuuacagcuaguagaa

SEQ ID NO: 120342 - RNA, 46 nt, Mus musculus
ucucauucuuuaaaggaugaguauuuuuuagcuuuaacugugaguu

SEQ ID NO: 120343 - RNA, 45 nt, Mus musculus
ggcuucuuaguuguccauguauccaugucaccauaagcagugguu

SEQ ID NO: 120344 - RNA, 46 nt, Mus musculus
aaguucuuuguacauuuaccugcugacuaaaucaacagggcagaac

SEQ ID NO: 120345 - RNA, 45 nt, Mus musculus
auuaagaaaaugauaagugaaauugauaaagaaggaacaggaaaa

SEQ ID NO: 120346 - RNA, 53 nt, Mus musculus
ggaucauggaugcaacccaagauggaaagauuaggaaggcucccuggaggagg

SEQ ID NO: 120347 - RNA, 46 nt, Mus musculus
ggguaauuguagaagcaaggguggagugaaggggacuuugggcuug

SEQ ID NO: 120348 - RNA, 46 nt, Mus musculus
augcuugcuuuuuuuccauauuacauuuucccucugcaacccaagu

SEQ ID NO: 120349 - RNA, 65 nt, Mus musculus
cuuuuuuuccacguaguauaccuccuuccugcugccuuguuggcuugccggcgggagccccaggg

SEQ ID NO: 120350 - RNA, 44 nt, Mus musculus
cuggcagagccagcgcugucuaaggucucuaaaucacuugcaua

SEQ ID NO: 120351 - RNA, 42 nt, Mus musculus
ugggccaagugcauuccuugagaagggauuggacuaguagag

SEQ ID NO: 120352 - RNA, 46 nt, Mus musculus
gagagauagguggagcagagugggcaccuggucacaguauuaggag

SEQ ID NO: 120353 - RNA, 41 nt, Mus musculus
uauacaguggugcccgauacuggaccuacugaaggcaggua

SEQ ID NO: 120354 - RNA, 36 nt, Mus musculus
gcaucagguggcucaucuggaaaaagggcauguaac

SEQ ID NO: 120355 - RNA, 46 nt, Mus musculus
cuggaacuuggauuggcucugaucacaauaauuuagagaggcaaag

SEQ ID NO: 120356 - RNA, 46 nt, Mus musculus
cccauuuaaauuaaaaaaauuauauguauaaguguuuugccugcac

SEQ ID NO: 120357 - RNA, 47 nt, Mus musculus
cgaccuauagugacaggugauauuagugccucauucucaacacacac

SEQ ID NO: 120358 - RNA, 57 nt, Mus musculus
acuugggggaacacacacacacugaggagugugucagcauagaucuagucagacugc

SEQ ID NO: 120359 - RNA, 44 nt, Mus musculus
ugcacccgugacugcagcagauuucuguugcgcaggcagauuug

SEQ ID NO: 120360 - RNA, 46 nt, Mus musculus
gcuccauagccucaguaaucaaaugcuaccuuuauaaaaccuucaa

SEQ ID NO: 120361 - RNA, 45 nt, Mus musculus
caugagugacacggacuguggggaagagagaaauggaaugaaaaa

SEQ ID NO: 120362 - RNA, 45 nt, Mus musculus
cucagcacuccagauucuugugaggagaacaaugcagcccccaag

SEQ ID NO: 120363 - RNA, 42 nt, Mus musculus
cagcucaucaauaccacagauucuuaaaauauaccaggccuc

SEQ ID NO: 120364 - RNA, 46 nt, Mus musculus
uuggccauugauugaucuguacugaggccagacuguuucuugaaag

SEQ ID NO: 120365 - RNA, 46 nt, Mus musculus
ggagguauagcaaacuacaggagccagagagacacuuaccaaguag

SEQ ID NO: 120366 - RNA, 46 nt, Mus musculus
ugaggcuggacuaccuggggcuagcugcuuuggaacugucuuggau

SEQ ID NO: 120367 - RNA, 45 nt, Mus musculus
uggaguauauauauacauauauauauauauacauacauggcagaa

SEQ ID NO: 120368 - RNA, 79 nt, Mus musculus
gggguauagagauuagacagacauuuuuagcacaguaccaaguauagacuuagaagacaacuaaaggaaauuuaaaaua

SEQ ID NO: 120369 - RNA, 62 nt, Mus musculus
aagccgcugagcuuuugaagucuuaauauaacaauagcauagagggaaagaaaucugaaacc

SEQ ID NO: 120370 - RNA, 46 nt, Mus musculus
uuauguaacuucucaaagaaaagcuugcuauccagugaaacgucaa

SEQ ID NO: 120371 - RNA, 46 nt, Mus musculus
auuaauguacacaaauuauaauaaauguuaagauguuacacagcag

SEQ ID NO: 120372 - RNA, 42 nt, Mus musculus
auaauuuuacuuucuaggguuggugggguguugcaugcuaug

SEQ ID NO: 120373 - RNA, 50 nt, Mus musculus
ccgcaggauccagccugucuucaggaucaucuacacagcucuaggggagc

SEQ ID NO: 120374 - RNA, 68 nt, Mus musculus
ugggcagaggacaccagugccugggaacaagcacggcuaggcagggagacaguacccaggagaggagg

SEQ ID NO: 120375 - RNA, 42 nt, Mus musculus
aggcacugguguccucugcccaagacaacccuguggcaggcu

SEQ ID NO: 120376 - RNA, 41 nt, Mus musculus
gguaauccagaccgcaguugggauacuagugggucacaaga

SEQ ID NO: 120377 - RNA, 45 nt, Mus musculus
aaucauggggcagcccagacaaaggaacaggggacaugaguguug

SEQ ID NO: 120378 - RNA, 46 nt, Mus musculus
ggaaauagaggcucaggacagccaggaauuccuuccuguggcaggc

SEQ ID NO: 120379 - RNA, 45 nt, Mus musculus
ccguuucacugaugucaucuccucuccuguggucugggugcugac

SEQ ID NO: 120380 - RNA, 47 nt, Mus musculus
ugguaguggaggagcaggagcagguacgaagggacagcagcgcaugu

SEQ ID NO: 120381 - RNA, 46 nt, Mus musculus
agggugcccaccuacuuuucuggaauuaaugaaacuuacucgagac

SEQ ID NO: 120382 - RNA, 50 nt, Mus musculus
ucgaguaaguuucauuaauuccagaaaaguaggugggcacccuugcugau

SEQ ID NO: 120383 - RNA, 46 nt, Mus musculus
gcaaaaagcagugcagcagagcccacugucagcacacagugcagau

SEQ ID NO: 120384 - RNA, 46 nt, Mus musculus
cacaucuuuggaaauaaagaggacucuaaggucuuacaguucaggu

SEQ ID NO: 120385 - RNA, 97 nt, Mus musculus
cugaaaguauuuucuggcagucccuuuccaggcccaggagaagaaagcuuugaaaccugguuagaggaggucacugagcugaugcaguuauggcagg

SEQ ID NO: 120386 - RNA, 79 nt, Mus musculus
ggccugggaagugguugucaaaccccguagcccagaugaugaguuuaugaauaaguugaucuacuuucuaagagaugaa

SEQ ID NO: 120387 - RNA, 45 nt, Mus musculus
auaaacucaucaucugggcuacgggguuugacaaccacuucccag

SEQ ID NO: 120388 - RNA, 47 nt, Mus musculus
cuccugaacauccugccuaucaccuuguaugcacacaagggagguaa

SEQ ID NO: 120389 - RNA, 46 nt, Mus musculus
cuuaccucccuugugugcauacaaggugauaggcaggauguucagg

SEQ ID NO: 120390 - RNA, 45 nt, Mus musculus
cugcacggggaugcccacaaugagcacagccuucuugggauccag

SEQ ID NO: 120391 - RNA, 88 nt, Mus musculus
uucagguuguggaaaccaggacaucacugccuuucuauauggcauugguuuagaaucuuugaguccuaguguuaggucugcugauaga

SEQ ID NO: 120392 - RNA, 61 nt, Mus musculus
cuuuuugguggaacuugcacgugauuuugacuaugcuuuggugcccagggaaauagaagga

SEQ ID NO: 120393 - RNA, 46 nt, Mus musculus
cucuaggugcagugaugcagccucugcuagaacaaauguuguaccg

SEQ ID NO: 120394 - RNA, 46 nt, Mus musculus
cccaggguuauuggccuucgauuccuggcuugaacacaccacugag

SEQ ID NO: 120395 - RNA, 58 nt, Mus musculus
gggcagaggacaccagugccugggaacaagcacggcuaggcagggagacaguacccag

SEQ ID NO: 120396 - RNA, 41 nt, Mus musculus
cagggugaggguauagggguaggagagcagcagaggguacu

SEQ ID NO: 120397 - RNA, 45 nt, Mus musculus
caggacuccuaucuaacacaagaagauucuagcuaugucaagcag

SEQ ID NO: 120398 - RNA, 80 nt, Mus musculus
cugcuggcaggcacucaaggauggauccaaaucucuccucagaugacagccagaacccaggugcagucgcagcagguaaa

SEQ ID NO: 120399 - RNA, 46 nt, Mus musculus
gguagggaggacauuauuuccucaggaacagagaggcaacaggcca

SEQ ID NO: 120400 - RNA, 46 nt, Mus musculus
uucuuucuuucuuucuuucuuucuuucuuuccuuuugcccacucau

SEQ ID NO: 120401 - RNA, 45 nt, Mus musculus
cacagagaaacccugucucaacccccccccccaaaauuuuaggau

SEQ ID NO: 120402 - RNA, 47 nt, Mus musculus
cagugccauggaggucaaaauuaaggauguucugaaaacccacugug

SEQ ID NO: 120403 - RNA, 45 nt, Mus musculus
ucccugucagaauauuuuagaucuccuuucccagucuugcauuua

SEQ ID NO: 120404 - RNA, 92 nt, Mus musculus
ggcagaaacuuugucaggacuauucucuucaguuuacaaauuugaauaggaaguuaacuucggaugcauacaaacucaagaaacaugccgaa

SEQ ID NO: 120405 - RNA, 108 nt, Mus musculus
uugguuuuuuaucccccuucugugggaagaugacaaggguaaugauggguuaggagucugcaugguacaggccuggggggaugagcagguacugucugcagagugcag

SEQ ID NO: 120406 - RNA, 46 nt, Mus musculus
gggauuguauccugaggggggacccuucaggaucgacacagugcag

SEQ ID NO: 120407 - RNA, 45 nt, Mus musculus
acucagaaaaauaauuuacaucugugccuuaguuucuugggagug

SEQ ID NO: 120408 - RNA, 41 nt, Mus musculus
gcuaggcuggcuggcugcucagcaguuccuuugcugccaca

SEQ ID NO: 120409 - RNA, 46 nt, Mus musculus
gcuuauggagcaagcuccuccacuacugcugcauucuuacccccca

SEQ ID NO: 120410 - RNA, 46 nt, Mus musculus
uguuaagaucucuguguuguuccaguuucuguggucacugaacaag

SEQ ID NO: 120411 - RNA, 46 nt, Mus musculus
ggugcacaguggucauaguacgggacaagcuauuccaucuugcuaa

SEQ ID NO: 120412 - RNA, 25 nt, Mus musculus
auucucggggaaauuccaucgcuga

SEQ ID NO: 120413 - RNA, 46 nt, Mus musculus
cuguuaaauccaaauaaacccugggauuugugugacagcagugcaa

SEQ ID NO: 120414 - RNA, 42 nt, Mus musculus
ucaucuccccaaauuggaaggcacacaagugggcuauuguug

SEQ ID NO: 120415 - RNA, 46 nt, Mus musculus
cugggagguaaaggguucugaggagauuguggugaggcagugucag

SEQ ID NO: 120416 - RNA, 41 nt, Mus musculus
ccugagcagugaggagcagaggcgacuaggguuugggggug

SEQ ID NO: 120417 - RNA, 46 nt, Mus musculus
guaaaacaccacagggugagguugggggugagggaguaggccccaa

SEQ ID NO: 120418 - RNA, 42 nt, Mus musculus
cugaacaauaaauauuuauaaggauuuucaauacagggccca

SEQ ID NO: 120419 - RNA, 46 nt, Mus musculus
ccaaaacauugaguggaauguugaccacuucuugaaaguccagcau

SEQ ID NO: 120420 - RNA, 46 nt, Mus musculus
cccuuuuguaaauuacaaauaugcaaaaguaugcucugccuuaaag

SEQ ID NO: 120421 - RNA, 41 nt, Mus musculus
gagcucugggacauaaggagggugguugauguggaggggag

SEQ ID NO: 120422 - RNA, 46 nt, Mus musculus
gggauuguauccugagaggggacccuucaggaucgacacagugcag

SEQ ID NO: 120423 - RNA, 46 nt, Mus musculus
ugauggauggaccugcgauggugacugagucaccuuuagccuggag

SEQ ID NO: 120424 - RNA, 46 nt, Mus musculus
acucagaaaaauaauuuacaucugugccuuaguuucuuggaaguag

SEQ ID NO: 120425 - RNA, 46 nt, Mus musculus
cgccgaaaagcuauuauugaggaagccagaaagcuaauggacuacu

SEQ ID NO: 120426 - RNA, 42 nt, Mus musculus
aacuuuacugagaauguuuuguuuguggaauuuaucgcacau

SEQ ID NO: 120427 - RNA, 42 nt, Mus musculus
aucuccccaaauuggaaggcacacaagugggcuauuguuguc

SEQ ID NO: 120428 - RNA, 46 nt, Mus musculus
guuaaauccaaauaaacccugggauuugugugacagcagugcaaau

SEQ ID NO: 120429 - RNA, 25 nt, Mus musculus
ucucggggaaauuccaucgcugaag

SEQ ID NO: 120430 - RNA, 46 nt, Mus musculus
ugcacaguggucauaguacgggacaagcuauuccaucuugcuaaga

SEQ ID NO: 120431 - RNA, 46 nt, Mus musculus
uuaagaucucuguguuguuccaguuucuguggucacugaacaagau

SEQ ID NO: 120432 - RNA, 46 nt, Mus musculus
uuauggagcaagcuccuccacuacuacugcauucuuaccccccaag

SEQ ID NO: 120433 - RNA, 41 nt, Mus musculus
uaggcuggcuggcugcucagcaguuccuuugcugccacagg

SEQ ID NO: 120434 - RNA, 45 nt, Mus musculus
ucagaaaaauaauuuacaucugugccuuaguuucuugggagugga

SEQ ID NO: 120435 - RNA, 42 nt, Mus musculus
uggggggaugagcagguucugucugcagagugcaggagaagg

SEQ ID NO: 120436 - RNA, 50 nt, Mus musculus
gguuuuuuaucccccuucugugggaagaugacaaggguaaugauggguua

SEQ ID NO: 120437 - RNA, 92 nt, Mus musculus
cagaaacuuugucaggacuauucucuucaguuuacaaauuugaauaggaaguuaacuucggaugcauacaaacucaagaaacaugccgaaac

SEQ ID NO: 120438 - RNA, 45 nt, Mus musculus
ccugucagaauauuuuagaucuccuuucccagucuugcauuuagu

SEQ ID NO: 120439 - RNA, 47 nt, Mus musculus
gugccauggaggucaaaauuaaggauguucugaaaacccacugugaa

SEQ ID NO: 120440 - RNA, 41 nt, Mus musculus
uccaggacagccagggcuacacagagaaacccuggcccaaa

SEQ ID NO: 120441 - RNA, 46 nt, Mus musculus
uagggaggacauuauuuccucaggaacagagaggcaacaggccagg

SEQ ID NO: 120442 - RNA, 80 nt, Mus musculus
gcuggcaggcacucaaggauggauccaaaucucuccucagaugacagccagaacccaggugcagucgcagcagguaaaaa

SEQ ID NO: 120443 - RNA, 45 nt, Mus musculus
ggacuccuaucuaacacaagaagauucuagcuaugucaagcagaa

SEQ ID NO: 120444 - RNA, 42 nt, Mus musculus
gugucugggagcuccaagucccgauacagaaauggggcaggu

SEQ ID NO: 120445 - RNA, 45 nt, Mus musculus
accagugagaccaguggaugaaaaggguuccaggaggguugcagg

SEQ ID NO: 120446 - RNA, 46 nt, Mus musculus
cuuagucaucagggaaggauuuuucugaguagauauggcccuuuug

SEQ ID NO: 120447 - RNA, 51 nt, Mus musculus
ccugcauggauuuccacuugccuggugcuugcaguuugaagggaaggagga

SEQ ID NO: 120448 - RNA, 45 nt, Mus musculus
gaauugaugaaguaacacagaaguacaagauccuuacugacagau

SEQ ID NO: 120449 - RNA, 41 nt, Mus musculus
caccccaauuccaggguagggcaggguacagagaaccagua

SEQ ID NO: 120450 - RNA, 42 nt, Mus musculus
cugcccagucagagggagaaaagguggcagaucuggccaggc

SEQ ID NO: 120451 - RNA, 46 nt, Mus musculus
uggaugcuccaguaguucuagguaaaggugucagugucacaggcag

SEQ ID NO: 120452 - RNA, 31 nt, Mus musculus
agucugaggaugcuauugcugaguucaagag

SEQ ID NO: 120453 - RNA, 45 nt, Mus musculus
augauaucuagaguuagaaggaaaaauagcacaggaugacaagga

SEQ ID NO: 120454 - RNA, 46 nt, Mus musculus
auauacuagauggccauguaaaaaugugcuagauacugcagaagau

SEQ ID NO: 120455 - RNA, 59 nt, Mus musculus
gauugaagcaggcuggcuuggaggcguauuggcaucugaagaguauucccagggcccca

SEQ ID NO: 120456 - RNA, 46 nt, Mus musculus
ugaauagguuaaaaggugugcucuacuugauuuguugagaggagau

SEQ ID NO: 120457 - RNA, 48 nt, Mus musculus
gauacagaggguuggaauaaaggugauuuuauugacagaagauggcaa

SEQ ID NO: 120458 - RNA, 45 nt, Mus musculus
guagaaccuuaaccuggugugaauguuacauaaagaugagcaaaa

SEQ ID NO: 120459 - RNA, 45 nt, Mus musculus
ggggcgugaaccaguuguaguucagagcgcgaaacauggcggagg

SEQ ID NO: 120460 - RNA, 44 nt, Mus musculus
ccgucagggccaaccgggagcagcugcucgcuccugggcaguuc

SEQ ID NO: 120461 - RNA, 45 nt, Mus musculus
caagaccccaagaaaggcugagcugggagagcaaggcuagcagga

SEQ ID NO: 120462 - RNA, 46 nt, Mus musculus
caucauucaucaugagcagcccaucauccaaggugaagucccagaa

SEQ ID NO: 120463 - RNA, 46 nt, Mus musculus
agguguccccgaccuggacucugucacaccuaccuucagugccaug

SEQ ID NO: 120464 - RNA, 46 nt, Mus musculus
ccgaaaggacacauggcacugaagguaggugugacagaguccaggu

SEQ ID NO: 120465 - RNA, 92 nt, Mus musculus
gugcccaaggagaucucaccugacaccacacugcuagaccugcagaacaaugacauuucugagcuucgcaaggaugacuucaaaggccucca

SEQ ID NO: 120466 - RNA, 46 nt, Mus musculus
caauaagaucuccaagauccaugagaaggccuuuagcccucugcgg

SEQ ID NO: 120467 - RNA, 67 nt, Mus musculus
auggauucguaguucuaccagggagcugggcagguugggaggaaucuccaccaggugguucuuggag

SEQ ID NO: 120468 - RNA, 87 nt, Mus musculus
aucuccaagaaccaccugguggagauuccucccaaccugcccagcucccugguagaacuacgaauccaugacaaccguauccgcaaa

SEQ ID NO: 120469 - RNA, 54 nt, Mus musculus
ugaaccaggagccuuugauggccugaagcucaauuaccugcgcaucucagaggc

SEQ ID NO: 120470 - RNA, 78 nt, Mus musculus
guagaucucccugagacccugaacgaacuucaccuggaccacaacaaaauccaggcuauugaguuggaggaccuacuu

SEQ ID NO: 120471 - RNA, 54 nt, Mus musculus
aauagccuggauuuuguugugguccaggugaaguucguucagggucucagggag

SEQ ID NO: 120472 - RNA, 51 nt, Mus musculus
cuuaggucacaaucagauucggaugauugagaaugggagccugaguuuucu

SEQ ID NO: 120473 - RNA, 42 nt, Mus musculus
ucaccuggaggagcuugagaucugggaggccagcaggcaccc

SEQ ID NO: 120474 - RNA, 35 nt, Mus musculus
gugauguuguuggagugcagauagacaaccugggg

SEQ ID NO: 120475 - RNA, 54 nt, Mus musculus
gcuucggagucaagagggccuacuauaauggcaucagccucuucaacaacccug

SEQ ID NO: 120476 - RNA, 66 nt, Mus musculus
caaccacugccucuacuucuuauaauuuccaaauuggauggccaggcggucaguaacgcagcggaa

SEQ ID NO: 120477 - RNA, 139 nt, Mus musculus
ccaccaugguggccuuggugagagucucugaggaacauagccagaugaagaagcaacaccuuuguuccccaauauuaacucacugccccaccacagcuucccccugacuccuaagcaugcauauaugcacauggccugg

SEQ ID NO: 120478 - RNA, 71 nt, Mus musculus
aaauuucaaagguugaggggaaugggugagagggccaggccaugugcauauaugcaugcuuaggagucagg

SEQ ID NO: 120479 - RNA, 63 nt, Mus musculus
uucuugcucauccugaaacucagauguuuuuggcaagaggggcuaggaaagauggauagagca

SEQ ID NO: 120480 - RNA, 138 nt, Mus musculus
uacagccagguuguagcugggauugacagguagugaacuuguugaagagagaacaccagaggauaagggcagcaagcagagcccaggagagcuggaagucagacaugagcaaggaagaggaggaacacaugccuggau

SEQ ID NO: 120481 - RNA, 71 nt, Mus musculus
acaaguucacuaccugucaaucccagcuacaaccuggcuguacuaacuccuggaucuuucccucucuccaa

SEQ ID NO: 120482 - RNA, 83 nt, Mus musculus
auggagaaauaugaccuagguccagagauggaaggggacaggucaauaacuccagaaggaagaaaagugucaggaagcauaac

SEQ ID NO: 120483 - RNA, 47 nt, Mus musculus
ucauauuucuccaucuuugucucuuucuguaucuccuugccuauauc

SEQ ID NO: 120484 - RNA, 97 nt, Mus musculus
gagagacagauacaaagauagagagauacacagagacagagagacagaaauagagacagacagagauauaggcaaggagauacagaaagagacaaag

SEQ ID NO: 120485 - RNA, 89 nt, Mus musculus
ucuaucuuuguaucugucucucucugacaacacacacacacacacacacacacacacacacacacacacacacacacacggaucaucug

SEQ ID NO: 120486 - RNA, 46 nt, Mus musculus
ccuggggcagaugauccgugugugugugugugugugugugugugug

SEQ ID NO: 120487 - RNA, 66 nt, Mus musculus
uaucuuccugauugcccuacccagaacuugaccccccaacccuggaggaagcuggaagguggaggc

SEQ ID NO: 120488 - RNA, 45 nt, Mus musculus
uccuagccccuggagaggcucagcaggccaucagagccgccagaa

SEQ ID NO: 120489 - RNA, 42 nt, Mus musculus
caccuccuaccacaucagggacccaggggugagggaggggac

SEQ ID NO: 120490 - RNA, 46 nt, Mus musculus
cugcuuaugaggucaguugucucucaauuaaagaaacacugugcaa

SEQ ID NO: 120491 - RNA, 46 nt, Mus musculus
uuugaguccagcuuaagagcaauugaggcaauggaaggaccaagaa

SEQ ID NO: 120492 - RNA, 42 nt, Mus musculus
gcagaugcgcgccgacucauacagcucccggcugcggcaguc

SEQ ID NO: 120493 - RNA, 46 nt, Mus musculus
cucagaaucuaggccacagcucaaggugucacggucagccucagac

SEQ ID NO: 120494 - RNA, 42 nt, Mus musculus
gagguuaggaagguugggggugacauugaggauauagcggau

SEQ ID NO: 120495 - RNA, 46 nt, Mus musculus
gacucuggucccccacugccccgccccccggagcgcuuccccccca

SEQ ID NO: 120496 - RNA, 44 nt, Mus musculus
gcaucccaucccugcuuauacuaggggucauaaguagggaccag

SEQ ID NO: 120497 - RNA, 45 nt, Mus musculus
caggucugcucccacaggugggcauucggggacagguauggagcc

SEQ ID NO: 120498 - RNA, 45 nt, Mus musculus
cucuggguucacacccuacaguuccaagaagucuaagcccuagug

SEQ ID NO: 120499 - RNA, 45 nt, Mus musculus
aucccaagccuggcucaagcacccaguguuccaagccugggccag

SEQ ID NO: 120500 - RNA, 42 nt, Mus musculus
ggccaucucuugugccacacuucuuuuuggcaggcagcagaa

SEQ ID NO: 120501 - RNA, 45 nt, Mus musculus
ggcucagaacucagugagccaagggcuccccaugguauagggaac

SEQ ID NO: 120502 - RNA, 42 nt, Mus musculus
cagagauaguggaagaacauggcaaaucuuagccagagacag

SEQ ID NO: 120503 - RNA, 45 nt, Mus musculus
uagggaacuugcugucaggaacucaucagggaucaaugccaacuc

SEQ ID NO: 120504 - RNA, 43 nt, Mus musculus
gguuggccaggcuggcauuggcacagucuucauggcggaagau

SEQ ID NO: 120505 - RNA, 46 nt, Mus musculus
ccagcaggcacaaggucaccucccaguugagggcuccuggaaccuc

SEQ ID NO: 120506 - RNA, 46 nt, Mus musculus
ugcuggucuacuucuguguguggaagggggucaagucaacaggaaa

SEQ ID NO: 120507 - RNA, 46 nt, Mus musculus
acgugaccuguggggacucucaacucugugauccucaggcccccaa

SEQ ID NO: 120508 - RNA, 42 nt, Mus musculus
gcuugagauaguagaugauaccauccagggcuccaggcagca

SEQ ID NO: 120509 - RNA, 29 nt, Mus musculus
agcucaccugauucugccaccuuggagau

SEQ ID NO: 120510 - RNA, 45 nt, Mus musculus
gacaggggguccccagcuccagagaauuguuugucucagcugcag

SEQ ID NO: 120511 - RNA, 45 nt, Mus musculus
accauccugaauauccuaaugcucaaguccucccugucccccaga

SEQ ID NO: 120512 - RNA, 103 nt, Mus musculus
uacccccacucacaucagucaccauggagagaucgaugacaaagcagagggcgcagcagagagcaacggagaucucccuuuggaaacggaaguaguaggaggc

SEQ ID NO: 120513 - RNA, 24 nt, Mus musculus
gaggagacagcccaggagguggag

SEQ ID NO: 120514 - RNA, 43 nt, Mus musculus
caggggccugaccacccugacucccguguccgagagcagcaag

SEQ ID NO: 120515 - RNA, 72 nt, Mus musculus
ggagagugucauguaacaggcacccccagcucacaucaccagcucauccuuugguagccauagcagccccaa

SEQ ID NO: 120516 - RNA, 44 nt, Mus musculus
guuauuuuuguuagcacucauggugcucccuccccucccccagg

SEQ ID NO: 120517 - RNA, 49 nt, Mus musculus
gcuaacaaaaauaacuuuuuccauuuuuaauaaaacgccaaaaauauca

SEQ ID NO: 120518 - RNA, 45 nt, Mus musculus
cauugcuuccaggcccuaccuccucuccuucuuuccagugcccag

SEQ ID NO: 120519 - RNA, 44 nt, Mus musculus
gugggcuuggcaaggcuaggagauggguccugggcacuggaaag

SEQ ID NO: 120520 - RNA, 41 nt, Mus musculus
uggcagcuuggguaacaggagaggagggaaaauaagguagg

SEQ ID NO: 120521 - RNA, 46 nt, Mus musculus
ugaauuagacccuuccuaccccuauucuagaagcuagagagccagu

SEQ ID NO: 120522 - RNA, 42 nt, Mus musculus
acauacacacacacacacacacacacacacagaggggggugu

SEQ ID NO: 120523 - RNA, 46 nt, Mus musculus
guguguguguguguguguguauguguguguauguguaggucuguag

SEQ ID NO: 120524 - RNA, 26 nt, Mus musculus
cuuguauauuucuaaaaagcccccac

SEQ ID NO: 120525 - RNA, 42 nt, Mus musculus
agagagguggggcuggguaagggugcaagccuuuggggacau

SEQ ID NO: 120526 - RNA, 42 nt, Mus musculus
uguaagggguagggagagaaaaaagaacaguaauucagguag

SEQ ID NO: 120527 - RNA, 45 nt, Mus musculus
ggguucacuaggagauuggaagcaccaaauggugcugaggaaaga

SEQ ID NO: 120528 - RNA, 45 nt, Mus musculus
cgauaugagcaauguggucuguaggcaaagagaaaguuuggaguu

SEQ ID NO: 120529 - RNA, 47 nt, Mus musculus
ccucgucugcuccgcauguccaggguggcuugcucucuuuuccccuc

SEQ ID NO: 120530 - RNA, 42 nt, Mus musculus
ugucuggccuaucuugcugcucagguagcggccuggccggag

SEQ ID NO: 120531 - RNA, 46 nt, Mus musculus
ccacaaagcagcucaccugcuccuaaaguaccccagaagcccagua

SEQ ID NO: 120532 - RNA, 94 nt, Mus musculus
cagaugccgucauuucuacagagacuguauucaucguggagauuucacugaccugcaagaacaggguccaggugagacaguagggacucagcag

SEQ ID NO: 120533 - RNA, 45 nt, Mus musculus
agggugcaggagagaugagggcacagcgaggccagauccuagcaa

SEQ ID NO: 120534 - RNA, 45 nt, Mus musculus
gaguauuguucccccccgaaaaaguuccaauuucuuucuuuagau

SEQ ID NO: 120535 - RNA, 44 nt, Mus musculus
ugauaaaaaaaaaaaauggccuuguuauuucuuggagcuugaga

SEQ ID NO: 120536 - RNA, 45 nt, Mus musculus
agaagagaggaaaaugcgauucuugcuuuuauuaccccccccucc

SEQ ID NO: 120537 - RNA, 47 nt, Mus musculus
gaagugcuggguagguugccaagaaaagggagaaaugagcaagagac

SEQ ID NO: 120538 - RNA, 42 nt, Mus musculus
acagaggugcuggcugcaguaauuggcauagugaucuacuac

SEQ ID NO: 120539 - RNA, 45 nt, Mus musculus
cugugaucucacuuuccuucagucacuggcaagagaggugggccu

SEQ ID NO: 120540 - RNA, 46 nt, Mus musculus
ggagggccagaagggguccgauucaaguuggaauugccagcaccag

SEQ ID NO: 120541 - RNA, 46 nt, Mus musculus
gcagaaggacuagaaaguucacagcuugcuccucuccaggcccaug

SEQ ID NO: 120542 - RNA, 75 nt, Mus musculus
gcaggccuucuuccuuccuuaccugcuggacaggaggugacuuuagcuuccuagcacgaagguccccuucauucu

SEQ ID NO: 120543 - RNA, 57 nt, Mus musculus
ccaaugcccuuccaccuugcccuagacccugcgcacucaguaaaguaaaacaggcca

SEQ ID NO: 120544 - RNA, 42 nt, Mus musculus
agagcauaugugcucagagaauggagaaguagaagagggcag

SEQ ID NO: 120545 - RNA, 45 nt, Mus musculus
uacucauggcugaugggggggcugcccaggagaagggggggucag

SEQ ID NO: 120546 - RNA, 58 nt, Mus musculus
cauaacaaaccagcauagguuacaagaaaaccugucagacauagaaaaaagaaggaag

SEQ ID NO: 120547 - RNA, 58 nt, Mus musculus
agggagggaagaaaaaccaaacaagugagaaggcuaguuuucuuaggauacugaacaa

SEQ ID NO: 120548 - RNA, 30 nt, Mus musculus
aagauguuagagaugaucugaggauuucag

SEQ ID NO: 120549 - RNA, 46 nt, Mus musculus
ggucauacccacuggauucuauuccccuuucuucaucaggucauag

SEQ ID NO: 120550 - RNA, 42 nt, Mus musculus
uaaaauaaauaaaucuuaagagagagagagagagagagagag

SEQ ID NO: 120551 - RNA, 42 nt, Mus musculus
cagugauauagaguccagcuugagguuuaugggauggggggg

SEQ ID NO: 120552 - RNA, 42 nt, Mus musculus
ucugugggacagagggccuggaacacacugccccacccccau

SEQ ID NO: 120553 - RNA, 41 nt, Mus musculus
ugcagaggcagaggcagaggcaggcacaaggaggcccccaa

SEQ ID NO: 120554 - RNA, 42 nt, Mus musculus
acauaaaauaaaggcaaauacauuuaagaaagagagaggcag

SEQ ID NO: 120555 - RNA, 42 nt, Mus musculus
ccgaucgauccccgcgucacccacucacccaaaaugccugag

SEQ ID NO: 120556 - RNA, 52 nt, Mus musculus
cccuggaugguucccacagggcgccagcacccagcaacccauaaucugaggg

SEQ ID NO: 120557 - RNA, 45 nt, Mus musculus
ccacacacauauuacaucccaugaugcuggccggcgagggaaaga

SEQ ID NO: 120558 - RNA, 45 nt, Mus musculus
gccgagccgccuagcgggggaggggggcacgcccccaagaggaag

SEQ ID NO: 120559 - RNA, 42 nt, Mus musculus
cugcuuccaugugccgcggugccuggccaugugcgagcagau

SEQ ID NO: 120560 - RNA, 90 nt, Mus musculus
ccuuauagaaaugugucaagacuuugccuccugaggacugggacuaagggcaugccccauuacauagggcuaaaggaaagacugugaguc

SEQ ID NO: 120561 - RNA, 46 nt, Mus musculus
ugggaaaccugauccuugccuuacuuuccuccaacucugacuaggc

SEQ ID NO: 120562 - RNA, 46 nt, Mus musculus
cagagggauggacaaguuguacuggagaauguaucagaggauggaa

SEQ ID NO: 120563 - RNA, 45 nt, Mus musculus
gguggagcccagcuugcugagggcggaaauggguguguccuaaga

SEQ ID NO: 120564 - RNA, 41 nt, Mus musculus
gugcccaugaugcugcucagccugguggagcagcuuggaga

SEQ ID NO: 120565 - RNA, 46 nt, Mus musculus
ccugagagugaccugaaucccagaguccccgaaaauaguauuggga

SEQ ID NO: 120566 - RNA, 44 nt, Mus musculus
aguagcucuggggccuacucgaguugguucaggaagucccugug

SEQ ID NO: 120567 - RNA, 46 nt, Mus musculus
ugaaauuaaugaaguuaacauuuuuauuguaauuuuagccuuagcg

SEQ ID NO: 120568 - RNA, 66 nt, Mus musculus
auuuccagccaccucccaucccuucuucaagcuuagccagauccuaucucgcccagugaaaucaca

SEQ ID NO: 120569 - RNA, 45 nt, Mus musculus
accugguacccucccuggguugaguaugaauggacagcucagaga

SEQ ID NO: 120570 - RNA, 45 nt, Mus musculus
aacagcaccaucuucccacugaggcucuggccccagcugacaguc

SEQ ID NO: 120571 - RNA, 42 nt, Mus musculus
cagggacaaaacaaaggcuaucuuguuuuucugccccacugc

SEQ ID NO: 120572 - RNA, 46 nt, Mus musculus
ggugacagcacaaauaucaccagugccagugcuaucacuacaagug

SEQ ID NO: 120573 - RNA, 42 nt, Mus musculus
aacaugagcucaaaccaagguaaguagaaguguccgguagag

SEQ ID NO: 120574 - RNA, 42 nt, Mus musculus
ccccagcagcaaggacaugcccacagggcgccaaccagagac

SEQ ID NO: 120575 - RNA, 46 nt, Mus musculus
cagugccaaacccagcagaccaacaugaccaccaccaccaugacug

SEQ ID NO: 120576 - RNA, 42 nt, Mus musculus
acuacagcaauguccagcaugggcacugggcagcagcgagac

SEQ ID NO: 120577 - RNA, 46 nt, Mus musculus
gccugucucccagccuacccaggucacucugauuacagcacccagu

SEQ ID NO: 120578 - RNA, 58 nt, Mus musculus
ggccccuggacaaccaggcaccauccuccguacugugccuaugggcggcguucgccug

SEQ ID NO: 120579 - RNA, 72 nt, Mus musculus
caauuaucaccaccaaagugaugacuucaggaacaggagcgccugcuaaaaucaucacugcuguccccaaga

SEQ ID NO: 120580 - RNA, 115 nt, Mus musculus
gcccacuauccugggcaucaguaguguuucucccagcaccaccaaaccuggcacaacuaccauuauuaagaccauuccuaugucggccauuaucacccaggcaggugccacaggu

SEQ ID NO: 120581 - RNA, 51 nt, Mus musculus
agcggggacuauccugaagcuggugacaucagcagauggcaagcccacaac

SEQ ID NO: 120582 - RNA, 63 nt, Mus musculus
agcaucuacagguccugugacucagaucauccaggugagcacucacucucucaggcccaagag

SEQ ID NO: 120583 - RNA, 63 nt, Mus musculus
ucugggaaaagugaugucggugguccagaccaaaccaguucagacaucagcagugacaggcca

SEQ ID NO: 120584 - RNA, 46 nt, Mus musculus
ccacggugguagguggagucaccaagaccaucacccuagugaagag

SEQ ID NO: 120585 - RNA, 41 nt, Mus musculus
cauuggcugcugcugcugcugccacacagaaaaucccucca

SEQ ID NO: 120586 - RNA, 45 nt, Mus musculus
gacaucucucugugugugugugugugugugugugugugugugugu

SEQ ID NO: 120587 - RNA, 46 nt, Mus musculus
ggggugcaguggcaacagcugacaguuaccuucuacaacuccagaa

SEQ ID NO: 120588 - RNA, 46 nt, Mus musculus
gcacugacugcucuuccaaagguccugaauucaaaucccagaaacc

SEQ ID NO: 120589 - RNA, 45 nt, Mus musculus
aacagaguaaggcuuggugcacuacuaacauggacuuuugagaga

SEQ ID NO: 120590 - RNA, 35 nt, Mus musculus
gagguaguuccaagcugacacccucuuacucuagg

SEQ ID NO: 120591 - RNA, 46 nt, Mus musculus
agaaaccuaggcaagagguagaauuggccuggucccuaucccacag

SEQ ID NO: 120592 - RNA, 58 nt, Mus musculus
aggcaagucguugggaauggaagagacugaaggcaaagacacccaaaaaugggccucc

SEQ ID NO: 120593 - RNA, 42 nt, Mus musculus
ggaugauuucccuuucuuggugacuucuccuuugccccaguu

SEQ ID NO: 120594 - RNA, 46 nt, Mus musculus
gguaugacagacauaggagccuaggugaaagagcaaacugccagca

SEQ ID NO: 120595 - RNA, 61 nt, Mus musculus
augcagcaggucugccucugggcccuggucuuagauuuuggggacgaacaaacggacugac

SEQ ID NO: 120596 - RNA, 46 nt, Mus musculus
caccuucaacuccugaucuuccugcuuccaccuuucaaggccuagg

SEQ ID NO: 120597 - RNA, 46 nt, Mus musculus
ugaauucaggugaguuucccuucgugugugugugugugugugugug

SEQ ID NO: 120598 - RNA, 46 nt, Mus musculus
aaggauuggguuacaugauaccccacuggguguuugagggcaaggg

SEQ ID NO: 120599 - RNA, 45 nt, Mus musculus
gguggacuccuuuccucaaauuccccucuucugaugagggucagg

SEQ ID NO: 120600 - RNA, 45 nt, Mus musculus
ccaaucacacugaaaggaaaauaauuucuugaacugcaccguguu

SEQ ID NO: 120601 - RNA, 42 nt, Mus musculus
auugaccacuuugguguuaauuuguuaccauuuugcagaggu

SEQ ID NO: 120602 - RNA, 46 nt, Mus musculus
agcccaguaagguaaggcuaagggcagggguacaacuuguguagua

SEQ ID NO: 120603 - RNA, 45 nt, Mus musculus
gugugucuuuugugugugugugugugugugugugugugugugugu

SEQ ID NO: 120604 - RNA, 45 nt, Mus musculus
cgcccaugcucguucgggagaaaagauaauauuuagaucacagau

SEQ ID NO: 120605 - RNA, 46 nt, Mus musculus
gacuggugagggggaggggaugucgcgggcgacagugacuucagac

SEQ ID NO: 120606 - RNA, 51 nt, Mus musculus
auugccaucuuugcuuucucccugauuuuucaacccccguucuuacacccc

SEQ ID NO: 120607 - RNA, 62 nt, Mus musculus
ggccaccgugcaguggcuaucaaggagcuuauagugguguuuggcggcggcaacgaggggau

SEQ ID NO: 120608 - RNA, 62 nt, Mus musculus
gcuguguaaggagccgcuucuucgugagagcugccuuagacgaaagggggugugugaagaau

SEQ ID NO: 120609 - RNA, 48 nt, Mus musculus
ccuccugcucgagguucuaagcgggaacacccaggcaaauaguuagag

SEQ ID NO: 120610 - RNA, 48 nt, Mus musculus
cugacacgccuuuauuacuuaggaacguugggguucugcgaucggugg

SEQ ID NO: 120611 - RNA, 46 nt, Mus musculus
aagcccagcuuugugguacccagacagugagaagccccaagaaaga

SEQ ID NO: 120612 - RNA, 42 nt, Mus musculus
gaaugugaacacagacagggccagccaaagaacuugauagaa

SEQ ID NO: 120613 - RNA, 36 nt, Mus musculus
uccuggaacuugcucuguagaccaagcuggccccaa

SEQ ID NO: 120614 - RNA, 47 nt, Mus musculus
caucccugcugucaucagaaccaccacagaucaucaucaacccagcc

SEQ ID NO: 120615 - RNA, 61 nt, Mus musculus
aaaaaaaagcagggacagcuaagaaguuacuaucucugcucaggcucacccacgggcagcu

SEQ ID NO: 120616 - RNA, 41 nt, Mus musculus
accauggcagccucuaguagugaccacaagagccccagccc

SEQ ID NO: 120617 - RNA, 44 nt, Mus musculus
ccuggcucaacuagcuugcugcugcaugcaccgucgggccaaga

SEQ ID NO: 120618 - RNA, 45 nt, Mus musculus
ggguguagccacggaugcuugggcugcuccaauugcugcccagau

SEQ ID NO: 120619 - RNA, 46 nt, Mus musculus
ucugggcagcaauuggagcagcccaagcauccguggcuacacccac

SEQ ID NO: 120620 - RNA, 45 nt, Mus musculus
ugcuggucagagggcugugaggacacaaggugcaaagaccaagua

SEQ ID NO: 120621 - RNA, 42 nt, Mus musculus
gggaugcaagcuuaagcaaaaggaugcaaauuaugaccacaa

SEQ ID NO: 120622 - RNA, 42 nt, Mus musculus
caggcaaguaggcgaggguaccucgaacuguggaaguccggg

SEQ ID NO: 120623 - RNA, 42 nt, Mus musculus
cuccugucuaggggcacaaggugagccacaccacggccucau

SEQ ID NO: 120624 - RNA, 46 nt, Mus musculus
guguguaccgagcagucaugagaaauacuacauaugcugugaagag

SEQ ID NO: 120625 - RNA, 81 nt, Mus musculus
aagguuaaguuucuuccucuuugucuggaaaauucccuggggguuaagagacaccuaccuugguggaggaaggggcugaag

SEQ ID NO: 120626 - RNA, 45 nt, Mus musculus
aggagcucugacucagaaugggucugggagccuggaaaagcuuca

SEQ ID NO: 120627 - RNA, 46 nt, Mus musculus
gaaagcugcagguuacuuugagacagucgucccaaaagcauuagag

SEQ ID NO: 120628 - RNA, 44 nt, Mus musculus
aagguuuuaaaauaaaacagaaacagcuacaguucuuagcagga

SEQ ID NO: 120629 - RNA, 46 nt, Mus musculus
cauggaggaagcuuuggaggugguggaggaaacuuuggucguggag

SEQ ID NO: 120630 - RNA, 44 nt, Mus musculus
aaaaggcccuuucuaaacaagagaugcagucugcuggaucccag

SEQ ID NO: 120631 - RNA, 45 nt, Mus musculus
guggaugcugcaaugugugcucggccacacaagguugauggacgu

SEQ ID NO: 120632 - RNA, 42 nt, Mus musculus
gagaauuuccugugagacaucucgccgccacacgccgcagac

SEQ ID NO: 120633 - RNA, 44 nt, Mus musculus
uccuggccugucaacuucccggacgaugugggucaugccagccu

SEQ ID NO: 120634 - RNA, 42 nt, Mus musculus
gaaagagaacuagaaggugguuguacauaggacuuccaccuc

SEQ ID NO: 120635 - RNA, 46 nt, Mus musculus
cuucuuugguucugggagguggaaguccuauguacaaccaccuucu

SEQ ID NO: 120636 - RNA, 46 nt, Mus musculus
gcaaugagcauccccacaccuguccuauucccaagaagccccauuu

SEQ ID NO: 120637 - RNA, 42 nt, Mus musculus
uaggacagguguggggaugcucauugccaugggagcuucuag

SEQ ID NO: 120638 - RNA, 37 nt, Mus musculus
agacaguugugagcugccaugugggugcugugacuug

SEQ ID NO: 120639 - RNA, 45 nt, Mus musculus
accuuccaggccugcuccauaggcggacacuaagccugggucccc

SEQ ID NO: 120640 - RNA, 44 nt, Mus musculus
caaugacugccaauauuggccacagaaggggcacgucgccugcg

SEQ ID NO: 120641 - RNA, 42 nt, Mus musculus
ccuugggcugaaggccucuaccaauagcccggcaggcagcug

SEQ ID NO: 120642 - RNA, 31 nt, Mus musculus
cgaagguaaaagcauggagaaaagagacgaa

SEQ ID NO: 120643 - RNA, 41 nt, Mus musculus
auugagauggaauagugcaggaucaggguccagaugaggcc

SEQ ID NO: 120644 - RNA, 42 nt, Mus musculus
ugcuccagagugggggaaaagacagaggaaguguuggcaagg

SEQ ID NO: 120645 - RNA, 85 nt, Mus musculus
uugguugugcuugcggugcauuuucuucuggcugaguaccucgagcagcgcgaugagccgcaacccaucgcucagguccgucugc

SEQ ID NO: 120646 - RNA, 46 nt, Mus musculus
aggcaccuccgagcaugaacgacgaggcacagaacagagguugcac

SEQ ID NO: 120647 - RNA, 46 nt, Mus musculus
ugguuguuacaguggaagauaggccgccuauauaaggcgugagcag

SEQ ID NO: 120648 - RNA, 45 nt, Mus musculus
aaagcaaaaguugaugaauucccacuuuguggccauaugguguca

SEQ ID NO: 120649 - RNA, 41 nt, Mus musculus
gaguuguggcaaggauggcuuucauauccgagugaggcucc

SEQ ID NO: 120650 - RNA, 43 nt, Mus musculus
uguagccuauuaucuauaugggcugccucaagggaccuuggag

SEQ ID NO: 120651 - RNA, 45 nt, Mus musculus
aggguucacauuggccaggucaucauguccauccgaaccaaguug

SEQ ID NO: 120652 - RNA, 47 nt, Mus musculus
uagauccacaucucaaagaaguggggcuucaccaaguuuaaugcaga

SEQ ID NO: 120653 - RNA, 48 nt, Mus musculus
guucuccuauacccuaccaaaucguucaauaauaaaaucucgcaucaa

SEQ ID NO: 120654 - RNA, 53 nt, Mus musculus
agagauucaagaaauguucagggccaacagcagggagaauacuaauuagcuga

SEQ ID NO: 120655 - RNA, 42 nt, Mus musculus
augaauuagcugaucugcuucaggaaacuaaggugcucaaaa

SEQ ID NO: 120656 - RNA, 46 nt, Mus musculus
gguugaccucauccccauuguuagugaaaauguaaaauggcacaaa

SEQ ID NO: 120657 - RNA, 41 nt, Mus musculus
agaugugcagagucaggaagacagaacaaaccagccagaua

SEQ ID NO: 120658 - RNA, 41 nt, Mus musculus
gccccagugcucacauguauuccaaaacagacaccccagug

SEQ ID NO: 120659 - RNA, 28 nt, Mus musculus
uaugagcucauugagaaccgaggcccug

SEQ ID NO: 120660 - RNA, 46 nt, Mus musculus
uagaaggacuuaggggagccaugauauggcaguauaguuggcagag

SEQ ID NO: 120661 - RNA, 46 nt, Mus musculus
uugcuugaaaaggaaucuacauacccagaugaaagggcaaugugga

SEQ ID NO: 120662 - RNA, 57 nt, Mus musculus
auuauuuuguugaaugauauagucucagugccauuuccucucagauccugcucugau

SEQ ID NO: 120663 - RNA, 46 nt, Mus musculus
caaaauaaaauuuuuauuuuuuauuuuacugaagacagguuuauug

SEQ ID NO: 120664 - RNA, 46 nt, Mus musculus
uuucuggaagcaagaccuuuagaaaaagaauugaaaucaggcgggg

SEQ ID NO: 120665 - RNA, 46 nt, Mus musculus
agguuucuuggucauagguacagaaagaagacucaauuggucccuu

SEQ ID NO: 120666 - RNA, 42 nt, Mus musculus
caccacacuaggcaagagaggaaaacauagaggcagacaggg

SEQ ID NO: 120667 - RNA, 42 nt, Mus musculus
ugauggcggcaacagugguaucucggauacggacggggacag

SEQ ID NO: 120668 - RNA, 45 nt, Mus musculus
aacccugucucgaaaaaccaaaaagaaaaaaaaaaggaagcaaug

SEQ ID NO: 120669 - RNA, 46 nt, Mus musculus
uaaaaugaauugcugaauugugauuugcacaauacacuacuuccag

SEQ ID NO: 120670 - RNA, 69 nt, Mus musculus
ggcugcuugugagacuggagccuaguaugugauugaaagguuaggagaugauccgcuaggucaccuaga

SEQ ID NO: 120671 - RNA, 31 nt, Mus musculus
gggcuuauguauaguaaacauaaugaguuua

SEQ ID NO: 120672 - RNA, 103 nt, Mus musculus
ugccugacccuuguuuuguagguuaucacaaaccagcuguacauaaaucucucaacccuaugaucaccuucuauaucuugucaucaugcccucagagugcugg

SEQ ID NO: 120673 - RNA, 34 nt, Mus musculus
ccagccuuccugcccugcugcucauccgucugcc

SEQ ID NO: 120674 - RNA, 55 nt, Mus musculus
aaguccacagacuuaguaaguggggcuaguaggaagggaaauguuagaagggcug

SEQ ID NO: 120675 - RNA, 46 nt, Mus musculus
ccacuuugggcagugugauuguuaguuuagggagauggaauaucag

SEQ ID NO: 120676 - RNA, 105 nt, Mus musculus
gucauuguaacucacaggaggauggaucgcaggagaugccaccugagucugaagcagcuggcgaccuagacccccagccaccaugguuauaucacgggccaccug

SEQ ID NO: 120677 - RNA, 46 nt, Mus musculus
cuccugcgauccauccuccugugaguuacaaugacacugccccaag

SEQ ID NO: 120678 - RNA, 45 nt, Mus musculus
cuguggauuucaagucguuccauggcaaaccaauaucgggcagac

SEQ ID NO: 120679 - RNA, 45 nt, Mus musculus
caagucacaggaccuagcaucuauucuuuccacugugaguacguc

SEQ ID NO: 120680 - RNA, 75 nt, Mus musculus
caccagucacauugaaggccuggaucuaggagacacauugacauggaucagaugguuccacaagguuccacacac

SEQ ID NO: 120681 - RNA, 41 nt, Mus musculus
uccuaugcuagcgacugugcugguuucuucucuccgggcau

SEQ ID NO: 120682 - RNA, 86 nt, Mus musculus
gaaaagcaugaagaggguggugagcagacccauccagaugcccggagagaagaaaccagcacagucgcuagcauaggagaacuguu

SEQ ID NO: 120683 - RNA, 48 nt, Mus musculus
ucagccuaaagaccauggaucgcuuugaugaccacaagggccccacca

SEQ ID NO: 120684 - RNA, 45 nt, Mus musculus
uacauacgccacccucagucucucuugcuuccucuuuaacccgga

SEQ ID NO: 120685 - RNA, 86 nt, Mus musculus
gaugggggauagccacaggggagucccucuccggguuaaagaggaagcaagagagacugaggguggcguauguaggguucaugcua

SEQ ID NO: 120686 - RNA, 45 nt, Mus musculus
uagggucuccccuuuacccucucuccuuauuuauucuugccccuc

SEQ ID NO: 120687 - RNA, 60 nt, Mus musculus
acuacuugacugucuguccagcuuagcuguuauguuuuuugggggggaggggugaugugu

SEQ ID NO: 120688 - RNA, 45 nt, Mus musculus
ucacuggguuucuggauuauucccauaaagacugccugucaagag

SEQ ID NO: 120689 - RNA, 46 nt, Mus musculus
cucuacuauugcuacugcugcuacugccgcugcugcugcugccccu

SEQ ID NO: 120690 - RNA, 43 nt, Mus musculus
acauuccagucucggccccggcccauugauucagggggcccuu

SEQ ID NO: 120691 - RNA, 45 nt, Mus musculus
gaugucauccacugguuuguucagcauguauguucccccauagau

SEQ ID NO: 120692 - RNA, 45 nt, Mus musculus
guugguagagugcuugccuguuaugcauaaagccccagguuagau

SEQ ID NO: 120693 - RNA, 45 nt, Mus musculus
aagguuaaggauauggucagugaauaaaaucaauaagguggguga

SEQ ID NO: 120694 - RNA, 25 nt, Mus musculus
acaccuaagaguugggggaggagau

SEQ ID NO: 120695 - RNA, 46 nt, Mus musculus
uacuccaaaguuaauaaauuagaauaaauuauaaggaggaggagga

SEQ ID NO: 120696 - RNA, 34 nt, Mus musculus
uuccgagacaggguuucucuguguagcugacugu

SEQ ID NO: 120697 - RNA, 46 nt, Mus musculus
agaagagggagaagcagcgugagcaaauggagcagaugaagcagag

SEQ ID NO: 120698 - RNA, 44 nt, Mus musculus
uucaguuggaaguuuuuuuguuuuguuuuguuuuuuguuguugu

SEQ ID NO: 120699 - RNA, 46 nt, Mus musculus
ggaaacuagagaagcuucgagagaaggagcgcaagaaggaggccaa

SEQ ID NO: 120700 - RNA, 62 nt, Mus musculus
cuucaccuuggaggaagaggaggagggaguugaagaggaggaagagauggcuauguacgagg

SEQ ID NO: 120701 - RNA, 41 nt, Mus musculus
gauguggacacaagcuucuugccugaccgggaccgggaggu

SEQ ID NO: 120702 - RNA, 46 nt, Mus musculus
caccuuuaguuacugggauggcucugggcaccggcgcacaguuaag

SEQ ID NO: 120703 - RNA, 46 nt, Mus musculus
ugcuaaggagcugguaugagaagaacaagcacauuuuuccugccag

SEQ ID NO: 120704 - RNA, 41 nt, Mus musculus
uuuaaaaaagauuuauuguauacaguguucugccugcauau

SEQ ID NO: 120705 - RNA, 42 nt, Mus musculus
aucacagucgcacccagccccucugcuacaguccugccagca

SEQ ID NO: 120706 - RNA, 45 nt, Mus musculus
ggaccccaugggaaaaugggacuggggauggaaagucggggcaag

SEQ ID NO: 120707 - RNA, 42 nt, Mus musculus
cagaaugcugugcuuggccagaucuccucuauagccccuuga

SEQ ID NO: 120708 - RNA, 41 nt, Mus musculus
ggaaaaaauuacaacaacgaagaaaaacucaugcaacagaa

SEQ ID NO: 120709 - RNA, 42 nt, Mus musculus
auggcucacaaccaucuguaaugcuacuucgugcccucuucu

SEQ ID NO: 120710 - RNA, 46 nt, Mus musculus
ugguuugaguuacccccaauauauuucauauuauuuguggccauug

SEQ ID NO: 120711 - RNA, 46 nt, Mus musculus
gccuggagcuacugcuccaguuccacugacugauuggcccggugau

SEQ ID NO: 120712 - RNA, 46 nt, Mus musculus
aaaacacaguaaauuuacuggcuuauaaagcugaaaaagccuagga

SEQ ID NO: 120713 - RNA, 46 nt, Mus musculus
aguaaugcuggcccuccauucuuaauguuucuacccguccccuacc

SEQ ID NO: 120714 - RNA, 41 nt, Mus musculus
cagacuggucgacuccccagccacccccaucuggcagcuga

SEQ ID NO: 120715 - RNA, 42 nt, Mus musculus
agaugaaaaacgacugucagauuacaacauugggcccaauuc

SEQ ID NO: 120716 - RNA, 46 nt, Mus musculus
gcugagccaucaccaccccaccaccccauagccagaugcugcagug

SEQ ID NO: 120717 - RNA, 45 nt, Mus musculus
cuaauuucuugcaguggaauaaaguguauucagauguccucagug

SEQ ID NO: 120718 - RNA, 45 nt, Mus musculus
aguaugagggcuggccagaggcccuggagauggaaggcuguaucc

SEQ ID NO: 120719 - RNA, 46 nt, Mus musculus
cgcuagcauaaacccugacugauguacccuaagagagaacccaggg

SEQ ID NO: 120720 - RNA, 45 nt, Mus musculus
aaacaaaggaaugaaagacaaaaggaaggaaagaaagaaggaagu

SEQ ID NO: 120721 - RNA, 45 nt, Mus musculus
uauaucccaagccagaauauaaauuuuuaaagaguuugguggaga

SEQ ID NO: 120722 - RNA, 59 nt, Mus musculus
ucauagguggucuuguuuggaagguuauuuaguugguguuaugggagcacgacuagauu

SEQ ID NO: 120723 - RNA, 48 nt, Mus musculus
agaauggggucaggagacaguacuguccuggaaucuaguagugaagug

SEQ ID NO: 120724 - RNA, 46 nt, Mus musculus
gagaguagguuugggggugggggcaguggcaagucugugcugggag

SEQ ID NO: 120725 - RNA, 46 nt, Mus musculus
aacagacuccaggacuggagcguagcaaugauucuucuccacccgg

SEQ ID NO: 120726 - RNA, 62 nt, Mus musculus
cucaggucgauccgcucgaggcugguggcagagauugggcgggccaaggauguugucugggu

SEQ ID NO: 120727 - RNA, 85 nt, Mus musculus
cagaccggaucagggaguuacccaguugucucgcucugccggcuaggugaagcaagugagucacguagaaaagcuuaucaggcac

SEQ ID NO: 120728 - RNA, 45 nt, Mus musculus
acccuccagggcagcuugagcuacauuuacugaccccggucucag

SEQ ID NO: 120729 - RNA, 42 nt, Mus musculus
cuggaguggcauaauaauacucuuguggaggucugcgggcau

SEQ ID NO: 120730 - RNA, 46 nt, Mus musculus
gcauuaauuccaaacuugcauuaauucuauugcuuuuggccuccag

SEQ ID NO: 120731 - RNA, 45 nt, Mus musculus
gaauuaaaggcaugugcuacaaagcccagcucucuuucucucuga

SEQ ID NO: 120732 - RNA, 46 nt, Mus musculus
uagccaggcaauuuuacuuugagauucugaaaacuuauacccuggg

SEQ ID NO: 120733 - RNA, 42 nt, Mus musculus
cagagauucaguccauuaucauggcagacacagugcuggggg

SEQ ID NO: 120734 - RNA, 52 nt, Mus musculus
gggcagccuccuuaccaaaggaaggcaagcacagcagcuagaauuuuccuau

SEQ ID NO: 120735 - RNA, 46 nt, Mus musculus
uggccacacuagccucagugcuacuagacauuccuccucaccagau

SEQ ID NO: 120736 - RNA, 42 nt, Mus musculus
auggggaggagccuuaggccucaaagggacaaugaccaaacc

SEQ ID NO: 120737 - RNA, 84 nt, Mus musculus
aguccaggggcagacugauaggcauucuuucugcagcggcuggaagggaggugauucaggucuuguggaaagauggguggcuca

SEQ ID NO: 120738 - RNA, 46 nt, Mus musculus
ucccuuuucaccaucuaacccuauauuaggacuauugaccccauau

SEQ ID NO: 120739 - RNA, 53 nt, Mus musculus
uccuuccaauauggggucaauaguccuaauauaggguuagauggugaaaaggg

SEQ ID NO: 120740 - RNA, 42 nt, Mus musculus
cacaccacugcugcacaagauugaucgagaaaagccccagcc

SEQ ID NO: 120741 - RNA, 51 nt, Mus musculus
gaucaaucuugugcagcaguggugugaagauacgccaggcuucccugaguu

SEQ ID NO: 120742 - RNA, 41 nt, Mus musculus
augaugaccaagaagccuggcauguucuuuaacccugagga

SEQ ID NO: 120743 - RNA, 46 nt, Mus musculus
aaacugacaacgugguccuuggccaauauguggggaaccccaaugg

SEQ ID NO: 120744 - RNA, 45 nt, Mus musculus
ggaaccgcaucaucguggagaagcccuucgggagagaccuacaga

SEQ ID NO: 120745 - RNA, 42 nt, Mus musculus
gccaaccuuggauacaugagacuaauuaaaguaaaacuagua

SEQ ID NO: 120746 - RNA, 44 nt, Mus musculus
caaucuccaucauacugaaauuauuuaugugucaccuugcccag

SEQ ID NO: 120747 - RNA, 45 nt, Mus musculus
ggaugcaggccaaccgucuauucuaccuggccuugccccccacag

SEQ ID NO: 120748 - RNA, 45 nt, Mus musculus
augaagguaucuucagguagaaggccaucccggaacagccaccug

SEQ ID NO: 120749 - RNA, 46 nt, Mus musculus
ugugccacgaagcccagcuuuucuuucuuguuuugguuguuuaguu

SEQ ID NO: 120750 - RNA, 45 nt, Mus musculus
guuaggcuggguuggguuuuguuuuggauuuugguggugguggua

SEQ ID NO: 120751 - RNA, 45 nt, Mus musculus
acuuucuguuaucacagguagaacuaauauacagcauagcccaag

SEQ ID NO: 120752 - RNA, 46 nt, Mus musculus
ugaucuaggacaccugcaaguucuccauucauuaaacguagcaauc

SEQ ID NO: 120753 - RNA, 43 nt, Mus musculus
cugagagagagagacagacagacccuaugcuuagccccuagag

SEQ ID NO: 120754 - RNA, 82 nt, Mus musculus
aagcagagucccacaugcuaagguuuguggcagauacaugcauagcuccuuuaaggggacuaggcuagagacagggcugagg

SEQ ID NO: 120755 - RNA, 45 nt, Mus musculus
gugcuuugguuugucugucccuuccccuuucaguggcagggcccu

SEQ ID NO: 120756 - RNA, 41 nt, Mus musculus
aggugugugggauccugagggaagaguuguaccagggugau

SEQ ID NO: 120757 - RNA, 42 nt, Mus musculus
cacuacuuuaauccuagcagacgggaaaaaagaggcagguag

SEQ ID NO: 120758 - RNA, 46 nt, Mus musculus
cugccgcaagcuucuaauuauucgcuacccagauuauuuaggcuag

SEQ ID NO: 120759 - RNA, 44 nt, Mus musculus
gaguuccuuaugugcaaauuccaggaagcccggaagcuggugga

SEQ ID NO: 120760 - RNA, 91 nt, Mus musculus
cauucuuaucuggggagacagcagcaagguaccacacagcaggggcuuagauaacagaggauugucucuaguugagaucagaggucuaaga

SEQ ID NO: 120761 - RNA, 60 nt, Mus musculus
uggccuuuucucuucagaaaguuuuguuauauuuuauuuuggguagugugugugucugug

SEQ ID NO: 120762 - RNA, 70 nt, Mus musculus
cuugcacucacacauguggauguguguauugccaugggguucacauguaggugacaggacaacuugcagg

SEQ ID NO: 120763 - RNA, 46 nt, Mus musculus
uuuaguuuccaggacuucaaaaaauaagauaaagacagagguacag

SEQ ID NO: 120764 - RNA, 46 nt, Mus musculus
ugcugcuguccuccauauaguuagugaagcuaacaggccuucucag

SEQ ID NO: 120765 - RNA, 42 nt, Mus musculus
aagauguuggcuuuaaggaaaacaugaacuauguagcagcca

SEQ ID NO: 120766 - RNA, 79 nt, Mus musculus
ccagaccaaaccaaaccaacaacaaaaaaccaaccccccaaaacaaaaauacuccacuaucgaauaaacaacuccagag

SEQ ID NO: 120767 - RNA, 69 nt, Mus musculus
ggcaacagcuccagcaagcugaggaggcccugguagccaaacaggaauugauugauaagcugaaagagg

SEQ ID NO: 120768 - RNA, 45 nt, Mus musculus
agcacaagauugugauggagacugugccagucuugaaggcccagg

SEQ ID NO: 120769 - RNA, 40 nt, Mus musculus
uuuucucagcucaccacuccuuucauuuggccuuguccaa

SEQ ID NO: 120770 - RNA, 66 nt, Mus musculus
auaacauguguuaccucugguagacauguggaaaguauucuguccuuuuguuacuguaauuaaugg

SEQ ID NO: 120771 - RNA, 46 nt, Mus musculus
gaauccaucccgggggcuuuuauuuacaugguuucuuucccauuaa

SEQ ID NO: 120772 - RNA, 45 nt, Mus musculus
agucuuguucucacauuauggggguuugggcuuauauaacccgga

SEQ ID NO: 120773 - RNA, 47 nt, Mus musculus
ucauaaaacaaaaaguuaacuggugauucccuggaggugagaggggu

SEQ ID NO: 120774 - RNA, 46 nt, Mus musculus
auguaaaugaggaaaauaccuaauuaaaaaaaaagaugaggucuua

SEQ ID NO: 120775 - RNA, 46 nt, Mus musculus
caaucucuggcacuagggggucaucuggguuuggaucacauagcag

SEQ ID NO: 120776 - RNA, 75 nt, Mus musculus
uaccccuucaaaccaccuaagguugcauuuacaacaagaauuuaucauccaaauauuaacaguaauggcagcauu

SEQ ID NO: 120777 - RNA, 70 nt, Mus musculus
ggaugauaaauucuuguuguaaaugcaaccuuaggugguuugaagggguagucuguaggaaaaugaauug

SEQ ID NO: 120778 - RNA, 45 nt, Mus musculus
agggucacgggccaaaucacuaaguuccuuauuaauccguuucag

SEQ ID NO: 120779 - RNA, 64 nt, Mus musculus
ggcgaaaagcacagacuauggcgcugaaacggauuaauaaggaacuuagugauuuggcccguga

SEQ ID NO: 120780 - RNA, 69 nt, Mus musculus
uccccgccuccgggauaaucaagaguuuuggccggaccuuugaguacaccucgggauagugaggagccc

SEQ ID NO: 120781 - RNA, 46 nt, Mus musculus
ucacaccggcucugccagacacaggcgcuugggauggagguggcgg

SEQ ID NO: 120782 - RNA, 46 nt, Mus musculus
gcagugugggcagucgugacaggacagggagacuccuugccugaga

SEQ ID NO: 120783 - RNA, 44 nt, Mus musculus
gagaaacauucagcgccuggaguuuguggcuguugucaaacgag

SEQ ID NO: 120784 - RNA, 45 nt, Mus musculus
uuagggguaguccuggucuugggugacagaagaugguagugccag

SEQ ID NO: 120785 - RNA, 50 nt, Mus musculus
uggccucaggguugggaggcaguguacacuguaggggcuugcuaguggag

SEQ ID NO: 120786 - RNA, 46 nt, Mus musculus
uuuguuguugcuguuguuguuguuguugcuguuguuguugcugcug

SEQ ID NO: 120787 - RNA, 47 nt, Mus musculus
uucuggaugaaauucagugcaaucuaucagaaguaaagcggggagag

SEQ ID NO: 120788 - RNA, 45 nt, Mus musculus
gaccagugagaccaauggaugaaaaggguuccaggaggguugcag

SEQ ID NO: 120789 - RNA, 45 nt, Mus musculus
uauacgaggugaggguauagggauaggaaagcagcagaggguacu

SEQ ID NO: 120790 - RNA, 45 nt, Mus musculus
uccaggacuccuauguaacacaagaagauucuagcuaugucaagc

SEQ ID NO: 120791 - RNA, 45 nt, Mus musculus
gacacugcuggcaggcacucaaggauggauccaaaucucuccuca

SEQ ID NO: 120792 - RNA, 47 nt, Mus musculus
gcugguagggaggacauuacuuccucaggaacagagaggcaacaggc

SEQ ID NO: 120793 - RNA, 45 nt, Mus musculus
cccaauaccacagaguuuuccaugagucaaguuuucccuuuaaau

SEQ ID NO: 120794 - RNA, 46 nt, Mus musculus
uuucagugccauagaggucaaaauuaaggauguucugaaaacccag

SEQ ID NO: 120795 - RNA, 41 nt, Mus musculus
agcucugggagacaaggagggugguugauguggaggggaga

SEQ ID NO: 120796 - RNA, 48 nt, Mus musculus
ccccuucugugggaagaugacaaggguaaugauggguuaggagcccgc

SEQ ID NO: 120797 - RNA, 41 nt, Mus musculus; identical to SEQ ID NO: 120408

SEQ ID NO: 120798 - RNA, 46 nt, Mus musculus; identical to SEQ ID NO: 120409

SEQ ID NO: 120799 - RNA, 46 nt, Mus musculus; identical to SEQ ID NO: 120410

SEQ ID NO: 120800 - RNA, 25 nt, Mus musculus
auucucggggaaauuccaucgcuga

SEQ ID NO: 120801 - RNA, 42 nt, Mus musculus
cuggcucuaccugugaaugcacgcauucgugaccagugacua

SEQ ID NO: 120802 - RNA, 66 nt, Mus musculus
uagcauuucugcuggcacuaggcaggacauuauggaaaugaggguagcaaaggugcagagcaaggg

SEQ ID NO: 120803 - RNA, 45 nt, Mus musculus
aacucagaccuacaagaaaaacuuuaagagaucacaagccccuau

SEQ ID NO: 120804 - RNA, 46 nt, Mus musculus
agccauccuaguguuuggccucacaaacguaaguucucuccaguaa

SEQ ID NO: 120805 - RNA, 48 nt, Mus musculus
acgagccacucguuuggugaaaucacaacagagugcagguuuguaaaa

SEQ ID NO: 120806 - RNA, 69 nt, Mus musculus
cacuuauugcugcaguaaagaggcagcuucgagugaggacuaucuacgagagcaaaaugauagaauaug

SEQ ID NO: 120807 - RNA, 45 nt, Mus musculus
ugucuccgccucuugagauuaaaaucagccuccaucacgcccaag

SEQ ID NO: 120808 - RNA, 45 nt, Mus musculus
ucucucucucucucucugucucugucucugucucucucugugugu

SEQ ID NO: 120809 - RNA, 45 nt, Mus musculus
uucuggagucaugagugaaaagguaugcaguugugggacuagaag

SEQ ID NO: 120810 - RNA, 45 nt, Mus musculus
ugauguacucgaugcucaguggcuguaugauaaccauaaggauga

SEQ ID NO: 120811 - RNA, 47 nt, Mus musculus
uggcauugaggucaaccaggagauuguggucauuacuacuaaggggg

SEQ ID NO: 120812 - RNA, 45 nt, Mus musculus
aacuuguaguuaguaucagugacguuugguuuuugguguuucaag

SEQ ID NO: 120813 - RNA, 45 nt, Mus musculus
uaaguauuucuuucugugauggagacauuucuccauacauccgga

SEQ ID NO: 120814 - RNA, 72 nt, Mus musculus
ugacuacagcagugauuucuaccugugaccaugguauaguagccaaaauaaagagggugaucauggagagag

SEQ ID NO: 120815 - RNA, 50 nt, Mus musculus
ggaucugggcaagauuuuuccacuucagcuauugugaagaauagguuaga

SEQ ID NO: 120816 - RNA, 48 nt, Mus musculus
caggaccagcccuuuuaugugcugcagcaguucauagaugggguagau

SEQ ID NO: 120817 - RNA, 44 nt, Mus musculus
ggguaauguaguacacuugaguacaggaaacugcacagccaagg

SEQ ID NO: 120818 - RNA, 45 nt, Mus musculus
aaucagucuguaaaaccaacuguugguucuuuugucuagcaucag

SEQ ID NO: 120819 - RNA, 46 nt, Mus musculus
agcaguacaagccccucaguuagcugcugaagcaguaaaugucaua

SEQ ID NO: 120820 - RNA, 46 nt, Mus musculus
gaaucaauuaccuugguuccuaccuccacugugacacaguguggag

SEQ ID NO: 120821 - RNA, 49 nt, Mus musculus
ugaaagugaugagaccccaacaguuccccaguugaaggaaaagaagaag

SEQ ID NO: 120822 - RNA, 46 nt, Mus musculus
gacaacgacaccaccaaaaagaaaaagaagaagaaaguaaaagugg

SEQ ID NO: 120823 - RNA, 47 nt, Mus musculus
ggaagaaaaagaaaagccuuauuggaaaaacuuuuuguugagggaga

SEQ ID NO: 120824 - RNA, 46 nt, Mus musculus
cuccuacuuugcuuuuuaaaaaguugguaaaaauuaaaucugcuac

SEQ ID NO: 120825 - RNA, 46 nt, Mus musculus
ccuguuagauuuacuaugauaaucuuggacuggcaacaaaagugag

SEQ ID NO: 120826 - RNA, 46 nt, Mus musculus
auaucuucugaaaacuuucuaaaaugccaaaaucaaacagcugugc

SEQ ID NO: 120827 - RNA, 42 nt, Mus musculus
agucacuaacucaauggaaacaugagcuaaggauauggccag

SEQ ID NO: 120828 - RNA, 45 nt, Mus musculus
uuggcaccaaauuugaaacagugcaccagauucauaagcaggaca

SEQ ID NO: 120829 - RNA, 93 nt, Mus musculus
uuugaguucuuauacacagauacaacacggccaccaaagaagagugaggaagaugggaaggaguaucauuucaucucaacagaggagaugacg

SEQ ID NO: 120830 - RNA, 46 nt, Mus musculus
gaaggauugguacuggaagguaguacagauacaauacccccaccua

SEQ ID NO: 120831 - RNA, 42 nt, Mus musculus
ggaguaggagggagaaggaaagggaaagggagagggggaagg

SEQ ID NO: 120832 - RNA, 45 nt, Mus musculus
uggauugugacugagcagaccauucuuaauauggcuacgacccac

SEQ ID NO: 120833 - RNA, 46 nt, Mus musculus
aagaaauagcaauuauguuccauaucuuaacucuuaggccuuagaa

SEQ ID NO: 120834 - RNA, 46 nt, Mus musculus
gaaaggacugacaugaccccauuuuaauucugaaugaacuaucuag

SEQ ID NO: 120835 - RNA, 42 nt, Mus musculus
auguuuccaucuuguucggagcauucagagacagugacagau

SEQ ID NO: 120836 - RNA, 46 nt, Mus musculus
agaaagauauaucaacuuuaccauauuuuugagaguauuuucagac

SEQ ID NO: 120837 - RNA, 42 nt, Mus musculus
uguucuuauuucacauguuagcaggauugccaagggcauuag

SEQ ID NO: 120838 - RNA, 45 nt, Mus musculus
uaaaucuaaaaaaaacugggcacaauguguugccugaaauuccag

SEQ ID NO: 120839 - RNA, 42 nt, Mus musculus
aaaggaaaucccauuauuugauacaacauaggugcaccagga

SEQ ID NO: 120840 - RNA, 46 nt, Mus musculus
acauugaacuacuugcaaaugagcauaagcuaaaaagauaguacau

SEQ ID NO: 120841 - RNA, 45 nt, Mus musculus
aaaggucaggaggcucggagaguucgucucauacaauuugagaag

SEQ ID NO: 120842 - RNA, 46 nt, Mus musculus
ccuauguuauaagacauacuucucuccuuagguuucuaggccagau

SEQ ID NO: 120843 - RNA, 28 nt, Mus musculus
ugugauacagcgaagauggcuuugugau

SEQ ID NO: 120844 - RNA, 46 nt, Mus musculus
uugaagaaggaaaauaagacuuuaaggaacacauccaauaguagau

SEQ ID NO: 120845 - RNA, 42 nt, Mus musculus
ucacuggauuuaaugguaucccuuuuacuauucagcggcuau

SEQ ID NO: 120846 - RNA, 96 nt, Mus musculus
uaaucgaccaaagcuuucuuugucagcccccuugacaacaaaugguuugccugagagcacagauagcaaagauucugagcugcagcuaagugaaga

SEQ ID NO: 120847 - RNA, 115 nt, Mus musculus
ugaggugaaaagacugaaguuugacaaagaaggugacgucagagagacagcuagccaaacggugucuggugaagucucuucaguuagagcagaggaaacggaaacagcaauuccc

SEQ ID NO: 120848 - RNA, 47 nt, Mus musculus
agaagaggaagaggaggaggaagaaucguuuaugacaccaagagaaa

SEQ ID NO: 120849 - RNA, 30 nt, Mus musculus
cgucguccauggagaaugaggaagccacag

SEQ ID NO: 120850 - RNA, 46 nt, Mus musculus; identical to SEQ ID NO: 95015

SEQ ID NO: 120851 - RNA, 36 nt, Mus musculus
uuuuaauuuagaauaaaaguuuuuaaacuggaagau

SEQ ID NO: 120852 - RNA, 86 nt, Mus musculus
ucuuucagucuguugaaauaccagguuaaacacauuccaagagaucugugcaaacuaaauucuuuuguauacuucuaaggugccug

SEQ ID NO: 120853 - RNA, 46 nt, Mus musculus
aaaguugacuggcaaagaguagaaaaagacaugaagaaagccaaag

SEQ ID NO: 120854 - RNA, 45 nt, Mus musculus
agugaagagacacuguguacuuugcauaauggugcaaggaggaug

SEQ ID NO: 120855 - RNA, 70 nt, Mus musculus
aacgguuauugagcucaagaccgcagugaugccggagauguagauggguggacauuuagcacagagagca

SEQ ID NO: 120856 - RNA, 46 nt, Mus musculus
ugugcuucauugcuagcaauuuucauauuuauuacuagagccacau

SEQ ID NO: 120857 - RNA, 46 nt, Mus musculus
cuuuuuguuuguuugccuauuuucuaaagaaagagaaauuggggag

SEQ ID NO: 120858 - RNA, 45 nt, Mus musculus
uuuaugucucagcuucacagcuuggcccuuucucugccucugaag

SEQ ID NO: 120859 - RNA, 46 nt, Mus musculus
ugcaccuucgugguggcuuacaaccauccauagcccaguuguagau

SEQ ID NO: 120860 - RNA, 46 nt, Mus musculus
cuugacucuuugguuauaggcauuucauuuguuuuguaggguucac

SEQ ID NO: 120861 - RNA, 45 nt, Mus musculus
gaaaugauuuuagguauucuuaaaauguuuuauucugagguagua

SEQ ID NO: 120862 - RNA, 46 nt, Mus musculus
gaugaccugucuauuggagaaagugggguauugaaaucaccuacua

SEQ ID NO: 120863 - RNA, 46 nt, Mus musculus
auuuauuucuuuuccaacuaaauaaaucuucaugaugguacuguuu

SEQ ID NO: 120864 - RNA, 46 nt, Mus musculus
auagccucacaagagucaucuauaucagggucuuggcggagaugag

SEQ ID NO: 120865 - RNA, 46 nt, Mus musculus
aauugugucugcguuuggugguugauuauggcauggauccccagau

SEQ ID NO: 120866 - RNA, 57 nt, Mus musculus
aauguuuuuaucucccuuugauuuuagaaagaauaaagcuguagaguucaaguaguc

SEQ ID NO: 120867 - RNA, 54 nt, Mus musculus
aggaguuugaguaugcugggaaagcagucuaccauggaucuagucaucaccccc

SEQ ID NO: 120868 - RNA, 47 nt, Mus musculus
aaucugccugccucugccucccaagugccaccaccgccuggcccccu

SEQ ID NO: 120869 - RNA, 42 nt, Mus musculus
guauggacuacaugagucuuaaaaaaacaaagggggccaggc

SEQ ID NO: 120870 - RNA, 46 nt, Mus musculus
cccaacuauuucuccaguuaauguuuugucuuuuuuaaaugcauaa

SEQ ID NO: 120871 - RNA, 45 nt, Mus musculus
aaauguuugucuauaagacuguaauaguuuuacaaagagcccuau

SEQ ID NO: 120872 - RNA, 46 nt, Mus musculus
gugucagucuuuaaucccagcacucaggagguagaggcaggcagau

SEQ ID NO: 120873 - RNA, 33 nt, Mus musculus
cugcccacaucugugaugcucccugagccuugg

SEQ ID NO: 120874 - RNA, 45 nt, Mus musculus
guaguaaccacuccccacugcaaaaagaaucuucucugaaccaag

SEQ ID NO: 120875 - RNA, 49 nt, Mus musculus
aagaaggcaguuugacaugaccauuuaguggaacagcagcaguuaagcc

SEQ ID NO: 120876 - RNA, 71 nt, Mus musculus
gggugaagggagagaggggagagagaggauagaaaggagagagagaggagagagggagagacagagagaga

SEQ ID NO: 120877 - RNA, 46 nt, Mus musculus
agcuauaugcuaggauccacucugacaaaucucuccagagccacag

SEQ ID NO: 120878 - RNA, 45 nt, Mus musculus
gaagaaaugggguuacuuuaugggauaaauaaaauguucuggaga

SEQ ID NO: 120879 - RNA, 41 nt, Mus musculus
cuuguuuguuugcuuguguaaagucuuccuauguugcccag

SEQ ID NO: 120880 - RNA, 46 nt, Mus musculus
aagaccuugacuuucuucgagaucaguuuacuaccacagaagucag

SEQ ID NO: 120881 - RNA, 46 nt, Mus musculus
aaaguuuaaagguagaauaauaaauuagaaauguaaagauguggag

SEQ ID NO: 120882 - RNA, 26 nt, Mus musculus
uuuugcugugguaaaagucugaccag

SEQ ID NO: 120883 - RNA, 45 nt, Mus musculus
aaaggaguaucuccaaguaaauaaagagaaaucauuccagguagg

SEQ ID NO: 120884 - RNA, 45 nt, Mus musculus
auuuuccuacuacaugauacauguuugggagacuucaguuccugc

SEQ ID NO: 120885 - RNA, 46 nt, Mus musculus
auaguagacaggcauuagaguauguucuaaugaaucuaaacuccau

SEQ ID NO: 120886 - RNA, 44 nt, Mus musculus
uuaaagauugaucuaauuuucacugauuuuuuuuuucacagcaa

SEQ ID NO: 120887 - RNA, 46 nt, Mus musculus
ugcugcuuuuguuuuauuuuaucuguuauaagacaacuccuaacug

SEQ ID NO: 120888 - RNA, 46 nt, Mus musculus
uauacuuacuugggaucaaaguguuauggaugucaauagcccucau

SEQ ID NO: 120889 - RNA, 45 nt, Mus musculus
gcuaagguaauuuuuauauuauguaacaguuuuccaaagcaccuc

SEQ ID NO: 120890 - RNA, 46 nt, Mus musculus
aagaguuguaagcuuuuuuauucaugauaaaauuuacauaggacag

SEQ ID NO: 120891 - RNA, 26 nt, Mus musculus
aauauaaaauaacuaguauauuuuaa

SEQ ID NO: 120892 - RNA, 46 nt, Mus musculus
guggagauguuuaaauucuacuugaaguccuuaaccaaccaaccuu

SEQ ID NO: 120893 - RNA, 46 nt, Mus musculus
caugucugugcuuguuuugcacugauguggcauaaguugcccaaag

SEQ ID NO: 120894 - RNA, 47 nt, Mus musculus
gaggguacaggagaggagaggaagaaagggagaagaggggaaggagg

SEQ ID NO: 120895 - RNA, 46 nt, Mus musculus
uaugugcaaauuaaacaaugugcuuaaaacaaccagcaaauaagag

SEQ ID NO: 120896 - RNA, 46 nt, Mus musculus
agggaaaaaaacaauagcauaacaaaaauaaagaagaugucaucag

SEQ ID NO: 120897 - RNA, 46 nt, Mus musculus
aagaaauacaggagaacagugcuaaacagguagaagcccuuaaaga

SEQ ID NO: 120898 - RNA, 46 nt, Mus musculus
auggcaacacaguuuaacccuuaauaguuguuguaugauuuguaga

SEQ ID NO: 120899 - RNA, 51 nt, Mus musculus
aucuuuuacguccuguagcuuugcuauacugcuccagucacaugcugccau

SEQ ID NO: 120900 - RNA, 46 nt, Mus musculus
uguuuuucacagcaacaggaaaguagcuaauacaaauauauagcag

SEQ ID NO: 120901 - RNA, 42 nt, Mus musculus
cacuuccauacugcaaggaagucaggacuggaacucaagcag

SEQ ID NO: 120902 - RNA, 46 nt, Mus musculus
cuaccagcccagagauggcaccacccacaaggacccuucccccuug

SEQ ID NO: 120903 - RNA, 46 nt, Mus musculus
uuccaucaaauugaaagagagcaaacagggaaguacauggggauga

SEQ ID NO: 120904 - RNA, 46 nt, Mus musculus
uuuagggccauccacuggcauguggucaaccuaugagggacugcau

SEQ ID NO: 120905 - RNA, 79 nt, Mus musculus
uagcuaagcagcuauugcaguugauggcuccuggagaagagaaagucaguuuucuucagagaugcagucccucauaggu

SEQ ID NO: 120906 - RNA, 45 nt, Mus musculus
ccaagagggaccuuacugaaaaguuauugaauuuaaagaacaaua

SEQ ID NO: 120907 - RNA, 45 nt, Mus musculus
gaaugugucauggauaugugaauaagaaguagggagaaggguaag

SEQ ID NO: 120908 - RNA, 46 nt, Mus musculus
auuaucagacucccuugggcuguauggauaauagacugguagggaa

SEQ ID NO: 120909 - RNA, 45 nt, Mus musculus
aauguuguucauucuucagaagagguuaucaaaucagagaggaga

SEQ ID NO: 120910 - RNA, 53 nt, Mus musculus
cgagaugccauuaauguggagaaagccuucacagaccugacaagagacauaua

SEQ ID NO: 120911 - RNA, 49 nt, Mus musculus
uuugacauuaccaaccgcagguccuuccagaauguccaugagugguuag

SEQ ID NO: 120912 - RNA, 45 nt, Mus musculus
cgguugguaaugucaaauaagagaagaccaccuacugaauuccug

SEQ ID NO: 120913 - RNA, 46 nt, Mus musculus
aauaaaaacuuuguagagaacaguuugaacuaaaguaagguagaac

SEQ ID NO: 120914 - RNA, 64 nt, Mus musculus
gauguauauugacuucuuucuauauauccguuuauauuuguggggaagaaaagacagagggaga

SEQ ID NO: 120915 - RNA, 82 nt, Mus musculus
auucauuaucacauuauuugaaccacaacuccaucaaucugcuuuugguagcuaauaaauaacuugaaauugaucacuguau

SEQ ID NO: 120916 - RNA, 45 nt, Mus musculus
gaaagaggacuucccgguucuuuucgcgaugcugccagggugaca

SEQ ID NO: 120917 - RNA, 41 nt, Mus musculus
gagguucaggugggagugcaccacgggcccgcgcgagcagu

SEQ ID NO: 120918 - RNA, 43 nt, Mus musculus
acauuauaugaaacuuucugccucuaaaggauggcauccuuua

SEQ ID NO: 120919 - RNA, 46 nt, Mus musculus
gcuucuguggugcucacucucaccugugcagacuaaguuccuaagu

SEQ ID NO: 120920 - RNA, 46 nt, Mus musculus
aaguucucuaucuuuguggggucuuuuuguggauuagguaucagag

SEQ ID NO: 120921 - RNA, 46 nt, Mus musculus
cuuuuauaaacccaugcaugaugucagcauuuacauuaaaacagga

SEQ ID NO: 120922 - RNA, 42 nt, Mus musculus
uauacugccaaaacucuucaggcugcuggcugugcacccggu

SEQ ID NO: 120923 - RNA, 42 nt, Mus musculus
caaacaaaauaaaacaaagaccuauguguaaagccaccuuca

SEQ ID NO: 120924 - RNA, 46 nt, Mus musculus
uagguaggccaggguuacacagagaaaccaaguccuaagaaaagag

SEQ ID NO: 120925 - RNA, 46 nt, Mus musculus
ccaucggucagagacacuaagcugggcccaaauaaaagaagaaaau

SEQ ID NO: 120926 - RNA, 52 nt, Mus musculus
gcgaagaccaaaaaauacagaaaaagcacccaaaacagacgaaaugccaguu

SEQ ID NO: 120927 - RNA, 55 nt, Mus musculus
agagucaaugcucuaaaauacugcacaaacuaauucucagacauuaacugcagga

SEQ ID NO: 120928 - RNA, 24 nt, Mus musculus
aagaugaccaagauggaaaugguu

SEQ ID NO: 120929 - RNA, 42 nt, Mus musculus
gaugacuggaugacucucuggggcagcauucaccggaacuca

SEQ ID NO: 120930 - RNA, 82 nt, Mus musculus
uggaauaauuguuccuucucuugauguguccuuguucucaggucagguugauauggcuaggcggccugcuggcgagauagug

SEQ ID NO: 120931 - RNA, 45 nt, Mus musculus
ugguaaagggcugggguguaguggaggugggguggagaauuuagg

SEQ ID NO: 120932 - RNA, 83 nt, Mus musculus
uccagcacagguagguagguggcugugugggaggacacagauagaaggauccaugugugagagugacuuggggacuucggagg

SEQ ID NO: 120933 - RNA, 46 nt, Mus musculus
uugcaagccaguuguuauuacccuguguuagugagcauguggagag

SEQ ID NO: 120934 - RNA, 62 nt, Mus musculus
uguacauauuggugauccagaggcagagaauagguagguagguagguagguagguagguagg

SEQ ID NO: 120935 - RNA, 46 nt, Mus musculus
acuacucccaaaccuucacacacacacacacucacucacaccagcc

SEQ ID NO: 120936 - RNA, 41 nt, Mus musculus
uguuucugugugugugugugugugugugugugagagagaga

SEQ ID NO: 120937 - RNA, 42 nt, Mus musculus
agagagagagagagagagagagauagggagagagagagaggg

SEQ ID NO: 120938 - RNA, 42 nt, Mus musculus; identical to SEQ ID NO: 120929

SEQ ID NO: 120939 - RNA, 82 nt, Mus musculus; identical to SEQ ID NO: 120930

SEQ ID NO: 120940 - RNA, 46 nt, Mus musculus
auaaagggcugggguguaguggaggugggguggagaauuuagggag

SEQ ID NO: 120941 - RNA, 83 nt, Mus musculus; identical to SEQ ID NO: 120932

SEQ ID NO: 120942 - RNA, 46 nt, Mus musculus; identical to SEQ ID NO: 120933

SEQ ID NO: 120943 - RNA, 46 nt, Mus musculus
gaacuguacauauuggugauccagaggcagagaauagguagguagg

SEQ ID NO: 120944 - RNA, 46 nt, Mus musculus; identical to SEQ ID NO: 120935

SEQ ID NO: 120945 - RNA, 46 nt, Mus musculus; identical to SEQ ID NO: 120935

SEQ ID NO: 120946 - RNA, 41 nt, Mus musculus
ggccuucuuggcugugugccuggaccuggaaaguugagaga

SEQ ID NO: 120947 - RNA, 42 nt, Mus musculus; identical to SEQ ID NO: 120929

SEQ ID NO: 120948 - RNA, 82 nt, Mus musculus; identical to SEQ ID NO: 120930

SEQ ID NO: 120949 - RNA, 46 nt, Mus musculus; identical to SEQ ID NO: 120940

SEQ ID NO: 120950 - RNA, 83 nt, Mus musculus; identical to SEQ ID NO: 120932

SEQ ID NO: 120951 - RNA, 46 nt, Mus musculus; identical to SEQ ID NO: 120933

SEQ ID NO: 120952 - RNA, 62 nt, Mus musculus; identical to SEQ ID NO: 120934

SEQ ID NO: 120953 - RNA, 46 nt, Mus musculus; identical to SEQ ID NO: 120935

SEQ ID NO: 120954 - RNA, 42 nt, Mus musculus; identical to SEQ ID NO: 120929

SEQ ID NO: 120955 - RNA, 82 nt, Mus musculus; identical to SEQ ID NO: 120930

SEQ ID NO: 120956 - RNA, 46 nt, Mus musculus; identical to SEQ ID NO: 120940

SEQ ID NO: 120957 - RNA, 83 nt, Mus musculus; identical to SEQ ID NO: 120932

SEQ ID NO: 120958 - RNA, 23 nt, Mus musculus
gugaccuagaaggucaggagagu

SEQ ID NO: 120959 - RNA, 62 nt, Mus musculus; identical to SEQ ID NO: 120934

SEQ ID NO: 120960 - RNA, 46 nt, Mus musculus; identical to SEQ ID NO: 120935

SEQ ID NO: 120961 - RNA, 45 nt, Mus musculus
guggaaggccuagugcucaggcuccauguuuguggcuggugguug

SEQ ID NO: 120962 - RNA, 41 nt, Mus musculus; identical to SEQ ID NO: 120946

SEQ ID NO: 120963 - RNA, 42 nt, Mus musculus; identical to SEQ ID NO: 120929

SEQ ID NO: 120964 - RNA, 53 nt, Mus musculus
uuguucucaggucagguugauauggcuaggcggccugcuggcgagauaguggg

SEQ ID NO: 120965 - RNA, 46 nt, Mus musculus
guaaugggcugggguguaguggaggugggguggagaauuuagggag

SEQ ID NO: 120966 - RNA, 83 nt, Mus musculus; identical to SEQ ID NO: 120932

SEQ ID NO: 120967 - RNA, 46 nt, Mus musculus; identical to SEQ ID NO: 120933

SEQ ID NO: 120968 - RNA, 46 nt, Mus musculus
gaacuguacauauuggugauccagaggcagagaauagguagguaug

SEQ ID NO: 120969 - RNA, 41 nt, Mus musculus
ugccccccaggaagagaaguaacugacuaucagcuuuagag

SEQ ID NO: 120970 - RNA, 46 nt, Mus musculus
ucucucaacuuuccagguccaggcacacagccaagaaggcccuccc

SEQ ID NO: 120971 - RNA, 42 nt, Mus musculus; identical to SEQ ID NO: 120929

SEQ ID NO: 120972 - RNA, 82 nt, Mus musculus; identical to SEQ ID NO: 120930

SEQ ID NO: 120973 - RNA, 45 nt, Mus musculus; identical to SEQ ID NO: 120931

SEQ ID NO: 120974 - RNA, 41 nt, Mus musculus
uccagcacagguagguagguggcugugugggaggacacaga

SEQ ID NO: 120975 - RNA, 46 nt, Mus musculus; identical to SEQ ID NO: 120933

SEQ ID NO: 120976 - RNA, 46 nt, Mus musculus; identical to SEQ ID NO: 120943

SEQ ID NO: 120977 - RNA, 45 nt, Mus musculus
ucucugucucucaccaucucucucuaccucucucucucucccucu

SEQ ID NO: 120978 - RNA, 45 nt, Mus musculus
agugcucaggcuccauguuuguggcuggugguugcagguuggcgu

SEQ ID NO: 120979 - RNA, 42 nt, Mus musculus; identical to SEQ ID NO: 120929

SEQ ID NO: 120980 - RNA, 53 nt, Mus musculus; identical to SEQ ID NO: 120964

SEQ ID NO: 120981 - RNA, 45 nt, Mus musculus; identical to SEQ ID NO: 120931

SEQ ID NO: 120982 - RNA, 23 nt, Mus musculus
ucugaguugcaugcaugcccagu

SEQ ID NO: 120983 - RNA, 46 nt, Mus musculus; identical to SEQ ID NO: 120933

SEQ ID NO: 120984 - RNA, 45 nt, Mus musculus
agguccaucuugauucaggguuuggcaguucuuaugguguugagc

SEQ ID NO: 120985 - RNA, 44 nt, Mus musculus
ucucugucucucaccaucucucucuaccucucucucucucuccc

SEQ ID NO: 120986 - RNA, 46 nt, Mus musculus
ucuuugaauauggugucucucugccacuguacuguccacgccaggg

SEQ ID NO: 120987 - RNA, 42 nt, Mus musculus
caaguugcacggcucgcggcgaggugaguacacgccgggcag

SEQ ID NO: 120988 - RNA, 42 nt, Mus musculus
cauccucgaggcgcgggccggcgcucccggaacacgguggac

SEQ ID NO: 120989 - RNA, 45 nt, Mus musculus
ucaguuuccgaggcgcaaacugucagggaaguccgggagcccccu

SEQ ID NO: 120990 - RNA, 46 nt, Mus musculus
gggagcaggaguuuauguaggaggggugcgccuuugaacgucggug

SEQ ID NO: 120991 - RNA, 42 nt, Mus musculus
cgcuggugcuggauggggccugggcuucacgugcgugaccag

SEQ ID NO: 120992 - RNA, 41 nt, Mus musculus
ucugguugcauguguauauguaugaaggagguggaugucag

SEQ ID NO: 120993 - RNA, 45 nt, Mus musculus
ggauacuaugaaaaagcccaccuacuugaccaguugcuggaccau

SEQ ID NO: 120994 - RNA, 44 nt, Mus musculus
gcccugaguucaguccccauuuguagaugucauuucagcguuga

SEQ ID NO: 120995 - RNA, 46 nt, Mus musculus
ugucaaucaguauuaguuauuucuuucucaucaucuuggaaggcag

SEQ ID NO: 120996 - RNA, 45 nt, Mus musculus
gcuaggauuaaagucaggccacuuaccagcaugccuagcccccac

SEQ ID NO: 120997 - RNA, 45 nt, Mus musculus
guguugcaaggacuuugcuggcccaacuaccucuccagcccccag

SEQ ID NO: 120998 - RNA, 42 nt, Mus musculus
guuauguggauguguuagcgaugucauuuguaagagaggaca

SEQ ID NO: 120999 - RNA, 41 nt, Mus musculus
uagguacaauaagaguuucagaugcuuauagaaaaaaggga

SEQ ID NO: 121000 - RNA, 46 nt, Mus musculus
ugggcagguaguccaaaguuuuacuauaagauaacaagcugugcaa

SEQ ID NO: 121001 - RNA, 53 nt, Mus musculus
uguuuuguuuccucaaauuuuagaacccuuucuagauuuaauuaaacuuucgg

SEQ ID NO: 121002 - RNA, 46 nt, Mus musculus
agcugagcuacagcacuagcccuggguguuugaaaaucuugugaag

SEQ ID NO: 121003 - RNA, 45 nt, Mus musculus
gaagugucuauucaugaauaaacaaacaaugaauggccaaugcag

SEQ ID NO: 121004 - RNA, 46 nt, Mus musculus
accaaacaaacaaaaaauacugcuuuaaaaagagcccaggcugugc

SEQ ID NO: 121005 - RNA, 45 nt, Mus musculus
cuggguuugauuucuugguggcaagaagaaucuauuggggauccc

SEQ ID NO: 121006 - RNA, 42 nt, Mus musculus
aucuuggagcucauugauugaaccaggcuugcuggccagcaa

SEQ ID NO: 121007 - RNA, 45 nt, Mus musculus
gaauagucauagucagcaauuucucgugauuauauuaggugugga

SEQ ID NO: 121008 - RNA, 45 nt, Mus musculus
uggauaaccagcuggcuugggcugcugguucauugagagauccua

SEQ ID NO: 121009 - RNA, 45 nt, Mus musculus
gguccaugcugguuuuuaugcaaauaggauuuaggggcaagggca

SEQ ID NO: 121010 - RNA, 42 nt, Mus musculus
ugcuguuauaggccaggcuggccuggaacuuaccuagcccag

SEQ ID NO: 121011 - RNA, 46 nt, Mus musculus
uuacuuuuuauuuuaauuuuuguuuacauuuuugagauggggucuc

SEQ ID NO: 121012 - RNA, 46 nt, Mus musculus
uacucuuccccacccuuuuuagugcauuguaucauugauguaggag

SEQ ID NO: 121013 - RNA, 59 nt, Mus musculus
auugauuguuauacaaaagcuauuuuuuagaguaagacaaguuuuucauaccaaaaccc

SEQ ID NO: 121014 - RNA, 46 nt, Mus musculus
gcuuccaguugaauauauuuuauuguuauuuguuugugugccaaag

SEQ ID NO: 121015 - RNA, 45 nt, Mus musculus
uccucuucucccaguacaccugccuuacuucccagucucccccag

SEQ ID NO: 121016 - RNA, 46 nt, Mus musculus
cccaguaggaggaaaagguucucaaaaacaggcaauugagacccua

SEQ ID NO: 121017 - RNA, 46 nt, Mus musculus
aagccuuugacagaguacaacccuccauguuaaaagucuuggcaag

SEQ ID NO: 121018 - RNA, 46 nt, Mus musculus
auuaacucaaagaaaucaguagccuuccuuuacaaauaagacaggu

SEQ ID NO: 121019 - RNA, 45 nt, Mus musculus
auccaauuuuaaauaaacagucaguucagauauucaguggccgag

SEQ ID NO: 121020 - RNA, 46 nt, Mus musculus
aguugugucuaccugugcuuuacuaaauagaguuucacugccuuag

SEQ ID NO: 121021 - RNA, 45 nt, Mus musculus
acaggggauugacuaugcaggagaugauauuauuggcaccagagc

SEQ ID NO: 121022 - RNA, 49 nt, Mus musculus
uuguugaaggucagggaggcuguuagugccuauguuuuggcuguuaaga

SEQ ID NO: 121023 - RNA, 70 nt, Mus musculus
gagggaaagccuuucuaucaaaugacucagagagcacuaggccacuguuuaucgaugagcaacccccagc

SEQ ID NO: 121024 - RNA, 47 nt, Mus musculus
ucuuugccuuaacucauucagccauaggcuauaaccucuugcaggaa

SEQ ID NO: 121025 - RNA, 48 nt, Mus musculus
acucagggccugucuuaacugagaugccacuggaaaguauaaaauaca

SEQ ID NO: 121026 - RNA, 47 nt, Mus musculus
accuuaucuuccauuugaucuggggugaucuuugccucaugaagucc

SEQ ID NO: 121027 - RNA, 52 nt, Mus musculus
uauucuccuccccccuccuccuuauugucuuauugugguugguuuauuuucu

SEQ ID NO: 121028 - RNA, 46 nt, Mus musculus
cacaugccuugguauugagauugagugacugugugagggcaggagu

SEQ ID NO: 121029 - RNA, 47 nt, Mus musculus
cugguucauuuacugauuugugcaagugagacacagaauaggaguag

SEQ ID NO: 121030 - RNA, 49 nt, Mus musculus
guggcuuuggguuuaaguaagcaagaauuuauuuuguguguugagacag

SEQ ID NO: 121031 - RNA, 71 nt, Mus musculus
uuauucuuggguggauaauaauagaugaggcaggcuggugaggugggauaggagccaagaggcccaggaaa

SEQ ID NO: 121032 - RNA, 45 nt, Mus musculus
uggccuccugacaggaaagugaaacugcaccucaagaggacagaa

SEQ ID NO: 121033 - RNA, 55 nt, Mus musculus
uagccuagccagggauggggggaagggggaggggaagguguaggcauuggaagga

SEQ ID NO: 121034 - RNA, 44 nt, Mus musculus
acaauuaacuuguuucugugagcagauccugucucaagggggau

SEQ ID NO: 121035 - RNA, 45 nt, Mus musculus
gcacaggcuaaucugucaccuguuuuuguacagauaaugaaccag

SEQ ID NO: 121036 - RNA, 45 nt, Mus musculus
uuuggaggugagcuggaaaccaugugaccgguuaaagugauguag

SEQ ID NO: 121037 - RNA, 41 nt, Mus musculus
cuuagggaaaucugugguguuuacugucuaggcugggggag

SEQ ID NO: 121038 - RNA, 46 nt, Mus musculus
uauuguuuuucaaagcauucaagauggagggacacuaaggcacaaa

SEQ ID NO: 121039 - RNA, 46 nt, Mus musculus
cucuaguuuuggcugaaccaaggagauaugauuucacaaagcuuag

SEQ ID NO: 121040 - RNA, 41 nt, Mus musculus
gugaugugucugcagcaggcugaagguaggagacauggaau

SEQ ID NO: 121041 - RNA, 46 nt, Mus musculus
cauauuacuucuuccugguaagggcauucauuuauaucauccagag

SEQ ID NO: 121042 - RNA, 116 nt, Mus musculus
ggaccuuuggggaauuggaugucuuaagugucuaugaggaaagaauguuuaagauagggggucucaagaaugugugugugugugugagagagagaggggggagaagaauaggaagg

SEQ ID NO: 121043 - RNA, 45 nt, Mus musculus
aguauucuguggacugccuaaaguuaauucuugaguaugcuguac

SEQ ID NO: 121044 - RNA, 46 nt, Mus musculus
gguagguuucugagauggaauuauagaggugugcuuuuuagaaagg

SEQ ID NO: 121045 - RNA, 47 nt, Mus musculus
aaacugugcagucucucaggaagugcuauggaacuacccugugcaag

SEQ ID NO: 121046 - RNA, 45 nt, Mus musculus
uuuccuuauguauuuuguacagagaaaauaauuuuucccaaggag

SEQ ID NO: 121047 - RNA, 61 nt, Mus musculus
ugcuucagagggaggaugcugaaauauguagugaugugugaguguuaugcuacacuccugc

SEQ ID NO: 121048 - RNA, 45 nt, Mus musculus
uccaucacuucuguguguguguuguguauguuguguucaugcaga

SEQ ID NO: 121049 - RNA, 45 nt, Mus musculus
uuucucguucuaauucugucauggauguuuuuaguuuugguggua

SEQ ID NO: 121050 - RNA, 45 nt, Mus musculus
uuuauaaugaaguuuauaaaucaaauuuaaagugugugugugugu

SEQ ID NO: 121051 - RNA, 46 nt, Mus musculus
cucaucuguugaugucagagugaagcuaauugugauugggguaggg

SEQ ID NO: 121052 - RNA, 45 nt, Mus musculus
cucagaagagggaacuucaguugccuccuuaagaugagacuguag

SEQ ID NO: 121053 - RNA, 45 nt, Mus musculus
uaaagaaggaugugugggauguucuuuuguauggguuuccaggga

SEQ ID NO: 121054 - RNA, 50 nt, Mus musculus
gccuagaacaugcuacucagugagcaggagggagagagagaauuggcagg

SEQ ID NO: 121055 - RNA, 45 nt, Mus musculus
cugugggagagucagaaaaaugcuuaaugaaguaaguuuugggag

SEQ ID NO: 121056 - RNA, 55 nt, Mus musculus
agaaggaagggugcuggaggagccuagacauugaaaucugagaacaggaucacag

SEQ ID NO: 121057 - RNA, 45 nt, Mus musculus
cuauaccagacuuuuuguaugagaccuguauauuugaacagcaag

SEQ ID NO: 121058 - RNA, 45 nt, Mus musculus
gugugagcuuaugcaagugccuucagaggccaaaagaggcuacca

SEQ ID NO: 121059 - RNA, 51 nt, Mus musculus
uauuaaaagaaaacuauuaugaugaugaugaugaugugugugggagaggaa

SEQ ID NO: 121060 - RNA, 49 nt, Mus musculus
ugcucaguggucuuuaucugcucagccaucuaagaaauugcugccacag

SEQ ID NO: 121061 - RNA, 38 nt, Mus musculus
aggcaugggaguuugaugaucccuucguuuuauuauaa

SEQ ID NO: 121062 - RNA, 46 nt, Mus musculus
uggugcaugccuuuaauccccacucuggggaggcagaggcaggcag

SEQ ID NO: 121063 - RNA, 47 nt, Mus musculus
ucccaggcccuggccuagaauaagucuuaauuaccauggcaauuaga

SEQ ID NO: 121064 - RNA, 45 nt, Mus musculus
gccucagagggaagacuggggagggugucaggggaugguggccau

SEQ ID NO: 121065 - RNA, 77 nt, Mus musculus
ucauuucuaagagccccuucacuugugaguuugguuguguuaaagggaguuacaagccugggauccuagaaauagcc

SEQ ID NO: 121066 - RNA, 54 nt, Mus musculus
gggcauggugauuggaguuggaugaaaguguucauugaaggcaugguuaaaggg

SEQ ID NO: 121067 - RNA, 49 nt, Mus musculus
cgaguucccccuggccucgggcuucugagcaaagcuaaugagagagaga

SEQ ID NO: 121068 - RNA, 62 nt, Mus musculus
uuacauuuaggucauuuucauagaauguaggucacucaauucaauaggagaguaugcuguuu

SEQ ID NO: 121069 - RNA, 85 nt, Mus musculus
uuacuuuuuugguguguauauauguuguguguuggggagguauuuguacuaguugguguaugugcgugcauguuugcaugugggu

SEQ ID NO: 121070 - RNA, 45 nt, Mus musculus
gguacuucuggucucugcuagcuggaagccuaggaugcuguugca

SEQ ID NO: 121071 - RNA, 46 nt, Mus musculus
aaaggagggaacaagugaggcagguacugucaaaaaaugggccaag

SEQ ID NO: 121072 - RNA, 42 nt, Mus musculus
uguaugaagaauugacugagucagcugaaaaaaaauuccaag

SEQ ID NO: 121073 - RNA, 42 nt, Mus musculus
gaagcaguagcugagagcuuacauccaaucacuagcucaagg

SEQ ID NO: 121074 - RNA, 42 nt, Mus musculus
auaaaacagcgcagguuuacugucauacaguuuggaggucac

SEQ ID NO: 121075 - RNA, 46 nt, Mus musculus
gcuaccacaucccuuaguccauagccccuuccacucugaaagccag

SEQ ID NO: 121076 - RNA, 41 nt, Mus musculus
gaauugguuugugugauaugaacugcuuuagaagacuagua

SEQ ID NO: 121077 - RNA, 45 nt, Mus musculus
cuuagaguccuuuuaucuguaacuuauauucccccuugccaggaa

SEQ ID NO: 121078 - RNA, 46 nt, Mus musculus
gaauucuaugugguuauagucauaggacuuaauaucugguggguag

SEQ ID NO: 121079 - RNA, 46 nt, Mus musculus
aagagacagaaagacagagauggaagcuugcuuuauuuuuagccag

SEQ ID NO: 121080 - RNA, 46 nt, Mus musculus
ucugagagaacgggauucaauuagucacucuguucacacagauaag

SEQ ID NO: 121081 - RNA, 42 nt, Mus musculus
uaccaacauuuuuuacaauuggcugauuuuacuagcaaaagg

SEQ ID NO: 121082 - RNA, 46 nt, Mus musculus
ugaguucauuuuguguuugucaucuacuauuggauguggggccuuc

SEQ ID NO: 121083 - RNA, 46 nt, Mus musculus
gcucauugucuagcuguauuuuugucuguguguuguucccaccugc

SEQ ID NO: 121084 - RNA, 45 nt, Mus musculus
uuugcucacacgugugcuaauacauacauaaaauacuuggcuugu

SEQ ID NO: 121085 - RNA, 45 nt, Mus musculus
gcaucuguguguccuuaucauuuucuuuaacaaacuucacuuaga

SEQ ID NO: 121086 - RNA, 46 nt, Mus musculus
gugguguagagugaaaaacacagcagcuguggaagcagaugaguga

SEQ ID NO: 121087 - RNA, 45 nt, Mus musculus
ccacuccucuggucaccccgcccucauucccaacccuacccccag

SEQ ID NO: 121088 - RNA, 46 nt, Mus musculus
gguuugggguuuggagagaggaugauuauggcauagggcuucguag

SEQ ID NO: 121089 - RNA, 42 nt, Mus musculus
ugauuaauugauugacugacugauuaaugugugagggcacag

SEQ ID NO: 121090 - RNA, 46 nt, Mus musculus
aaauacuguaagaagcauuaaacauuagucuucuuauaucaaacac

SEQ ID NO: 121091 - RNA, 42 nt, Mus musculus
uuuuuugguagauuuccaugcugcccaugaaacacagagcaa

SEQ ID NO: 121092 - RNA, 46 nt, Mus musculus
guguauaguuauugguuccaugaugcugaaaaccaugaccaaauag

SEQ ID NO: 121093 - RNA, 46 nt, Mus musculus
uggaaaguaaauagcccaguauacucagaugauaccaaaaacaaag

SEQ ID NO: 121094 - RNA, 42 nt, Mus musculus
gagccuagcaccaccucugucggguaguggacuuuagggaag

SEQ ID NO: 121095 - RNA, 45 nt, Mus musculus
ugggcugaggauggugacaaaccuggauccagggaaauggaggau

SEQ ID NO: 121096 - RNA, 45 nt, Mus musculus
cagagggaagcuuugagugcgcauggguaugucauuguaguccac

SEQ ID NO: 121097 - RNA, 41 nt, Mus musculus
caagauggggauguuuguaaagacaagcuuguaauauggga

SEQ ID NO: 121098 - RNA, 45 nt, Mus musculus
caguugggguuggcuugauguccuucgggugguuaaaaugcgaua

SEQ ID NO: 121099 - RNA, 46 nt, Mus musculus
uuaucagauugcucucuucaaaggucaaggaacugguaccaugggg

SEQ ID NO: 121100 - RNA, 46 nt, Mus musculus
gaauggggggaggguucuggguucaauagaaagacccugaaaagag

SEQ ID NO: 121101 - RNA, 45 nt, Mus musculus
uaaauagaaugugauugaaaugaacaaaaaauaauguagucaaua

SEQ ID NO: 121102 - RNA, 35 nt, Mus musculus
agcuaauuguccuguuuucucuuuacuucuugcca

SEQ ID NO: 121103 - RNA, 45 nt, Mus musculus
uugccauaguuucaugaguaaaaagaaaauugaggaugguggccu

SEQ ID NO: 121104 - RNA, 46 nt, Mus musculus
ucccuggaagggaaauugcucaacuacuaacaacauggugcauggc

SEQ ID NO: 121105 - RNA, 45 nt, Mus musculus
ccuuuguuggugugugugugugugugugugugugugugucugugu

SEQ ID NO: 121106 - RNA, 46 nt, Mus musculus
ggcugacugaccucaguuuacgcccagggagggauacacaugguag

SEQ ID NO: 121107 - RNA, 46 nt, Mus musculus
auuugacuuaggaugagaagaaugucuaaaggaacaggaggguuga

SEQ ID NO: 121108 - RNA, 44 nt, Mus musculus
guagggugguccuggacuuugugagcaccucucaaguucuguga

SEQ ID NO: 121109 - RNA, 46 nt, Mus musculus
agcgacgaggugaacuuucugguauaucgcuaccuccaggaaucag

SEQ ID NO: 121110 - RNA, 46 nt, Mus musculus
agggcaguuggugcucuuacccgcuaagccaucucaccagccccag

SEQ ID NO: 121111 - RNA, 46 nt, Mus musculus
acauuagccaguccaacaucaaugguacacuagugccaccggcugc

SEQ ID NO: 121112 - RNA, 42 nt, Mus musculus
cuuuucgggagaaacuugcccagcagcaagccaaugcagcag

SEQ ID NO: 121113 - RNA, 46 nt, Mus musculus
agcggcuacaacaccagcagcugcugcucagcaaaacccaccaaag

SEQ ID NO: 121114 - RNA, 48 nt, Mus musculus
ugaaauuccaccgaguaaagccacaguccuucgaggccaugagucuga

SEQ ID NO: 121115 - RNA, 103 nt, Mus musculus
aacgggggcuccacacagcuugugcugaggcacuguauacgugaagguggacaugauguucccaguaauaaggaugucacuucauuggacuggaauguaaguu

SEQ ID NO: 121116 - RNA, 48 nt, Mus musculus
acacuguuggcaacagguuccuaugaugguuuugcaagaauauggaca

SEQ ID NO: 121117 - RNA, 89 nt, Mus musculus
gguaaccuagccagcaccuuaggucaacauaaaggucccaucuuugcuuugaaguggaacaaaaaggggaauuauauuuugagugcugg

SEQ ID NO: 121118 - RNA, 41 nt, Mus musculus
ccauauuacugccugugaaaugcacaguguacauggacuua

SEQ ID NO: 121119 - RNA, 63 nt, Mus musculus
ugaccuccaggcucacagcaaagagauauauaccaucaaguggagucccacaggaccagccac

SEQ ID NO: 121120 - RNA, 46 nt, Mus musculus
cauaguuguuuaauuuuguuugccuacaaccucugaauaccugcuu

SEQ ID NO: 121121 - RNA, 46 nt, Mus musculus
caggguggggggauggcuuaaucuagugaaaguuuuuagcacaaag

SEQ ID NO: 121122 - RNA, 45 nt, Mus musculus
acuuaaaaugccagucaaccaagucccagaaccaaagugccagag

SEQ ID NO: 121123 - RNA, 45 nt, Mus musculus
ugucuauaguguagcguucagccccgacgggaaguauuuggccag

SEQ ID NO: 121124 - RNA, 42 nt, Mus musculus
cugucacuuuagaaaugcugcccuuuguggaaagguccugug

SEQ ID NO: 121125 - RNA, 46 nt, Mus musculus
cuccagauuucaaauccagcacugaagggugggaagaaagaauaag

SEQ ID NO: 121126 - RNA, 46 nt, Mus musculus
uucagaguggaagucucguccacagcuaccgaggaacaggcggcau

SEQ ID NO: 121127 - RNA, 46 nt, Mus musculus
uuuagaucuccgaaaguaaacacaaaauguagaaaacaaaaccauu

SEQ ID NO: 121128 - RNA, 46 nt, Mus musculus
gggcuccaaacugugugaacuugacuuguucgagucuacuuggaaa

SEQ ID NO: 121129 - RNA, 46 nt, Mus musculus
gugcaugguugguuuccauccagaacaggcucuaaugacugaacag

SEQ ID NO: 121130 - RNA, 46 nt, Mus musculus
cccuccuaucaauuuggauacuacaguugcuuuccaaaaagaccag

SEQ ID NO: 121131 - RNA, 45 nt, Mus musculus
acagaaaaaaaaaaaagacuuacuuauaagagaaagaaccuggag

SEQ ID NO: 121132 - RNA, 45 nt, Mus musculus
ccagcuacaucuuucucacaacaguguagcuaccgaugggcacuu

SEQ ID NO: 121133 - RNA, 28 nt, Mus musculus
auuggaacaguugccaccauuuuugcuc

SEQ ID NO: 121134 - RNA, 58 nt, Mus musculus
ucuggaggggguggaggcaaaauuucaucaaccacuggcccacgccaaggguuggcag

SEQ ID NO: 121135 - RNA, 45 nt, Mus musculus
aguuuccuuuaaccuggccucugagugguauggaauuugguauug

SEQ ID NO: 121136 - RNA, 42 nt, Mus musculus
ucuccccgucgucauccucuuucuucuucuccuuggcagcuu

SEQ ID NO: 121137 - RNA, 47 nt, Mus musculus
agccccagccuucucagccuccuccuccugggcagcaggagcuggcu

SEQ ID NO: 121138 - RNA, 46 nt, Mus musculus
cugguugcauuuuccuccuccuccaaaucagaagcccuuuccccag

SEQ ID NO: 121139 - RNA, 46 nt, Mus musculus
ucuugaugucaucauccuuggcagguuucuccaggcggcacgucag

SEQ ID NO: 121140 - RNA, 45 nt, Mus musculus; identical to SEQ ID NO: 25179

SEQ ID NO: 121141 - RNA, 56 nt, Mus musculus
ugaauaaaauauguuauaucucuuccugcgauuggaauguguuuaauacagcugcu

SEQ ID NO: 121142 - RNA, 47 nt, Mus musculus
guccaggaugcagcuaaggcaagaacagccugcacagcaauguacaa

SEQ ID NO: 121143 - RNA, 58 nt, Mus musculus; identical to SEQ ID NO: 25186

SEQ ID NO: 121144 - RNA, 83 nt, Mus musculus
gccuuucaucacccuccucugggcuuggucacccacuuuugcagacucuuuaauggcaauacaugaugggaugauaaacugug

SEQ ID NO: 121145 - RNA, 46 nt, Mus musculus
cccuuccgugcugcugagaggccggggagcuagagaugggagcugg

SEQ ID NO: 121146 - RNA, 24 nt, Mus musculus
ucacaacuggaaaauguauaaaga

SEQ ID NO: 121147 - RNA, 47 nt, Mus musculus
cucaugguuguaaggguuucacaggcagugaggggcggacgcuuaga

SEQ ID NO: 121148 - RNA, 85 nt, Mus musculus
gauucuuuuaaagguguugggaccugugcgcaagguuaguagugguagaaaugauugucguggaagugguuugcaaauaauuguu

SEQ ID NO: 121149 - RNA, 50 nt, Mus musculus
uaguuuacuaccgcguaucugcuuauaaaguggauuaaguaggauaggag

SEQ ID NO: 121150 - RNA, 49 nt, Mus musculus
cuuugucaauuuuuaucauuuauaauguauuuaggaguuuguaaacgga

SEQ ID NO: 121151 - RNA, 46 nt, Mus musculus
uaucuuuggcuggaaauucuagaaauguuuugcaguuugggaucuu

SEQ ID NO: 121152 - RNA, 46 nt, Mus musculus
cuguaugcauaagacuuguacaaguucaagacagaacaaagcccag

SEQ ID NO: 121153 - RNA, 107 nt, Mus musculus
accacacuccaguggaaggcagaauuuaauagggcagugauauccaggaguauuugggaagcacaaauggguuuugauaggauuuucuuuuaaaggacaugaaguug

SEQ ID NO: 121154 - RNA, 46 nt, Mus musculus
cuauacugccuaauaaagugacuaugacuaccaacuguguauccag

SEQ ID NO: 121155 - RNA, 45 nt, Mus musculus
ugcccguggcugguuuauaaagggccagaucaccucagauguacc

SEQ ID NO: 121156 - RNA, 91 nt, Mus musculus
ugcaaacaaacaaaaaauucucuuugagucccaggccagccuagacuacagggagcuucuauuuaacaaacaaacaaaaauaacaguaugg

SEQ ID NO: 121157 - RNA, 45 nt, Mus musculus
ugauacuuccaagcaugcuguggcaugcacauacacuccccauag

SEQ ID NO: 121158 - RNA, 45 nt, Mus musculus
uguguguguguguguguguaugacacauaauggcauuuguguggg

SEQ ID NO: 121159 - RNA, 36 nt, Mus musculus
cacugaacuuuaugcucugagauaaaagguaagagu

SEQ ID NO: 121160 - RNA, 42 nt, Mus musculus
auaaaaguuucucauuuuuaauauaguuauuuuuucucacag

SEQ ID NO: 121161 - RNA, 46 nt, Mus musculus
uuccguugcccuagguaucuaccucaucccagaaauguguuccagu

SEQ ID NO: 121162 - RNA, 46 nt, Mus musculus
ucuucccucccgucccugucccagcacacauuacuccuuucccuug

SEQ ID NO: 121163 - RNA, 45 nt, Mus musculus
uuucucugcuucccauuauauuuuucaccuuuacaguuaaacuca

SEQ ID NO: 121164 - RNA, 45 nt, Mus musculus
acucuuuucuuuacugauugagucaaggucuuucuauguggccca

SEQ ID NO: 121165 - RNA, 46 nt, Mus musculus
cauuuuaauuauaucuuauauauauacacacauacuagaaaccagu

SEQ ID NO: 121166 - RNA, 46 nt, Mus musculus
uggcaaagagccacaugcccuagucaaguauuaugucugccagucu

SEQ ID NO: 121167 - RNA, 46 nt, Mus musculus
cuguaguuugcacuuuauucacuuuuccuuggguuuuaaccagguc

SEQ ID NO: 121168 - RNA, 46 nt, Mus musculus
uccuggcuaggauuuuguggauauauuuuaccauacacacacacug

SEQ ID NO: 121169 - RNA, 42 nt, Mus musculus
gcguuauuuugggguuggggcgucugugaggcccuggaggca

SEQ ID NO: 121170 - RNA, 45 nt, Mus musculus
uuuguuggauuuuucuuuuuaauggaaauuguauugaauguguag

SEQ ID NO: 121171 - RNA, 44 nt, Mus musculus
auaucucuuaauuucauuauuucuccauucaguuuuugucugga

SEQ ID NO: 121172 - RNA, 46 nt, Mus musculus
uccugccauuuuuauguuguuguuguuuguauguaugugcgugcau

SEQ ID NO: 121173 - RNA, 46 nt, Mus musculus
guuggcauaugugcuuaucuagagguugcaagguacacccuucuag

SEQ ID NO: 121174 - RNA, 42 nt, Mus musculus
aggagaauggggauucaguggagauggcaagcugcucagggg

SEQ ID NO: 121175 - RNA, 45 nt, Mus musculus
cacccacuuaaaauccuccuaaauugggaagaauaaucacaugua

SEQ ID NO: 121176 - RNA, 46 nt, Mus musculus
ugagaaaacuugggguugagucacaauguucauuacauuucuguag

SEQ ID NO: 121177 - RNA, 46 nt, Mus musculus
gaauaacaacaaucuagaagccuguugucgagcccuuucccaggag

SEQ ID NO: 121178 - RNA, 42 nt, Mus musculus
caccaccuccguccuacaugcacauaccucgguauaguacaa

SEQ ID NO: 121179 - RNA, 46 nt, Mus musculus
ucaacagaacuaucaaccuucucaguauucucccaaacaacagcag

SEQ ID NO: 121180 - RNA, 46 nt, Mus musculus
auaaugucaaauaacuuugaaaaucauuaagucuaucuccuuugag

SEQ ID NO: 121181 - RNA, 45 nt, Mus musculus
ggguaguuaggcaacuuguaaucauuuaggugucaguaagguguu

SEQ ID NO: 121182 - RNA, 46 nt, Mus musculus
gaaaguugagcuaucaagccagguucucauuuucaaaagccgcauu

SEQ ID NO: 121183 - RNA, 46 nt, Mus musculus
gaauccucaguauccaagcucagguggauuuggguacagcgggcag

SEQ ID NO: 121184 - RNA, 42 nt, Mus musculus
acgcagacaggauacuuuuaaaaugugauuuguaguagucag

SEQ ID NO: 121185 - RNA, 46 nt, Mus musculus
aagcgaaguuggccaacaucauaaaguugcauuaaugaaggaguga

SEQ ID NO: 121186 - RNA, 46 nt, Mus musculus
uggugggaaaacaggcgcaaacccauggacuuggaaagggugaaag

SEQ ID NO: 121187 - RNA, 48 nt, Mus musculus
aagaaaugcauuguacaaauauguaguuuuagugcagguuaaugaugg

SEQ ID NO: 121188 - RNA, 45 nt, Mus musculus
acuuggcaaggguuucagaagaaguacuugccgcagcgucuccag

SEQ ID NO: 121189 - RNA, 46 nt, Mus musculus
augagcuuggcaaaguugucauugagagcaaugccagccccgacau

SEQ ID NO: 121190 - RNA, 25 nt, Mus musculus
caccuccaggagagcauucagggag

SEQ ID NO: 121191 - RNA, 42 nt, Mus musculus
uggagaggguggugcgccagagauuaauuguaauggagugau

SEQ ID NO: 121192 - RNA, 46 nt, Mus musculus
gcgccaggcagaauuacuagagaagugaaugcaggaaauugaggac

SEQ ID NO: 121193 - RNA, 46 nt, Mus musculus
aaugaacugcagcagccugaggcagggcugggcagagaccucaaaa

SEQ ID NO: 121194 - RNA, 46 nt, Mus musculus
ccguggguggggugggguggggugcuuccuucuggaaugagcacgu

SEQ ID NO: 121195 - RNA, 58 nt, Mus musculus
uauauggccuagccaaggagcacggauuccaggaacccacuaccauacagagcaacuc

SEQ ID NO: 121196 - RNA, 65 nt, Mus musculus
ucgaguaccugcugugcaccucuaccuccugguaccccagccacucccucaaguugccugcaugu

SEQ ID NO: 121197 - RNA, 42 nt, Mus musculus
gaaacccggggcgcccacagaagaaucucuuaccuggcucuc

SEQ ID NO: 121198 - RNA, 44 nt, Mus musculus
cuacaaacugcauuaccugauccauguuuguuggauggcgguuu

SEQ ID NO: 121199 - RNA, 45 nt, Mus musculus
auuaauaacauuauuguggguggcugaguccuucucaucacagga

SEQ ID NO: 121200 - RNA, 41 nt, Mus musculus
agaaguccagguugauggcacaauaucuguuaugaggcaga

SEQ ID NO: 121201 - RNA, 71 nt, Mus musculus
guucagcuacuggcuacaagcauggcugauuucagugcugucuuucauauaaguggugcaggugguaggga

SEQ ID NO: 121202 - RNA, 46 nt, Mus musculus
caaauguggauguguagcuaaggaacaaaaaucuugaggcugaguu

SEQ ID NO: 121203 - RNA, 47 nt, Mus musculus
guugucauucugacucugcuguguggcagcguaaauaguccccuuuc

SEQ ID NO: 121204 - RNA, 45 nt, Mus musculus
agaggaaaacugaacaaaugacuucuugcccucccagccccuaug

SEQ ID NO: 121205 - RNA, 42 nt, Mus musculus
uacacagagacaauuaugacugacuauauaacaccugacaga

SEQ ID NO: 121206 - RNA, 46 nt, Mus musculus
aaccguauggugggaagucaugcaauuaaaaaacugacugaaauua

SEQ ID NO: 121207 - RNA, 35 nt, Mus musculus
ccacauugauggcucuuuuuaaacauuaggggagu

SEQ ID NO: 121208 - RNA, 46 nt, Mus musculus
ugcugucaccaaacaguauauucucuuuuaauguaugcacccagga

SEQ ID NO: 121209 - RNA, 45 nt, Mus musculus
gcuuuucacuuguagacuagaguaaggcaaguugugugcggagau

SEQ ID NO: 121210 - RNA, 46 nt, Mus musculus
gagaagccuguguucuuuugcaugauauuuagcagcaagagcaagg

SEQ ID NO: 121211 - RNA, 45 nt, Mus musculus
uuuguguguaauaguguauguuaauaugugagagagggugcaugu

SEQ ID NO: 121212 - RNA, 42 nt, Mus musculus
aauuuauaaacaaauaauuuaggacagaaaggaaauggagau

SEQ ID NO: 121213 - RNA, 46 nt, Mus musculus
ucuuugcauaauuaauacagaacaucagcuguguuaugucuguaug

SEQ ID NO: 121214 - RNA, 45 nt, Mus musculus
ugccugggcuauguaguaaggcauuauuuuuauaaaagagaagua

SEQ ID NO: 121215 - RNA, 23 nt, Mus musculus
aucagaauuacaaaaggcuccag

SEQ ID NO: 121216 - RNA, 45 nt, Mus musculus
gaucuguuuuuaaaggucacuguugcacucuaggauaacaagagg

SEQ ID NO: 121217 - RNA, 42 nt, Mus musculus
gccauucuccagcccccuguauaaauuucauaugcagcagua

SEQ ID NO: 121218 - RNA, 45 nt, Mus musculus
ugguugcugcucugcuaaacagaugugggaacuuaaaggcaaaga

SEQ ID NO: 121219 - RNA, 45 nt, Mus musculus
aaguaaucauacccuucucuccauuuguguuuauaaucaccugau

SEQ ID NO: 121220 - RNA, 45 nt, Mus musculus
gacagaugauuguuaguugcuauuauuuuuguugcuggagguagu

SEQ ID NO: 121221 - RNA, 46 nt, Mus musculus
uuggaccauuuacuuggaaagcuuuuuccagccuuuacuuugaggu

SEQ ID NO: 121222 - RNA, 46 nt, Mus musculus
ucuaacugguugauuucaaccaugauuuugacuauuuccugcagug

SEQ ID NO: 121223 - RNA, 46 nt, Mus musculus
uuugggcauaugcccaagagcaguauagcuggaucuuaggguagau

SEQ ID NO: 121224 - RNA, 45 nt, Mus musculus
cuuacucaggaugauaauuucuaguuccauccauuugccugcaaa

SEQ ID NO: 121225 - RNA, 41 nt, Mus musculus
acuuuauaugccccaguacaggggaauaccagggccaggga

SEQ ID NO: 121226 - RNA, 26 nt, Mus musculus
uccuaauugagauaaagaacacaauc

SEQ ID NO: 121227 - RNA, 46 nt, Mus musculus
uauacagauggcauuguagguuuguaaacagcagcauuaguaggcu

SEQ ID NO: 121228 - RNA, 73 nt, Mus musculus
auaaagagagcauuuuggugcaugguaauguugcaucagagauaaagugaaggaaaaaaugggcuggggaaaa

SEQ ID NO: 121229 - RNA, 46 nt, Mus musculus
gaacagugcuuggcacaugcuaagugugccacaaaugucaguuuau

SEQ ID NO: 121230 - RNA, 46 nt, Mus musculus
ucuuuaaagcaugauugaugauaauagcaugauaaaagccuuagua

SEQ ID NO: 121231 - RNA, 46 nt, Mus musculus
aauugauuuccaaagugauuguacaaguuuacauccccaucaguaa

SEQ ID NO: 121232 - RNA, 46 nt, Mus musculus
gcuaugaugccuuuaccauucaaaacgacauacaaauugcacagug

SEQ ID NO: 121233 - RNA, 33 nt, Mus musculus
cuauccguuuugcuucuucauagcuagaaagaa

SEQ ID NO: 121234 - RNA, 46 nt, Mus musculus
aaauggucacauuugacugccucauccuguggugccuuggccugaa

SEQ ID NO: 121235 - RNA, 42 nt, Mus musculus
uuucugugggacauuggcauuauugucguaacugcuccagaa

SEQ ID NO: 121236 - RNA, 46 nt, Mus musculus
ugaugcggacugugcacuggaaaaacuuacugaacaugagaaaggu

SEQ ID NO: 121237 - RNA, 45 nt, Mus musculus
uacaaaaugagaccaugucucauaucaagacagaauauuauagaa

SEQ ID NO: 121238 - RNA, 45 nt, Mus musculus
aggagccucuguauuuucauuuguaaaacuaagaaagccucuuga

SEQ ID NO: 121239 - RNA, 45 nt, Mus musculus
gauuuccagaguaguuguaccaguuugcaauccaaccagcagugg

SEQ ID NO: 121240 - RNA, 45 nt, Mus musculus
aacguauccugcauacaggcaacagcuuuugugauagcccccacu

SEQ ID NO: 121241 - RNA, 42 nt, Mus musculus
gacuuggggguagauaaauaaaaaaauccaacauggaggaga

SEQ ID NO: 121242 - RNA, 46 nt, Mus musculus
auuugaaaugaauagaaaauagagucucaggaaagaaguagaagau

SEQ ID NO: 121243 - RNA, 46 nt, Mus musculus
uuacuccaaaaguuuuaacaauugaacuaguaccaaugccacagaa

SEQ ID NO: 121244 - RNA, 45 nt, Mus musculus
gaauuuguuagguccaagacacauuuugaaguuaaagcugguaga

SEQ ID NO: 121245 - RNA, 46 nt, Mus musculus
aaauauauuucaugggugcaauuggccagggacagggagggcagca

SEQ ID NO: 121246 - RNA, 46 nt, Mus musculus
uauccucacucaccagagcacugacuuccuguggaacuggccagua

SEQ ID NO: 121247 - RNA, 32 nt, Mus musculus
ucacaacacaguucaacaaugcuauacauaca

SEQ ID NO: 121248 - RNA, 45 nt, Mus musculus
ggguaggugggggagcaccaucauagaagcaaggagagggaggau

SEQ ID NO: 121249 - RNA, 46 nt, Mus musculus
ugacaauaauuguggucucuuaaggaauuaugaaugaaauggguga

SEQ ID NO: 121250 - RNA, 46 nt, Mus musculus
ucagaauggcuaugccuaaacaaauuguugguuuaaugaguaaggg

SEQ ID NO: 121251 - RNA, 46 nt, Mus musculus
cugucaccaucacugucaugcacagcuucuguucuuccagggagag

SEQ ID NO: 121252 - RNA, 42 nt, Mus musculus
ucuuaaaggauacuuccaggggaaaccauaacaugcccuuuu

SEQ ID NO: 121253 - RNA, 42 nt, Mus musculus
uuugggccuacagaacaaguaccagaauagccagccaggacu

SEQ ID NO: 121254 - RNA, 46 nt, Mus musculus
aaaccaaaaaaaacaaaacaaaacaaaacaaaacaaaaagagagag

SEQ ID NO: 121255 - RNA, 46 nt, Mus musculus
uuauuguguaaugaaauaaagggagaagucccagugggcugagaau

SEQ ID NO: 121256 - RNA, 28 nt, Mus musculus
uguuaaaacuuccccuggagagcuuagg

SEQ ID NO: 121257 - RNA, 42 nt, Mus musculus
auuauaaccuaagaauguugcuugcuuuugaguugagugaau

SEQ ID NO: 121258 - RNA, 46 nt, Mus musculus
uuagauuguggguauccaaaguuucccauguuacagccagagguca

SEQ ID NO: 121259 - RNA, 42 nt, Mus musculus
agaagccucacaggcagucaguccugguacuagccagaagag

SEQ ID NO: 121260 - RNA, 46 nt, Mus musculus
cagguauauuagguaauuauuacaagugaagggauucuggacagau

SEQ ID NO: 121261 - RNA, 42 nt, Mus musculus
cauguaguuugauuuccuuugauggguagagauucaguaguc

SEQ ID NO: 121262 - RNA, 46 nt, Mus musculus
uuguagcauauugaacacaaugacaggauguaucaacugagcuuau

SEQ ID NO: 121263 - RNA, 46 nt, Mus musculus
caaucugauuaaaaugugcaugcagaugcaugcaugccuuagagaa

SEQ ID NO: 121264 - RNA, 42 nt, Mus musculus
aagguacauuuucaagaaauuguuucuuuaaagcaaacagaa

SEQ ID NO: 121265 - RNA, 24 nt, Mus musculus
caucagaacaucagcgguugacag

SEQ ID NO: 121266 - RNA, 44 nt, Mus musculus
uaggaagagggcucgucagguuguugugcuuugccagggagagu

SEQ ID NO: 121267 - RNA, 46 nt, Mus musculus
acuuaacgaaagacuagcaaacugauaaacuaagucacacacuagg

SEQ ID NO: 121268 - RNA, 46 nt, Mus musculus
guggcuguuuuugagcaagagaaaaaugauuuuaagaagaggagau

SEQ ID NO: 121269 - RNA, 41 nt, Mus musculus
caugcuuuguuuugguaucuuaaaguaaucuuucacagagc

SEQ ID NO: 121270 - RNA, 46 nt, Mus musculus
gaggucaaguauaaaaucaggugcgguaaacauuuguauacagauu

SEQ ID NO: 121271 - RNA, 45 nt, Mus musculus
ucaauguacaccaagcaaagaugugauucuuagaaaggaagaacu

SEQ ID NO: 121272 - RNA, 45 nt, Mus musculus
aagaaguuaaaagaaccaucuuuuaaauugaagugcaguuugaga

SEQ ID NO: 121273 - RNA, 46 nt, Mus musculus
uggaucccuuuaucccaucuauuaggauauuugaaagagcagaggu

SEQ ID NO: 121274 - RNA, 46 nt, Mus musculus
uucuccauuccacaugaaaaauuaagguggcuguucacucggagcu

SEQ ID NO: 121275 - RNA, 46 nt, Mus musculus
cuguagauaugcaagcaugaggagcuuugcucuugugcccucuuag

SEQ ID NO: 121276 - RNA, 43 nt, Mus musculus
gcuaagguaguuuaucauauagcuaguaaguacggggcuguag

SEQ ID NO: 121277 - RNA, 42 nt, Mus musculus
ugaucuggaaguggaaacucauuuuugacauuugccuaagca

SEQ ID NO: 121278 - RNA, 46 nt, Mus musculus
agucgaaucucacaaguuuaaaguauaaaacaaguagccccuaaga

SEQ ID NO: 121279 - RNA, 46 nt, Mus musculus
uauaauuuacuagugugaauauuaaauucuguuguuucagucaaga

SEQ ID NO: 121280 - RNA, 77 nt, Mus musculus
agaucagccucaacagcaacaaaaaaucaugagagaaaagauuaaauucaacaaaagccuaauucuauagggugagc

SEQ ID NO: 121281 - RNA, 42 nt, Mus musculus
cugaguaagauuauucuuuuuucauuaguaagagccauagua

SEQ ID NO: 121282 - RNA, 46 nt, Mus musculus
gguaggacaucaggguuuuuuucucugaaagugcuugacuccaguu

SEQ ID NO: 121283 - RNA, 45 nt, Mus musculus
aaucccagaaaccacaugguggcucacaaccauccguaacgaaau

SEQ ID NO: 121284 - RNA, 46 nt, Mus musculus
accuauauguuggugcacaacuguuugcaacucuaauccaggagau

SEQ ID NO: 121285 - RNA, 59 nt, Mus musculus
cuuaggcuucugugugguuaugccaguuacuaauugauggagagggaaaucuugaggau

SEQ ID NO: 121286 - RNA, 50 nt, Mus musculus
agucuucaaucuaacuaaucaaaugagaaaauuacaaacaugaggagaac

SEQ ID NO: 121287 - RNA, 56 nt, Mus musculus
gcacuuucuguuacaaacuuauugcuuauguugauauucagaguaaauucagugcu

SEQ ID NO: 121288 - RNA, 46 nt, Mus musculus
ugcauugggcuugaaagguuguauuugaugauaccuauugucagau

SEQ ID NO: 121289 - RNA, 46 nt, Mus musculus
cuuauuuacuuuauuuacauaaaguuuauguauugagcuuugagug

SEQ ID NO: 121290 - RNA, 23 nt, Mus musculus
cauuguauagaauaauguguuug

SEQ ID NO: 121291 - RNA, 54 nt, Mus musculus
ugauauguaaaaauaaauuucaauuguauagagauaauuagaaaaaggcaaaag

SEQ ID NO: 121292 - RNA, 45 nt, Mus musculus
uuugcaaaaacucuuuacuaucuaucuugguagauacuaucugaa

SEQ ID NO: 121293 - RNA, 44 nt, Mus musculus
caaaagagcagccagugcucuuaaccacucucuaggccccuuaa

SEQ ID NO: 121294 - RNA, 46 nt, Mus musculus
aauggcaaguuagauuaggauggaggccuacauaaagucgugagau

SEQ ID NO: 121295 - RNA, 50 nt, Mus musculus
uguguguguguguuuguguguguguuuugugugugugugugugugugugu

SEQ ID NO: 121296 - RNA, 30 nt, Mus musculus
uaauuagcuugugucucaaggccuagagaa

SEQ ID NO: 121297 - RNA, 93 nt, Mus musculus
cugcuugaaauagacauugaugcuguuuucaagucucugcuguugcugaagaaaaagaaauaugcugcucuaguuguugaaccaacaucagau

SEQ ID NO: 121298 - RNA, 85 nt, Mus musculus
auuuauggagacacagauucaauuaugauaaauaccaauagcaccaaccuggaagaaguauuuaaguugggaaacaaggugagau

SEQ ID NO: 121299 - RNA, 46 nt, Mus musculus
ugcuuuugucuguguguacauuauuuuauguuuuguagccugucga

SEQ ID NO: 121300 - RNA, 45 nt, Mus musculus
accucuuggagaucuuggggaaagaaauuauagaaugugggaagu

SEQ ID NO: 121301 - RNA, 46 nt, Mus musculus
ugaacuaaguuggacaguaguaaaaacagauaguuggcaauggaga

SEQ ID NO: 121302 - RNA, 42 nt, Mus musculus
uuugguuacuagagaagccgggcaagaacagaucaaugagau

SEQ ID NO: 121303 - RNA, 41 nt, Mus musculus
acagauugugcauugaaguggguuucuuguuaguggcuguu

SEQ ID NO: 121304 - RNA, 46 nt, Mus musculus
uuuucuuuccuaucauucaaaauccuucauuuugcuacccccauua

SEQ ID NO: 121305 - RNA, 46 nt, Mus musculus
gaauucuagaguuuuaucagauuuuaagauaaucccagccuccuug

SEQ ID NO: 121306 - RNA, 45 nt, Mus musculus
gacauauuuguagauguguaugggcacuugguagaaguagaaaag

SEQ ID NO: 121307 - RNA, 45 nt, Mus musculus
guuuggaaaacauguuuagcaacuucuaguuuagugacuucuaga

SEQ ID NO: 121308 - RNA, 90 nt, Mus musculus
gagaugaauguuuugauuuauaauaguguuauaaaugggcuuucaaaaugggcgacugagauuuuuccucauuuuaccuuaaccugagau

SEQ ID NO: 121309 - RNA, 46 nt, Mus musculus
ugagcuagaaauucacuuguugauuugucuagauaauaugcauugu

SEQ ID NO: 121310 - RNA, 46 nt, Mus musculus
aacucagaggacaaauauucacauuagagauuagaaauuguaagau

SEQ ID NO: 121311 - RNA, 42 nt, Mus musculus
ucuacagggaauuuaauauuuuaaaacuaugcaggcccauac

SEQ ID NO: 121312 - RNA, 45 nt, Mus musculus
agcauagcaaugucaugaaauuguuuuuaggaacuuguaaugaga

SEQ ID NO: 121313 - RNA, 45 nt, Mus musculus
uaaauuauuuuugguacaucaauaaaugaauucuuuggggggguu

SEQ ID NO: 121314 - RNA, 46 nt, Mus musculus
uuugugucccuacagacacuguuucuaugcugcuuagcccauagca

SEQ ID NO: 121315 - RNA, 45 nt, Mus musculus
uuccuaugaagcucaucagcaucauuucaaaaacagaggcagaga

SEQ ID NO: 121316 - RNA, 46 nt, Mus musculus
auuuuaaggggaagggaauuuucaaagaauuuuuuggaggguauuu

SEQ ID NO: 121317 - RNA, 47 nt, Mus musculus
caguuauuucagcugaggccagacacaagugcucaguacuaguauug

SEQ ID NO: 121318 - RNA, 46 nt, Mus musculus
agagucuaccccuccaggggauccauuccauaaucagccaccaaaa

SEQ ID NO: 121319 - RNA, 35 nt, Mus musculus
uaaagagaugauuauaaaaaugugggcagacaaua

SEQ ID NO: 121320 - RNA, 46 nt, Mus musculus
acucugccaccaucugucucaugggauuuaaucauagcugguagac

SEQ ID NO: 121321 - RNA, 47 nt, Mus musculus
ugguaauaaaugauaguauucuuuuuuauauauaacugucccuugcu

SEQ ID NO: 121322 - RNA, 45 nt, Mus musculus
gagguucaugaaaacugucauguguguagaauugaagcccaagaa

SEQ ID NO: 121323 - RNA, 46 nt, Mus musculus
uacgacagagaaagauagguauaagcacacuuguucugcacuaaau

SEQ ID NO: 121324 - RNA, 45 nt, Mus musculus
gcucaaguauuuaaacccauuguccccaguugguggucuguuuca

SEQ ID NO: 121325 - RNA, 46 nt, Mus musculus
uuucaauagaagugguugaucuguguuaaaaugaauguccgaagau

SEQ ID NO: 121326 - RNA, 45 nt, Mus musculus
aaguacuuuguauuuuaaaagauacuggauauuuuaaagggauug

SEQ ID NO: 121327 - RNA, 46 nt, Mus musculus
gcccagagauugugaguuggaucccagacauuggaugguuggagau

SEQ ID NO: 121328 - RNA, 45 nt, Mus musculus
auuaagagagccuaugagaggcuauuggugaagccuaguuacagc

SEQ ID NO: 121329 - RNA, 41 nt, Mus musculus
cagaacuacuaaaggaaaaacuuugcauuacugggacuauu

SEQ ID NO: 121330 - RNA, 45 nt, Mus musculus
aguucuguggaauguuguguaggagcuuaggagauaauguugaga

SEQ ID NO: 121331 - RNA, 46 nt, Mus musculus
uugagccauuuuuggcuaaccuugaauuuacaaucuugccucagac

SEQ ID NO: 121332 - RNA, 41 nt, Mus musculus
cauggagccuaacaaaugccuccauuacaguugcugccagu

SEQ ID NO: 121333 - RNA, 43 nt, Mus musculus
uguugucugagccuuagaccugagaaaggacauggggacccua

SEQ ID NO: 121334 - RNA, 49 nt, Mus musculus
uugcaaaguggcaauaccaugagguuguccuugacgccacagaacaggc

SEQ ID NO: 121335 - RNA, 33 nt, Mus musculus
cugacugauugggucagccaaagauggagaacg

SEQ ID NO: 121336 - RNA, 46 nt, Mus musculus
uuuuugcuucaaagucugucucuguacucuacuaauuuugacagau

SEQ ID NO: 121337 - RNA, 45 nt, Mus musculus
cugggguaagggaguuuuuguaaguuuuaauauuuagcauucugu

SEQ ID NO: 121338 - RNA, 46 nt, Mus musculus
ggcuuuuucaaccacuuuucuuuuauugaauccuaagcuugcuuga

SEQ ID NO: 121339 - RNA, 46 nt, Mus musculus
aaaagucaucuggaagacucaugcugcuaauguaaugcacagugaa

SEQ ID NO: 121340 - RNA, 46 nt, Mus musculus
ucacaacugcuauaaaauuaaacccaggagucuucuuuccagaggg

SEQ ID NO: 121341 - RNA, 46 nt, Mus musculus
aaaguuuaucucuaguuguguuguuuggugauuaauaguugaagug

SEQ ID NO: 121342 - RNA, 54 nt, Mus musculus
guagcuucauaacagugagguggcaaagcuuaauugggcgccuaauccuuucuu

SEQ ID NO: 121343 - RNA, 46 nt, Mus musculus
ugcuguuucucuagguuuaccaucacugcucugaauuucugugaag

SEQ ID NO: 121344 - RNA, 46 nt, Mus musculus
acaagaagggacuuucuaccaauugagcccagucaguaguagaguu

SEQ ID NO: 121345 - RNA, 46 nt, Mus musculus
acuccacuuaccaggguaacucagaacuuuuugaucacauugagau

SEQ ID NO: 121346 - RNA, 56 nt, Mus musculus
ccaucuucuuaccacagcaauaaugaaaagcauaacuagauugucaaguucacauc

SEQ ID NO: 121347 - RNA, 46 nt, Mus musculus
ugaaaucuuccuguggucaacucauacuaauccuuuggauggggaa

SEQ ID NO: 121348 - RNA, 46 nt, Mus musculus
auaaauuguaauguuuaaguauaugagaaugcaaccucugaaagga

SEQ ID NO: 121349 - RNA, 46 nt, Mus musculus
caccucucuuagaaagguagagggaguucuaauuugaccccaguca

SEQ ID NO: 121350 - RNA, 61 nt, Mus musculus
ugaagugagacgggaaggagauggaaaggaaagaaaacuugacuuuuugauuagauauaag

SEQ ID NO: 121351 - RNA, 47 nt, Mus musculus
uaagagugaaaguugcaagccuggcauuggugguuuaugauaggauu

SEQ ID NO: 121352 - RNA, 46 nt, Mus musculus
uaguuuggggguggggggcuaagugaaauguguuguggcagcagag

SEQ ID NO: 121353 - RNA, 46 nt, Mus musculus
uccaggguuuuuuuccaauuaguuuuauguuauaaauuuggcagaa

SEQ ID NO: 121354 - RNA, 45 nt, Mus musculus
acagaagguugugagugcucagugucauguuuaaagccccaggau

SEQ ID NO: 121355 - RNA, 42 nt, Mus musculus
ggaaaauaguuucuuuaaaugcauuuuauauuugcugaaggu

SEQ ID NO: 121356 - RNA, 45 nt, Mus musculus
uaggcuccuuuguagcucugauuauagauugaaggauggcaagga

SEQ ID NO: 121357 - RNA, 46 nt, Mus musculus
ugugcaggaauagaaacccugacuaagacaaguaguauguacagaa

SEQ ID NO: 121358 - RNA, 46 nt, Mus musculus
gagaaacccugccuuguaaaaccaaaagaaaaaaaagccguuagau

SEQ ID NO: 121359 - RNA, 46 nt, Mus musculus
guuacuugcuaaauuauuuuacaauucuguuuucccugccaucucu

SEQ ID NO: 121360 - RNA, 46 nt, Mus musculus
gaguguucaauguaggaagagguaguauuauuucauggagguagau

SEQ ID NO: 121361 - RNA, 52 nt, Mus musculus
uguaggacucaguccaaagggucugcaucuugaugcugguagaggcgggagg

SEQ ID NO: 121362 - RNA, 46 nt, Mus musculus
cauaguuuggaacauuaguuaauucuugucaacauaguuaccauau

SEQ ID NO: 121363 - RNA, 45 nt, Mus musculus
uuaaggucagcuucugguuuucuguagguaaauugguggggccuu

SEQ ID NO: 121364 - RNA, 65 nt, Mus musculus
aauggaaguagagaaaugauguuaauuguaauuucagaaacuaaaaauuauagauuucaaaggca

SEQ ID NO: 121365 - RNA, 71 nt, Mus musculus
gauauauaugugacaaacaaaagagaggcuacaaauuugaggagcaagggaauacuaggggcgggggaaga

SEQ ID NO: 121366 - RNA, 46 nt, Mus musculus
caggcaaaacacucauaucuauaaaauaaaaaauaaucuuaaaaag

SEQ ID NO: 121367 - RNA, 45 nt, Mus musculus
ucaguugcaaauucuugaaguaauauuugcugaauauguaccaug

SEQ ID NO: 121368 - RNA, 46 nt, Mus musculus
uucagugguguucugguugacaaaacaaaauaacuuguuuucagaa

SEQ ID NO: 121369 - RNA, 46 nt, Mus musculus
uuucaguguaggagggugguguguuuuccccuggaagaggguaaua

SEQ ID NO: 121370 - RNA, 78 nt, Mus musculus
caguuaaaauaagguuugucuuuugaguuuagugauggaauuuauuugccuuaaggcuaaauguugacuggggauggg

SEQ ID NO: 121371 - RNA, 46 nt, Mus musculus
uuuguaugugucucucucucucucucucucucucucucucugugug

SEQ ID NO: 121372 - RNA, 45 nt, Mus musculus
uguaauguacaugaaggcauuauacuuuuucuuucagccacacag

SEQ ID NO: 121373 - RNA, 46 nt, Mus musculus
aagacaaaaagaaaagugugaaguuauuaacuauuguucaccagua

SEQ ID NO: 121374 - RNA, 46 nt, Mus musculus
uuuucaugacugcuacauacuugucugaccugagccuugaagaguu

SEQ ID NO: 121375 - RNA, 46 nt, Mus musculus
aaauuuaggagaucauaaaguuggauuuuauuagaggcacccggga

SEQ ID NO: 121376 - RNA, 46 nt, Mus musculus
gaucccuaugauuuaaaacaauagccaaaaacaaaaaaacaaagau

SEQ ID NO: 121377 - RNA, 46 nt, Mus musculus
aaauagcucacuaaguucuuaucuuuggcaaguuacagauccagau

SEQ ID NO: 121378 - RNA, 46 nt, Mus musculus
aaugaaauugggugagacuucuggguaacacugagugggcacaaau

SEQ ID NO: 121379 - RNA, 39 nt, Mus musculus
uaagauaguuuagacaaaauaauacaguagccugaagac

SEQ ID NO: 121380 - RNA, 46 nt, Mus musculus
guugauaaugauaagccccaaauuuguccaaugaucucuccuacuu

SEQ ID NO: 121381 - RNA, 76 nt, Mus musculus
ccaucuuauuuuuguauuaggaaaugcacucacuaugccccaacugggugauaauacauagguugacuauugagau

SEQ ID NO: 121382 - RNA, 46 nt, Mus musculus
aggugguguugaccuuaacugucuggaggcuagcuuaggcuuagau

SEQ ID NO: 121383 - RNA, 45 nt, Mus musculus
ugcaaaauaaaauugccaucuguaaauauaugcuacaauauggga

SEQ ID NO: 121384 - RNA, 42 nt, Mus musculus
uuacauuaaauugaaauguguaaguaacaagugugagcagua

SEQ ID NO: 121385 - RNA, 66 nt, Mus musculus
cugagcugagagguaauauagagagagacagagaaaaagagacagagugagagaccgagccagaga

SEQ ID NO: 121386 - RNA, 46 nt, Mus musculus
aacacuugaacucaacagugaaaaaugcauauaugcacacacaaac

SEQ ID NO: 121387 - RNA, 45 nt, Mus musculus
uaaaguuaaauggacuacuuggcaaguaugauagggauaggagac

SEQ ID NO: 121388 - RNA, 80 nt, Mus musculus
gcaaguuccagaacagccaggaauacacagaaaaucccugucucaauuccucuucccuccaaaacuuuuaccugcugaau

SEQ ID NO: 121389 - RNA, 42 nt, Mus musculus
aaacuuuucauccuagcacuugggaggcacaggcaggcaggu

SEQ ID NO: 121390 - RNA, 42 nt, Mus musculus
uuguuuuacaacagugcaaagaguuacuucagaggugcagaa

SEQ ID NO: 121391 - RNA, 45 nt, Mus musculus
guuaaaacaaaugaaauaaccauugaauuaaaauuuagcaggaga

SEQ ID NO: 121392 - RNA, 47 nt, Mus musculus
cccaaaugacauuucuaggauuuuagagaccuuuaaauauagaaauc

SEQ ID NO: 121393 - RNA, 45 nt, Mus musculus
cauauguauguauguugaauaucccuaauacauaauguuuggaau

SEQ ID NO: 121394 - RNA, 33 nt, Mus musculus
gauuuucagaaaaccucagcaaaaacugguggg

SEQ ID NO: 121395 - RNA, 42 nt, Mus musculus
uaaaaauucuguuuaauagucuaggacacugauggguggacg

SEQ ID NO: 121396 - RNA, 46 nt, Mus musculus
ugcagaucaugugugagcuaaauguucuuccauuagcauugcagau

SEQ ID NO: 121397 - RNA, 46 nt, Mus musculus
acuucauuaaccuucacugagcauacccuaguacaagccaccauac

SEQ ID NO: 121398 - RNA, 46 nt, Mus musculus
cauccuuuacuuuuauacuugaauccuaagugauuggauuacagau

SEQ ID NO: 121399 - RNA, 46 nt, Mus musculus
uuagaacagcaucagauauauaguagguguucagaaguacguagaa

SEQ ID NO: 121400 - RNA, 42 nt, Mus musculus
ccuuuucuaguuaaaugaucucaagucacagaacccccucug

SEQ ID NO: 121401 - RNA, 46 nt, Mus musculus
aaaaaaacaaacauaaaacaacuaaagagagaauuaggagggagag

SEQ ID NO: 121402 - RNA, 46 nt, Mus musculus
accccaaccaugauaauugggaaauaaguuucccuuaugcccuucu

SEQ ID NO: 121403 - RNA, 45 nt, Mus musculus
uacauaguccagggaauuagggacaagucuaugacaaacgcagau

SEQ ID NO: 121404 - RNA, 93 nt, Mus musculus
uguagcuaauguccuaagagccuauguuuggauuguugcugaagucuguauacccuuaugauauuucaggauuugucuuuaaaguaccaagaa

SEQ ID NO: 121405 - RNA, 52 nt, Mus musculus
auaguagagugcuugcuuaccaugugggaggcucagguccuagguucuauca

SEQ ID NO: 121406 - RNA, 106 nt, Mus musculus
gucagugccuauauuucaaaagcaauauuagcaauuugguuacaucaaagucuugugcugucaaauuagagauaaguagacauuugagaaaaaauggaggggcugg

SEQ ID NO: 121407 - RNA, 42 nt, Mus musculus
aagaauguuuuuagaaugagaugacccuguggcuuggugaga

SEQ ID NO: 121408 - RNA, 46 nt, Mus musculus
uccaaugauaaggaguaauuaaacaaccacagacaaugaucccaua

SEQ ID NO: 121409 - RNA, 41 nt, Mus musculus
acguugggacacgaggaagugucccaagagcaggcacaaga

SEQ ID NO: 121410 - RNA, 65 nt, Mus musculus
caaaaauuucagcaaaauauaaaauaaugaaguucaaguccaaggucuguauucaauacuguauu

SEQ ID NO: 121411 - RNA, 45 nt, Mus musculus
uuuaguucuaucuacugaccauucacauaaugcugggggcuggaa

SEQ ID NO: 121412 - RNA, 23 nt, Mus musculus
caacagaccuuccagcucagcuu

SEQ ID NO: 121413 - RNA, 45 nt, Mus musculus
aaguaucuuggggauacuguaaaacauauccccaaauggaguagu

SEQ ID NO: 121414 - RNA, 46 nt, Mus musculus
uguaucugucugucuguguugugucucucucuguguauacaugcau

SEQ ID NO: 121415 - RNA, 45 nt, Mus musculus
uaugcagagaagugugugugugugugugugugugugugugugugu

SEQ ID NO: 121416 - RNA, 46 nt, Mus musculus
aaggcacuuuagcuuaaggaaacaauaagggcaaagguguaaaaga

SEQ ID NO: 121417 - RNA, 83 nt, Mus musculus
cugaagugaaacaggagaguggaucuaggggagagaggaaguagaggggaacuaagaggaggagaggggaaguugugguuggg

SEQ ID NO: 121418 - RNA, 45 nt, Mus musculus
aguucaaguggauuccaguaaucucccauugguaaaaggggcaga

SEQ ID NO: 121419 - RNA, 46 nt, Mus musculus
ccauggacacagagaagguagaugagaagccugugacugcuaagac

SEQ ID NO: 121420 - RNA, 47 nt, Mus musculus
gaaagguugaauuuauaguaguaaaaguugaaagcauccaagaugaa

SEQ ID NO: 121421 - RNA, 42 nt, Mus musculus
acuauguuuaauuuuagugacaagcaagaaaaucacagagua

SEQ ID NO: 121422 - RNA, 44 nt, Mus musculus
aaccaaacaauaucaaggcaauguucauugcuagugccgggaag

SEQ ID NO: 121423 - RNA, 44 nt, Mus musculus
aaccacaaaaaacacccccaaagagccaagaaaacccccacaaa

SEQ ID NO: 121424 - RNA, 45 nt, Mus musculus
uggacucaauggugauaguagaaaaagacaggaaauucggggagu

SEQ ID NO: 121425 - RNA, 42 nt, Mus musculus
uucugaagaggaaaggagggggaauggaucugagggagaggg

SEQ ID NO: 121426 - RNA, 46 nt, Mus musculus
aauuaaggucuccuuugggucccaaccccagagaagagggggaaag

SEQ ID NO: 121427 - RNA, 41 nt, Mus musculus
auaguacuucuuguuuccacuugguugauuuugccccugag

SEQ ID NO: 121428 - RNA, 48 nt, Mus musculus
gucaacucuauuugaaaaaaccuuauuauggauuggcuuguguacaau

SEQ ID NO: 121429 - RNA, 50 nt, Mus musculus
cccccaugccuacagcucaccauugucuuuugccagaagccugguaagau

SEQ ID NO: 121430 - RNA, 89 nt, Mus musculus
agaaaagagaauccaguugcuccaguguugaucacaccaguagccacuucaaagaauguaugcaauauuucuuaaaugaaggagccauc

SEQ ID NO: 121431 - RNA, 52 nt, Mus musculus
ucuugaccugaucuuaucaccugaucuuaguuuugccaccugcauaguagga

SEQ ID NO: 121432 - RNA, 45 nt, Mus musculus
cccggcuuauguuaguuucuuuuaaguggggaauugaauucagau

SEQ ID NO: 121433 - RNA, 46 nt, Mus musculus
uauugauaauaaguuugauuucuugguuaagaugauaaugucagau

SEQ ID NO: 121434 - RNA, 46 nt, Mus musculus
uacaguguguguguguguguguguguguguguguguguauugugug

SEQ ID NO: 121435 - RNA, 63 nt, Mus musculus
uuguucuuucagaugggauaggcuauguggaagauggcagagagauuuuugaugaugaccuug

SEQ ID NO: 121436 - RNA, 45 nt, Mus musculus
uuaugaaguagcagugaaaguaauuuugugguuuagggggcacua

SEQ ID NO: 121437 - RNA, 36 nt, Mus musculus
uugaggaccucacaaguguuuaugaagaaguugaug

SEQ ID NO: 121438 - RNA, 46 nt, Mus musculus
ugagguagcuaggcacuggaaaguuagugagauccuaguggcagau

SEQ ID NO: 121439 - RNA, 45 nt, Mus musculus
gucaagaagcuuuagagagacugaaaaaggcuaaagcuggggaga

SEQ ID NO: 121440 - RNA, 63 nt, Mus musculus
uagguguuuuaacuggaaguuagaggaaauuucuggagagucacaggaucgucauauugggcc

SEQ ID NO: 121441 - RNA, 46 nt, Mus musculus
cccagucaacugugggaggugccaccauggguagacaccgggagau

SEQ ID NO: 121442 - RNA, 45 nt, Mus musculus
uagaacuggugugcugcuuaguuuuagcacaaaguaggaucaucu

SEQ ID NO: 121443 - RNA, 45 nt, Mus musculus
guuaagucugauucccaucuuucauguuuuucuauaugauuuuga

SEQ ID NO: 121444 - RNA, 46 nt, Mus musculus
gggaagauguauuuucuccuuuucaugaguguaaaagggucuuaaa

SEQ ID NO: 121445 - RNA, 46 nt, Mus musculus
uuggaaggugggacaccuggacagugucagcaaaauguagcaaggc

SEQ ID NO: 121446 - RNA, 45 nt, Mus musculus
aggaagucccaggaaaauuguuagcauugucauugaagugagaga

SEQ ID NO: 121447 - RNA, 46 nt, Mus musculus
caugcuuagggcacgugguugggaaugugggggucgcgguaugauc

SEQ ID NO: 121448 - RNA, 46 nt, Mus musculus
cuuaccuauguuaaguauacacuccacacucagcuacaagcccagg

SEQ ID NO: 121449 - RNA, 23 nt, Mus musculus
auagaaccugacucugaccacac

SEQ ID NO: 121450 - RNA, 46 nt, Mus musculus
ugccuggcaaauacagaaagguuguagcuuugagucaugaugacau

SEQ ID NO: 121451 - RNA, 41 nt, Mus musculus
guaagccaccaugugguugcugggauuugaacucagcagcu

SEQ ID NO: 121452 - RNA, 41 nt, Mus musculus
aggaggaggggggauacgauagagggguuuuggaggggaaa

SEQ ID NO: 121453 - RNA, 46 nt, Mus musculus
agcccccuccccccagagccuggaccacagccuugcacccccagcu

SEQ ID NO: 121454 - RNA, 45 nt, Mus musculus
cguagggucucaaaguucauaagcaauggagcuggcauuugaaga

SEQ ID NO: 121455 - RNA, 46 nt, Mus musculus
ugcacuucuuagauaagauaaagcuguuuccugaggugccccagac

SEQ ID NO: 121456 - RNA, 46 nt, Mus musculus
uugucuucccuggggggaaguaaagagguuacccccacccccaccc

SEQ ID NO: 121457 - RNA, 45 nt, Mus musculus
uggauuagcauugaaaucuguaaguccagauuaugugggggcuca

SEQ ID NO: 121458 - RNA, 41 nt, Mus musculus
auuaccugugcacaccccucucaggccaacuaggcaaggag

SEQ ID NO: 121459 - RNA, 46 nt, Mus musculus
ucuugcuucccugacaucuggggcuuucuaguggcuacccccaguu

SEQ ID NO: 121460 - RNA, 47 nt, Mus musculus
gggguuaggggagggagaaagacagaaaggucacaggugcagggaga

SEQ ID NO: 121461 - RNA, 46 nt, Mus musculus
auugaugauugauguagagaggcugaguucauuuucuuaauuagua

SEQ ID NO: 121462 - RNA, 46 nt, Mus musculus
ucauaagcuugagauauugugcccaaguuucaaaucaaacccagau

SEQ ID NO: 121463 - RNA, 48 nt, Mus musculus
cuacaaaaauggcuuuaacucuaugcaguccuagcaacaaggaggagg

SEQ ID NO: 121464 - RNA, 46 nt, Mus musculus
uagaaucccaaaucacauaguugauaugaaaguucugccagcagaa

SEQ ID NO: 121465 - RNA, 45 nt, Mus musculus
uuuuuagucagccucuuaaaaugaaaaccucacucucuccagaca

SEQ ID NO: 121466 - RNA, 46 nt, Mus musculus
uggggagggagagagacaauggagagagagagagagagagagagag

SEQ ID NO: 121467 - RNA, 41 nt, Mus musculus
aaggagagagagagacagaaagaaggauaagagagagaaag

SEQ ID NO: 121468 - RNA, 42 nt, Mus musculus
aauaaauuccucuugcuuuuugcaucaauuccuggcuuugca

SEQ ID NO: 121469 - RNA, 41 nt, Mus musculus
ucugaggcauaauaugaacaacuugaguaaagagaccaacc

SEQ ID NO: 121470 - RNA, 46 nt, Mus musculus
ucacuggauuccucuaccucaauacuaaugacaauaagggcuagau

SEQ ID NO: 121471 - RNA, 46 nt, Mus musculus
cugaacguuaaccccaaagugaccucucugcugcuguuuucaggga

SEQ ID NO: 121472 - RNA, 46 nt, Mus musculus
agauaauuagagcugcacauaauuauaaaugccuacuuuugcagac

SEQ ID NO: 121473 - RNA, 43 nt, Mus musculus
aacccugucuugaaaaaccaaaaaaagaagaagaagaagaaga

SEQ ID NO: 121474 - RNA, 45 nt, Mus musculus
ucacaaccaucuguaaugagaucugcugcccucuucuggggugcc

SEQ ID NO: 121475 - RNA, 46 nt, Mus musculus
gcuuuucagguuuacucccacuuuauuuguauauuugcuuaaagaa

SEQ ID NO: 121476 - RNA, 46 nt, Mus musculus
caagcauggucucccuuucuaaaagaaagggaagagaggggguagg

SEQ ID NO: 121477 - RNA, 46 nt, Mus musculus
uucccaugaaagaccuugcugagaaauugcuaucugggcaaaagcu

SEQ ID NO: 121478 - RNA, 45 nt, Mus musculus
agcaaaaagcgcgcugcaguagagaaacguaaggcaggagaagau

SEQ ID NO: 121479 - RNA, 45 nt, Mus musculus
gaggggggagaggucuuguuugggagccaggagaagguaggagau

SEQ ID NO: 121480 - RNA, 50 nt, Mus musculus
cccgucucccagcagagcugcagcucucaacaccacccaggcaucccggg

SEQ ID NO: 121481 - RNA, 46 nt, Mus musculus
gucuguguggguuuucaggucagaaaccuccaugcugagcccaggc

SEQ ID NO: 121482 - RNA, 27 nt, Mus musculus
cugauccuuuaagaagcuccaagagau

SEQ ID NO: 121483 - RNA, 46 nt, Mus musculus
caggcgguucuugagaucaagcauuucagcagggugucauggggga

SEQ ID NO: 121484 - RNA, 42 nt, Mus musculus
aaaggcuuccucaacagagagucuccgcacauacaaccagaa

SEQ ID NO: 121485 - RNA, 45 nt, Mus musculus
gcuacaguggcacucucugaugagucacguauguggcaccuggca

SEQ ID NO: 121486 - RNA, 45 nt, Mus musculus
augagaauugccugaagaacccacacaaagugcagucauggcucc

SEQ ID NO: 121487 - RNA, 41 nt, Mus musculus
aauuuuaaguagauaggcuucuuauggcuuuguccccagac

SEQ ID NO: 121488 - RNA, 42 nt, Mus musculus
gcaguggcagucaccacuuagcuaugcugaaugucaggucca

SEQ ID NO: 121489 - RNA, 45 nt, Mus musculus
guaggacagagacagaggucuaaagcccucugagauuuucagaga

SEQ ID NO: 121490 - RNA, 45 nt, Mus musculus
ccuuugcggacaguguucacugaaaagagaagagaaaagagagau

SEQ ID NO: 121491 - RNA, 46 nt, Mus musculus
uugccgcuugucaggagacccuauuuaacacuugagcuccucagag

SEQ ID NO: 121492 - RNA, 45 nt, Mus musculus
gaggguugccauuugauucuuuguaacagaaacucagcacagguu

SEQ ID NO: 121493 - RNA, 24 nt, Mus musculus
acagugaccaaagcagagugaaau

SEQ ID NO: 121494 - RNA, 45 nt, Mus musculus
cuuggacacacaugcauacaggcacacaugcacacauacagagag

SEQ ID NO: 121495 - RNA, 45 nt, Mus musculus
auaaauaucuguguuuucugaugguccuaggugaccccugugaaa

SEQ ID NO: 121496 - RNA, 46 nt, Mus musculus
augcuuuugagacagggucucacuauguaucccuggcuggccugga

SEQ ID NO: 121497 - RNA, 46 nt, Mus musculus
uauaggggcuugggauguagcuccgucauacagauugugccuaaca

SEQ ID NO: 121498 - RNA, 45 nt, Mus musculus
uuagccaucuggaugguuuuggucccuagauguucuuguaguagg

SEQ ID NO: 121499 - RNA, 46 nt, Mus musculus
gguuuauucauuuucuuuuuaaaggccucuaucaucuuuauaagau

SEQ ID NO: 121500 - RNA, 46 nt, Mus musculus
aguuuuauuuauuuccuuuaccuguuuaauuuuauuuuucuuuaug

SEQ ID NO: 121501 - RNA, 42 nt, Mus musculus
gaugaucacagucagcuauuagaugggucacacagcccccaa

SEQ ID NO: 121502 - RNA, 27 nt, Mus musculus
aguuugccaugcuuaccaagggcgccg

SEQ ID NO: 121503 - RNA, 44 nt, Mus musculus
gaacuccuuuuugauggauauuauccuuuuuucauuccagagau

SEQ ID NO: 121504 - RNA, 45 nt, Mus musculus
ccugggagauccuguagccguuuuauaauuugaaucauuucagaa

SEQ ID NO: 121505 - RNA, 46 nt, Mus musculus
guuaaagacuuggcugcuagucugugguacaaauaggaggugcuag

SEQ ID NO: 121506 - RNA, 42 nt, Mus musculus
aguauaugaugggcuaaaguuguuuacuucauggaugccagg

SEQ ID NO: 121507 - RNA, 46 nt, Mus musculus
ucugcccucuucauuucugcugucgucuuuuaaaggcuaguuacau

SEQ ID NO: 121508 - RNA, 46 nt, Mus musculus
auaccaacauuacugauuuuuaacuuucuuaacagagccucuaggg

SEQ ID NO: 121509 - RNA, 41 nt, Mus musculus
uuuuaaaaucaagacuccaccggcuuuagaauaagccuuua

SEQ ID NO: 121510 - RNA, 46 nt, Mus musculus
gcucguuuuaugggauucuuuuauugugguuguaauggggccugag

SEQ ID NO: 121511 - RNA, 41 nt, Mus musculus
aaaguacacauaauugagcaagccuuucgaugacuccuaga

SEQ ID NO: 121512 - RNA, 46 nt, Mus musculus
acagaaauagccaucgcaaauacuaugcugagggaaagaaacaagu

SEQ ID NO: 121513 - RNA, 46 nt, Mus musculus
ggcaugcugugaugcaguacccacagaggccagaagagggcaucag

SEQ ID NO: 121514 - RNA, 46 nt, Mus musculus
accccacauagcagcucgucacuaucuguaacuccaguuccaggag

SEQ ID NO: 121515 - RNA, 46 nt, Mus musculus
uuauccuaggcuauaccaaguuugaggcgauccugggcuacaugag

SEQ ID NO: 121516 - RNA, 46 nt, Mus musculus
ggguuccaguugagguguggcucagggaggaggugcauaugcagua

SEQ ID NO: 121517 - RNA, 46 nt, Mus musculus
auacauacacagacaugcacacauacacacauacauacacacacac

SEQ ID NO: 121518 - RNA, 59 nt, Mus musculus
gcacacagacauacacacauacacacauacauacacagacaugcacacauacacacaua

SEQ ID NO: 121519 - RNA, 41 nt, Mus musculus
gcaugucuguguauguauguguguauguguguaugucugug

SEQ ID NO: 121520 - RNA, 41 nt, Mus musculus
cucuuuucuaaagggaaauggaggaggacaggguccggggg

SEQ ID NO: 121521 - RNA, 42 nt, Mus musculus
ggucaggauguaagaaaagaauucuauuugaaaagaccaaag

SEQ ID NO: 121522 - RNA, 46 nt, Mus musculus
uuagauauuuauucuccuguuguggagucuaaguuaguccccaggu

SEQ ID NO: 121523 - RNA, 78 nt, Mus musculus
guuugauccguucauuagcaguaacauucaauauuuccuggaucgguuuuauaccaaccgcauuucuuuccgcaugcu

SEQ ID NO: 121524 - RNA, 46 nt, Mus musculus
uaucagaaacagacacaaugauguuguuccuacaauggcccaaggc

SEQ ID NO: 121525 - RNA, 36 nt, Mus musculus
ugcaugugugugugugugcauguaugugugugagag

SEQ ID NO: 121526 - RNA, 46 nt, Mus musculus
uaaguaugaugccaauuacaugaaaguaaaaauaccucggcaagag

SEQ ID NO: 121527 - RNA, 46 nt, Mus musculus
gagcuuccuugaacuuuuagaauaugaaaacaagagcccagaagac

SEQ ID NO: 121528 - RNA, 45 nt, Mus musculus
ucugcagcuucagggcuucaggccgaggugacuccuccagagcau

SEQ ID NO: 121529 - RNA, 46 nt, Mus musculus
cccaguaacuggacaugguggcacacagugugcccucagcacucag

SEQ ID NO: 121530 - RNA, 45 nt, Mus musculus
aaauagagaauaaaaugaaggaaugacauuacagugaccaguauc

SEQ ID NO: 121531 - RNA, 46 nt, Mus musculus
caaucuuucauucuaauuuguuuaaauauggaaaugggguccaggu

SEQ ID NO: 121532 - RNA, 47 nt, Mus musculus
gcccugcugaaaacugucuggaauguuuagauacuuagaauagggag

SEQ ID NO: 121533 - RNA, 42 nt, Mus musculus
guggaggauauacaaaccaucacaaaccauaagccccaaauu

SEQ ID NO: 121534 - RNA, 46 nt, Mus musculus
auggggcuggcuuacagguucagagguucaguccaauaucauuaag

SEQ ID NO: 121535 - RNA, 46 nt, Mus musculus
aguggguccuaggaacagugaacacaccuucaugguuuuuaaagug

SEQ ID NO: 121536 - RNA, 45 nt, Mus musculus
ugagugaaaaaggagaacaaagggaaaguccuagugaggccugaa

SEQ ID NO: 121537 - RNA, 46 nt, Mus musculus
aaauuguuguacuucagugguaguucugucuuagaguuggguagau

SEQ ID NO: 121538 - RNA, 45 nt, Mus musculus
uguguuacacauguguuagucaugaaacuagaaaggugacuauga

SEQ ID NO: 121539 - RNA, 45 nt, Mus musculus
cagagaaaaaaaauggguaacaggacagauguggcaugaaagcag

SEQ ID NO: 121540 - RNA, 24 nt, Mus musculus
uuuuuuaaguuggauaccgauuuc

SEQ ID NO: 121541 - RNA, 46 nt, Mus musculus
auccaauggucagacaaggucauaaaacuaaaccuaaagccaugaa

SEQ ID NO: 121542 - RNA, 46 nt, Mus musculus
acacacacacacacacacacacaccacacacacacacaccccgacc

SEQ ID NO: 121543 - RNA, 45 nt, Mus musculus
gugugguguguguguguguguguguguguguugauagggauggga

SEQ ID NO: 121544 - RNA, 45 nt, Mus musculus
cuuguaaacuuccuuucccuuuuucugacggcugaggguucauau

SEQ ID NO: 121545 - RNA, 46 nt, Mus musculus
ugcaaaauaugguguugucuauauuugggggagcaacacaggggau

SEQ ID NO: 121546 - RNA, 46 nt, Mus musculus
guucucuuucugaaguuuucaggagagugcgguuugagucaaguag

SEQ ID NO: 121547 - RNA, 42 nt, Mus musculus
gaugcaugccugagggcccuccuggggcauagguuucggguu

SEQ ID NO: 121548 - RNA, 43 nt, Mus musculus
uaccgaaguccaggaacuguuugauagacaguggcgacgggga

SEQ ID NO: 121549 - RNA, 46 nt, Mus musculus
uuaaugcugccacuuggcaguaucaguccauacucugcauggggau

SEQ ID NO: 121550 - RNA, 44 nt, Mus musculus
gcaggaaaaggcagacuugaaguguucuccacaggggccgcugg

SEQ ID NO: 121551 - RNA, 41 nt, Mus musculus
cuuuuggacagcccuaaagggcucuuuguguuuuagcaggc

SEQ ID NO: 121552 - RNA, 45 nt, Mus musculus
cuguuccauacuaucacuggagccucuuaacagggugagguacca

SEQ ID NO: 121553 - RNA, 42 nt, Mus musculus
gaaacuuggcccuggauucagaaaagcugagggggaagagau

SEQ ID NO: 121554 - RNA, 45 nt, Mus musculus
ucucuggaucaacaggagguaucaucuggguguacaugucccccu

SEQ ID NO: 121555 - RNA, 46 nt, Mus musculus
uuaugcagaugauuucguggcgaggguagacucugagccuagggag

SEQ ID NO: 121556 - RNA, 46 nt, Mus musculus
cacgucugaacagccugucccuccuacucuuacauagcccccagug

SEQ ID NO: 121557 - RNA, 44 nt, Mus musculus
guuuuguguaguugucaaggggcucagcaaaagcagcuagagau

SEQ ID NO: 121558 - RNA, 46 nt, Mus musculus
augugugacauuauuguaauuguguacuugagaauaacgugcaaaa

SEQ ID NO: 121559 - RNA, 44 nt, Mus musculus
uacgaaagacuauccucaccgcugugaguacugcaagaaaggau

SEQ ID NO: 121560 - RNA, 46 nt, Mus musculus
agaaaagcccuaugaaugccaguacugcgaauacaggucugcagau

SEQ ID NO: 121561 - RNA, 45 nt, Mus musculus
caaguguaaguucugugaauaugaaacagcugaacaaggccuauu

SEQ ID NO: 121562 - RNA, 46 nt, Mus musculus
aaccagcaaggcagagaaagccauagaaugcgaugagugcggaaag

SEQ ID NO: 121563 - RNA, 42 nt, Mus musculus
gaaaagacacaugaaaaaccauccugaacaccuugccaagaa

SEQ ID NO: 121564 - RNA, 42 nt, Mus musculus
uuaugcuccuuuccucucuuagcaauaauuauuggcccagau

SEQ ID NO: 121565 - RNA, 42 nt, Mus musculus
aaauguuaguacuauauaaggauuauuugauuuaaacaagag

SEQ ID NO: 121566 - RNA, 45 nt, Mus musculus
cugguaaaauagaacaugaugguucaucuggacugacuauggaca

SEQ ID NO: 121567 - RNA, 46 nt, Mus musculus
aggacagaugccucaaauucaaggccagcuugggccacagcgagac

SEQ ID NO: 121568 - RNA, 85 nt, Mus musculus
caaaaucuugcuaguguaugcaaugguaucagcauuggcacaugcuuuuauugauuuuuaauuguuuuugaaauucuaucucucu

SEQ ID NO: 121569 - RNA, 41 nt, Mus musculus
ugaaugugaacauccacuuauguguuugcuaggccccagca

SEQ ID NO: 121570 - RNA, 45 nt, Mus musculus
uugaauucuguauuauagguguaugacaguuugcauguuguaaga

SEQ ID NO: 121571 - RNA, 46 nt, Mus musculus
uuaacauaaaaucuauauugacuucagaccuuuaagaauggcagag

SEQ ID NO: 121572 - RNA, 45 nt, Mus musculus
agccaucuuggcccaaaacgguauuuuuaaaugccagugccagau

SEQ ID NO: 121573 - RNA, 41 nt, Mus musculus
gcuucccucuccucucucuucucuugaguguugggcauauc

SEQ ID NO: 121574 - RNA, 46 nt, Mus musculus
uauggguacagggacaaacuaauggacagggccauuuugacaauag

SEQ ID NO: 121575 - RNA, 46 nt, Mus musculus
guauuuagauuaguuucaguaaaccacaagagaguggguaggagau

SEQ ID NO: 121576 - RNA, 47 nt, Mus musculus
guuguaggcauuugaaguuagcuuaggcugcaaggucucauuagaaa

SEQ ID NO: 121577 - RNA, 45 nt, Mus musculus
auuuucucucauguuuacauuauggauugaaauuuguguauggag

SEQ ID NO: 121578 - RNA, 46 nt, Mus musculus
uguaccacagagaccuacauggcaaaguuuaccgcuguaccauaag

SEQ ID NO: 121579 - RNA, 45 nt, Mus musculus
uaaaucuuuaaaaaaaagaaaauauaaauuugacauuuuagagag

SEQ ID NO: 121580 - RNA, 45 nt, Mus musculus
gugcuuccuuguuggagacagucucauacuuguuuucuggacagu

SEQ ID NO: 121581 - RNA, 45 nt, Mus musculus
gguuguaagauugggccaugauaaucauucaagaaagguaguaga

SEQ ID NO: 121582 - RNA, 46 nt, Mus musculus
aacaaaaugacaauaaauaucccaaagaccuuaauaguaaagaaga

SEQ ID NO: 121583 - RNA, 48 nt, Mus musculus
guuauugaugaguccuaaauacauaaaguagagaaaguucuuaggggg

SEQ ID NO: 121584 - RNA, 47 nt, Mus musculus
aacagucaucaucccugaacaagugcuggauucagauguaaccgaag

SEQ ID NO: 121585 - RNA, 46 nt, Mus musculus
aauaauaauaauagguuaaagggaaucuaaauguuugagaaaagug

SEQ ID NO: 121586 - RNA, 72 nt, Mus musculus
aaggaagugaaggaaaaaaauggagucaugggaaagauggaaauaagaaaaaaaaaauacaaguucagggaa

SEQ ID NO: 121587 - RNA, 46 nt, Mus musculus
uaaaauucuguagucauagguagagaauguucaugauaccagagca

SEQ ID NO: 121588 - RNA, 46 nt, Mus musculus
ccccacuuaucauguagccgagacugauuuagaacccucuguauag

SEQ ID NO: 121589 - RNA, 45 nt, Mus musculus
gccucuggagugcuagguuuaaagauguaccaccacuacccagcu

SEQ ID NO: 121590 - RNA, 42 nt, Mus musculus
gaaauuagagauggggaaaaugaugaagagguuucugcagua

SEQ ID NO: 121591 - RNA, 54 nt, Mus musculus
gguaguuuggaguuagaauuuaagauaguaugagcuugaaccuucauugaacag

SEQ ID NO: 121592 - RNA, 69 nt, Mus musculus
uggcauuuuugcuuauuggaguaugugugcauguguggugguaaaagguacuugggagaaaguugggaa

SEQ ID NO: 121593 - RNA, 44 nt, Mus musculus
ucuguagacagaggcuagaucguuagcauauuuugugagguugg

SEQ ID NO: 121594 - RNA, 85 nt, Mus musculus
gaauucaguacaugcaaauacaauucaguacauuaagcaagacauaaaauagccaugguuaacaaggauacuaagaaagauaaca

SEQ ID NO: 121595 - RNA, 61 nt, Mus musculus
gaaaaugagaacuuuaacuggagaugggggaagaggggauggagauaaauacaggaaggau

SEQ ID NO: 121596 - RNA, 92 nt, Mus musculus
guacagauguggauccuagaauccuaucuuuaggguucaguguauaaccugaaguaaccauagaagccaagguaguagacagcagacagggc

SEQ ID NO: 121597 - RNA, 83 nt, Mus musculus
gagguggugacagaucagucacuggagcucauuagccagccagcccagccaagucaguaagaagccuugccucaaaaaauaaa

SEQ ID NO: 121598 - RNA, 64 nt, Mus musculus
gagauaauaaggacuaggauggauugcugaggagucaaguggagaagaucugaaugugaguggg

SEQ ID NO: 121599 - RNA, 46 nt, Mus musculus
uuccauguuugcucgaauguuagauuaugauaagaagaugagagua

SEQ ID NO: 121600 - RNA, 46 nt, Mus musculus
ucucaccagcccgguggggguguuuauguugcccuguuuuaaagau

SEQ ID NO: 121601 - RNA, 46 nt, Mus musculus
aaaacaaguaaacuauccaaaauuccuaauuuaagacuuggaagua

SEQ ID NO: 121602 - RNA, 45 nt, Mus musculus
auuaguucucuugaguguagcagugaaaagacuagucagccauaa

SEQ ID NO: 121603 - RNA, 46 nt, Mus musculus
auuuggagaaaugauggcuggcuaguauugaacaacauggcaagau

SEQ ID NO: 121604 - RNA, 42 nt, Mus musculus
aauuccugagugaagcauacagaaguuccaaguggggcaggg

SEQ ID NO: 121605 - RNA, 46 nt, Mus musculus
ugucuuuauccuuuuuuuauacacuccaguacaccuacagcuaaaa

SEQ ID NO: 121606 - RNA, 46 nt, Mus musculus
gauuguauaguuuaaaaacacuuauugauagucagcuuggaguaug

SEQ ID NO: 121607 - RNA, 44 nt, Mus musculus
uauuuuauuguccucauacuuuuuaggggaaaaaaacccuuaga

SEQ ID NO: 121608 - RNA, 46 nt, Mus musculus
gcaacuugaaaaucaaauuuaggacaaggauaauuuguaauaagau

SEQ ID NO: 121609 - RNA, 46 nt, Mus musculus
agccucuagaauuuguaagccaauuguguacuaccagccaccccuc

SEQ ID NO: 121610 - RNA, 46 nt, Mus musculus
cuauccagaaugcuaagauuauagacauguaccauuaugccaaguu

SEQ ID NO: 121611 - RNA, 46 nt, Mus musculus
cguauguccuaggccguuuccaaacuagcuguauguagccaagaau

SEQ ID NO: 121612 - RNA, 42 nt, Mus musculus
cuuuuccuuuguucucuguccuuccacccugaacccccuuug

SEQ ID NO: 121613 - RNA, 95 nt, Mus musculus
uuuuaaaauccauguaaucuuaaaacuuuuuuuuuugcucagcaggaaguacacuuuaaagaaacuaaauggccuuaauguauauagccucauuc

SEQ ID NO: 121614 - RNA, 106 nt, Mus musculus
gcaggucaaacccaggugcugaguaaccucuauccuugccccauaucugauuggaauauggccaaccugcucuuacuccugccaaauuguuuauccagacagcauu

SEQ ID NO: 121615 - RNA, 45 nt, Mus musculus
gaucaucaucuucccagacaauuaucuaaauuauugggcucagua

SEQ ID NO: 121616 - RNA, 74 nt, Mus musculus
aauguauguuuuuauuuuugucuucuaaauggaauguagacacagguccucauuugucuuuguccccaagcagu

SEQ ID NO: 121617 - RNA, 44 nt, Mus musculus
ucaggauuaagaugaaauaagagucagguuguauaauuaggaag

SEQ ID NO: 121618 - RNA, 45 nt, Mus musculus
guuggaaaucuugcuccuagagagugguuuuccuagaggccacgg

SEQ ID NO: 121619 - RNA, 45 nt, Mus musculus
auuugacuuuucuagaugcuuaugugggaaaugugucucacaguu

SEQ ID NO: 121620 - RNA, 49 nt, Mus musculus
aaguguucccaugauguuuuuaggaagucaguuuugaaaaugaguuugg

SEQ ID NO: 121621 - RNA, 45 nt, Mus musculus
auugcaguuuugaaugauccauuuuuguuagacagcugguccuuu

SEQ ID NO: 121622 - RNA, 49 nt, Mus musculus
cugugcuugauagcuaucagcucgguugggcuaggacaaguuugagaga

SEQ ID NO: 121623 - RNA, 46 nt, Mus musculus
aaauagguggcauuuugagguuacaagccugauggcccagacaggc

SEQ ID NO: 121624 - RNA, 38 nt, Mus musculus
agugguggcugugggaggcuuguuguucagaaguagaa

SEQ ID NO: 121625 - RNA, 45 nt, Mus musculus
guauauauauuuauuuauuuaacugaggaaaauuaaagggcagaa

SEQ ID NO: 121626 - RNA, 42 nt, Mus musculus
gcggccggccggcgccugcugcaggcuacgacggaggggguu

SEQ ID NO: 121627 - RNA, 23 nt, Mus musculus
gccccgaggaggccgcaguuagg

SEQ ID NO: 121628 - RNA, 93 nt, Mus musculus
ggaaaccuauugauauauguauuugauugacucuaaaaaguuguuguauuggaacaugaagaaaacauuuaaauaaaacaagauucugaaaca

SEQ ID NO: 121629 - RNA, 46 nt, Mus musculus
acuguguccucugguuucuaaaucuauuccccacgugccuccaauu

SEQ ID NO: 121630 - RNA, 46 nt, Mus musculus
caccacucuuagaaguugugugcccauucccuuaacacagguagau

SEQ ID NO: 121631 - RNA, 46 nt, Mus musculus
guccuucuauuugggguucuguugucugaaauuugaaggaauacga

SEQ ID NO: 121632 - RNA, 42 nt, Mus musculus
auauccaaugagggaugguggcagaccugcacagccucagac

SEQ ID NO: 121633 - RNA, 44 nt, Mus musculus
aaucuaugucauguucgaaugguggggaucgugaaagggccacc

SEQ ID NO: 121634 - RNA, 47 nt, Mus musculus
guagcacaccaacaacagaacaaagccuagaaaacaugccaucgugg

SEQ ID NO: 121635 - RNA, 41 nt, Mus musculus
ucuaggcuuuguucuguuguuggugugcuacuuugggggag

SEQ ID NO: 121636 - RNA, 81 nt, Mus musculus
ucuuuuuauugauuccuuguuugacaucauguagcccaaucccauucauccccucauauccaaccuuugcccaugcgaccu

SEQ ID NO: 121637 - RNA, 46 nt, Mus musculus
cauuuucaucgccaaaauauaagaauaaauuuauagcugcuacuag

SEQ ID NO: 121638 - RNA, 46 nt, Mus musculus
gaauuucuuuuacuagccuagggguauauuuucaaagcaauacuag

SEQ ID NO: 121639 - RNA, 81 nt, Mus musculus
ucuucuguuuuuauuuugcaguuuaauugguuggggucagauaagaagaggagugaccauuaagccaacuguagaugauga

SEQ ID NO: 121640 - RNA, 51 nt, Mus musculus
uuuugaccaaucccgugugcacagaaguaggagaaaaaauugcccuuagca

SEQ ID NO: 121641 - RNA, 42 nt, Mus musculus
aucagccuugacugcacuaacucuuccuccugucgacaggga

SEQ ID NO: 121642 - RNA, 46 nt, Mus musculus
cuaagaaugaagugcuuauggucaacauaggcucccugucgacagg

SEQ ID NO: 121643 - RNA, 41 nt, Mus musculus
acauaccuuugcugcuuucuugucuccuucaguacguacac

SEQ ID NO: 121644 - RNA, 58 nt, Mus musculus
ugggacaagugcucggugcaguuggagcuuuaccugaaauauucaccgaacuggagau

SEQ ID NO: 121645 - RNA, 45 nt, Mus musculus
guaaagcuccaacugcaccgagcacuugucccaccauucugucag

SEQ ID NO: 121646 - RNA, 51 nt, Mus musculus
uaggaguuggaacaaagaucgaccccaccuugugccgagcugacagaaugg

SEQ ID NO: 121647 - RNA, 46 nt, Mus musculus
aauuaaaacaggacaugguaggacauaucuuuaauaucagcacuug

SEQ ID NO: 121648 - RNA, 45 nt, Mus musculus
aaaacauuuuucacugggcauaguggugcauuccuuuagccccag

SEQ ID NO: 121649 - RNA, 49 nt, Mus musculus
agggagguguagcuggugguaguauccuaaaaggaguguuaaagguaaa

SEQ ID NO: 121650 - RNA, 103 nt, Mus musculus
uucuguguacuguuaaagaaaaaaguagcagcugugugguggaggaggaagaagagggagaggaggaggaggcaaugaagagagacggacaguuagagcugca

SEQ ID NO: 121651 - RNA, 53 nt, Mus musculus
agaaggaaacagggcagcaaaguuaaaaguagauuuagaagguguugagccag

SEQ ID NO: 121652 - RNA, 46 nt, Mus musculus
ucucuuguaugcuucauugauugacauuucuggugaagcuggagau

SEQ ID NO: 121653 - RNA, 43 nt, Mus musculus
accucgucuacgggugagugaguuccaaucagucagggcuaca

SEQ ID NO: 121654 - RNA, 46 nt, Mus musculus
aaagucucuugggggcacugguauuuucuucacuauauacucacag

SEQ ID NO: 121655 - RNA, 97 nt, Mus musculus
caauuucugcucaacugaaguacaauauugaaguugucugugaguauauagugaagaaaauaccagugcccccaagagacuuuacuucagagccccg

SEQ ID NO: 121656 - RNA, 45 nt, Mus musculus
agaucaaaauaugcuugaguuucaugauuucuauggcagccaggu

SEQ ID NO: 121657 - RNA, 42 nt, Mus musculus
ggucauuggaagcuucuugcuuaggacugugaggcugcagug

SEQ ID NO: 121658 - RNA, 50 nt, Mus musculus
guucaaaucccagcaaccacaugguggcucacaaccaucugacgcccucu

SEQ ID NO: 121659 - RNA, 56 nt, Mus musculus
ucuggugugucugaagacagcuacaguguacuuacauauaauaaagaaagaaagaa

SEQ ID NO: 121660 - RNA, 45 nt, Mus musculus
cuguuuuuacuguuuaggcauccccuuaaaauguaaaccugaggu

SEQ ID NO: 121661 - RNA, 42 nt, Mus musculus
acuuaggaccuucagaauguuuuuuuuucuuuagcaccagga

SEQ ID NO: 121662 - RNA, 42 nt, Mus musculus
gccaagaagugggagugguuagguaggggagcagggcggagg

SEQ ID NO: 121663 - RNA, 46 nt, Mus musculus
gccccucaugugcugggauuaaaggcguaugucaccacuaccaggc

SEQ ID NO: 121664 - RNA, 45 nt, Mus musculus
cugguaguggugacauacgccuuuaaucccagcacaugaggggca

SEQ ID NO: 121665 - RNA, 42 nt, Mus musculus
aacuugaugacccaaguuguccuagaccagaauguuacagau

SEQ ID NO: 121666 - RNA, 45 nt, Mus musculus
aguccacuguggugaaggcuauuucuggaguucacacugucagau

SEQ ID NO: 121667 - RNA, 45 nt, Mus musculus
auguuaccaaguugacaccacuuucacaugaaguuaucagcagac

SEQ ID NO: 121668 - RNA, 30 nt, Mus musculus
cguccacuagaggcuggacaggacccccga

SEQ ID NO: 121669 - RNA, 58 nt, Mus musculus
acggagccucaguuucuuaucuaugcgguguagucgauaauagccacaucagagaggu

SEQ ID NO: 121670 - RNA, 43 nt, Mus musculus
augugcuguagauuaauucgcugucagacauuuccucagaagu

SEQ ID NO: 121671 - RNA, 49 nt, Mus musculus
cuggccauuagugagggcuuguugaaauagugguuuauuaggaaggggu

SEQ ID NO: 121672 - RNA, 45 nt, Mus musculus
agguuaguguuaguaguuuuaacaagguuuuguuuucucccccag

SEQ ID NO: 121673 - RNA, 45 nt, Mus musculus
guuauccuugugccucagccucccauaggcacauguaacuauacc

SEQ ID NO: 121674 - RNA, 45 nt, Mus musculus
cucagccuggaauaugagacccugucucaaaacaaauuacuucag

SEQ ID NO: 121675 - RNA, 87 nt, Mus musculus
aaugaagggaaggagggaaggagggagggagagagagaaaagaaagaaagaaagaaagaaagaaagaaagaaagaaaguguguguua

SEQ ID NO: 121676 - RNA, 46 nt, Mus musculus
guauagaauauguacacauuagguuuauaagccauaauuugcccug

SEQ ID NO: 121677 - RNA, 42 nt, Mus musculus
acaggugugcugaugucuuuagauuuuuuuugacagggaguu

SEQ ID NO: 121678 - RNA, 45 nt, Mus musculus
ucaaaucccaccaaccacaugguggcucacaaccauccguaauga

SEQ ID NO: 121679 - RNA, 46 nt, Mus musculus
ucuugauaaaauggaaaauauaaaagaaaaaacugaguagggacag

SEQ ID NO: 121680 - RNA, 46 nt, Mus musculus
caguguacaaaaguguuuguugcacaauugauuuacuauauggcag

SEQ ID NO: 121681 - RNA, 47 nt, Mus musculus
uggaaguguaagcugaauaaaccuuuucacccaccacccacaaaaaa

SEQ ID NO: 121682 - RNA, 44 nt, Mus musculus
ucacaaccaucuuuaaugggauccgaugcccucuacuggugugu

SEQ ID NO: 121683 - RNA, 45 nt, Mus musculus
ccuggaacuagaguuaugugggugcugggaauuaaacuggggucc

SEQ ID NO: 121684 - RNA, 130 nt, Mus musculus
guuaaggaaaggauaagaaauaucuguuugucuugaaagagguuuuuuucuaagaauacugaagguagggauagaaacagcaugucuggaaggugggaauuuaaggaaaaauguuuaaaugaggauggag

SEQ ID NO: 121685 - RNA, 46 nt, Mus musculus
uauacguguaaugaaauuuguauaugauaaaggaagauucuacaga

SEQ ID NO: 121686 - RNA, 46 nt, Mus musculus
gcuagaagcaaagaaagagcaagauagaagauggcuugaggugggu

SEQ ID NO: 121687 - RNA, 46 nt, Mus musculus
agcugcuaaucuacauuucaauuaucaguuuucaagauaggcagug

SEQ ID NO: 121688 - RNA, 46 nt, Mus musculus
aaacaaacacaccauguaaguuaauaguuguuaacauguuuucuag

SEQ ID NO: 121689 - RNA, 45 nt, Mus musculus
cgaaaacuaagaaauucauaauccugaaagacaauauccugaaag

SEQ ID NO: 121690 - RNA, 46 nt, Mus musculus
uucacuccugugauucuaguacugggaaggcggaggcaggaguauu

SEQ ID NO: 121691 - RNA, 32 nt, Mus musculus
auuggaagaaaugguagaaaaacagaaaauga

SEQ ID NO: 121692 - RNA, 45 nt, Mus musculus
agaauugguuguguuuguugauauugaguaguuuugaaaagcaca

SEQ ID NO: 121693 - RNA, 46 nt, Mus musculus
uguuugaccccaguaaagaagggacuauagagcagcggaccaggag

SEQ ID NO: 121694 - RNA, 46 nt, Mus musculus
acaaaaaguagcugauuuuuuaaaaugguauuuuaccuggcaccac

SEQ ID NO: 121695 - RNA, 45 nt, Mus musculus
aaaacaacauagacaauaguguaaauuagaaauauuggagggcua

SEQ ID NO: 121696 - RNA, 46 nt, Mus musculus
ugacuuuuuacuaggucauguagauuaaauaggaaggauacaggag

SEQ ID NO: 121697 - RNA, 46 nt, Mus musculus
ugaauucaaagaaauuauaaaaauugaauauuuaucaaucucagcu

SEQ ID NO: 121698 - RNA, 45 nt, Mus musculus
aucagaagccaaugaugguggucuuggugaggauggugagagaag

SEQ ID NO: 121699 - RNA, 45 nt, Mus musculus
gguagaggaaauaacaauugaugaagaacgggguuauuugaaaga

SEQ ID NO: 121700 - RNA, 45 nt, Mus musculus
acgacucagacgugaguaaacaaaacacauuucuccuggggcaua

SEQ ID NO: 121701 - RNA, 44 nt, Mus musculus
gggaugacauugaguuugagcugcugaccugggaugaggaagga

SEQ ID NO: 121702 - RNA, 45 nt, Mus musculus
uaaaaaggcuggggguaaugguguguuuuugcaguccagugcugg

SEQ ID NO: 121703 - RNA, 52 nt, Mus musculus
guuccucuggggccuccgcuccuaccaugagacuagcaagaugaaagugcug

SEQ ID NO: 121704 - RNA, 45 nt, Mus musculus
gugaccugagaaaacuucuuacuuacgaguuuguaaagcagaagu

SEQ ID NO: 121705 - RNA, 42 nt, Mus musculus
uagaaauuuggaauccagcugaaggaaaucgacaaagaagag

SEQ ID NO: 121706 - RNA, 46 nt, Mus musculus
gaugucuauccagaaaucauugagcgcgcaugcuuuguccuggaga

SEQ ID NO: 121707 - RNA, 82 nt, Mus musculus
cucuuuccugaagaagggccacaucucggggcuguggaggacccugguucugugaggcacgagaguuggaggaggaucucag

SEQ ID NO: 121708 - RNA, 45 nt, Mus musculus
aacucucgugccucacagaaccaggguccuccacagccccgagau

SEQ ID NO: 121709 - RNA, 47 nt, Mus musculus
cguaaguucugccagucagguggaauuggccagucggcggggaucca

SEQ ID NO: 121710 - RNA, 46 nt, Mus musculus
acuggaggucugcuccgguuccagugaccacucagcagaacccacc

SEQ ID NO: 121711 - RNA, 42 nt, Mus musculus
ggguucugcugaguggucacuggaaccggagcagaccuccag

SEQ ID NO: 121712 - RNA, 46 nt, Mus musculus
gaugaaacgccugucugaaagacaaagagaaucaaagugaccagug

SEQ ID NO: 121713 - RNA, 47 nt, Mus musculus
gaacguggagucccggacuauaauucggggcaagaggacccgcaagg

SEQ ID NO: 121714 - RNA, 45 nt, Mus musculus
gagccaucugcugaugucugggcugcugcaccaucagcuucagag

SEQ ID NO: 121715 - RNA, 90 nt, Mus musculus
cagacccagaauguaaaucaggccaaaauggcugacguagggaccagcgcagguaucucugaagcugauggugcagcagcccagacauca

SEQ ID NO: 121716 - RNA, 45 nt, Mus musculus
cagccauuuuggccugauuuacauucugggucugggcaucagcuc

SEQ ID NO: 121717 - RNA, 44 nt, Mus musculus
accagccuaagacagcuaaggcuuggaaugacacuacuaagguc

SEQ ID NO: 121718 - RNA, 43 nt, Mus musculus
gcacugggagacugagggaaauuguaggugguaccggggccag

SEQ ID NO: 121719 - RNA, 42 nt, Mus musculus
ugauuacucucaggcacguaaugccaaggagaugcccaagaa

SEQ ID NO: 121720 - RNA, 45 nt, Mus musculus
gccagugggccaaaugcuaguccccagaguucacagcccccaacu

SEQ ID NO: 121721 - RNA, 42 nt, Mus musculus
gggagucucgcggcguggagaaagggaggguggaggcgagag

SEQ ID NO: 121722 - RNA, 44 nt, Mus musculus
aauuaagguucugaauucagaggaaccaucuaacgggaucaagg

SEQ ID NO: 121723 - RNA, 42 nt, Mus musculus
uugggguucggcccugaggcaaggugagguucgcccccagac

SEQ ID NO: 121724 - RNA, 46 nt, Mus musculus
ccgaaccccaaucccuucgcuguuuccuucuucgcgacucaagagg

SEQ ID NO: 121725 - RNA, 44 nt, Mus musculus
ggagaugcagggcccccagaagaaagugucaaggaagugaugga

SEQ ID NO: 121726 - RNA, 42 nt, Mus musculus
guugacagaaggacacuugagaaauacgaacgagaagcuaag

SEQ ID NO: 121727 - RNA, 46 nt, Mus musculus
aaauacuuaauagugcuuauuaauaagauggaugaccccacaguag

SEQ ID NO: 121728 - RNA, 46 nt, Mus musculus
gauuaccauuuauuccguauuuggauaguuugccaaacuucaacag

SEQ ID NO: 121729 - RNA, 46 nt, Mus musculus
acacacacacacaccuaucaguuggcuaaaagaaaagccaggacag

SEQ ID NO: 121730 - RNA, 46 nt, Mus musculus
gcacagauaggacuugugcaaaugccacuccuccugaaacgcacag

SEQ ID NO: 121731 - RNA, 46 nt, Mus musculus
caacauauauuucauuugcugaaugcuaauaaacuucugugcucau

SEQ ID NO: 121732 - RNA, 45 nt, Mus musculus
ggauggagagguaacaaaugcagaugauuccaugaugucucagga

SEQ ID NO: 121733 - RNA, 42 nt, Mus musculus
auguauauuuaggucacguuaaauaaaauggcugggggaaga

SEQ ID NO: 121734 - RNA, 41 nt, Mus musculus
caaaugcauuguccaaggaccugcaauggagucaggagguu

SEQ ID NO: 121735 - RNA, 46 nt, Mus musculus
ugaguaucuaaagcaaauacuaacugcagccuagaaggggaaagaa

SEQ ID NO: 121736 - RNA, 42 nt, Mus musculus
uagggacaaaauauuuacaaccuaaaaugggauagccaagau

SEQ ID NO: 121737 - RNA, 46 nt, Mus musculus
ccccuuguaaguaacuucauaacuuugcauggcaccagcacuagaa

SEQ ID NO: 121738 - RNA, 46 nt, Mus musculus
gaaaguaugucuacaaagcaaucuugacucagaaggccaccagcau

SEQ ID NO: 121739 - RNA, 45 nt, Mus musculus
guucauuucagaaaggacugcaacugccaugcaaaucagcccugu

SEQ ID NO: 121740 - RNA, 45 nt, Mus musculus
ucacaagaaacuccaaagcaaaaauuggagcacagaagcagcagc

SEQ ID NO: 121741 - RNA, 45 nt, Mus musculus
guugggcagagggguaggggugaguagugcuguuccacuugaaaa

SEQ ID NO: 121742 - RNA, 42 nt, Mus musculus
cagcuacuccucuacugccaugaauggaaaccuagccaagua

SEQ ID NO: 121743 - RNA, 47 nt, Mus musculus
gagaaggcaagugugaagagaauccugaguucaacaaugacgaagau

SEQ ID NO: 121744 - RNA, 42 nt, Mus musculus
uggggggcagcucagggagguuuugagugaaggaugagucag

SEQ ID NO: 121745 - RNA, 72 nt, Mus musculus
gggaaugccacugugaguuucucacaggcccuaguagaguucaccagcaauggaaaccuuuuuaccagcaug

SEQ ID NO: 121746 - RNA, 47 nt, Mus musculus
aaggcguacccuaguuacucacccccugaggagccagaggaagaaga

SEQ ID NO: 121747 - RNA, 47 nt, Mus musculus
ccacuucagcuuucccugcuacuucuagcagugagccagacuggagg

SEQ ID NO: 121748 - RNA, 48 nt, Mus musculus
ugaggcccuuaggucccucagugaugggucugguggcagggacaucag

SEQ ID NO: 121749 - RNA, 56 nt, Mus musculus
gcuuaugcccgagacacccauacucgggaaucuuauggcagaaauguccgagcccg

SEQ ID NO: 121750 - RNA, 58 nt, Mus musculus
gaacuuggagcccuuuucuucucggccaccuggggcaauggaaaccgaggaagaacgg

SEQ ID NO: 121751 - RNA, 47 nt, Mus musculus
gacagcuauaguggugaugcgcuauaugaguucuaugagccagauga

SEQ ID NO: 121752 - RNA, 45 nt, Mus musculus
agaagaagaagaagaagaagaagaagaagaagaauuauuagagga

SEQ ID NO: 121753 - RNA, 49 nt, Mus musculus
ggaggagauggccuugccagaugaugaugacaaugaugaugaagaagaa

SEQ ID NO: 121754 - RNA, 44 nt, Mus musculus
ggcaaggccaucuccuccccaccuccuugguagguuaccaagca

SEQ ID NO: 121755 - RNA, 46 nt, Mus musculus
aaugucuccagcacaaguacauuuuucaccaacuacugagaaggca

SEQ ID NO: 121756 - RNA, 62 nt, Mus musculus
aaaagcuggaguugagaagguacccucugugcacaagccgaagaaaagccuaaaaagcuucu

SEQ ID NO: 121757 - RNA, 46 nt, Mus musculus
cagagugccaauggagcguuggagauaggcucuaaacauaagacau

SEQ ID NO: 121758 - RNA, 44 nt, Mus musculus
caagaagggaaucuguacucugccuaguuucuuuggggguggac

SEQ ID NO: 121759 - RNA, 64 nt, Mus musculus
gagcaucaacuucuagcgaugcccaagaccagggagcugaaaagggagccaagaauaagacaac

SEQ ID NO: 121760 - RNA, 43 nt, Mus musculus
ugaucauguuauaagugugcccggaauccaaaggcagcauauc

SEQ ID NO: 121761 - RNA, 46 nt, Mus musculus
aguccuagccagagcaauuagacaacaaaggagaucaaggggauac

SEQ ID NO: 121762 - RNA, 45 nt, Mus musculus
agguuucuuuuggaccaaauguauuccagauuugaggcugggagu

SEQ ID NO: 121763 - RNA, 45 nt, Mus musculus
cauugcaauagaaaacaaagaagagggcauuaaguuguaagggag

SEQ ID NO: 121764 - RNA, 45 nt, Mus musculus
auagauagaugauaaaaaagagaaaagaaaguaaagaugcuuuga

SEQ ID NO: 121765 - RNA, 24 nt, Mus musculus
gaaaaaaaacuaagagagagauau

SEQ ID NO: 121766 - RNA, 42 nt, Mus musculus
aucuuugcagcuggucuuuuauuuccagcaucugacucugcc

SEQ ID NO: 121767 - RNA, 34 nt, Mus musculus
acugcuguagucccggugaaggcugcggcaggag

SEQ ID NO: 121768 - RNA, 46 nt, Mus musculus
cgauuuuacaucugucucuuccuacccucuaauaguuccauucccc

SEQ ID NO: 121769 - RNA, 46 nt, Mus musculus
uaguaagcuccucccagucaggggaauuuuuuuagagauagcauau

SEQ ID NO: 121770 - RNA, 46 nt, Mus musculus
uccucuucuucuacaucaucacuuuccucaacaucugccuccaucu

SEQ ID NO: 121771 - RNA, 47 nt, Mus musculus
guugaauacuuucuucggacucacaguugguaccaggugguuguagg

SEQ ID NO: 121772 - RNA, 46 nt, Mus musculus
aaaugagaacaggagaaaacuggaggaaucuguccugggggccaag

SEQ ID NO: 121773 - RNA, 45 nt, Mus musculus
ggccagaguagccuggcugaaggguaaggccugugucagggagcu

SEQ ID NO: 121774 - RNA, 23 nt, Mus musculus
ccucaaacuaagauugcuggugu

SEQ ID NO: 121775 - RNA, 66 nt, Mus musculus
cagacacgcccaaguucaaacaacaagaauugccauugcagaacaagagggaaggagagcaggaga

SEQ ID NO: 121776 - RNA, 46 nt, Mus musculus
ucugcuugaacugaacacugugggcagggcaacacacagccauaau

SEQ ID NO: 121777 - RNA, 46 nt, Mus musculus
uggaauguucaccuaauuagacaugagaaaauaauaaagcuugcag

SEQ ID NO: 121778 - RNA, 42 nt, Mus musculus
auauguuuagggcaaagaauagagaaagaggagugugggcaa

SEQ ID NO: 121779 - RNA, 44 nt, Mus musculus
augcacacaacaggaaggguuauuugaaagaggguggauaggag

SEQ ID NO: 121780 - RNA, 42 nt, Mus musculus
cauagagcagucuaaguucaucagugcccaagguaccggcug

SEQ ID NO: 121781 - RNA, 48 nt, Mus musculus
cugugggaaaauucagauguaaccuuucccauacauuagcaugaaauc

SEQ ID NO: 121782 - RNA, 47 nt, Mus musculus
agaucccagaaacugcaacucugacuccucugaggcccuggcccaag

SEQ ID NO: 121783 - RNA, 44 nt, Mus musculus
gcuccgcuuccugcuaacgggccacgacuuuacaaaccccaccc

SEQ ID NO: 121784 - RNA, 45 nt, Mus musculus
uaggggauugauccagucccucaaagaguuuccacugucucaucc

SEQ ID NO: 121785 - RNA, 42 nt, Mus musculus
gaaagcaguuggggcuaagacgcgguggaaggggacagagca

SEQ ID NO: 121786 - RNA, 46 nt, Mus musculus
gggagaaggagagaggauaaugggggaaggguaaugagggugggac

SEQ ID NO: 121787 - RNA, 45 nt, Mus musculus
ugaagaagguggucccuguuaugaagaacaggaaauugguugagg

SEQ ID NO: 121788 - RNA, 45 nt, Mus musculus
gacaugguggcaugugucugccauuccaaaacuugugugauagag

SEQ ID NO: 121789 - RNA, 42 nt, Mus musculus
ugugccugugugugugugugugugugugugugugucugagaa

SEQ ID NO: 121790 - RNA, 46 nt, Mus musculus
ggucugugugugugugugugugugugugugugugugugccucugug

SEQ ID NO: 121791 - RNA, 24 nt, Mus musculus
cuaucucagaagugaauggaagaa

SEQ ID NO: 121792 - RNA, 46 nt, Mus musculus
uaugccaauuuaucagauguaggagcgaggugugucacaggcagaa

SEQ ID NO: 121793 - RNA, 42 nt, Mus musculus
cuaaggagccaucugagggucggaaaugaacuagggccauga

SEQ ID NO: 121794 - RNA, 42 nt, Mus musculus
gucaaaacauacccuagaaacaaacaaugcccaaccccaggu

SEQ ID NO: 121795 - RNA, 42 nt, Mus musculus
aaacuccagcucugcauccaugguggugacacgcacacugau

SEQ ID NO: 121796 - RNA, 41 nt, Mus musculus
auacaaucaugcucccggucucuuuucucccuuguucgaga

SEQ ID NO: 121797 - RNA, 45 nt, Mus musculus
agcaaacuuagcuagagcacaguauugaguccuccgguuugagga

SEQ ID NO: 121798 - RNA, 50 nt, Mus musculus
aucaguucuucagauacauccucuggguagaacuuggcccggaacuugaa

SEQ ID NO: 121799 - RNA, 46 nt, Mus musculus
ggacaguaaaugucgucauugagaaugcccuccuucacuugcagaa

SEQ ID NO: 121800 - RNA, 46 nt, Mus musculus
uggggaagcaacuuaucuccagccagguagccagacuugugcacuu

SEQ ID NO: 121801 - RNA, 42 nt, Mus musculus
cgugcauuaaaagaaauaaauaaagaaauuggggguucagau

SEQ ID NO: 121802 - RNA, 46 nt, Mus musculus
ccagccauagcucugagccuuucuuguucuugaugcugaaauaguu

SEQ ID NO: 121803 - RNA, 46 nt, Mus musculus
gucuuguuaagauucuaggccccaguauaggggaaugccagggcca

SEQ ID NO: 121804 - RNA, 45 nt, Mus musculus
ucaaugggcuugaugacaaauuucuuaucauugaaagagauauuc

SEQ ID NO: 121805 - RNA, 71 nt, Mus musculus
gacgcauguacagcucaugauuucccaugcacagggccaagauccgcuuguuaauccgaagccggggagca

SEQ ID NO: 121806 - RNA, 51 nt, Mus musculus
gcuccaucugcuucuggugcuucucuucccgagccugggccuucaucugcu

SEQ ID NO: 121807 - RNA, 45 nt, Mus musculus
aauuuuuauuuuauuuuauuuguguguguguguguguguguguuu

SEQ ID NO: 121808 - RNA, 47 nt, Mus musculus
uccuucucccgcucaaucuucuccuucucuuucucagccagcucacg

SEQ ID NO: 121809 - RNA, 41 nt, Mus musculus
aguaaccugcuuccugggaauuuuccacuucauggugcagu

SEQ ID NO: 121810 - RNA, 46 nt, Mus musculus
ucugggcacgcuuccguuccugcucaaguucuagggcccugcgggu

SEQ ID NO: 121811 - RNA, 42 nt, Mus musculus
ccugggucuucuucuggucccgagaagccugcagcagggccu

SEQ ID NO: 121812 - RNA, 41 nt, Mus musculus
ucacuuuccuucuucuuucgagccauuuccaacugggagau

SEQ ID NO: 121813 - RNA, 45 nt, Mus musculus
caggaagcgggaguggguggguuggugagcagggggugcgggaag

SEQ ID NO: 121814 - RNA, 44 nt, Mus musculus
cagcacgagucuucuccaagucuuccuguaccaucugggccugu

SEQ ID NO: 121815 - RNA, 46 nt, Mus musculus
gguacguuccuccucacugcgguccuuggccauagcaucagcccgc

SEQ ID NO: 121816 - RNA, 43 nt, Mus musculus
cuccagcacaguguuaguuaggcaaaacuaugggagugugggg

SEQ ID NO: 121817 - RNA, 46 nt, Mus musculus
ucuugauuagaaacuaaaucccuaaacacagagacaaggcccacug

SEQ ID NO: 121818 - RNA, 108 nt, Mus musculus
guuuagaugcaacuggcuagguuugaggguacucauccucucuguccuagcuggaagagaucugaggauuggagaggguagggacagauuuagaaaaggaaccaagaa

SEQ ID NO: 121819 - RNA, 43 nt, Mus musculus
ggugugggggugugaagggacaaggccagaauacccagcagcu

SEQ ID NO: 121820 - RNA, 46 nt, Mus musculus
uggacuaaggauacugcauagagggacaagacagccuuuuggggac

SEQ ID NO: 121821 - RNA, 48 nt, Mus musculus
uuuacauauuugagcuagcaacagaaaauauuuguguacaggggauag

SEQ ID NO: 121822 - RNA, 46 nt, Mus musculus
aguuuucuugaacaguuggaguuaauaacuaaaauaaggugaaguu

SEQ ID NO: 121823 - RNA, 46 nt, Mus musculus
uuggcaugaacaaggucuuauuuuugauccuagcaaaaggaagaaa

SEQ ID NO: 121824 - RNA, 45 nt, Mus musculus
aaauucaagaugcacacaauuauucugggucaaagagguaaagau

SEQ ID NO: 121825 - RNA, 45 nt, Mus musculus
auauccuagacuucuguaaaaaugauaguugucaagccaguauau

SEQ ID NO: 121826 - RNA, 46 nt, Mus musculus
aaaaucacagaacaacccaaucucagaauuagacuagaacccagga

SEQ ID NO: 121827 - RNA, 46 nt, Mus musculus
ucugugguaggcaaauaagaaauauauuuuuaaacaagcagcaauu

SEQ ID NO: 121828 - RNA, 46 nt, Mus musculus
uaagcagcacaacacuguagagauauguggcuccauauucagagaa

SEQ ID NO: 121829 - RNA, 87 nt, Mus musculus
uacacugaacuucuaggacaagaauugucuagagaucaggcagguugacaugaggcuaauauauuuaucuugacucuacuagcaacu

SEQ ID NO: 121830 - RNA, 46 nt, Mus musculus
uaggguuuggacuaaagaauagcaggaaacuagguccgauagaggu

SEQ ID NO: 121831 - RNA, 46 nt, Mus musculus
aaaaaaaauguuucuaaugagaaaacauuuguauucauacuuugug

SEQ ID NO: 121832 - RNA, 45 nt, Mus musculus
uacuggcuaguuuugugucaacuuaaaacagcuggauuuaucaua

SEQ ID NO: 121833 - RNA, 46 nt, Mus musculus
aguuaauuaaucgugguuuucuguaaugguuuccuguagcaaagau

SEQ ID NO: 121834 - RNA, 45 nt, Mus musculus
ucuuaggcccuaauauucuuuucucaauauucacugaguuuuagg

SEQ ID NO: 121835 - RNA, 46 nt, Mus musculus
cucuuuaaaaaagguaaccucaccaagaaauguuucuggccaagcu

SEQ ID NO: 121836 - RNA, 45 nt, Mus musculus
aagaacacauguauggaucugugcaucagaauauaggacccagau

SEQ ID NO: 121837 - RNA, 45 nt, Mus musculus
acaacuuuaacaguccuaaacugugcaaugugauuagagguuuuu

SEQ ID NO: 121838 - RNA, 48 nt, Mus musculus
uacuuuaauugaaagagcaagaaaagggcaaaccccaaaucaguagau

SEQ ID NO: 121839 - RNA, 46 nt, Mus musculus
aagaggcugggaagcaaaagaggaagacaaagagagcaugaauaaa

SEQ ID NO: 121840 - RNA, 46 nt, Mus musculus
aaaucuaucagaauucuaauggauuuuugaagagacaccuuaaaag

SEQ ID NO: 121841 - RNA, 49 nt, Mus musculus
gccuaaauaauacaauagaucauguggaagaaagaauucuagagacaga

SEQ ID NO: 121842 - RNA, 46 nt, Mus musculus
uaauaaaagaagaaagaaauaaaacccugaauaaacucaagaagac

SEQ ID NO: 121843 - RNA, 45 nt, Mus musculus
agaugcaaaaaucuaaacagaauagaacaagaaagaugacaaauc

SEQ ID NO: 121844 - RNA, 46 nt, Mus musculus
ucuguaaaaugaaauuaauaauaauuugugacaucuuuuuggagaa

SEQ ID NO: 121845 - RNA, 46 nt, Mus musculus
ggggaaaaguuaagagaaaaguuauacuucagcaaaacuggcagcc

SEQ ID NO: 121846 - RNA, 46 nt, Mus musculus
gagcaaaaaugugauguccuauauugggagguguaugacauuagau

SEQ ID NO: 121847 - RNA, 106 nt, Mus musculus
ccaguaaguuauagcuuuauuuuugaacauaaaccuggugcuagaaacugugggagaucuagggagagauccuggacuuuauggaacaggcaaacaagagucagua

SEQ ID NO: 121848 - RNA, 46 nt, Mus musculus
caugguaauuuuagucaaauacacuuacuguuacuuuucagaagau

SEQ ID NO: 121849 - RNA, 46 nt, Mus musculus
ccagggccaagaagugggaguggguggguaagggaacagagugggu

SEQ ID NO: 121850 - RNA, 45 nt, Mus musculus
uuguguuuugcaaauuguaucuuaagaaaguacccaaggggcuga

SEQ ID NO: 121851 - RNA, 42 nt, Mus musculus
uauguauguacacauacuugauaaaguauuaaugcagcaaua

SEQ ID NO: 121852 - RNA, 42 nt, Mus musculus
caaugggaacagguucagagauggugcaaaugacagggauag

SEQ ID NO: 121853 - RNA, 45 nt, Mus musculus
cagcagcaugagugccuuacauccagaagaaauuuagccagcauc

SEQ ID NO: 121854 - RNA, 46 nt, Mus musculus
acaucuggaauugaugagugcacuauacauauuagaaagcgggguu

SEQ ID NO: 121855 - RNA, 46 nt, Mus musculus
uaagaaaaccauuauguauuaagaaggucauaaguacuauggagaa

SEQ ID NO: 121856 - RNA, 46 nt, Mus musculus
gacaacugccuugaaaaagaacuauauauuucuaccuaccucagau

SEQ ID NO: 121857 - RNA, 46 nt, Mus musculus
uuuucuugcugcauuaguauucacugguuguauacaacaaagagau

SEQ ID NO: 121858 - RNA, 44 nt, Mus musculus
caaaucaaaaguacacaaagcccuggaccugacgugguggcuau

SEQ ID NO: 121859 - RNA, 26 nt, Mus musculus
auauuggauguuuuaguauaauuagg

SEQ ID NO: 121860 - RNA, 23 nt, Mus musculus
agauauggguuugcuuguuuuug

SEQ ID NO: 121861 - RNA, 89 nt, Mus musculus
gaauaugcccggacuuguccaacaacccugugcaucugggauccagagauaaggaagagaaggagccugggaguuagcucuuggagagg

SEQ ID NO: 121862 - RNA, 43 nt, Mus musculus
guagucaguuccugccugugcagguucgaacuggggccagaug

SEQ ID NO: 121863 - RNA, 63 nt, Mus musculus
uccuucgugugguaaaucacuuggaaccuguggcaccuagggacggaaauagaggaccagaga

SEQ ID NO: 121864 - RNA, 61 nt, Mus musculus
guucaaagaaucccauuguaagauccauccauuugaucuugacagaguaagugugggaaca

SEQ ID NO: 121865 - RNA, 45 nt, Mus musculus
ugacuccagcagaaccuugguugcaacggauuccaccuauuguga

SEQ ID NO: 121866 - RNA, 45 nt, Mus musculus
ugcuuccucugagucucccgcagcuuuuagaaacuucaccgaaga

SEQ ID NO: 121867 - RNA, 45 nt, Mus musculus
accugccuuuaaaauggcauaacuucuaugaagugccuaauacag

SEQ ID NO: 121868 - RNA, 25 nt, Mus musculus
gauaaggucauuugggccaucuuau

SEQ ID NO: 121869 - RNA, 25 nt, Mus musculus
aauuuucuuucccccaaucuuuucu

SEQ ID NO: 121870 - RNA, 42 nt, Mus musculus
acaugacagcuccacacugaaugaauccauucgucggaccau

SEQ ID NO: 121871 - RNA, 51 nt, Mus musculus
cgagaucuaaaagcugugggaaggaaauuuaugcauguuuuauauccaagg

SEQ ID NO: 121872 - RNA, 46 nt, Mus musculus
ucugaguggaagguaaguaauuagguaaagauagaaaauauggcau

SEQ ID NO: 121873 - RNA, 42 nt, Mus musculus
gcgucuucuauuuuuuuuaauuuauuuauuaagaaagaaaag

SEQ ID NO: 121874 - RNA, 46 nt, Mus musculus
ccugcuccaacuucugaguccuaguauuucaaguaugcaccaccac

SEQ ID NO: 121875 - RNA, 45 nt, Mus musculus
cuugaaaaaauauauauauugcugaguuuuaaaagauuaaccuua

SEQ ID NO: 121876 - RNA, 46 nt, Mus musculus
aguuuucauacuguuuucuuaggauguuacagaaaaguuccauuga

SEQ ID NO: 121877 - RNA, 41 nt, Mus musculus
agcaguuaccaucacgcugaauuccaaacuucuuggcggaa

SEQ ID NO: 121878 - RNA, 46 nt, Mus musculus
auucuacuuugucaucaguuggaugauacucacguucacgccauga

SEQ ID NO: 121879 - RNA, 45 nt, Mus musculus
guuuguuuguuuugauuauauauggaggaauuuuuuuuuuuggag

SEQ ID NO: 121880 - RNA, 46 nt, Mus musculus
cuguaugugucauauugaacucuaauagaugaagauuaggagucag

SEQ ID NO: 121881 - RNA, 83 nt, Mus musculus
ugcugcuuccacaucucagaccaugacacuguuuuacauggcuuagcaauaggaagaguagagacuugauuuaauugggcuuc

SEQ ID NO: 121882 - RNA, 42 nt, Mus musculus
cugacuuacugcauuuuagcugccugcuuauuccuggagaug

SEQ ID NO: 121883 - RNA, 45 nt, Mus musculus
aagauuaaagucauucaaguacugaaugccuuucuauucggauag

SEQ ID NO: 121884 - RNA, 52 nt, Mus musculus
uuaagacaaaauuuggauaucauauuauuaugguugaagggagaaaauaaaa

SEQ ID NO: 121885 - RNA, 45 nt, Mus musculus
gauucagugaaguggccacacaauauagugaagauaaagccagac

SEQ ID NO: 121886 - RNA, 42 nt, Mus musculus
gucgugggacgcgccggcgcggagucccacuguggcccggag

SEQ ID NO: 121887 - RNA, 45 nt, Mus musculus
ggggcggcgagcccccgucgcgccucgugcggcggagaggccagg

SEQ ID NO: 121888 - RNA, 50 nt, Mus musculus
ccuccuggccagccgggcgaaggagagcgaccccgaggccagcgggaggg

SEQ ID NO: 121889 - RNA, 46 nt, Mus musculus
uggcccggccugggcagcguuggcucagcaaguggcuuguggcuau

SEQ ID NO: 121890 - RNA, 42 nt, Mus musculus
cuauuuuauaucuggccuuuucuaguguuuucuugcgggcag

SEQ ID NO: 121891 - RNA, 45 nt, Mus musculus
cacuugccauacuagcuuaggugcaugagggugcccaggccuugg

SEQ ID NO: 121892 - RNA, 45 nt, Mus musculus
uagcucuggucaggugggacgaagaggcgggcagaguuuguguag

SEQ ID NO: 121893 - RNA, 46 nt, Mus musculus
cgcuaccuggggaggaccaggggaaagugaaaaaaagugccgugag

SEQ ID NO: 121894 - RNA, 42 nt, Mus musculus
gagaaccgggagggaggugugugucgcacccgcacuaugaag

SEQ ID NO: 121895 - RNA, 42 nt, Mus musculus
ucuugcccccugggcuucggaggggggugcuugugcccccaa

SEQ ID NO: 121896 - RNA, 41 nt, Mus musculus
cuguucucuccuuaucuuuggcaucuuugguucaaggugga

SEQ ID NO: 121897 - RNA, 46 nt, Mus musculus
gguguauaauugcuuguuguacagaaaugguugacuaaagagagag

SEQ ID NO: 121898 - RNA, 50 nt, Mus musculus
ggagucucucgccguugaugucgaaguggccaacccaccagcaagcaagg

SEQ ID NO: 121899 - RNA, 45 nt, Mus musculus
aagccaucuccuacguggauccucaguuccucaccuacauggcuc

SEQ ID NO: 121900 - RNA, 44 nt, Mus musculus
cgacgauuacuaccgauacuacgaggaagauucugacagcgaca

SEQ ID NO: 121901 - RNA, 42 nt, Mus musculus
aggaaccgguggugagacccaaaguccggaauguggcgacuc

SEQ ID NO: 121902 - RNA, 45 nt, Mus musculus
cugcugaaggcagggcagcugcaaaagguaacaacagcuuggaga

SEQ ID NO: 121903 - RNA, 47 nt, Mus musculus
gaagggggcaaggucuucccgcuuuacuaguguuaaccaugaugcga

SEQ ID NO: 121904 - RNA, 41 nt, Mus musculus
agggugggcacggggagaaauccggugaccccuuugcgggu

SEQ ID NO: 121905 - RNA, 78 nt, Mus musculus
augaugaguucgaccucgugcugcauaaauacuuacaggcagaagaguacucuauccgguccugcacgaaaggcugca

SEQ ID NO: 121906 - RNA, 42 nt, Mus musculus
caaucugggggcccacaaacacaguucuccaacaauggucag

SEQ ID NO: 121907 - RNA, 46 nt, Mus musculus
ucagagaagccugaauuuaugagacccugaaucagguaguguuuua

SEQ ID NO: 121908 - RNA, 48 nt, Mus musculus
ucugggccaaaagacgaguccagcuggcucuaaagaagaaagggauaa

SEQ ID NO: 121909 - RNA, 45 nt, Mus musculus
aauagauugauuuuggaaaaaucauucuucucuauacaagccuag

SEQ ID NO: 121910 - RNA, 45 nt, Mus musculus
gcuuaauacccaauugaaauucucaacacugagguacguugcuga

SEQ ID NO: 121911 - RNA, 45 nt, Mus musculus
cagaugauuauuucuugccaugauucauauccaagacagguccuc

SEQ ID NO: 121912 - RNA, 42 nt, Mus musculus
uggccaggggucccauggguaccuuaagaagauaagcagcca

SEQ ID NO: 121913 - RNA, 42 nt, Mus musculus
augaccacagaguagggggcugauuacacaguuuggggagag

SEQ ID NO: 121914 - RNA, 75 nt, Mus musculus
cagacccggugccccuuuauccucccugacaaugaagaaaugguguauggaggccucccuggcuuuaucuguaca

SEQ ID NO: 121915 - RNA, 64 nt, Mus musculus
gguaaagucagggcacuggggaagagggggagaugaaagagcuuaggggcauggagacaggaag

SEQ ID NO: 121916 - RNA, 46 nt, Mus musculus
ccaccaccagcaauuccaccacuccuauuuucaccacuaccaccau

SEQ ID NO: 121917 - RNA, 42 nt, Mus musculus
cccagccaccgucgcucaggaacgggucccugcagcccccag

SEQ ID NO: 121918 - RNA, 45 nt, Mus musculus
cccagagguagagcgcagggaaccccugccugcggcagcgccaag

SEQ ID NO: 121919 - RNA, 41 nt, Mus musculus
uggcagcucagaacuuccuacaacuccaguuccaggggauc

SEQ ID NO: 121920 - RNA, 46 nt, Mus musculus
auccguuauuuuuauuuuuaauuauguguaugugugcuugugucua

SEQ ID NO: 121921 - RNA, 46 nt, Mus musculus
aacauuuucacauguauuuuaggauuggcuuuuuauguaccucaag

SEQ ID NO: 121922 - RNA, 55 nt, Mus musculus
uugugauuacauugaauuuaaaaauuguauuaguuaagauuucuuuucuauugcu

SEQ ID NO: 121923 - RNA, 46 nt, Mus musculus
aaaaacaaauguaguuuaauuuugcauaugaaguuuguauccaaag

SEQ ID NO: 121924 - RNA, 45 nt, Mus musculus
gagagagagagagagagaacaugaaguuuggggggaaaggugugg

SEQ ID NO: 121925 - RNA, 46 nt, Mus musculus
ccagaacauuaaaaucuauaaaacaaugaugaaagaaguugaagac

SEQ ID NO: 121926 - RNA, 46 nt, Mus musculus
uuguaauagaauaaacacagcuggaaauuauuauuaaaugaaauaa

SEQ ID NO: 121927 - RNA, 43 nt, Mus musculus
gacgaugaguggaucuguggaagagggcagauaaggggugggg

SEQ ID NO: 121928 - RNA, 23 nt, Mus musculus
cuuuuuaagaguuugaaggguaa

SEQ ID NO: 121929 - RNA, 45 nt, Mus musculus
cagcauuuggaggcuaauuaugggauggauccccggauauggcag

SEQ ID NO: 121930 - RNA, 46 nt, Mus musculus
auaauuaugcuguuuccuccuucuucugucuuccucaagugaccac

SEQ ID NO: 121931 - RNA, 25 nt, Mus musculus
agggccuuauacaugguagagaacu

SEQ ID NO: 121932 - RNA, 56 nt, Mus musculus
gaaaagugugaauaauaacaggauguuuaauucaggguggcaauaagaauaaaaua

SEQ ID NO: 121933 - RNA, 49 nt, Mus musculus
uauuauuguuauuauuaugugcugagaaauaagcaaagagaauagccaa

SEQ ID NO: 121934 - RNA, 54 nt, Mus musculus
augugaaauauagccuuuucuuugagcuugaagaaaguuguaguccccaucaua

SEQ ID NO: 121935 - RNA, 46 nt, Mus musculus
uugguggggcagucuaaacuaagagcauugcuuuuguaguauggag

SEQ ID NO: 121936 - RNA, 46 nt, Mus musculus
gucuuauuuaauuagaaugaauacacaaagacuuacuaaaggagaa

SEQ ID NO: 121937 - RNA, 83 nt, Mus musculus
acauugauaacauaaaauauuauuuaaaauaacgaauggaauucagacagggaaguucugaaaaagcaugugugaaagucuca

SEQ ID NO: 121938 - RNA, 71 nt, Mus musculus
aagcaaagaagaucucuggacgauggaagagcuaccaaaagagcaguguaagugugaagucauaaggggga

SEQ ID NO: 121939 - RNA, 49 nt, Mus musculus
uuuuucucagagcaguccuaagacagcaaagaguuugguguguugaagg

SEQ ID NO: 121940 - RNA, 46 nt, Mus musculus
uuucacaguaagaccuugucuccuaugaacaaauaagugaaugcag

SEQ ID NO: 121941 - RNA, 45 nt, Mus musculus
aaagggcuuauuuugcauguaacacuucaaaacuuaggcaaccag

SEQ ID NO: 121942 - RNA, 46 nt, Mus musculus
aguccagcacucaggaaacugaggcaggaggaucacaaguucgcag

SEQ ID NO: 121943 - RNA, 46 nt, Mus musculus
ucugaauuuauucaguggugagaggauuuguuuuauuauugacaga

SEQ ID NO: 121944 - RNA, 47 nt, Mus musculus
cuauuguucuuuguauagaauucaggccucuugagcacccucaaccc

SEQ ID NO: 121945 - RNA, 77 nt, Mus musculus
guuuccucuaugaagggugaggacuacacuuaccugugaguauaaggauaaauauuuagaauguaguuagggauuau

SEQ ID NO: 121946 - RNA, 64 nt, Mus musculus
ugggguagucgucuaaguuuucaguauucagaacaguuuuccucagguuauuugaauuuuuagu

SEQ ID NO: 121947 - RNA, 56 nt, Mus musculus
auuaaauuacacuggaaaccauaaggggcuaaggaaaagaacaaacagauuuugag

SEQ ID NO: 121948 - RNA, 46 nt, Mus musculus
auuuuagauauagugauguuuuuagaacugucauaaaacggaccuu

SEQ ID NO: 121949 - RNA, 46 nt, Mus musculus
acauugaguaaauaacgcuccucucuauuagcaagauaagcagaag

SEQ ID NO: 121950 - RNA, 46 nt, Mus musculus
gauccuaaacuucauuauuauagcauuaaagcuagaagccacuuag

SEQ ID NO: 121951 - RNA, 46 nt, Mus musculus
gggaagagaaugaugguucauuccagauagaagggcuagcgguuua

SEQ ID NO: 121952 - RNA, 46 nt, Mus musculus
guggggugggcgucagauguaaagugaaagaaccagaucuugugga

SEQ ID NO: 121953 - RNA, 46 nt, Mus musculus
uguguauguguguguguguguguguguguguugguauuuugcuaaa

SEQ ID NO: 121954 - RNA, 45 nt, Mus musculus
uugaagugucugucaucccagaacuuaaaaggcugagguagaaag

SEQ ID NO: 121955 - RNA, 46 nt, Mus musculus
uggauauggauauugauauauggauauagauauauucuucuggcag

SEQ ID NO: 121956 - RNA, 46 nt, Mus musculus
ggacagucaugccagucuccugucugcaugcacaauauggccucag

SEQ ID NO: 121957 - RNA, 46 nt, Mus musculus
ggcugccuguggaagacagucuccuccuggccaccuuucgaucaag

SEQ ID NO: 121958 - RNA, 46 nt, Mus musculus
uggaguagaaucucaacucaaccaaagcauuuauccuaccugaaaa

SEQ ID NO: 121959 - RNA, 46 nt, Mus musculus
aaaaaauacaaaauacauggcucaaguauuaaaggagcacugggaa

SEQ ID NO: 121960 - RNA, 78 nt, Mus musculus
aacacaagcauauuuaaaccaugauacauauaaauucuaaauuuugauuugagacuauaaucuggaguagucaaugaa

SEQ ID NO: 121961 - RNA, 54 nt, Mus musculus
caggugcuacaaagcagacacugaggaaauggguacgggcaaaagaguaauaca

SEQ ID NO: 121962 - RNA, 49 nt, Mus musculus
uacacacauccacauacauauaaaacacacacacagagacagacagaga

SEQ ID NO: 121963 - RNA, 46 nt, Mus musculus
aauugaagauaauaccagauaauggaaagaccucccauguucaugg

SEQ ID NO: 121964 - RNA, 46 nt, Mus musculus
uacaaaucuucuggacugaaaaggaaaaagauaauuaagugaacag

SEQ ID NO: 121965 - RNA, 42 nt, Mus musculus
aggauaauuaugcaacaaauccacagacccagaaaggcugag

SEQ ID NO: 121966 - RNA, 71 nt, Mus musculus
uggggcagauggagaugggaacaggaggggucaugcauggggcuauagagggagagauuacuguaggaguu

SEQ ID NO: 121967 - RNA, 46 nt, Mus musculus
gaggguucgugccuagucuuauuguaaauuguuuuucuauguacag

SEQ ID NO: 121968 - RNA, 42 nt, Mus musculus
cagagggccggagggaccugaaugagagaggggagggggaag

SEQ ID NO: 121969 - RNA, 46 nt, Mus musculus
ggggauugcaacccuguaagaauuagaacaauaucaacuaacccag

SEQ ID NO: 121970 - RNA, 42 nt, Mus musculus
aaggcugccuugucuggccucagugggaaaggaugcaccuaa

SEQ ID NO: 121971 - RNA, 45 nt, Mus musculus
cacaauuaggaggugugaccuuguuggaauggguauggccuuguu

SEQ ID NO: 121972 - RNA, 50 nt, Mus musculus
auuaaggaaaaguaauuguugcuuccuauuuuuuguuuguuuguuuguuu

SEQ ID NO: 121973 - RNA, 46 nt, Mus musculus
cacuuuagcagcugagacaggaauaucuugaguucaaagccagcaa

SEQ ID NO: 121974 - RNA, 46 nt, Mus musculus
uuuuugaguauuuuguuaagcccuuuugaaucuauguucaucagag

SEQ ID NO: 121975 - RNA, 42 nt, Mus musculus
gcuaguuuugugucauaugaagaaagcaguuugguccugagg

SEQ ID NO: 121976 - RNA, 46 nt, Mus musculus
ugugcuuccuauuucaagccuggaguguugguagauauagaucugg

SEQ ID NO: 121977 - RNA, 46 nt, Mus musculus
ggaauaucaggcauaaucacuagauuaggcccuggagagggacuug

SEQ ID NO: 121978 - RNA, 46 nt, Mus musculus
augaagguaguuaucguuggagaacaauuuuuagguuuaguggaac

SEQ ID NO: 121979 - RNA, 25 nt, Mus musculus
aaagagaagagagagaugguguaau

SEQ ID NO: 121980 - RNA, 46 nt, Mus musculus
uuuuuauguuagcuauuuuaaaguuuugucaaguaauucccaguag

SEQ ID NO: 121981 - RNA, 45 nt, Mus musculus
cuacccugccugaguucuucaccucaucuccccugcccccaccuc

SEQ ID NO: 121982 - RNA, 46 nt, Mus musculus
cuuugucucagucaguugcugauagagucucucagagaacagccgc

SEQ ID NO: 121983 - RNA, 50 nt, Mus musculus
agacaucaagugugaguguugcauaaacuuggauuggcaguaauuuggua

SEQ ID NO: 121984 - RNA, 46 nt, Mus musculus
ugacuaauaucaagaauuaauccuagccaaauggauggaccuggag

SEQ ID NO: 121985 - RNA, 46 nt, Mus musculus
guuuugcaugcuagaaagacuugcaguagaaggauauuggggauuu

SEQ ID NO: 121986 - RNA, 46 nt, Mus musculus
cugcuuucucuuuugcugcagaaagaaaccuggagcuaggaaugaa

SEQ ID NO: 121987 - RNA, 46 nt, Mus musculus
acauuuucccucaccuaaaagaauuuccuauauaguuuuuggccag

SEQ ID NO: 121988 - RNA, 44 nt, Mus musculus
gugugugugugagagagagagagagagagagagagagauugggu

SEQ ID NO: 121989 - RNA, 46 nt, Mus musculus
accaugugguuuuugucuuugaguuuguuuauauaguggauuuuug

SEQ ID NO: 121990 - RNA, 46 nt, Mus musculus
augagaagugauuuuagaucugagucuugcuuuuccagugugauag

SEQ ID NO: 121991 - RNA, 45 nt, Mus musculus
aggaaaacagaccacaagucauuucauuuguaagcagccauguag

SEQ ID NO: 121992 - RNA, 46 nt, Mus musculus
caggcuucacauagccacauugugguaacuccauaaguaagugcag

SEQ ID NO: 121993 - RNA, 45 nt, Mus musculus
agauaucugucaaguuuuuuguuuaaaacuggacauuugcgguua

SEQ ID NO: 121994 - RNA, 46 nt, Mus musculus
agauauaucaugucacuaucuaguuacugauuacuauuacugcagu

SEQ ID NO: 121995 - RNA, 42 nt, Mus musculus
cuuugguuggucauucagucucugagcuccccaaagguccag

SEQ ID NO: 121996 - RNA, 44 nt, Mus musculus
guucucaggcucauggacaaccaggcacugcagggaguggcaga

SEQ ID NO: 121997 - RNA, 46 nt, Mus musculus
aaacauagugacuaguaguaacuucagucuguuucuucagucccga

SEQ ID NO: 121998 - RNA, 47 nt, Mus musculus
auuuguucacauuuagaacccuugagaaagacugauucagauagaga

SEQ ID NO: 121999 - RNA, 49 nt, Mus musculus
gaagaagugacagaacccagaucauguugauuaagauuuauaggccaua

SEQ ID NO: 122000 - RNA, 46 nt, Mus musculus
augagucuuuaacaagaugauguuguacagaauggauaauggauag

SEQ ID NO: 122001 - RNA, 45 nt, Mus musculus
ggagauagaagcaggaggacuuuguugauaauuuaaagguaguua

SEQ ID NO: 122002 - RNA, 23 nt, Mus musculus
agaaugagugaaagaggacugca

SEQ ID NO: 122003 - RNA, 42 nt, Mus musculus
ucuuagucaucauguaaacaaacuuaggauguuugccaccug

SEQ ID NO: 122004 - RNA, 46 nt, Mus musculus
caguaucuauguguuuguuuuaaaagguuuuuuuuuaaaguauuua

SEQ ID NO: 122005 - RNA, 26 nt, Mus musculus
ccuauucccuuucccuuucccaccca

SEQ ID NO: 122006 - RNA, 45 nt, Mus musculus
ccucacuuggguccuucagcuuguuaaccuucuugagugcugcag

SEQ ID NO: 122007 - RNA, 46 nt, Mus musculus
cgugaaaacuggaaguuccauuuuuuaacuuuuaaaaauaugcaag

SEQ ID NO: 122008 - RNA, 46 nt, Mus musculus
ggacucaacauauaauucuggugaaacucaggaagaaccguauuag

SEQ ID NO: 122009 - RNA, 45 nt, Mus musculus
ucuaaagaugcaaguuaguuacaauguggaaugagaacaauaaga

SEQ ID NO: 122010 - RNA, 46 nt, Mus musculus
agcuuuccucaguugccugcugugagugugugugugugugugugug

SEQ ID NO: 122011 - RNA, 46 nt, Mus musculus
auggcucuuaugaucuuccugccuuccucuucuauaauguccccgg

SEQ ID NO: 122012 - RNA, 42 nt, Mus musculus
gagacauucucuucccccauaccucaccaccaccucccagag

SEQ ID NO: 122013 - RNA, 46 nt, Mus musculus
ggcucacuaaagugcaagagggguacuccugaaaggcagacugagg

SEQ ID NO: 122014 - RNA, 44 nt, Mus musculus
gcggcuucacacuaggcagaggcagugcuuuugaaaccugugcu

SEQ ID NO: 122015 - RNA, 46 nt, Mus musculus
uacuuccuccagcaagccugcauccuccuucaaacagugcuaccaa

SEQ ID NO: 122016 - RNA, 41 nt, Mus musculus
auaaagacaaucaguagcuugauguguuauguuuggaggua

SEQ ID NO: 122017 - RNA, 46 nt, Mus musculus
aacuguaaggcagcaccaaugaaauguucuccguuauaggacucgc

SEQ ID NO: 122018 - RNA, 80 nt, Mus musculus
uaugacugaauauuuacugaaucagcuuugugcaggccccguguaggcaaguguagcuguuagucauguuguacccccaa

SEQ ID NO: 122019 - RNA, 45 nt, Mus musculus
uaaagcuacaaaaguuuaauauaaucacuuuaaaggguaccaaaa

SEQ ID NO: 122020 - RNA, 46 nt, Mus musculus
uacauguaauaauaauaauaaaaagagaucauauauuugagggaga

SEQ ID NO: 122021 - RNA, 41 nt, Mus musculus
guccaagaccaauuacaccagaguucugaggcacugaggcu

SEQ ID NO: 122022 - RNA, 45 nt, Mus musculus
guauuuuccaccaagggagccaaauacaaacuggaauggucagag

SEQ ID NO: 122023 - RNA, 45 nt, Mus musculus
gccuacucaaucaugauggaugaucauuuugauguguucuuggau

SEQ ID NO: 122024 - RNA, 42 nt, Mus musculus
ucugcuggcaagguagcccggggcucgagucacgagucuugc

SEQ ID NO: 122025 - RNA, 42 nt, Mus musculus; identical to SEQ ID NO: 122024

SEQ ID NO: 122026 - RNA, 46 nt, Mus musculus
ucucuuugauacuaauguaauuccucauuaacaauuuaagccagac

SEQ ID NO: 122027 - RNA, 46 nt, Mus musculus
gcuuuauaaagaaccuggccaaaaagcuuuugguaucaaugggcag

SEQ ID NO: 122028 - RNA, 42 nt, Mus musculus
gagugugugugugcaugugcgugcgugugugugugugugugu

SEQ ID NO: 122029 - RNA, 46 nt, Mus musculus
ucaagacauaugaauuagagaaguuaaauuuauaacagaaacucag

SEQ ID NO: 122030 - RNA, 41 nt, Mus musculus
cucuuuuccugaaagaaaaguaggaagagaaugugguaagg

SEQ ID NO: 122031 - RNA, 46 nt, Mus musculus
uucccccauucaucuuggcaugucaguugaugcuuucaucguuuag

SEQ ID NO: 122032 - RNA, 45 nt, Mus musculus
ggugugacuuaccugacauauaugguagacacaaucuugcagcag

SEQ ID NO: 122033 - RNA, 41 nt, Mus musculus
auaauguccuugaaaaguaaacaagacugacaaagccccag

SEQ ID NO: 122034 - RNA, 42 nt, Mus musculus
aauggaggaguguuuucucuuucuccacauucucaccagcau

SEQ ID NO: 122035 - RNA, 45 nt, Mus musculus
acacccuuccccucaaggcucaggaaucuaugugaaaaaggaggc

SEQ ID NO: 122036 - RNA, 46 nt, Mus musculus
gcaucauuuagacacagagggacugagcccauaugaacucauggag

SEQ ID NO: 122037 - RNA, 46 nt, Mus musculus
aucaugaaugaguucuuuauuuuaccauguggguccugggauuuga

SEQ ID NO: 122038 - RNA, 46 nt, Mus musculus
caugcuaaaacucuaacccucauacaccccacccucugacagccau

SEQ ID NO: 122039 - RNA, 46 nt, Mus musculus
aaauuaccacaaaacaaucuuacaauccuaaaggcuaauggcugag

SEQ ID NO: 122040 - RNA, 46 nt, Mus musculus
aaaagagaagcaaccucagcuuuuaaaaaaauaaaucaccuuucag

SEQ ID NO: 122041 - RNA, 46 nt, Mus musculus
ucuugaagauacuggacaagagaaaggggaagaacaaaagggugau

SEQ ID NO: 122042 - RNA, 45 nt, Mus musculus
gcgcacgccuuuaaucccagcacuugggaggcagaggagaccagc

SEQ ID NO: 122043 - RNA, 24 nt, Mus musculus
aaaauacaauuuaaaauuugccaa

SEQ ID NO: 122044 - RNA, 46 nt, Mus musculus
acagagaccaagaccacucaccaucaucagaacgcagcacccccac

SEQ ID NO: 122045 - RNA, 46 nt, Mus musculus
uuuucagggccauugcuauuuugauugugaagauucugugguuuug

SEQ ID NO: 122046 - RNA, 42 nt, Mus musculus
acauaacccuauaauauggccuaguauuugucucaccgguag

SEQ ID NO: 122047 - RNA, 46 nt, Mus musculus
aaugagauuuuuaagcugacauuugucagugugaguaagggccaau

SEQ ID NO: 122048 - RNA, 45 nt, Mus musculus
gauauaaagaacuaaauggcuugaauugcuauuucugagauggag

SEQ ID NO: 122049 - RNA, 46 nt, Mus musculus
acaugcuccacuauuuucauagcagccuuauuuauaauaaccagaa

SEQ ID NO: 122050 - RNA, 45 nt, Mus musculus
uguaaagagggcuaacaguagcggagagaaggaagagaaagagga

SEQ ID NO: 122051 - RNA, 45 nt, Mus musculus
gcaacacuagagauagaaauccuaggaaagaaaucuggaaccaua

SEQ ID NO: 122052 - RNA, 41 nt, Mus musculus
agguaccaaaguuauggggcaugauggggaaggaggugugg

SEQ ID NO: 122053 - RNA, 46 nt, Mus musculus
caucugaaggcuaaagguaaugaaaacuauugaaauaauccagggg

SEQ ID NO: 122054 - RNA, 46 nt, Mus musculus
gacaaggaaagaacugaggaaaagaacaacaauuggaagcaugcag

SEQ ID NO: 122055 - RNA, 45 nt, Mus musculus
cucuuuuuuugguaguucagucucugugagucccuaugggcccag

SEQ ID NO: 122056 - RNA, 46 nt, Mus musculus
ucagcagucagucaggaggcagagaaguacaugagcccacccccaa

SEQ ID NO: 122057 - RNA, 45 nt, Mus musculus
uuuuccucauuuacauuuccagugcuaucccaaaagucucccaua

SEQ ID NO: 122058 - RNA, 46 nt, Mus musculus
ugugaccugguuggaguaguugugucauugugggugugggcauaag

SEQ ID NO: 122059 - RNA, 46 nt, Mus musculus
uagaacucuagcuccuccugcaccaugccugccuggaugcugccau

SEQ ID NO: 122060 - RNA, 42 nt, Mus musculus
ugucaggcauaugugugugugugugugugugugugugugugu

SEQ ID NO: 122061 - RNA, 42 nt, Mus musculus
augaaaagcagccaacuagcuguaggcugaggccagccuggg

SEQ ID NO: 122062 - RNA, 42 nt, Mus musculus
cuugaauacccagccuaauagccucgcaaguacaagucggag

SEQ ID NO: 122063 - RNA, 46 nt, Mus musculus
uucucuagacagauggauuguuugauuaagugguuuccuggggccc

SEQ ID NO: 122064 - RNA, 45 nt, Mus musculus
auaugguucugugccuacucuccucuuucaccaucgccaccucag

SEQ ID NO: 122065 - RNA, 46 nt, Mus musculus
cuccucagagcuacaaguacauaggccuugaggucaggguuaccag

SEQ ID NO: 122066 - RNA, 46 nt, Mus musculus
ugggaacuggaaguuggugugucccgagcauugauuaagcacccaa

SEQ ID NO: 122067 - RNA, 46 nt, Mus musculus
auccuagauucucccauuccauccuggcccaugccccugccccagg

SEQ ID NO: 122068 - RNA, 46 nt, Mus musculus
ucagaaaacuaccuggagucuucccaccugucaccacccaccccag

SEQ ID NO: 122069 - RNA, 46 nt, Mus musculus
gaugguuaaacuggauaaccuccaaaagccccuuagaguuugaaga

SEQ ID NO: 122070 - RNA, 42 nt, Mus musculus
ucuucaccgagcccgaggccggcaacuucuacacccgagagg

SEQ ID NO: 122071 - RNA, 45 nt, Mus musculus
cucuucacuucaaagucaaccccacagggcuauaaaaaaaucaga

SEQ ID NO: 122072 - RNA, 45 nt, Mus musculus
ccacuaagugcucggauuacaagcgugcauccccccaccccacuc

SEQ ID NO: 122073 - RNA, 45 nt, Mus musculus
ccaccaaguugacucuaacuuuguaggacaccaggauccccagaa

SEQ ID NO: 122074 - RNA, 42 nt, Mus musculus
ggaaaaagaggaauaccuugaauggucaauccaguggggggg

SEQ ID NO: 122075 - RNA, 45 nt, Mus musculus
ggaggagggagaagaagaauuccaaaaagagcagcaggugacggg

SEQ ID NO: 122076 - RNA, 45 nt, Mus musculus
cagagggaaaggauuaaaaaaaaagaugagggugaugcggaaaag

SEQ ID NO: 122077 - RNA, 48 nt, Mus musculus
aacucuucgaugacuauguccuccgagcuuucaggagcagcaaagggg

SEQ ID NO: 122078 - RNA, 24 nt, Mus musculus
ucugaagacuggaucucucacuga

SEQ ID NO: 122079 - RNA, 42 nt, Mus musculus
aaacuccaaggagacacguccugcucauccccgcccccaccc

SEQ ID NO: 122080 - RNA, 42 nt, Mus musculus
ggucacuuauacagcuaauuuuauucguagaaaucaguagaa

SEQ ID NO: 122081 - RNA, 48 nt, Mus musculus
gggaucugccaggacaagcuggcuagaccucugagaaguuggagaagu

SEQ ID NO: 122082 - RNA, 42 nt, Mus musculus
cccagacuacaacaaugaguugacccaguuucugccccgaau

SEQ ID NO: 122083 - RNA, 41 nt, Mus musculus
uaaaaacugccaugguguuuccugucaaagaaaauggagua

SEQ ID NO: 122084 - RNA, 45 nt, Mus musculus
accucgcuggaucagaaagacagaagaaaaccaaggcugagggag

SEQ ID NO: 122085 - RNA, 46 nt, Mus musculus
guaggcauccccacugccucgucucagaauauuuuaucaccccaaa

SEQ ID NO: 122086 - RNA, 42 nt, Mus musculus
cuugggcccgauuugggaucuggaugcugauugguagguguc

SEQ ID NO: 122087 - RNA, 46 nt, Mus musculus
ggcucauucuugcaauuucuggggucaucuggagacagccacagaa

SEQ ID NO: 122088 - RNA, 46 nt, Mus musculus
gauuuauugauuuuuuuuuauaugugugaauauuuugccugaauga

SEQ ID NO: 122089 - RNA, 45 nt, Mus musculus
ggcauuccucuuugaacucacugaccucguggaccucaugucaau

SEQ ID NO: 122090 - RNA, 46 nt, Mus musculus
cacacaaucuuggcuggucuugggugcaaugugugaacuuacagau

SEQ ID NO: 122091 - RNA, 46 nt, Mus musculus
gcacuuguagguuagagagccacaaagcugggaccauaauggggga

SEQ ID NO: 122092 - RNA, 94 nt, Mus musculus
cagccaguguggcccgggcuuggagcucugcuuuugacaaccugauuggaaaccacaucucucggacucugaaggggaccaucuugcugaagau

SEQ ID NO: 122093 - RNA, 45 nt, Mus musculus
cacacacagaguaagguggguaauuauggcaggaaucugugaggc

SEQ ID NO: 122094 - RNA, 46 nt, Mus musculus
uacaauuguucaccuccgucugguguucauucauuaagauguuagu

SEQ ID NO: 122095 - RNA, 48 nt, Mus musculus
ugggccuucaccaccggcuggaaucucauucucuccuacgucauuggu

SEQ ID NO: 122096 - RNA, 59 nt, Mus musculus
cacauuaggugcagguguguauguccuggcuggagagguggccaaagauaaagcaggac

SEQ ID NO: 122097 - RNA, 64 nt, Mus musculus
cauccucuucaauuccaacuagaaugcuguggcaggcacuucgaagauuuggucaaaagcuggu

SEQ ID NO: 122098 - RNA, 46 nt, Mus musculus
cucauucaccugguggagggaguggguuuuguaauucacuuuugga

SEQ ID NO: 122099 - RNA, 85 nt, Mus musculus
gccggaggagguggggaacauuugcuuucuccgagggcaaagaaggcucagguggaucgccggggcuuggugagaagggauaaga

SEQ ID NO: 122100 - RNA, 55 nt, Mus musculus
aaaaucuagaugcugagucuagggccaccgggcgggaccccuaaucggccgagag

SEQ ID NO: 122101 - RNA, 73 nt, Mus musculus
aagacccuagcccaggagccagggcucccuagcuccagcgcauuuccagauuguuuuucuucauggagccaua

SEQ ID NO: 122102 - RNA, 43 nt, Mus musculus
ccaacccaacucgacugaagucagccucacugaaccggaucug

SEQ ID NO: 122103 - RNA, 41 nt, Mus musculus
uguugcaaagccaugugacuggugacugacggugugcgugu

SEQ ID NO: 122104 - RNA, 46 nt, Mus musculus
ccucccuuuuucuaccuaugauucaacuguuuccaaaucaacaaga

SEQ ID NO: 122105 - RNA, 28 nt, Mus musculus
uuucuguuccauaugcccuacuugagag

SEQ ID NO: 122106 - RNA, 44 nt, Mus musculus
uauaguccuaagugacgcuaaccuccccuacucaccuuggcaau

SEQ ID NO: 122107 - RNA, 48 nt, Mus musculus
cagcucuaccagacauuuguuguccagcuccaggacccccagaaaccc

SEQ ID NO: 122108 - RNA, 41 nt, Mus musculus
caucaaagcugguaggaaaccuaggaccagagggaguuguu

SEQ ID NO: 122109 - RNA, 41 nt, Mus musculus
ugggagagugguucaggguucugacacagacuacacccaga

SEQ ID NO: 122110 - RNA, 27 nt, Mus musculus
caguucuuugcucggaguaugggcgac

SEQ ID NO: 122111 - RNA, 46 nt, Mus musculus
uaccuugacuuggauuugaacacagcaaagugucugccucgcaguc

SEQ ID NO: 122112 - RNA, 64 nt, Mus musculus
gaguaauauaguuuauuuaagacacaggaaggggaguugggaaggggggagaaagagggagagg

SEQ ID NO: 122113 - RNA, 25 nt, Mus musculus
auucuucaggucaauagucaagccu

SEQ ID NO: 122114 - RNA, 45 nt, Mus musculus
cgagaucugacucccucuucuggagugucugaagacagcuucagu

SEQ ID NO: 122115 - RNA, 45 nt, Mus musculus
aagcgcacucgcagcugcuucccacggaggggcauguuguccagc

SEQ ID NO: 122116 - RNA, 45 nt, Mus musculus
cccucuccaccuggccgaacacagaaaaggcuucuuccagcaguu

SEQ ID NO: 122117 - RNA, 46 nt, Mus musculus
agcagcuggcuucccugagaacucaacaaugccuuucccugagggc

SEQ ID NO: 122118 - RNA, 47 nt, Mus musculus
cacaucuaaacauauuucuaaagaauuuuauaccuagccccaaguaa

SEQ ID NO: 122119 - RNA, 82 nt, Mus musculus
caucuaacugguccauaggcuccacagucacaggccgaggaaaucugggugauagaagaaaguuaguguuaaugaggccaua

SEQ ID NO: 122120 - RNA, 43 nt, Mus musculus
auacucauacucaaaggagccagguugugcaaaucuggguggc

SEQ ID NO: 122121 - RNA, 44 nt, Mus musculus
cccugccucauuagcauaaccuggugcucaugacgugcagccuc

SEQ ID NO: 122122 - RNA, 24 nt, Mus musculus
auacaagauauagucagucuggaa

SEQ ID NO: 122123 - RNA, 43 nt, Mus musculus
aaauuauaauuuucuauuagaaaauuauauuagaggccacagg

SEQ ID NO: 122124 - RNA, 46 nt, Mus musculus
gguuccaucuggcaucauaguggcagguccuggaggagcuggagua

SEQ ID NO: 122125 - RNA, 45 nt, Mus musculus
uaaaaugcuuguucugcaaguuugaggacucaaagaagggggaga

SEQ ID NO: 122126 - RNA, 46 nt, Mus musculus
ugagaucugaugcccucuucuggcauaucugaagacagcuccagug

SEQ ID NO: 122127 - RNA, 45 nt, Mus musculus
ccacagacuuugacuuguugaauaccaccccucccuugccccucu

SEQ ID NO: 122128 - RNA, 36 nt, Mus musculus
cugaguucauuuucccaugguucuccaggcccucaa

SEQ ID NO: 122129 - RNA, 49 nt, Mus musculus
uuggaggauguuuaugguuugugguauauauggcagugucucagggguu

SEQ ID NO: 122130 - RNA, 27 nt, Mus musculus
cugcacuugggucgaggauuccugcuu

SEQ ID NO: 122131 - RNA, 23 nt, Mus musculus
gugcuggcccugugggaugcugu

SEQ ID NO: 122132 - RNA, 42 nt, Mus musculus
cagagucuggagccgcagccuacaacuggccagcuggccaaa

SEQ ID NO: 122133 - RNA, 39 nt, Mus musculus
gaagaggcggucaucagagcugcaccagcuagaggccga

SEQ ID NO: 122134 - RNA, 45 nt, Mus musculus
uucugcccugccggcaccugugccugugccaggcuugcacugaga

SEQ ID NO: 122135 - RNA, 45 nt, Mus musculus
ucucuaacuggguuccuguucggcaacaucaauggagcagggcag

SEQ ID NO: 122136 - RNA, 42 nt, Mus musculus
aagcaucuugcgggcuugggggcuuugggucuuggcagccug

SEQ ID NO: 122137 - RNA, 46 nt, Mus musculus
aaaacauaaguauuuucccugcuguauuuuagaauaacagucucag

SEQ ID NO: 122138 - RNA, 41 nt, Mus musculus
gccucaaaacaacaacaacaacaaaaaauacauacaggcaa

SEQ ID NO: 122139 - RNA, 45 nt, Mus musculus
ccuccaccuccacccccaggaccacugaagaaagagaaggaccaa

SEQ ID NO: 122140 - RNA, 51 nt, Mus musculus
uauaaugccuucagacagacagacagacaugcaggcagaauaccagugcac

SEQ ID NO: 122141 - RNA, 46 nt, Mus musculus
gcuugggacuauaucuccugccacagaaccaugcauauuagcuuag

SEQ ID NO: 122142 - RNA, 45 nt, Mus musculus
gcaucaucuugcccuccaucauugccccuuccucuuuggccucag

SEQ ID NO: 122143 - RNA, 46 nt, Mus musculus
caguggcagauaauuguuuguacaggaacuuuuuaugcuguauuag

SEQ ID NO: 122144 - RNA, 42 nt, Mus musculus
ugagagguagaggcagguggguaucaguaaguuugaggccag

SEQ ID NO: 122145 - RNA, 46 nt, Mus musculus
aggccauacuccuugagccuucucaggcaguuccacuaacugggaa

SEQ ID NO: 122146 - RNA, 46 nt, Mus musculus
ugaguucaagaacaaucugggcagcuuagugagaccuugacucaag

SEQ ID NO: 122147 - RNA, 48 nt, Mus musculus
gugcucggagaaagaggaaaaagaagcaccgugagcuuauacaggaag

SEQ ID NO: 122148 - RNA, 46 nt, Mus musculus
acaaugauggcuccuguggaguccaaguuuucccagucaacuggag

SEQ ID NO: 122149 - RNA, 46 nt, Mus musculus
aaauuaaggaaacuugaggaaaacaguggcgucgaucuucuggcag

SEQ ID NO: 122150 - RNA, 46 nt, Mus musculus
accuggaacucaacuguuuaccucagguuguccuuaaacucaccau

SEQ ID NO: 122151 - RNA, 45 nt, Mus musculus
ccccuaccuguugagugcugggauuauacauauacaucaccacau

SEQ ID NO: 122152 - RNA, 45 nt, Mus musculus
uguuuugauacaugaucuugguguguagccauuagccagcccuca

SEQ ID NO: 122153 - RNA, 45 nt, Mus musculus
ucucugaagaagagucgaauucucuuaggaaaaacaggagucauc

SEQ ID NO: 122154 - RNA, 46 nt, Mus musculus
agaaaaauaguucuguaagguaauugagguacaaauugggggguua

SEQ ID NO: 122155 - RNA, 49 nt, Mus musculus
accauuaaugaugcaaguuggcauggcaaccaagauaaaaaacuacuau

SEQ ID NO: 122156 - RNA, 90 nt, Mus musculus
aucgccuuuccuggguucucuucauccuggccaguuacugcagguaaagaauucuuuccugucuuuauucucuucuaaggaaauugacag

SEQ ID NO: 122157 - RNA, 46 nt, Mus musculus
uucuguguuaucuuuuagaucuuuagccuaaauauaaaggagugag

SEQ ID NO: 122158 - RNA, 46 nt, Mus musculus
aguguuuuaaauucuuuaugugaaauuaggauguuugacggacuag

SEQ ID NO: 122159 - RNA, 42 nt, Mus musculus
gugaaccaccauguaguugcugggauuggaacucaggaccuu

SEQ ID NO: 122160 - RNA, 44 nt, Mus musculus
aacaaccuuuuucgugcuccaauuuaucuucauaagaugccaga

SEQ ID NO: 122161 - RNA, 47 nt, Mus musculus
gguuacuuuauucgagaauuaguggauauuuuuguuguuggccagca

SEQ ID NO: 122162 - RNA, 46 nt, Mus musculus
gauggaagauauaaagaaagccuuuccuucacauucagaaagcagc

SEQ ID NO: 122163 - RNA, 25 nt, Mus musculus
gaagucugauuuucguuuaccaacg

SEQ ID NO: 122164 - RNA, 41 nt, Mus musculus
uuugcuccugaggaagaaaaugaagaagauuuccagaugaa

SEQ ID NO: 122165 - RNA, 46 nt, Mus musculus
ugaaggguucuccuaugugaagauuccaaacaaaccgacacaacag

SEQ ID NO: 122166 - RNA, 34 nt, Mus musculus
gcagcuucuucguaaauuuggugugccugaggag

SEQ ID NO: 122167 - RNA, 55 nt, Mus musculus
caucaacagaggucuuaucaacugacacagacagcagcucagcugaagacaguga

SEQ ID NO: 122168 - RNA, 49 nt, Mus musculus
auaugcugcagaacaagaaaacaaguucucagcugucucgggagcggga

SEQ ID NO: 122169 - RNA, 46 nt, Mus musculus
uauuugguggaauaguaauauuuagcuauugcuucucugucuccag

SEQ ID NO: 122170 - RNA, 45 nt, Mus musculus
uggccgcugucucaagauuuaucgaacauuucgagaugaggaggg

SEQ ID NO: 122171 - RNA, 56 nt, Mus musculus
gucgaaaauuugcccuuuuugaugagcaacaccgagaagagaugagaaaagaacgg

SEQ ID NO: 122172 - RNA, 41 nt, Mus musculus
auauacuuauauauaauaauaaauaaaucuuugggucugag

SEQ ID NO: 122173 - RNA, 46 nt, Mus musculus
caaacaaaugcuccaccuucuaacccuguugcuaugaccgaggaac

SEQ ID NO: 122174 - RNA, 46 nt, Mus musculus
cauucauaaugauaaugaagaacuuaucaagguugaagggaccaag

SEQ ID NO: 122175 - RNA, 43 nt, Mus musculus
aucccagcaaccacaugguggcucacaaccauccacaauggga

SEQ ID NO: 122176 - RNA, 45 nt, Mus musculus
ugacacugucuucuaucuuggagucuauuaucaaugacaugagag

SEQ ID NO: 122177 - RNA, 45 nt, Mus musculus
aguuugugauuugcuagaaauaauguuauuuauguugacaguuca

SEQ ID NO: 122178 - RNA, 45 nt, Mus musculus
uuuuguguaagacauuugcuuucauuucucuuugguauaugcaua

SEQ ID NO: 122179 - RNA, 45 nt, Mus musculus
uguaagaauccuuagugagauccugaaauuauaauuuugcgugca

SEQ ID NO: 122180 - RNA, 46 nt, Mus musculus
uagucuuggccauuucaucacccaguuaauaagaaauuuguuccag

SEQ ID NO: 122181 - RNA, 46 nt, Mus musculus
aguacuuuauacuucaguugauauaaacaaaacacaucuugacaag

SEQ ID NO: 122182 - RNA, 46 nt, Mus musculus
ggggaauauaacugacguucaaaggccaaguaagucacacuaaacc

SEQ ID NO: 122183 - RNA, 51 nt, Mus musculus
cugugaguuugaggacagccagggcuacacagaagauauugucucgaauaa

SEQ ID NO: 122184 - RNA, 42 nt, Mus musculus
ccucccagcagccucaacacuuuguucccagagaggccccau

SEQ ID NO: 122185 - RNA, 41 nt, Mus musculus
aucuacaauaaauuuugauuaagucagagucucacugggug

SEQ ID NO: 122186 - RNA, 41 nt, Mus musculus
acacgccuguaaucucagcacucaggaggcagaggcaggca

SEQ ID NO: 122187 - RNA, 41 nt, Mus musculus
uuugacucaacuugagaaagauauuuguacagcuaaagaag

SEQ ID NO: 122188 - RNA, 46 nt, Mus musculus
auccauguuuuacaguugaggaaaacagggugguuaacaacgguag

SEQ ID NO: 122189 - RNA, 46 nt, Mus musculus
augcuguaccuauucucaagguuucaugauagagaauaaaacccag

SEQ ID NO: 122190 - RNA, 47 nt, Mus musculus
uaugucugaaggcgaagaugaugaggaagaugcugggagugacgaag

SEQ ID NO: 122191 - RNA, 45 nt, Mus musculus
ucagcuaagugaaaguggaagugacucugauguggaaucuggcag

SEQ ID NO: 122192 - RNA, 43 nt, Mus musculus
gauaugugugugguuauauguuacuaugcauacuuucaaggug

SEQ ID NO: 122193 - RNA, 42 nt, Mus musculus
aggguuuuucugagacauggagaaggguggggagggaagcug

SEQ ID NO: 122194 - RNA, 77 nt, Mus musculus
aacagugaacauacauuugugucggggguugugaaauuuagaguaagcagaaaauaaaacacacuugcagaaaugug

SEQ ID NO: 122195 - RNA, 61 nt, Mus musculus
cagcagugcaggccaggcccaguaacacaggacuaagcaacaucagacagaggaggaauag

SEQ ID NO: 122196 - RNA, 66 nt, Mus musculus
cucguguauaucaaguugacaaguugauguuuuugagugggaucauuuuucuuaggggcauaugaa

SEQ ID NO: 122197 - RNA, 55 nt, Mus musculus
ccaacacccaggauaccagcuucagcagcaucgguggguaugagguaucagagga

SEQ ID NO: 122198 - RNA, 97 nt, Mus musculus
uuggguauauaugauaugcuuguauauacuuguaugugcaaaggaaaagauaugaaagaauguacauuaaaguguuagcagugauagccucugaggg

SEQ ID NO: 122199 - RNA, 45 nt, Mus musculus
aggaagguucugucaaaguucaggcugaaauccugugggcagggc

SEQ ID NO: 122200 - RNA, 46 nt, Mus musculus
uggggagauggcagccauaagcuuuaagugauucaauaaguggagg

SEQ ID NO: 122201 - RNA, 46 nt, Mus musculus
cagaaaagucgaagggaaaaugcuagagcaggagaaaaggauagaa

SEQ ID NO: 122202 - RNA, 42 nt, Mus musculus; identical to SEQ ID NO: 113381

SEQ ID NO: 122203 - RNA, 45 nt, Mus musculus; identical to SEQ ID NO: 49624

SEQ ID NO: 122204 - RNA, 45 nt, Mus musculus
gagcaguacaucuaaaaaggaaaagggacaauaucuacaucauaa

SEQ ID NO: 122205 - RNA, 47 nt, Mus musculus
gggaggucaugccugaucuuuucuuccacagagacccagaggagauu

SEQ ID NO: 122206 - RNA, 48 nt, Mus musculus
acugcugcucagccugagguggccgacuggucugagggugugcagguu

SEQ ID NO: 122207 - RNA, 41 nt, Mus musculus
uggccuaccccgggcaggaaagauauugggacaggggcaga

SEQ ID NO: 122208 - RNA, 46 nt, Mus musculus
gagacuccaacaccagagccccucaaguuccagcaaacccacaguu

SEQ ID NO: 122209 - RNA, 42 nt, Mus musculus
ggacagagacucaaaucagcuacuguagaaccagccacuuuc

SEQ ID NO: 122210 - RNA, 42 nt, Mus musculus
gucuuuucgggggaccaauugggggccggaaaguggggagca

SEQ ID NO: 122211 - RNA, 46 nt, Mus musculus
cccaggaguugcagaggguccgagcccccuccaagggccucuggag

SEQ ID NO: 122212 - RNA, 45 nt, Mus musculus
gggguacagugcaccuucggggcccuguuucccucucacagagcu

SEQ ID NO: 122213 - RNA, 41 nt, Mus musculus
uauggccuaccccgggcaggaaagauauugggacaggggca

SEQ ID NO: 122214 - RNA, 48 nt, Mus musculus
ugcugcucagccugagguggccgacuggucugagggugugcagguucc

SEQ ID NO: 122215 - RNA, 47 nt, Mus musculus
gaggucaugccugaucuuuucuuccacagagacccagaggagauuga

SEQ ID NO: 122216 - RNA, 45 nt, Mus musculus
gcaguacaucuaaaaaggaaaagggacaauaucuacaucauaaau

SEQ ID NO: 122217 - RNA, 46 nt, Mus musculus
aggauuaugaauuugaggaggaggaugaagacgacgacgacgagga

SEQ ID NO: 122218 - RNA, 46 nt, Mus musculus
augaaaaugaagguguggaguucuacagugaaaaugagggugaggg

SEQ ID NO: 122219 - RNA, 46 nt, Mus musculus
guacccugggcagcuaugcagaugcuuuucaguucuuggcccaguu

SEQ ID NO: 122220 - RNA, 42 nt, Mus musculus
ucugccuccuccugcacuccccauaacucccuacccccaagu

SEQ ID NO: 122221 - RNA, 46 nt, Mus musculus
ucuuccaaaacuucaugccuuuuucaguuugauugucuaugcggag

SEQ ID NO: 122222 - RNA, 46 nt, Mus musculus
uugcucacucuccuggaggaugcagcaagaggccagaaacaaacag

SEQ ID NO: 122223 - RNA, 45 nt, Mus musculus
agaaacuauaguuguuuuggaaguguuuaaaacauuugacaugaa

SEQ ID NO: 122224 - RNA, 42 nt, Mus musculus
uagaauagacaguaaguuggagggaacucaaauuggccccag

SEQ ID NO: 122225 - RNA, 41 nt, Mus musculus
agauaguagccucuaaguacugugccgaauguaguugugag

SEQ ID NO: 122226 - RNA, 42 nt, Mus musculus
aauccuauucacuguguacccccaagaacuugaacuggggaa

SEQ ID NO: 122227 - RNA, 57 nt, Mus musculus
uaacacuuaauaugcugccuucgacacaaaacuuaaaagaaguaagaugugcuacca

SEQ ID NO: 122228 - RNA, 72 nt, Mus musculus
augcuugauagccugaauguagcagauuccaggaggauaucaguagcuguugugguagacugaaggggaaaa

SEQ ID NO: 122229 - RNA, 45 nt, Mus musculus
aauuguauuauuuuauauaauggcaguguuaaguuagaaggcaag

SEQ ID NO: 122230 - RNA, 44 nt, Mus musculus
ugacaagaagucucaggguccuaaaggugguggcaaugcaguaa

SEQ ID NO: 122231 - RNA, 46 nt, Mus musculus
gagcuguucuacucaguagaccuaugccucagaaauauagcagaag

SEQ ID NO: 122232 - RNA, 50 nt, Mus musculus; identical to SEQ ID NO: 99941

SEQ ID NO: 122233 - RNA, 99 nt, Mus musculus
ccuugccuguaagugggauggauaagccuguguuuacagacccaccaguuaagacaaaauuuggauaucauauuauuaugguugaagggagaaaauaaa

SEQ ID NO: 122234 - RNA, 101 nt, Mus musculus
ucccuggcuucuaggaggucucugaucaaugugguuuuagaugauguggaagauauggaggaaaggcuugauaacagcagcgaggaggagagugagccagg

SEQ ID NO: 122235 - RNA, 46 nt, Mus musculus
aucugugaaacaauuugaugcuucaacuccccaaaguggcagcaau

SEQ ID NO: 122236 - RNA, 46 nt, Mus musculus
ucagaugaugaagaugaagaugaagaagaugcuuuuaaagguaguc

SEQ ID NO: 122237 - RNA, 45 nt, Mus musculus
caguuggaguugaaagaggaugacccuuuaaaaucaccaccacaa

SEQ ID NO: 122238 - RNA, 42 nt, Mus musculus
ggauagugugguuuuauaucaccgcagucccacagcaaauga

SEQ ID NO: 122239 - RNA, 46 nt, Mus musculus
ggccccaucagagaaccugggaaguuuucauuauuuaccuagagaa

SEQ ID NO: 122240 - RNA, 45 nt, Mus musculus
acuauagcuucuuuaccccagggggcugaaaguauaggcgaaguu

SEQ ID NO: 122241 - RNA, 50 nt, Mus musculus
caaauggccaguauaaccauuugcgaucagucugcagagagugagcccca

SEQ ID NO: 122242 - RNA, 52 nt, Mus musculus
aacagaagaagaaagguacugaauucaacaaaccucagccccagccuucacg

SEQ ID NO: 122243 - RNA, 50 nt, Mus musculus
auagcaggaaucucagaccaugauuugauguucacccgugaucugucugu

SEQ ID NO: 122244 - RNA, 51 nt, Mus musculus
agaugcagcuucagugucuacaugcugcucagcggagaucugaugagaaac

SEQ ID NO: 122245 - RNA, 45 nt, Mus musculus
aauuuaauggaaaucauaaaacccuauuuucuaaggaggaccaaa

SEQ ID NO: 122246 - RNA, 42 nt, Mus musculus
acgucauccuugaugaagcccauaagaucaaaagcgccucua

SEQ ID NO: 122247 - RNA, 46 nt, Mus musculus
gcacuagaagccugacacggauucaacaaaggaacggcguugugau

SEQ ID NO: 122248 - RNA, 46 nt, Mus musculus
gauggaagaaaagggggcaucuuagcagaugauaugggacugggga

SEQ ID NO: 122249 - RNA, 36 nt, Mus musculus
auaugugcaagaagccaaagaagcagcuaagaaugg

SEQ ID NO: 122250 - RNA, 43 nt, Mus musculus
accuaugugauguacaugcgcccccccacccccgccccgcgcg

SEQ ID NO: 122251 - RNA, 53 nt, Mus musculus
uuucaccagaugccuagguuggaauauuuaacuauuaaaaauuguagugcagg

SEQ ID NO: 122252 - RNA, 76 nt, Mus musculus
aaaagaaaggggguccaguuacgaagggaagacauaugcccccaaaggaaccauuaagcccagugaaugaauacgc

SEQ ID NO: 122253 - RNA, 46 nt, Mus musculus
gaaguggagacuuugagcccacaacuggccgagaguuaccugaggu

SEQ ID NO: 122254 - RNA, 44 nt, Mus musculus; identical to SEQ ID NO: 91939

SEQ ID NO: 122255 - RNA, 41 nt, Mus musculus
ucagaggcacucaggaugguccagcguuugacauaccgcug

SEQ ID NO: 122256 - RNA, 44 nt, Mus musculus
ugucucgaaccccuggcaacaggauuguuuaccucuacaccaag

SEQ ID NO: 122257 - RNA, 41 nt, Mus musculus
cggcacacgccacaugcggauuuaggugcuuucccaaucuu

SEQ ID NO: 122258 - RNA, 30 nt, Mus musculus
ggaucaugaauucaaagccagccugggaua

SEQ ID NO: 122259 - RNA, 46 nt, Mus musculus
gaauaacccagagaaaagaagccagaagccuaauuccagagaggaa

SEQ ID NO: 122260 - RNA, 42 nt, Mus musculus
auuuuuacauguuucaaagcuggcaauugaauguacggagau

SEQ ID NO: 122261 - RNA, 46 nt, Mus musculus
gccuugaguacacucauagaaguaucauuguacagacugagcaaau

SEQ ID NO: 122262 - RNA, 42 nt, Mus musculus
uuaguuugaggaauggugauauccaucugaacgcccacauuu

SEQ ID NO: 122263 - RNA, 46 nt, Mus musculus
gagagccucugucuggcauuccccaaacucuagacucccaggagga

SEQ ID NO: 122264 - RNA, 46 nt, Mus musculus
uuucuuuauuucaaauguuauccccuuuccucauuuccccuccgaa

SEQ ID NO: 122265 - RNA, 46 nt, Mus musculus
auaugguguugaacaaaaugaaaaugauacaaugaugcucacaauu

SEQ ID NO: 122266 - RNA, 46 nt, Mus musculus
aaauaaaucuaaagcuaaaaaccuaaauaaauaaauggauccagaa

SEQ ID NO: 122267 - RNA, 46 nt, Mus musculus
ccuuuaguguuuguauuuuaugcaaggggaagacugauauaagaag

SEQ ID NO: 122268 - RNA, 46 nt, Mus musculus
aggcaccaaccacacacaugguguacauacauacaugcaggcaaaa

SEQ ID NO: 122269 - RNA, 46 nt, Mus musculus
ggugcaugccuauaaccccacacacaggggauacaaguuggaggau

SEQ ID NO: 122270 - RNA, 45 nt, Mus musculus
aguagaggguacaacuuccaucauagaggaaaggagagggcacau

SEQ ID NO: 122271 - RNA, 46 nt, Mus musculus
aauucacaguaacuaguuuuagguggaauucacuucucgugcagau

SEQ ID NO: 122272 - RNA, 46 nt, Mus musculus
agagaagagggaggggaaugggaaggggaaggaacaaaaggacuga

SEQ ID NO: 122273 - RNA, 43 nt, Mus musculus
gaaguugaaggaguagaggaagagaaaggcagagaggggagag

SEQ ID NO: 122274 - RNA, 41 nt, Mus musculus
aacacacacacacauaucccacaccacaccacaccaggaga

SEQ ID NO: 122275 - RNA, 46 nt, Mus musculus
cauuccugggauccuggguucaauucuuugcacuacaugaggagaa

SEQ ID NO: 122276 - RNA, 38 nt, Mus musculus
uugguuuuucgagacaggguuucuguguuaguccuagu

SEQ ID NO: 122277 - RNA, 42 nt, Mus musculus
cccuaccuguuucugaauacccaaauuuuucaugggcaacgu

SEQ ID NO: 122278 - RNA, 46 nt, Mus musculus
aacaaaauacagugaagucucaguaaagaaguagaaagcacaaagg

SEQ ID NO: 122279 - RNA, 45 nt, Mus musculus
ggaauuccucaucuugaaugugcaaaaggaauugauagaggcagc

SEQ ID NO: 122280 - RNA, 46 nt, Mus musculus
cccuauugcuuuggggucuguaaugacauaccagauuauggcagca

SEQ ID NO: 122281 - RNA, 46 nt, Mus musculus
uccuacagaucuuaacuuuucccguaaaugucaacuucuugcagau

SEQ ID NO: 122282 - RNA, 46 nt, Mus musculus
aguuuuaaggcauuuauuguagaaaaucagagagggggagagagua

SEQ ID NO: 122283 - RNA, 46 nt, Mus musculus
ggaagaauuuuggucgcaucugaaaagggcuuaaaaauuagaagag

SEQ ID NO: 122284 - RNA, 46 nt, Mus musculus
ugagggcuuacauccuuaucugcaguuaggagacagacagagagac

SEQ ID NO: 122285 - RNA, 46 nt, Mus musculus
ccacagcuucccuggaguuggugacagacaguggaauacagcagac

SEQ ID NO: 122286 - RNA, 46 nt, Mus musculus
aaagcuucuuugaugaguggugagagcuacauguaccugugcggau

SEQ ID NO: 122287 - RNA, 46 nt, Mus musculus
gaagacugguucucccugucucagcagccauuaauugccuauagau

SEQ ID NO: 122288 - RNA, 41 nt, Mus musculus
guagaccaggcuggccucgaacucaaagauccaccugccuc

SEQ ID NO: 122289 - RNA, 46 nt, Mus musculus
aggauguuaaaauagguacaccaauguaacuauaagcugaugucgu

SEQ ID NO: 122290 - RNA, 46 nt, Mus musculus
uccugaccauugaguaauccaaguauagucauuaaguucuucaguu

SEQ ID NO: 122291 - RNA, 41 nt, Mus musculus
ggaggagguaugggguguggaacagucagaggguagauggg

SEQ ID NO: 122292 - RNA, 46 nt, Mus musculus
gagacuggaggccccaggaaguuuagauggcaggugggguggagag

SEQ ID NO: 122293 - RNA, 69 nt, Mus musculus
guaaguaacaaugauuaaugaaaaaagagaccaugaauuugaaagagaucaaggaggaguguauggaag

SEQ ID NO: 122294 - RNA, 68 nt, Mus musculus
aaacccggggaaagccuacaaggccucuaagucacacaaagaacuacaagaaacuaaggaaugggaaa

SEQ ID NO: 122295 - RNA, 51 nt, Mus musculus
uauacuauauugaaaaaaaugcaccugaaaaacugcaagagccagaggaac

SEQ ID NO: 122296 - RNA, 45 nt, Mus musculus
ugcucuucaggguagacuuuuuauaggaaaaacuagguuaaaagu

SEQ ID NO: 122297 - RNA, 45 nt, Mus musculus
cugcuaggaaaggaacaaucaauuuucuccaauggcgugacaggg

SEQ ID NO: 122298 - RNA, 45 nt, Mus musculus
aucuuuaauuucuuucuuuauuuuuuccuugaccaagguauaauu

SEQ ID NO: 122299 - RNA, 76 nt, Mus musculus
aguuugaugcuaccugggauauauaucauggcccugucaaagaaaguggggagaggaaaagagagaaaagguugaa

SEQ ID NO: 122300 - RNA, 46 nt, Mus musculus
aauagucucggaucuugcauucucacaacauacuaacauauaauac

SEQ ID NO: 122301 - RNA, 45 nt, Mus musculus
caaggucugcucagggcaguggcccagacagaaaagaggaaagaa

SEQ ID NO: 122302 - RNA, 45 nt, Mus musculus
ugccuggguccugcuggucucaguuauuuccaguguuggggcaga

SEQ ID NO: 122303 - RNA, 73 nt, Mus musculus
uuuauuauagaaaggcagggagaaagagaaaagguagaaggagagagggagaggccagccauggccacgagga

SEQ ID NO: 122304 - RNA, 44 nt, Mus musculus
gaauaggggcccugggguggcacuuggccccagagauacgggga

SEQ ID NO: 122305 - RNA, 59 nt, Mus musculus
ucugguguucugggcaggcagaugagcacaugcuuucuaugcagccccgggugggcauc

SEQ ID NO: 122306 - RNA, 32 nt, Mus musculus
ugggaauggcucucauccuaugauccugugua

SEQ ID NO: 122307 - RNA, 44 nt, Mus musculus
caguaacagcaagaaacuaagaaaaagauuagcuagaaauuuuu

SEQ ID NO: 122308 - RNA, 46 nt, Mus musculus
uucugaagaaaauugccuuuacaaaugaagugugagaaaauuagau

SEQ ID NO: 122309 - RNA, 45 nt, Mus musculus
gcuagguuuuuuauuauuauuuauuaauucucagaugccaggaga

SEQ ID NO: 122310 - RNA, 38 nt, Mus musculus
cugcauuuucucacuaaacuguucuuauacauuugagc

SEQ ID NO: 122311 - RNA, 47 nt, Mus musculus
aauaaccgauguaaaacuaguaagugaacauagauuaaguccaauac

SEQ ID NO: 122312 - RNA, 77 nt, Mus musculus
gaaacagacagacagguggaucuuuagaaggccucauggaacugagaagaggguucguguucugugugugugugugg

SEQ ID NO: 122313 - RNA, 42 nt, Mus musculus
aagguuagccagaggcuguggcaccuguuuucaugcacccag

SEQ ID NO: 122314 - RNA, 42 nt, Mus musculus
acaguugugagccaacauagaguuguugggaacugaacccag

SEQ ID NO: 122315 - RNA, 45 nt, Mus musculus
ccagaccagagagagagagagagagagagagagagagagaagaga

SEQ ID NO: 122316 - RNA, 46 nt, Mus musculus
gugagugaaagagcaggugauggugagcagggacagucgggaucag

SEQ ID NO: 122317 - RNA, 45 nt, Mus musculus
cucugggcagcagcaagaaaaaggaagaauaguauaaagggacag

SEQ ID NO: 122318 - RNA, 81 nt, Mus musculus
aggagagggagagaaagagagggagaggaggaggaggaggaggagagaggaggagauggagaggagagggagaggaggaga

SEQ ID NO: 122319 - RNA, 80 nt, Mus musculus
agggagagggagagggagagggagagggagaggggaggggaggggaggggaggagaggagaggagaggagaggaaaggaa

SEQ ID NO: 122320 - RNA, 46 nt, Mus musculus
gaaaggaaaggaaaggaaaggaaaggaaaggaaaggaaaaucaugg

SEQ ID NO: 122321 - RNA, 46 nt, Mus musculus
ggaauggugaagccuucccaggcugaaucuuauaagcagaucucag

SEQ ID NO: 122322 - RNA, 64 nt, Mus musculus
ggcaacagaaagcugagcccacaggauagucugccuuugggcuaggucaggggccgccauucca

SEQ ID NO: 122323 - RNA, 50 nt, Mus musculus
caugggugucaacaaacaucugucagguguagaaagcugggaagggagga

SEQ ID NO: 122324 - RNA, 66 nt, Mus musculus
guggaggaguggaggcuagcagguggggaacacaaaggaaaucgguggaaaggcggagcaagggaa

SEQ ID NO: 122325 - RNA, 45 nt, Mus musculus
ccgaggcugcugguguauuccuccuggaaaugggauguguggagu

SEQ ID NO: 122326 - RNA, 63 nt, Mus musculus
gugggagguacugggugauugagacaacacgaggaaccugagauuaugugaguacaaauggga

SEQ ID NO: 122327 - RNA, 89 nt, Mus musculus
ggaggcagagaucugggaaggggugcauucaaaaagguuuaaggugggaaguccucaaaaugguguugagugucuucagaugaggcugu

SEQ ID NO: 122328 - RNA, 100 nt, Mus musculus
ugggcagccgagugggaaagaauucuuggucuuuuacagcugcaaaggagaacccugugucccagccugaagaccugccucaagcaagcccccaggaggu

SEQ ID NO: 122329 - RNA, 42 nt, Mus musculus
ucugugagucaggacaugggcuuacugccacaggagcaggag

SEQ ID NO: 122330 - RNA, 72 nt, Mus musculus
ucaccaccauccacuggagucacagguccccacagagaagcaggaggguucuggaaacgugggugggaggag

SEQ ID NO: 122331 - RNA, 82 nt, Mus musculus
cagauguucagccuggauucucucaugagguguauuuugcaaccagaucucaaaugacccagggcaaguguuuaugagcuga

SEQ ID NO: 122332 - RNA, 41 nt, Mus musculus
ccacuggucucagugacagauguucacuugugggagacaaa

SEQ ID NO: 122333 - RNA, 46 nt, Mus musculus
aauguaucuucuguggauagcacugugcaauuuaaugugaccaguc

SEQ ID NO: 122334 - RNA, 47 nt, Mus musculus
aagaggguaguacaggcagagaaaggcagagagcuggagcgaguaga

SEQ ID NO: 122335 - RNA, 51 nt, Mus musculus
agagaggggggaagggaauucagaaagaggggaagcaagaggacaagagag

SEQ ID NO: 122336 - RNA, 42 nt, Mus musculus
ugggcaagguauuuguaaauauauuuugagucugagccuuau

SEQ ID NO: 122337 - RNA, 46 nt, Mus musculus
guugggaugugaagucgugaugggaaugggccacagagacccagag

SEQ ID NO: 122338 - RNA, 46 nt, Mus musculus
gcccugggaggaaagaauuucaagaaaaauauagaaguuugacaag

SEQ ID NO: 122339 - RNA, 42 nt, Mus musculus
gcagccacagguccugacaaaguaguggguccagguccccug

SEQ ID NO: 122340 - RNA, 44 nt, Mus musculus
gcgaggagcccauagugaagcaaacugguucauuaugguaggua

SEQ ID NO: 122341 - RNA, 42 nt, Mus musculus; identical to SEQ ID NO: 122314

SEQ ID NO: 122342 - RNA, 42 nt, Mus musculus
agacagagagagacagagagagacagagagacagagacauag

SEQ ID NO: 122343 - RNA, 46 nt, Mus musculus; identical to SEQ ID NO: 122316

SEQ ID NO: 122344 - RNA, 41 nt, Mus musculus
gaaggagaagagaggagaagagaggagaggagaggagagga

SEQ ID NO: 122345 - RNA, 46 nt, Mus musculus
uguaucuucuguggauagcacugugcaauuuaaugugaccagucug

SEQ ID NO: 122346 - RNA, 41 nt, Mus musculus
acuggucucagugacagauguucacuugugggagacaaaga

SEQ ID NO: 122347 - RNA, 74 nt, Mus musculus
uucagccuggauucucucaugagguguauuuugcaaccagaucucaaaugacccagggcaaguguuuaugagcu

SEQ ID NO: 122348 - RNA, 72 nt, Mus musculus
accaccauccacuggagucacagguccccacagagaagcaggaggguucuggaaacgugggugggaggagcu

SEQ ID NO: 122349 - RNA, 42 nt, Mus musculus
ugugagucaggacaugggcuuacugccacaggagcaggagga

SEQ ID NO: 122350 - RNA, 68 nt, Mus musculus
uacagcugcaaaggagaacccugugucccagccugaagaccugccucaagcaagcccccaggagguaa

SEQ ID NO: 122351 - RNA, 121 nt, Mus musculus
aggcagagaucugggaaggggugcauucaaaaagguuuaaggugggaaguccucaaaaugguguugagugucuucagaugaggcuguugggcagccgagugggaaagaauucuuggucuuu

SEQ ID NO: 122352 - RNA, 81 nt, Mus musculus
uuggugggagguacugggugauugagacaacacgaggaaccugagauuaugugaguacaaaugggagaugaaggcagaaga

SEQ ID NO: 122353 - RNA, 45 nt, Mus musculus
gaggcugcugguguauuccuccuggaaaugggauguguggaguga

SEQ ID NO: 122354 - RNA, 66 nt, Mus musculus
ggaggaguggaggcuagcagguggggaacacaaaggaaaucgguggaaaggcggagcaagggaaua

SEQ ID NO: 122355 - RNA, 52 nt, Mus musculus
cgccauuccacaugggugucaacaaacaucugucagguguagaaagcuggga

SEQ ID NO: 122356 - RNA, 42 nt, Mus musculus
gccucaccaugucaggugucuauccaagguggagggcaagga

SEQ ID NO: 122357 - RNA, 42 nt, Mus musculus
cucuggagauggggacuugaagaaaacagggugcacacccag

SEQ ID NO: 122358 - RNA, 46 nt, Mus musculus
uagcccaggcugccuguuuacuuaacaaauugcccugcccccagaa

SEQ ID NO: 122359 - RNA, 38 nt, Mus musculus
gaacccuagguuuacagcagccccugugcuguggcaga

SEQ ID NO: 122360 - RNA, 45 nt, Mus musculus
uucucuccuccagaaguguuacuggggggagaggaggggcaggcg

SEQ ID NO: 122361 - RNA, 41 nt, Mus musculus
guggcagugguggugguggaggcagggaugugcugugugug

SEQ ID NO: 122362 - RNA, 46 nt, Mus musculus
gucacagagagagcaugcucaugcuguucuagcuucugugugugug

SEQ ID NO: 122363 - RNA, 26 nt, Mus musculus
gaagccuucccagcugcccggaccac

SEQ ID NO: 122364 - RNA, 41 nt, Mus musculus
agauguuguacagcgccuuguugucgauggucuugcccagg

SEQ ID NO: 122365 - RNA, 45 nt, Mus musculus
cuggcuggguccugggaagucuucaucgaaagguggccucgucau

SEQ ID NO: 122366 - RNA, 48 nt, Mus musculus
ggggagaaagggagggaaggagagggcauuagaagagaggggcugaga

SEQ ID NO: 122367 - RNA, 46 nt, Mus musculus
cugcauuguuggacauucagguggugccuaguucuuucccuguguu

SEQ ID NO: 122368 - RNA, 46 nt, Mus musculus
augacucccaugccuucuccaacuguacucaucucuaugugcccag

SEQ ID NO: 122369 - RNA, 45 nt, Mus musculus
auuuuggacuuauuaaguucuuuacuuagaaauccccaccuguag

SEQ ID NO: 122370 - RNA, 41 nt, Mus musculus
aagcgcauggccacggaaguagccgcugaugcucuugguga

SEQ ID NO: 122371 - RNA, 42 nt, Mus musculus
cuuaaacaaagaagguaagaagcccaggaccaaagcaccuaa

SEQ ID NO: 122372 - RNA, 45 nt, Mus musculus
ggugggucauagccagguaggguggauucuauaggaagccuagag

SEQ ID NO: 122373 - RNA, 46 nt, Mus musculus
uaaucccagcacuuggcagagacagaggcagaggcagaggcagagg

SEQ ID NO: 122374 - RNA, 42 nt, Mus musculus
gcagagagagacagaggggcagaggcagaggggcagaggcag

SEQ ID NO: 122375 - RNA, 45 nt, Mus musculus
ggcagaggcagaggcagagguagaggcagagaggcagagaggcag

SEQ ID NO: 122376 - RNA, 48 nt, Mus musculus
uuggggagaaagggagggaaggagagggcauuagaagagaggggcuga

SEQ ID NO: 122377 - RNA, 45 nt, Mus musculus
uacuggcuggguccugggaagucuucaucgaaagguggccucguc

SEQ ID NO: 122378 - RNA, 41 nt, Mus musculus
gaagauguuguacagcgccuuguugucgauggucuugccca

SEQ ID NO: 122379 - RNA, 26 nt, Mus musculus
agccuucccagcugcccggaccacag

SEQ ID NO: 122380 - RNA, 46 nt, Mus musculus
cacagagagagcaugcucaugcuguucuagcuucugugugugugug

SEQ ID NO: 122381 - RNA, 41 nt, Mus musculus
ggcagugguggugguggaggcagggaugugcugugugugug

SEQ ID NO: 122382 - RNA, 45 nt, Mus musculus
cucuccuccagaaguguuacuggggggagaggaggggcaggcgag

SEQ ID NO: 122383 - RNA, 38 nt, Mus musculus
acccuagguuuacagcagccccugugcuguggcagagu

SEQ ID NO: 122384 - RNA, 42 nt, Mus musculus
cuggagauggggacuugaagaaaacagggugcacacccagau

SEQ ID NO: 122385 - RNA, 45 nt, Mus musculus
gagggaaacaacaacuuaaguggagugucuuaggaaugggcaaug

SEQ ID NO: 122386 - RNA, 45 nt, Mus musculus
guaugcuuugguggaauauuuaaagaaguaggggguuguuguaga

SEQ ID NO: 122387 - RNA, 46 nt, Mus musculus
auugaccuuugaaauuuacuacuacccugaaacucaccccacagau

SEQ ID NO: 122388 - RNA, 42 nt, Mus musculus
ugaauugcaguaaguggaagaaguauauagggaaacaggcaa

SEQ ID NO: 122389 - RNA, 46 nt, Mus musculus
ucugaaguccuugugccauguaucuauuaaucuguggcugugaaua

SEQ ID NO: 122390 - RNA, 54 nt, Mus musculus
auaauuccaagaucaguguuauuuuucucaggagaugcacuugaaucucagcag

SEQ ID NO: 122391 - RNA, 42 nt, Mus musculus
auuucuucucuccucaugggaucagcuuaaauggaggggaug

SEQ ID NO: 122392 - RNA, 46 nt, Mus musculus; identical to SEQ ID NO: 52903

SEQ ID NO: 122393 - RNA, 45 nt, Mus musculus; identical to SEQ ID NO: 52904

SEQ ID NO: 122394 - RNA, 45 nt, Mus musculus
ucccuuggguagauucucuggggagugagcaggaaaacgggcagg

SEQ ID NO: 122395 - RNA, 48 nt, Mus musculus
ucagugcuccugagguaugguccuuuggccaaauaauugacagaucua

SEQ ID NO: 122396 - RNA, 46 nt, Mus musculus
caagagagcccaguacaucaaugggggguggggagggagcccagac

SEQ ID NO: 122397 - RNA, 46 nt, Mus musculus
aauugauccaauuggucaauuuaaagcuuauguaaaaggccaguag

SEQ ID NO: 122398 - RNA, 46 nt, Mus musculus
agaugggaaagugccuugucuuuuucaaagauaacgugguauguag

SEQ ID NO: 122399 - RNA, 50 nt, Mus musculus
aacacauuguguccuaguccugaaugauugggggcaagggggagagagag

SEQ ID NO: 122400 - RNA, 46 nt, Mus musculus
agcuuucccagaagagaaucauaguggcuaugucugucgaaccaag

SEQ ID NO: 122401 - RNA, 45 nt, Mus musculus
gugucaucaucugugaucaugaaaaaucaaaugugaaagugcagc

SEQ ID NO: 122402 - RNA, 50 nt, Mus musculus
gagggagagggacagagagagagagagagagagagagagagagauuggcu

SEQ ID NO: 122403 - RNA, 46 nt, Mus musculus
uugaacucucugacuuccuacaaaaaugagagccaggcccacaaaa

SEQ ID NO: 122404 - RNA, 81 nt, Mus musculus
ucgggggggagauguggaaaggggauauaacauuugaaauguaaauaaagaaaauauccaauaaaaggaaaaaggaaaaaa

SEQ ID NO: 122405 - RNA, 44 nt, Mus musculus
aaucccagcaaccacaugguggcuugcaaccacccguaaugaga

SEQ ID NO: 122406 - RNA, 45 nt, Mus musculus
uauaauuggugacgugaucuggaaaaauacuucuaauugguaagg

SEQ ID NO: 122407 - RNA, 41 nt, Mus musculus
ugguguuguguuguguuguguuguguuguguuguuugagac

SEQ ID NO: 122408 - RNA, 45 nt, Mus musculus
guguguugucucgugccuguaaugcccauguucaggagagagaga

SEQ ID NO: 122409 - RNA, 25 nt, Mus musculus
caagggaggagaugcagaucccauu

SEQ ID NO: 122410 - RNA, 41 nt, Mus musculus
cccaggggcccucaccagcucagagaagaaugggagggaga

SEQ ID NO: 122411 - RNA, 46 nt, Mus musculus
caccccaacccuuuccuccccagucuugccuccuccugcccccucu

SEQ ID NO: 122412 - RNA, 45 nt, Mus musculus
cgggaguggaugcaggacucaagaugcguggauaucucggaaagu

SEQ ID NO: 122413 - RNA, 45 nt, Mus musculus
aucuuccagauccccaguggcagacauuuuagugauagcccagau

SEQ ID NO: 122414 - RNA, 45 nt, Mus musculus
aucuuccagauccccaguggcagacauuuuagugauagcccaggu

SEQ ID NO: 122415 - RNA, 45 nt, Mus musculus; identical to SEQ ID NO: 122414

SEQ ID NO: 122416 - RNA, 42 nt, Mus musculus
caggucccuggcggcggcaggcauuuuagugauagcccaggu

SEQ ID NO: 122417 - RNA, 45 nt, Mus musculus
uucaaagcacucagauuauuuucgaauuucaacgauaccagagau

SEQ ID NO: 122418 - RNA, 45 nt, Mus musculus
cuccuuucuaaacuggauucauuccuuagugccauuguuugcucg

SEQ ID NO: 122419 - RNA, 93 nt, Mus musculus
cucuuccgaauugaaaacugaacauuaauccaaacauggcggcagaagccuuuaaaaucggcacugucccacugaaggcaguggcaggcagag

SEQ ID NO: 122420 - RNA, 41 nt, Mus musculus
cgcagggcagccagaaggcagccauucacaauccaggaaga

SEQ ID NO: 122421 - RNA, 46 nt, Mus musculus
acaccaggcagugaguccccaugucaaaaaauaagucgagccaggc

SEQ ID NO: 122422 - RNA, 42 nt, Mus musculus
aaaaaagaaagaaagaggagagagagagagagagagagagag

SEQ ID NO: 122423 - RNA, 46 nt, Mus musculus
cggaccgugguugugguucaauucccagcacccacauggcagcuca

SEQ ID NO: 122424 - RNA, 46 nt, Mus musculus
uaagcucaguuccaauagaaagaauaacuaaaagaauucuguagac

SEQ ID NO: 122425 - RNA, 46 nt, Mus musculus
aguuccucugugcuuuacucgaaccaaaauuugucuccuaucaggg

SEQ ID NO: 122426 - RNA, 82 nt, Mus musculus
ggugaagcuggcacaagaauaaagaagaggaagaaauagagcuguagauagaagagacagcaacguguaauaacauggcgcc

SEQ ID NO: 122427 - RNA, 45 nt, Mus musculus
gaggaucagguagaaguucccagacugucccugccauccaagagg

SEQ ID NO: 122428 - RNA, 45 nt, Mus musculus
gcccggcuuuaaauaggauuuuuuauuauaaauuuuucauaggua

SEQ ID NO: 122429 - RNA, 44 nt, Mus musculus
aagccaaacacugcgauucuucaaaggcgggaucugggcuaagu

SEQ ID NO: 122430 - RNA, 69 nt, Mus musculus
cacaccauccacauucauauacaauacgcaucacacaaaagaaggaaggaaggaacgaacgaaaaagag

SEQ ID NO: 122431 - RNA, 50 nt, Mus musculus
uacuuauguaaaacaaaauguuuuaaaaaauagaaaggaagaaagagaga

SEQ ID NO: 122432 - RNA, 45 nt, Mus musculus
aauaugacagagacauuuuguaaggaauaaggggugcuggccagg

SEQ ID NO: 122433 - RNA, 61 nt, Mus musculus
augcuaauacaaggagccaacaaaaccacaaaagccucaucuacaaugugauuggcaagaa

SEQ ID NO: 122434 - RNA, 53 nt, Mus musculus
uaauacaaggagccaacaaaaccacaaaagccucaucuacaaugugauuggca

SEQ ID NO: 122435 - RNA, 48 nt, Mus musculus
guuacagacgccaucuuguguguagccggaauguaauucagauccccu

SEQ ID NO: 122436 - RNA, 46 nt, Mus musculus
gcacaugauguuuucaaaacaaagcauuuuauuuaacagcaaacua

SEQ ID NO: 122437 - RNA, 46 nt, Mus musculus
guugguaagcaacaguuuuuuuuuucaagucuucaaaacacccaag

SEQ ID NO: 122438 - RNA, 46 nt, Mus musculus
aagcccauuccuacccauacaaagggauauuacugaauccagccaa

SEQ ID NO: 122439 - RNA, 44 nt, Mus musculus
gacauucaggcaaaagaaaaggaacagagaagauggagccaggu

SEQ ID NO: 122440 - RNA, 46 nt, Mus musculus
uuuagcgaauuaauaccaauuuuguggaacugcauuaaagucccaa

SEQ ID NO: 122441 - RNA, 46 nt, Mus musculus
cuuuccauuuuucuuucacucacagagggugggacaggaggccgag

SEQ ID NO: 122442 - RNA, 46 nt, Mus musculus
aaaauuuaagaauaauaaaauugacaacaaucagaaaacuggagga

SEQ ID NO: 122443 - RNA, 42 nt, Mus musculus
uuagcauguaaaaagguaaaagguuuaacgaacacaggcaaa

SEQ ID NO: 122444 - RNA, 42 nt, Mus musculus
aaaauggcuuguuugccccaggauaaugcaaaguagccuaag

SEQ ID NO: 122445 - RNA, 44 nt, Mus musculus
uuucuaggccauuuuagcuaugacugugaccacuacuggucagg

SEQ ID NO: 122446 - RNA, 42 nt, Mus musculus
uaaggacuaagucgugccacuacccagaaaagagaccccccc

SEQ ID NO: 122447 - RNA, 46 nt, Mus musculus
gccuucacuuggcuccugagacauggaaaaaggaaacauagacaua

SEQ ID NO: 122448 - RNA, 46 nt, Mus musculus
aauagagaaccucuuuuauuauuuccacucuaccaagcaugcccau

SEQ ID NO: 122449 - RNA, 42 nt, Mus musculus
ggcaaguuaaauaaaaaguugcuccccuccucaugggcaugc

SEQ ID NO: 122450 - RNA, 46 nt, Mus musculus
uuuauuuaacuugccuccucuacaccuugauguuuuucccagcuaa

SEQ ID NO: 122451 - RNA, 45 nt, Mus musculus
guugugagcccccaugugguuguugggauuugaacucaggaccuu

SEQ ID NO: 122452 - RNA, 42 nt, Mus musculus
aucccaacaaccacaugggggcucacaaccaucuguaaugug

SEQ ID NO: 122453 - RNA, 42 nt, Mus musculus
uuuauauacaauguuucauuagguguuguguucugcaugcuu

SEQ ID NO: 122454 - RNA, 77 nt, Mus musculus
aaacaccuugccaguaaaggaguuuuauagggccagagugagauaaucccagagcauggguaucagggaacaaaacg

SEQ ID NO: 122455 - RNA, 45 nt, Mus musculus
uuccugucauuaauaaaaccuuuuccaccuccucagucaagccag

SEQ ID NO: 122456 - RNA, 42 nt, Mus musculus
cuuauggucuucccaggcuagccuccaauuucugggcucaag

SEQ ID NO: 122457 - RNA, 43 nt, Mus musculus
cauagucucuacaaaauuuucauuguacuuuuuagcccauaau

SEQ ID NO: 122458 - RNA, 46 nt, Mus musculus
cacacuggccuuaaguauauggacuguuauucauucaagccccguu

SEQ ID NO: 122459 - RNA, 46 nt, Mus musculus
ugcugaauacuaaggcugugaugcuucacuguggucacccccaggu

SEQ ID NO: 122460 - RNA, 89 nt, Mus musculus
cggccacuacuaugagcagggaguucagaccucauuuuguccccaaaccauuauuagaaaaccauacccugcucaccuaagcccaaaga

SEQ ID NO: 122461 - RNA, 49 nt, Mus musculus
uguuuucccccuaacaaccugaugcuuuccuuuucuugucagccuaggg

SEQ ID NO: 122462 - RNA, 45 nt, Mus musculus
aggcuauauacacuggcuggauuuaguuccgucucaaguggagca

SEQ ID NO: 122463 - RNA, 42 nt, Mus musculus
ucacuugagauguaauuuuucauuguugccauugcccauaaa

SEQ ID NO: 122464 - RNA, 44 nt, Mus musculus
aaugucacccguggagccguuccucacaccagacugcccugaga

SEQ ID NO: 122465 - RNA, 43 nt, Mus musculus
guacaugugcgugugugcauguguguuaugugugucaugugug

SEQ ID NO: 122466 - RNA, 90 nt, Mus musculus
uacauacaaagaaacauccaagaaaggauuacuuuagaauacaagagagacacagacuuguaaagagaugaaaugcucaaagugaacaga

SEQ ID NO: 122467 - RNA, 75 nt, Mus musculus
aaguagaagauagaaacacaagcaaacacaaagcaacagaaugaugcugagauaagaaauccaccaauagcaaag

SEQ ID NO: 122468 - RNA, 125 nt, Mus musculus
aaacagagaaaguggcccaagaaaggcagggaagaaauguaaacaagaauucacuaaggauagaagcagcagaaagaaaacugaaauggacugacaaagagaacuugaacaaagaacaagugggg

SEQ ID NO: 122469 - RNA, 78 nt, Mus musculus
caugcaacaugugacccaaaggggagucacgaaaggcaggagugaaagaaaagcuaagagaaauagcaaccagauaga

SEQ ID NO: 122470 - RNA, 92 nt, Mus musculus
auagguaagacacacugcagacagaaaagacacacaaaggaaagaaggagacaugcaaaggaaggaagaaauagauguaacaaagaauuaga

SEQ ID NO: 122471 - RNA, 51 nt, Mus musculus
uccuuccuuugcaugucuccuucuuuccuuugugugucuuuucugucugca

SEQ ID NO: 122472 - RNA, 62 nt, Mus musculus
ugcuuugugugucuauuucuuccuugcuuugugugucuaugucuuccuugcuuugugugucu

SEQ ID NO: 122473 - RNA, 101 nt, Mus musculus
cacacaaggaagaaguagauacacaaaacaaggaagacauagacacacaaagcaaggaagacauagacacacaaagcaaggaagaaauagacacacaaagc

SEQ ID NO: 122474 - RNA, 52 nt, Mus musculus
agacacacaaaagcaaggaagaaauagauguaacaaagaauuagacacaacu

SEQ ID NO: 122475 - RNA, 45 nt, Mus musculus
uugcuuuugugugucuuucuuucuugcuuuugugugucuauuucu

SEQ ID NO: 122476 - RNA, 60 nt, Mus musculus
cacaaaagcaaggaagaaauagauguaacaaagaauuagacacaacugcaaggaagaaau

SEQ ID NO: 122477 - RNA, 42 nt, Mus musculus
cuaauucuuuguuauaucuauuucuuccuugcuuuguguguc

SEQ ID NO: 122478 - RNA, 90 nt, Mus musculus
agcaaggaagaaauagauguaacaaagaauuagacacaacugcaaggaagaaauagacacaaagcaaggaagaaauagauauaacaaaga

SEQ ID NO: 122479 - RNA, 70 nt, Mus musculus
uaauucuuuguuacaucuauuucuuccuugcuuugugugucuauuucuuccuugcuuugugugucuauuu

SEQ ID NO: 122480 - RNA, 101 nt, Mus musculus
auuagacauaaugcaaggaagaaauagacacacaaagcaaggaagaaauagacacacaaagcaaggaagaaauagauguaacaaagaauuagacacacaga

SEQ ID NO: 122481 - RNA, 41 nt, Mus musculus
uaaugauugauaguaagcaaagaccaccagaaagaggguaa

SEQ ID NO: 122482 - RNA, 46 nt, Mus musculus
acagagccuggcaaauaugcccuggaguugcaugacuaggccauuu

SEQ ID NO: 122483 - RNA, 61 nt, Mus musculus
uucugcuaagaccugucuguuugugaaggucaaaugaaaucaugaauggaaaguguugagu

SEQ ID NO: 122484 - RNA, 90 nt, Mus musculus
uuaaauaguuuauuucuuaucuccaucugugaagcagccauuagacuugugaaggauguaaaaaccaagcccccccuuuuuuuuaauaga

SEQ ID NO: 122485 - RNA, 42 nt, Mus musculus
agucaggcauguugauccucgggucauuuauaaagcugccuu

SEQ ID NO: 122486 - RNA, 41 nt, Mus musculus
uucugccuaaugauagauacuucuguaucaauuccagccag

SEQ ID NO: 122487 - RNA, 45 nt, Mus musculus
acugaugaugaaugccucuaacuacaaauggaaaccuggcuggaa

SEQ ID NO: 122488 - RNA, 43 nt, Mus musculus
ccuaccuagcuauuuacgaguacacuguugcuguccucagaca

SEQ ID NO: 122489 - RNA, 46 nt, Mus musculus
uugauguaggguggcauucuuugagccuuugucuuccuugcugggu

SEQ ID NO: 122490 - RNA, 45 nt, Mus musculus
caggccuagcccagauuucagugagacgcuuuccugaacccagca

SEQ ID NO: 122491 - RNA, 53 nt, Mus musculus
gcuugcugcuuugcagugcuggcgaccuauucccuuugacgaucccuaggugg

SEQ ID NO: 122492 - RNA, 70 nt, Mus musculus
ggucgccagcacugcaaagcagcaagcccacaauucuggggggagaucuggaaaagaggugaaagaaaag

SEQ ID NO: 122493 - RNA, 59 nt, Mus musculus
ccaauucuugaaaucaagaauacugggaaaguugucucauuauguaguaaccagcaguu

SEQ ID NO: 122494 - RNA, 46 nt, Mus musculus
cauccaaguucuuucuggcuuuuauucugucaccuaccaaugagag

SEQ ID NO: 122495 - RNA, 45 nt, Mus musculus
agccauaucuacuuacucuaucaaguacaaaagacuaggguguca

SEQ ID NO: 122496 - RNA, 79 nt, Mus musculus
ggggcaagucaauaaagcacuccccaucuccugguccccuggcauagucaguuagccaaugagauccuugccuuaugau

SEQ ID NO: 122497 - RNA, 94 nt, Mus musculus
aggcaaggaucucauuggcuaacugacuaugccaggggaccaggagauggggagugcuuuauugacuugcccccucauucucugaugaacugga

SEQ ID NO: 122498 - RNA, 46 nt, Mus musculus
cuguuuugugcuccugccucaagaagaaggauugccuggauuuaga

SEQ ID NO: 122499 - RNA, 42 nt, Mus musculus
ccugccccuuacuuaguccucuggcucaucccaggggaagau

SEQ ID NO: 122500 - RNA, 36 nt, Mus musculus
agaagagguucacuggacugggagagagggcacagg

SEQ ID NO: 122501 - RNA, 42 nt, Mus musculus
uggucugguucugccacagggcuuuguaaaaucagcuggcaa

SEQ ID NO: 122502 - RNA, 44 nt, Mus musculus
gcugaaagcucauucuuaauguauacaguucaggcagccugaag

SEQ ID NO: 122503 - RNA, 46 nt, Mus musculus
uccauuacaugauuacugacagugagggcugggucaggacacuaau

SEQ ID NO: 122504 - RNA, 46 nt, Mus musculus
cagauguccuacuacaaauaaguguguauuuuacagugccguggag

SEQ ID NO: 122505 - RNA, 41 nt, Mus musculus
caggcugaaagcucuaggugccuaggcaagccugggggggg

SEQ ID NO: 122506 - RNA, 42 nt, Mus musculus
uggcuauccuggaacucaaacucaagagauccgcccgcagag

SEQ ID NO: 122507 - RNA, 45 nt, Mus musculus
gaaagacuccaugcauuaugcuuagcuguacgccaaggguagcaa

SEQ ID NO: 122508 - RNA, 44 nt, Mus musculus
agcuaacaagguaguacuuacuguagucuaaacagccagagucu

SEQ ID NO: 122509 - RNA, 46 nt, Mus musculus
uuucaucagcaaugucauaucaaacacucagcagcgggauggcaag

SEQ ID NO: 122510 - RNA, 45 nt, Mus musculus
gacaacaaugggagcugguucgucuaucuuguggguccuggagau

SEQ ID NO: 122511 - RNA, 46 nt, Mus musculus
uccuuaagaaaggcauuuggauugcaagguggauugacugugagau

SEQ ID NO: 122512 - RNA, 46 nt, Mus musculus
cucaggaagacaauuuucaguucauacuguaaaggaaagccccaag

SEQ ID NO: 122513 - RNA, 42 nt, Mus musculus
agguaggcaagaaugguuccuggcccuagaaugugccagcag

SEQ ID NO: 122514 - RNA, 46 nt, Mus musculus
guguauuuauacacugaauagcaaaagcaggccaaaacuaggugga

SEQ ID NO: 122515 - RNA, 46 nt, Mus musculus
agcaaggagaaggcaacugagacacuguagccauaugaagugagua

SEQ ID NO: 122516 - RNA, 48 nt, Mus musculus
gcuuugcccagucaauacuguucaaacaaagaggcaaaagggauggca

SEQ ID NO: 122517 - RNA, 45 nt, Mus musculus
ugaccacuuuucugaaucacuaauucucacaaacccaucauuaag

SEQ ID NO: 122518 - RNA, 45 nt, Mus musculus
uagugauucagaaaaguggucaauggacaaacuagaggccgggca

SEQ ID NO: 122519 - RNA, 46 nt, Mus musculus
uaaaccauccagaacugccauugugccuauuaagagucccaaaauc

SEQ ID NO: 122520 - RNA, 42 nt, Mus musculus
ugagguuacuaauaguuacuaccacucagcagccccagucaa

SEQ ID NO: 122521 - RNA, 49 nt, Mus musculus
gaccugugcggcagcaaagguucugaaaugccuaccuuuugacuggggc

SEQ ID NO: 122522 - RNA, 23 nt, Mus musculus
cuuccuuugucuuugccaguaaa

SEQ ID NO: 122523 - RNA, 46 nt, Mus musculus
uuaccaacaaaaugacuugacuuaguuugguuucuuuauccaaugc

SEQ ID NO: 122524 - RNA, 42 nt, Mus musculus
guacacaagacucaagguuugauuccccagcacagcagaaag

SEQ ID NO: 122525 - RNA, 46 nt, Mus musculus
agaggcauuaaguaaucagcacccucuuuacauaaagcaaggguag

SEQ ID NO: 122526 - RNA, 49 nt, Mus musculus
cauggacaaguaaaguaggacuguaugcaaagugaaauuccaugacucu

SEQ ID NO: 122527 - RNA, 46 nt, Mus musculus
uacgauucuaugcauuaagugaaauuccaugacucuggaacucagu

SEQ ID NO: 122528 - RNA, 49 nt, Mus musculus
gaaaucuauacauuaugugaaauuccaugacucuggaagucaguaugga

SEQ ID NO: 122529 - RNA, 37 nt, Mus musculus
cguaugcaaagugaaauucuaugucucuggaagucag

SEQ ID NO: 122530 - RNA, 41 nt, Mus musculus
gaaacuccaugacucuggaagucaguauggaguggguauag

SEQ ID NO: 122531 - RNA, 45 nt, Mus musculus
uaagugaaauuccaugacucuggaagucaguauggaguggguaua

SEQ ID NO: 122532 - RNA, 44 nt, Mus musculus
aagugaaauuccaugacucuggaagucaguauggaggggguaug

SEQ ID NO: 122533 - RNA, 44 nt, Mus musculus
aagugaaauuccaugacucuggaagucaguauggaggggguaua

SEQ ID NO: 122534 - RNA, 41 nt, Mus musculus
uaugcaaagugaaauucuaugacucuggaagucaguaugga

SEQ ID NO: 122535 - RNA, 41 nt, Mus musculus; identical to SEQ ID NO: 122534

SEQ ID NO: 122536 - RNA, 46 nt, Mus musculus
aauacgauucuauguauuaagugaaauuccaugacccuagaaguca

SEQ ID NO: 122537 - RNA, 52 nt, Mus musculus
acugcaugcauuaagugaaacuccaugacucuguaagucaguauggaggggg

SEQ ID NO: 122538 - RNA, 42 nt, Mus musculus
uaagugaaauuccaugacucuagaagucaguauggagggggu

SEQ ID NO: 122539 - RNA, 51 nt, Mus musculus
aaucaaugaagauucgaauuucucuaaguagaagugggcuugggauagguc

SEQ ID NO: 122540 - RNA, 42 nt, Mus musculus
aauccaguccagcccugccccagcccaguccuagccccaggc

SEQ ID NO: 122541 - RNA, 45 nt, Mus musculus
gcugcuauugcugccccagccccaggcccagccccagccccugcc

SEQ ID NO: 122542 - RNA, 65 nt, Mus musculus
uaucuguguuauaagacuuaaaaauuugaagaguagcucgguggaugaguuugaaagaaaguaca

SEQ ID NO: 122543 - RNA, 49 nt, Mus musculus
ucuggccaaagucaccacuuauacccaguaggcuuagagaaccgcuuga

SEQ ID NO: 122544 - RNA, 46 nt, Mus musculus
guuucaaugauuuacaucgaccaagaacccgcagccucggucucuc

SEQ ID NO: 122545 - RNA, 45 nt, Mus musculus
cacgugugucuuuagucaucauuuuuucgaagugccugcccaggu

SEQ ID NO: 122546 - RNA, 45 nt, Mus musculus
gcacuucgaaaaaaugaugacuaaagacacacgugaaguaccaag

SEQ ID NO: 122547 - RNA, 44 nt, Mus musculus
ugacuuccaguuagaaaugugcauuauugcuugguggccaggau

SEQ ID NO: 122548 - RNA, 87 nt, Mus musculus
uuccauccuggccaccaagcaauaaugcacauuucuaacuggaagucaagcaaacaccaacacuuucacacuugugcccauuucuga

SEQ ID NO: 122549 - RNA, 102 nt, Mus musculus
ucgaguggcacaagguaggaccaaccacacccuaccauaaugcaccaaguguacccucgggcaaagcccgccaaguagcuaaagcccgccaaaaaaaaaauc

SEQ ID NO: 122550 - RNA, 94 nt, Mus musculus
gcuacuuggcgggcuuugcccgaggguacacuuggugcauuaugguagggugugguugguccuaccuugugccacucgaagcugaggcaaggcu

SEQ ID NO: 122551 - RNA, 47 nt, Mus musculus
uggcggaagucaugugaccugcccucuagugguuucuuucagugauu

SEQ ID NO: 122552 - RNA, 74 nt, Mus musculus
agcugacaugugacacacaaagcccuuugcguuauaccgcaccaagaacuugagccgccaucuuuuccuguacg

SEQ ID NO: 122553 - RNA, 42 nt, Mus musculus
uuauaggacauuuaggucguacaggaaaagauggcggcucaa

SEQ ID NO: 122554 - RNA, 94 nt, Mus musculus
accuaaauguccuauaauccauugcuacacaccagaacaaagauugggcugucgagccucggguggagcccccgagccgccauuuuauagacuu

SEQ ID NO: 122555 - RNA, 53 nt, Mus musculus
gguccauaugcacacacacccugcccaauccccacacccacgcugagcccuau

SEQ ID NO: 122556 - RNA, 66 nt, Mus musculus
ucguauuagugugcgguguugcgcggaagccgcagaggacuaggggauagggcucagcgugggugu

SEQ ID NO: 122557 - RNA, 71 nt, Mus musculus
cacuccuuggcuuucuacuuccggcuagcacaaccccgcaaaugcuaccacaaaucaaggcgaaucccgca

SEQ ID NO: 122558 - RNA, 42 nt, Mus musculus
ugauuugugguagcauuugcgggguugugcuagccggaagua

SEQ ID NO: 122559 - RNA, 43 nt, Mus musculus
aauggcggacgcgggcucuccacgcccugaacacccacucagu

SEQ ID NO: 122560 - RNA, 46 nt, Mus musculus
ggcuuagaaaaacgacuuugcucuuaaacugaguggguguucaggg

SEQ ID NO: 122561 - RNA, 45 nt, Mus musculus
ccuggaauaucuaugccucuuauuugcguguacuguugcugcuga

SEQ ID NO: 122562 - RNA, 46 nt, Mus musculus
uggccccgaugggcuaaggagaagaaaaaaagaauaaaagcaggua

SEQ ID NO: 122563 - RNA, 42 nt, Mus musculus
uagaaaaaaaaauaauaagaaaaaaaaagaaugaaaaggcag

SEQ ID NO: 122564 - RNA, 46 nt, Mus musculus
gguggacuuaccuuucuuucauuguuuauauauucuugcccaucgg

SEQ ID NO: 122565 - RNA, 47 nt, Mus musculus
aaagguaaguccaccauacacacacaaguaucaaccaaaaggcacaa

SEQ ID NO: 122566 - RNA, 46 nt, Mus musculus
gggaaacgagcaaacauggcuggagcaagccguugcacgccuuuaa

SEQ ID NO: 122567 - RNA, 45 nt, Mus musculus
gucaacuaaaguuagacaaaguaaccuuuacuucucaauucagau

SEQ ID NO: 122568 - RNA, 42 nt, Mus musculus
ccuuugcaaauaaaacaggagauguaugggaucaucugugag

SEQ ID NO: 122569 - RNA, 46 nt, Mus musculus
acucaaaaaaaaaaguggacauaaagcaggugauuuguuugcccau

SEQ ID NO: 122570 - RNA, 46 nt, Mus musculus
auuuaaaagaaaaaacugagccagacuaaggaauggcagagagcca

SEQ ID NO: 122571 - RNA, 45 nt, Mus musculus
uaggacuugagcuggaacuggaaccagagcuguuaccgccaccag

SEQ ID NO: 122572 - RNA, 46 nt, Mus musculus
cuucuuacuugaagaucaagaacuaugguuggaggucuuuggccag

SEQ ID NO: 122573 - RNA, 46 nt, Mus musculus
auaccacgaaguuguuuuaaaauguaagaauauuuauuacagccag

SEQ ID NO: 122574 - RNA, 46 nt, Mus musculus
cagcugugccaccaaacaugucuccagucauugcuaacagccccca

SEQ ID NO: 122575 - RNA, 45 nt, Mus musculus
gcacacacccuuaaaucccagcacucagauggcagagaugggcag

SEQ ID NO: 122576 - RNA, 42 nt, Mus musculus
cccacccccaaaagaaccaaaaccaaaaccaaguaaccgcaa

SEQ ID NO: 122577 - RNA, 46 nt, Mus musculus
gucuagcuugauacuauaaaagacugcauuuuuaaaaaaggaggag

SEQ ID NO: 122578 - RNA, 46 nt, Mus musculus
aacaguguuugcuaaggcaguggcuuccaucagaaguuuguugcuu

SEQ ID NO: 122579 - RNA, 45 nt, Mus musculus
uugagugguggaaaauaacauuuuaaagguaaagauguguugcag

SEQ ID NO: 122580 - RNA, 46 nt, Mus musculus
caaguauggugauggacacauuuaucccagcacuuaagacaggcag

SEQ ID NO: 122581 - RNA, 46 nt, Mus musculus
uguggugguguuauaugccuucaaucucagcacuuaggagccagag

SEQ ID NO: 122582 - RNA, 46 nt, Mus musculus
aaaaaaacagggcauagugcaacauaccuuuaauuccagcacucag

SEQ ID NO: 122583 - RNA, 46 nt, Mus musculus
auugaagaguccuuaucaagcugggccucugaaacacuccuguuaa

SEQ ID NO: 122584 - RNA, 46 nt, Mus musculus
uucaaaucccagcaaccacaugguggcucacaaccaucguaauggg

SEQ ID NO: 122585 - RNA, 46 nt, Mus musculus
uccugugucugguccuccaacugucaggauuccagaugugggccac

SEQ ID NO: 122586 - RNA, 45 nt, Mus musculus
cacuagcuuucugguaacuggagaaccaacagguauagaggugag

SEQ ID NO: 122587 - RNA, 41 nt, Mus musculus
ggguuuuuuucugagugggggagggguagggcugcuggcag

SEQ ID NO: 122588 - RNA, 42 nt, Mus musculus
ccaggagggaacucaacugggcuccgccgccgccacugggac

SEQ ID NO: 122589 - RNA, 42 nt, Mus musculus
acccgccucuagaacagcgccagcucggagacguagcucaau

SEQ ID NO: 122590 - RNA, 46 nt, Mus musculus
gugagacccagucugaaaaauaaaaauauaaaagaaagaaggagga

SEQ ID NO: 122591 - RNA, 46 nt, Mus musculus
cuauaagagaguggcuuaguggaaaguuuuaaggaaugaaugaggc

SEQ ID NO: 122592 - RNA, 45 nt, Mus musculus
gcuuuugugacaaaaauuuucaccuucucugacucuuuucuuugc

SEQ ID NO: 122593 - RNA, 46 nt, Mus musculus
caaaaacccuggauuuuccuugaucugaaauuucugacuacccccu

SEQ ID NO: 122594 - RNA, 42 nt, Mus musculus
uuaggaauggagugcuuucuauguaaccaaaaaguggaaauu

SEQ ID NO: 122595 - RNA, 42 nt, Mus musculus
ucaaugagcccuggaaaaugauuuagugggaaggcaccaacu

SEQ ID NO: 122596 - RNA, 48 nt, Mus musculus
ugaauugugccaaauuuucuuacuucaucucacagauucaccccacag

SEQ ID NO: 122597 - RNA, 48 nt, Mus musculus
cagcuccaagggccugcgagaugagaaauauaagggaaagcgcgugga

SEQ ID NO: 122598 - RNA, 91 nt, Mus musculus
cuuucuggagauugggcuuugggaaaggaaagcaggccaggcuggaaugacaugaguguagucacuaauaccaacaaccuucuggaugaug

SEQ ID NO: 122599 - RNA, 45 nt, Mus musculus
caacaaagggguugaaaagccaccuagcaaaaccucccgccaggu

SEQ ID NO: 122600 - RNA, 42 nt, Mus musculus
gcaaagugucaaaaucaagaaagaaaacuucaccuggcaaga

SEQ ID NO: 122601 - RNA, 63 nt, Mus musculus
acguaaagagcccccuguuauuauuaaauauaucauuaucaaucguuuuaaaggugagaagaa

SEQ ID NO: 122602 - RNA, 61 nt, Mus musculus
caggugguuccaaagaagaagaugaugaugaauggugucccaaaaagagaagaaaaguaac

SEQ ID NO: 122603 - RNA, 45 nt, Mus musculus
cuaauucuggaaguucauccucccagcagaacuacggacugcgag

SEQ ID NO: 122604 - RNA, 48 nt, Mus musculus
gaagaaaggcaaagaggaaguacaugaagacaaaagcauagagacaaa

SEQ ID NO: 122605 - RNA, 41 nt, Mus musculus
ggcuucccccugcauaagucaagggcaggagauagacgaga

SEQ ID NO: 122606 - RNA, 45 nt, Mus musculus
guccuucuuaccgguuggaacaucuuauggauauaugcccaggag

SEQ ID NO: 122607 - RNA, 41 nt, Mus musculus
ggaacgccagggccaaaaaaaaaugagaaugaguggguagg

SEQ ID NO: 122608 - RNA, 45 nt, Mus musculus
guccaguuccagucagccauccucacaacugauccuaccccaguu

SEQ ID NO: 122609 - RNA, 86 nt, Mus musculus
caaaucccaguaaccacaugguggcucacaaccauccgaaacaacuaucuggcgcccucuucuggagugucugaagacagcuacag

SEQ ID NO: 122610 - RNA, 45 nt, Mus musculus
auucugaguguuggaauuacaauagcacuccaccaugccccucug

SEQ ID NO: 122611 - RNA, 45 nt, Mus musculus
gaauccaaggauggaugcccucugcuuccuagagcagacagaaga

SEQ ID NO: 122612 - RNA, 46 nt, Mus musculus
ccucaccagagagucacaacaggcaaaauaaucuuaugaaagagau

SEQ ID NO: 122613 - RNA, 45 nt, Mus musculus
uucaccccuuccugcagcacuauugguaguuugauugcugaagga

SEQ ID NO: 122614 - RNA, 46 nt, Mus musculus
aagaaagggagagggacaugaagagaggggcuaugugaggggggac

SEQ ID NO: 122615 - RNA, 45 nt, Mus musculus
ccuauagguggaacaacaauaugaacuaaccaguaccugccggag

SEQ ID NO: 122616 - RNA, 46 nt, Mus musculus
guaauagugggagacuucaacacaccacuaucaucaauggauagau

SEQ ID NO: 122617 - RNA, 46 nt, Mus musculus
acccaguacugggcaccccagcacacccaaaaagcuagacccggau

SEQ ID NO: 122618 - RNA, 41 nt, Mus musculus
cuuccagucugcgccagcaccaggucaccuggacacagagu

SEQ ID NO: 122619 - RNA, 46 nt, Mus musculus; identical to SEQ ID NO: 107808

SEQ ID NO: 122620 - RNA, 46 nt, Mus musculus
uaugauggaaaguuuaggaagaauuagaaaguauguccuuguugga

SEQ ID NO: 122621 - RNA, 41 nt, Mus musculus
uuuggugacuggugugaauagugguacucuugaugcuguga

SEQ ID NO: 122622 - RNA, 68 nt, Mus musculus
ccuguggaggcuugaugccccagcauagggggauguuagagcagugaggcacgagugaugggugaggu

SEQ ID NO: 122623 - RNA, 46 nt, Mus musculus
gugaaccaccaugugguugcuaggaauugaacucaggaccuuugga

SEQ ID NO: 122624 - RNA, 45 nt, Mus musculus
guacacugucacugucuucagacacaccagaagugggcaucaaau

SEQ ID NO: 122625 - RNA, 46 nt, Mus musculus
uccuugaaguaagagaaagugagcauaauauaccaucuucagauau

SEQ ID NO: 122626 - RNA, 46 nt, Mus musculus
uaagcuucucauauuuuccuauucuuuggaagucuuugcccaucuu

SEQ ID NO: 122627 - RNA, 46 nt, Mus musculus
gagucuguuucuuucaugaccuugaacaagcaucuaagcccccuag

SEQ ID NO: 122628 - RNA, 50 nt, Mus musculus
uguacauuccucuuggucuuggaccuuauucacuaucccagaauucaguc

SEQ ID NO: 122629 - RNA, 45 nt, Mus musculus
gaauauuaggccuauuaguauuauugcucuuugacugcaggagaa

SEQ ID NO: 122630 - RNA, 41 nt, Mus musculus
agauccccgaaaacauuuaaaucccauugaauuaagucacu

SEQ ID NO: 122631 - RNA, 45 nt, Mus musculus
ugccuuuuacauuaugauauagccaugaaaauaugggggccagag

SEQ ID NO: 122632 - RNA, 25 nt, Mus musculus
acagggauauauacauguugcuggc

SEQ ID NO: 122633 - RNA, 46 nt, Mus musculus
auccucacaugucaggauuuauagauaaaguauuucuaagggagaa

SEQ ID NO: 122634 - RNA, 46 nt, Mus musculus
ucccgugggguacuaguuuugaagacauaagagggaucauggagaa

SEQ ID NO: 122635 - RNA, 45 nt, Mus musculus
guggauauuucuuaaauauccauuuuaaaagucuacccaccuaag

SEQ ID NO: 122636 - RNA, 46 nt, Mus musculus
acaugauuauuggagacaggcuacggaaaucguuuuggcacaagac

SEQ ID NO: 122637 - RNA, 46 nt, Mus musculus
aucauaaauaucagauuugcaggauaucugguauaugcccccuaag

SEQ ID NO: 122638 - RNA, 45 nt, Mus musculus
gcacagccaggucagcugugaauauaaauucagaugggucugagu

SEQ ID NO: 122639 - RNA, 48 nt, Mus musculus
accgagaacuugggaauugugaugauauaauugagucuccuagagagg

SEQ ID NO: 122640 - RNA, 25 nt, Mus musculus
uggagaguagagcuuguugacaauu

SEQ ID NO: 122641 - RNA, 47 nt, Mus musculus
gcugaaacgaaauagccaucuaucuguggugccaccuacuggccaga

SEQ ID NO: 122642 - RNA, 84 nt, Mus musculus
ucuuaauaucaauuuggacaaaguauaaauugugguguguacaaacuauuucaaaucagcuccucgggauaaaagauugccaua

SEQ ID NO: 122643 - RNA, 46 nt, Mus musculus
ccccagugccccuuccccgcuguucuauuuuagaagauucggagac

SEQ ID NO: 122644 - RNA, 46 nt, Mus musculus
ugcaagaauuaaaauaaaaccucgguuuuuuuguauggugguagau

SEQ ID NO: 122645 - RNA, 49 nt, Mus musculus
uaaaaaauaaaauaagugggguacagagugguuaagaucagugguuaag

SEQ ID NO: 122646 - RNA, 45 nt, Mus musculus
guaauccaugcaaagugcauucaauugucaggaauuucuggaaga

SEQ ID NO: 122647 - RNA, 44 nt, Mus musculus
aacgggauggaaaucauuaaaaugucuuuaucacuuacuaagag

SEQ ID NO: 122648 - RNA, 46 nt, Mus musculus
caaauacaucuacaacacaacuccuguaccuaagacucaggaaaca

SEQ ID NO: 122649 - RNA, 42 nt, Mus musculus
aacuuuauuuaaacuauacuuggauaaguauacauguaacuu

SEQ ID NO: 122650 - RNA, 42 nt, Mus musculus
cuacauagggggacacugguucagaaagcggcaaggaaagga

SEQ ID NO: 122651 - RNA, 45 nt, Mus musculus
caauuguuagguauggugauagggucagagacggaaaugacagau

SEQ ID NO: 122652 - RNA, 45 nt, Mus musculus
cucccgaguacuggcauuacauacaauguuccaaaaaccccuggc

SEQ ID NO: 122653 - RNA, 42 nt, Mus musculus
ugugugugugugcgcgcgcgugcgugugagugugugugagug

SEQ ID NO: 122654 - RNA, 103 nt, Mus musculus
agccaucaaugaagauaacagcgugguguccuugucccagcccaagauggaugaacugcaguuguuccgaggugacacgguguugcuaaaaggaaagaaaaga

SEQ ID NO: 122655 - RNA, 42 nt, Mus musculus
gucgguucuucuguuugagaauggcuguugauaaaucaucac

SEQ ID NO: 122656 - RNA, 45 nt, Mus musculus
ccacaguagccaggccuuuauaaagagaagggagagagagagaga

SEQ ID NO: 122657 - RNA, 34 nt, Mus musculus
gcucaaucagccuucuacaaaggaauugguguag

SEQ ID NO: 122658 - RNA, 52 nt, Mus musculus
acugaaucaguagaaaagacaauggaugcucacuaacaugggugugguagga

SEQ ID NO: 122659 - RNA, 57 nt, Mus musculus
auugcugugacucaauugaauuggugcuugucuuggcugcaguauuaucuuugaaua

SEQ ID NO: 122660 - RNA, 42 nt, Mus musculus
caaaucuaagcauguaguuuagaauuauuucuacgucugcug

SEQ ID NO: 122661 - RNA, 46 nt, Mus musculus
aaacuagaaacagccaaaguguacaucacaugauaaauguauaaag

SEQ ID NO: 122662 - RNA, 45 nt, Mus musculus
uagaagaaaguucugcugugcuauuacauacuugugugucuguag

SEQ ID NO: 122663 - RNA, 46 nt, Mus musculus
uuuuguaugcauggaacaauaauugaugaaaaaugagcccaugaau

SEQ ID NO: 122664 - RNA, 45 nt, Mus musculus
uugggaugugugugugugugugugugugugugugugugcuuguuu

SEQ ID NO: 122665 - RNA, 46 nt, Mus musculus
caaaaaguuucuauauaagaacauuauuaaucaacagcccacagaa

SEQ ID NO: 122666 - RNA, 37 nt, Mus musculus
caucugaccaaaaaauaagagagagagagagagagag

SEQ ID NO: 122667 - RNA, 45 nt, Mus musculus
uuuagaagaggccaugaauuuaaaagaaaguaaggagggauagag

SEQ ID NO: 122668 - RNA, 46 nt, Mus musculus
uguuacauuacuaccucugguccacaccccacagcugcccagcaug

SEQ ID NO: 122669 - RNA, 45 nt, Mus musculus
gcaccaucucuccagccugugcuuacucuugaauagccccaaagu

SEQ ID NO: 122670 - RNA, 41 nt, Mus musculus
auuuaaagaaaaggauuuuuaaaauucuucuaggagcuaga

SEQ ID NO: 122671 - RNA, 45 nt, Mus musculus
aaauauaaaguauuccuauuuaaauaaaauaucauucuggaagaa

SEQ ID NO: 122672 - RNA, 58 nt, Mus musculus
uauuucuacucaugcacacaccccccaacacuaauuaaagaauaagaggucaugaauu

SEQ ID NO: 122673 - RNA, 45 nt, Mus musculus
ucucauucaauauauuuuguucauguucuggccuuuccccaacuu

SEQ ID NO: 122674 - RNA, 45 nt, Mus musculus
ucucuggugagaagucuggugucauucugauaugucugccuuuau

SEQ ID NO: 122675 - RNA, 46 nt, Mus musculus
auguccaaagugcuuccucucuuuggacuagugucuggguucucuu

SEQ ID NO: 122676 - RNA, 46 nt, Mus musculus
uuucuugccucuucuuccuucuguauugccauucucuugcccacgu

SEQ ID NO: 122677 - RNA, 46 nt, Mus musculus
uucuggagauuuucuucuuugcauuuugcuauaggagcacugagau

SEQ ID NO: 122678 - RNA, 46 nt, Mus musculus
auaugugccgguggucaaaauuacauguuucccucuguccccaccu

SEQ ID NO: 122679 - RNA, 46 nt, Mus musculus
gucuuuuauucuuuuguuuuguuuuguuucaaguauaaacccagag

SEQ ID NO: 122680 - RNA, 45 nt, Mus musculus
ccaggccagcuuuggcuagagaucccugaaggaagugaaggagau

SEQ ID NO: 122681 - RNA, 45 nt, Mus musculus
agagguuuuauuggaagggagagacaagguaguggcagaaagaga

SEQ ID NO: 122682 - RNA, 71 nt, Mus musculus
uucccagguuucgggaccaaaugauguauuagaauggcaggucacaucuuaaccgcacacuaggccaaagc

SEQ ID NO: 122683 - RNA, 48 nt, Mus musculus
uggcagagguuguguaguuuucauggcuaagaggaguuggguuggaga

SEQ ID NO: 122684 - RNA, 45 nt, Mus musculus
ggugcaucugacagugggcauguggguaaagucaaguuguaagau

SEQ ID NO: 122685 - RNA, 46 nt, Mus musculus
uaggauuugagaaacuugggaaguaaauuuggaaccauugucugau

SEQ ID NO: 122686 - RNA, 41 nt, Mus musculus
gguuuuaaagagcaguuaguucuuucuaccuuaccugaaga

SEQ ID NO: 122687 - RNA, 68 nt, Mus musculus
gggcagaaagcacuuagguggaagaccaggaguuaagacuggacgaccauacaugaguucaaagggcg

SEQ ID NO: 122688 - RNA, 60 nt, Mus musculus
aacaaaguuccauaagcgagaacagagguggcaaaguaaugggguaaguagauggucugg

SEQ ID NO: 122689 - RNA, 46 nt, Mus musculus
cuuaacagagcaugguccuguuagggucgauguguaugaagaaggg

SEQ ID NO: 122690 - RNA, 66 nt, Mus musculus
ccauuuucuacaauuaucuuuugucuggucaaagagaaagcaaguauagagaucauaauauuuaga

SEQ ID NO: 122691 - RNA, 46 nt, Mus musculus
cauggcugccaaugaaucgaucugcuucuggauaauaagcacaguu

SEQ ID NO: 122692 - RNA, 67 nt, Mus musculus
gaaaagguguuacaaaagggaguauccacuucgauauaugauuuucgaaaaucccaaaacuguaggu

SEQ ID NO: 122693 - RNA, 71 nt, Mus musculus
uugucauugaaggaauguagaaacaagauuaauaaggcaaggagcaaauaauaacgccaggaagaugacua

SEQ ID NO: 122694 - RNA, 25 nt, Mus musculus
cagcuuccucuguggacaacggcuc

SEQ ID NO: 122695 - RNA, 45 nt, Mus musculus
ccugaugccaacauaccucccuuguuauuauaaagaaaaggaaag

SEQ ID NO: 122696 - RNA, 55 nt, Mus musculus
uuauuggaagggagagacaagguaguggcagaaagagaagagggggagagacagu

SEQ ID NO: 122697 - RNA, 59 nt, Mus musculus
aauagcaggucgcaucucagcagcacacuaggccaaagcaguuccaugugggagagguu

SEQ ID NO: 122698 - RNA, 51 nt, Mus musculus
agcaugcauagguguuuggguucaaucccuagaacuuugagaaaaaacaaa

SEQ ID NO: 122699 - RNA, 70 nt, Mus musculus
gucuggguuauaagaauuguuuccuaauucuuucccugcuuuguccuucucuuauccacacugaugaccu

SEQ ID NO: 122700 - RNA, 88 nt, Mus musculus
uuuaaucauucaugucacaggcugagaaugacuuugcuuuuuucuuccccccucauuuuucaucuuucaaaaaaucuugugaguucug

SEQ ID NO: 122701 - RNA, 92 nt, Mus musculus
cucugcccaggcuucaaauugaacuuguauagcuuucauauaaacggucauauucacaauucuccggggcagguaacagcaacuacuguucu

SEQ ID NO: 122702 - RNA, 49 nt, Mus musculus
ggccuccuggccauguacgccugccaugucacuauaaagccaaaucaac

SEQ ID NO: 122703 - RNA, 42 nt, Mus musculus
uagcaaaugcucaauacacaagaauaacauaaaggggcagac

SEQ ID NO: 122704 - RNA, 46 nt, Mus musculus
uccuuccuauauucuggauaguuuaucagaugaguagcugccaaau

SEQ ID NO: 122705 - RNA, 53 nt, Mus musculus
cauauuacuaaauggcaaccaagcgagagaagcugauaucugggagaugcucu

SEQ ID NO: 122706 - RNA, 46 nt, Mus musculus
agaaggcuuucuguuuuugggaacgugaagagacuucugucuguag

SEQ ID NO: 122707 - RNA, 46 nt, Mus musculus
augaguuuuacuggggcccacgaucccgcgcagaaaccaccaagau

SEQ ID NO: 122708 - RNA, 45 nt, Mus musculus
guccuugaucccaggaaccacuccuacacccuguacaaccgaaga

SEQ ID NO: 122709 - RNA, 29 nt, Mus musculus
gcucugguucucauguauuaggagugggu

SEQ ID NO: 122710 - RNA, 45 nt, Mus musculus
ugcuccugaaaaauggacugaaggccuuucagaauggccucacca

SEQ ID NO: 122711 - RNA, 55 nt, Mus musculus
auaauggcaggaaaaucgucucuuuuuaaaauaauucuucuuggagaugguggag

SEQ ID NO: 122712 - RNA, 46 nt, Mus musculus
uuccacacaauagguguggaauuuuuaaauaaagaucuggaggugg

SEQ ID NO: 122713 - RNA, 25 nt, Mus musculus
uuccagaauuugagcaacuggaaga

SEQ ID NO: 122714 - RNA, 46 nt, Mus musculus
auaaaauucaguuaacgcauauuguugccucauuagucggucgggg

SEQ ID NO: 122715 - RNA, 44 nt, Mus musculus
ccuugacuauucuagaaguacacuuagauuguuuugacccacaa

SEQ ID NO: 122716 - RNA, 45 nt, Mus musculus
aagcuaagcucauucacucccuucuucggucauucuuuccccuaa

SEQ ID NO: 122717 - RNA, 45 nt, Mus musculus
uguuacccccugcgguuugggacacguuccgugaaguaguuagau

SEQ ID NO: 122718 - RNA, 42 nt, Mus musculus
agauccuggaggguuaucuuggggaccccugggcggcugaga

SEQ ID NO: 122719 - RNA, 42 nt, Mus musculus
ggagagccgagcauuggagguaggagggccgggcccggaagg

SEQ ID NO: 122720 - RNA, 41 nt, Mus musculus
gggcggggggugucgcgggccaccgaacgcuugcggucagu

SEQ ID NO: 122721 - RNA, 41 nt, Mus musculus
cuauguguguaugugugugucugucugucugucugugugug

SEQ ID NO: 122722 - RNA, 42 nt, Mus musculus
ggugcccuaggcccgcgcgcggcuucgcggucagcggcaucg

SEQ ID NO: 122723 - RNA, 46 nt, Mus musculus
ucccaguacuuuucguucagccacuggcgccgaggagcgcagaacg

SEQ ID NO: 122724 - RNA, 42 nt, Mus musculus
ugaauguacaugcaaugggugugugccuggucucuguaaaga

SEQ ID NO: 122725 - RNA, 46 nt, Mus musculus
gcauucugccugcauuauuccugcaggccagaagagggcaccagau

SEQ ID NO: 122726 - RNA, 45 nt, Mus musculus
cugcggcgacuaugcugcugccuuggugcaaauucaccccagcua

SEQ ID NO: 122727 - RNA, 64 nt, Mus musculus
auagucgccgcaguuccaucuucgucuccgcgauguugcccuuagccaaaaacgcacuaagccg

SEQ ID NO: 122728 - RNA, 41 nt, Mus musculus
accaugcaccuagaauuaaaacccgcaggauuuggggcgga

SEQ ID NO: 122729 - RNA, 47 nt, Mus musculus
gcaucuggauucauagcaagggguugaaaaccuuaagccuggcagcu

SEQ ID NO: 122730 - RNA, 46 nt, Mus musculus
aaugaaggugaccuuacacaauacuuacuugcuuuucuagccaugg

SEQ ID NO: 122731 - RNA, 46 nt, Mus musculus
guacuuugggaauaauugaaaaaaaaaaaaaagaaagaagcccaac

SEQ ID NO: 122732 - RNA, 46 nt, Mus musculus
ugauuuagcguuauaaacuuguuuuuguaaaacagagguuaguaag

SEQ ID NO: 122733 - RNA, 42 nt, Mus musculus
uuuguuuguuuguuuuuaauuuuauuuugguauagaggggag

SEQ ID NO: 122734 - RNA, 46 nt, Mus musculus
uaagaacaccaacuacucuucagaagguccugaguucaaaucccag

SEQ ID NO: 122735 - RNA, 46 nt, Mus musculus
aucugcaaugauauccgaugcuccgaugcccucuucuggugugucu

SEQ ID NO: 122736 - RNA, 65 nt, Mus musculus
uaauauagcauucccauauuugucauggaaacuaggugcccucuucugguggcucugccuugcca

SEQ ID NO: 122737 - RNA, 48 nt, Mus musculus
auagaauggaacauguccccuguuggcagagucaccccaaaggaaugg

SEQ ID NO: 122738 - RNA, 73 nt, Mus musculus
aaggaauuguuuaaaaccaacuuauaagugaaugccaagucaaagaaucauguacucauuauacuauggcaga

SEQ ID NO: 122739 - RNA, 42 nt, Mus musculus
cccgccccgccccugagcccgccccugagcccgcccccggac

SEQ ID NO: 122740 - RNA, 45 nt, Mus musculus
gaaagcgacauuuuggcaacaccgugaggucgaaaggcccggaga

SEQ ID NO: 122741 - RNA, 42 nt, Mus musculus
ugagguaauuccguacugcugcccucaagcccucggggccac

SEQ ID NO: 122742 - RNA, 57 nt, Mus musculus
gggaccuugaaaggucauuuagcuaguuucccuucccccaagauucuuggaccaucc

SEQ ID NO: 122743 - RNA, 62 nt, Mus musculus
gugacgaauccgaaaccgcccacguuucauugguccugguacaaaugauuucuuucccaaaa

SEQ ID NO: 122744 - RNA, 42 nt, Mus musculus
uuuuugccuuucauaauguauacuuuuuuuuuuuugccagga

SEQ ID NO: 122745 - RNA, 65 nt, Mus musculus
aguuugggauuuuaugcuauuuucuacagagaaacuaucuuaaaggaauuaacuccgguugaggg

SEQ ID NO: 122746 - RNA, 46 nt, Mus musculus
uuccugcugauuuuugucaugucauuuccuuuucacccauaggucc

SEQ ID NO: 122747 - RNA, 45 nt, Mus musculus
uguaagucuaggagagagugaaggucaaaggcaaucaagagguca

SEQ ID NO: 122748 - RNA, 41 nt, Mus musculus
gucccucaagcuccuuugugcgguagauuggucuucagggu

SEQ ID NO: 122749 - RNA, 42 nt, Mus musculus
guggcacuucuaaaccuuuuaacauuuauaacucuuagccag

SEQ ID NO: 122750 - RNA, 46 nt, Mus musculus
ggugcuggggauugaacccagggaccugagcacgacacccccaguc

SEQ ID NO: 122751 - RNA, 44 nt, Mus musculus
cuucaacguuccuaugaagaacaaccagauaacaaacaaccaaa

SEQ ID NO: 122752 - RNA, 46 nt, Mus musculus
agaccgaaaacaaccuggucugcacaaagaguucuaggauagccag

SEQ ID NO: 122753 - RNA, 42 nt, Mus musculus
caauccuucuuaacuacuguguacucuccagugccccugcag

SEQ ID NO: 122754 - RNA, 58 nt, Mus musculus
auggagccaaguccguuguccuuaugagccaccugggccggccugaugguguucccau

SEQ ID NO: 122755 - RNA, 58 nt, Mus musculus
gccugacaaguacuccuuagagccaguugcugcugaacucaaaucucugcugggcaag

SEQ ID NO: 122756 - RNA, 49 nt, Mus musculus
gcggcugggacugucauccugcuggaaaaccuccgcuuucauguagagg

SEQ ID NO: 122757 - RNA, 46 nt, Mus musculus
uguguauaguuuuccgggagaggcagaggggauaagaaaugagcaa

SEQ ID NO: 122758 - RNA, 50 nt, Mus musculus
gccggccaaaauugaugcuuuccgagccucacuguccaaacuaggagaug

SEQ ID NO: 122759 - RNA, 42 nt, Mus musculus
gggagcucuagguuguccuagguugacaauaagaaccaagag

SEQ ID NO: 122760 - RNA, 46 nt, Mus musculus
cuauuaacuaaguauguuuuuccuuccuauuguguuuugccugcau

SEQ ID NO: 122761 - RNA, 46 nt, Mus musculus
gguauggaacugacuucuagguggggacaugguacaauuugacuag

SEQ ID NO: 122762 - RNA, 67 nt, Mus musculus
ugugaaucugccacagaaggcugguggauuuuugaugaagaaggagcugaacuacuuugccaaggcu

SEQ ID NO: 122763 - RNA, 46 nt, Mus musculus
guagugguuauaacaugggguaacugaggacaguuuaauaaaggga

SEQ ID NO: 122764 - RNA, 42 nt, Mus musculus
uccccagcaaccacaugguagcucacaaccaucuauagggga

SEQ ID NO: 122765 - RNA, 42 nt, Mus musculus
uaaucuggcaaucugggccuugugaauuuuggaugggagcau

SEQ ID NO: 122766 - RNA, 46 nt, Mus musculus
augggaucaacgcagagaggguuggagaaauggaaacuuuaggcag

SEQ ID NO: 122767 - RNA, 54 nt, Mus musculus
cgcuaaaguugcagacaagauccagcugaucaauaauaugcuagacaaagucaa

SEQ ID NO: 122768 - RNA, 61 nt, Mus musculus
gauuggcacaucucuguaugaugaagaaggagccaagauugucaaagaucucauguccaaa

SEQ ID NO: 122769 - RNA, 46 nt, Mus musculus
ggcaagguaaucuucacaccauuuuucucagcuuuggacaugagau

SEQ ID NO: 122770 - RNA, 68 nt, Mus musculus
gcugagaaaaauggugugaagauuaccuugccuguugacuuugucacugcugacaaauuugaugagaa

SEQ ID NO: 122771 - RNA, 46 nt, Mus musculus
uugauucuuuuucaguguguguuuuagcacuaugugcuacagggag

SEQ ID NO: 122772 - RNA, 41 nt, Mus musculus
ggaacucacuuuauagacaaguuggcuuuggacucgacaga

SEQ ID NO: 122773 - RNA, 72 nt, Mus musculus
gaggcugugggucgagcuaagcagauuguuuggaaugguccuguugggguauuugaaugggaagccuuugcc

SEQ ID NO: 122774 - RNA, 46 nt, Mus musculus
uggagacacugccacuugcugugccaaauggaacacagaggauaaa

SEQ ID NO: 122775 - RNA, 46 nt, Mus musculus
agucaaccuaguguuuuccacaucuccauuugguguuagcgcaaga

SEQ ID NO: 122776 - RNA, 100 nt, Mus musculus
acugcaucaggauuugucuguguucuucaagaucccauuuaaauuccuuagugacuaaaaccauugugcauuguagagggcgucuauuuauauucugccu

SEQ ID NO: 122777 - RNA, 54 nt, Mus musculus
cuguucuugacucagcauggcaaucugaugaaaucccagcuguaagucugcaga

SEQ ID NO: 122778 - RNA, 45 nt, Mus musculus
gauuacuuucaaucagguugcacagguaacugaaggucuggacag

SEQ ID NO: 122779 - RNA, 44 nt, Mus musculus
gucuucaacaauagcugcaucacaucugaagcauccugcaugaa

SEQ ID NO: 122780 - RNA, 44 nt, Mus musculus
ugcuauugaaaucaucaucuucuagcucaucagcauuugcccag

SEQ ID NO: 122781 - RNA, 45 nt, Mus musculus
ugaacugugggaaccuggcuaugggaaaaugaaacugcuagugac

SEQ ID NO: 122782 - RNA, 25 nt, Mus musculus
ccaaugguucaccuaguacauagag

SEQ ID NO: 122783 - RNA, 45 nt, Mus musculus
agaggaaguauccaaggaacagauuuccuagucaccuugggagag

SEQ ID NO: 122784 - RNA, 45 nt, Mus musculus
gaaggggggucucucugucuuagaacuacuugggucuacucuauu

SEQ ID NO: 122785 - RNA, 42 nt, Mus musculus
ucucuugaauuuauaggguuuagauuucugaaagcagcauga

SEQ ID NO: 122786 - RNA, 49 nt, Mus musculus
caugcuauuuacucauacauuuacucuauugcuuauacuggaaaaggaa

SEQ ID NO: 122787 - RNA, 68 nt, Mus musculus
uuucaacaagcgugccauugacaaaugcuggaagauuagacacuuccccaaugaauuuaucguugaaa

SEQ ID NO: 122788 - RNA, 46 nt, Mus musculus
ggacaagagaaguaguuggaggaagaaaucaaggaagaggugagag

SEQ ID NO: 122789 - RNA, 46 nt, Mus musculus
gcagaguggagucagaaagguuaggagaagaauagagggaguugag

SEQ ID NO: 122790 - RNA, 45 nt, Mus musculus
agacagcaggagaaccccuggagguagaaagaacacaggacagaa

SEQ ID NO: 122791 - RNA, 41 nt, Mus musculus
gcaguaguggagucagaggaaaaggcagcaguagagucuga

SEQ ID NO: 122792 - RNA, 42 nt, Mus musculus
gcucugaguaccgaguucaggggaaguagugcauuucuguaa

SEQ ID NO: 122793 - RNA, 46 nt, Mus musculus
agguugcuggguuguugucauuuacauuuaguaggauuuggaauag

SEQ ID NO: 122794 - RNA, 45 nt, Mus musculus
ugauuugccugcauauguauacugugugaauacaaugcccaugga

SEQ ID NO: 122795 - RNA, 47 nt, Mus musculus
ugacaauaaugccaugauuauguuucuuucagaaaaggagaugcaga

SEQ ID NO: 122796 - RNA, 46 nt, Mus musculus
uccaacaaugaaucaagacuaauuaaacuucaguuuuaagcagcag

SEQ ID NO: 122797 - RNA, 46 nt, Mus musculus
agugcucuaucugcauguacaccugugugccagaagagggcaucag

SEQ ID NO: 122798 - RNA, 46 nt, Mus musculus
ugaaaaucauucauuuuuagagauagauuuuucucucuacuauugg

SEQ ID NO: 122799 - RNA, 42 nt, Mus musculus
agauaaaggaggacgcuucauuaaggaagaagagaggucuag

SEQ ID NO: 122800 - RNA, 46 nt, Mus musculus
auauauaugaaugaaaauguauuucacucaguauccugccagucag

SEQ ID NO: 122801 - RNA, 42 nt, Mus musculus
uuuguaucugugcacacugaaccauuucccuguccuggacuu

SEQ ID NO: 122802 - RNA, 42 nt, Mus musculus
agcauaacagaaggauuugggagaagagaagcugagcccaga

SEQ ID NO: 122803 - RNA, 45 nt, Mus musculus
caauugcuguuaguccaugagugcuguggucuuuucacacccaga

SEQ ID NO: 122804 - RNA, 72 nt, Mus musculus
ucuuaauagaaauuauuccuugcacauuagacaguuauaaaucuuugcagugggugcuguucacugcagaaa

SEQ ID NO: 122805 - RNA, 71 nt, Mus musculus
agggccugugauuuuccuuagccaugggcuucugacuagauuugaagaggaaugaguuccuuccuguggag

SEQ ID NO: 122806 - RNA, 42 nt, Mus musculus
gcugcucacuggccccucuccuauuccugggauagcagccag

SEQ ID NO: 122807 - RNA, 46 nt, Mus musculus
gcugucuuucuugaugacaaucucuaguccauaacagaggccguag

SEQ ID NO: 122808 - RNA, 46 nt, Mus musculus
uugagcucucaguuucucaucucaguuguccugggagcugcugacu

SEQ ID NO: 122809 - RNA, 45 nt, Mus musculus
guaacaaaaaaguaacaaaaugauaaaaagaaagaggccaugaau

SEQ ID NO: 122810 - RNA, 46 nt, Mus musculus
guuuuuauauuugguguauaacugugcaucauagcauguggagaga

SEQ ID NO: 122811 - RNA, 46 nt, Mus musculus
gcucugaauauuuauaaaaucaaaacuaaucaaggacagccccccc

SEQ ID NO: 122812 - RNA, 46 nt, Mus musculus
guguguguguguguguguguguguguguuugugugugugucuggaa

SEQ ID NO: 122813 - RNA, 46 nt, Mus musculus
ucaauuguucaaaugucuuugaaucuuuucucugucuugccucccu

SEQ ID NO: 122814 - RNA, 45 nt, Mus musculus
gcuguauucuugauaaaacugcagucaagauguacugacuuguga

SEQ ID NO: 122815 - RNA, 46 nt, Mus musculus
ucucccaaaccugaucauuccuguuuccaacaccaccugcccccag

SEQ ID NO: 122816 - RNA, 50 nt, Mus musculus
aauauauaagaaaaaauauauuguauuaugagaaagccacaguauuuguc

SEQ ID NO: 122817 - RNA, 45 nt, Mus musculus
agugaagaaaccuaacucauacuccacuuaccaaguaauccaggu

SEQ ID NO: 122818 - RNA, 46 nt, Mus musculus
aacuagauaagucuggcuggagaagcauuaccauauaucugaccag

SEQ ID NO: 122819 - RNA, 46 nt, Mus musculus
gccaacaaaauaggauuugaagaaaaagauauugcagcuaaugaag

SEQ ID NO: 122820 - RNA, 53 nt, Mus musculus
uucucaucauuucaacuuuaaggaacugaaaggagcgagagaggagagagaga

SEQ ID NO: 122821 - RNA, 45 nt, Mus musculus
auggaacacugauucuuuucaucugaugaauuucaauaaaacuga

SEQ ID NO: 122822 - RNA, 41 nt, Mus musculus
augugucucuguuuaguuucuguuuccaggaccuguucauu

SEQ ID NO: 122823 - RNA, 28 nt, Mus musculus
agggcaacaguaagcaaagcaggaggaa

SEQ ID NO: 122824 - RNA, 44 nt, Mus musculus
ccuuaguuagagucaugccuaggcuuuuuauauuauuuguggcu

SEQ ID NO: 122825 - RNA, 44 nt, Mus musculus
ucuaagaaguccuuaauuucuuucuuuauuccuuccuugcccaa

SEQ ID NO: 122826 - RNA, 42 nt, Mus musculus
auucuuguucauugacuaucugagguggauuagccuugggag

SEQ ID NO: 122827 - RNA, 46 nt, Mus musculus
agccugggauacaugaggcaugagucuugaaggagaaauagagggg

SEQ ID NO: 122828 - RNA, 31 nt, Mus musculus
cucugagggauccgguuaguugauauuguug

SEQ ID NO: 122829 - RNA, 46 nt, Mus musculus
augucuucauagcuagugauuuuuaaaucaaauauuuucauccagu

SEQ ID NO: 122830 - RNA, 45 nt, Mus musculus
aggguacuguaaauuggucuguugaggacacuguuaaaggcauaa

SEQ ID NO: 122831 - RNA, 45 nt, Mus musculus; identical to SEQ ID NO: 77905

SEQ ID NO: 122832 - RNA, 72 nt, Mus musculus
ugaugccauuucaaauaucuuucaggcugcagagaaacuaggugagacagaaaagcucagaauaaugauuga

SEQ ID NO: 122833 - RNA, 44 nt, Mus musculus
gggcuucauugaacuuaauugagaaguacuucucaguggaggaa

SEQ ID NO: 122834 - RNA, 46 nt, Mus musculus
aagcacaauucggagauggauggaggagagagagagagacagagag

SEQ ID NO: 122835 - RNA, 46 nt, Mus musculus
guccaucacuacaguggcaauaauauugaacugggcacagcgugug

SEQ ID NO: 122836 - RNA, 44 nt, Mus musculus
guguugguuggggguugucccgcaccuaaggcaggaagauggug

SEQ ID NO: 122837 - RNA, 69 nt, Mus musculus
ccaccaucuuccugccuuaggugcgggacaacccccaaccaacaccagccgccaagauggccggggagc

SEQ ID NO: 122838 - RNA, 45 nt, Mus musculus
aguagggagggcucccuaggccccuccuguuauuauggggaucug

SEQ ID NO: 122839 - RNA, 46 nt, Mus musculus
aggguuucuuacuccuuggaggacauguaggccaugagguccacca

SEQ ID NO: 122840 - RNA, 86 nt, Mus musculus
augcacagaugagagcagcaauuaaccaaaaguuaauagaaacuggagaaaaagaacgccucaaagaguugcugagagcuaaauua

SEQ ID NO: 122841 - RNA, 45 nt, Mus musculus
ugagcuugacaaaguugucauugagagcaaugccagccccugcau

SEQ ID NO: 122842 - RNA, 46 nt, Mus musculus
agggaggacucccuaggccccuccuguuauuaugggggucugggau

SEQ ID NO: 122843 - RNA, 99 nt, Mus musculus
uuguuauagaaaggggguggagggaugaaaaacagaaguccaacugguagccagaacaugggauuccuauagaugccugguuaacuggugaccagauca

SEQ ID NO: 122844 - RNA, 62 nt, Mus musculus
aagugauggaagcuaccucuucuguccaauauuucauucaaaugcugaaagaaaucguuuau

SEQ ID NO: 122845 - RNA, 46 nt, Mus musculus
uuuaaucccacgggaaguucagagccgaugacaauuugcuggccag

SEQ ID NO: 122846 - RNA, 45 nt, Mus musculus
ugucuuucauugguaaaaaaggauauauucauuucucuaggucag

SEQ ID NO: 122847 - RNA, 45 nt, Mus musculus
ugaaauucaaacgcucagcagacaaaagcuguacuugaguuagag

SEQ ID NO: 122848 - RNA, 47 nt, Mus musculus
gacuuaggcguuuacaguccuuaauaaaaaauaucacgcuuagaaga

SEQ ID NO: 122849 - RNA, 24 nt, Mus musculus
cgcguggggaugggaaauugaaga

SEQ ID NO: 122850 - RNA, 44 nt, Mus musculus
gaaaaagcagacucuacggauuguauagauauagcuccugaaga

SEQ ID NO: 122851 - RNA, 24 nt, Mus musculus
cauguuccagaagaaguuccugag

SEQ ID NO: 122852 - RNA, 46 nt, Mus musculus
cacuacacaacugcaaccaaccaccuuccgugguuugcccucacga

SEQ ID NO: 122853 - RNA, 46 nt, Mus musculus; identical to SEQ ID NO: 122852

SEQ ID NO: 122854 - RNA, 44 nt, Mus musculus
aacucauuauuuuuguacuaaguuuuuuaaaagagcccgauagg

SEQ ID NO: 122855 - RNA, 45 nt, Mus musculus
cuacuuuauuauuugaaagguuauaauuacuuuaauggcaucaga

SEQ ID NO: 122856 - RNA, 46 nt, Mus musculus
ccuauucuuacaccccuguaucucugaaacacuggaagugcuagua

SEQ ID NO: 122857 - RNA, 46 nt, Mus musculus
ugucaccaauuacggagauuggaaagguacgaacuauuacucagaa

SEQ ID NO: 122858 - RNA, 38 nt, Mus musculus
cuaaaacccaugcuuauuguuagaaucaagugccaguc

SEQ ID NO: 122859 - RNA, 42 nt, Mus musculus
uauguucuauaaugucuuuguuucuuggaauuggccguagcu

SEQ ID NO: 122860 - RNA, 45 nt, Mus musculus
augacuuuaccucaaaguauuuacgggaguauguuguccccagag

SEQ ID NO: 122861 - RNA, 51 nt, Mus musculus
guucuaggaauguuaaaguacaagggcuuuuucccacccccgacugacuga

SEQ ID NO: 122862 - RNA, 67 nt, Mus musculus
ugagaggagcagagagcaaagaaaaagaagagagaugaacgagaccacaaaaaucauaaaauaaaaa

SEQ ID NO: 122863 - RNA, 45 nt, Mus musculus
auguuccugcucuuuucaaagcuuccaguagaacgauagcucccu

SEQ ID NO: 122864 - RNA, 44 nt, Mus musculus
auggcguugcaugggaaacaaugaugaaugaaugcuugcugaaa

SEQ ID NO: 122865 - RNA, 45 nt, Mus musculus
gaaagucauuccccuuuauccugguacuucuggccacauagcccu

SEQ ID NO: 122866 - RNA, 91 nt, Mus musculus
gcuugacucccguugugacuauagcuguucuaguggcuaccaccuagaaggagaucgcagccgcaucugcauggaagaugggcgauggagu

SEQ ID NO: 122867 - RNA, 72 nt, Mus musculus
gacauagauccacccaagauccguuguccucacucucgugagaaaauggcagagccagagaaacuaacugcu

SEQ ID NO: 122868 - RNA, 46 nt, Mus musculus
ugaugacuaugcaugacucugugugugugugugugugugugugugu

SEQ ID NO: 122869 - RNA, 45 nt, Mus musculus
ugguagugagacgcugucccauucugaagccaccacagcacggcu

SEQ ID NO: 122870 - RNA, 42 nt, Mus musculus
agagacagcacuuagugccaugcggaacuugaaugggcguga

SEQ ID NO: 122871 - RNA, 45 nt, Mus musculus
agaucuacuaagccaucaguuauuucucuguguugcuagacuagu

SEQ ID NO: 122872 - RNA, 46 nt, Mus musculus
gccuuggcacuggugcaccugucauagagucaccuuauggagaaag

SEQ ID NO: 122873 - RNA, 42 nt, Mus musculus
uuuagcacuguucugacauugaaugcacaguuuaggcaagaa

SEQ ID NO: 122874 - RNA, 45 nt, Mus musculus
accaauaaccuguauguuaguauuucaugacaauggaaguacaga

SEQ ID NO: 122875 - RNA, 23 nt, Mus musculus
gggcugaacauggggcuuuuugc

SEQ ID NO: 122876 - RNA, 42 nt, Mus musculus
uuuacaaauauuguccucuucuuugaaacuuggcacugagga

SEQ ID NO: 122877 - RNA, 46 nt, Mus musculus
acaggugguugugagccaccauguggcugcugggaauugaacucag

SEQ ID NO: 122878 - RNA, 45 nt, Mus musculus
auacccauacauguauaaaauauccuaugaguaauacugccuucc

SEQ ID NO: 122879 - RNA, 41 nt, Mus musculus
uuuucccugccguuuauuuucuaggaguuaugcaagcccaa

SEQ ID NO: 122880 - RNA, 53 nt, Mus musculus
cuuuggguuagguggcagugccuuaguuuuacagguaaagacauggaagcaca

SEQ ID NO: 122881 - RNA, 46 nt, Mus musculus
uauuaaacagcugaaagguucacugauaagacugauggccugggaa

SEQ ID NO: 122882 - RNA, 45 nt, Mus musculus
cuuggcuucuuacugacauguaaauuucuuaaucuccugucuccg

SEQ ID NO: 122883 - RNA, 46 nt, Mus musculus
ugggcaucuguccgaggcucuacucccucccuacuggugucaggag

SEQ ID NO: 122884 - RNA, 45 nt, Mus musculus
agguucuugcagagccaugacaguguucauaugccaagccccuac

SEQ ID NO: 122885 - RNA, 45 nt, Mus musculus
auugaaguuucuagucauacauaccuaaacaaggaaaacuuggag

SEQ ID NO: 122886 - RNA, 25 nt, Mus musculus
acacaauaacuauccauuaauucuu

SEQ ID NO: 122887 - RNA, 46 nt, Mus musculus
uuaauggcagaaccaagaggacccaugcuagaucagaggggcccac

SEQ ID NO: 122888 - RNA, 42 nt, Mus musculus
gcauuaccugucuggaucccuggggaacaacugcccccaugu

SEQ ID NO: 122889 - RNA, 46 nt, Mus musculus
ugcuuuuuaaaaaauguuuguggguuuugauuuuuguugcacccuc

SEQ ID NO: 122890 - RNA, 46 nt, Mus musculus
acuuaacuaccuaguguuagguaauuauuucauacuagugucucag

SEQ ID NO: 122891 - RNA, 45 nt, Mus musculus
ucaaaagcccaugauaagcccaguaucuccuucucugccuucaga

SEQ ID NO: 122892 - RNA, 45 nt, Mus musculus
caugaaaaugugaaggugaagacaauuucaguggagacccgaaga

SEQ ID NO: 122893 - RNA, 42 nt, Mus musculus
ugcagaccagaucgccaugcugccuccugagcaaagacagag

SEQ ID NO: 122894 - RNA, 46 nt, Mus musculus
gguggagacaggaacaucuuuggcacuuacugaccagcccgccuaa

SEQ ID NO: 122895 - RNA, 46 nt, Mus musculus
acaacagaauaaacugcuuuccuuuggagcaauggcgauguaagac

SEQ ID NO: 122896 - RNA, 45 nt, Mus musculus
ucuaaccacgugcuuuuuuguuuuccucccagaaagcucugagac

SEQ ID NO: 122897 - RNA, 49 nt, Mus musculus
aggaaaacaaaaaagcacgugguuagaacuaaaaaugaucagaaggcca

SEQ ID NO: 122898 - RNA, 62 nt, Mus musculus
auauuccaaucuuucagaaaaucacaaagcuuucagcccugucaucuuaacuaaauccauuc

SEQ ID NO: 122899 - RNA, 44 nt, Mus musculus
gcauuaaggaggaacuugguuucucuccaccaguuugaccucaa

SEQ ID NO: 122900 - RNA, 52 nt, Mus musculus
ucuugaggucaaacugguggagagaaaccaaguuccuccuuaaugccacugu

SEQ ID NO: 122901 - RNA, 62 nt, Mus musculus
uagcacuaauuguaagcuuauuuguauucccagaucccuacccucugcauuaggauuauggg

SEQ ID NO: 122902 - RNA, 42 nt, Mus musculus
uuuuaugccuuaaguagugauuuuaauucaccugcccauaau

SEQ ID NO: 122903 - RNA, 101 nt, Mus musculus
uuugcuggaucugucauauuauaaccugucaagaaaaguauaaaacaacaagcacuccugccugccuauuccacucaugcccaguucaaccccgauggaug

SEQ ID NO: 122904 - RNA, 47 nt, Mus musculus
uuuggcagcugucuugacuuaaaagcaccaauguauuuagaugcaga

SEQ ID NO: 122905 - RNA, 46 nt, Mus musculus
uggguuuuacacaaccaguuccaaaucaagauaagugaagcugaag

SEQ ID NO: 122906 - RNA, 42 nt, Mus musculus
auuauuuuucagucauuaguuuugaacauaauaaaggcagau

SEQ ID NO: 122907 - RNA, 46 nt, Mus musculus
cuggauuaacucauguaacaauguacuuagugggugauaugggagu

SEQ ID NO: 122908 - RNA, 67 nt, Mus musculus
cuagcucaugaguacuauucuuauuaccagacagccacgagaagaaguuaacuuacuauguauaucc

SEQ ID NO: 122909 - RNA, 46 nt, Mus musculus
uacugugacuuacuuaacucgcaaauugaaaauauggucucaaggu

SEQ ID NO: 122910 - RNA, 65 nt, Mus musculus
ccaggucagacaugaaagaaagcucacaguuaaacagugccaggaucuuuccccacugccaauuu

SEQ ID NO: 122911 - RNA, 50 nt, Mus musculus
guaaaucuugauuuguauggguucauuucugauuuuuuuagggagaucuu

SEQ ID NO: 122912 - RNA, 45 nt, Mus musculus
uugguuguguuuuuaaagcuaaccaugugacaauaauugacagau

SEQ ID NO: 122913 - RNA, 50 nt, Mus musculus
gacaucuugucaccugagaaugaacaaagaccaauuuuuauguaugggag

SEQ ID NO: 122914 - RNA, 44 nt, Mus musculus
agcucuucaauucuugaacuacuuuuccaaagagguaaugcuga

SEQ ID NO: 122915 - RNA, 46 nt, Mus musculus
ccuuucugacugaucucagcauuaccucuuuggaaaaguaguucaa

SEQ ID NO: 122916 - RNA, 45 nt, Mus musculus
cugaagguuaguauguagauuuucuuuguuugaguuggggcaccu

SEQ ID NO: 122917 - RNA, 45 nt, Mus musculus
aggacaggacuugagaauauaacggugaauaugcucaaaguagau

SEQ ID NO: 122918 - RNA, 46 nt, Mus musculus
uaaguacacuguagcugucuucagacacuccagaagagggcagcag

SEQ ID NO: 122919 - RNA, 46 nt, Mus musculus
aggggacuuuggcaaaggggcagaggcguuuguuuguagcugagau

SEQ ID NO: 122920 - RNA, 46 nt, Mus musculus
auaaucucuccuaacacacauauauuaguugccuucgccgugaguc

SEQ ID NO: 122921 - RNA, 44 nt, Mus musculus
auccgcugcaccuagggucucccugaggagucacuguagugccu

SEQ ID NO: 122922 - RNA, 41 nt, Mus musculus
cuccaccucgaugaaaugcugcaacugaggguccacggcgc

SEQ ID NO: 122923 - RNA, 46 nt, Mus musculus; identical to SEQ ID NO: 66278

SEQ ID NO: 122924 - RNA, 65 nt, Mus musculus
ugggggcaucuucuggggaggugggggaugugcaauauuccaagguggacugggaaggggauaaa

SEQ ID NO: 122925 - RNA, 46 nt, Mus musculus
agcucuagcacccagaaccaggauuuaaagcuaaaccagccagaca

SEQ ID NO: 122926 - RNA, 42 nt, Mus musculus
aaauaaaguaucccaaaggcauugcccuuaaaagcugcuuuu

SEQ ID NO: 122927 - RNA, 56 nt, Mus musculus
gaauggacuuugaccuuaaaaacucgaguaaaccccucaggcacuguuuuguuucg

SEQ ID NO: 122928 - RNA, 46 nt, Mus musculus
gagccuuuaagcguaaauccaugcccuggguggacauacuucaguu

SEQ ID NO: 122929 - RNA, 45 nt, Mus musculus
uguauacuccugugaguggccacuuuauuugagacccuuucauaa

SEQ ID NO: 122930 - RNA, 64 nt, Mus musculus
uuuccccgggaguuuuggauccuaugacauugaugcgcagacauuugcugacuggggcguagau

SEQ ID NO: 122931 - RNA, 44 nt, Mus musculus
gcgcugaaguagucaccuaacacauuggaaugacugucugaauu

SEQ ID NO: 122932 - RNA, 53 nt, Mus musculus
uuuucuuuauuucuuuugugcuucggcguggaccuggaggccccaccccuucu

SEQ ID NO: 122933 - RNA, 45 nt, Mus musculus
cuuguuaguuacaauagcuuuucaguuuuguuauggguugcauuc

SEQ ID NO: 122934 - RNA, 41 nt, Mus musculus
acacauggucacugcaaacaaguuagugguaaaaaugauau

SEQ ID NO: 122935 - RNA, 48 nt, Mus musculus
gauagcugagguguuccugaaccccccucccuuaagcauagcaccagg

SEQ ID NO: 122936 - RNA, 52 nt, Mus musculus
cucuuguuuagugcuagccuugagcuagccauacguacaguuggauugggca

SEQ ID NO: 122937 - RNA, 42 nt, Mus musculus
gcugcauugggaacguuucaugugcaaccuugacugccaaga

SEQ ID NO: 122938 - RNA, 36 nt, Mus musculus
ucaugaguagcaaacucaacaucugccucaccagua

SEQ ID NO: 122939 - RNA, 46 nt, Mus musculus
ugagcagucauauacccagaaauauguguuuagugugcagcuuuua

SEQ ID NO: 122940 - RNA, 46 nt, Mus musculus
aguucagacaaagcaaagcaaaaugggagcaaguaagugugaacua

SEQ ID NO: 122941 - RNA, 41 nt, Mus musculus
cuucucuaaaacuucuguuaaaaucuaacugccagccgggu

SEQ ID NO: 122942 - RNA, 46 nt, Mus musculus
cucuagggaccucuuauaagugaacagccuuauaguugggguagaa

SEQ ID NO: 122943 - RNA, 86 nt, Mus musculus
ugucucgaaccccuggcaacaggauuguuuaccucuacaccaagaagguugggaaagcaccuaaauccgcauguggcgugugccca

SEQ ID NO: 122944 - RNA, 52 nt, Mus musculus
guccaugacaggaucaagcgggcuuuccuuauugaggagcagaaaaucguug

SEQ ID NO: 122945 - RNA, 46 nt, Mus musculus
ggugccugaguacuucuucacaggagacucuggauaguuuaaugaa

SEQ ID NO: 122946 - RNA, 42 nt, Mus musculus
acaggcaacccccuccucgcguccgugcgccaagccccagag

SEQ ID NO: 122947 - RNA, 42 nt, Mus musculus
gggccggaugccagcccgccgcgcgcagggcagcggggaguu

SEQ ID NO: 122948 - RNA, 41 nt, Mus musculus
uggacagcccccuccccaauccaucuccauugcgcugaggg

SEQ ID NO: 122949 - RNA, 42 nt, Mus musculus
uggaaugaacgaaguucccgcuucuguccuucuuuugcuugg

SEQ ID NO: 122950 - RNA, 57 nt, Mus musculus
guuaaucuguaaaugcaguagcagguaccagcccagaucaccaguccugcagucgcc

SEQ ID NO: 122951 - RNA, 55 nt, Mus musculus
caaugaacuggucucagacugggucucuaucucuuccucaagcauugucuuggcc

SEQ ID NO: 122952 - RNA, 46 nt, Mus musculus
gccucuuucaugguuacuuccuuggcuugggauguggauucaguca

SEQ ID NO: 122953 - RNA, 46 nt, Mus musculus
aagauucuccuuagugucaacugcagcaucaagccuagccucagau

SEQ ID NO: 122954 - RNA, 46 nt, Mus musculus
gcggggagccuuuggcauguaagggccuagaauccggagggacaag

SEQ ID NO: 122955 - RNA, 86 nt, Mus musculus
uuccccguacucgcugggcccgcccccagugcugcgcuuccaaaggggugugguuuuugcaggaaaaaauggccgaccaccgcaag

SEQ ID NO: 122956 - RNA, 44 nt, Mus musculus
ugcgguggucggccauuuuuuccugcaaaaaccacaccccuuug

SEQ ID NO: 122957 - RNA, 41 nt, Mus musculus
uguagcuguauagcaucggggcguugucagcugaguccaga

SEQ ID NO: 122958 - RNA, 42 nt, Mus musculus
aguauuuaggugguauauauuuuguguucugucucugcuuag

SEQ ID NO: 122959 - RNA, 46 nt, Mus musculus
aaguuuuccucccuucccugcuucuugguuuagucuggagcgagag

SEQ ID NO: 122960 - RNA, 46 nt, Mus musculus
auucaauagaucguugaggcugucuuuaagguaguccggugggcag

SEQ ID NO: 122961 - RNA, 50 nt, Mus musculus
cugaccuggggaaaagaugagaaugagaaguugugggaugaggaagagga

SEQ ID NO: 122962 - RNA, 44 nt, Mus musculus
caaaacugagaaagaacuuaagacuaauguugggguaggggcga

SEQ ID NO: 122963 - RNA, 46 nt, Mus musculus
aacaucucuaggaauaggacccugacaucaaguuugccuugcccag

SEQ ID NO: 122964 - RNA, 46 nt, Mus musculus
ucucuuguuuuuaucagcuuugcaauaauggggacuccacccagcu

SEQ ID NO: 122965 - RNA, 46 nt, Mus musculus
gacuuacaaugcucuuaauaacuugagcguuaauucugagaaucag

SEQ ID NO: 122966 - RNA, 48 nt, Mus musculus
aaguaccuucggaauugauuucucuguuuaauaaagaaugggauagag

SEQ ID NO: 122967 - RNA, 46 nt, Mus musculus
gaauucagcaggagcucacuguuuuucuuauuuaaagagucuggag

SEQ ID NO: 122968 - RNA, 46 nt, Mus musculus
guuugcacgugggaacaaugcauuuugugaauucuuagguuuucau

SEQ ID NO: 122969 - RNA, 45 nt, Mus musculus
gcuugcacaaagaaaacauuuauuaaacuugcuaucuagguugag

SEQ ID NO: 122970 - RNA, 42 nt, Mus musculus
cuuugcuauccaaggggaguggaugugcagaggugcggggcu

SEQ ID NO: 122971 - RNA, 45 nt, Mus musculus
ugcacuuuaccugcaaacuacaaaacccagaaguugcccacagcu

SEQ ID NO: 122972 - RNA, 46 nt, Mus musculus
ccugucuaagcgcugaaccacuuagcagaaaugacacccauaugag

SEQ ID NO: 122973 - RNA, 45 nt, Mus musculus
uacccucacccccaguuuguauccucaauaaacugugugcuuuga

SEQ ID NO: 122974 - RNA, 45 nt, Mus musculus
cccucacccccaguuuguauccucaauaaacugugugcuuugauu

SEQ ID NO: 122975 - RNA, 46 nt, Mus musculus
ugucuaagcgcugaaccacuuagcagaaaugacacccauaugagag

SEQ ID NO: 122976 - RNA, 42 nt, Mus musculus
uugcuauccaaggggaguggaugugcagaggugcggggcuug

SEQ ID NO: 122977 - RNA, 47 nt, Mus musculus
agguucacgaagaacauaaaugcuggcuuuucccuuagccccaauau

SEQ ID NO: 122978 - RNA, 81 nt, Mus musculus
gacugggaugaaccuggggccccaggugggacugaggacagacggucaggugguggaaaggcaaacagagcacacccaauc

SEQ ID NO: 122979 - RNA, 46 nt, Mus musculus
gcagacaauugguuugauuucacagcaauggcucgacccuggagug

SEQ ID NO: 122980 - RNA, 73 nt, Mus musculus
acaccuauaaucaugggucgggcccgggaaauggguuggauggcagccggacucaugauuggagcuggugccu

SEQ ID NO: 122981 - RNA, 46 nt, Mus musculus
aucucugagaauccuggaagcauaaagguagauccugaggguagau

SEQ ID NO: 122982 - RNA, 46 nt, Mus musculus
agggagcugguacucagacgggaacaacgaccaggacaagaaggac

SEQ ID NO: 122983 - RNA, 45 nt, Mus musculus
ccugccccuuucugaagagaaacagaggggaaguguauugggagg

SEQ ID NO: 122984 - RNA, 45 nt, Mus musculus
aagagggagaggauguagaggaagaggaagaagaagaaaagcgga

SEQ ID NO: 122985 - RNA, 42 nt, Mus musculus
ccuguugagaccauauccaguggauaggcauggccccugguc

SEQ ID NO: 122986 - RNA, 46 nt, Mus musculus
uuuauaauucuuauguggaaucagaaauucuuauuaaugcccuuac

SEQ ID NO: 122987 - RNA, 45 nt, Mus musculus
uuuuccgcuuguuaucucagggggguggaaaaaucaagguugaga

SEQ ID NO: 122988 - RNA, 46 nt, Mus musculus
ccauucccaugcauaagcgccccuuuccauaugaaauugaugagau

SEQ ID NO: 122989 - RNA, 49 nt, Mus musculus
guggaggaggcaaggguggaaacaagaaccggaguggaggcaagggcaa

SEQ ID NO: 122990 - RNA, 41 nt, Mus musculus
uaguagugccuccuagggcaguacaguauucuggggcagca

SEQ ID NO: 122991 - RNA, 42 nt, Mus musculus
cagucuccugggacggugauaccuccccuuccacccccauca

SEQ ID NO: 122992 - RNA, 46 nt, Mus musculus
aacaaggcccaaggagaagccuccaaucuugccaccaccguagcug

SEQ ID NO: 122993 - RNA, 45 nt, Mus musculus
ugcucccuccccucccuucccuccccuccccucccagcccccugc

SEQ ID NO: 122994 - RNA, 46 nt, Mus musculus
gcaagaggaguaggccuuuugccuauguucucucucccugucucuc

SEQ ID NO: 122995 - RNA, 46 nt, Mus musculus
uuaaucucuggucacuguaaaaaaaagaaauuucucuucuagagac

SEQ ID NO: 122996 - RNA, 45 nt, Mus musculus
aacaugaugugccuuuuaucuauuuucuuuagaaacggauugaga

SEQ ID NO: 122997 - RNA, 49 nt, Mus musculus
gcacuaggcucuagggaugggaaagcagagucugaggugugggaaugcu

SEQ ID NO: 122998 - RNA, 41 nt, Mus musculus
augggguucucaggcucuuggacauccaggugcugcuggga

SEQ ID NO: 122999 - RNA, 46 nt, Mus musculus
auaccccacuucucagggugggccugagauuaaaugccuuuugcag

SEQ ID NO: 123000 - RNA, 42 nt, Mus musculus
gcuggcuggcuggcuggcuggcucugcacggggcgugcaguu

SEQ ID NO: 123001 - RNA, 42 nt, Mus musculus
gguucacagcguugcuuuugguggaauauucugccgacagau

SEQ ID NO: 123002 - RNA, 42 nt, Mus musculus
cucuccuggcaagugauaccgauugcugggauccugccucuu

SEQ ID NO: 123003 - RNA, 46 nt, Mus musculus
agacacgcguccagauccagucacaagaggcaggaucccagcaauc

SEQ ID NO: 123004 - RNA, 47 nt, Mus musculus
ugucauauucacuacauuaucccaugugauauauaaaauuuggggag

SEQ ID NO: 123005 - RNA, 46 nt, Mus musculus
uagcacuguugcugaaguuugaaaauguuugcauguuuaacaugag

SEQ ID NO: 123006 - RNA, 42 nt, Mus musculus
gcuggcuggcuggcuggcuggcucggcacggggcgugcaguu

SEQ ID NO: 123007 - RNA, 42 nt, Mus musculus; identical to SEQ ID NO: 123001

SEQ ID NO: 123008 - RNA, 42 nt, Mus musculus; identical to SEQ ID NO: 123002

SEQ ID NO: 123009 - RNA, 46 nt, Mus musculus; identical to SEQ ID NO: 123003

SEQ ID NO: 123010 - RNA, 42 nt, Mus musculus
ucgcauuccugcaugccuacacugaaugugauuuagaagcag

SEQ ID NO: 123011 - RNA, 45 nt, Mus musculus
uguuagauaccauaagugguggaaauaaagugacuaaagaccgag

SEQ ID NO: 123012 - RNA, 49 nt, Mus musculus
gggcccgcugccagcccgccgcgcgcagaggagcuccgagcugcuggcc

SEQ ID NO: 123013 - RNA, 45 nt, Mus musculus
ucccauuuguaccaugucuguguagagaccagaaaagggcaccag

SEQ ID NO: 123014 - RNA, 42 nt, Mus musculus
uucccucuggcuuccuuagccagaggaauaaaacuggcaauc

SEQ ID NO: 123015 - RNA, 46 nt, Mus musculus
uguugauuuuuuuuaaugaauacgugucucacaaagaacugcagau

SEQ ID NO: 123016 - RNA, 61 nt, Mus musculus
cuuuuaauaauaauuaccuggcgguauuuucuguuauguaguuucguuguuaccagcaucu

SEQ ID NO: 123017 - RNA, 128 nt, Mus musculus
ggagaaaaugugagggaggaaacugaagggagccauagaggagagccugcugaacccagcccagagcccaaagaggacacucccgcaaggcaucugaaccccgaagaagugauaagaggcguagauga

SEQ ID NO: 123018 - RNA, 131 nt, Mus musculus
uuaagaaaauaaucaacaugcaaaagucuugugacgagaacgaaggaacaccccagaacacaccaaaagcagacgaaggccauccuucagaagauccaccacagcaggcaggagaaacucuucaggcuucu

SEQ ID NO: 123019 - RNA, 46 nt, Mus musculus
ugcagggccugcugggaaaauggugggcuggagccgggacaggaga

SEQ ID NO: 123020 - RNA, 82 nt, Mus musculus
aggccccugcaaauccugcugcggaaauggggugaaggaaggaaagggagaggcuaaagacauuuaaaagagagaggagacc

SEQ ID NO: 123021 - RNA, 46 nt, Mus musculus
caggggccuucugugcuuaauccggaugggaggcagccgugacgcc

SEQ ID NO: 123022 - RNA, 45 nt, Mus musculus
gauuuuccucucuucuugcaccucgauuuaugucgcgcucaaaag

SEQ ID NO: 123023 - RNA, 42 nt, Mus musculus
cacucuugaucuuuugagcgcgacauaaaucgaggugcaaga

SEQ ID NO: 123024 - RNA, 58 nt, Mus musculus
ggaaacaggguacagaugaaggcgggguugccacaaagggagggagaagagggggaug

SEQ ID NO: 123025 - RNA, 49 nt, Mus musculus
ggauggggcagauugggagggagguagcuaaccgaguccggcagagaaa

SEQ ID NO: 123026 - RNA, 42 nt, Mus musculus
guggggggaggggaagggaaguauagggagcaagggagagaa

SEQ ID NO: 123027 - RNA, 42 nt, Mus musculus
uaaaaguucagacgucuaauaauagccuaagcucaggcaaag

SEQ ID NO: 123028 - RNA, 46 nt, Mus musculus
uaauauuuggaggugaggaaggauugaaugcaaagaauggacauga

SEQ ID NO: 123029 - RNA, 62 nt, Mus musculus
ucucgcaccaccgucugcaaggcuaaagggagcugguacccagauggaaacaaggaccagac

SEQ ID NO: 123030 - RNA, 45 nt, Mus musculus
ccuuuagccuugcagacgguggugcgagaggccagcggccagaag

SEQ ID NO: 123031 - RNA, 45 nt, Mus musculus
ccuuugggaaacaaagggugggaaacuuccauaagcaagcccuua

SEQ ID NO: 123032 - RNA, 46 nt, Mus musculus
auuucuuuuuccuacuuauuuuagccuggugcgguacaaagaacaa

SEQ ID NO: 123033 - RNA, 46 nt, Mus musculus
guaccgcaccaggcuaaaauaaguaggaaaaagaaaucgaccagau

SEQ ID NO: 123034 - RNA, 41 nt, Mus musculus
aagguaucuggugagggcaguuagaccgaacgagggugggg

SEQ ID NO: 123035 - RNA, 58 nt, Mus musculus
agacacaagaugaaacccugccaaaaaauggaaggaaaccuagaaaaggaggaugagc

SEQ ID NO: 123036 - RNA, 46 nt, Mus musculus
gcucaggugccuguuguguauauccuccugaaaauccugcagagac

SEQ ID NO: 123037 - RNA, 51 nt, Mus musculus
caggaggauauacacaacaggcaccugagcagugaugaucuguuuagagau

SEQ ID NO: 123038 - RNA, 45 nt, Mus musculus
ugauaagaccuuugcccaucuuccuacuuugaaucuguugcuguu

SEQ ID NO: 123039 - RNA, 47 nt, Mus musculus
aaaaaaagaauaacaaaaugagcuucugaugggauacaaaaugagaa

SEQ ID NO: 123040 - RNA, 37 nt, Mus musculus
cggggucuggacaggcaaaaaggaccgggaugagaga

SEQ ID NO: 123041 - RNA, 42 nt, Mus musculus
uaauugcuugaagaaacuucucaacauggaaaacacgcgcag

SEQ ID NO: 123042 - RNA, 82 nt, Mus musculus
ggcccguauccgcccucaauucauaggagacauucauggcagaaauuuaaguaaugaagaaaugauacaggcagcggaugag

SEQ ID NO: 123043 - RNA, 46 nt, Mus musculus
cauauacauguccacagaauuaccugagauggccagaaggcaccag

SEQ ID NO: 123044 - RNA, 71 nt, Mus musculus
ggacuucacugguacugccuccgucuccguugccaggagccuucugcuuguucuuccuggucuuccgcaca

SEQ ID NO: 123045 - RNA, 80 nt, Mus musculus
gaaccggaagggggguucucagcagagcgaccuccccaucuuccgggcagggcuggaucgagauucuuuggcugcgaacc

SEQ ID NO: 123046 - RNA, 45 nt, Mus musculus
ugucuucuucagcagauuguuguccacgaguuugagaagccugcu

SEQ ID NO: 123047 - RNA, 46 nt, Mus musculus
acuuuaccaacugggcuacacucgcaacccaacugauggucuccag

SEQ ID NO: 123048 - RNA, 126 nt, Mus musculus
aggaaaaaaaaacaccaacgcccccccaaaaaaaccaaaggcaaaggaauggugaagguuuugaggugugaggcgugugaggguggugagugccacugggcggaugccuggaugcuuuggagaaac

SEQ ID NO: 123049 - RNA, 81 nt, Mus musculus
gcuguggagugugggugugggcgcacagccgcccucguggcgcuggcgaugaugggugugcgcaggcgugcugcccuggug

SEQ ID NO: 123050 - RNA, 72 nt, Mus musculus
gugugugugugugugugcgcgcgcgcgcgugagcguaggcgaggucccucauuuugguggauuuuucugccu

SEQ ID NO: 123051 - RNA, 55 nt, Mus musculus
uuuuuauguuugcaaacugcauuaauaaaacugagaauaacuaggacagugcuag

SEQ ID NO: 123052 - RNA, 42 nt, Mus musculus
ccuucacggccuucgagcgcugggauuaaaagcaugcgccac

SEQ ID NO: 123053 - RNA, 46 nt, Mus musculus
uguguuggccccucagguuuauguagugguucugugcuguccggag

SEQ ID NO: 123054 - RNA, 42 nt, Mus musculus
agucccccuuaaaauacggggguuauagauaggugccccaug

SEQ ID NO: 123055 - RNA, 34 nt, Mus musculus
uacaucuacauguguguaugugacauguguucag

SEQ ID NO: 123056 - RNA, 45 nt, Mus musculus
agccacaacagugaaagguugucuuaaagcaguucuccaacucag

SEQ ID NO: 123057 - RNA, 44 nt, Mus musculus
auagaucauuuucaccaucacagaaugcucugcugggcugcgcu

SEQ ID NO: 123058 - RNA, 50 nt, Mus musculus
ugucugugcauccuuuaugugccucgugcccccugaggucagaagaggac

SEQ ID NO: 123059 - RNA, 79 nt, Mus musculus
aaauagugguuuugaucuacuuucagcaguguguuaccauauggauaagugaaugaggguguuuguacacuagggugag

SEQ ID NO: 123060 - RNA, 27 nt, Mus musculus
aggggaugaggagcagagacuauugga

SEQ ID NO: 123061 - RNA, 46 nt, Mus musculus
uaggcuuuuauucuaauuacacauauuguguauuauuaggugccag

SEQ ID NO: 123062 - RNA, 46 nt, Mus musculus
cccacauagcuugggaacugguaauugaaguuaugaguaugagauc

SEQ ID NO: 123063 - RNA, 46 nt, Mus musculus
agccaugcauugaguucccuuugaauauguguaacaacauuuggag

SEQ ID NO: 123064 - RNA, 45 nt, Mus musculus
caggaagcaaggacaggaagauagaaaucaaagaaauugaaggga

SEQ ID NO: 123065 - RNA, 46 nt, Mus musculus
ggcuauugaaaagaguugaauuuguuucuacuuaccuaggagccaa

SEQ ID NO: 123066 - RNA, 46 nt, Mus musculus
cucugaagugccugaugcucaagauacauuccaccaaucagaagag

SEQ ID NO: 123067 - RNA, 46 nt, Mus musculus
gauuuccuguggaguuugagcucacuccauauagcuucauaucaag

SEQ ID NO: 123068 - RNA, 46 nt, Mus musculus
acaauacaguguuuccugaacuaccuacacacaccauaagccucau

SEQ ID NO: 123069 - RNA, 42 nt, Mus musculus
uugggcacaggaggcacccuucagauaguuucccauggccag

SEQ ID NO: 123070 - RNA, 42 nt, Mus musculus
aaagaagaaugccaucucacccaguguguuaauguggccuag

SEQ ID NO: 123071 - RNA, 47 nt, Mus musculus
uugcccaaacaaacaaguaccccuacuucuuucagguuacaggacaa

SEQ ID NO: 123072 - RNA, 23 nt, Mus musculus
uucuuugugaggagcaguguuuc

SEQ ID NO: 123073 - RNA, 46 nt, Mus musculus
uggagaagugcccaggaggaaauuggcagugagcacaggggagcuu

SEQ ID NO: 123074 - RNA, 46 nt, Mus musculus
gaagcaggagguuaguauguuuaaggucagccugggcuagagagag

SEQ ID NO: 123075 - RNA, 45 nt, Mus musculus
ccagugccauugccaauuaacuucuuucucugccuugugcuucca

SEQ ID NO: 123076 - RNA, 56 nt, Mus musculus
uauugcuaaggauacagaggccuaggaauugagaggacacagagaaaaaggagaca

SEQ ID NO: 123077 - RNA, 46 nt, Mus musculus
accaugcccagaugggaagauggcuacuggcccaguguguacugac

SEQ ID NO: 123078 - RNA, 46 nt, Mus musculus
uggccuccacauuuguaccccaccccccacauacacagacaagcau

SEQ ID NO: 123079 - RNA, 42 nt, Mus musculus
guuauuaucaauggcaccucccuaucaccagagcugcagcag

SEQ ID NO: 123080 - RNA, 46 nt, Mus musculus
agaauaguauguagauuaugucagucacugggggaggggcacagag

SEQ ID NO: 123081 - RNA, 42 nt, Mus musculus
acucaaugaaucucuugccccaugccuaguuucagccccaau

SEQ ID NO: 123082 - RNA, 46 nt, Mus musculus
cuaaguggcuugcaugaaaaugauuuuuguacuuuauauaacguag

SEQ ID NO: 123083 - RNA, 46 nt, Mus musculus
uaccagaguuuuaauaauugcaaucauggaagaaggcaggacagag

SEQ ID NO: 123084 - RNA, 46 nt, Mus musculus
uguuugcuuucuccuccugcaccucuuuccuuccagcaauaaguag

SEQ ID NO: 123085 - RNA, 45 nt, Mus musculus
cugccggucucucucucucucucucucucucucucucugugugug

SEQ ID NO: 123086 - RNA, 45 nt, Mus musculus
aguggcuuacugucuacauuguuaccuuuuuggugugugucugug

SEQ ID NO: 123087 - RNA, 42 nt, Mus musculus
uuuuguaaagugccugaacuugguagggagaagugguagaau

SEQ ID NO: 123088 - RNA, 46 nt, Mus musculus
augccuucauaggaaggcccugaauauggucuucgggaaccgccaa

SEQ ID NO: 123089 - RNA, 46 nt, Mus musculus
cucuaaacuugccaggugcaagccaagaaggggaaagaaaacagag

SEQ ID NO: 123090 - RNA, 42 nt, Mus musculus
ugugggcaaauuggcugcuuagacagagcuuagcuggggcau

SEQ ID NO: 123091 - RNA, 46 nt, Mus musculus
agaaagcccuuuucauugcaggagaagaggacaaagauacucagag

SEQ ID NO: 123092 - RNA, 45 nt, Mus musculus
gccaacaggcuacaauuggagucagagugccaaagacauggguga

SEQ ID NO: 123093 - RNA, 47 nt, Mus musculus
ucugguagacaggggcaacaauaacuguuuugucuacuuucagggug

SEQ ID NO: 123094 - RNA, 45 nt, Mus musculus
uugaauuacuuccucaggggauaaggcccugaagagauaaagaca

SEQ ID NO: 123095 - RNA, 46 nt, Mus musculus
uugcuuguuuguuuguuugcuuguuuguuuguuuaguguguaugag

SEQ ID NO: 123096 - RNA, 45 nt, Mus musculus
uugaugagaagaguucuauuacagauugguuacacuuggggggug

SEQ ID NO: 123097 - RNA, 45 nt, Mus musculus
gcuuauccuguauuuguuaacuuugggugaaagaaagaaagaaag

SEQ ID NO: 123098 - RNA, 46 nt, Mus musculus
guaacccuaugcaauauauagacauguuaggcagcuccugguagau

SEQ ID NO: 123099 - RNA, 45 nt, Mus musculus
aaauggagugacuucagaucucgaauaugcuugcugcccccagac

SEQ ID NO: 123100 - RNA, 46 nt, Mus musculus
aauuuaacuggguaagguauagcuguuuaaugugaggcuucuaaau

SEQ ID NO: 123101 - RNA, 35 nt, Mus musculus
uuccuggcucagguggggaaaggauggagggagag

SEQ ID NO: 123102 - RNA, 41 nt, Mus musculus
uucaguaggaaauaagauccacagcaccagcuaagcagaag

SEQ ID NO: 123103 - RNA, 45 nt, Mus musculus
uaaagaaaauauccaauaaaauaauaggaaaagcaaugaaaagau

SEQ ID NO: 123104 - RNA, 46 nt, Mus musculus
agagacugaagaaaugaccuuguagagacugacucaccugggaauc

SEQ ID NO: 123105 - RNA, 67 nt, Mus musculus
agccaauguauggcuucccagaauccuggaauacccaagauacaauucacaaaccacaugaaaccca

SEQ ID NO: 123106 - RNA, 45 nt, Mus musculus
cuaggggcugaagggacuuugguugcugucacgucugccacagug

SEQ ID NO: 123107 - RNA, 46 nt, Mus musculus
auaacccuaugcaauauauagacauguuaggcagcuccugguagau

SEQ ID NO: 123108 - RNA, 45 nt, Mus musculus; identical to SEQ ID NO: 123099

SEQ ID NO: 123109 - RNA, 46 nt, Mus musculus
ucugagccaccaugugguugcuaggauuugaacucggggccucugg

SEQ ID NO: 123110 - RNA, 41 nt, Mus musculus; identical to SEQ ID NO: 123102

SEQ ID NO: 123111 - RNA, 45 nt, Mus musculus
auuccaggcuccuguugcuuuagaggucugauugacccgggcagg

SEQ ID NO: 123112 - RNA, 46 nt, Mus musculus
caaacuaucucagcagcuuugcucauaaaaugguuguguugaugag

SEQ ID NO: 123113 - RNA, 46 nt, Mus musculus
cagucuugcgcuaaaacguagcagugcacccauuuaacagagagga

SEQ ID NO: 123114 - RNA, 45 nt, Mus musculus
gaauucacguuugaaaucggcuuugaugagcugcuauggagaaaa

SEQ ID NO: 123115 - RNA, 44 nt, Mus musculus
aggucagcuucagcuucugauugcaggcugagacgugagggaga

SEQ ID NO: 123116 - RNA, 34 nt, Mus musculus
gguaugugcuuggaaaugugcguguacaaauagg

SEQ ID NO: 123117 - RNA, 63 nt, Mus musculus
gagaggagaauugaugagagagaggggagagacuaauaaguaggucaguuugagaaauuguga

SEQ ID NO: 123118 - RNA, 104 nt, Mus musculus
ggagagaacucuggaauagagaucuguauugaagaaugcccaguagagaagugguagaugaagcuguggcuaugaaugagauggccagauagaaugugccaagg

SEQ ID NO: 123119 - RNA, 50 nt, Mus musculus
cauaugguaaauauaggguuaaaaagauaagacaaaaacaaguuuaagga

SEQ ID NO: 123120 - RNA, 46 nt, Mus musculus
auagaaggaggagauaaauagauaaguuauuuaaagcuugaauagg

SEQ ID NO: 123121 - RNA, 44 nt, Mus musculus
aaguuuugacuuuguagcccuuucacuggaaauuggcugugagg

SEQ ID NO: 123122 - RNA, 67 nt, Mus musculus
cacaaccaucuguaaugggaucugacgcccccuucuggugugucugaagacagcaacaauguacuca

SEQ ID NO: 123123 - RNA, 46 nt, Mus musculus
aacaaagggaagcccaaaucaaacagacagacagcaaauaaaagca

SEQ ID NO: 123124 - RNA, 46 nt, Mus musculus
uccccaccauagaagacaaaaucgcuguaaggagucaaaagcagau

SEQ ID NO: 123125 - RNA, 52 nt, Mus musculus
aacaaagugaauuuguucauguucauuauuguaugcuuuggauuguagugcu

SEQ ID NO: 123126 - RNA, 46 nt, Mus musculus
aggaaacauguccaggagggugugggacgucucgugagccgcaaau

SEQ ID NO: 123127 - RNA, 45 nt, Mus musculus
gugcaagcuucuaguugauuagcaacuuucccugaggccuuuggg

SEQ ID NO: 123128 - RNA, 45 nt, Mus musculus
gguucaggaaccccacagggucaaaccaagguuggagguuggaau

SEQ ID NO: 123129 - RNA, 46 nt, Mus musculus
guagcgccaagguuaauacauugaauauagcacauugaaagcaggg

SEQ ID NO: 123130 - RNA, 42 nt, Mus musculus
caggaccccugugggaaaauuaaucuuaaccugaggccagaa

SEQ ID NO: 123131 - RNA, 67 nt, Mus musculus
ggaggccauacggcuggauaggucagucccagggaagaggacaaggugggaugucgcggcggggugu

SEQ ID NO: 123132 - RNA, 41 nt, Mus musculus
uccccuccucgggcggcugcggugggcacacucgggggcgg

SEQ ID NO: 123133 - RNA, 42 nt, Mus musculus
guaaaggccaugcagacauagauugcucucuugaagccagag

SEQ ID NO: 123134 - RNA, 45 nt, Mus musculus
agcagcauacacauauggucuauauuacuuggggugccaaaguag

SEQ ID NO: 123135 - RNA, 46 nt, Mus musculus
caaaagcuucuuauugaaaauugaagguacuuuuaaaagccacaga

SEQ ID NO: 123136 - RNA, 41 nt, Mus musculus
acacucacagaucugaaaaccugaggaacaucgagagagag

SEQ ID NO: 123137 - RNA, 44 nt, Mus musculus
cugaauugaauucuucaugguugggaaguaggcaggaagucaug

SEQ ID NO: 123138 - RNA, 44 nt, Mus musculus
uuuuauaguuuuugaaagcauauuguacaguuaggaaauaagua

SEQ ID NO: 123139 - RNA, 46 nt, Mus musculus
aaugauuucuaccauaguuauguaauuuuugguucuuaucagggau

SEQ ID NO: 123140 - RNA, 42 nt, Mus musculus
ucacaaugggguuucagccucaguuucaaucuaguucugcag

SEQ ID NO: 123141 - RNA, 42 nt, Mus musculus
cuccaguguuggaaacucugcuucaaacuccagugccaacau

SEQ ID NO: 123142 - RNA, 46 nt, Mus musculus
cuuaaugguaagauuuuuuuuaaguuuacuuuuucaaaagggccau

SEQ ID NO: 123143 - RNA, 46 nt, Mus musculus
cuggaauuuugucacuagcaagaaaagagauggaacuagacggaga

SEQ ID NO: 123144 - RNA, 45 nt, Mus musculus
auaagucuccuuuucauagauuuauccagagacauuuuauuagag

SEQ ID NO: 123145 - RNA, 46 nt, Mus musculus
aagcaaaauggcauguauuuuuauacaguuuugcaaauguuuaaag

SEQ ID NO: 123146 - RNA, 45 nt, Mus musculus
gucaugaacaaaacuaacuuucugaagagaucagauuucuagaga

SEQ ID NO: 123147 - RNA, 45 nt, Mus musculus
uaaguuucuagaaaugaaaugucuaugauugguuguauguauaga

SEQ ID NO: 123148 - RNA, 46 nt, Mus musculus
aaauguuuugugugaguaaauauguucauuuauuagucaacgguag

SEQ ID NO: 123149 - RNA, 50 nt, Mus musculus
uauucuacacuaauuuucuuagaacauuauucaaaauuuauacaagauau

SEQ ID NO: 123150 - RNA, 46 nt, Mus musculus
ccaaaggaggcugaaguccuaguggauaaauagcaacuggguagau

SEQ ID NO: 123151 - RNA, 53 nt, Mus musculus
ucuauaaacagugguggaguauauugagauauggauugaaaaugaaggaguag

SEQ ID NO: 123152 - RNA, 38 nt, Mus musculus
agaguacucuggugaugaaguagagauuugaccuaaga

SEQ ID NO: 123153 - RNA, 45 nt, Mus musculus
gugguguguuugagugugugugugugugugugugugugugucugu

SEQ ID NO: 123154 - RNA, 46 nt, Mus musculus
ucaagagaguagcgaaccaucuucacaggucaccucuggccacuua

SEQ ID NO: 123155 - RNA, 45 nt, Mus musculus
cagacuggaaugaaaggaucaaaugaguaggggcacagagagggu

SEQ ID NO: 123156 - RNA, 42 nt, Mus musculus
gaugggggggugggggagcugugaggaggaaggaauggggga

SEQ ID NO: 123157 - RNA, 43 nt, Mus musculus
accaggauuugaggagaauggggagggaaacacuggagguugu

SEQ ID NO: 123158 - RNA, 24 nt, Mus musculus
ugcuuucuuucccccaaucuuuag

SEQ ID NO: 123159 - RNA, 44 nt, Mus musculus
gcacaaaugugcagcacagucccuauaggaagaaaagaagggaa

SEQ ID NO: 123160 - RNA, 42 nt, Mus musculus
gagauaagaauauugauaagugccugcuuuuccaggugggag

SEQ ID NO: 123161 - RNA, 41 nt, Mus musculus
uguauauguguauguauauguauauauaugugugugugugu

SEQ ID NO: 123162 - RNA, 25 nt, Mus musculus
aaaaagcuacaggaaaagaaaaaaa

SEQ ID NO: 123163 - RNA, 46 nt, Mus musculus
uagggggaauuagguugaccucuugaagcaugugguaauccuaaag

SEQ ID NO: 123164 - RNA, 46 nt, Mus musculus
aagaagaagaagaagaagaagaagaagaagaagaagaagauucauu

SEQ ID NO: 123165 - RNA, 45 nt, Mus musculus
aaaaaaagaaaaaaaaaaaaaagaaaaaaagaaagaaaagagaau

SEQ ID NO: 123166 - RNA, 46 nt, Mus musculus
cucaaaggggucagauaguacccaggcagaucuugaagaaucucag

SEQ ID NO: 123167 - RNA, 46 nt, Mus musculus
uuagaguuugaaauuaaguugcagaaauugacuaaugagcuuccag

SEQ ID NO: 123168 - RNA, 42 nt, Mus musculus
agcauuauuggauacugucauggagucacacuuagcccccca

SEQ ID NO: 123169 - RNA, 42 nt, Mus musculus
agucauauccuauccugccuacaggcuggcuccaggcaccaa

SEQ ID NO: 123170 - RNA, 45 nt, Mus musculus
aaacauaucuaaacaaacaaaaguaucuaaaaucaaauguuggag

SEQ ID NO: 123171 - RNA, 46 nt, Mus musculus
uugcauccccagguuuauugcugcuuuauucacuauagcagagaac

SEQ ID NO: 123172 - RNA, 50 nt, Mus musculus
auccauguauacaaaagaacaugugcauacagcauaacaugaaugaaaga

SEQ ID NO: 123173 - RNA, 46 nt, Mus musculus
uauuucugucaugacuuuugggggauuuggugauagauaagugcag

SEQ ID NO: 123174 - RNA, 46 nt, Mus musculus
aaccucccuagccgguugugguggcgcacgccuuuauucccagcac

SEQ ID NO: 123175 - RNA, 114 nt, Mus musculus
aguuccauuaaaaucauuggagaaggccuuacccccacacucacucccacccuaccucccccuaccccaucacucccaccucaucccuccacccccacugcucaccccuucacc

SEQ ID NO: 123176 - RNA, 46 nt, Mus musculus
uuaauccuuacgaauggccauucucucucgggugugaaguuuggag

SEQ ID NO: 123177 - RNA, 50 nt, Mus musculus
uugugccaugucugauaacaagaagccagacaaagcccacaguggcucag

SEQ ID NO: 123178 - RNA, 103 nt, Mus musculus
gcaguaugaaagggauguggccuggauagccaggcaaagcaagcgcauguccucugucgaugaggaugaagacgaugaggaugaugaggaugacuacuacgac

SEQ ID NO: 123179 - RNA, 106 nt, Mus musculus
gacgaggacgacgacgacgaugccuucuaugaugaugaggaugaugaggaagaagaauuggagaaccugauggaugaugaaucagaagaugaggccgaagaagaga

SEQ ID NO: 123180 - RNA, 46 nt, Mus musculus
cuuuacaggacccccucccccucccuguuucccuuccagcacccuu

SEQ ID NO: 123181 - RNA, 31 nt, Mus musculus
cucuacucuacuugaucuucucuccucucca

SEQ ID NO: 123182 - RNA, 46 nt, Mus musculus
uguuccuggccaucauuuaaggaagaaugaagugaaguguaggaug

SEQ ID NO: 123183 - RNA, 72 nt, Mus musculus
agugaacccuaaggaacaaauggaguguaggugugaaaaugcugaugaagagguugcaauggaagaggaaga

SEQ ID NO: 123184 - RNA, 42 nt, Mus musculus
ucuucuacaguugcaaagcccagaagaaagaaauggacagcg

SEQ ID NO: 123185 - RNA, 42 nt, Mus musculus
uugauuuuguucuaaaguucauuaugcaaagaugucaccaac

SEQ ID NO: 123186 - RNA, 48 nt, Mus musculus
acuuggaagucuuaauucuaggcaguagugguuauauucaaggaccca

SEQ ID NO: 123187 - RNA, 46 nt, Mus musculus
gcaaaagccauauccucaguaucucauuauauagcuacagugggag

SEQ ID NO: 123188 - RNA, 46 nt, Mus musculus
cuguuaccuggggugucuugaccucagguuccuagaauagaguuag

SEQ ID NO: 123189 - RNA, 41 nt, Mus musculus
guaggguaauaagggaguagcgaaucuaccaaaccggccaa

SEQ ID NO: 123190 - RNA, 42 nt, Mus musculus
aacugggauagccuggaagcguaggguagugagggaggggcu

SEQ ID NO: 123191 - RNA, 45 nt, Mus musculus
aaguuggcccuauuggcagguuuuagauuauuggcucugggagag

SEQ ID NO: 123192 - RNA, 42 nt, Mus musculus
guuauaaaccgagaugcaugaugggaaucuaggggcgagaag

SEQ ID NO: 123193 - RNA, 46 nt, Mus musculus
gcagcaguucucaacaugugggucacaaccccuuugggagauguag

SEQ ID NO: 123194 - RNA, 46 nt, Mus musculus
auagcccacauaaucagagaccuuccaggaaaagaaaaagcccaag

SEQ ID NO: 123195 - RNA, 85 nt, Mus musculus
ugaguuaagaauaccaccagaggcaucuggaagaguccagagcauggagaggggaguagacuguaucaggucaggagaggggaga

SEQ ID NO: 123196 - RNA, 42 nt, Mus musculus
cuuguaugcuaauagguaccauaguuagccaucuguccccag

SEQ ID NO: 123197 - RNA, 46 nt, Mus musculus
cauccauucugcccgauugcugcugcuucuacuugcuucagcagug

SEQ ID NO: 123198 - RNA, 42 nt, Mus musculus
cucccacugcugaagcaaguagaagcagcagcaaucgggcag

SEQ ID NO: 123199 - RNA, 46 nt, Mus musculus
uaauucacugaaaacaggucuuugcgaagacagcccugcccccuua

SEQ ID NO: 123200 - RNA, 42 nt, Mus musculus
ggaaucucagguaccugcuggguggguucuuaugggggaggg

SEQ ID NO: 123201 - RNA, 46 nt, Mus musculus
gccuuuauuuggggguggaacagggcucuauaucgacuuuggagag

SEQ ID NO: 123202 - RNA, 46 nt, Mus musculus
aggguuucuuacuccuuggaggccauguaggccaugacguccacca

SEQ ID NO: 123203 - RNA, 28 nt, Mus musculus
ggucgguuuagucguuuuguuuucuuga

SEQ ID NO: 123204 - RNA, 42 nt, Mus musculus
gauuucaaaacccauuugacuuacacuacagugaccugagau

SEQ ID NO: 123205 - RNA, 46 nt, Mus musculus
aaauaaugguuaaaagugucacucaaacuagacuacuaaaacagau

SEQ ID NO: 123206 - RNA, 42 nt, Mus musculus
auaaaucgaauacagucaaaaguuaaggugugggcuggagau

SEQ ID NO: 123207 - RNA, 41 nt, Mus musculus
uacaacccaaaauacuuuaaaauguaaacacuggggccagu

SEQ ID NO: 123208 - RNA, 45 nt, Mus musculus
uuuaucuacuuugugugugugugugugugugugugugugugugug

SEQ ID NO: 123209 - RNA, 44 nt, Mus musculus
agagagacaagaggcuugcggccaaacagagcagugggugaaau

SEQ ID NO: 123210 - RNA, 56 nt, Mus musculus
uauggugacuggaggugcuaacuugggaagaauugguguaaucaccaacagagaaa

SEQ ID NO: 123211 - RNA, 62 nt, Mus musculus
cgcuuugcuguucaucguauuacaccggaggaggccaaguacaaauugugcaaagugagaaa

SEQ ID NO: 123212 - RNA, 75 nt, Mus musculus
ccugcuggguuuauggaugucaucagcauugacaagaccggagagaacuuccgucucaucuaugacaccaagggu

SEQ ID NO: 123213 - RNA, 49 nt, Mus musculus
augcccugacuggagaugaaguaaaaaagauuugcaugcagcgauucau

SEQ ID NO: 123214 - RNA, 46 nt, Mus musculus
uccuaaauuauuaaauuacaguccggcucucuuuccguucccagcg

SEQ ID NO: 123215 - RNA, 41 nt, Mus musculus
auaugccaguaucacucugaaaugcuggauguucgggcaga

SEQ ID NO: 123216 - RNA, 46 nt, Mus musculus
ccuguauauaugcuaagaaaggaaagggccaaguucucaccacuag

SEQ ID NO: 123217 - RNA, 46 nt, Mus musculus
uugggaaggaguaugaagaagaagaauaugaagaugguugggagau

SEQ ID NO: 123218 - RNA, 46 nt, Mus musculus
guaagaggcaaacguuucagauaacuucauggaaacuuucccagac

SEQ ID NO: 123219 - RNA, 46 nt, Mus musculus
aucugggaaugcaaacuuugaaaagguaucuaccacagcuuuagau

SEQ ID NO: 123220 - RNA, 45 nt, Mus musculus
ggucucucuguggagcccuggcuguccuggaacuugcuaugcagg

SEQ ID NO: 123221 - RNA, 42 nt, Mus musculus
aaagagaaaggagagaggagagaagacaaagagaggggagag

SEQ ID NO: 123222 - RNA, 45 nt, Mus musculus
guuuuaccuacacugaagcaucauaaccaauaauccagcccugcu

SEQ ID NO: 123223 - RNA, 46 nt, Mus musculus
gcagccuauuagcauguuauaaaagauuuucaauuuguccauagau

SEQ ID NO: 123224 - RNA, 23 nt, Mus musculus
ggagccaggccucaucugcccag

SEQ ID NO: 123225 - RNA, 45 nt, Mus musculus
gcuauucaguuagucugaguauuggccuaagaugagucaggagau

SEQ ID NO: 123226 - RNA, 54 nt, Mus musculus
uuucaaagacaccaacaccaguuccaagcaauguuaaggcaccuggagggaagg

SEQ ID NO: 123227 - RNA, 52 nt, Mus musculus
gggaauagggaggcuugauuucugaagcccucaugaaguagagcaggaagga

SEQ ID NO: 123228 - RNA, 45 nt, Mus musculus
ggaggaggaggaggaggaggaggaagaugaugaagaagaagagga

SEQ ID NO: 123229 - RNA, 45 nt, Mus musculus
aaggcucuuguauucagccuucugucccagacaagccuggcugcc

SEQ ID NO: 123230 - RNA, 45 nt, Mus musculus
uuuuugucuaacaucaucuacacaguauaaaauaagcaucaaggg

SEQ ID NO: 123231 - RNA, 95 nt, Mus musculus
cugugagguuugaacucguguuaaauaccacuguggaaagaaagauugaagaguguugcccauucuuaccagaagccaugacuuaguaugaagac

SEQ ID NO: 123232 - RNA, 46 nt, Mus musculus
aauaguaugaauggaagcccgugagaggaggaauaucagugaaugu

SEQ ID NO: 123233 - RNA, 46 nt, Mus musculus
ugguguguaugagugguauccacaugacauggaagauagaguagag

SEQ ID NO: 123234 - RNA, 45 nt, Mus musculus
cuaucuccuuacuucuguccucccucacuuggagcuucgugagau

SEQ ID NO: 123235 - RNA, 74 nt, Mus musculus
cagccacugcuggaaaaggaaaggauugccaggacaguagaagucggaacaugccaaagauaaagaccccaaaa

SEQ ID NO: 123236 - RNA, 46 nt, Mus musculus
guauuaggugucucugagguacuaaaagacaugacagccaucauau

SEQ ID NO: 123237 - RNA, 45 nt, Mus musculus
cacuuaaaacagaagagucaugucauuuauuuuccagauuuggau

SEQ ID NO: 123238 - RNA, 42 nt, Mus musculus
ugaacuauguuccagguuauaacuaaugaauucaggggaucc

SEQ ID NO: 123239 - RNA, 45 nt, Mus musculus
uaaauugucuugaagccaguguacacuuguggaaaugucaguaca

SEQ ID NO: 123240 - RNA, 46 nt, Mus musculus
ugaucugugacucacugaacaaucuaagcgacagaaacagggggaa

SEQ ID NO: 123241 - RNA, 46 nt, Mus musculus
auacugauuuauuuauuccuuagucaucaacucaaaagccucuuca

SEQ ID NO: 123242 - RNA, 42 nt, Mus musculus
aacuucaaugcuugcauuuuauauuuauugcagcccccuucc

SEQ ID NO: 123243 - RNA, 42 nt, Mus musculus
auacagagagagagagagagagagagagagagacauaggcag

SEQ ID NO: 123244 - RNA, 46 nt, Mus musculus
uuguaguuauuuauaugaaaguugauacaguuauaagauagaagaa

SEQ ID NO: 123245 - RNA, 44 nt, Mus musculus
acagccuuuacuuugugagcgagugagagcaggaauacaggagg

SEQ ID NO: 123246 - RNA, 45 nt, Mus musculus
gaaaaacuggcuagaguaacugguuuugcggaugaagucagcaga

SEQ ID NO: 123247 - RNA, 46 nt, Mus musculus
gagaguguggggaguggagaagagaggacuugggguagaagaaggg

SEQ ID NO: 123248 - RNA, 46 nt, Mus musculus
uccauaaagagaaacaaauaaaaaaauaccaaugggcuggagcaag

SEQ ID NO: 123249 - RNA, 46 nt, Mus musculus
uauuuaagcuuuuugguaucuuaacuaagaaaucuuucccggaauc

SEQ ID NO: 123250 - RNA, 45 nt, Mus musculus
ucaguggaauuugagacuuuuguccaguuuuaaauugguggagua

SEQ ID NO: 123251 - RNA, 45 nt, Mus musculus
gauuccucgacagacaggauaggaaaagccgacaccgugccaguc

SEQ ID NO: 123252 - RNA, 91 nt, Mus musculus
uaagucguucccuaaauccucacgcauuuaacacuaagaaguggcuacaauggaggaggggcggagugcuuguauuauuaugucugccagu

SEQ ID NO: 123253 - RNA, 45 nt, Mus musculus
gcaaccacaugguggcucacaaccauccauaacgagaccugacuc

SEQ ID NO: 123254 - RNA, 46 nt, Mus musculus
cugcaccugcuacagauagcauauuugcaacaagcuuagcugagau

SEQ ID NO: 123255 - RNA, 46 nt, Mus musculus
cacggauccucuuacccacaauuucacuugggaagacuaaguccuc

SEQ ID NO: 123256 - RNA, 78 nt, Mus musculus
ucgugaguuggagaaaaaguucaguggcaagcacgaggucuucauugcucagaggaggauucugcccaagccaacccc

SEQ ID NO: 123257 - RNA, 46 nt, Mus musculus
cgugcuugccacugaacuuuuucuccaacucacgaacuagccggac

SEQ ID NO: 123258 - RNA, 46 nt, Mus musculus
ccaucauaauuuuuguaccaguuccucugcuuaaaucuuuccagaa

SEQ ID NO: 123259 - RNA, 45 nt, Mus musculus
gugccagacuuagcaaugguucccaaguuauuaaugaggucaugc

SEQ ID NO: 123260 - RNA, 42 nt, Mus musculus
ugugaucacaaccacuuucucugccacuagauaggccgagua

SEQ ID NO: 123261 - RNA, 42 nt, Mus musculus
cuaugaacugcgaauguuucuucaccacuuccuugacccucc

SEQ ID NO: 123262 - RNA, 45 nt, Mus musculus
guuuucuuuuucuugucuuugccacugucaucuuccucaucagau

SEQ ID NO: 123263 - RNA, 46 nt, Mus musculus
aucaucuccagacugagaggugugauagagaaggagcucagagagg

SEQ ID NO: 123264 - RNA, 46 nt, Mus musculus
ugcuugucacaaugcagcagggugaagauacaagccuauuggagau

SEQ ID NO: 123265 - RNA, 78 nt, Mus musculus
augcaguuggaguggguuuggggauccucaagugagaaaccagaagagagcagagcaguuucaaacagcagcaccacc

SEQ ID NO: 123266 - RNA, 42 nt, Mus musculus
gguagaguuacaagagccuucagcgaugcuuccucggcagcg

SEQ ID NO: 123267 - RNA, 46 nt, Mus musculus; identical to SEQ ID NO: 61688

SEQ ID NO: 123268 - RNA, 46 nt, Mus musculus; identical to SEQ ID NO: 61689

SEQ ID NO: 123269 - RNA, 46 nt, Mus musculus; identical to SEQ ID NO: 61690

SEQ ID NO: 123270 - RNA, 46 nt, Mus musculus
cgugguuuagcaaaguacuggccuccaccaccauaagggccagagc

SEQ ID NO: 123271 - RNA, 46 nt, Mus musculus
acccaagcaaccauaaauaaauuccaaauggaacuuggcaccaccc

SEQ ID NO: 123272 - RNA, 23 nt, Mus musculus
ugccugccggcauggaagggagg

SEQ ID NO: 123273 - RNA, 69 nt, Mus musculus
cggguguaggccaggaugaggccuccggcuaggcaggcauagaagaucaugaugaguaggauguagaga

SEQ ID NO: 123274 - RNA, 71 nt, Mus musculus
aaggaugccaagucugucaagaucaagaagaacaaggauaaugugaaguucaggguucgcugcagcaggua

SEQ ID NO: 123275 - RNA, 45 nt, Mus musculus
cuggccacacagaaaugagugcugaggcaaauaaaaggccuguga

SEQ ID NO: 123276 - RNA, 42 nt, Mus musculus
cagaucaggagcuguggcucccugcuuuggcgauauggagac

SEQ ID NO: 123277 - RNA, 42 nt, Mus musculus
ggguaggcuguggagggaaggcugcgaggcggggcaguggug

SEQ ID NO: 123278 - RNA, 45 nt, Mus musculus
cagccgagugccgccuggggcugcggggagugaggggagacggag

SEQ ID NO: 123279 - RNA, 42 nt, Mus musculus
gggacucggcggccaguccucggggggccggacgaggaggag

SEQ ID NO: 123280 - RNA, 46 nt, Mus musculus
aagcaaaugggauugauaggggaaguugccagcuggguaccaguaa

SEQ ID NO: 123281 - RNA, 45 nt, Mus musculus
gggcuauguuacuuuaggccaggaaguaggggaguuggagggaaa

SEQ ID NO: 123282 - RNA, 46 nt, Mus musculus
uccagagaagauugcagagaauuuccccaucuuucauugucggcag

SEQ ID NO: 123283 - RNA, 41 nt, Mus musculus
cucugucuuuuuaucugacaacuccauuuaaguuggccucc

SEQ ID NO: 123284 - RNA, 46 nt, Mus musculus
aagugggacuggcauguggauagacuccacuggcuaucugggaaag

SEQ ID NO: 123285 - RNA, 46 nt, Mus musculus
aaaguugagucucuuugucuuuagacaaaggacugagaccauauua

SEQ ID NO: 123286 - RNA, 41 nt, Mus musculus
aaaaaaaagaaagaaagacagacagacagacagacagacau

SEQ ID NO: 123287 - RNA, 46 nt, Mus musculus
uccaucccagcacuuuccagcccccacucccaucacaagccagcau

SEQ ID NO: 123288 - RNA, 45 nt, Mus musculus
guuugcaaguagcuacagggaggaguaggagggggaacaucagag

SEQ ID NO: 123289 - RNA, 42 nt, Mus musculus
gccagaaugauccauucuugaaagcccaucagccgcccccag

SEQ ID NO: 123290 - RNA, 46 nt, Mus musculus
uccuuucuucccucccuucuucucucccucccuuccuccgccucac

SEQ ID NO: 123291 - RNA, 46 nt, Mus musculus
uucagucccuuugcuuuucaggugaggagacuggcuuagagaaaaa

SEQ ID NO: 123292 - RNA, 45 nt, Mus musculus
ggaauauaaaggaaaaagagacaaggggcagccuucaggcucaag

SEQ ID NO: 123293 - RNA, 45 nt, Mus musculus
gugugucugugucuguguuuguguguuuguggcucuuuauggcag

SEQ ID NO: 123294 - RNA, 41 nt, Mus musculus
cuaagacaguuuaaaaaguaaguguguguguguguguguga

SEQ ID NO: 123295 - RNA, 41 nt, Mus musculus
ccugucaaggacaaaucccaucucaagcacugccaggaaag

SEQ ID NO: 123296 - RNA, 88 nt, Mus musculus
uuuggcaugcaaaaagcuccucaucugcuaaauacuguguggugaaucuacaucauuuaacaguuauuaaguaauuacucugggccua

SEQ ID NO: 123297 - RNA, 46 nt, Mus musculus
ugggggugggggaaccaauuaugucagaaacguaaaaguggggaag

SEQ ID NO: 123298 - RNA, 46 nt, Mus musculus
guauggaguauuaauauaucccaguauuaauauaucccagccccug

SEQ ID NO: 123299 - RNA, 37 nt, Mus musculus
cuuuugaaacaguggaucaaggcagagaauaaaguug

SEQ ID NO: 123300 - RNA, 45 nt, Mus musculus
agggagaagcauugcuaugacaacaaauuccuuauauuugauuua

SEQ ID NO: 123301 - RNA, 42 nt, Mus musculus
ggcuucaguaauaaacguuacaaagaaagauuugugggccag

SEQ ID NO: 123302 - RNA, 45 nt, Mus musculus
caggaacaaacugggcacccacaauucuuuucucguuugccuacu

SEQ ID NO: 123303 - RNA, 46 nt, Mus musculus
ggcauuuauauaucuacuuccuucuacguacuuuuucuugcccuca

SEQ ID NO: 123304 - RNA, 45 nt, Mus musculus
aaguuguuauguuucuauaagccacccuaauuaaacucagaguca

SEQ ID NO: 123305 - RNA, 46 nt, Mus musculus
aaggaagaaaggaagaaagaaaggaggaaaagugggacuagcuggg

SEQ ID NO: 123306 - RNA, 45 nt, Mus musculus
gaugaucauaggguguaaagcaaauggacugagugcuuguggaga

SEQ ID NO: 123307 - RNA, 51 nt, Mus musculus
acuuguauagauuuuuuaaguaguuuaaugagacuuuaauagggaugaaga

SEQ ID NO: 123308 - RNA, 33 nt, Mus musculus
augcacacgggggugggguggggguaggggaga

SEQ ID NO: 123309 - RNA, 42 nt, Mus musculus
uucagauugcacuuucccauggacacaauaguuuucuggugg

SEQ ID NO: 123310 - RNA, 44 nt, Mus musculus
ccuagugaccugaguucaauccguggaagccauguaaagguaga

SEQ ID NO: 123311 - RNA, 41 nt, Mus musculus
cuuuauucccaaauucuagguguguuuccaugaagggccuc

SEQ ID NO: 123312 - RNA, 45 nt, Mus musculus
gaagcugcugcuguaaccaggaaaagagagagagagcagggggga

SEQ ID NO: 123313 - RNA, 46 nt, Mus musculus
acgguaaaugguguagcuuggcuauaugggaaugcaugugaagggg

SEQ ID NO: 123314 - RNA, 47 nt, Mus musculus
cauuaacucucaacuuccuauguucuuccuauacaucugcaaugccc

SEQ ID NO: 123315 - RNA, 46 nt, Mus musculus
uguagaccaaacucccaggcacauaaaauaauagagcaaaauuaag

SEQ ID NO: 123316 - RNA, 45 nt, Mus musculus
aucuucuggugucuauggucauaggugggguacaacuccaccucu

SEQ ID NO: 123317 - RNA, 49 nt, Mus musculus
uaguuggucauacucacguucccauucacccugcaacuucuuccagauc

SEQ ID NO: 123318 - RNA, 46 nt, Mus musculus
cacuauuguuuucucugacugauguagaacucacuguguagaccag

SEQ ID NO: 123319 - RNA, 46 nt, Mus musculus
gggcauguaauugaguauggugaagcuguuagagauuaggcuguag

SEQ ID NO: 123320 - RNA, 72 nt, Mus musculus
auggcgggguggggggagcauggggaauuaagacuguuuuuuuuuuuuuaauagcaucugggcauuuuuuuu

SEQ ID NO: 123321 - RNA, 46 nt, Mus musculus
aauuucagcugugccacagggagcagaggugcacuucuggguggag

SEQ ID NO: 123322 - RNA, 46 nt, Mus musculus
auacaaauguaaaaaauauauacaauauaauaaagaggguuuucag

SEQ ID NO: 123323 - RNA, 46 nt, Mus musculus
uagggguagauuuuacuugcauggaaccugguccucacauggcuaa

SEQ ID NO: 123324 - RNA, 46 nt, Mus musculus; identical to SEQ ID NO: 53366

SEQ ID NO: 123325 - RNA, 44 nt, Mus musculus
uauggguuacaaguauaauaaugcuuauuaaaaaccacucagaa

SEQ ID NO: 123326 - RNA, 44 nt, Mus musculus
agaggagagagggaagagaaaagaggguaugugaaggagagaaa

SEQ ID NO: 123327 - RNA, 46 nt, Mus musculus
uccauuccuuucugaacuugugguaagguaggguacuguggcagag

SEQ ID NO: 123328 - RNA, 46 nt, Mus musculus
guaggacagucauuugggucucacaggugacucuaacucuuuucua

SEQ ID NO: 123329 - RNA, 45 nt, Mus musculus
ucaguggguuuccgaagaacagagcacaugaaaaugggagcagaa

SEQ ID NO: 123330 - RNA, 46 nt, Mus musculus
uaaaagaauucccaacauguuaguacgcaacuauugaaacauugaa

SEQ ID NO: 123331 - RNA, 42 nt, Mus musculus
aguccacuuugaaucuauaaauauauuuaggcuuucccagag

SEQ ID NO: 123332 - RNA, 45 nt, Mus musculus
agcaugcuaugcucuacguggucccugucuaccugcuuuggaaag

SEQ ID NO: 123333 - RNA, 45 nt, Mus musculus
guaccucguuacagaugguagugagccaccaugugguugcuggga

SEQ ID NO: 123334 - RNA, 42 nt, Mus musculus
agacagagagauccccucugggaagguaacgcuuaaauggag

SEQ ID NO: 123335 - RNA, 42 nt, Mus musculus
uuacaaucugaccuugcauggcuccaucuucuuucccauuac

SEQ ID NO: 123336 - RNA, 46 nt, Mus musculus
uggguaccgcugucugcauccacacauccaugcaugugccacagau

SEQ ID NO: 123337 - RNA, 42 nt, Mus musculus
uaaggucaaaagaguccaagcugggcugaacagaagggaggu

SEQ ID NO: 123338 - RNA, 30 nt, Mus musculus
uuuuugaaauccccacuugcugucuggccg

SEQ ID NO: 123339 - RNA, 41 nt, Mus musculus
cuguguuaaagggccagccaaccguuuguggauagaaucaa

SEQ ID NO: 123340 - RNA, 46 nt, Mus musculus
gaagcaagaagauauucuuucauaauggaauuuaugccccuguuag

SEQ ID NO: 123341 - RNA, 45 nt, Mus musculus
uggucaccagacuuauccaguaggaaagaggaagcaaguguugua

SEQ ID NO: 123342 - RNA, 45 nt, Mus musculus
ucgagaagagaggagaggauauuaaauugugaccucagaaagcga

SEQ ID NO: 123343 - RNA, 46 nt, Mus musculus
ggacagccagugcuguuauacagagaaacucucuuaaauauaagag

SEQ ID NO: 123344 - RNA, 42 nt, Mus musculus
uugugcuccccuggaacaaggaacugcacguaauugcccaca

SEQ ID NO: 123345 - RNA, 46 nt, Mus musculus
uacuuuuugccauugaguccaaugugcaucauagauauugccugag

SEQ ID NO: 123346 - RNA, 46 nt, Mus musculus
aauagcgucgauguugcauggguaucuaaucagugucaaaagugag

SEQ ID NO: 123347 - RNA, 70 nt, Mus musculus
caugcuguguccggccaucucagacccauucuacggccccugguaucgcaucugggccucgggacaccag

SEQ ID NO: 123348 - RNA, 46 nt, Mus musculus
cagccaaaauagauucuuucagugacuggugucccaugacugaaag

SEQ ID NO: 123349 - RNA, 46 nt, Mus musculus
gggaacucucaguggaccugaggcccauagguucaaguguucugaa

SEQ ID NO: 123350 - RNA, 46 nt, Mus musculus
ggaccagugucugucuaucugcugacuccuugucaacaucuaguag

SEQ ID NO: 123351 - RNA, 53 nt, Mus musculus
auuggccugccuuugcuuuggugccagcucgguagguauuuucuggugcucag

SEQ ID NO: 123352 - RNA, 52 nt, Mus musculus
gccaggauaccuggcauggccaagccagagucaaacauacgugucaggaaag

SEQ ID NO: 123353 - RNA, 64 nt, Mus musculus
uccuucaacagacuccauagggaggcucagccugggugugagauguuggggagcaggggaccug

SEQ ID NO: 123354 - RNA, 42 nt, Mus musculus
ugcccccaguauuugguuuuguguauauaagacuuggcccag

SEQ ID NO: 123355 - RNA, 46 nt, Mus musculus
cagaguggacagguucacaaaugcuauguaguuaugguuugagugg

SEQ ID NO: 123356 - RNA, 48 nt, Mus musculus
guuccaucaguuguugcaaaugguccaucauucuggcaugggaugcug

SEQ ID NO: 123357 - RNA, 45 nt, Mus musculus
gagauugccauaagguucauauagaucuugcuaagacaucuggga

SEQ ID NO: 123358 - RNA, 45 nt, Mus musculus
ugagcccugucucauuacaucugcuacuaugaauguccgguccaa

SEQ ID NO: 123359 - RNA, 42 nt, Mus musculus
uacuaaguuaauacugcuuccucaccauucaaaauucccaag

SEQ ID NO: 123360 - RNA, 45 nt, Mus musculus
auguguucccaggaaauaugggacuagugucuuucaguagcagag

SEQ ID NO: 123361 - RNA, 46 nt, Mus musculus
ucugcagaguuuuacccaaugaccauuuccccagugccgugcaugc

SEQ ID NO: 123362 - RNA, 46 nt, Mus musculus
gggagugugcucuaguuuggaggaaauagcagauagagagggucug

SEQ ID NO: 123363 - RNA, 45 nt, Mus musculus
cugugaacuuguagaaacucuggaauuccuuuuuucagguuuaga

SEQ ID NO: 123364 - RNA, 46 nt, Mus musculus; identical to SEQ ID NO: 40199

SEQ ID NO: 123365 - RNA, 48 nt, Mus musculus
gucugcauuucuacgugcagguggucgauacguuucaauagaagggcu

SEQ ID NO: 123366 - RNA, 46 nt, Mus musculus
gaagggucuauaagugucuucuacgcugcuaagcacuggugguuca

SEQ ID NO: 123367 - RNA, 46 nt, Mus musculus
guuaccugugguaaguucaguuguuaaaguaaaaagauuuagccau

SEQ ID NO: 123368 - RNA, 44 nt, Mus musculus
aucauggcuaaaucuuuuuacuuuaacaacugaacuuaccacag

SEQ ID NO: 123369 - RNA, 42 nt, Mus musculus; identical to SEQ ID NO: 61547

SEQ ID NO: 123370 - RNA, 45 nt, Mus musculus; identical to SEQ ID NO: 61548

SEQ ID NO: 123371 - RNA, 72 nt, Mus musculus
ccugccaguaacuccaguuccagggaaucugacaccccccacacaagacacaugcaggcaaaacaccaguac

SEQ ID NO: 123372 - RNA, 42 nt, Mus musculus; identical to SEQ ID NO: 61550

SEQ ID NO: 123373 - RNA, 46 nt, Mus musculus
cuauacuguugguagaaaacggguugaucguggaucagugguaaag

SEQ ID NO: 123374 - RNA, 49 nt, Mus musculus
gaaggaucccaaggaaugggcagcucaguaccgagaggcaauggaagca

SEQ ID NO: 123375 - RNA, 63 nt, Mus musculus
cacacacacaaacacacacauucacaugugcagaaaacccuuagcuauaaaagaaacuacaga

SEQ ID NO: 123376 - RNA, 45 nt, Mus musculus
augugcuuuauauacaauaguccauuacuuucuuucacacacaga

SEQ ID NO: 123377 - RNA, 39 nt, Mus musculus
cugccugcugcuggauacaccaucucauguguugcagau

SEQ ID NO: 123378 - RNA, 41 nt, Mus musculus
ggaggaaagcagagaccuacugcauccucaucacuguagag

SEQ ID NO: 123379 - RNA, 46 nt, Mus musculus
agaauauacugauguauacccugaaaucauugaacgagcaggcuau

SEQ ID NO: 123380 - RNA, 41 nt, Mus musculus
caggaaccugaggcacccccacccagagauguggcccuuuu

SEQ ID NO: 123381 - RNA, 41 nt, Mus musculus
acauugcgcaugcgcuuuauguauagcuagaaaggggcgug

SEQ ID NO: 123382 - RNA, 41 nt, Mus musculus
ggaggggcuuggagagaguggacacacucgggaauuguagg

SEQ ID NO: 123383 - RNA, 46 nt, Mus musculus
aggaaaugcgaugggaaauagggaguccggaguuaggcaagggaau

SEQ ID NO: 123384 - RNA, 45 nt, Mus musculus
gagacuggcagagguggaggggagaaaaaggggaacugugcaugc

SEQ ID NO: 123385 - RNA, 42 nt, Mus musculus
guuuuaauuuuccccuuugcuaggcucacccugcccccaaag

SEQ ID NO: 123386 - RNA, 46 nt, Mus musculus
gccugucuauucuacuguuuucuccagaaagccagacuucccaccu

SEQ ID NO: 123387 - RNA, 47 nt, Mus musculus
agucaccaccccauguaaggucauacaugugaagacacuggcugagg

SEQ ID NO: 123388 - RNA, 43 nt, Mus musculus
aggcuggcuggauugguaauccagccaggauaagcauacaguu

SEQ ID NO: 123389 - RNA, 66 nt, Mus musculus
aagcccuaguugugggguugaugggaccuauuccagccccuugaaucuuaagguaccauaugagag

SEQ ID NO: 123390 - RNA, 42 nt, Mus musculus
cauguuuugggcccucguuuguuaaauguuaugagacuuaua

SEQ ID NO: 123391 - RNA, 47 nt, Mus musculus
ucugauccagacacccagacuauuaaggaagaggauauaguugaaga

SEQ ID NO: 123392 - RNA, 42 nt, Mus musculus
ggcugaagaugauguggacagcguggaagaaauggaggugaa

SEQ ID NO: 123393 - RNA, 47 nt, Mus musculus
aaagcuagucuuucauuuaggaaagauagaccauuggcccagaagau

SEQ ID NO: 123394 - RNA, 46 nt, Mus musculus
aaauuuuaaggcuguaagauuugaaugguagguaaaaguagaagug

SEQ ID NO: 123395 - RNA, 46 nt, Mus musculus
caugguggcucacaaccacccguaaugagaucugauggccucuucu

SEQ ID NO: 123396 - RNA, 25 nt, Mus musculus
agugcauuauauuaaggggauggaa

SEQ ID NO: 123397 - RNA, 46 nt, Mus musculus
auuaagcauuuuucacuuuuaguauuaaauuucacaaucuggaguu

SEQ ID NO: 123398 - RNA, 49 nt, Mus musculus
aacugguaacaaaaucagguacaacucuaagagaagacacuggaggaga

SEQ ID NO: 123399 - RNA, 45 nt, Mus musculus
cuuagaguuguaccugauuuuguuaccaguuuucauccggaucca

SEQ ID NO: 123400 - RNA, 41 nt, Mus musculus
cugcacacuguugcaggccucgccaagccccugcggcggag

SEQ ID NO: 123401 - RNA, 45 nt, Mus musculus
aaagaaguaaaggcccagccuucaguuuuucucuuaaggguugga

SEQ ID NO: 123402 - RNA, 46 nt, Mus musculus
ucgcuucgcguggggugagagcggagcgguggcgauuugggguuug

SEQ ID NO: 123403 - RNA, 42 nt, Mus musculus
cuucgccucuguuuucgucgucgcagugggcggguugggaag

SEQ ID NO: 123404 - RNA, 44 nt, Mus musculus
aucaucuacccugucccauguccuuccguggugcuuuuggcgca

SEQ ID NO: 123405 - RNA, 46 nt, Mus musculus
uuuuaacaucugcgccaaaagcaccacggaaggacaugggacaggg

SEQ ID NO: 123406 - RNA, 42 nt, Mus musculus
aauguuuugagaccauacuugggcagaacaauaaacggguca

SEQ ID NO: 123407 - RNA, 42 nt, Mus musculus
gaccagcagacuacagaaacauaggcgggaaagggggcgggu

SEQ ID NO: 123408 - RNA, 45 nt, Mus musculus
cugggggucgacaccuugcuaggggauucagcuccuggggguggg

SEQ ID NO: 123409 - RNA, 45 nt, Mus musculus
cccaaguguucuaccuuuuggaagggagugccucaucccuugccu

SEQ ID NO: 123410 - RNA, 42 nt, Mus musculus
accucuaucauuuuuagacaaacuuugucuaaguugggucag

SEQ ID NO: 123411 - RNA, 46 nt, Mus musculus
aaaguuuuuauuugguacugccacuccuuccucucuucucagagau

SEQ ID NO: 123412 - RNA, 134 nt, Mus musculus
guagccugaccugaguguuagugcuucagaggaacaaaccaguagaccagaacuuggucaggaaguuucaggaagcuauuggagcaguguugggauuucccaccaggaugacuaugauuggcugugauuuuagg

SEQ ID NO: 123413 - RNA, 47 nt, Mus musculus
ugcgguugguauuuguauuuuacaucuugaaauggagauggggcugg

SEQ ID NO: 123414 - RNA, 46 nt, Mus musculus
uguuagccauucugggucuguacuauggucaaaaccagaaaaugag

SEQ ID NO: 123415 - RNA, 46 nt, Mus musculus
uauguguguaucuggugcacuaagaggucaguagaagguaugagau

SEQ ID NO: 123416 - RNA, 45 nt, Mus musculus
aaucaccaauaucugugcacaaacauauaaaaccaacuuggggug

SEQ ID NO: 123417 - RNA, 46 nt, Mus musculus
auugcuguaucacuaauuuuugauuccauaauuugauggggaauag

SEQ ID NO: 123418 - RNA, 45 nt, Mus musculus
gggugaguccaaucuuuguugucuggauaccagccguucagucca

SEQ ID NO: 123419 - RNA, 42 nt, Mus musculus
uagucuacuuggcagucuccauacaggaaccagcaaggggag

SEQ ID NO: 123420 - RNA, 46 nt, Mus musculus
uagcaaaugcaugaaaggacacaugauguucagaaagaauauaaau

SEQ ID NO: 123421 - RNA, 46 nt, Mus musculus
uuccacuucaugguuaauauagauuucccauuuuaggccugagcac

SEQ ID NO: 123422 - RNA, 46 nt, Mus musculus
uccuauguagaccauacaaaauguaguuuacaaagauaagcaacag

SEQ ID NO: 123423 - RNA, 31 nt, Mus musculus
aggaaugagcaaaauguuacagcaguuuaua

SEQ ID NO: 123424 - RNA, 46 nt, Mus musculus
augaauuacagauacagaaauuuauauugccuauugauggugaaag

SEQ ID NO: 123425 - RNA, 45 nt, Mus musculus
agguuuccuuuaagcaacuugcuuuuauuucuaaauguguuacca

SEQ ID NO: 123426 - RNA, 55 nt, Mus musculus
aaaaacuuaaguaaaaggcaggacuccaaagaaagccccccaccuauaaacacac

SEQ ID NO: 123427 - RNA, 111 nt, Mus musculus
auuuccacugucauccucuuauggguuagccuaauuuggcagguuuuuaaggguguuuuuguuguugguuuguuuuuagaaggaauuuuuguuuugauagucucauuuuag

SEQ ID NO: 123428 - RNA, 59 nt, Mus musculus
uagcugaggcuagccucaaaccugugccaauccugcugccuuaaagucccuaauguuug

SEQ ID NO: 123429 - RNA, 49 nt, Mus musculus
uuuaaaauuuauuuuauguauaugaguguacugucacuauccucagaca

SEQ ID NO: 123430 - RNA, 46 nt, Mus musculus
cuguuuucacacauauguguggacacuguaugucaauaagugggaa

SEQ ID NO: 123431 - RNA, 95 nt, Mus musculus
gaacugggaauguaguucauuaguggagcacuucuuuugccccaaguccuggauuuggugugagcacugaaaaagaaaauguuuucaaagcccau

SEQ ID NO: 123432 - RNA, 83 nt, Mus musculus
guauguggauugaggguaaaauuuuaccuugagagaggugucauagugaggagguaacauuuaagcucaacuuuuagggauau

SEQ ID NO: 123433 - RNA, 46 nt, Mus musculus
aagcaugagaagaauacuauauaaugccauuuugccauuaagagag

SEQ ID NO: 123434 - RNA, 46 nt, Mus musculus
ucuauauauuaaaaguaugcuaaauuaaggcucuauccugccagau

SEQ ID NO: 123435 - RNA, 45 nt, Mus musculus
ucuaaaaagaguuucaggggaacugagugacuugauuucugccag

SEQ ID NO: 123436 - RNA, 42 nt, Mus musculus
aagcaaugucugcaaaugaguuuccagauuuugggggggggg

SEQ ID NO: 123437 - RNA, 45 nt, Mus musculus
gggagugguugguaguuugaauuugcauucuuaucccugccuaua

SEQ ID NO: 123438 - RNA, 47 nt, Mus musculus
guaaauuggucacagucuucauuucucaagcugucaugaggguuaga

SEQ ID NO: 123439 - RNA, 45 nt, Mus musculus
ucagugaugucuauaacucuguaaucaauagugaauaggcugggg

SEQ ID NO: 123440 - RNA, 45 nt, Mus musculus
caacuaaucuaaggcauuuguaauacugcuuuaaauuuggcccau

SEQ ID NO: 123441 - RNA, 46 nt, Mus musculus
gagagagagagaacgagaacguguguacguguguguguacgugugu

SEQ ID NO: 123442 - RNA, 46 nt, Mus musculus
ugccucccaagugcuggauuuaaaggcgugcgccaccacaccccaa

SEQ ID NO: 123443 - RNA, 46 nt, Mus musculus
agacaaauguuuuucuacauggcccuaacuauccuggaacucagau

SEQ ID NO: 123444 - RNA, 46 nt, Mus musculus
uagcucauuuaguacuaaauauuccuuugucugauauacaccaaag

SEQ ID NO: 123445 - RNA, 46 nt, Mus musculus
gggcuucauuuucuguuccauugauuuguucuuccccccaccccca

SEQ ID NO: 123446 - RNA, 46 nt, Mus musculus
ucaaaaaucugccaauccaaaaaccaauaaauggcaaggaauaaag

SEQ ID NO: 123447 - RNA, 46 nt, Mus musculus
ugaauacuuuaaaauuguguuucaacacuggagaaacggcucagag

SEQ ID NO: 123448 - RNA, 44 nt, Mus musculus
gaaagaagaaugaaauaggguacuucauucccaaguaccagaag

SEQ ID NO: 123449 - RNA, 60 nt, Mus musculus
auacacaaaacaauuauccaauuauucauugcugguuagcgugcaaauuaauacaacuaa

SEQ ID NO: 123450 - RNA, 46 nt, Mus musculus
gaaaugguuggacauugaauguucugucugacugagcuugggggau

SEQ ID NO: 123451 - RNA, 45 nt, Mus musculus
gcucacaaccauccguaaugagaucugacucccucuucugaagug

SEQ ID NO: 123452 - RNA, 45 nt, Mus musculus
cugaaagaacaauacauuaaaaaaaacaaucagggcuggugagau

SEQ ID NO: 123453 - RNA, 46 nt, Mus musculus
auuaauucauucaccuuacauccugaucauaguccccuguccccau

SEQ ID NO: 123454 - RNA, 45 nt, Mus musculus
aaguguugggggacccuaugaagacuaagcuauacaucugcuaaa

SEQ ID NO: 123455 - RNA, 46 nt, Mus musculus
ucuguuccuucuuucuacaccaugaauucuuacauuucaccucuug

SEQ ID NO: 123456 - RNA, 45 nt, Mus musculus
auuuuggaauaguuuagguuuacucaagagucuuacugggauugg

SEQ ID NO: 123457 - RNA, 46 nt, Mus musculus
guauuuugaaguuguugauaggaguuaaucuuguccuuuguguuag

SEQ ID NO: 123458 - RNA, 46 nt, Mus musculus
cugggauguguauguauucaugacugguuaccuuaaauagcaccag

SEQ ID NO: 123459 - RNA, 46 nt, Mus musculus
uuuguuaagacuucucuuucccgaagguccugaguucaaaccccac

SEQ ID NO: 123460 - RNA, 46 nt, Mus musculus
agaucuuaaaucagaaaacugaaaacaugaaaguagacaggacuaa

SEQ ID NO: 123461 - RNA, 46 nt, Mus musculus
ucccugaaagggacucucaggcuacaauauaagcauugaaagacag

SEQ ID NO: 123462 - RNA, 45 nt, Mus musculus
gagaguugaaaaucaggacaacuuagcauacauaagaacuuaaua

SEQ ID NO: 123463 - RNA, 45 nt, Mus musculus
cuguuuuacugaaguaaauuguagauaagucaucaaaagucagau

SEQ ID NO: 123464 - RNA, 45 nt, Mus musculus
cuauggggcaucuaaaauagucaaaagguauguaaguaggcaaca

SEQ ID NO: 123465 - RNA, 46 nt, Mus musculus
aucucaaugagcucagccccuagaacauaaggugaagaaaaccaac

SEQ ID NO: 123466 - RNA, 46 nt, Mus musculus
cuuguuauugcugagaggggaaagagggaaggauuaggggacaggg

SEQ ID NO: 123467 - RNA, 46 nt, Mus musculus
acccugucucaaaacaagaaagaauuuaagcaagaaagagaaggag

SEQ ID NO: 123468 - RNA, 46 nt, Mus musculus
gguguuagguguuuuucauacauaucaucaccaaaauuugagguag

SEQ ID NO: 123469 - RNA, 46 nt, Mus musculus
cagaauguuagaaggagggaaaaugaggggauggaagagagaagag

SEQ ID NO: 123470 - RNA, 46 nt, Mus musculus
acuccucuuggaacugcagcaaaucaaaacauggaacauuggcaag

SEQ ID NO: 123471 - RNA, 45 nt, Mus musculus
ggcauuucuuaggcauaaguauuaccugucuuaggauugauguga

SEQ ID NO: 123472 - RNA, 46 nt, Mus musculus
ugccaaaugcugcagccgugucaguagcggaguccucuugucagau

SEQ ID NO: 123473 - RNA, 46 nt, Mus musculus
gaaauucagaauaaggauucuaugugaaaaagaagcauaccgagag

SEQ ID NO: 123474 - RNA, 46 nt, Mus musculus
uuggcccuguaaagguucaauguccgaguguagaagaaugccaggg

SEQ ID NO: 123475 - RNA, 46 nt, Mus musculus
cauuggaacaguggcugagagcuuaacauccugauuugcaagcaag

SEQ ID NO: 123476 - RNA, 45 nt, Mus musculus
ugggaagaagaguugguuggggggaggaacggaaggauaauuaug

SEQ ID NO: 123477 - RNA, 45 nt, Mus musculus
cuuaccaccaagcuuaacaguaaugaccagaguuugauccagaca

SEQ ID NO: 123478 - RNA, 72 nt, Mus musculus
cauaugauaauccccacuggguaggugaguacauacagcaaggcuaauaaauuaaugaguauuauuuugggg

SEQ ID NO: 123479 - RNA, 45 nt, Mus musculus
uccuagaaaaguuaugagaugcaaaauguaauguucuuagguguu

SEQ ID NO: 123480 - RNA, 42 nt, Mus musculus
uugugguuuuuuucuuaccuguuucuuuuguguagccuguag

SEQ ID NO: 123481 - RNA, 46 nt, Mus musculus
aacauguaagaaauuaaguuauagcaaugguagugcaugccuuuaa

SEQ ID NO: 123482 - RNA, 46 nt, Mus musculus
auuucacagagagguuggaaagaaaagagaaaacaacacagcggua

SEQ ID NO: 123483 - RNA, 45 nt, Mus musculus
auuuggugcuaagagauaagaguucauggccaucauggugaggag

SEQ ID NO: 123484 - RNA, 82 nt, Mus musculus
agaaaaacagccaaauagugguugggacacauacuggauuagugagaauuguaugaaggcguuuguguuugagcugggccag

SEQ ID NO: 123485 - RNA, 46 nt, Mus musculus
auggaaguuaccaggaacugugcuacucauuaccacaggcacuugu

SEQ ID NO: 123486 - RNA, 48 nt, Mus musculus
ugagucuauaaaggccauucuuauucaaaccaacaugcaaauaauaua

SEQ ID NO: 123487 - RNA, 46 nt, Mus musculus
ugaaggaaaggguuaaaaaaccuagaauggugagaaaggccagcua

SEQ ID NO: 123488 - RNA, 45 nt, Mus musculus
ggcuuuggacuugcagaauguugcagagacuugcaaauguuggug

SEQ ID NO: 123489 - RNA, 46 nt, Mus musculus
gaacauauuuuaaugaagaauucugaagcucauucugcauguuaag

SEQ ID NO: 123490 - RNA, 55 nt, Mus musculus
ccacccagugcaaccacacuacacuuugaauuuuaugcagauccuggagcugagg

SEQ ID NO: 123491 - RNA, 36 nt, Mus musculus
cagaugcuguuauuuacacauauacgacuggcccau

SEQ ID NO: 123492 - RNA, 46 nt, Mus musculus
guuacuacuguagucauucaucaucuugagcuccuuuauguacuag

SEQ ID NO: 123493 - RNA, 46 nt, Mus musculus
ucuuacuauguuuaugauaaaaguacuacaaauguaacgcgccguu

SEQ ID NO: 123494 - RNA, 46 nt, Mus musculus
uacuuuuuucuuucucccauguuaggaguucaguguauuccacaac

SEQ ID NO: 123495 - RNA, 46 nt, Mus musculus
auguugaauuuccucaagaaggccauucaagacccugcuuucucag

SEQ ID NO: 123496 - RNA, 46 nt, Mus musculus
acuaugagagguggcaguaggauagaagagaucagaauccaaagcu

SEQ ID NO: 123497 - RNA, 32 nt, Mus musculus
auacauuuauaaaguaccuggaggcaaaaggc

SEQ ID NO: 123498 - RNA, 160 nt, Mus musculus
cacgcaagcuuuuagaacuuuuuuuuaauuucuuuuuuuaugagauauuuuuucauuuacaacucaaaugcuaucccaaaaguccuuuauaccacucccuacccuggacccugcuuuccaacccaccuacucccacuuccugguaaaugcuacaaagccc

SEQ ID NO: 123499 - RNA, 46 nt, Mus musculus
aaacaaugggcuuuguagcauuuaccaggaagugggaguagguggg

SEQ ID NO: 123500 - RNA, 45 nt, Mus musculus
aaguuggaacuccauuuaaaauucuauaaagcaauuuagggggag

SEQ ID NO: 123501 - RNA, 46 nt, Mus musculus
aaugaaacaguuuaugaaucuguauuucuaucuugugaucuugcag

SEQ ID NO: 123502 - RNA, 93 nt, Mus musculus
uaguuggaucuaugauauuccaguuacuaaauaugaguacaggucagguccuguaaaggaguuggaguugugacaaaggaaaaucagccuaag

SEQ ID NO: 123503 - RNA, 42 nt, Mus musculus
agggugguggagaugggguugggaggagugaagagagggaau

SEQ ID NO: 123504 - RNA, 46 nt, Mus musculus
gguucccucccaaauguauucagugcacuuugcuugaaugcccgag

SEQ ID NO: 123505 - RNA, 45 nt, Mus musculus
caauccaccaaaucauggugauggugguggugguggugguugagg

SEQ ID NO: 123506 - RNA, 55 nt, Mus musculus
cuugaagaaaucuguaaucuuggaagagauccuaaauacauuugucagaagccau

SEQ ID NO: 123507 - RNA, 45 nt, Mus musculus
agcuuuaauucugcccagcagaaugaaacugagccuaaucagcag

SEQ ID NO: 123508 - RNA, 46 nt, Mus musculus
acccuuuaugucacuucagucuauaaaaaaguaaaaaauacaucag

SEQ ID NO: 123509 - RNA, 46 nt, Mus musculus
gaaaauagucuaguagaguaugaauaaagcccaggaauagcagaag

SEQ ID NO: 123510 - RNA, 46 nt, Mus musculus
ucaacuuucucuuaucugcccucuuuccaguucacauuaccccccc

SEQ ID NO: 123511 - RNA, 46 nt, Mus musculus
gcccaaucucuauucucucaaacaaaugcuacagagcugcacagac

SEQ ID NO: 123512 - RNA, 45 nt, Mus musculus
ggacaauuauaacucauuuacaaaaacagacuuuuguugcucagg

SEQ ID NO: 123513 - RNA, 80 nt, Mus musculus
uuauccuuuucaacuaagccucaccucccuagaaagaaccuaaagauccaccucuaaaacuacaaguacagauaccacuc

SEQ ID NO: 123514 - RNA, 57 nt, Mus musculus
aaaggaaaucuuuaagccaggauugaaaagaacauuuccuagauaaugcacaacugc

SEQ ID NO: 123515 - RNA, 44 nt, Mus musculus
gguaugaauacuuaagcugauacugaaaaucacacagcacagug

SEQ ID NO: 123516 - RNA, 46 nt, Mus musculus
ucucaacaccacuaucucuguuccuccauugccaccucuuacucag

SEQ ID NO: 123517 - RNA, 45 nt, Mus musculus
gaacugucauccugcaauuacaaauuagcaguaaaaggaggccuu

SEQ ID NO: 123518 - RNA, 41 nt, Mus musculus
acagggucguugguaccgaggaacguauaccuauaccccuc

SEQ ID NO: 123519 - RNA, 42 nt, Mus musculus
aauacaacagaugaccacugucaagaauuuguaaaccagaaa

SEQ ID NO: 123520 - RNA, 43 nt, Mus musculus
acagccugacaggcagcagaugugggaaagucaaugggcagau

SEQ ID NO: 123521 - RNA, 45 nt, Mus musculus
guuaccauugacauacuaaagguuuugaugcugaccaggcccauu

SEQ ID NO: 123522 - RNA, 37 nt, Mus musculus
gagaaacugcaauuuaauguuuuauuuuguuucacuc

SEQ ID NO: 123523 - RNA, 32 nt, Mus musculus
agacaacuuuauagcucugaaaguacuucuug

SEQ ID NO: 123524 - RNA, 45 nt, Mus musculus
gccauuuauaaauugagaaauguaacugacugaaauuucggagag

SEQ ID NO: 123525 - RNA, 45 nt, Mus musculus
ugagcccccaggggauucaaucggccgauguaaaggcuccaagga

SEQ ID NO: 123526 - RNA, 46 nt, Mus musculus
guggagacagggaagcuuccucaguuucaaaauaacugcuguguaa

SEQ ID NO: 123527 - RNA, 41 nt, Mus musculus
uucuaucucaguaaaccagugggguucacaauuggguuuga

SEQ ID NO: 123528 - RNA, 45 nt, Mus musculus
ggaacuaguuucugcauguccgcuugaccaaauucacauccagau

SEQ ID NO: 123529 - RNA, 55 nt, Mus musculus
caugcagaaacuaguuccaaaggaugagaaggcagguacgacccagggcggaaaa

SEQ ID NO: 123530 - RNA, 46 nt, Mus musculus
acauauuauaaaaaaauacugggguaacaacauauuuugccaccaa

SEQ ID NO: 123531 - RNA, 90 nt, Mus musculus
uuagaaucugaagaagaagguucaucugucuccaugggugccagugugucaccaucuaguucaauuccuucuaauaaacccugggcagau

SEQ ID NO: 123532 - RNA, 46 nt, Mus musculus
cacccauggagacagaugaaccuucuucuucagauucuaagggcaa

SEQ ID NO: 123533 - RNA, 39 nt, Mus musculus
uuuuaaaaauaacucuuagcuuuuuauaugaccaagcaa

SEQ ID NO: 123534 - RNA, 46 nt, Mus musculus
uuuuauauuguauaauauuaauuauggaacaggcuacugccuaggu

SEQ ID NO: 123535 - RNA, 46 nt, Mus musculus
gucuagugaaaugacuaaagugacuacaguguaaaugagaguuuag

SEQ ID NO: 123536 - RNA, 46 nt, Mus musculus
gcccucacuaagcuacucacaaaaggcuuaucauggcagcccccac

SEQ ID NO: 123537 - RNA, 42 nt, Mus musculus
cucaucaaagagcauuggagaggugaauccaacugaacagau

SEQ ID NO: 123538 - RNA, 26 nt, Mus musculus
acauguguguguuuauugccaaggaa

SEQ ID NO: 123539 - RNA, 45 nt, Mus musculus
uaaaucccaccacggugcuugaaucuccacauucguugccugcua

SEQ ID NO: 123540 - RNA, 46 nt, Mus musculus
ggcagccuuuacuuguaucaagaaccuguggaaccggaaaccccuu

SEQ ID NO: 123541 - RNA, 52 nt, Mus musculus
gaagcaggccaggaagaagguggcucacgcagagaaccucaagucaaccagc

SEQ ID NO: 123542 - RNA, 42 nt, Mus musculus
accuacauagcaguuucuggcacugugaaagcuagccagcau

SEQ ID NO: 123543 - RNA, 46 nt, Mus musculus
uucugaaagcuucagaagcugcuaggaucuucuauucccuggccau

SEQ ID NO: 123544 - RNA, 47 nt, Mus musculus
augucucugggacaggauauuccaauggaucaaagggcagagucacc

SEQ ID NO: 123545 - RNA, 45 nt, Mus musculus
aaagcucgagaaaaacaagaagaggaagaagcuaaaugucuagag

SEQ ID NO: 123546 - RNA, 46 nt, Mus musculus
cugacugauccacucugaaacuguuuuugugucacuuguuguuaga

SEQ ID NO: 123547 - RNA, 89 nt, Mus musculus
gcaauacauugaauuggagagaaguacaaaauaugguccuuguauuucauguguaccaauagacuaaaaauguacaucaugagguuagg

SEQ ID NO: 123548 - RNA, 45 nt, Mus musculus
cucuuagaagugguucaacccugccuacaggcugccaaagagcaa

SEQ ID NO: 123549 - RNA, 46 nt, Mus musculus
guuuagggucugaaucacuuuucugaagcauaugugaaauccugag

SEQ ID NO: 123550 - RNA, 71 nt, Mus musculus
gaaaucuggagaaacaaguguaagauucacugcuggccgacgaagauacacuguccaguucacuacaaugg

SEQ ID NO: 123551 - RNA, 49 nt, Mus musculus
cacgacugaguaagaacucaaaaagcagcaauggacaggaacuagagaa

SEQ ID NO: 123552 - RNA, 46 nt, Mus musculus
gaaagaauggauuuguuuaauuguauuuaguaccuuuggaggccag

SEQ ID NO: 123553 - RNA, 42 nt, Mus musculus
uuuucagcucaagugauggcugauuauuuuggaaggagagag

SEQ ID NO: 123554 - RNA, 46 nt, Mus musculus
aacacugaaaaagaggcaagccuggaugaaacaaaaauuggggaga

SEQ ID NO: 123555 - RNA, 42 nt, Mus musculus
uggucucgggugagccuuaaacagagacgaaggguggcaugc

SEQ ID NO: 123556 - RNA, 47 nt, Mus musculus
cuguuuaaggcucacccgagaccacaaauaugccaugauguuugcag

SEQ ID NO: 123557 - RNA, 46 nt, Mus musculus
acuuucuugguggcacaugccuuuaaucccagcacucaggaggcag

SEQ ID NO: 123558 - RNA, 45 nt, Mus musculus
aguacuacaucugguguuguaucuggcagccucgguucucgggag

SEQ ID NO: 123559 - RNA, 46 nt, Mus musculus
uauguguaugagcaaagaugccccaaaaagcuaugagccaccagaa

SEQ ID NO: 123560 - RNA, 46 nt, Mus musculus
gaagaaagauaaagaaggggaccguacaucugaggaaggcaagcag

SEQ ID NO: 123561 - RNA, 46 nt, Mus musculus
ugguauugcuacccugauugcaaacuacagcuauaccgugggccag

SEQ ID NO: 123562 - RNA, 43 nt, Mus musculus
uaccaagcuagccuaggcuaggcuauaugauucccagccucag

SEQ ID NO: 123563 - RNA, 42 nt, Mus musculus
ugcuagcuuuuguccuggaccaccuccucccacacacccaga

SEQ ID NO: 123564 - RNA, 45 nt, Mus musculus
ccauuaugcugagucuuggcuguagcacuacuguagaagcuggag

SEQ ID NO: 123565 - RNA, 46 nt, Mus musculus
uuaccaagauguaacuauagacuuauaccauuaaaugacuugaguu

SEQ ID NO: 123566 - RNA, 46 nt, Mus musculus
uacauuuuguagacuuaaaaguggucauuguguuuuuaaagacuaa

SEQ ID NO: 123567 - RNA, 45 nt, Mus musculus
caggaugcucaaggagcuucucaggacuccagcagccaucagcaa

SEQ ID NO: 123568 - RNA, 45 nt, Mus musculus
ucaguggugauugccgggcagccugaggugcucaguucacaagag

SEQ ID NO: 123569 - RNA, 50 nt, Mus musculus
augaacuggaggaccugauagaugaguugcuugagagggauggcggaucu

SEQ ID NO: 123570 - RNA, 66 nt, Mus musculus
uauaggccuguaacaggucugaaguguuguguaugucggguggcggugaggguaacaaucaguaua

SEQ ID NO: 123571 - RNA, 50 nt, Mus musculus
augaagcuccuuccaaccucagccaagcuuccaccuugcaggccaaccga

SEQ ID NO: 123572 - RNA, 41 nt, Mus musculus
accuucucgguuggccugcaagguggaagcuuggcugaggu

SEQ ID NO: 123573 - RNA, 42 nt, Mus musculus
cuacacuaggguuuuccuggaggcagcugcccacaugugcag

SEQ ID NO: 123574 - RNA, 46 nt, Mus musculus
ggacuauacugaguagcuagaaaacaggccacugugcaggccggca

SEQ ID NO: 123575 - RNA, 79 nt, Mus musculus
gaggaggaacauacucaggaagaggacagcaguggcaguaacgaggaugaggaugauagucaggaugaagaggaggagg

SEQ ID NO: 123576 - RNA, 46 nt, Mus musculus
ugaaggugaagaaggagaugaagaugaugacgacgaugguucugag

SEQ ID NO: 123577 - RNA, 45 nt, Mus musculus
accuguaaaugaaaagcaugaagagaaaaacaaaaugagcaguag

SEQ ID NO: 123578 - RNA, 46 nt, Mus musculus
ccaggaaauaucccuaccacccacccauugaugguacgucaugcag

SEQ ID NO: 123579 - RNA, 47 nt, Mus musculus
uccacaacucgucuuacccagggcaucggucgcagucaaaggacccu

SEQ ID NO: 123580 - RNA, 40 nt, Mus musculus
agcugcuggaugacuuuuuucaugaccagaguacagccac

SEQ ID NO: 123581 - RNA, 46 nt, Mus musculus
agugguuaaagugcccauugucaaucaccuggaauucuugagagau

SEQ ID NO: 123582 - RNA, 58 nt, Mus musculus
aaacgcaggaaacaauuggcugaggaagaaacaaaaauaauagacaaaggcaaagaag

SEQ ID NO: 123583 - RNA, 46 nt, Mus musculus
accgaaacacagcauaaccguaacaggaacuugaacagggcuaguu

SEQ ID NO: 123584 - RNA, 46 nt, Mus musculus
aaacaggaauauaauaaaggaagguggaagggaacagaugauagag

SEQ ID NO: 123585 - RNA, 28 nt, Mus musculus
ugccugacagcuauccaacaacccccuc

SEQ ID NO: 123586 - RNA, 47 nt, Mus musculus
acccccaccauccuuaggagagauuccucaggaacuacaguccccug

SEQ ID NO: 123587 - RNA, 45 nt, Mus musculus
ggggacuguaguuccugaggaaucucuccuaaggauggugggggu

SEQ ID NO: 123588 - RNA, 46 nt, Mus musculus
acgugugguacauagaaaagucuuaaggaacuuaagggcaguugag

SEQ ID NO: 123589 - RNA, 46 nt, Mus musculus
agagauggccacggcagaaucucuaguggaagaacucuccgaggau

SEQ ID NO: 123590 - RNA, 45 nt, Mus musculus
gacacccccauggacccugugacuuucauucagacuuugcccuca

SEQ ID NO: 123591 - RNA, 45 nt, Mus musculus
aggcaagacagggcuucauggucuagaaggagucguccucggagg

SEQ ID NO: 123592 - RNA, 99 nt, Mus musculus
ugaagcccugucuugccucuugguccuacuuuuuguggaugagccaaagcucaauacuagccgucuacaccgaguacugagaaaucucugcuaucaugc

SEQ ID NO: 123593 - RNA, 42 nt, Mus musculus
ucugggcaugauagcagagauuucucaguacucgguguagac

SEQ ID NO: 123594 - RNA, 46 nt, Mus musculus
gaaagugaguuaugcauugagacaccuaagcucuccacaagugaag

SEQ ID NO: 123595 - RNA, 71 nt, Mus musculus
gucaugagaaccguccccuggaucugcuccacaagauggaguccaaaaguuccaaucagcucuccuggcuc

SEQ ID NO: 123596 - RNA, 42 nt, Mus musculus
cguugaaucuggaauauguuaguccuacagccuaaagcagca

SEQ ID NO: 123597 - RNA, 32 nt, Mus musculus
gcagugguuccacuguccacauccacccccag

SEQ ID NO: 123598 - RNA, 45 nt, Mus musculus
ugcuaauacaagacagauggauuauaugacuucuauccaguagau

SEQ ID NO: 123599 - RNA, 55 nt, Mus musculus
augccacugcuggaggacugugaggagcaugggcugcaggccugcuuacugcccc

SEQ ID NO: 123600 - RNA, 45 nt, Mus musculus
augaauguuagccgaaaaggcaagaacuccgugaagucaguacca

SEQ ID NO: 123601 - RNA, 44 nt, Mus musculus
gcggaugacuggaugugacaacauguucaugagcugccccagug

SEQ ID NO: 123602 - RNA, 49 nt, Mus musculus
agacuccucucucucaucucaauugcucucccagaaaacaaaguaucag

SEQ ID NO: 123603 - RNA, 61 nt, Mus musculus
guggaggaaccacuguugcuggaguuaguuugcacuucugauacuuuguuuucugggagag

SEQ ID NO: 123604 - RNA, 57 nt, Mus musculus
ugccaccucaaacacaucuacuacuaccaccaccaccacuacugccacugcccccac

SEQ ID NO: 123605 - RNA, 46 nt, Mus musculus
ccaccauuacuguagcugcuucuaccacagugacuacccccacaac

SEQ ID NO: 123606 - RNA, 46 nt, Mus musculus
agaagagaaaauaagccagguagcagaggauucucggcagguauag

SEQ ID NO: 123607 - RNA, 45 nt, Mus musculus
uaauaauauuauucuauucugucuucuuauaagacacacacagag

SEQ ID NO: 123608 - RNA, 42 nt, Mus musculus
cuuuuuuuucucccuaauuauuaguaucuacaagagccccau

SEQ ID NO: 123609 - RNA, 46 nt, Mus musculus
guggucugugguugcuccucagguaggccaucaggagagagggucu

SEQ ID NO: 123610 - RNA, 46 nt, Mus musculus
uuugggcauucccacuuccuacauuuuauaucaugccuuuccccuu

SEQ ID NO: 123611 - RNA, 46 nt, Mus musculus
gaaccugggagaaagaggaaaaggggaaaggcaugauauaaaaugu

SEQ ID NO: 123612 - RNA, 46 nt, Mus musculus
uaccuuguaugcuuuugcauuacguuugcuaaaugaaugccucuag

SEQ ID NO: 123613 - RNA, 46 nt, Mus musculus
agaccaaauuggccuugaacucacagagaucccccuugccccuguc

SEQ ID NO: 123614 - RNA, 42 nt, Mus musculus
ccagucggagucuucuaaccagucagagacaucuguccggag

SEQ ID NO: 123615 - RNA, 46 nt, Mus musculus
aguaucuugagcacuaggagauggcugguccacauccaugggcgau

SEQ ID NO: 123616 - RNA, 46 nt, Mus musculus
guucacaagauuauaaauguagcaucagccaagacaacauaggaag

SEQ ID NO: 123617 - RNA, 45 nt, Mus musculus
gagccuugaagaauaguuaggauuugguuagaggacaaaagugaa

SEQ ID NO: 123618 - RNA, 41 nt, Mus musculus
aauaaacuuccagagaggauagaaaaaaauaacaaccaugg

SEQ ID NO: 123619 - RNA, 48 nt, Mus musculus
uaucuaguaaucucagauggaacaccacagggagagaaggagaaagag

SEQ ID NO: 123620 - RNA, 46 nt, Mus musculus
gauuccuccaguucuuuuaaacauuccccuagcaugucccacaguu

SEQ ID NO: 123621 - RNA, 42 nt, Mus musculus
uacagccugcugucgaggccuucuuuuugguccaugccacag

SEQ ID NO: 123622 - RNA, 48 nt, Mus musculus
gcacacaucaaggaugaaccuccuccacucucccccgcccccuuaacc

SEQ ID NO: 123623 - RNA, 45 nt, Mus musculus
auaucuucuuuccggagcccuucguccaaacgcuccagcucuugg

SEQ ID NO: 123624 - RNA, 44 nt, Mus musculus
aaucgauucuucauuucuucaggagauuugcgaugcagcucacg

SEQ ID NO: 123625 - RNA, 46 nt, Mus musculus
ccuuguuccguaccucaccuggugaccgggucaccuacaccaucaa

SEQ ID NO: 123626 - RNA, 27 nt, Mus musculus
aggugguugggguuacagugggaagau

SEQ ID NO: 123627 - RNA, 46 nt, Mus musculus
uaccaucgacauugaugaucuaaaaucuaacacugaguaccacaag

SEQ ID NO: 123628 - RNA, 46 nt, Mus musculus
cagauccagugguuuuggagagcauugcguuccuuugaccaagcag

SEQ ID NO: 123629 - RNA, 47 nt, Mus musculus
cuugaagguaugaauggcauucagaaguuucagauucaucgagauga

SEQ ID NO: 123630 - RNA, 46 nt, Mus musculus
cuaccauuguuggaccuggggagggggguggauuuaaaagauccag

SEQ ID NO: 123631 - RNA, 61 nt, Mus musculus
aggucccuguaaaggcuacugccuucuuaacacaugggguggggaucauggacggcaugga

SEQ ID NO: 123632 - RNA, 46 nt, Mus musculus
aacagugugcuccucagauucuguguucagaaggauuugcugcauu

SEQ ID NO: 123633 - RNA, 46 nt, Mus musculus
ugugcuuggaauguguugaugugcacagcuaaugauucaaugcgag

SEQ ID NO: 123634 - RNA, 46 nt, Mus musculus
ucagugaguucuaggcugugccaauggggaggaagcccgggguagg

SEQ ID NO: 123635 - RNA, 77 nt, Mus musculus
cugccaucagaaaaacucaagaaacacaacgacaagaaaaaaaggaacagcgccaagccgaaaaguuaguggaagcu

SEQ ID NO: 123636 - RNA, 45 nt, Mus musculus
gggucccuacuaggcagccaagcaagcccugcagcagcgccguga

SEQ ID NO: 123637 - RNA, 46 nt, Mus musculus
cuucauggaugcuagcaagcacuucaccacacuccaggcccauuac

SEQ ID NO: 123638 - RNA, 42 nt, Mus musculus
ugagugaguguguguguguguguguguguguguagcagucag

SEQ ID NO: 123639 - RNA, 44 nt, Mus musculus
uagccagcaaggggggagacggggagaagcgcuucagccaagga

SEQ ID NO: 123640 - RNA, 24 nt, Mus musculus
ccaaaagggaaagcaaguucagau

SEQ ID NO: 123641 - RNA, 45 nt, Mus musculus
ucccagaggugucaaacaaguuuaggaagguggaacaaugcagac

SEQ ID NO: 123642 - RNA, 48 nt, Mus musculus
cacaaccauccgcaacaacaucugacucccucuucuggagugucugaa

SEQ ID NO: 123643 - RNA, 45 nt, Mus musculus
auuaguugcuuuuuuaaguaacuguaaacuuuuaguauuccaaga

SEQ ID NO: 123644 - RNA, 46 nt, Mus musculus
gcuuggacuaauauaauacaagagagaaaauaaaaucuguugucag

SEQ ID NO: 123645 - RNA, 46 nt, Mus musculus
aagagcaccacagucaucuauuggauggaacacagggcccccaaug

SEQ ID NO: 123646 - RNA, 54 nt, Mus musculus
aagacuucugucuuuauuagacuaacccagcugaggggagaaauaggaaggggu

SEQ ID NO: 123647 - RNA, 53 nt, Mus musculus
aacagagcuguccucuccuugggguucuucauggcaauagacuccacugcacc

SEQ ID NO: 123648 - RNA, 46 nt, Mus musculus
agccuucaccauuucuuucuuucgcuugucauacuccugugcaagu

SEQ ID NO: 123649 - RNA, 38 nt, Mus musculus
gcuucucaaucuccacuucguugugguagaguuuaaag

SEQ ID NO: 123650 - RNA, 45 nt, Mus musculus
aagauaaauuaguacaauaguagacuuuaggcucagaggauccca

SEQ ID NO: 123651 - RNA, 45 nt, Mus musculus
gauuuugugggauguauucucuuuugcuuugauguacugaggccu

SEQ ID NO: 123652 - RNA, 45 nt, Mus musculus
ccuuuacguuucuuauaauguuucugagcauuuugaagagacuuc

SEQ ID NO: 123653 - RNA, 42 nt, Mus musculus
uuaccugguucuccuccagggucaagucucugcccugacucu

SEQ ID NO: 123654 - RNA, 45 nt, Mus musculus
cuaaagggcucugguagacccgccuaaagaggggcaggaugagca

SEQ ID NO: 123655 - RNA, 46 nt, Mus musculus
uggaacuuugggcuugaagauccauucauuguuaagagcccugucg

SEQ ID NO: 123656 - RNA, 45 nt, Mus musculus; identical to SEQ ID NO: 54689

SEQ ID NO: 123657 - RNA, 48 nt, Mus musculus
gacccccagccugagcacccacuccgggcugaccuagcugaagaauac

SEQ ID NO: 123658 - RNA, 46 nt, Mus musculus; identical to SEQ ID NO: 54696

SEQ ID NO: 123659 - RNA, 46 nt, Mus musculus
agauggcggccagcaggaggcugaugaaggagcuugaagagauccg

SEQ ID NO: 123660 - RNA, 46 nt, Mus musculus
uuguucgugugacugcauguuauauguguguagguaccgucagaga

SEQ ID NO: 123661 - RNA, 45 nt, Mus musculus
agaacuacucugagagcagugagcaugugcaaggaacugugucau

SEQ ID NO: 123662 - RNA, 46 nt, Mus musculus
ggucuacauagagaguuucuaggcauccagggcuauccagugagau

SEQ ID NO: 123663 - RNA, 45 nt, Mus musculus
caugccuuuaaugcuagcacuugggaggcagagacagauggaucu

SEQ ID NO: 123664 - RNA, 48 nt, Mus musculus
aaagaacuuaagaaagaacuuaggaagaaagaaagaaagaaagaaaga

SEQ ID NO: 123665 - RNA, 46 nt, Mus musculus
gguguaaugugauaucaaagugagggugggagggcacaaaggagga

SEQ ID NO: 123666 - RNA, 42 nt, Mus musculus
auggugaggugcaccuuuaauucuaguacuugggaggcagau

SEQ ID NO: 123667 - RNA, 45 nt, Mus musculus
ugugcaugugaaugcaggaacccaggaaggcuaaacgugccagau

SEQ ID NO: 123668 - RNA, 92 nt, Mus musculus
guuuguacacaagaaugcuggugccaaguggaggacaaagaugucggauccccaggagcugguauuauagauaguuagaagcugccugagau

SEQ ID NO: 123669 - RNA, 46 nt, Mus musculus
auguccaaaucaguuaaagacaugaugacaaaaggaagcuauagac

SEQ ID NO: 123670 - RNA, 46 nt, Mus musculus
gggcacauggagaaaaaggccuccaagacaaaccccaaggccaaga

SEQ ID NO: 123671 - RNA, 82 nt, Mus musculus
ggagucauaucuaagcacuacuggccuagggcagagguugucaagguaugccagaggucaaagaggguuucccagaggaagg

SEQ ID NO: 123672 - RNA, 42 nt, Mus musculus
uuuuuuuccugcccaucauacacuagguuagguggcucucuu

SEQ ID NO: 123673 - RNA, 54 nt, Mus musculus
uagugaaggcuucaguaguugggaggcagcgguaagguguggaagaaacggaac

SEQ ID NO: 123674 - RNA, 74 nt, Mus musculus
aggacuaagaaccuguaaaaggaaccucagccugagacuuuuagagcacggcacccgccccccuaagcccuuga

SEQ ID NO: 123675 - RNA, 45 nt, Mus musculus
gucggaccccagcuccauggugggcccgagggcugggccagagau

SEQ ID NO: 123676 - RNA, 45 nt, Mus musculus
ucgccagcggcgaguuuguggguggauccggguagccagugguga

SEQ ID NO: 123677 - RNA, 45 nt, Mus musculus
gggaagaauaugggauggcugguauuuuguggaugccucacgaag

SEQ ID NO: 123678 - RNA, 46 nt, Mus musculus
cccaggggacuguucuuugguaggcuucuuuucuccacuccaguag

SEQ ID NO: 123679 - RNA, 45 nt, Mus musculus
cuguuuggaacuugaauuacucacccaagugauucuuaggcccag

SEQ ID NO: 123680 - RNA, 49 nt, Mus musculus
cagugcuuagaguuugggguuugagcaccuuucugucuggguuaucugu

SEQ ID NO: 123681 - RNA, 42 nt, Mus musculus
auggcucacaaccauccauaaugagaucugacgcccccuucu

SEQ ID NO: 123682 - RNA, 42 nt, Mus musculus
ucugugagccuuuaacugagaaaacaggcauugauggccuaa

SEQ ID NO: 123683 - RNA, 70 nt, Mus musculus
ugagcuacucugcauguguauucauugguggggucagauuuagagauuuagauuuagauuuuauuuagau

SEQ ID NO: 123684 - RNA, 49 nt, Mus musculus
uccauuuggaugcuucccagguugauagaucugagguggcuagaaguuu

SEQ ID NO: 123685 - RNA, 46 nt, Mus musculus
uaaaccugaaguuauccacuuccacggcaaaggguggcugccaguc

SEQ ID NO: 123686 - RNA, 52 nt, Mus musculus
uggaaguggauaacuucagguuuacuccccgaauccagagguugaaugagcu

SEQ ID NO: 123687 - RNA, 45 nt, Mus musculus
agcaucuagugugugugugugugugugugugugugugugugugua

SEQ ID NO: 123688 - RNA, 42 nt, Mus musculus
ggagcagggaugaggccaaguuuagaaagauaagggguucag

SEQ ID NO: 123689 - RNA, 47 nt, Mus musculus
ucugggagauccagggcucauccuuaaagauucccaauguagaacgg

SEQ ID NO: 123690 - RNA, 45 nt, Mus musculus
accaauguuuuugccagguggguaguugagacgcugggccacacg

SEQ ID NO: 123691 - RNA, 45 nt, Mus musculus
acgcucucacuaugaacgcauuguuuaucccuaugaaauguacca

SEQ ID NO: 123692 - RNA, 26 nt, Mus musculus
ugacaggcuggccuagaaguuaccau

SEQ ID NO: 123693 - RNA, 44 nt, Mus musculus
ccaaguucaacaguuauggacgacgggcaaagagacuacagccu

SEQ ID NO: 123694 - RNA, 47 nt, Mus musculus
uucuucaguucuggauucuuuucaaugucuuccucuguggguuccgg

SEQ ID NO: 123695 - RNA, 109 nt, Mus musculus
gaagacauugaaaagaauccagaacugaagaaauuacagauauauggagcaggccccaagaugauggggcugggccuaauggccaaagauaagacucugcggaaaaaag

SEQ ID NO: 123696 - RNA, 77 nt, Mus musculus
cuacagauaaagaagggccugaguguccccccacuguggugguaaaggaggaauuagguggggaugucaagauggaa

SEQ ID NO: 123697 - RNA, 77 nt, Mus musculus
aaggcaaggaggaacugagucauagcccugagcccugcaccaagaugaccaugaggcuucgaaggaaccacagcaau

SEQ ID NO: 123698 - RNA, 23 nt, Mus musculus
gccuucccagucccaguucacau

SEQ ID NO: 123699 - RNA, 97 nt, Mus musculus
guagucagcuuuaaaggagucagccaucucuccaaagcucugcagaguauauucccggguagcuugcucaaagccaaaggcuucagggggccgcuua

SEQ ID NO: 123700 - RNA, 48 nt, Mus musculus
ugguacccacagaacuuguagagaaggaguuuuggcggcuggugaaua

SEQ ID NO: 123701 - RNA, 46 nt, Mus musculus
cuuuucaaaaugccaauuuuguuuccuuugguuauagaaccuguag

SEQ ID NO: 123702 - RNA, 58 nt, Mus musculus
caaauacuuauucaguauauugucuuuuugcuagugugugugugugugugugugugug

SEQ ID NO: 123703 - RNA, 46 nt, Mus musculus
uuuauuaauauguaaguacacuguagcugacuucagacacuccaga

SEQ ID NO: 123704 - RNA, 45 nt, Mus musculus
caauaugccagcaaaaggcugagaagaccauucccacauacagcc

SEQ ID NO: 123705 - RNA, 46 nt, Mus musculus
uuucaaaaugccaauuuuguuuccuuugguuauagaaccuguagua

SEQ ID NO: 123706 - RNA, 54 nt, Mus musculus
gugugcccauaaguggaagaaagagaacaguaaacaauuaaaauaaguugggag

SEQ ID NO: 123707 - RNA, 62 nt, Mus musculus
aacauuuggggcuauccauuucacaguccuauuuaaaagaguaagaauuuaccugcuaaacu

SEQ ID NO: 123708 - RNA, 53 nt, Mus musculus
uuaucuauguaaucaugaaauuuauucuagaggcuuugggugaggcgugccau

SEQ ID NO: 123709 - RNA, 46 nt, Mus musculus
ugacuuuauuuaagaagaaaaugugauggugauacaucaucaauag

SEQ ID NO: 123710 - RNA, 46 nt, Mus musculus
uaggguuaagacuuuuauuguuggggcuggaaagauggcucaaugg

SEQ ID NO: 123711 - RNA, 45 nt, Mus musculus
gauuaauccccugauccuggaauaacaggaggcuguaagcugcca

SEQ ID NO: 123712 - RNA, 46 nt, Mus musculus
ugugagccacaaugugguugcugggauuggaacuuaggaccuuugg

SEQ ID NO: 123713 - RNA, 45 nt, Mus musculus
ccaaucccagcaaccacauuguggcucacaaccauccguaccauu

SEQ ID NO: 123714 - RNA, 45 nt, Mus musculus
gguuguaagccaccaugugguugcugggauuggaacucaggaccu

SEQ ID NO: 123715 - RNA, 44 nt, Mus musculus
ucauuauuuugcuuucauagauccauggucaacugcagcccaaa

SEQ ID NO: 123716 - RNA, 49 nt, Mus musculus
caggaaaggggguaaaacagaaaauaaguacuugaaauaauaggaugaa

SEQ ID NO: 123717 - RNA, 46 nt, Mus musculus
guggccuaccuaguauaggaauaaaaauagauccacacaaagauag

SEQ ID NO: 123718 - RNA, 46 nt, Mus musculus
ugauuuuuauuuuggaauucuauaugcaaucaacuguaagaguuag

SEQ ID NO: 123719 - RNA, 46 nt, Mus musculus
uuugccuuucuguuaagucaguuuuggguuuuuugggggaggugug

SEQ ID NO: 123720 - RNA, 46 nt, Mus musculus
cuuuucucaugaggagcucauuugcaagauggcugccugcccugag

SEQ ID NO: 123721 - RNA, 45 nt, Mus musculus
aaaaguaagugguggugcuuuugauccgggauccuaggcugguaa

SEQ ID NO: 123722 - RNA, 45 nt, Mus musculus
guaauuuucacaugaugaauggguggcgacccauuaguggagcaa

SEQ ID NO: 123723 - RNA, 46 nt, Mus musculus
aaaaauuagaaguguuuauaaucaacaucuguagaagauuugagag

SEQ ID NO: 123724 - RNA, 46 nt, Mus musculus
agaagccacacuuuauucuuacaucuccacuaaccggcauggaguu

SEQ ID NO: 123725 - RNA, 46 nt, Mus musculus
aacugagacagcuagagcuacagguauugacagcacacuccuggag

SEQ ID NO: 123726 - RNA, 42 nt, Mus musculus
ugugagugggauguugaauggauauuaucaguguggccccug

SEQ ID NO: 123727 - RNA, 45 nt, Mus musculus
ccaacacagggccagacaacugugguaauauugaggauagcagcu

SEQ ID NO: 123728 - RNA, 50 nt, Mus musculus
cccuguguuggaacugccugaggcaacccgagccccacuggaggaacuua

SEQ ID NO: 123729 - RNA, 43 nt, Mus musculus
ccagaagugucuggacccucuucaagucuggaggcugcccagc

SEQ ID NO: 123730 - RNA, 49 nt, Mus musculus
aggcugggcagccuccagacuugaagaggguccagacacuucuggaggu

SEQ ID NO: 123731 - RNA, 46 nt, Mus musculus
ggccaaguaggcagagagcccugacuacuugcauguacgcaaggag

SEQ ID NO: 123732 - RNA, 44 nt, Mus musculus
agagcgccaugggagucggacacgaggccgagcccuagagagga

SEQ ID NO: 123733 - RNA, 45 nt, Mus musculus
aaagaggguacgaagcucaggaccagaagccgaggaaguccagga

SEQ ID NO: 123734 - RNA, 46 nt, Mus musculus
ucuccuccuccagcuccucuuccuccuggacuuccucggcuucugg

SEQ ID NO: 123735 - RNA, 46 nt, Mus musculus
gguggugagggggaagucucuccaccuacccgcccaccuccaagaa

SEQ ID NO: 123736 - RNA, 42 nt, Mus musculus
ggcggguagguggagagacuucccccucaccaccauccccaa

SEQ ID NO: 123737 - RNA, 45 nt, Mus musculus
cccuggauuugucucuggaauggugcuggcccagccccaguagau

SEQ ID NO: 123738 - RNA, 42 nt, Mus musculus
uuuuaaaugaauuuuguugggguugagcagggcugccuaugg

SEQ ID NO: 123739 - RNA, 46 nt, Mus musculus
uucucucuaaccuuggaaaagauauccuuccuggucuucccccaag

SEQ ID NO: 123740 - RNA, 44 nt, Mus musculus
ucagaccauccuugguguuucuccauuaguucuuccugccccua

SEQ ID NO: 123741 - RNA, 41 nt, Mus musculus
aaaauaauccuucugaacauauaaaugaggaagggcaaagu

SEQ ID NO: 123742 - RNA, 42 nt, Mus musculus
uugauacuuuacuaccacucuaguccaggaagcuaggcacag

SEQ ID NO: 123743 - RNA, 46 nt, Mus musculus
aucucucucccuccuccccuguuccccauucuccucucuuacugag

SEQ ID NO: 123744 - RNA, 45 nt, Mus musculus
uggaaguaagagcagguaagauugcaaauuugaaacuagccugag

SEQ ID NO: 123745 - RNA, 46 nt, Mus musculus
ugacuucuugcagugcauguguaaucaauuaucaucaaggcaaagg

SEQ ID NO: 123746 - RNA, 46 nt, Mus musculus
aaugaaaaaguccacuuuucuauuuuuauuuuucuuugcuucugag

SEQ ID NO: 123747 - RNA, 45 nt, Mus musculus
caaagcagagauuucuguguuguuuacugcuguaacuccaguguc

SEQ ID NO: 123748 - RNA, 42 nt, Mus musculus
accugcaggacuucuguauuuccuguuuuuccuaccugagac

SEQ ID NO: 123749 - RNA, 48 nt, Mus musculus
auuagacagcuauugguuaccacgaacaaaugaaugccgcaauugcac

SEQ ID NO: 123750 - RNA, 45 nt, Mus musculus
uuagaaugcagguaggaauucugcuguuuuaguaaacuggaggua

SEQ ID NO: 123751 - RNA, 46 nt, Mus musculus
auauagccaaagcugaccucaaacuaugauccucuugccucaaccc

SEQ ID NO: 123752 - RNA, 42 nt, Mus musculus
cacagccaagagauguaccucacuaauguucuaggccaggua

SEQ ID NO: 123753 - RNA, 46 nt, Mus musculus
uccuaucaggacuuucuacuccccauuaauuucuuacugcuuuuau

SEQ ID NO: 123754 - RNA, 45 nt, Mus musculus
gaugauugaaagucagcggcauugcugaaaugcccaccccagcau

SEQ ID NO: 123755 - RNA, 58 nt, Mus musculus
ccccaaagguuugaucuccaguauucuagauccugucaaguugacagucaguauuaac

SEQ ID NO: 123756 - RNA, 46 nt, Mus musculus
uauccccucuucuuugauagucaaaaagguuucuuuugacucacag

SEQ ID NO: 123757 - RNA, 46 nt, Mus musculus
aucuggaaucuaaauucuagauaauccugagcagaucugcccagau

SEQ ID NO: 123758 - RNA, 69 nt, Mus musculus
ugcucaggacuauuuuauggucaaugauggcugucuguacugaagaucuccccacagaaaaccccuuug

SEQ ID NO: 123759 - RNA, 46 nt, Mus musculus
aagugauggccuauuaggccaucuuuugauacauaugcaacuagag

SEQ ID NO: 123760 - RNA, 42 nt, Mus musculus
uacccauacugaccuauguuuuauuucuauuacaagacacuu

SEQ ID NO: 123761 - RNA, 44 nt, Mus musculus
cagaguguggaugcuaggaacuaaacugauccucuggaagaaca

SEQ ID NO: 123762 - RNA, 46 nt, Mus musculus
ucauaagguccagguucuuuccagagcacugcaaaaagguccacau

SEQ ID NO: 123763 - RNA, 46 nt, Mus musculus
uacacuguagcugucuucagacacacacuagaagagggcaucagau

SEQ ID NO: 123764 - RNA, 46 nt, Mus musculus
caguauggaggauuaaguuuccaacacaugaacuuccggaggacac

SEQ ID NO: 123765 - RNA, 46 nt, Mus musculus
uuuagaaaaucaccucagagauaagauguuacguaaaaugggaguu

SEQ ID NO: 123766 - RNA, 45 nt, Mus musculus
auuugcacauuaacacauucacauuuuuguugggcccaaccaccc

SEQ ID NO: 123767 - RNA, 48 nt, Mus musculus
ucuaaguauccuggcuaguuauuugauagaauucagguuuguguaagu

SEQ ID NO: 123768 - RNA, 51 nt, Mus musculus
ugaguuuucagaauuuuuaaacuuuuuggaagaguuucaauauauacuuca

SEQ ID NO: 123769 - RNA, 80 nt, Mus musculus
gcaacaggugcuuucagccucugagccaucucuacagcccuauguuuucauuuuuuguuuguuuuguuuuucaagauaag

SEQ ID NO: 123770 - RNA, 45 nt, Mus musculus
agaaaaaagucagaagagagcaccgggccucuggaucugggguua

SEQ ID NO: 123771 - RNA, 46 nt, Mus musculus
uccccucccuuucaaauaaauacucuuccccagauuauccacagau

SEQ ID NO: 123772 - RNA, 46 nt, Mus musculus
uggugcaugacuacauucacagcauucaggaggauugccacaaguu

SEQ ID NO: 123773 - RNA, 46 nt, Mus musculus
ccauaucugccucuacccaacauuuucucucucugagacguacuaa

SEQ ID NO: 123774 - RNA, 46 nt, Mus musculus
uaugaggaggagguagaacucaucucugaagacucaguugaagaag

SEQ ID NO: 123775 - RNA, 66 nt, Mus musculus
ugaagaugaugaugguaaugagggggacaaugagggcagugaugaugaugaugaugacaaugaggg

SEQ ID NO: 123776 - RNA, 46 nt, Mus musculus
agggagcguugccgcaaauccagaugacaacagugaugacccagag

SEQ ID NO: 123777 - RNA, 45 nt, Mus musculus
uggugccugagagguugggggguuguuuuuaaauagggcagagac

SEQ ID NO: 123778 - RNA, 46 nt, Mus musculus
gacauacaguauucugugaacauaagcacaagaaucacauggacau

SEQ ID NO: 123779 - RNA, 48 nt, Mus musculus
aaagaguagcauugcaacauuuaaaaagaaaauggaucccagacaaua

SEQ ID NO: 123780 - RNA, 45 nt, Mus musculus
ugcaugggccagaagcccaugacugaaggggagauguguggaaga

SEQ ID NO: 123781 - RNA, 41 nt, Mus musculus
aggaggagaaggaagcagaggaaggcgaaggagagccgaga

SEQ ID NO: 123782 - RNA, 90 nt, Mus musculus
agggugggggccccagauguuaguugguccgaagaggaaggaggaggcuaucauaauaguggaagaugaggaugaggaugacaaggagag

SEQ ID NO: 123783 - RNA, 45 nt, Mus musculus
guugaacucuccagaguaccuagagcccagaccauggggucagag

SEQ ID NO: 123784 - RNA, 46 nt, Mus musculus
ccagacuucacagguguuucuugaggcuguuugagaagccaagagc

SEQ ID NO: 123785 - RNA, 60 nt, Mus musculus
gauucaguaaaugaaaacaaacugaaaaugcaggguuuuuaauaauaacagcugaggaag

SEQ ID NO: 123786 - RNA, 42 nt, Mus musculus
gagcugccaugugguugcugggauuugaacucagaaccuuug

SEQ ID NO: 123787 - RNA, 45 nt, Mus musculus
uguuauuuuuguguuuuuuauuuuguuuuguuuuggcuuugaggg

SEQ ID NO: 123788 - RNA, 46 nt, Mus musculus
uagcauggcauagacaauaacaaacaguaaagauccugucucaaag

SEQ ID NO: 123789 - RNA, 36 nt, Mus musculus
cuaacuaggauaugugcaguuaucuggauggauagg

SEQ ID NO: 123790 - RNA, 45 nt, Mus musculus
acguguggguguauugguguuggguauaugugugaaaguggaugu

SEQ ID NO: 123791 - RNA, 45 nt, Mus musculus
ugaaagagaucauagguacaucuaagacagguaugagugcuccaa

SEQ ID NO: 123792 - RNA, 46 nt, Mus musculus
cgcgcacaugugcgugugugugugugugugugugugugugugugug

SEQ ID NO: 123793 - RNA, 32 nt, Mus musculus
ccuuuucuuuagggucuuagcagagaucuagg

SEQ ID NO: 123794 - RNA, 42 nt, Mus musculus
uuugaaacagaguuuuguccuuaacaguucaaauggcaagau

SEQ ID NO: 123795 - RNA, 43 nt, Mus musculus
cuaccauggaucugauggagggaauuuuucccaaagaugagua

SEQ ID NO: 123796 - RNA, 46 nt, Mus musculus
ggcagagacauacugagaauuucuuuuucccugaauuuggccagaa

SEQ ID NO: 123797 - RNA, 45 nt, Mus musculus
gacucauauuuuacuaaggccucauacgcuaugccauugauagag

SEQ ID NO: 123798 - RNA, 44 nt, Mus musculus
aagagagagaaagaauauguauaugagaaugccaggaaaggaga

SEQ ID NO: 123799 - RNA, 46 nt, Mus musculus
cuguauuuagugcguuuguuguucugauuauaauguguugggagga

SEQ ID NO: 123800 - RNA, 46 nt, Mus musculus
cuggaacaaauuugaaugguuggcauauuuucugguugaaguagau

SEQ ID NO: 123801 - RNA, 45 nt, Mus musculus
acuaucugagucuguauucacugacucaugggaguaggugucauc

SEQ ID NO: 123802 - RNA, 51 nt, Mus musculus
uauuguuuugggccauguugcuaaaugaugaauugccuuugcugcaggcaa

SEQ ID NO: 123803 - RNA, 46 nt, Mus musculus
gcaauuucuguuuaggaccaugccacugagguuggggguuuguggu

SEQ ID NO: 123804 - RNA, 46 nt, Mus musculus
uggaggcugcauaauaacauguuacuugguaaaaugcgcaggagac

SEQ ID NO: 123805 - RNA, 46 nt, Mus musculus
uaguagaaagguuaguauuugugaagauuaaggauaagaagggggc

SEQ ID NO: 123806 - RNA, 46 nt, Mus musculus
guuuaucuaauacuaauaauucaaucagcuauaaauggggagaaag

SEQ ID NO: 123807 - RNA, 46 nt, Mus musculus
uggagcugacugaccacaucuuuaucuaaauaaggacaacagagug

SEQ ID NO: 123808 - RNA, 41 nt, Mus musculus
gcuucugccaaguggauuuuggaaguaacagagauugauua

SEQ ID NO: 123809 - RNA, 42 nt, Mus musculus
aacuuacuccuauagaggaacaaaacugaauucaugcgaggg

SEQ ID NO: 123810 - RNA, 91 nt, Mus musculus
uaggugccaaauaaaugguuggugaaugaauacacuggugaauugauagaugggugagggaacagacagauaaaccaguccuuggguagau

SEQ ID NO: 123811 - RNA, 45 nt, Mus musculus
guauaaacaaacagacaaacaaaaaguuacaugaaacaucagaaa

SEQ ID NO: 123812 - RNA, 46 nt, Mus musculus
acgguucacagcagagcagaaacuaaaguccuauucugagccagag

SEQ ID NO: 123813 - RNA, 46 nt, Mus musculus
aguucuccgaugugcacuuucugaagucuuaccacgggagccagca

SEQ ID NO: 123814 - RNA, 86 nt, Mus musculus
cccuccauucucagacuuggccaguaugcagcacuuuaucacccugccccaugugcaaccccggggggaccauagaauggaaacua

SEQ ID NO: 123815 - RNA, 55 nt, Mus musculus
ugggagauccaauuuugggccugugugguauguuccugacaagaaaaaagccccu

SEQ ID NO: 123816 - RNA, 67 nt, Mus musculus
ggccaucauguuucauaccuaggguuccugguaacaguaguaaaaguccaaggccggaggauaaugu

SEQ ID NO: 123817 - RNA, 50 nt, Mus musculus
agacucagcuuacggcuccuuuuccacaugcuccagcaccccugaccaca

SEQ ID NO: 123818 - RNA, 45 nt, Mus musculus
uuuaauuuuauauccagccacuuugcugaaguuguuuaucaccug

SEQ ID NO: 123819 - RNA, 46 nt, Mus musculus
gauaccauuaguucccuuuguuggguccugcuguuguccuggacag

SEQ ID NO: 123820 - RNA, 41 nt, Mus musculus
ccucaguacaggggaaugccagggccaagaagugggguuug

SEQ ID NO: 123821 - RNA, 46 nt, Mus musculus
gagccuaauuucuaaguggauuucaaacguucuuaucaccugagaa

SEQ ID NO: 123822 - RNA, 41 nt, Mus musculus
uauuagauucagugcaucugguuuuauguggagguccuuga

SEQ ID NO: 123823 - RNA, 46 nt, Mus musculus
aaugagaucuggcgcccucuucuggagugucugaaggcagcuacag

SEQ ID NO: 123824 - RNA, 46 nt, Mus musculus
cccuccagggcagacaccucuccucugcugaggaaggugcccggau

SEQ ID NO: 123825 - RNA, 45 nt, Mus musculus
cuggcugaagaaaaaggccugaaacagggccugucccagaagaug

SEQ ID NO: 123826 - RNA, 45 nt, Mus musculus
uucuugauuuucuuguguuuuacauauuuuauguucgguguucua

SEQ ID NO: 123827 - RNA, 42 nt, Mus musculus
uccuugggugcauucgcuagcuucuccauugggggcccugug

SEQ ID NO: 123828 - RNA, 46 nt, Mus musculus
uugagacaaaguuucacuaggcccagguuggccucaaacaugagau

SEQ ID NO: 123829 - RNA, 46 nt, Mus musculus
ugucuccuucuauuuccucuccucuccucuuuucuccuuuccagug

SEQ ID NO: 123830 - RNA, 45 nt, Mus musculus
ugccucugccucccaagugcugggaucaaaggcgugcgcaaccac

SEQ ID NO: 123831 - RNA, 46 nt, Mus musculus
cucuauuaagugguauaaguaauagaucagauaaauuggcuaagga

SEQ ID NO: 123832 - RNA, 45 nt, Mus musculus
ugaacccagggccucauacaugaagacaagugcuuucccacagaa

SEQ ID NO: 123833 - RNA, 47 nt, Mus musculus
gggagccacauaacuccauuugaaacuaccaauuaagauccugaaga

SEQ ID NO: 123834 - RNA, 42 nt, Mus musculus
aaugguuaggcuuuauaggaaaagagaaacuggggacaagaa

SEQ ID NO: 123835 - RNA, 46 nt, Mus musculus
caagguaugguggagaagguuuauugucuaaagaacugccagagga

SEQ ID NO: 123836 - RNA, 45 nt, Mus musculus
guggccuuucccaaccuguuaaauaccccacccccggccugaguc

SEQ ID NO: 123837 - RNA, 44 nt, Mus musculus
agagagauuuguauuagccuaacaaguuaccuaccccccucccc

SEQ ID NO: 123838 - RNA, 42 nt, Mus musculus
guggaacagaacuauucaucucacaauagccaggaagcagag

SEQ ID NO: 123839 - RNA, 45 nt, Mus musculus
guauccugucuuaguucaaggacagagcaaagagauggccccaga

SEQ ID NO: 123840 - RNA, 46 nt, Mus musculus
aguacacuguagcugucuucaaacacuccagaagagggggucagau

SEQ ID NO: 123841 - RNA, 46 nt, Mus musculus
aaaugauucuuaguuucuguuauguuugauguuucaagugguggca

SEQ ID NO: 123842 - RNA, 47 nt, Mus musculus
gcagcaaaaugccugauccugguuguauaucuagucuguaggucuuc

SEQ ID NO: 123843 - RNA, 45 nt, Mus musculus
guugugaggcaccaugugguugcugggauuugaacuccggaccuu

SEQ ID NO: 123844 - RNA, 46 nt, Mus musculus
gggccucagaccagcucacgguuacugccugguugguggcucagua

SEQ ID NO: 123845 - RNA, 42 nt, Mus musculus
cuugcuuaacaagcaaaaaaguuccaagauuccacccccagu

SEQ ID NO: 123846 - RNA, 45 nt, Mus musculus; identical to SEQ ID NO: 85501

SEQ ID NO: 123847 - RNA, 41 nt, Mus musculus
guggugcaagccuuuaauaccagcacuugggaggcagagac

SEQ ID NO: 123848 - RNA, 46 nt, Mus musculus
uauuacauuuauuguguguauguguuugugagagagagagagagaa

SEQ ID NO: 123849 - RNA, 44 nt, Mus musculus
ugcuugcaguugcguguaaaaaacuacauguacuacgggaagga

SEQ ID NO: 123850 - RNA, 42 nt, Mus musculus
uuguguggguauauguuucugucugucugucugucugucugu

SEQ ID NO: 123851 - RNA, 46 nt, Mus musculus
ugucugaggggcacagagcuuauucccccauucccaagagaccacu

SEQ ID NO: 123852 - RNA, 46 nt, Mus musculus
gucucaacccugagcucagugucugaauaaugaacagcagcucucc

SEQ ID NO: 123853 - RNA, 50 nt, Mus musculus
uaaaccaaauauuuaaaaaauguguuucauguugccucucucugaccuca

SEQ ID NO: 123854 - RNA, 50 nt, Mus musculus
ucuuugcuucacugaacucugaauuaucugcuccuguuaguaguuuucca

SEQ ID NO: 123855 - RNA, 31 nt, Mus musculus
aggccuggcaguucauuuccgccugguccug

SEQ ID NO: 123856 - RNA, 45 nt, Mus musculus
gaggucagcagauuuuucagaggaugaauauguccuuauggagag

SEQ ID NO: 123857 - RNA, 46 nt, Mus musculus
aaaugccugaaagccaucagugccugaaauccaucagcacacaguu

SEQ ID NO: 123858 - RNA, 42 nt, Mus musculus
cugauguugcagccaguuuacuuugagccuuuggggggaguu

SEQ ID NO: 123859 - RNA, 59 nt, Mus musculus
uggaagaggauaggcagacgagggaccaagugaagaggagaauagaaugaguaguauag

SEQ ID NO: 123860 - RNA, 62 nt, Mus musculus
gagagccauguuuggagaugcuggauuagagguuacccagagaggaauaagagaaaggacaa

SEQ ID NO: 123861 - RNA, 47 nt, Mus musculus
uguauucuuuucucuuugcaccuaggguuguccaugaggcagguggc

SEQ ID NO: 123862 - RNA, 42 nt, Mus musculus
uucuuauaucuagcugauguuggaaacuuacaugccccgauu

SEQ ID NO: 123863 - RNA, 46 nt, Mus musculus
cucuaggagaacauccagagacaugcugagucucaggccccaacaa

SEQ ID NO: 123864 - RNA, 45 nt, Mus musculus
caauguauucugaagugcuggagaggcugggauuuugauguguga

SEQ ID NO: 123865 - RNA, 45 nt, Mus musculus
aguacacuguagcugucuucagaaaccccagaagagggccucaga

SEQ ID NO: 123866 - RNA, 42 nt, Mus musculus
uuuuaagauugcuacugcaaccugacacaaacaacauaagga

SEQ ID NO: 123867 - RNA, 45 nt, Mus musculus
acaaaaaauaauuauacugccaaaucuuuggaaucagaagacaga

SEQ ID NO: 123868 - RNA, 45 nt, Mus musculus
uagucuugccuuuccuccaugucuguagaugcuuacuugggaauu

SEQ ID NO: 123869 - RNA, 45 nt, Mus musculus
uaacaauagaagagacccuucccuugcucagcugagugaacaaga

SEQ ID NO: 123870 - RNA, 45 nt, Mus musculus
uuuuuuuuuuuuuugauuaauucuuuugucuaauaauacugaggc

SEQ ID NO: 123871 - RNA, 45 nt, Mus musculus
ggggcagagagagacagagagagagacagagagagagacagagag

SEQ ID NO: 123872 - RNA, 46 nt, Mus musculus
ggugcacucugguaggauuugcugaaggaggcagagguaggaagau

SEQ ID NO: 123873 - RNA, 46 nt, Mus musculus
uggacauuauugauauuuggggcuaaauuauucuuuaucaugagau

SEQ ID NO: 123874 - RNA, 46 nt, Mus musculus
ugguaauuauuugccauauuauuuaaaaaugacaaagggcucggga

SEQ ID NO: 123875 - RNA, 46 nt, Mus musculus
ugcucuuuuauaucagauaguccuggcucgcucucagcuuuuuaga

SEQ ID NO: 123876 - RNA, 89 nt, Mus musculus
cuccuaauguccauauuagcccucaucuucaucaugggcaacagcgcaaaggaggcccugguguggaaagugcuggggaaguuagggau

SEQ ID NO: 123877 - RNA, 44 nt, Mus musculus
cuguagccccgagcacacccgaagaauaccugagcggcccggag

SEQ ID NO: 123878 - RNA, 46 nt, Mus musculus
gccggaacgcaaaggcagcugaagagaaucgcaacaaucgcaagag

SEQ ID NO: 123879 - RNA, 46 nt, Mus musculus
aagcccuuucccaggcaagcugacuugcgcaaggagucgccgcccg

SEQ ID NO: 123880 - RNA, 49 nt, Mus musculus
cagagccuguacccugcuacguguucgccuggucaauuaagcgggggca

SEQ ID NO: 123881 - RNA, 51 nt, Mus musculus
aagcagcuggaugaaagugagcuguugccauggggacugagagacagaaag

SEQ ID NO: 123882 - RNA, 46 nt, Mus musculus
caagcagcagcagcaggugagaguggcauuuaagaaaugcgccuug

SEQ ID NO: 123883 - RNA, 46 nt, Mus musculus
gaaagauuuuacauguguuccguuuuugaaaaaaugguuuggugug

SEQ ID NO: 123884 - RNA, 46 nt, Mus musculus
gugggcaugcaagcaucucugugcccuuaaggucaguacccaggag

SEQ ID NO: 123885 - RNA, 46 nt, Mus musculus
acgggcaugcaagcaucucugugcccuuaaggucaguacccaggag

SEQ ID NO: 123886 - RNA, 50 nt, Mus musculus
ugagcagagacagucuaugguuuuagagcuuuauuguagaauggcaggga

SEQ ID NO: 123887 - RNA, 45 nt, Mus musculus
cuaauccuccucgugugugugugugugugugugugugugugugug

SEQ ID NO: 123888 - RNA, 45 nt, Mus musculus
cccaaccccaacugauauauuuacaacucagucucuaugccugag

SEQ ID NO: 123889 - RNA, 46 nt, Mus musculus
gagcuucugagaaagggauuguuuuuucccagggauuagcccccau

SEQ ID NO: 123890 - RNA, 46 nt, Mus musculus
cagcacucacaugguggcucacaacuguguuuaacuccagcuccag

SEQ ID NO: 123891 - RNA, 46 nt, Mus musculus
gggugaagagauucuaggagccagagaaagaaagaaaggaagggac

SEQ ID NO: 123892 - RNA, 45 nt, Mus musculus
gcacuucuugguaucagcaauagugucaggguuuggugucugcug

SEQ ID NO: 123893 - RNA, 41 nt, Mus musculus
auuuccuuuagacaagagcaauucuggguuaauauuuuuga

SEQ ID NO: 123894 - RNA, 91 nt, Mus musculus
agcuggagucagacgcugggauaaagcaaugacuggggagagagaauaggaagcgaagaucagugggauccauuggagauggaggcagagg

SEQ ID NO: 123895 - RNA, 47 nt, Mus musculus
agagguuaggagggcaagaccuggugauccacuggugauggggcaga

SEQ ID NO: 123896 - RNA, 23 nt, Mus musculus
gagggagagguggaggucuggag

SEQ ID NO: 123897 - RNA, 45 nt, Mus musculus
aaaaucuguuucuggguauugggagcugacauguagaaauggaga

SEQ ID NO: 123898 - RNA, 46 nt, Mus musculus
uuguuuuguuuuguuuuguuuugcauuuccauauguaccugaagau

SEQ ID NO: 123899 - RNA, 46 nt, Mus musculus
cacauacuuguagaaagggacucuuguuucuaauucaugcauagac

SEQ ID NO: 123900 - RNA, 46 nt, Mus musculus
uuuacauuuaaauuuuagugugugugugugugugugugugugugug

SEQ ID NO: 123901 - RNA, 37 nt, Mus musculus
gagcucuggguuucacugaaagacccugccucgaaga

SEQ ID NO: 123902 - RNA, 46 nt, Mus musculus
agaagaacgguacugcggauuuagaaggcacugugaaggacuuguu

SEQ ID NO: 123903 - RNA, 45 nt, Mus musculus
cuaauuguaaagaguauugugagaugcaacaaccucuaaccugca

SEQ ID NO: 123904 - RNA, 46 nt, Mus musculus
aaaaugaagacuucugaaaagaggucucauccauacuuagcugcuu

SEQ ID NO: 123905 - RNA, 41 nt, Mus musculus
aguguugauggauaaguugagacuuaguagaaagaagaaua

SEQ ID NO: 123906 - RNA, 45 nt, Mus musculus
aaucaugggcugaaguggaaaacagccugaccuugaacagagcag

SEQ ID NO: 123907 - RNA, 45 nt, Mus musculus
aauacaggaguuaguuguugucuuuauuaaaagguaaacuuggag

SEQ ID NO: 123908 - RNA, 47 nt, Mus musculus
aguauagucuuucuugccuacaagggcuaucagagcagugaaaugga

SEQ ID NO: 123909 - RNA, 45 nt, Mus musculus
cucugggauacgaaggaggaggaggaacauuauugcuauuugggg

SEQ ID NO: 123910 - RNA, 50 nt, Mus musculus
uuuuggagcaaccuucauuuuacugaauaauaauuaaagccacaacucuu

SEQ ID NO: 123911 - RNA, 45 nt, Mus musculus
cucuagaaacuguaauuguccaaauguuuuucuuucuuguaccuu

SEQ ID NO: 123912 - RNA, 46 nt, Mus musculus
uuuuaaaauauuguuugccuuuaauguguuaauguuuuccugguuu

SEQ ID NO: 123913 - RNA, 60 nt, Mus musculus
uucuggggaccuuggagagaauugugaggggaaagaagaaugaaaggaggagagguuuua

SEQ ID NO: 123914 - RNA, 68 nt, Mus musculus
uauuaggcagcugguuaaauucaccgagauggagaacacugaaaaaggaacagauuugcugggaugaa

SEQ ID NO: 123915 - RNA, 45 nt, Mus musculus
guauauugcuuuggggaagacuauuuugagucccuaagaacccua

SEQ ID NO: 123916 - RNA, 45 nt, Mus musculus
cccaugagggagaaacuuccaaagauuucguaacugugaugccag

SEQ ID NO: 123917 - RNA, 42 nt, Mus musculus
uaaguagaagcuaauucuaaaagcuuucuugacuugccuaag

SEQ ID NO: 123918 - RNA, 46 nt, Mus musculus
ggagagauaaugguaggugggauuuuugucagggaaagagggcuuu

SEQ ID NO: 123919 - RNA, 45 nt, Mus musculus
guuuguuuuauguuugcuuucugucuguuuuguuuggaaguuggc

SEQ ID NO: 123920 - RNA, 46 nt, Mus musculus
gugucugaagacagcuacaguguacucauauaaaauaaaugaauaa

SEQ ID NO: 123921 - RNA, 46 nt, Mus musculus
aguguguuuauaaccaaaggagaggccagacaugauaaguaugcag

SEQ ID NO: 123922 - RNA, 46 nt, Mus musculus
gaggcuggcaaguaugaaaauuggaugggaagccaacauacuacag

SEQ ID NO: 123923 - RNA, 45 nt, Mus musculus
uauauguaugcauauaacaauaauaacuaaaggaaaauacuauca

SEQ ID NO: 123924 - RNA, 46 nt, Mus musculus
auaugaguaauauauguuauuaaaaccuacgucuauaauacuggag

SEQ ID NO: 123925 - RNA, 46 nt, Mus musculus
ucccaguuguuucuuuuauaaugacauacuauaucuuugaagggag

SEQ ID NO: 123926 - RNA, 46 nt, Mus musculus
auggagugcucagugguuaagagcagauugcucucucaaccaccug

SEQ ID NO: 123927 - RNA, 46 nt, Mus musculus
gcgagaugcccaccgauuugagaaaaucagcaacauuauuaagcaa

SEQ ID NO: 123928 - RNA, 46 nt, Mus musculus
aucauaaggucacaggaagacuaaauuccaugaggaaaagaugcag

SEQ ID NO: 123929 - RNA, 46 nt, Mus musculus
aacauauagccaaagaguagaagaauacucaagcaaauguaaggag

SEQ ID NO: 123930 - RNA, 42 nt, Mus musculus
agcacagugacaccaucgagaaugucaaggccaagauccaag

SEQ ID NO: 123931 - RNA, 45 nt, Mus musculus
auauuuagaaacacacacacauaaguagcagggaauacaugggag

SEQ ID NO: 123932 - RNA, 45 nt, Mus musculus
uacagagaaacccugucucgaaaaaccaaaaaaaaaaaguaguuc

SEQ ID NO: 123933 - RNA, 46 nt, Mus musculus
caggaaagaagucacauucacaguugcuucaaaacaaaguaaccaa

SEQ ID NO: 123934 - RNA, 45 nt, Mus musculus
caaagaaagugaaagaccucuaaaaugaaaacuuuaaaagcacag

SEQ ID NO: 123935 - RNA, 46 nt, Mus musculus
agcuaaagaaaacugugcauauacaguacggauuauuauucaucau

SEQ ID NO: 123936 - RNA, 41 nt, Mus musculus
aggcagagagagagaggcagagaggcagagagagagaggca

SEQ ID NO: 123937 - RNA, 42 nt, Mus musculus
aggcagagaggcagagagagaggcagaggcagagaggcagag

SEQ ID NO: 123938 - RNA, 42 nt, Mus musculus
aggcagaggcagagaggcagaggcagagaggcagaggggcag

SEQ ID NO: 123939 - RNA, 51 nt, Mus musculus
agagcaauuucauugcuagcuugagguacauaguaagguugucuaagaaag

SEQ ID NO: 123940 - RNA, 46 nt, Mus musculus
cucuaguuucaggggaucugacacacucacacagacauacaugcag

SEQ ID NO: 123941 - RNA, 47 nt, Mus musculus
agacugacucaaauauuuagagauagcauucauaguuguuaaugagg

SEQ ID NO: 123942 - RNA, 42 nt, Mus musculus
uuggggcgcuuguguuaaauguguccuuuuugacucggccag

SEQ ID NO: 123943 - RNA, 46 nt, Mus musculus
uucaaaauacuucaaacuaaaagaauaaaaguggucuuggggucaa

SEQ ID NO: 123944 - RNA, 46 nt, Mus musculus
auggaacacagggacccccaauggaggagcuagagaaaguacccaa

SEQ ID NO: 123945 - RNA, 46 nt, Mus musculus
agauuaaaauacugaauauugaaaugcugaaaacagaaacucccaa

SEQ ID NO: 123946 - RNA, 48 nt, Mus musculus
auucacuguagcugauaaucucugggaaccugucuuugcccgaagaag

SEQ ID NO: 123947 - RNA, 46 nt, Mus musculus
uuuaaaaagagaaccuucauguacaaaaugucuaucaauugcuaga

SEQ ID NO: 123948 - RNA, 46 nt, Mus musculus
agugugagguuaugugucaauuguagcuuugaguuguauuugccua

SEQ ID NO: 123949 - RNA, 46 nt, Mus musculus
aggugaugauuuauagucagccuaccuguuuccuuggcuguagagg

SEQ ID NO: 123950 - RNA, 45 nt, Mus musculus
cauagcaucaguaauagugucaggguuuugugcccccuccccaag

SEQ ID NO: 123951 - RNA, 46 nt, Mus musculus
aguugugaguugccauaugggugcugggaauugaaccuagguccac

SEQ ID NO: 123952 - RNA, 46 nt, Mus musculus
uugaacugauauggcguacauagagaacaaugccuggaaaacucag

SEQ ID NO: 123953 - RNA, 45 nt, Mus musculus
ggcuccaccuccaaaaggcuccacaaccuuccaaaacagcaccac

SEQ ID NO: 123954 - RNA, 46 nt, Mus musculus
guugguaaugauaaugcuugugguguauuuuugcuaguggacuguu

SEQ ID NO: 123955 - RNA, 46 nt, Mus musculus
cauccaacuccaugcccuuuuaucugccccccucuuuagaaaacag

SEQ ID NO: 123956 - RNA, 46 nt, Mus musculus
ucuagguuaucaucuccguuauauuagggauuuuguagggccccgu

SEQ ID NO: 123957 - RNA, 41 nt, Mus musculus
ugcuacuaguagguguggccuuauugaaguaggugugguuu

SEQ ID NO: 123958 - RNA, 46 nt, Mus musculus
cuuaugagaucauauuuggguuauuuauugccccaguagcauugag

SEQ ID NO: 123959 - RNA, 45 nt, Mus musculus
agcagggaaggaggucagugguagacugaggaaggagggaguagg

SEQ ID NO: 123960 - RNA, 42 nt, Mus musculus
ucaaaaucccccaaaacaaaccaaacaaacaaguagggccaa

SEQ ID NO: 123961 - RNA, 46 nt, Mus musculus
uuaaaagcguguaccaccacgcccggcuggaaauauuacuuaauag

SEQ ID NO: 123962 - RNA, 50 nt, Mus musculus
caagcuagagucauuagagaggaaggagccuuaguugagaaaaugccucc

SEQ ID NO: 123963 - RNA, 46 nt, Mus musculus
caccugaacuuaugaucacuccaccuuggcacugccuuugaccaag

SEQ ID NO: 123964 - RNA, 45 nt, Mus musculus
acgucuaucauauauaugugugugugugugugugugugugugugu

SEQ ID NO: 123965 - RNA, 41 nt, Mus musculus
gacuuguaaacuuuauauaccccaguacaggggaaugccag

SEQ ID NO: 123966 - RNA, 42 nt, Mus musculus
aguuucaggacagauagggauacacaaagaaauccuggucag

SEQ ID NO: 123967 - RNA, 46 nt, Mus musculus
uuucuggagggaaaggaaggagcaguagauuuaggggagaggagag

SEQ ID NO: 123968 - RNA, 46 nt, Mus musculus
gggaaaaggugaaaauaggguacugggauccauguaauaggacaga

SEQ ID NO: 123969 - RNA, 46 nt, Mus musculus
aucuaauguuuggaguuugucuguucuucuuuucccagaggcuaag

SEQ ID NO: 123970 - RNA, 45 nt, Mus musculus
guguuucauuuggaauacccauaggagucagaaagucaguaagga

SEQ ID NO: 123971 - RNA, 45 nt, Mus musculus
aaggauauaauggaauagagaguauuaauuagaauugggaugaga

SEQ ID NO: 123972 - RNA, 46 nt, Mus musculus
augguugugagccaccaugugguugcugggauuugaacugcaguca

SEQ ID NO: 123973 - RNA, 42 nt, Mus musculus
uccagucugugaaaaggaaaaaauccaggagcaugaaagggg

SEQ ID NO: 123974 - RNA, 46 nt, Mus musculus
uuggaauacccaacauuucaauucacagaccauaugaagcccaaga

SEQ ID NO: 123975 - RNA, 45 nt, Mus musculus
uauuacagcugugagaagugaucuuuuagaaagaaauaguguugu

SEQ ID NO: 123976 - RNA, 41 nt, Mus musculus
caaguuuaggcagugaaggauuuggaaaacagaaagccagu

SEQ ID NO: 123977 - RNA, 46 nt, Mus musculus
ugcaaaggauuugaggcuuggcacccugaagagagccuaugaaagg

SEQ ID NO: 123978 - RNA, 46 nt, Mus musculus
ggaagcacuaaaugaacuuaauggguuauuaauuuaaaacagaaga

SEQ ID NO: 123979 - RNA, 42 nt, Mus musculus
uaauuggaugagguuuagauaaggagaagaaagggagggcag

SEQ ID NO: 123980 - RNA, 42 nt, Mus musculus
agagaggacacauaguuuggguggggacauaaggagguggau

SEQ ID NO: 123981 - RNA, 46 nt, Mus musculus
uuguuuuguuuugagagaaagaaugugaaguuuggugcuguggaag

SEQ ID NO: 123982 - RNA, 46 nt, Mus musculus
uuuuacaagccuguuuguuuucuaaugagagacagaaagggaguga

SEQ ID NO: 123983 - RNA, 45 nt, Mus musculus
acauagaauauacauuacuauuccaaaagguagagaugaggggau

SEQ ID NO: 123984 - RNA, 41 nt, Mus musculus
ucacaucuaaggcgcagggauuauuguagaagauggggcag

SEQ ID NO: 123985 - RNA, 41 nt, Mus musculus
guguguuuguauguguauguguguguuugcagguacccuca

SEQ ID NO: 123986 - RNA, 46 nt, Mus musculus
cauucuaccuucuuacaaugaggucuugugggagaagcaggcauag

SEQ ID NO: 123987 - RNA, 45 nt, Mus musculus
ucuuaaaguauuuuaaauuuguuguuguuuuuucugcugggagca

SEQ ID NO: 123988 - RNA, 42 nt, Mus musculus
cccuauccuuuuccagccuggagaaaacagggagguggggga

SEQ ID NO: 123989 - RNA, 45 nt, Mus musculus
gcgcugucagacaugggcgggugcaaggggaacagcugccuugag

SEQ ID NO: 123990 - RNA, 42 nt, Mus musculus
ccacuuggcuuuggguuuuagcagugaagugggaugggggag

SEQ ID NO: 123991 - RNA, 46 nt, Mus musculus
aggcucuuaaggauguggccaagggguuagcuccuguagguggaag

SEQ ID NO: 123992 - RNA, 46 nt, Mus musculus
acugcugauagacuucguacuucauuguccuuaaagcacauuucag

SEQ ID NO: 123993 - RNA, 45 nt, Mus musculus
uaggcacagugccuuuagguuagcuuagaggacagauaggcaaag

SEQ ID NO: 123994 - RNA, 46 nt, Mus musculus
aggugggucuugacgacucauccguuucgacucugccaggggcuua

SEQ ID NO: 123995 - RNA, 45 nt, Mus musculus
ggcaaguuccaggcaguguaaaacauuaucuugaucucacagaaa

SEQ ID NO: 123996 - RNA, 46 nt, Mus musculus
aaaaaaucccuguucggucagacaauucucuuauaauccagagggg

SEQ ID NO: 123997 - RNA, 46 nt, Mus musculus
ugauuggucuauggcauauaauuggaucuaaguuacguaugcauuu

SEQ ID NO: 123998 - RNA, 46 nt, Mus musculus
ugucacauucauuaguguguauaaagaggaauuguccaauagcgcu

SEQ ID NO: 123999 - RNA, 46 nt, Mus musculus
gcagcagccauucucucuuuggagagugguuaauuauugacuagag

SEQ ID NO: 124000 - RNA, 46 nt, Mus musculus
cuucuccucuugugcauaggcaaggcagcuccguuaagggaaaggg

SEQ ID NO: 124001 - RNA, 46 nt, Mus musculus
gcuagucagucggaggcaaguaggaauguaggaaaaaugguagcuu

SEQ ID NO: 124002 - RNA, 45 nt, Mus musculus
auggagaacccagcucuguuuaaugauaucaagaucgagccccca

SEQ ID NO: 124003 - RNA, 44 nt, Mus musculus
aaugguccacaugcagggagaagagucucuugacuuaaagagaa

SEQ ID NO: 124004 - RNA, 45 nt, Mus musculus
agucuagaacucauuauguagaccaagcuggcuuugaacucagag

SEQ ID NO: 124005 - RNA, 89 nt, Mus musculus
gaguagccagugcucugaacaacugugccaucucucuaaccccaauuaauuaacuuuugcaacagaagcucacuuagaaaccuaguuua

SEQ ID NO: 124006 - RNA, 59 nt, Mus musculus
cuuuccuuagcaugcaggucucaugauacaauccagcuauaaccugaagucuccaagca

SEQ ID NO: 124007 - RNA, 46 nt, Mus musculus
ugaaauacagagucucaugcuaaccgugaagguuuuguagauccag

SEQ ID NO: 124008 - RNA, 45 nt, Mus musculus
cuuuuuagguuaaguuuggacaaauauucaaagcacagaaagaua

SEQ ID NO: 124009 - RNA, 45 nt, Mus musculus
agaccugggagcacccugugaacaauuacuuggauaagguguuag

SEQ ID NO: 124010 - RNA, 56 nt, Mus musculus
cauaaggcaaccauucagcguauuaccugaugagaaauugcacacugagcacguua

SEQ ID NO: 124011 - RNA, 51 nt, Mus musculus
uuuacuucaugccauuuugggcauuuguucuucucuuucuaaugggaugga

SEQ ID NO: 124012 - RNA, 68 nt, Mus musculus
uuuuggauguuuuacaacuucuauuaauacccaagccauuuauuuuauuuagauauaacaacaagaug

SEQ ID NO: 124013 - RNA, 46 nt, Mus musculus
ucucgccuaaagguuuucuucauaugaaaccuuuauuucuuggcag

SEQ ID NO: 124014 - RNA, 46 nt, Mus musculus
uuauguacuucuguuccacuuuggauccuaaauuuguuuuccagag

SEQ ID NO: 124015 - RNA, 46 nt, Mus musculus
gauuagccucauuguuaguaaacagcuaaaauuaagucaauaaaag

SEQ ID NO: 124016 - RNA, 71 nt, Mus musculus
aucuuucaggaucuuuccggcgaaaaucagcacgagcugaucggucugcgauuugaagcguuuggaaaucg

SEQ ID NO: 124017 - RNA, 43 nt, Mus musculus
uucaagcccagguuacuaaggcuggaaaggcuucccagcccaa

SEQ ID NO: 124018 - RNA, 63 nt, Mus musculus
cccugagaugaugauccagaucauggaaaaucccuuuguucagagcaugcuuucgaauccuga

SEQ ID NO: 124019 - RNA, 63 nt, Mus musculus
auuucuggguuucucuggaucaauuguugcaucuguggauuggccaugaugagcugccucauc

SEQ ID NO: 124020 - RNA, 85 nt, Mus musculus
ucugaugaggcagcucaucauggccaauccacagaugcaacaauugauccagagaaacccagaaaucagccaccuacugaacaac

SEQ ID NO: 124021 - RNA, 45 nt, Mus musculus
gagcaguuccaccucaggggaagguacucagcccucccgcacgga

SEQ ID NO: 124022 - RNA, 46 nt, Mus musculus
ccugcagcagaugcagaauccagaaaccaucgcggccaugucaaac

SEQ ID NO: 124023 - RNA, 45 nt, Mus musculus
cuggaacagcucaacgccaugggguucuuaaaccgcgaagcaaac

SEQ ID NO: 124024 - RNA, 43 nt, Mus musculus
gcuccuccuccccccacccucucccuucccuuccagccugccc

SEQ ID NO: 124025 - RNA, 46 nt, Mus musculus
cucacaauuuuguagaaucuuacagcauauuugauaaauuucucag

SEQ ID NO: 124026 - RNA, 45 nt, Mus musculus
gaaaauaauaagaugugaaaauaugugucacucugucucugaugg

SEQ ID NO: 124027 - RNA, 70 nt, Mus musculus
ugaagaagugagcacagagcaagcauggguaugggcagugagggcggaaugaaaaggagggggagagugg

SEQ ID NO: 124028 - RNA, 41 nt, Mus musculus
auaccauaauuggcaaagcaguggaacacauguuugagggu

SEQ ID NO: 124029 - RNA, 47 nt, Mus musculus
auugcaaauguauacuguuuucuuucuguguucuuucauugggauua

SEQ ID NO: 124030 - RNA, 46 nt, Mus musculus
aauuucaggucacaauuugaaacuuuuauuacagaaagaaaaaggu

SEQ ID NO: 124031 - RNA, 45 nt, Mus musculus
aucuaccugucccaggauauauauuuuauaagcuagggcacaaau

SEQ ID NO: 124032 - RNA, 76 nt, Mus musculus
aacucuaaauccaacaagcaaucaacagaaaaugcagaccaagaugccccccauaaaacaacaaaagacaucaaag

SEQ ID NO: 124033 - RNA, 43 nt, Mus musculus
aucuccucuucugguauuguggagcagccacuggccccaguug

SEQ ID NO: 124034 - RNA, 49 nt, Mus musculus
uuaaaaggagacauucugaugaacuaaaagaaggauauaccuggagcua

SEQ ID NO: 124035 - RNA, 51 nt, Mus musculus
aaaucacugaugccucagauuaucccugguaaaaaauaugcagccagaauu

SEQ ID NO: 124036 - RNA, 45 nt, Mus musculus
auguucagccagaugacaucggugcccacaugaaugcaggaagaa

SEQ ID NO: 124037 - RNA, 45 nt, Mus musculus
ccaugccuugaaaacacuucauagaaauugggacugggagucaga

SEQ ID NO: 124038 - RNA, 42 nt, Mus musculus
guguggaccccgauuguauuaaccguguuuuuaguggcuguu

SEQ ID NO: 124039 - RNA, 50 nt, Mus musculus
auuaccagugacguuguugcauguuugaaauucggucuguuuaaaguggc

SEQ ID NO: 124040 - RNA, 41 nt, Mus musculus; identical to SEQ ID NO: 84351

SEQ ID NO: 124041 - RNA, 46 nt, Mus musculus
gcauuguuggguucgccauguacuauuuuaccuaugacccauggau

SEQ ID NO: 124042 - RNA, 41 nt, Mus musculus
ugggggaaguaaauugaaaauuuauaugugggagggcaagu

SEQ ID NO: 124043 - RNA, 31 nt, Mus musculus
gcuaaaaggggaaguuguuugggugggugcu

SEQ ID NO: 124044 - RNA, 47 nt, Mus musculus
ggcuaaauaugaauacauggaagaucaagucauuuuaacugagaaag

SEQ ID NO: 124045 - RNA, 42 nt, Mus musculus
caggcaggacucagucaccgcucuacccugccugccccauuu

SEQ ID NO: 124046 - RNA, 48 nt, Mus musculus
ggaagaaaagcaaaagacgaaaauggcuaaauuuaagauccguccagc

SEQ ID NO: 124047 - RNA, 46 nt, Mus musculus; identical to SEQ ID NO: 84354

SEQ ID NO: 124048 - RNA, 46 nt, Mus musculus
ugaugccccgaguccagacaccucagugaaagaggauuccaaagau

SEQ ID NO: 124049 - RNA, 41 nt, Mus musculus
aggaauuggaggaggaaauaauacuggaagaaaagcgaaga

SEQ ID NO: 124050 - RNA, 46 nt, Mus musculus
caagaagguggcaauuaaugccaagcuauucauaaugggccuuguc

SEQ ID NO: 124051 - RNA, 48 nt, Mus musculus
gagaaauauauuugcuuuuuggaauagcugagauuaguagaugggcaa

SEQ ID NO: 124052 - RNA, 46 nt, Mus musculus
cagacucggugcucuuaaccacugagccaucucuccagcccaagag

SEQ ID NO: 124053 - RNA, 46 nt, Mus musculus
acugcguuugguucaagccuuccaguacacugacaagcauggagaa

SEQ ID NO: 124054 - RNA, 46 nt, Mus musculus
ccugaaccaucagaucucaaaggacuaugguguauaccuugaagac

SEQ ID NO: 124055 - RNA, 46 nt, Mus musculus
gguagcaugcucuguugacucucaguuuacccacuuggccugguca

SEQ ID NO: 124056 - RNA, 42 nt, Mus musculus
agagaaauuucaccaaauaaggacaggcuuuggccaguagaa

SEQ ID NO: 124057 - RNA, 76 nt, Mus musculus
caagccagcaccuuauugggaaggaacagcugugauuaacggagaauucaaggagcucaaacugacugacuaucgu

SEQ ID NO: 124058 - RNA, 46 nt, Mus musculus
ucucagaagucugugagcuuccagacuuccaaugaaguucaaagau

SEQ ID NO: 124059 - RNA, 46 nt, Mus musculus
cuuaacauuuuggggucaauuuuuuggacauggggacuggacagau

SEQ ID NO: 124060 - RNA, 45 nt, Mus musculus
aaaaaaaacaagucuuauggaguauuuuggagggaaacuggggaa

SEQ ID NO: 124061 - RNA, 45 nt, Mus musculus
agguggguuccuggugugaagaaagaaauggguuucucugaacag

SEQ ID NO: 124062 - RNA, 46 nt, Mus musculus
gggcaugcccuaguguaucauagguaggagaggcaaggcagcagag

SEQ ID NO: 124063 - RNA, 41 nt, Mus musculus
gcucaucuccauccugcucggcgccagcuucagccgcuacc

SEQ ID NO: 124064 - RNA, 68 nt, Mus musculus
uaaaacaauuucuuuugcauucaaucucuuggcugccuccagagccucuuuagcaguguuggcaacaa

SEQ ID NO: 124065 - RNA, 64 nt, Mus musculus
gagcuucuugcucugguacuccugcagguucagccaucuucgggggguuaagugaccugccugg

SEQ ID NO: 124066 - RNA, 54 nt, Mus musculus
ucgaugggauagauguugggauggccaauuuauagcccuggaucugggccugau

SEQ ID NO: 124067 - RNA, 41 nt, Mus musculus
uggaaaaaacaguuugcuacaauaacauuacuggggaaaua

SEQ ID NO: 124068 - RNA, 45 nt, Mus musculus
agauccaguaacuggcuuaguaggcaguucaagcuaacagaguaa

SEQ ID NO: 124069 - RNA, 46 nt, Mus musculus
auuaucgcaucguggaguauuuccuauaugguggagggggaaagag

SEQ ID NO: 124070 - RNA, 45 nt, Mus musculus
ggggacuaucuuacugaucugucuguugcaucauucauagaaggg

SEQ ID NO: 124071 - RNA, 46 nt, Mus musculus
gguggggauuugaaauaauagauuauuuugauguuucuugugguag

SEQ ID NO: 124072 - RNA, 46 nt, Mus musculus
aagauucugggcuuagauuuaaauuuuacauauguguauaugugag

SEQ ID NO: 124073 - RNA, 44 nt, Mus musculus
gccuuggaaacuugaagcugaaauguuugagaaaggugaagcca

SEQ ID NO: 124074 - RNA, 45 nt, Mus musculus
cuugccaggaugccaccguguugcuucagcuugguauuauguuga

SEQ ID NO: 124075 - RNA, 45 nt, Mus musculus
uccagaaucagcauuauuucagaaccauuucccaauagaccccag

SEQ ID NO: 124076 - RNA, 94 nt, Mus musculus
aguuucugggaagaugugaaauuaagcuaugggaguuugaaaaaagauacacggugagcuaagguuaucuuaaguauauaaaaucucucguuag

SEQ ID NO: 124077 - RNA, 42 nt, Mus musculus
augauuccuuccagggccagccuagggcacuucgucaguuag

SEQ ID NO: 124078 - RNA, 24 nt, Mus musculus
gccccugcuuucugugugggugca

SEQ ID NO: 124079 - RNA, 46 nt, Mus musculus
uucagagccggaugugguaauuaauauacauccuauaaucccugaa

SEQ ID NO: 124080 - RNA, 46 nt, Mus musculus
uuguucauaguggugugugugugugugugugugugugugugugcau

SEQ ID NO: 124081 - RNA, 45 nt, Mus musculus
aacuagaagauauuaguggaggggagaaguggugaggucaaauua

SEQ ID NO: 124082 - RNA, 42 nt, Mus musculus
auuuuuaaaaucagaugagagacaaagauuagccaaagagag

SEQ ID NO: 124083 - RNA, 43 nt, Mus musculus
gaaaacuugaggagcagcgccaacgggaggaucagaagagggc

SEQ ID NO: 124084 - RNA, 45 nt, Mus musculus
gaaugcaauuaucugcauggaguccguuauuacuaagcucuggga

SEQ ID NO: 124085 - RNA, 46 nt, Mus musculus
gucucaguaucccuuaguaucacauuagggguuuacaaauggccag

SEQ ID NO: 124086 - RNA, 46 nt, Mus musculus
aucccuaaugagaucuggcgcccuccucuggugugucugaagacag

SEQ ID NO: 124087 - RNA, 46 nt, Mus musculus
accacgccaggcucuguauauauucuugcuacuaauccccugucag

SEQ ID NO: 124088 - RNA, 41 nt, Mus musculus
uaugucuugccauuucccaaccucugguuggucaccagcga

SEQ ID NO: 124089 - RNA, 45 nt, Mus musculus
aagaagaagugcucaugggcaggaucaccagggccuggcggacgu

SEQ ID NO: 124090 - RNA, 32 nt, Mus musculus
aguauuagaaugaguuugaacauuuaaagaga

SEQ ID NO: 124091 - RNA, 46 nt, Mus musculus
uaaugcauuucucugcagcaugugacaaacuuucaacaucaaccau

SEQ ID NO: 124092 - RNA, 45 nt, Mus musculus
agugaauggguagaccuugucucuccaguuugcuucuuucuggug

SEQ ID NO: 124093 - RNA, 46 nt, Mus musculus
augaucuuuguuuuuccaguguuauauguccuuaguaagggaguuc

SEQ ID NO: 124094 - RNA, 46 nt, Mus musculus
aucuugugguaaaugcuuauaauguuagcuacuuaguaggccaaag

SEQ ID NO: 124095 - RNA, 45 nt, Mus musculus
ugaugcgcugauucuaucucaucaguaacccuaaauucuuaacca

SEQ ID NO: 124096 - RNA, 46 nt, Mus musculus
uuuauuaugaugaaaagcuauacaagagaauccaccaagggggaaa

SEQ ID NO: 124097 - RNA, 46 nt, Mus musculus
cugacugauuauuuuuuaaccccaguuuagguagaauagccaaaag

SEQ ID NO: 124098 - RNA, 42 nt, Mus musculus
ggaaggaaggaagggaggaaggaaggaaagaaagaaagagag

SEQ ID NO: 124099 - RNA, 45 nt, Mus musculus
cacccaaaacauaggcuauugcucuuugccuuaguugcucucaga

SEQ ID NO: 124100 - RNA, 46 nt, Mus musculus
uuguuauaggacagaugcucaguaugugucugucuuaguucauuag

SEQ ID NO: 124101 - RNA, 46 nt, Mus musculus
ggcacacaaccauccccaacgaaaucugauucccuuuucuggagua

SEQ ID NO: 124102 - RNA, 45 nt, Mus musculus
cuggcaagcugaacaucaauguucauuguuguuuccugacugcag

SEQ ID NO: 124103 - RNA, 42 nt, Mus musculus
agacuucucuggcagacgcacuguaugguuauccacucccau

SEQ ID NO: 124104 - RNA, 45 nt, Mus musculus; identical to SEQ ID NO: 52258

SEQ ID NO: 124105 - RNA, 48 nt, Mus musculus
uacuuuccacccauugcaaacgaagaaacaccaaagaagaaggcagag

SEQ ID NO: 124106 - RNA, 41 nt, Mus musculus
aaagagacgucaggcucggcuacagaaggaacaagaggagc

SEQ ID NO: 124107 - RNA, 45 nt, Mus musculus
uaagucacaaagcugugguuaccaguugagaaaauguagcaaaag

SEQ ID NO: 124108 - RNA, 46 nt, Mus musculus
ggaguuaggacaagcauucuuauacccuaaauccagucuggugaag

SEQ ID NO: 124109 - RNA, 45 nt, Mus musculus
augcacaagugauagcauuuacagucauuugcauauuaggcagaa

SEQ ID NO: 124110 - RNA, 46 nt, Mus musculus
caaagcagagaaggaaaacuggguuaguauggauaugauaacaaag

SEQ ID NO: 124111 - RNA, 51 nt, Mus musculus
ugcgcauagaaauggccuauaaacgagaacaggaaaaaaagcggcaggagg

SEQ ID NO: 124112 - RNA, 46 nt, Mus musculus
agcucuugucaaaagagaagcaagaaaaggaaaaacaagaacaaga

SEQ ID NO: 124113 - RNA, 55 nt, Mus musculus
acagaugcguuuagaaagagaacagaucaugcugcagauugagcaggaacgacug

SEQ ID NO: 124114 - RNA, 45 nt, Mus musculus
uucugucaguuuuguuacacauacacacacauacacagagagaga

SEQ ID NO: 124115 - RNA, 29 nt, Mus musculus
auagaugaaaucaugaagagaacaaggaa

SEQ ID NO: 124116 - RNA, 45 nt, Mus musculus
uauuucaugagugaagaacagcagaauacauuuagugagguugaa

SEQ ID NO: 124117 - RNA, 46 nt, Mus musculus
uuucauccuuacaucaccuuuugauuucuuccucagucauugccag

SEQ ID NO: 124118 - RNA, 46 nt, Mus musculus
auguugaaaauaaagcaaacaaagcaaagccaguuguccccaacaa

SEQ ID NO: 124119 - RNA, 42 nt, Mus musculus
aaucuccacaggcuaucuagagguugguuuuccaccagggca

SEQ ID NO: 124120 - RNA, 46 nt, Mus musculus
gaucugauacccucuucugguaugucugaagacagcuacagugucu

SEQ ID NO: 124121 - RNA, 45 nt, Mus musculus
acuguaacaaaaaccucaucgaaggauuuaacagucccgggcaag

SEQ ID NO: 124122 - RNA, 46 nt, Mus musculus
ggguugaagaaagguuugguugaaugaauaaguaaauaguggcaau

SEQ ID NO: 124123 - RNA, 45 nt, Mus musculus
cgaguuuccacagaaagacccuuguccauuuaauucaagcacgug

SEQ ID NO: 124124 - RNA, 95 nt, Mus musculus
uuacauguuuucaagccuuuuguugucuggguauuuccuguccaaguugagagcacagaguuccuuacgcuggaugggaacacccauccacccac

SEQ ID NO: 124125 - RNA, 46 nt, Mus musculus
cuguagaugugauagccuaguuccuccaacgggggcucaggaucag

SEQ ID NO: 124126 - RNA, 46 nt, Mus musculus
gcaagauugcuguucaccauucuauccuugagaagcauaauagggu

SEQ ID NO: 124127 - RNA, 42 nt, Mus musculus
ucuuguaaaaccaaaaaggaaggagggaaggaaagaaggaag

SEQ ID NO: 124128 - RNA, 46 nt, Mus musculus
guagcaucauuugcaaaauuacgggaagcaaccagcacucggcuug

SEQ ID NO: 124129 - RNA, 42 nt, Mus musculus
uggcauucgugccacugaccaacucaagauaaccaccccccc

SEQ ID NO: 124130 - RNA, 109 nt, Mus musculus
cauuguaauaugauaacagaauaccaagacugggaaauuuaagcaguauggaaguuucuuuuuucauaacucuagaggcugaaaaguccaagaucccaaguucaacugu

SEQ ID NO: 124131 - RNA, 46 nt, Mus musculus
auacauccacccacccacacacucacacacacagacacacacacac

SEQ ID NO: 124132 - RNA, 44 nt, Mus musculus
auggaucuuuaauucuaugugugucacuuuugaccuuggccuca

SEQ ID NO: 124133 - RNA, 56 nt, Mus musculus
uguguguuuuauuccacuuuaauauucuaaaguucuguacagagacuaccuaagcu

SEQ ID NO: 124134 - RNA, 93 nt, Mus musculus
uggauuuaauaggauugguacuucuuuuuuuguuuucaaaagucagcagcaaguauaugaaaucgaaguggcgccuguaucccagccaaguga

SEQ ID NO: 124135 - RNA, 45 nt, Mus musculus
gucagugaagcuagccagauagaaagcuagcagggcaaaagggag

SEQ ID NO: 124136 - RNA, 81 nt, Mus musculus
ucugccuccuccccgcuggcggguagcgaggucugagccgcucuccucucucucccucucgccaaacuuggaacgagacuu

SEQ ID NO: 124137 - RNA, 45 nt, Mus musculus
gcaggcgcuccuugccucucccaggcacgucacgcaguccucgcu

SEQ ID NO: 124138 - RNA, 41 nt, Mus musculus
acucucuuuacucgccaucuugcgucgggucguuucgcccc

SEQ ID NO: 124139 - RNA, 27 nt, Mus musculus
ggugggggugggggaaggggggccucu

SEQ ID NO: 124140 - RNA, 46 nt, Mus musculus
gcucacaaccguccguaaugagaucugauucccucuucuggagugu

SEQ ID NO: 124141 - RNA, 46 nt, Mus musculus
ugugcccauauuccuauagaaaaaguacaugccaggcuggugagau

SEQ ID NO: 124142 - RNA, 45 nt, Mus musculus
aauucccagcaaccacaugguggcucacagccaucuguauuggga

SEQ ID NO: 124143 - RNA, 46 nt, Mus musculus
acuucaauuauuuaauaaggaacaggaauauaauccaguuguagag

SEQ ID NO: 124144 - RNA, 44 nt, Mus musculus
uugugagccaccaugugguugcugggauuugaacuccuaaccuu

SEQ ID NO: 124145 - RNA, 45 nt, Mus musculus
cucccagcuccccaagccugcaggcaggaagucauguuucuagua

SEQ ID NO: 124146 - RNA, 46 nt, Mus musculus
cuuacaggccgcgacccgaacuggcguuuugaagacuucuuggcau

SEQ ID NO: 124147 - RNA, 33 nt, Mus musculus
gcagcgcuuugggucaagcucucuccgcggcag

SEQ ID NO: 124148 - RNA, 42 nt, Mus musculus
ccgucgccgugcuguggaagggaagccguggugccgcgggga

SEQ ID NO: 124149 - RNA, 41 nt, Mus musculus
cgccgccgccguaagugcugaaggaguccgcugagcuggca

SEQ ID NO: 124150 - RNA, 45 nt, Mus musculus
ggucccuuccccaaguucugauaacgguuugcguucaauguccag

SEQ ID NO: 124151 - RNA, 42 nt, Mus musculus
agcaaagugccacccuuguaaguccugaagacagcggcaucg

SEQ ID NO: 124152 - RNA, 46 nt, Mus musculus
uagcaggaaauucuauuggaaagaucuuacuauauguagguaagug

SEQ ID NO: 124153 - RNA, 46 nt, Mus musculus
uucuucuuuucuuugucugacagugggacauaccauuucugcaguc

SEQ ID NO: 124154 - RNA, 45 nt, Mus musculus
cugcagaaaugguaugucccacugucagacaaagaaaagaagaag

SEQ ID NO: 124155 - RNA, 46 nt, Mus musculus
uuuuagcacggaaacccaagaugugcagcuuccuugaguggagaga

SEQ ID NO: 124156 - RNA, 45 nt, Mus musculus
uaaauguggaggcaauaguuuuaaauagguguggaaagacauaga

SEQ ID NO: 124157 - RNA, 23 nt, Mus musculus
ccucucagcucaggaaccaauca

SEQ ID NO: 124158 - RNA, 46 nt, Mus musculus
agugaccuucauguaaaccuggcauuaguguucuuacucucaaguc

SEQ ID NO: 124159 - RNA, 46 nt, Mus musculus
acagaacuuuugauauaaugaggcaaagguggagagguggagaaau

SEQ ID NO: 124160 - RNA, 46 nt, Mus musculus
aggugaugugcuuucccuguuccgacuggaagaccuuuuaagccag

SEQ ID NO: 124161 - RNA, 45 nt, Mus musculus
uuccaaaauuucucuugcacauuuauuacuuuuguaaucuaggag

SEQ ID NO: 124162 - RNA, 46 nt, Mus musculus
cuagcuccuuuucaggagccuaaguagcuuaccuccugcaggagau

SEQ ID NO: 124163 - RNA, 41 nt, Mus musculus
gucaaaacuguuauauucgugucuuaacuuccuuaccccag

SEQ ID NO: 124164 - RNA, 46 nt, Mus musculus
cuguguucauuugacuaccaaacagcagauggugugaaggccgcca

SEQ ID NO: 124165 - RNA, 45 nt, Mus musculus
guuuacuaucaaacuuaagagacaacaaacaaacaaaaaugauga

SEQ ID NO: 124166 - RNA, 46 nt, Mus musculus
gguuacccugaggcuucccucaaaacuuccuuuguagcccagaccu

SEQ ID NO: 124167 - RNA, 46 nt, Mus musculus
acugaucugugggacugcauaaaaauggaaagguaagaauccugag

SEQ ID NO: 124168 - RNA, 45 nt, Mus musculus
aacguuaagcaaauaaauauuucuuaaaguaucuuauaaugugaa

SEQ ID NO: 124169 - RNA, 46 nt, Mus musculus
ugagauuuuauugauacuugaaauagacaauccagaagcaggcaga

SEQ ID NO: 124170 - RNA, 44 nt, Mus musculus
gcuaaaaaauuucaaaggauaaacaaaaaagaagaggaggagga

SEQ ID NO: 124171 - RNA, 46 nt, Mus musculus
cucuucuuuuuuguuuauccuuugaaauuuuuuagccacacccccc

SEQ ID NO: 124172 - RNA, 45 nt, Mus musculus
aauucucuaaauuuagccaguuuucuaaacaaacaauuccuuaga

SEQ ID NO: 124173 - RNA, 42 nt, Mus musculus
uuuguuuagaaaacuggcuaaauuuagagaauuucggggcaa

SEQ ID NO: 124174 - RNA, 48 nt, Mus musculus
uucuuuuuaagaaaauaauaauagaaauagaugaguagcccaguauga

SEQ ID NO: 124175 - RNA, 46 nt, Mus musculus
aacuguuuucaauccuucuguuuuuaaaauucauugcucaaaauag

SEQ ID NO: 124176 - RNA, 46 nt, Mus musculus
auaauacaaggaguauggaaagaaacuccuuuuaaaacaacugaag

SEQ ID NO: 124177 - RNA, 46 nt, Mus musculus
auauuuauuauuauauauaauuuuuucucuuaucacauugaacuag

SEQ ID NO: 124178 - RNA, 42 nt, Mus musculus
aguacagaggaaagaugaaaaagcaugcauacugacgagaag

SEQ ID NO: 124179 - RNA, 46 nt, Mus musculus
aacauuagaaauaaagggguuuaaaauaugcuggauugaaaggggg

SEQ ID NO: 124180 - RNA, 46 nt, Mus musculus
aauggcaucuagaggagacccacuggggacuggggaaaagagaaaa

SEQ ID NO: 124181 - RNA, 46 nt, Mus musculus
accccacacuucgcuugcuauuuucucuuuuccccaguccccagug

SEQ ID NO: 124182 - RNA, 47 nt, Mus musculus
caacagacucaccaaagaauaaauaagugcugagcaaagggauuguc

SEQ ID NO: 124183 - RNA, 46 nt, Mus musculus
uuauguccuuguguuuuacucagaaaauguacugauaaggguccag

SEQ ID NO: 124184 - RNA, 42 nt, Mus musculus
uucuuccuauaaagaauauucuugacaauugauaggugcuaa

SEQ ID NO: 124185 - RNA, 45 nt, Mus musculus
agacuauguaucacagcaagaguuucauuggguauaagaaagcgu

SEQ ID NO: 124186 - RNA, 65 nt, Mus musculus
uugacaaaguauucuuaaauauuguaaaucaguaauguuaucacagaugaagccuucccugugag

SEQ ID NO: 124187 - RNA, 42 nt, Mus musculus
guucuaacuuuaaaauucaucggggaugcuguaagguccauu

SEQ ID NO: 124188 - RNA, 46 nt, Mus musculus
uugaugugaaaacaucuaacaucuugucagauauauuuauaagcag

SEQ ID NO: 124189 - RNA, 45 nt, Mus musculus
agaggaaauagagaacugauauacuuaugaaagaaaauguccuca

SEQ ID NO: 124190 - RNA, 45 nt, Mus musculus
guguugaagcaauauaagaaaaaaaucaauuguauaauucucuaa

SEQ ID NO: 124191 - RNA, 46 nt, Mus musculus
ucaauuuuuaagaaauuuuguauugccaauauuuauuaagccacau

SEQ ID NO: 124192 - RNA, 46 nt, Mus musculus
cuaggaacuucagaagguacccaaaugaguuucccacugaaagaag

SEQ ID NO: 124193 - RNA, 45 nt, Mus musculus
agaugguucauaggccuucagucccucaauuuuuagcaagccugu

SEQ ID NO: 124194 - RNA, 46 nt, Mus musculus
ugugauccugaauugccuucuuuaaucucuauaaugaacgugcccu

SEQ ID NO: 124195 - RNA, 45 nt, Mus musculus
aagaauaccugguaauuaaccgugcuauuuuauuuuggggcauug

SEQ ID NO: 124196 - RNA, 45 nt, Mus musculus
caggacccacaugacaguucacaaucaucuauaauucugcuccag

SEQ ID NO: 124197 - RNA, 45 nt, Mus musculus
ugaacacacauaugcacacacauacacagagagacagagaggaag

SEQ ID NO: 124198 - RNA, 42 nt, Mus musculus
cuccaacuccugcucugguuccugccccugccccugccccug

SEQ ID NO: 124199 - RNA, 45 nt, Mus musculus
guccgggccccuggagccagagcaggaggagccaccgcagcagga

SEQ ID NO: 124200 - RNA, 49 nt, Mus musculus
aggaggaggagcccgagucccgacuucuacaagagaaauggcgagucug

SEQ ID NO: 124201 - RNA, 49 nt, Mus musculus
cccgucuccagauuggacuagcuccuccuucgguaagaauucagagagg

SEQ ID NO: 124202 - RNA, 46 nt, Mus musculus
cugaauucuuaccgaaggaggagcuaguccaaucuggagacgggua

SEQ ID NO: 124203 - RNA, 46 nt, Mus musculus
cacagagaaaccuugucuugaaaaaucaaucucucucucucuauua

SEQ ID NO: 124204 - RNA, 44 nt, Mus musculus
uccugguuuggcagccgcgcucagaugagucaguguaacugaga

SEQ ID NO: 124205 - RNA, 45 nt, Mus musculus
guaaugugggaaauguuagccauggguaaugauugugcuggucau

SEQ ID NO: 124206 - RNA, 27 nt, Mus musculus
auguacuaguaaagcuacucgugagag

SEQ ID NO: 124207 - RNA, 46 nt, Mus musculus
uaaaaagauaaaggagaaacuagaaaagggcaauuaaauggggagc

SEQ ID NO: 124208 - RNA, 46 nt, Mus musculus
augccaacacaugcuuaugauuuccgaguguaucuacauggcacug

SEQ ID NO: 124209 - RNA, 107 nt, Mus musculus
ucaagucccaccuugcugauuaagggcauguuuacaacauuuggaauggagcagugucggagggaugacuaugacccugacucaagccuagaauucagugaagaaga

SEQ ID NO: 124210 - RNA, 46 nt, Mus musculus
cugugcccagcuuuaaaaaauuaauuaucauuguauauguguagga

SEQ ID NO: 124211 - RNA, 45 nt, Mus musculus
aaaggcagcugaaaccuaaagcagcacaccuucccaagucaugug

SEQ ID NO: 124212 - RNA, 46 nt, Mus musculus
gggcuuaacgagugaauccuuugcauuccauagccuuagggaagac

SEQ ID NO: 124213 - RNA, 51 nt, Mus musculus
uggcaccuggcagaacccagaaccgcccauggauauaagaguacuggagaa

SEQ ID NO: 124214 - RNA, 45 nt, Mus musculus
agaaacaauaguuuaaauaauauggcuuuugugguaggugguuuu

SEQ ID NO: 124215 - RNA, 42 nt, Mus musculus
cugucgcaguuacugaggauauuuaguuagguugggucaugg

SEQ ID NO: 124216 - RNA, 45 nt, Mus musculus
gugacuucuggaugggaggggcugaggguaagucagcaaaguaga

SEQ ID NO: 124217 - RNA, 95 nt, Mus musculus
uuccuuuaaagagaaaguuaaaggcagaaugggaagaacagcagagaaaagagcgagaggaagaggagcagaaacgacaagagaagagagaaaga

SEQ ID NO: 124218 - RNA, 43 nt, Mus musculus
gggcaaagaagaaaaaagaagaggaagcucgaaaacggaagga

SEQ ID NO: 124219 - RNA, 39 nt, Mus musculus
aaugguuacugagggaagaaaaggcacaagaagaauuca

SEQ ID NO: 124220 - RNA, 46 nt, Mus musculus
aaauggaguuauaaaaauaaauuaguaaauauacauucagccaggu

SEQ ID NO: 124221 - RNA, 44 nt, Mus musculus
ucuuccucaguuaauaacuucuggaaacucccgcaacagacaug

SEQ ID NO: 124222 - RNA, 42 nt, Mus musculus
auaguuuuuagucuucuauaguucaccagaguggggacagua

SEQ ID NO: 124223 - RNA, 46 nt, Mus musculus
auguauaguaaauauacauauaaaguguugacauaaaggccuaauu

SEQ ID NO: 124224 - RNA, 46 nt, Mus musculus
ucuuccucuaacaaccuuucuucuucuagucguuuuucuucagcaa

SEQ ID NO: 124225 - RNA, 51 nt, Mus musculus
ggaagaagauccucuugcugaagaaaaacgacuagaagaagaaagguuguu

SEQ ID NO: 124226 - RNA, 46 nt, Mus musculus
ggcauggcuguacaacgaguucagaaucaaacaagaaaaggagagg

SEQ ID NO: 124227 - RNA, 46 nt, Mus musculus
aauagaagguauaaacuuuucuuccauuaaaacuauuuugccagau

SEQ ID NO: 124228 - RNA, 46 nt, Mus musculus
uagauguuuauaagaugaccaagcacuuacaaaugcaggcaagagg

SEQ ID NO: 124229 - RNA, 29 nt, Mus musculus
caggcgcucgcucggcucagagaggcagg

SEQ ID NO: 124230 - RNA, 89 nt, Mus musculus
gaggaccuggguggcugcuuccgcugagaccuugccgugggagaacacagcgacagcaguauggaaacggcgggggcuacggcggacgc

SEQ ID NO: 124231 - RNA, 44 nt, Mus musculus
ucggucgcccacuccgcgcggccaccaaccgguaccugcccaag

SEQ ID NO: 124232 - RNA, 83 nt, Mus musculus
uccggggguggaagaucuccggggggcggcuucggugaggagacauuuucucagcccgcgaugccuggcugacuggccgaggg

SEQ ID NO: 124233 - RNA, 43 nt, Mus musculus
cugggcaaggggcggugcuaaggcccccgcgaggccccgagga

SEQ ID NO: 124234 - RNA, 66 nt, Mus musculus
cggggccucgcgggggccuuagcaccgccccuugcccagaauucaaggcguuaaggccuagcuccg

SEQ ID NO: 124235 - RNA, 41 nt, Mus musculus
aggucccgccucucuccgcggcuccacccaugagcgcccca

SEQ ID NO: 124236 - RNA, 46 nt, Mus musculus
uaauuaguuaaaguaagagacugaacagccuauaggugugcaggag

SEQ ID NO: 124237 - RNA, 45 nt, Mus musculus
ggaaggggagaaagaaagagagagagagagagagagagagagaga

SEQ ID NO: 124238 - RNA, 41 nt, Mus musculus
aagggagagagagagagagagacagggagagagacaggggg

SEQ ID NO: 124239 - RNA, 45 nt, Mus musculus
uugaagcacaaguuuggagacaacuauaaacauucuaagguaucu

SEQ ID NO: 124240 - RNA, 110 nt, Mus musculus
uggguucgagucccaccucgugcuuugguuuuacaccuggcagagugagaaacaagugagauucucugguuuugguugucuagguagaaguggacgacgguguuuguaga

SEQ ID NO: 124241 - RNA, 46 nt, Mus musculus
uuggguuguuugugucuuguccuauguuucugaaguacggcgaagu

SEQ ID NO: 124242 - RNA, 43 nt, Mus musculus
guauggggauccccucuugcgugcgugugugccggccgguguc

SEQ ID NO: 124243 - RNA, 45 nt, Mus musculus
caccugaugcaucagcacaaguccauuaccacccugcaaggagaa

SEQ ID NO: 124244 - RNA, 45 nt, Mus musculus
ccuuugcuauccaaaaguuugguuggcaugugugugcccgaagaa

SEQ ID NO: 124245 - RNA, 46 nt, Mus musculus
uuccugaaaaagcuugagaaauaauuugaauguguacaccuuaguu

SEQ ID NO: 124246 - RNA, 46 nt, Mus musculus
uucuuaacaucuuuuuuuuuuuuuucuuuugugcccuacuccagau

SEQ ID NO: 124247 - RNA, 46 nt, Mus musculus
auguaguauauguguuguuccugaaucaucgguuccauugccuggg

SEQ ID NO: 124248 - RNA, 73 nt, Mus musculus
agaaguucaaagauuucuugccuaaaaaauuaccugcacaagaucuacauaaaauuaagucagccaguaagaa

SEQ ID NO: 124249 - RNA, 46 nt, Mus musculus
augcacaccauagcuguguuucuaaaaaucaccuaaucuaggccau

SEQ ID NO: 124250 - RNA, 24 nt, Mus musculus
ugccagcuaacaaauuacuguaaa

SEQ ID NO: 124251 - RNA, 46 nt, Mus musculus
gcuggagucauaaaaauuugcaaguauguggugggcagaugggaga

SEQ ID NO: 124252 - RNA, 45 nt, Mus musculus
ugguauugcuugugaugaagcuaaaggguuauaggaauguagcaa

SEQ ID NO: 124253 - RNA, 44 nt, Mus musculus
ugugugugugugugugcauacaugaguuuagaugugggggugga

SEQ ID NO: 124254 - RNA, 46 nt, Mus musculus
uuaaaaacacuauuguuaaugaccaccuuuugggacuuguguguau

SEQ ID NO: 124255 - RNA, 54 nt, Mus musculus
auucauaaauuaaaaaagaacugcaaagaacugcaucaagucaggaagcagaga

SEQ ID NO: 124256 - RNA, 44 nt, Mus musculus
cauucuuuuucuuugugugguuuuacagaguuaagauuuaggga

SEQ ID NO: 124257 - RNA, 46 nt, Mus musculus
augaacuuuccugggccgucaggguaagugcuacuguaacuggcua

SEQ ID NO: 124258 - RNA, 45 nt, Mus musculus
uuuucuugaccccucaaucacucugugugugugugugugugugug

SEQ ID NO: 124259 - RNA, 46 nt, Mus musculus
uaaagaacaauauguaaaaauacugauagaggaaguucuaguggag

SEQ ID NO: 124260 - RNA, 46 nt, Mus musculus
uuuuguuauuucuugagauguccaggcacucugaccacuguccuag

SEQ ID NO: 124261 - RNA, 44 nt, Mus musculus
agacaagacagcaagguuuucaugcucucuccuaaaggucauuc

SEQ ID NO: 124262 - RNA, 42 nt, Mus musculus
uagguauuuaacaaacauucccuuugggcugaaaguggguag

SEQ ID NO: 124263 - RNA, 46 nt, Mus musculus
cguuaaaagauuauuuauuuauuuuugauuauguguaugcaugugu

SEQ ID NO: 124264 - RNA, 45 nt, Mus musculus
ugugugcauucuccacauaugugaacuugugugcaaauauacaaa

SEQ ID NO: 124265 - RNA, 45 nt, Mus musculus
uggaaaauugcuuuggaaaguaauaggggcuacauaggcaaccag

SEQ ID NO: 124266 - RNA, 46 nt, Mus musculus
ugagcuugcagacuagugaaugugguaagcucaugggaaggcagag

SEQ ID NO: 124267 - RNA, 45 nt, Mus musculus
ugaccucuuuccaugcuucucuaauuacaaauaaguguuccacaa

SEQ ID NO: 124268 - RNA, 45 nt, Mus musculus
aaagaaaguaagaauuggugucugcuuuuuaaguggucuguguag

SEQ ID NO: 124269 - RNA, 46 nt, Mus musculus
aagaauaugaucaaaauagacuguaugaaaaacuuuuuaagcugga

SEQ ID NO: 124270 - RNA, 45 nt, Mus musculus
uacccaagguacaagauacaauuugcaaaacacaugaaacugaag

SEQ ID NO: 124271 - RNA, 42 nt, Mus musculus
augaagaaaauaccuaauuuuaaaaaaaggaaaaaaaaaaga

SEQ ID NO: 124272 - RNA, 46 nt, Mus musculus
ugaauggguuggugugguaaguuuggggauccggugauuggucaag

SEQ ID NO: 124273 - RNA, 46 nt, Mus musculus
cgccugccucugccuccuaagugcugggauuaaaggugugagccac

SEQ ID NO: 124274 - RNA, 41 nt, Mus musculus
cauuuugcaaacauuuccaauagagaauuaugacaugaaaa

SEQ ID NO: 124275 - RNA, 46 nt, Mus musculus
aauaaacacaauuuauaucugcuacuucaacugaauucccagagag

SEQ ID NO: 124276 - RNA, 46 nt, Mus musculus
cagcugugaggcuaaaugugacaaaauuugaacaguuaugggccaa

SEQ ID NO: 124277 - RNA, 46 nt, Mus musculus
auuugucgaguuucugacaguaccagauuucuuuugcauuggccac

SEQ ID NO: 124278 - RNA, 44 nt, Mus musculus
uuaaugaagucaggagaaaaauggucuggcuuaagcccaggaau

SEQ ID NO: 124279 - RNA, 46 nt, Mus musculus
gaauaccagugacuauucccucuugauauguauaucugugccacaa

SEQ ID NO: 124280 - RNA, 46 nt, Mus musculus
ugugugcacagugagauguaguaacugucugagaagaaugaggcau

SEQ ID NO: 124281 - RNA, 27 nt, Mus musculus
acgucauacaguaaaaauuuaagagug

SEQ ID NO: 124282 - RNA, 44 nt, Mus musculus
uuauauaguugcuggaauuggccuuauggaacccaguacaauaa

SEQ ID NO: 124283 - RNA, 50 nt, Mus musculus
uuuucaaaagucucucccugaaccugaauucuacaguuucagccauacug

SEQ ID NO: 124284 - RNA, 49 nt, Mus musculus
cugcaaauaagucaaauacuuuguaaaaguaaauugcuggagaaaacaa

SEQ ID NO: 124285 - RNA, 45 nt, Mus musculus
uucuucucuaaugauugcauaugcuuauauuugguuggucccaag

SEQ ID NO: 124286 - RNA, 46 nt, Mus musculus
ucaacccaauauaaagaaaagguuugaaaauuauuuaugggccaga

SEQ ID NO: 124287 - RNA, 46 nt, Mus musculus
uaauuugguuuauuauaacuaucugauugaaaauuauagaccugag

SEQ ID NO: 124288 - RNA, 46 nt, Mus musculus
agacauuauauuguugcagaaaagauggaaagaauuuaagagccag

SEQ ID NO: 124289 - RNA, 46 nt, Mus musculus
guaucauuggcacuuuauuaaaugacaaaaaccuaaaagcaccuag

SEQ ID NO: 124290 - RNA, 41 nt, Mus musculus
gcaaguguuuguggucauaccaccuccuuauaaagcagcua

SEQ ID NO: 124291 - RNA, 45 nt, Mus musculus
ugcuuagucaucgguagacauuuaaaauauucaaaauguauggag

SEQ ID NO: 124292 - RNA, 45 nt, Mus musculus
aaaguaauauuaaaauuucuuuuuaaauuucauuuaguaugcuuc

SEQ ID NO: 124293 - RNA, 46 nt, Mus musculus
aaagaaacaagggagggcagagugagaagagacgaccaugggacag

SEQ ID NO: 124294 - RNA, 46 nt, Mus musculus
acuugccucaaaacaagaacaccaccaccaccaccaccaacaccac

SEQ ID NO: 124295 - RNA, 45 nt, Mus musculus
auauacagaugcaaaugugucccuguuugugaaugugaaggucag

SEQ ID NO: 124296 - RNA, 46 nt, Mus musculus
gccagugagcuggggaagacaaccaacacauucuucaagccccccu

SEQ ID NO: 124297 - RNA, 23 nt, Mus musculus
agugacugacaaaagguucuuga

SEQ ID NO: 124298 - RNA, 46 nt, Mus musculus
ccccgccauccuuacucaauuaucagaagauccauucagaccccag

SEQ ID NO: 124299 - RNA, 45 nt, Mus musculus
caccaaauguaaauguguuuugcaagacgagacuccacugccugg

SEQ ID NO: 124300 - RNA, 42 nt, Mus musculus
gugguugugauaaaauauugugaccaaaagcaacuuccggga

SEQ ID NO: 124301 - RNA, 41 nt, Mus musculus
guaacccaucauaguggggaagguaugugagcaggcaggca

SEQ ID NO: 124302 - RNA, 68 nt, Mus musculus
caggaacccacucucuguggaccgcacaugacguuugaugaagaucgcugugagugcgucuguaaagc

SEQ ID NO: 124303 - RNA, 69 nt, Mus musculus
accauguccgggagaucucauucagcacccggaaaacugcaguugcuuugagugcaaagaaagucugga

SEQ ID NO: 124304 - RNA, 46 nt, Mus musculus
agauguccuuuucacaccagaacaugugcaaguagaaagccagccu

SEQ ID NO: 124305 - RNA, 46 nt, Mus musculus
cucacugcuuugucaaguugcugucacuguugcccacuaccccugc

SEQ ID NO: 124306 - RNA, 45 nt, Mus musculus
caaaugacuuguagcuucagaugucuuugcgccaucagcacucag

SEQ ID NO: 124307 - RNA, 46 nt, Mus musculus
ucaaaucccagcaaccacaugguggcucacaaccgcccauaaugag

SEQ ID NO: 124308 - RNA, 46 nt, Mus musculus
uaccucucucauuuauauuauaucugaaauuuucgauuugaagcag

SEQ ID NO: 124309 - RNA, 31 nt, Mus musculus
uucuugacuuugucauuuacauggcuugggu

SEQ ID NO: 124310 - RNA, 46 nt, Mus musculus
gaggugggcaaggccagccuccuucagugucgccuuccccggguag

SEQ ID NO: 124311 - RNA, 46 nt, Mus musculus
cauugagagagggcacaaggucauaacugucacccaugcuuaugga

SEQ ID NO: 124312 - RNA, 46 nt, Mus musculus
aaauuuuugcccaaccuauuuuuagugaauagcuuacauuggugag

SEQ ID NO: 124313 - RNA, 45 nt, Mus musculus
cugcaaaauguaacacgaggaggaauggccacaucuauggcccag

SEQ ID NO: 124314 - RNA, 42 nt, Mus musculus
guggauacuugauguuuuccuuuaaaggaggaaaagggggag

SEQ ID NO: 124315 - RNA, 46 nt, Mus musculus
cucaauaucucaauguaaagaauaaagcaauuuccuuuaucuggag

SEQ ID NO: 124316 - RNA, 50 nt, Mus musculus
augaaacguacuucuuuggauuccuaguggucacuugaaagaaccagggg

SEQ ID NO: 124317 - RNA, 71 nt, Mus musculus
auuugucauuauccacacuuuccacgaaaaaugaaagauguaggugugggaucuauaaaaaagaaaagaaa

SEQ ID NO: 124318 - RNA, 46 nt, Mus musculus
gcaaauguacacguguauguuuuuuaauggaauaaacccagcucag

SEQ ID NO: 124319 - RNA, 46 nt, Mus musculus
uugggaaccgauggcaguuaguaaaugauuuuccgcaugcggcuag

SEQ ID NO: 124320 - RNA, 77 nt, Mus musculus
ugucagaaauaccaagaauuacauuuccuaauuggaggagagggaccaaagagaaucauuuuggaagaaguacggga

SEQ ID NO: 124321 - RNA, 45 nt, Mus musculus
aauaacagacuuggcuuagaaauuaaauuucuuucguggcaugac

SEQ ID NO: 124322 - RNA, 42 nt, Mus musculus
cuguaaauuguguuuugacuuugucaucuuaugaaccuccaa

SEQ ID NO: 124323 - RNA, 45 nt, Mus musculus
ugagaaugauaagauaucccaaagcagguagaagcaagcccaagu

SEQ ID NO: 124324 - RNA, 44 nt, Mus musculus
acaccaaguaccuuucugaccuguucuauguauaugcauucucu

SEQ ID NO: 124325 - RNA, 46 nt, Mus musculus
ucucucucucucucuguaugugugugugugugugugugcgugugug

SEQ ID NO: 124326 - RNA, 34 nt, Mus musculus
acuguaugugauauguauuauuaauccuuugaac

SEQ ID NO: 124327 - RNA, 46 nt, Mus musculus
gcgacauuugcaaaacuuuuaaaagaguaucuuaacaugccuauua

SEQ ID NO: 124328 - RNA, 45 nt, Mus musculus
aagagauauauuuguguuugguuucuauggaaacaaaugguagag

SEQ ID NO: 124329 - RNA, 45 nt, Mus musculus
uuccacugugcuacucauaauuaucugaaaugaaauuagcgugga

SEQ ID NO: 124330 - RNA, 45 nt, Mus musculus
agucucaaauuucauaaaaccauaacuuuuauaucuugccacuaa

SEQ ID NO: 124331 - RNA, 46 nt, Mus musculus
uaacagaaaaguauuucuagcaucacuggaaaacguuuaugcaggu

SEQ ID NO: 124332 - RNA, 46 nt, Mus musculus
agagugagaaguccgagcacuguucauuuaaacaggcuggggagau

SEQ ID NO: 124333 - RNA, 45 nt, Mus musculus
uuuucuuaauguuuuguauuguaauguuggcauuuuggggguaug

SEQ ID NO: 124334 - RNA, 37 nt, Mus musculus
ucuaucgcuuacaucuuuaggagccagagcgcaaaag

SEQ ID NO: 124335 - RNA, 45 nt, Mus musculus
uguaacuauguuucgaguauaucaucccucaacaauucagccaga

SEQ ID NO: 124336 - RNA, 46 nt, Mus musculus
cacaucccacaccuccucuccacccacccugucuccauguugauuu

SEQ ID NO: 124337 - RNA, 44 nt, Mus musculus
aauuuauuuuuuacacuccauauuuuauccaccccacccccguc

SEQ ID NO: 124338 - RNA, 45 nt, Mus musculus
cacuugguucuucucucauagccaaguccuauucuaauccgaggu

SEQ ID NO: 124339 - RNA, 46 nt, Mus musculus
gaauuuacccugacccuuuguaaacaguucuaaaaauaggccccaa

SEQ ID NO: 124340 - RNA, 45 nt, Mus musculus
ggggaaaaaguguaauuauuuguuaucuauaaaauauguccagga

SEQ ID NO: 124341 - RNA, 46 nt, Mus musculus
aacaaacuaaugcagggcaucuuaaauaagaaguaaauuggcaggu

SEQ ID NO: 124342 - RNA, 74 nt, Mus musculus
cauaaaagaucagaaaaccauaauggacaagaagaagcucauagcauucugguuggaacgauaugccaagagag

SEQ ID NO: 124343 - RNA, 53 nt, Mus musculus
gcacgcugucaggaugagcagagaagguccaugguuuuaagguguuuauugua

SEQ ID NO: 124344 - RNA, 46 nt, Mus musculus
uuaugaaaguaaaguuaaaugaccauccuguuuauuacuuguaugc

SEQ ID NO: 124345 - RNA, 26 nt, Mus musculus
guaacauggucuguuauggugacuuc

SEQ ID NO: 124346 - RNA, 46 nt, Mus musculus
gccuucaucauauauauuauaaagacaagcuuccuuucccccagaa

SEQ ID NO: 124347 - RNA, 46 nt, Mus musculus
cauauagcacuacuuuaagauaugcauuagaaaaccauuggaagaa

SEQ ID NO: 124348 - RNA, 45 nt, Mus musculus
ugagcauauccaacuuuuacugguguguuuguggguguuuugacg

SEQ ID NO: 124349 - RNA, 42 nt, Mus musculus
cgcucagaauaaagccaagcuaaucucagagacccggcggag

SEQ ID NO: 124350 - RNA, 42 nt, Mus musculus
caacuggaauccauuugcaguuggaacuggaucaacacagag

SEQ ID NO: 124351 - RNA, 32 nt, Mus musculus
ggaaauccuugucuuucaguuguccagaggag

SEQ ID NO: 124352 - RNA, 46 nt, Mus musculus
acuuuugaguuuugaacuaaaccaugcauuggaugagaacacaaag

SEQ ID NO: 124353 - RNA, 46 nt, Mus musculus
ugggaaaguuacuacuauaucacuuaugcuuuccucuauugagugg

SEQ ID NO: 124354 - RNA, 46 nt, Mus musculus
uucaugaugucccacaaguagacacaacacaaaugcuggucaccag

SEQ ID NO: 124355 - RNA, 45 nt, Mus musculus
gguuuucuuuuuguuuguuuuuguuuguuuguuuguuuguuuuug

SEQ ID NO: 124356 - RNA, 46 nt, Mus musculus
agaauagaguuuauucagggcacagggaaaggaguuaaaaggguag

SEQ ID NO: 124357 - RNA, 45 nt, Mus musculus
aaugaugacuauuacuauaucuuaccuuuacauuuuuguugucaa

SEQ ID NO: 124358 - RNA, 42 nt, Mus musculus
cauggugccauguacuagaugaugacuuaguugugggcgcaa

SEQ ID NO: 124359 - RNA, 45 nt, Mus musculus
aaaaaaacguguacaauaaaccaaauucuuuuguuuuuccccaca

SEQ ID NO: 124360 - RNA, 46 nt, Mus musculus
uguuccuucaaauaucugaaggucgaaaaugaggauuucuuaguug

SEQ ID NO: 124361 - RNA, 45 nt, Mus musculus
aucuuaagacuaaaaguuacagacacaaagccucuaugaauugug

SEQ ID NO: 124362 - RNA, 46 nt, Mus musculus
uaugcuagcaugauucgucaagauaacagugucuuugggauggcag

SEQ ID NO: 124363 - RNA, 42 nt, Mus musculus
gucuaucauugacauaaauugcauuuuuccuuuauggccuag

SEQ ID NO: 124364 - RNA, 46 nt, Mus musculus
uucuucaguuugaguucaucagacuugauccacuugcaaggcauag

SEQ ID NO: 124365 - RNA, 46 nt, Mus musculus
caaaucccagcaaccacaugguggcucacaaaccauccguagcgag

SEQ ID NO: 124366 - RNA, 45 nt, Mus musculus
ggaaaagaguauuguuugaaacaaaaaccaaagcugagguaggcu

SEQ ID NO: 124367 - RNA, 44 nt, Mus musculus
aguagaacccaggcauccacaagagggaaugaagcacgguguga

SEQ ID NO: 124368 - RNA, 48 nt, Mus musculus
gucccucaaugcagccaugcugucaaucaagacucaguaucacaacca

SEQ ID NO: 124369 - RNA, 46 nt, Mus musculus
aggaaaaugugcugagugaggguuaaggaugcugucuuuacuuggg

SEQ ID NO: 124370 - RNA, 46 nt, Mus musculus
uaaaauauuuucagaaacuaacugaucauuagaacacagcaaguug

SEQ ID NO: 124371 - RNA, 46 nt, Mus musculus
aaugguuuagucuagccuauaagucaguugauaaauacuugccuag

SEQ ID NO: 124372 - RNA, 45 nt, Mus musculus
uugguuuucucuuuaacaguccaguucauugaaauuauugccuag

SEQ ID NO: 124373 - RNA, 42 nt, Mus musculus
ccgcccgccgccugcuccgcccgcuccggccgcucggcccgc

SEQ ID NO: 124374 - RNA, 46 nt, Mus musculus
cacaguuucucagcaccagcuccuggcagccauaccagcaaagcag

SEQ ID NO: 124375 - RNA, 46 nt, Mus musculus
cugcacaaucuuuuugccccagcggucuuaaucuuuauucagccua

SEQ ID NO: 124376 - RNA, 46 nt, Mus musculus
caagugcuggaaucaaagauguauagcagcagaccuagcccuggag

SEQ ID NO: 124377 - RNA, 43 nt, Mus musculus
guugaaaaacauuugcaaauaaaagaagaaguggggacuguuu

SEQ ID NO: 124378 - RNA, 46 nt, Mus musculus
caugguguuuagagguggggggaggcgcuggagagauggcucggag

SEQ ID NO: 124379 - RNA, 44 nt, Mus musculus
cagaggcugagaauaaccguccugcuguaacucuagacccccua

SEQ ID NO: 124380 - RNA, 45 nt, Mus musculus
cuuggcuauucuagaaguacacuuagauuguuuugacccacaagg

SEQ ID NO: 124381 - RNA, 46 nt, Mus musculus
aaaauucaguuaacgcauauuguugccucauuagucggugggagaa

SEQ ID NO: 124382 - RNA, 73 nt, Mus musculus
gauaguuggugcauucuaaccaacacacacacacacacacagaaagguggagaaacaaauuaguaugcagaag

SEQ ID NO: 124383 - RNA, 37 nt, Mus musculus
uuacgcagaugugaaagagccugaaagcuuucccuuu

SEQ ID NO: 124384 - RNA, 42 nt, Mus musculus
ccgggguucugacuguugccugcuuacauuuagugucgauga

SEQ ID NO: 124385 - RNA, 46 nt, Mus musculus
ccacacaauagguguggaauuuuuaaauaaagaucuggagguggac

SEQ ID NO: 124386 - RNA, 48 nt, Mus musculus
ggcaggaaaaucgucucuuuuuaaaauaauucuucuuggagauggugg

SEQ ID NO: 124387 - RNA, 46 nt, Mus musculus
aagguaaggcucaugaccuuuguauuaugcuuuuuaaaauucagau

SEQ ID NO: 124388 - RNA, 42 nt, Mus musculus
aaaaaaaaaaaaaaaaguguguguuuggggugggggagauga

SEQ ID NO: 124389 - RNA, 46 nt, Mus musculus
cuggagcaauagcggagagcuuacaucuugauacaaaagcagagag

SEQ ID NO: 124390 - RNA, 45 nt, Mus musculus
cagggaaacagguaggcacaugcaacuuggagcauguaagcagau

SEQ ID NO: 124391 - RNA, 46 nt, Mus musculus
gaggaggcagagaagagaggccaucaggugcgcguggggcacgauc

SEQ ID NO: 124392 - RNA, 46 nt, Mus musculus
ugugucuugccucugcuucccaauauguauauuaccaugcccagcu

SEQ ID NO: 124393 - RNA, 25 nt, Mus musculus
caguagucuuacggacuauuuuagg

SEQ ID NO: 124394 - RNA, 52 nt, Mus musculus
aaaaugccucacauuuauuucaacaucucacugaggagaacgcuuaacagau

SEQ ID NO: 124395 - RNA, 49 nt, Mus musculus
uccaugaccgauuuuuuuguuuuaaaucuaaagaguaaagaaagaguag

SEQ ID NO: 124396 - RNA, 46 nt, Mus musculus
acuaccaggccauccacugaggccauguauuaaaggguugauggga

SEQ ID NO: 124397 - RNA, 46 nt, Mus musculus
uauuguguaagguauauaugcacauguguauuuagaggccaaagaa

SEQ ID NO: 124398 - RNA, 42 nt, Mus musculus
acuacuuccauuuuauccuauaguacucugaaggcccgaagu

SEQ ID NO: 124399 - RNA, 81 nt, Mus musculus
ucgugugcuuuguaguguuuugcuguacugaaacauuuauggcauggaggcuuacuuauuuagaacauugggggaauuuaa

SEQ ID NO: 124400 - RNA, 82 nt, Mus musculus
ugagccaucucaccagcccuacuuugucuuuuauaaucuuaggucaaaguuaucacuacuuguguagcacuccaaguaacuu

SEQ ID NO: 124401 - RNA, 46 nt, Mus musculus
ugcauguuggugaaggaaaaagcugggugggagaugaugaaauaga

SEQ ID NO: 124402 - RNA, 46 nt, Mus musculus
ugacugugcugccccuuucacaucaaagaaucagaacuacugagca

SEQ ID NO: 124403 - RNA, 56 nt, Mus musculus
uccagcaaccaugucugacaaacccgauauggcugagaucgagaaauucgauaagu

SEQ ID NO: 124404 - RNA, 45 nt, Mus musculus
cgccuggcaucuuuuggagagcaagcccuucuagaaaacggagau

SEQ ID NO: 124405 - RNA, 47 nt, Mus musculus
uggggaggcaguuuugugugccaaggcagcauuguuggacuagagag

SEQ ID NO: 124406 - RNA, 42 nt, Mus musculus
ggggggggggaugcuaaacucuuccagaugccgaguaacggg

SEQ ID NO: 124407 - RNA, 46 nt, Mus musculus
aauuagucugacacugcaguaccucuauggagaaagacuucuacag

SEQ ID NO: 124408 - RNA, 62 nt, Mus musculus
agaguuuuagagagggacuaaauguauuuugaauugugagaugaaaaugagaauuugggggc

SEQ ID NO: 124409 - RNA, 46 nt, Mus musculus
ccagagaaagcagcaguacuuguuaaaagacauuagcaacauuaaa

SEQ ID NO: 124410 - RNA, 46 nt, Mus musculus
guacuaaaagcaaauagcacuaagcaugugugaagagacugcaggu

SEQ ID NO: 124411 - RNA, 42 nt, Mus musculus
cuuuagaagguggagcuugcuggaggaagugcgucaccggaa

SEQ ID NO: 124412 - RNA, 45 nt, Mus musculus
agcugucuccuagcccgccuuuguugaauccauccacaccacagu

SEQ ID NO: 124413 - RNA, 46 nt, Mus musculus
uuuuuucuuccuauuaaggaaaguaccacgacaacuaauaggugag

SEQ ID NO: 124414 - RNA, 42 nt, Mus musculus
gaagcagcuagaggaugacuguuacuauaucaacaggaggaa

SEQ ID NO: 124415 - RNA, 41 nt, Mus musculus
aagcagcaccugucaugagagcuguggagaaaagaauggag

SEQ ID NO: 124416 - RNA, 46 nt, Mus musculus
gacuguagcagagccuucccaguaaccgccgucaucucugcuagca

SEQ ID NO: 124417 - RNA, 96 nt, Mus musculus
gguacaggaaaaaagaagaggcgcuguagguugccuggugucgacucugucuuaaaaagcgugccaguuaaagaaaaaucuaaaaaugacgaaaac

SEQ ID NO: 124418 - RNA, 45 nt, Mus musculus
gauuacagcgcaaauuggccaaaaaagcaauagcucgccuguaag

SEQ ID NO: 124419 - RNA, 88 nt, Mus musculus
uaguauuuccugguuucagaucaucgauguuauuaucgggaaagacgaaaagggcagaaagauuccagaauaucugauacauuuuaau

SEQ ID NO: 124420 - RNA, 44 nt, Mus musculus
gccgccgcggggggaacagggaggagaugcgggacuggguucga

SEQ ID NO: 124421 - RNA, 46 nt, Mus musculus
gaaguuauucucuguaaaugugauaguauaacaaauaaauguagaa

SEQ ID NO: 124422 - RNA, 45 nt, Mus musculus
uuagucagaaagauauguacaauaucauuagaauucacaaucaga

SEQ ID NO: 124423 - RNA, 46 nt, Mus musculus
aguggguuuacccuucugaacagauguucuggaaugccauguuacg

SEQ ID NO: 124424 - RNA, 46 nt, Mus musculus
uuacaccucugcuauuuuggucauaccacuuuuuuguugcugcucc

SEQ ID NO: 124425 - RNA, 42 nt, Mus musculus
gcauuccacauaaucauaggcccggucuuggugagcaggcac

SEQ ID NO: 124426 - RNA, 42 nt, Mus musculus
caggcuguccagugacugcagcaacaucugaccugaccagug

SEQ ID NO: 124427 - RNA, 42 nt, Mus musculus
uuggggcuggacuuguauggaacuaauggcuggaagucagag

SEQ ID NO: 124428 - RNA, 23 nt, Mus musculus
uucacugagagagaaguagauau

SEQ ID NO: 124429 - RNA, 45 nt, Mus musculus
cuuuaugcaucgggcauccugaagguggugaagcuggcugaccau

SEQ ID NO: 124430 - RNA, 46 nt, Mus musculus
gccgcccugcccccaagucuccgcuccgacuugucccgcgcggcgc

SEQ ID NO: 124431 - RNA, 42 nt, Mus musculus
guucgacgcgcucgcggccgcgccgcgcgggacaagucggag

SEQ ID NO: 124432 - RNA, 45 nt, Mus musculus
cugaggcagggggaugacugugagugauuuucugaggcaguguaa

SEQ ID NO: 124433 - RNA, 103 nt, Mus musculus
gugauuuucugaagcagggggaugacccugagugaccaugugagacagggggaugacugugagugauuuucugaagcagggggaugacccugagugaccaugu

SEQ ID NO: 124434 - RNA, 51 nt, Mus musculus
agugauuuucugaggcagggggaugacccugagugaccaugugaggcaggg

SEQ ID NO: 124435 - RNA, 96 nt, Mus musculus
ucccccugccucacacggucacucagggucaucccccugcuucaguagcagugagcccggaaagcugaagaccaacagugagugcugugaacucgg

SEQ ID NO: 124436 - RNA, 47 nt, Mus musculus
cccgguggcgagaaacgcgcaagugcacccccgguucucugccucgc

SEQ ID NO: 124437 - RNA, 140 nt, Homo sapiens
caccuguuuccuuuacuuccaucagcccugggaagcagaagaggugugggaagaaagguaaguggugcaaccucucugacccacacaggguguauaccugcagccccaccugagucccucaccugcuauagcuaccagac

SEQ ID NO: 124438 - RNA, 218 nt, Homo sapiens
ccgugaaagaugaugggaaagcccuggacauggggucgggggaaaccgucagccagaccacccucccucuauucccucccuucccaaacccuuccagagaguaagagauccuaggccaaggugacaaagggaggggcugcaccuucagugggagggaagucaggguacagggguggggccugcccugcucagccucaccugucgagguaggcccgccc

SEQ ID NO: 124439 - RNA, 129 nt, Homo sapiens
uugaaccucuggaaggaagaagugguguggucaugggagggaagagccccgagaauggaagaauuccugccaccccgaccagcccucaaaccuugggguucuuaaggaaacccagauuaaaguccagau

SEQ ID NO: 124440 - RNA, 44 nt, Homo sapiens
gcucauuccuccacucuggcuccacuugcagagacaggcccccu

SEQ ID NO: 124441 - RNA, 45 nt, Homo sapiens
uuggacugguaaaagcagacucccggcuagaggaaagggauccug

SEQ ID NO: 124442 - RNA, 42 nt, Homo sapiens
ggugagauccuggugaggugaaugcagcagagaaggcagcag

SEQ ID NO: 124443 - RNA, 37 nt, Homo sapiens
gugguggcagcccagguggugagaggaaccaucuuca

SEQ ID NO: 124444 - RNA, 31 nt, Homo sapiens
caggugacaguucgugaugcuauaaaucagg

SEQ ID NO: 124445 - RNA, 45 nt, Homo sapiens
ccauugggcccucugaagacuauaggcacaggcugaaggccacca

SEQ ID NO: 124446 - RNA, 46 nt, Homo sapiens
aauaaguccuuuagcauccucugaauuccagggacugaccaccuuu

SEQ ID NO: 124447 - RNA, 42 nt, Homo sapiens
accucacauucaacuccuucuuuagauagcacugcugcagcu

SEQ ID NO: 124448 - RNA, 58 nt, Homo sapiens
aaucaucuuguaacuguggaaggaggcuggccacaguuuggaguaggagcugaaaucu

SEQ ID NO: 124449 - RNA, 46 nt, Homo sapiens
ugauccuggcacagauuucagcuccuacuccaaacuguggccagcc

SEQ ID NO: 124450 - RNA, 57 nt, Homo sapiens
ugucacuggugcugaugucccuaugccuuaugcaaagauucuagaggacaacucuau

SEQ ID NO: 124451 - RNA, 68 nt, Homo sapiens
auuuuauccucucucaccacaaggacaaaguauggauguggcagaguccucaugaaagauguauccaa

SEQ ID NO: 124452 - RNA, 49 nt, Homo sapiens
gaaguucauuucuaugcaaauagguugaggucagagaaguuuuccucag

SEQ ID NO: 124453 - RNA, 48 nt, Homo sapiens
uccgaccucuuggucuucucuccugcaaggaaaaaaaagaauuuuaug

SEQ ID NO: 124454 - RNA, 56 nt, Homo sapiens
cgguuucuuggagccgggauucggcuuuaaguuggccaggcucacacgcggcaggc

SEQ ID NO: 124455 - RNA, 62 nt, Homo sapiens
gccauaacccgcagauccaagaacuuucaagggcgcccugagcugcucggaggccacguggu

SEQ ID NO: 124456 - RNA, 61 nt, Homo sapiens
ccacaaccacguuuucagcuuuacaaauacugaaucuuguagugggucuaguggguuaggg

SEQ ID NO: 124457 - RNA, 46 nt, Homo sapiens
uguuaacucugcaaggguggggcggcaccauuucucagaccaggua

SEQ ID NO: 124458 - RNA, 53 nt, Homo sapiens
agaaaaaugaaguuacugaagcuggacugguaugagagaggcgauaguaaugg

SEQ ID NO: 124459 - RNA, 56 nt, Homo sapiens
augacaaacgcagauuacuuugaggauguagaguagauaaaaggcuagcuaagccg

SEQ ID NO: 124460 - RNA, 41 nt, Homo sapiens
guaaagugaggguauagguuugucauguaagggaguaguug

SEQ ID NO: 124461 - RNA, 62 nt, Homo sapiens
uuguaacugguagggaguauuuaggaaggauugaagccggauagagauuuaaagacagagag

SEQ ID NO: 124462 - RNA, 46 nt, Homo sapiens
caacaccaggugcugguggucaauggaggagaaugcauggcugcag

SEQ ID NO: 124463 - RNA, 46 nt, Homo sapiens
gaccauuuauagcagaaugccgucaaacuauugccaaacuugauaa

SEQ ID NO: 124464 - RNA, 37 nt, Homo sapiens
uuuaaaacaaguuuuuuuuuaaugcaacucuuggcaa

SEQ ID NO: 124465 - RNA, 46 nt, Homo sapiens
ucaccaaguuucuuuagacuuggauucauuagcagaaaguccugaa

SEQ ID NO: 124466 - RNA, 46 nt, Homo sapiens
cuuuaaaaaaugaauaugaagguaaacuugacggacuaauaaagga

SEQ ID NO: 124467 - RNA, 53 nt, Homo sapiens
gguuaaacaugaaaaagaagcuguaaucugccugcagaaugaaaaggaucaga

SEQ ID NO: 124468 - RNA, 46 nt, Homo sapiens
gacacgagaugcaaguuagagguugaacuugcguugaaggaagcag

SEQ ID NO: 124469 - RNA, 57 nt, Homo sapiens
aauuaguaaacucaaccaaaagauucaggauaauaaugaaaauuaucaggugggcuu

SEQ ID NO: 124470 - RNA, 42 nt, Homo sapiens
uuaaagcugaauuaaacaaaguaacaucuuugcauaaccaag

SEQ ID NO: 124471 - RNA, 51 nt, Homo sapiens
auucagaauugagugcucuugaaagacaaaaagaugaaaaaauuacccaac

SEQ ID NO: 124472 - RNA, 47 nt, Homo sapiens
ugaaaaagaugaagcuauucagacugcccuaaaagaauuuaaauugg

SEQ ID NO: 124473 - RNA, 47 nt, Homo sapiens
uugggaaauguuggaucucuguauugcagugcauaugagaucauaaa

SEQ ID NO: 124474 - RNA, 49 nt, Homo sapiens
cauaauaaaugaucuuagugauaaguugaaaaguacaaugcagcaacaa

SEQ ID NO: 124475 - RNA, 68 nt, Homo sapiens
uuuguguuuauaaauuaagccuuuuuaugauuaacuuauuuuuguggucacuguuuugggaagucuug

SEQ ID NO: 124476 - RNA, 24 nt, Homo sapiens
uuuaaaugaucuugacaacugaaa

SEQ ID NO: 124477 - RNA, 74 nt, Homo sapiens
ucugaauuuuuggugugaaaugaaagauuaggagaaaaaaaucuugcuaugacuggauaaacuguaaugggugc

SEQ ID NO: 124478 - RNA, 50 nt, Homo sapiens
uaaauaaaucugccagguagguaggccauuuugacuuaauugguacccuu

SEQ ID NO: 124479 - RNA, 45 nt, Homo sapiens
ccuucaggauugcacuggccaucaucuuguguagguuguggaccc

SEQ ID NO: 124480 - RNA, 46 nt, Homo sapiens
aucacgucuugguccacuuggugccaucuauaagggacuccuggca

SEQ ID NO: 124481 - RNA, 43 nt, Homo sapiens
cauagccuuccauggcagccugcagugcacugauggggucagu

SEQ ID NO: 124482 - RNA, 49 nt, Homo sapiens
cggccaaggaugauauugacacagguugugguggugacaaagauguugc

SEQ ID NO: 124483 - RNA, 83 nt, Homo sapiens
ggccugagcaaggacagcagcuggaaagugaagggcaggccugacucucagcagcaguagugauccggcuugaaggggccauc

SEQ ID NO: 124484 - RNA, 46 nt, Homo sapiens
aaaugaaaugauauguacagagcaggaauugcuacacacuuuguag

SEQ ID NO: 124485 - RNA, 44 nt, Homo sapiens
uggcgaacugguccuccaaggggucggcauugccgggcaccuca

SEQ ID NO: 124486 - RNA, 44 nt, Homo sapiens
gcgggcccccuuuccucuugcccccaggccccugccggccuccc

SEQ ID NO: 124487 - RNA, 42 nt, Homo sapiens
gggcgcuguccuccuuuucucuugccacccaagccaggcggc

SEQ ID NO: 124488 - RNA, 47 nt, Homo sapiens
ccaggcaaauucuugcaaauaccaaaauacuacuaugccuuauaaaa

SEQ ID NO: 124489 - RNA, 45 nt, Homo sapiens
ugcugcuauagaaaauagcagaaucggcuugcugcuacgagagaa

SEQ ID NO: 124490 - RNA, 42 nt, Homo sapiens
agaguuuuguugaauguauuguacaguauguaggagcaggag

SEQ ID NO: 124491 - RNA, 47 nt, Homo sapiens
auggaaagcacacaugauuuuaugaaguacuuuugcccaugugcuga

SEQ ID NO: 124492 - RNA, 54 nt, Homo sapiens
acuuauuaugacugaacaagcaagaagauaucugaguacuuacacagcuaccag

SEQ ID NO: 124493 - RNA, 48 nt, Homo sapiens
auuggagguauauuuugaggcuggggagauaagcaggaucuggcagaa

SEQ ID NO: 124494 - RNA, 41 nt, Homo sapiens
acgucagucuuguacuugaagggaaaaaaaacacuuguaau

SEQ ID NO: 124495 - RNA, 43 nt, Homo sapiens
gaacuugagaugcuucuuaugucagcugagaaugaaguuagaa

SEQ ID NO: 124496 - RNA, 47 nt, Homo sapiens
cuaucaaaaaucauuggaauucuacuaugcgaagaaaaguggaacag

SEQ ID NO: 124497 - RNA, 34 nt, Homo sapiens
uucugcuuccuaauuguauuuuuguuuuuugcuu

SEQ ID NO: 124498 - RNA, 41 nt, Homo sapiens
cuauuaugccuauuguuuaccauacuacuauucaccugcug

SEQ ID NO: 124499 - RNA, 38 nt, Homo sapiens
auagaauuggagaguuaucuauauuuagggguagagga

SEQ ID NO: 124500 - RNA, 46 nt, Homo sapiens
acacacaaguucaguguuugaauuuacaaauuuaaauaaaauucuu

SEQ ID NO: 124501 - RNA, 29 nt, Homo sapiens
uuuguuccaauggaauugacaagucaaug

SEQ ID NO: 124502 - RNA, 39 nt, Homo sapiens
aaaaugucauuuagaaaccuguuuacuaguaacagauua

SEQ ID NO: 124503 - RNA, 53 nt, Homo sapiens
ucaucucugaaugauguaucucuuaagucuucauacuuaaauguguuucauac

SEQ ID NO: 124504 - RNA, 66 nt, Homo sapiens
aacuucaaggacccaauuaacaucaaucuucagaaaagauagauauuuaaagcucuuguaauuaug

SEQ ID NO: 124505 - RNA, 42 nt, Homo sapiens
cccagguuucucggugacucuccccguaaugcgcguccagau

SEQ ID NO: 124506 - RNA, 42 nt, Homo sapiens
uagaggaucggggagaaggagcauucgccggaggcuggagga

SEQ ID NO: 124507 - RNA, 51 nt, Homo sapiens
accaucaaacugauggaaccccuugaugaagaaaucucuggaauuauggaa

SEQ ID NO: 124508 - RNA, 36 nt, Homo sapiens
ucuaaugcgcaggcucggccuccgccauauuaaagg

SEQ ID NO: 124509 - RNA, 56 nt, Homo sapiens
auuuucuuuuuauuucagauauuuuaaaguauauuguaggcuuuuuggggaagcug

SEQ ID NO: 124510 - RNA, 61 nt, Homo sapiens
uuuuuuaaagaaucugcaaaauggcugauaauuuggaugaauuuauugaagagcaaaaagc

SEQ ID NO: 124511 - RNA, 63 nt, Homo sapiens
cagauuggccgaagacaaagcagaguuggaaagugauccaccuuacauggaaaugaagguaaa

SEQ ID NO: 124512 - RNA, 45 nt, Homo sapiens
cagggaaaguugucagcgaagcuuucugaaaacaguaagauacug

SEQ ID NO: 124513 - RNA, 60 nt, Homo sapiens
auugauuauggauuaaguuuaccacuuggagaagacuaugaacggaagaaacauaaauua

SEQ ID NO: 124514 - RNA, 45 nt, Homo sapiens
uauugcacaugaaaauuaaggccugauuuucccuuucagggaguu

SEQ ID NO: 124515 - RNA, 45 nt, Homo sapiens
uucacagauuuaaugaggaucguguuuuugauagacgguaucaua

SEQ ID NO: 124516 - RNA, 60 nt, Homo sapiens
ugcuuaauauagcaaauuaauuguuaauauuugcuguuguuacuuuuuaucauuauacua

SEQ ID NO: 124517 - RNA, 47 nt, Homo sapiens
augcugucaguuuuaagaugcaucauuauuuuaugucccacugaggg

SEQ ID NO: 124518 - RNA, 56 nt, Homo sapiens
cauugacuuguuuacuugacaaguguuaauacauuuugaguagcuuuugggaccug

SEQ ID NO: 124519 - RNA, 38 nt, Homo sapiens
gugccugaucuuguuugauguuggaaacuaaguaggcu

SEQ ID NO: 124520 - RNA, 48 nt, Homo sapiens
uguuuuaagugaacuaacagagcuaguucugggugauuaaaugcuaaa

SEQ ID NO: 124521 - RNA, 84 nt, Homo sapiens
gguugggugauuugcuaggaggauccauaaggacuuuggguauaguuguagucacaguuauaauuuauuacagcaaaaugauac

SEQ ID NO: 124522 - RNA, 38 nt, Homo sapiens
uauuacguuuaaacucuuagugucucauuaaccagcag

SEQ ID NO: 124523 - RNA, 27 nt, Homo sapiens
auuuuauuugagaaccuauacagccag

SEQ ID NO: 124524 - RNA, 46 nt, Homo sapiens
gaaauacagacuagaacuguuggaacaaauggcugagcaacagagg

SEQ ID NO: 124525 - RNA, 46 nt, Homo sapiens
aaagauuuagaacucaggguugcagcgucuggagcacaagacccug

SEQ ID NO: 124526 - RNA, 79 nt, Homo sapiens
ugucagcguuuauuuuaaauauaucuuauguugucaagauucgggaaagagaagaaagaaggaagaaagaacgugaaga

SEQ ID NO: 124527 - RNA, 46 nt, Homo sapiens
aauaugaagcuaaauuagaagcugaaaugagaacauauaaucccug

SEQ ID NO: 124528 - RNA, 37 nt, Homo sapiens
guuuuuaaaauaagcuaaauuauuuuuaacuuuuuaa

SEQ ID NO: 124529 - RNA, 112 nt, Homo sapiens
aggugacacagagcugaugcaggugaugcgggaggugacacagagcugaugcaggugaugugggaggugacacagagcugaugcaggggaugugggaggugacacagcugau

SEQ ID NO: 124530 - RNA, 59 nt, Homo sapiens
caaagguggcgcaggaggugaugcgggaggugacacagagcugaugcaggugaugcggg

SEQ ID NO: 124531 - RNA, 45 nt, Homo sapiens
agcugaugcaggggaugugggaggugacacagcugaugcagguga

SEQ ID NO: 124532 - RNA, 87 nt, Homo sapiens
cacaaagguggcgcaggaggugaugcgggaggugacacagagcugaugcaggugaugcgggaggugacacagagcugaugcagguga

SEQ ID NO: 124533 - RNA, 87 nt, Homo sapiens
gacacaaagguggcgcaggaggugaugcgggaggugacacagagcugaugcaggugaugcgggaggugacacagagcugaugcaggu

SEQ ID NO: 124534 - RNA, 126 nt, Homo sapiens
gaugcgggaggugacacagagcugaugcaggugaugugggaggugacacagagcugaugcaggggaugugggaggugacacagcugaugcaggugaugugggaggugacacagcugaugcaggagg

SEQ ID NO: 124535 - RNA, 49 nt, Homo sapiens
uccugauucugaacucccauucucuuuuguagcauuuauguauuacuug

SEQ ID NO: 124536 - RNA, 33 nt, Homo sapiens
auuauguguuauuaggagaccgaugacagguaa

SEQ ID NO: 124537 - RNA, 86 nt, Homo sapiens
aggaagcagagcgagagagacugagaauugcagaagaaaaagaagaaagacggcuugcagaacagagggcacgaauucagcaggag

SEQ ID NO: 124538 - RNA, 53 nt, Homo sapiens
gaggagguacaucuuuuuucccuauuguauuuuacuacuuagucugaagguga

SEQ ID NO: 124539 - RNA, 58 nt, Homo sapiens
augaagagcauauucgguuagcugaagaaagacaaaaagaagcagaaagaaagaagaa

SEQ ID NO: 124540 - RNA, 42 nt, Homo sapiens
uggaaagucguggagagcaauguaagcucauggcacaugugg

SEQ ID NO: 124541 - RNA, 43 nt, Homo sapiens
gcugguagauuccagacaggcuaauuagcagaagguaaagaaa

SEQ ID NO: 124542 - RNA, 45 nt, Homo sapiens
gagauucugauuuaguaggucugugguagauaaugcauaggaauu

SEQ ID NO: 124543 - RNA, 45 nt, Homo sapiens
auaagaugcuuuugcacaaguccagaugugagacugaggacccaa

SEQ ID NO: 124544 - RNA, 51 nt, Homo sapiens
uggugcuuguuaaauuagugccauugucuacgaugagugucuacaagagaa

SEQ ID NO: 124545 - RNA, 53 nt, Homo sapiens
ggaaggugcuuggagagaggaaguuggaaaaaagaauaaucggaggagaaugg

SEQ ID NO: 124546 - RNA, 68 nt, Homo sapiens
aggcaguaucuaaaaagggcaaaauguacuauucacaggaacacauaggaaggcuggucauauuggag

SEQ ID NO: 124547 - RNA, 36 nt, Homo sapiens
agucaguccuaccucuacccauccucugcuuuuagg

SEQ ID NO: 124548 - RNA, 96 nt, Homo sapiens
acggguacgggcaaaaucaagaggguacacaaaacacagggauguggccccugcggcaccacccgaugccagauucccugcaaaguagagccaaaa

SEQ ID NO: 124549 - RNA, 42 nt, Homo sapiens
aggccucggaauucccuuucagcuccagcuuuacccacauca

SEQ ID NO: 124550 - RNA, 283 nt, Homo sapiens
aguguucuugggauccggaagcauuccugggaauaggaaagagaugcuuuuaccaaaaagcagaguuuuacugacuuccuuuccccacauccccuaaacacgucaucuguacacaaggguugcauuggaugaucuuggcuuccuuuagcaauuaaaaaaacaacucuuuagcucuuggacuguuagguugguacaaugcucuuuuaaacugucuccuaagaacacaacguuaaagcccacagcaaacuuacccuuugcagugucauagauaccgaaguaggcg

SEQ ID NO: 124551 - RNA, 44 nt, Homo sapiens
auaggagcauugcagaagcggcaucuagucuauguuacacagaa

SEQ ID NO: 124552 - RNA, 79 nt, Homo sapiens
aguauuuaagaacacaaacauggccaaguuucaaauccugccucuggugcuuaccuagcugugccacccugagcaaguc

SEQ ID NO: 124553 - RNA, 42 nt, Homo sapiens
ucucugcaaacgauccuuugagaagcgggaccggcuucggau

SEQ ID NO: 124554 - RNA, 42 nt, Homo sapiens
caaggagcagaaccuaguugcugugcagugucaagggcauau

SEQ ID NO: 124555 - RNA, 49 nt, Homo sapiens
cucaagugugauauuuagguuacaaguauuaaaaaauuuauuuuauaga

SEQ ID NO: 124556 - RNA, 41 nt, Homo sapiens
ggaauauaguacaggaaaauaaucugaaauugaggcuaugu

SEQ ID NO: 124557 - RNA, 49 nt, Homo sapiens
acgccuuucccguccuauggacacuacagaaacagccuggccaccgugg

SEQ ID NO: 124558 - RNA, 42 nt, Homo sapiens
guguuugcuucuauugcuguuuuuucguuuugucuuaauugu

SEQ ID NO: 124559 - RNA, 69 nt, Homo sapiens
uuuacaguauauauauuguucuuuucaguguucacaucuuguuccccauuucucacuugugucaccagc

SEQ ID NO: 124560 - RNA, 45 nt, Homo sapiens
uaauggggcucauaauaaguuuaauaugcacagcaucuuagaaaa

SEQ ID NO: 124561 - RNA, 57 nt, Homo sapiens
guauuacauccccauuuuaaaaacaaaaacauaauaaucguuacaacacguggaguu

SEQ ID NO: 124562 - RNA, 46 nt, Homo sapiens
uaaguuaucuuucaggguaacauggaaauacuauaaaguuggaugu

SEQ ID NO: 124563 - RNA, 47 nt, Homo sapiens
ucuugaaaauacagucugugcucuuugauuuuugcuauuguacgguu

SEQ ID NO: 124564 - RNA, 49 nt, Homo sapiens
aauguagcagacucuccccggaauaaaaaagagaaaucuucauaaugaa

SEQ ID NO: 124565 - RNA, 44 nt, Homo sapiens
cugacuuuaauucuuucaguacugacuguugguuuuggccuugc

SEQ ID NO: 124566 - RNA, 81 nt, Homo sapiens
gaaggcuucuuggguuuacuuuucuguuauaacuuuuacuuuguuuguugcaugguuuuucuuuuggaggagugauagaga

SEQ ID NO: 124567 - RNA, 54 nt, Homo sapiens
guguuuucuauuuuagacuucuggaggagaaggagcagggagaauaaagaggaa

SEQ ID NO: 124568 - RNA, 50 nt, Homo sapiens
auuuaguaaauacauugugaugugagaauuggagaagggagaagauacga

SEQ ID NO: 124569 - RNA, 51 nt, Homo sapiens
uuauucucuuuaggaccuuaggcaaaugcauaaaauagaugaaaauauguc

SEQ ID NO: 124570 - RNA, 46 nt, Homo sapiens
aaauuaacaggcgaaugcacuucuccaaaacaaaacacagcaaguu

SEQ ID NO: 124571 - RNA, 48 nt, Homo sapiens
cuucuacaugcuaguggcgauaauuauucaugccguaauucaagagua

SEQ ID NO: 124572 - RNA, 50 nt, Homo sapiens
ugaugggaaauauuuuccgaccguauuuuagauagaacagcaugugcaga

SEQ ID NO: 124573 - RNA, 47 nt, Homo sapiens
cgaguaauuuuguuucuugaaguaggagaggaugggaaugucaggag

SEQ ID NO: 124574 - RNA, 36 nt, Homo sapiens
gagcagaaccggggcggagcaccugcaggcgcgggc

SEQ ID NO: 124575 - RNA, 40 nt, Homo sapiens
ucccccgggcggcccggcggcugcguacuggcugugggau

SEQ ID NO: 124576 - RNA, 44 nt, Homo sapiens
aauuuuauuacuauucuaaaaauaauaaccaaaauauuaacaaa

SEQ ID NO: 124577 - RNA, 70 nt, Homo sapiens
aaaguggccuggggucagacugugguaugguaaagagaauaaacauuaucuuguaugcagcgagagucau

SEQ ID NO: 124578 - RNA, 191 nt, Homo sapiens
uaaagauuucaaguagcacaaugaaggaugguaggcuaaaggggagagcuggagacaguaagauaaaggaggaaguacugguaguggaugugaagaagggauagcacugacaaauaugugugugugugucuguguguauuuaccuauuuuuuuuuuagagauggguuucuacuuuguggcccaggcuggag

SEQ ID NO: 124579 - RNA, 72 nt, Homo sapiens
ugaaagccucuauuuuuugagucaguccuaguuuauacaaaaaauuuaaaaguagcuagcuucggcauccug

SEQ ID NO: 124580 - RNA, 42 nt, Homo sapiens
uaccauuauugaugcuuuuacaaauaucuccuaugccuccag

SEQ ID NO: 124581 - RNA, 56 nt, Homo sapiens
aagauaugaacaacugaaggaggaccuggcaguuuucuggaaagguuaugaguuca

SEQ ID NO: 124582 - RNA, 61 nt, Homo sapiens
aauaauuaaagauuugauaaagaagaugacucuaucaaggugaaagagaaagagcagcuca

SEQ ID NO: 124583 - RNA, 46 nt, Homo sapiens
agguagguguuggugccuuggagggucaugggacccggguuacagc

SEQ ID NO: 124584 - RNA, 45 nt, Homo sapiens
aggggucuuacuccuuggaggccaugugggccaugagguccacca

SEQ ID NO: 124585 - RNA, 45 nt, Homo sapiens
ggagaucauaccccagaacuaaaaggccauugcuaauucccugaa

SEQ ID NO: 124586 - RNA, 47 nt, Homo sapiens
gugccagaggauaaauauacugcccagcuggaugcugaagacaaaga

SEQ ID NO: 124587 - RNA, 46 nt, Homo sapiens
cugugcggaugguagggaugccgacccuacugaggagcagauggca

SEQ ID NO: 124588 - RNA, 45 nt, Homo sapiens
uuuccgcgacggccgcuccgaggacuuccgcaggacccgcaacag

SEQ ID NO: 124589 - RNA, 54 nt, Homo sapiens
guugagaacgauauacauaugucaguuuuugacaagaauugcagcaggaaaaac

SEQ ID NO: 124590 - RNA, 51 nt, Homo sapiens
uguagucccugucaucuuagaacauugguucucaaacuuuagccugcucca

SEQ ID NO: 124591 - RNA, 61 nt, Homo sapiens
agugggcaguacuuacauaaaacugcuugcuuauugaaguguugucuuacauaaaauccca

SEQ ID NO: 124592 - RNA, 41 nt, Homo sapiens
uagguaggccugggccaguugcuggagaaguagcaggcugg

SEQ ID NO: 124593 - RNA, 221 nt, Homo sapiens
acucaauauuucucaaacacuaugucaacaaguagucaguguaaaaaauguuaguaaggccaggcacauggcucacaccuguaaucccagcucugggaggcugagguggguggaucacuugagcccacgaguuuaaggcugcagugagcuaugaucacaccacugcaccccaaccugggcagcacagcaaggcccccaucucuuaaaaaaaaucaaaugag

SEQ ID NO: 124594 - RNA, 58 nt, Homo sapiens
cugguauaaacaagaagaguaccuagcacauaguauacacucaguaaauauuuaaagg

SEQ ID NO: 124595 - RNA, 52 nt, Homo sapiens
augcacaguuugaaaaugaugaacgaauuacacccuuggaaucagcccugau

SEQ ID NO: 124596 - RNA, 34 nt, Homo sapiens
uguggugauugucaaguagaauuaggaccugagg

SEQ ID NO: 124597 - RNA, 46 nt, Homo sapiens
uaggcuauagcuguuuguauggaaaauggcaacuuuaaagaagcag

SEQ ID NO: 124598 - RNA, 48 nt, Homo sapiens
cauagaauuuuagaaguguuuauguagagugaggaaaacugaaagaaa

SEQ ID NO: 124599 - RNA, 97 nt, Homo sapiens
cauaacuuccuuucaagacuguaaauugguacuucuuugggagaucauuuuagcaaaauauuuuaagcaugcauuccagcaauuccacuucuagaca

SEQ ID NO: 124600 - RNA, 50 nt, Homo sapiens
uuuuuaaaguucuacuuuuuuuauugugcagccagcauugaaaaagcuac

SEQ ID NO: 124601 - RNA, 61 nt, Homo sapiens
aggcaugaagaauggaugaauaagugauguuuuugaucaguguaguacuuuacaauggcaa

SEQ ID NO: 124602 - RNA, 42 nt, Homo sapiens
aauguuguaaacauagaguugagugaaauauagcaaguuuca

SEQ ID NO: 124603 - RNA, 49 nt, Homo sapiens
cuuugugugauuuauguuaauauauuucuucuguuuucuuuagccuuuc

SEQ ID NO: 124604 - RNA, 46 nt, Homo sapiens
uucucaagauaaaccuagugguaaugauguugaaauggaaacugaa

SEQ ID NO: 124605 - RNA, 52 nt, Homo sapiens
uauccuuauugaggugaaguaaauugacguuuuucuucuuugucuuucaaau

SEQ ID NO: 124606 - RNA, 36 nt, Homo sapiens
uuuuugaaucuuaguuugcuccuucauaaaauugga

SEQ ID NO: 124607 - RNA, 58 nt, Homo sapiens
aaagaaaaaagaaagcagaagagccacugaaagcagaauaccuguuucaaagagucag

SEQ ID NO: 124608 - RNA, 71 nt, Homo sapiens
auacuuguuuuagaagauaagugacagacuuaauuuuauuuuguauugagguuuuuaaaaaaaaaaacuua

SEQ ID NO: 124609 - RNA, 89 nt, Homo sapiens
aaagauauuucuuccuuccucaucagaauuaaagagcccuccuuuuauaaacuuauuccauuaaagaagaaaaguaaaugccuuucaaa

SEQ ID NO: 124610 - RNA, 50 nt, Homo sapiens
cugccaacuuuuugguacugagucauacacgagaugguucucaugucaug

SEQ ID NO: 124611 - RNA, 23 nt, Homo sapiens
cuauuuuuaaguguacaguuugg

SEQ ID NO: 124612 - RNA, 56 nt, Homo sapiens
acuguugcauuauaaauucaacaaccggacaagugucauguuaaaagacagaugga

SEQ ID NO: 124613 - RNA, 77 nt, Homo sapiens
ggaaagguggccugggggcaacuggaacucauccacaucacucccccccugaauaauaaugauaggaccaggacugg

SEQ ID NO: 124614 - RNA, 46 nt, Homo sapiens
gggucaagugaguagcgaaccauuuucacagauuaccucaggcugc

SEQ ID NO: 124615 - RNA, 45 nt, Homo sapiens
uucacaaucaagcagggaggugggcaaaggugcaagcuacggcca

SEQ ID NO: 124616 - RNA, 46 nt, Homo sapiens
gaggaccagaagcaacucacucuacacccuccaugguuccagccgg

SEQ ID NO: 124617 - RNA, 41 nt, Homo sapiens
gacagcaucauuccuuaugcauggggaaagaagcacuggag

SEQ ID NO: 124618 - RNA, 46 nt, Homo sapiens
caguuugcugagaacgaaaccaaugaggucaauuuuagagagauac

SEQ ID NO: 124619 - RNA, 42 nt, Homo sapiens
ugaugccauguaugucaaauugauaucaucugauggccauga

SEQ ID NO: 124620 - RNA, 57 nt, Homo sapiens
acuaaaguuccuggggaagcaaaguagaauuucauaagaacaaaauggguaagcuaa

SEQ ID NO: 124621 - RNA, 31 nt, Homo sapiens
cuucaauugauuuuauaaaaguacaguguuu

SEQ ID NO: 124622 - RNA, 45 nt, Homo sapiens
uuuucucgauaauuauguuccguguauguauuuuaauggaaugaa

SEQ ID NO: 124623 - RNA, 52 nt, Homo sapiens
aagagggcggcgggaccuuuccuggcgccgcucgguggguuuggaaagaggu

SEQ ID NO: 124624 - RNA, 42 nt, Homo sapiens
cgcaaucccacuucccaccccuucccuucuaggcggggaagg

SEQ ID NO: 124625 - RNA, 26 nt, Homo sapiens
cuuaauaauguauucaccuacaacaa

SEQ ID NO: 124626 - RNA, 56 nt, Homo sapiens
uugccaaauauuaaaaugagaaaaaucugugcuaaugaugcaauucccaagaagug

SEQ ID NO: 124627 - RNA, 40 nt, Homo sapiens
aagaggaugaggaggaggaggaagaugaagaagaugaaga

SEQ ID NO: 124628 - RNA, 41 nt, Homo sapiens
agcuaaaggaaagccugaugcagcaaaaaagggaguuguca

SEQ ID NO: 124629 - RNA, 43 nt, Homo sapiens
caaaugaucaaauauuuucugaaauaacaauaaaaggcagaaa

SEQ ID NO: 124630 - RNA, 47 nt, Homo sapiens
augggagggggagucgucaucccuuacacaagaaauagccacuuucc

SEQ ID NO: 124631 - RNA, 45 nt, Homo sapiens
ccguaaccucuuuuggucuauuuugcuucccauucagcccaaagu

SEQ ID NO: 124632 - RNA, 45 nt, Homo sapiens
accaagagcaggagaaaagacguaaaccuaccccagcaacugugg

SEQ ID NO: 124633 - RNA, 37 nt, Homo sapiens
gcucugcuucccaguggacgggugugcuaaggguuua

SEQ ID NO: 124634 - RNA, 45 nt, Homo sapiens
auacaaguucagaccaauggaagaaaagagcagcaaaaauugaac

SEQ ID NO: 124635 - RNA, 46 nt, Homo sapiens
aggauuugaaccaaagaaagaagaaauuuaaaaaaugguagcugaa

SEQ ID NO: 124636 - RNA, 638 nt, Homo sapiens
uugccauuaugaguauaaaaaugauauaguuaugauuuuauuuuucaaagaaauacuagcaauaaccugcuacauuuuagggcuggagcaaucagaaguuuuauagagaagcaauuagaacuagguuuuuaaggaugggagauaggaagagcaagauuaaauauguuuucaggguaguaaugagaagacuaugauguggagaagagguuuuugucaggaaauaaugaggcuauauugcaggauagagagaauggggccagaauuuggaagccuuuaauucagcaacauauauugaaugccuauuuuugccaggcacuauucuaaggagcauugaaagauacaaccuuccauuuugaagcuuacauuuuugguaacggaucugaauuaugagguuuaauaagagaugcauucuggaccacccugugccuucuccaccuuagcaagcucuaccuuuaagcaccuugagggcaggugugaguacauaauuguuaaaagaccaauaaauaaaaucagaacacagcuacuuggcacauugcugcuuuagaccccaaagaucuaauuaaguccagcuugauaaaauaaauaaaugaaagacuggauaguugcuucuuuuuuaaaagaguaaaaaagaugaaaaa

SEQ ID NO: 124637 - RNA, 46 nt, Homo sapiens
gaucuacuggguaugaaccaggacagggguugagggauggaggugc

SEQ ID NO: 124638 - RNA, 46 nt, Homo sapiens
ucacacgagucuggccuguagcugugaaccaacucuccagcugaau

SEQ ID NO: 124639 - RNA, 46 nt, Homo sapiens
uaccucgagcaugaugauaggaguccuggcuccccacacaacaaaa

SEQ ID NO: 124640 - RNA, 42 nt, Homo sapiens
gaacuaaaauggucuacugcaaaauugaucagacccagagaa

SEQ ID NO: 124641 - RNA, 46 nt, Homo sapiens
ugagacuacuuacuuuuaugggaauggcaguagaaaauaaggaaau

SEQ ID NO: 124642 - RNA, 46 nt, Homo sapiens
uccaaaugcauuucuuuuugaccaccuucuuacuuuaaaaccaguc

SEQ ID NO: 124643 - RNA, 44 nt, Homo sapiens
uaagauacacaguguauugcagccuuauuaaaguggcagcaucu

SEQ ID NO: 124644 - RNA, 38 nt, Homo sapiens
uggagcuggcggggagaacaaauaaaauugcgguagcu

SEQ ID NO: 124645 - RNA, 27 nt, Homo sapiens
auggacccuaagggacggaugaccuga

SEQ ID NO: 124646 - RNA, 42 nt, Homo sapiens
aguaguuguugagcagagggaaagggauaggagaaggaugug

SEQ ID NO: 124647 - RNA, 61 nt, Homo sapiens
caggaauauggcaggcucaacacuaugcuugagcccauauugcuucccucauuagugaugc

SEQ ID NO: 124648 - RNA, 47 nt, Homo sapiens
auauauuuauguuuucuuuuaaucauuucauaacuuggaaaauacua

SEQ ID NO: 124649 - RNA, 70 nt, Homo sapiens
uucaauacacucaguauucuuuucuguuugaagucuguuuugccauuggaaaaaacuuauuguuguuuga

SEQ ID NO: 124650 - RNA, 52 nt, Homo sapiens
uaagcagaguggaaaacuuaguagugcuaaggagcaacagaaguaugugcaa

SEQ ID NO: 124651 - RNA, 62 nt, Homo sapiens
aaagggcaaacuuagaggaggcacuccucagguuucagcugccuguuccggccuggugaggu

SEQ ID NO: 124652 - RNA, 82 nt, Homo sapiens
ggaggguuuaacuucucucucagcuagaagguuaggcauugcaaauaccaguggauaauuuuuuucuuagcuuuaaccccag

SEQ ID NO: 124653 - RNA, 48 nt, Homo sapiens
aacagaauuaaaggacaaagcugucuuuuuuguuggaauuggggaugg

SEQ ID NO: 124654 - RNA, 50 nt, Homo sapiens
cagaggcaaugucacuaucuuuuaccugacaagugcuuuaccagggaguu

SEQ ID NO: 124655 - RNA, 31 nt, Homo sapiens
auaccagaggcaauuuuaagacuagcauuag

SEQ ID NO: 124656 - RNA, 44 nt, Homo sapiens
aacuauuuuguagucuugcuauuuuaaaaaaugugugggugugg

SEQ ID NO: 124657 - RNA, 35 nt, Homo sapiens
aacagucuaugagccuaagagaccugucugugcca

SEQ ID NO: 124658 - RNA, 41 nt, Homo sapiens
uuacagcauucguccacuuucaugaggcaaggaguagguag

SEQ ID NO: 124659 - RNA, 30 nt, Homo sapiens
gguuauguggacaugagaggagaagggugg

SEQ ID NO: 124660 - RNA, 44 nt, Homo sapiens
caucugcuccaagcccacuguagaaugcuaaugagccacacugg

SEQ ID NO: 124661 - RNA, 60 nt, Homo sapiens
uaucaaguuauauacagcaugauguuuugucuuccaaguagagaacuuaaccaaauucau

SEQ ID NO: 124662 - RNA, 43 nt, Homo sapiens
cuguggguucugccccuuucgaugguggugggugggguuauau

SEQ ID NO: 124663 - RNA, 50 nt, Homo sapiens
agaggaaguuaauuuugaugaacagugaugaggaaaauauccuugaagac

SEQ ID NO: 124664 - RNA, 47 nt, Homo sapiens
uuagagcauauuugugcagcaguugugaaaucucccuaacgguauuc

SEQ ID NO: 124665 - RNA, 54 nt, Homo sapiens
guguggugagaguguaaagcagcuaauugugaguaagugguagacagacuagag

SEQ ID NO: 124666 - RNA, 38 nt, Homo sapiens
aguuaaacgaaacaugguguuucuucccuaguagagag

SEQ ID NO: 124667 - RNA, 48 nt, Homo sapiens
gguguggguguuagggaugacgcugaccagagaggauucacaagagag

SEQ ID NO: 124668 - RNA, 41 nt, Homo sapiens
uuaacuaggagccuccaaaaauaaagccagaaauaaggcaa

SEQ ID NO: 124669 - RNA, 46 nt, Homo sapiens
gaacgccugaacgcaggcacauacuuccuauucuacacccuaguag

SEQ ID NO: 124670 - RNA, 46 nt, Homo sapiens
uacuaggguguagaauaggaaguaugugccugcguucaggcguucu

SEQ ID NO: 124671 - RNA, 52 nt, Homo sapiens
gaagaagcgagaaaaggggugaagagaaaaaaccagauuauauagaaaggaa

SEQ ID NO: 124672 - RNA, 42 nt, Homo sapiens
ugguuugcaaaacaagugcuaaaauagugcagugauguggug

SEQ ID NO: 124673 - RNA, 46 nt, Homo sapiens
aauaugguacugcaagauaucacugaguuugaaaucccaccagaag

SEQ ID NO: 124674 - RNA, 72 nt, Homo sapiens
uuucaucacaaugagaauuuuugauucuuacauuugucuacaagcucuagcaguagcagcuguaaggagcug

SEQ ID NO: 124675 - RNA, 41 nt, Homo sapiens
ugcuacugcuagagcuuguagacaaauguaagaaucaaaaa

SEQ ID NO: 124676 - RNA, 59 nt, Homo sapiens
aauucauccaacacaaagguacucuugggcaggugagcgaagggguccuuggccuuggg

SEQ ID NO: 124677 - RNA, 43 nt, Homo sapiens
uucugcuucucuucccgugaacccuucucuuuccguggugugu

SEQ ID NO: 124678 - RNA, 66 nt, Homo sapiens
uugguauugcgaaaggcccggcggaaagaaggcucuagaaccugcuuauagagccacaacagggug

SEQ ID NO: 124679 - RNA, 46 nt, Homo sapiens
guuuguuguggugcaugaugcccaagguggggaacacccagguacu

SEQ ID NO: 124680 - RNA, 35 nt, Homo sapiens
cuggaaguaggccuuuguacacaucaugcugagcc

SEQ ID NO: 124681 - RNA, 46 nt, Homo sapiens
ucaccuauuuugugugugugacuugaaauucaguaguaaaagaauu

SEQ ID NO: 124682 - RNA, 90 nt, Homo sapiens
uguagacaagaagccagauaaaccuaaaagugaagacuaugagaaggacaaagaacgagagaaaaguaaacacagagaaggagaaaagga

SEQ ID NO: 124683 - RNA, 47 nt, Homo sapiens
cacgguuaucacauggugaucgaggaacagauggaaaagcaagcaga

SEQ ID NO: 124684 - RNA, 47 nt, Homo sapiens
cuggauaggccauuuaauagggguaaaggggaccgccagagauuuua

SEQ ID NO: 124685 - RNA, 42 nt, Homo sapiens
ccccagaacaaguacaaacuuuucacccaugaggccacagca

SEQ ID NO: 124686 - RNA, 96 nt, Homo sapiens
acuucagaaagcaaagauggagauaguugccggaauggagaaaaacacaugcugccuggccugucacacaacaaggagcacuuaacagaacaaauc

SEQ ID NO: 124687 - RNA, 35 nt, Homo sapiens
gaucuaauguaggaaaaggaaacauagaugguaau

SEQ ID NO: 124688 - RNA, 91 nt, Homo sapiens
uuaacaaauuuaucaauucagucaaaacaagaggaaacuguggagaguaaagagaaaacauuaaaaagacagcuucaggaagaucaagaga

SEQ ID NO: 124689 - RNA, 98 nt, Homo sapiens
acuguuaaagaaauuccauuuuuaaaugagcagaccaacucaaaaauagagaaaacagauaauguggaaguaacugauggugaaaacaaggagauaaa

SEQ ID NO: 124690 - RNA, 51 nt, Homo sapiens
cuuuugggcaccacuggucaaguauaugaccaggcccagucagugauggaa

SEQ ID NO: 124691 - RNA, 80 nt, Homo sapiens
agacuccugaaagugcaccaccaauagcauugccaccugauaaaaaaaguaaaauagaaguuucuacagaagaagcacca

SEQ ID NO: 124692 - RNA, 45 nt, Homo sapiens
cuauuguugggcuuaauuauucgucagaaacugaagcgacagcac

SEQ ID NO: 124693 - RNA, 45 nt, Homo sapiens
ccugguagguauacguuuuaauaauaggauaagaaugaaauaaca

SEQ ID NO: 124694 - RNA, 46 nt, Homo sapiens
gaagcagguuaaagauauguaccuuauuccuuugggugccacagau

SEQ ID NO: 124695 - RNA, 46 nt, Homo sapiens
cagacaguuugggauuauguggaaaaaauaaaagcaucaggaacca

SEQ ID NO: 124696 - RNA, 45 nt, Homo sapiens
aaaaacaaaaagaggagguugacucuaugucuaaagauaccacua

SEQ ID NO: 124697 - RNA, 46 nt, Homo sapiens
ggccaaucaccaaaauaacucauaaaggugaaauagaaauugagag

SEQ ID NO: 124698 - RNA, 45 nt, Homo sapiens
agcuuguucaaccgaauuuucagggucacuaagcaggcuuaguua

SEQ ID NO: 124699 - RNA, 45 nt, Homo sapiens
uuacaucucaggcacuaaaccuccauauagaccuaugccagaucu

SEQ ID NO: 124700 - RNA, 46 nt, Homo sapiens
gaaaggagaaguaacuccugaucaucuuaucagaaugaguccagaa

SEQ ID NO: 124701 - RNA, 54 nt, Homo sapiens
aaauucauucauauguauucuucaaaaacuuuuaagcuaaaauuuauaacacua

SEQ ID NO: 124702 - RNA, 45 nt, Homo sapiens
gcuagcuccucuucguaagaugggacaaccaguuuuaccucggag

SEQ ID NO: 124703 - RNA, 60 nt, Homo sapiens
agaaccaaauauauagaugauacagugaagcacaaggucaaaauuuuaaaacgggugagc

SEQ ID NO: 124704 - RNA, 90 nt, Homo sapiens
uggugauuguguuggguuaagucuuucucaagcacagcagaugggcgaggaagacaaagaauaugucuguguaaaauguugugcugaaga

SEQ ID NO: 124705 - RNA, 45 nt, Homo sapiens
uucauuccagauaacauagcuaccauaagaagagaaggcucugau

SEQ ID NO: 124706 - RNA, 42 nt, Homo sapiens
uagucacgugaaggaagagcuugaacacccaggcguugagca

SEQ ID NO: 124707 - RNA, 46 nt, Homo sapiens
cugugaaaaaccaagcucauucuguacugaaaaaaacauuacagga

SEQ ID NO: 124708 - RNA, 111 nt, Homo sapiens
caaaacaguugaaugcuauagaaaguacuaaaauagagucccaugaaacagcaaaccuucaggaugacagaaacagccagucaaguagcguuucuuacuuagagucaaaaa

SEQ ID NO: 124709 - RNA, 109 nt, Homo sapiens
ugcuuguacaaauccaaauaagacagaaaacagccuuguagguuugccuaguuguguagaugaagugacugaauguaauuuggaauugaaggauaccauggguauugcu

SEQ ID NO: 124710 - RNA, 65 nt, Homo sapiens
ucagguaaaacgggugagacuguuguugaagaaaugauagcaacaagaaaaguugaacaagauuc

SEQ ID NO: 124711 - RNA, 58 nt, Homo sapiens
uguaaagccaagccuguugguaguccauuguuuaaguuuucagauaaagaagaacaug

SEQ ID NO: 124712 - RNA, 42 nt, Homo sapiens
accugaguaccauaaggagaauagaaggugcagccgaaauag

SEQ ID NO: 124713 - RNA, 46 nt, Homo sapiens
gggaagacuguaucuacugcuaaagcaggagugaaacaaccagaaa

SEQ ID NO: 124714 - RNA, 37 nt, Homo sapiens
accauuaugaguacuguucaauacauuuuuguugagc

SEQ ID NO: 124715 - RNA, 57 nt, Homo sapiens
uaggaauagcuuuaaugcuaaaauggugaccuaagggaagcacauugauaaaggaau

SEQ ID NO: 124716 - RNA, 63 nt, Homo sapiens
ucauuuuguguuucuccuuucuccugauacaagggggggauguaucagaauagggaaaugaaa

SEQ ID NO: 124717 - RNA, 49 nt, Homo sapiens
augaaagugugcuauuaauacuagaucagaacuacgagcaacaccugga

SEQ ID NO: 124718 - RNA, 46 nt, Homo sapiens
aguaauuuuuaaaaguuauuaaguacuuaaccuaauacucagauac

SEQ ID NO: 124719 - RNA, 55 nt, Homo sapiens
uucagcuuugguguuuugauauuucaugaugauauguauugguuuugguguauuu

SEQ ID NO: 124720 - RNA, 57 nt, Homo sapiens
auugaugaagaagaacugauuuuaccuaacaggaacuuaagggacaagguagaagaa

SEQ ID NO: 124721 - RNA, 48 nt, Homo sapiens
uguuacauuaagacuaucucacaguauuuucuguacugccuuuaauug

SEQ ID NO: 124722 - RNA, 44 nt, Homo sapiens
uugauuugggaguuugguaguggcaauuucacauguuagaaaau

SEQ ID NO: 124723 - RNA, 37 nt, Homo sapiens
gauucuagcaugaaccuagaaucuuucaggguaugga

SEQ ID NO: 124724 - RNA, 53 nt, Homo sapiens
ccguuucuuccuguuuuuuuuuucuuuugguaccagucaaaaguacaucugca

SEQ ID NO: 124725 - RNA, 47 nt, Homo sapiens
aguucucauacaucaucucacuugauccucacaacagcccugugagg

SEQ ID NO: 124726 - RNA, 48 nt, Homo sapiens
ucaugauucuguuuguugucaaauugcucuucaaaaagauugugucau

SEQ ID NO: 124727 - RNA, 43 nt, Homo sapiens
uuugagucuaguugaacauggagguucucaucuguugagauag

SEQ ID NO: 124728 - RNA, 53 nt, Homo sapiens
uuaggaugagagcauuuuacugguugacaacuccaguugguaccaaucucaga

SEQ ID NO: 124729 - RNA, 46 nt, Homo sapiens
uucuagugauuuuucucgcuguuuucuucuagucaugacaggauug

SEQ ID NO: 124730 - RNA, 32 nt, Homo sapiens
ugcagcuauguauguuauucauaccggcacua

SEQ ID NO: 124731 - RNA, 59 nt, Homo sapiens
agaacaaagaagauaguucuuuuuccuguuuaaagaauauauguguguuuguaggaaag

SEQ ID NO: 124732 - RNA, 41 nt, Homo sapiens
uauugguauauguauaguguauauguuuuuaagauauguaa

SEQ ID NO: 124733 - RNA, 26 nt, Homo sapiens
uuuaaacuaaauuuucuuccaaggag

SEQ ID NO: 124734 - RNA, 46 nt, Homo sapiens
uccaaccuggagaaugaagucugugaggauuuuagugcaagucaaa

SEQ ID NO: 124735 - RNA, 46 nt, Homo sapiens
auuuaguaggauuucugguaaaaugauauacuacaugcaugaugaa

SEQ ID NO: 124736 - RNA, 48 nt, Homo sapiens
uuaucuccagagccaguuggaaccacguaagaaaaauuauucugacuc

SEQ ID NO: 124737 - RNA, 40 nt, Homo sapiens
auuaaaauuuaaauuuuauugaguauuggaauccacuagg

SEQ ID NO: 124738 - RNA, 46 nt, Homo sapiens
cucugagaaguggucuauguaaauguagguaaaaaauugguuuggu

SEQ ID NO: 124739 - RNA, 46 nt, Homo sapiens
ccaaaguuugccucuuauuuacauuuuuuauagguucauuuauuga

SEQ ID NO: 124740 - RNA, 40 nt, Homo sapiens
aauuuaaaaagaauaaucgauuauugaggcuucucuaaau

SEQ ID NO: 124741 - RNA, 43 nt, Homo sapiens
cugcggggucucgcgccgucgcaccguccccacgcggcaagcg

SEQ ID NO: 124742 - RNA, 41 nt, Homo sapiens
uauuggaguuucaggaaauauaauuugagaauacuuuaaag

SEQ ID NO: 124743 - RNA, 94 nt, Homo sapiens
auuguuuccccuagugcccucuuuucccuagggcauugcucuccuauucccacgccuuaacacagcucuauaccuagaagcagccagcccaggc

SEQ ID NO: 124744 - RNA, 46 nt, Homo sapiens
uuuauagauuuugaaauuaauuuaaauauuaguauuugguacauga

SEQ ID NO: 124745 - RNA, 48 nt, Homo sapiens
aacaucuaaauaaauaaugacaugcauuuaucaucauugagauugguu

SEQ ID NO: 124746 - RNA, 46 nt, Homo sapiens
caaaauacccagcacaauacuuguauauuuuuaguaccauacagaa

SEQ ID NO: 124747 - RNA, 72 nt, Homo sapiens
uccauaggaguauugaaaggcaguuuuaccaggccucaagcuagacagauuuggcaaccucuguauuugggu

SEQ ID NO: 124748 - RNA, 47 nt, Homo sapiens
agacaguaaguaauggauucucuuuucauuuguacucucuuucauuu

SEQ ID NO: 124749 - RNA, 42 nt, Homo sapiens
aauugcugcuucuuguuaggagguucauuucacuuaucauua

SEQ ID NO: 124750 - RNA, 36 nt, Homo sapiens
ucucucuuucugucuuuuucuuuuaaacagcaauuc

SEQ ID NO: 124751 - RNA, 43 nt, Homo sapiens
auuuagaauuuggggugaaaguauaaugaaauuauuuucagau

SEQ ID NO: 124752 - RNA, 40 nt, Homo sapiens
cauuuuacacaugcuuucuuaggugcccuaagaccuaaau

SEQ ID NO: 124753 - RNA, 63 nt, Homo sapiens
ucuucaaaguagagaggagugucauauucacuggggaggguuugaauauagggcugccagaag

SEQ ID NO: 124754 - RNA, 45 nt, Homo sapiens
agucauacagaauacucggagaaaagccaaaagcugagcagagau

SEQ ID NO: 124755 - RNA, 32 nt, Homo sapiens
guuguuuuauauguuuuuaaaagaagugaggc

SEQ ID NO: 124756 - RNA, 34 nt, Homo sapiens
uuuacuacacacacaguguuaacaaagcacugug

SEQ ID NO: 124757 - RNA, 24 nt, Homo sapiens
aaaaagcaugacugcuuuuuccug

SEQ ID NO: 124758 - RNA, 46 nt, Homo sapiens
uggaaaugauccacaguauccaaaauagccaggacaugaggcagau

SEQ ID NO: 124759 - RNA, 34 nt, Homo sapiens
uggcuuuucauauguuucccaaaacuuauaacac

SEQ ID NO: 124760 - RNA, 47 nt, Homo sapiens
acaucagugauuaaauuacaacuugcuuaauuaacauuugagcugag

SEQ ID NO: 124761 - RNA, 132 nt, Homo sapiens
gccucugugugaguggcugggccaggugagggggucuggagcccggggccggggccggcaggccgaccacucaugcugugcaccgccccugcagagacuucgagcagccuacucgggacgggcugggcagug

SEQ ID NO: 124762 - RNA, 341 nt, Homo sapiens
ccggcgagcccacuugucagaaaacgagcuagaagcacuagagaagaaugacauggaggugaggugugaccugacccugggcucccuccccugugucccuuccaaguccccaucaccucaggcagcuggaguucaauuucucacguguuaaccccgugagccuucuuccccauuuuccuauccuggcugcuugugccugugauggccugacccucaggaccugagccucauuagccagauggcaugcccugugggaccccacuccccaugccuguguugccugagaaaagagaccagcuccccaacauucacauacacauacaaacuuucagcaaaugaag

SEQ ID NO: 124763 - RNA, 132 nt, Homo sapiens
agugagugcccaaggcagagaggggcgggggcucugaucuggccaggccugaccgcccacccucacccucuacagagcccuccgcgaggacugguggcagccuacagcggggagagugacagugaggaggag

SEQ ID NO: 124764 - RNA, 62 nt, Homo sapiens
aacuucaaaaauagcuuccagccuaucagcucccugcgagaugacgagaggcgggagucagc

SEQ ID NO: 124765 - RNA, 46 nt, Homo sapiens
ggagacaggggcacccucgaaggagggcaaagagaagaaggagaag

SEQ ID NO: 124766 - RNA, 165 nt, Homo sapiens
augaccccaacucccagguaauagggcagcccagggagggaugggaucgggucaggucgcgucaggaacagcuagcccugcagguucccuucacaaggucuucccucacauccccucuucccuccuccucccucaguauuacuacaaugcucagagccagcagua

SEQ ID NO: 124767 - RNA, 41 nt, Homo sapiens
cucccaagcccugucacagggcucggagccaagcucagaga

SEQ ID NO: 124768 - RNA, 46 nt, Homo sapiens
cucgcgaguauggcagccaggagggcaagcaugacuaugacgacuc

SEQ ID NO: 124769 - RNA, 81 nt, Homo sapiens
ucauuuccugcauaggaagaaaucggugacauuuggguggauacaguucccagccaaucgccccgaguucccucgcccacu

SEQ ID NO: 124770 - RNA, 46 nt, Homo sapiens
aagcagcauucacaagcuagaagaccuuguucaggaaucaauggua

SEQ ID NO: 124771 - RNA, 46 nt, Homo sapiens
gaacuucugcaguacaaaagcacuauagcaaaccuaaugggaaaag

SEQ ID NO: 124772 - RNA, 46 nt, Homo sapiens
ugaagaguguaguauccuggcauuaucucaucaaugaaauugauag

SEQ ID NO: 124773 - RNA, 47 nt, Homo sapiens
gauagccaggaaucccaagucuuuucaggcucagauauaacacaacu

SEQ ID NO: 124774 - RNA, 46 nt, Homo sapiens
aagagaugauuugcaugaaaguguguucagaaucacagaacaggag

SEQ ID NO: 124775 - RNA, 61 nt, Homo sapiens
gcccucguaaaacucuaugaaacuaaacugugugaagaagaagcaguuauagcugacaaga

SEQ ID NO: 124776 - RNA, 59 nt, Homo sapiens
uuuuaccaauuaauguauuuuagcaauggagaucugaaguagaugaaaagagacaggua

SEQ ID NO: 124777 - RNA, 46 nt, Homo sapiens
uuugacuggcacaaagaaaaagcagaucaauuaguugaaagguggc

SEQ ID NO: 124778 - RNA, 63 nt, Homo sapiens
gacacuuaccauccuuuagaugauuggauccagcagguugaaacuacucagagaaagauucag

SEQ ID NO: 124779 - RNA, 46 nt, Homo sapiens
gaugcugguguccgaaauagaaaugaaacagagcaaaauggacgag

SEQ ID NO: 124780 - RNA, 42 nt, Homo sapiens
uuacaaacaaugaccuaccgggccaugguagauucacaacaa

SEQ ID NO: 124781 - RNA, 48 nt, Homo sapiens
cucucaugacacaauauauuaaauuugcuggugauucauugaagaggc

SEQ ID NO: 124782 - RNA, 77 nt, Homo sapiens
gagaacuucugcagcuuugauucugcauuuaaaaaucauauuucugcauuuauaaaucauauauuuaaaaaucauau

SEQ ID NO: 124783 - RNA, 40 nt, Homo sapiens
aaagauacauagcuuaauuuuuagacucaaaagauuggug

SEQ ID NO: 124784 - RNA, 63 nt, Homo sapiens
aguauuaaucaccgugauuaaagggcaagauugaggaagauuuagagaaaaguuaaggaaguu

SEQ ID NO: 124785 - RNA, 347 nt, Homo sapiens
aaagucaagagacaacaugauuuuuuuuuuuuuuuuuuuuuuuuuuugagacggaucucuguugcccaggcuggagugcaguggcgugaucucggcucacugcaaccucugccuccuggguucaaguaauucacugccucagccuuccgaguagcugggauuacaggcgccugccgccugccaccacgccgggcuaauuuuucuauuuuuaguagagacgggguuucaccauguuggccaagcuggucuugaacuccugaccucaugauccacccgccuuggguucccaaagugcugggauuacaggcaugagccaccgugcccagccgagauucuuaacaaaucac

SEQ ID NO: 124786 - RNA, 50 nt, Homo sapiens
agauauuuuuuucugagggaauuuuuaguuuuucuaaaucugagcaugag

SEQ ID NO: 124787 - RNA, 30 nt, Homo sapiens
guuuuuguuugaggauguuucauaaccaga

SEQ ID NO: 124788 - RNA, 53 nt, Homo sapiens
aucaguccacaguggaagccguuaauaaagcaggaaaugaucuaauugaauca

SEQ ID NO: 124789 - RNA, 51 nt, Homo sapiens
aagcaaccuucagaacaagcuagagguuuuaaaucaacgcuggcaaaaugu

SEQ ID NO: 124790 - RNA, 35 nt, Homo sapiens
gugugcagugugucaaguucgucccaaguuuuaaa

SEQ ID NO: 124791 - RNA, 46 nt, Homo sapiens
gcugguguucccgggcgcccagcgaaugaaccgaggucgacaugaa

SEQ ID NO: 124792 - RNA, 42 nt, Homo sapiens
aguguacaugauccgucugggcacgcuggagcaggaggccac

SEQ ID NO: 124793 - RNA, 28 nt, Homo sapiens
ggccaagucugcagggcaaagcccaugg

SEQ ID NO: 124794 - RNA, 42 nt, Homo sapiens
cccccucaggagcagcauuugaccaguguuccugggcuucau

SEQ ID NO: 124795 - RNA, 46 nt, Homo sapiens
cucugagagcugcaacgcaaagagacucaaaacaacggagaaaaaa

SEQ ID NO: 124796 - RNA, 44 nt, Homo sapiens
uguggagcacugcaaucuuuuaccucuaugaauguaaaccuuua

SEQ ID NO: 124797 - RNA, 97 nt, Homo sapiens
caggauggggguggguugcagugaggguagggaaaaugucaggaguaggaagguucggggguuaagggaagggaaggaagaccagaacuggccaucc

SEQ ID NO: 124798 - RNA, 69 nt, Homo sapiens
ggacucuguaaagagcauucuucuagucagaggguggaauggcagcagcaacuggaagaaaaugaguuu

SEQ ID NO: 124799 - RNA, 46 nt, Homo sapiens
uaauaaaugcuaguuuuuucugaucugucuauacaacugcugauaa

SEQ ID NO: 124800 - RNA, 45 nt, Homo sapiens
aauugcuauguuuuuuuuuuuuucucguuuuucuggugaggggga

SEQ ID NO: 124801 - RNA, 46 nt, Homo sapiens
cagcugugcggauugucccggaguggcaggacuacgaccaagagau

SEQ ID NO: 124802 - RNA, 42 nt, Homo sapiens
gugugugugagagagagagagagagagagagauuuuuaucug

SEQ ID NO: 124803 - RNA, 55 nt, Homo sapiens
caggacccuaacagccuuucaaaucuugaucaaguaaguguccauuuuuuauggu

SEQ ID NO: 124804 - RNA, 49 nt, Homo sapiens
uccaugguugguuguaacaagcgggucuucuuuauucagugcacuauau

SEQ ID NO: 124805 - RNA, 44 nt, Homo sapiens
cccacuaguuguugacaaguuccuguuuguggaugcugaucagg

SEQ ID NO: 124806 - RNA, 41 nt, Homo sapiens
acagccagaagaggccacgggcuagggcugccugauguagu

SEQ ID NO: 124807 - RNA, 48 nt, Homo sapiens
agguucagaagaaggcagauauggugaacgaagacuugcugagugaug

SEQ ID NO: 124808 - RNA, 24 nt, Homo sapiens
auagccacaauucauaguguuguu

SEQ ID NO: 124809 - RNA, 47 nt, Homo sapiens
gcugaugaggugguuaucguccucaacaacuucaaaagcaaaauuau

SEQ ID NO: 124810 - RNA, 41 nt, Homo sapiens
acgugcuucugugcagcucgaaggagcuuaaggagcaagaa

SEQ ID NO: 124811 - RNA, 72 nt, Homo sapiens
gguuccaauaaugguucagggggccuguucccugcauuccuuuaucgaaggcucugugcuuggcucagagcu

SEQ ID NO: 124812 - RNA, 45 nt, Homo sapiens
ucuugaagcugugcuguuagugcugguauuccuuggucuguggug

SEQ ID NO: 124813 - RNA, 50 nt, Homo sapiens
gaugaaacagugguuuuuccaggaaauuaaauauggaagaauuguuagaa

SEQ ID NO: 124814 - RNA, 46 nt, Homo sapiens
ggcuacuuucagcugaaagccaacccaggagcuuggauccucagac

SEQ ID NO: 124815 - RNA, 46 nt, Homo sapiens
ggaaggucauugcuacgacaucaccacaggccagccuccacgggga

SEQ ID NO: 124816 - RNA, 45 nt, Homo sapiens
gccucagucuccacuguucacucugaauuugaacacaccugagag

SEQ ID NO: 124817 - RNA, 44 nt, Homo sapiens
uugggcugaugauauguuuggcaauaauuggaaaacuuucaguu

SEQ ID NO: 124818 - RNA, 46 nt, Homo sapiens
cucaggacagaaaauaaaaucucauauucaacagcuucggguagaa

SEQ ID NO: 124819 - RNA, 45 nt, Homo sapiens
uuuugucucaugccguguacugcagggauguucugaagcugaaga

SEQ ID NO: 124820 - RNA, 45 nt, Homo sapiens
guaacaauguuagaauaagcaugaucaauaauccugccaaagaga

SEQ ID NO: 124821 - RNA, 65 nt, Homo sapiens
aauggaaugcccuuugaaagggaacagcuagacccugaugaguuagaaaccaucacaaugcauaa

SEQ ID NO: 124822 - RNA, 45 nt, Homo sapiens
aguugaacauguggucaguguccuggagaagaaauauccguaugu

SEQ ID NO: 124823 - RNA, 46 nt, Homo sapiens
cccaagaaguggaugauuaucaugccuuccagacucugacacaugu

SEQ ID NO: 124824 - RNA, 96 nt, Homo sapiens
cuuuucccuuucccuccagaauugguuuuaucuuugugguuaaugacucugaagauguugaugggaugcaagaugcuggaguggcuguucuuagag

SEQ ID NO: 124825 - RNA, 44 nt, Homo sapiens
gugguacacaguuggcacuaauacaauauuucuugaauugaggg

SEQ ID NO: 124826 - RNA, 45 nt, Homo sapiens
uacaagaguugcuucgacccaccuuuccugguguuauucggcaga

SEQ ID NO: 124827 - RNA, 362 nt, Homo sapiens
ugaucuuucugagccuuugucuugucaucugucagagaauguggggaauagggcugggcuugguggcucgugccuguaaucccagcacuuugggaggccaaggcggguggaucaccuaaggucaggagauugagaccagccuggccaacauggugaaaccccgucuguacucaaaauacaaaaauuagccgggugugguggcacacaccuccuaaucuuagcuauucgggaggcugaggcaggagaauugcuucaaccuggggguggagguuacagguagcugagaucacgccacugcgcuccagucugggugacagagcaagacuccgucacaaaaaaaaaaaaaaaaauagagaaugugg

SEQ ID NO: 124828 - RNA, 45 nt, Homo sapiens
agcaauaacaaaaacagcugugagcucagaacuuagaaccgaagu

SEQ ID NO: 124829 - RNA, 41 nt, Homo sapiens
agaguaguagagaucauauauagaaauggggugcauauguu

SEQ ID NO: 124830 - RNA, 54 nt, Homo sapiens
ugacaaccaaagccaacucaacaggagaagccaagauucgagcagcagucugga

SEQ ID NO: 124831 - RNA, 36 nt, Homo sapiens
ucaacuguuuaucuauagaguguuuaagacauguca

SEQ ID NO: 124832 - RNA, 26 nt, Homo sapiens
accccgaccuggagggacaguugaaa

SEQ ID NO: 124833 - RNA, 26 nt, Homo sapiens
ucauuuaaugaaagcaucaucauaac

SEQ ID NO: 124834 - RNA, 42 nt, Homo sapiens
guggaauuggccauuaagagcacugaguacaaggccaaggau

SEQ ID NO: 124835 - RNA, 78 nt, Homo sapiens
gcccuguggugauuuucuacucugagauuggcucugaggaauuuuccaauuuucaccgccagcuuauaucaaaaagca

SEQ ID NO: 124836 - RNA, 45 nt, Homo sapiens
ggcuguucuccucaguaaaggccgacucaaaagccauuacaaccu

SEQ ID NO: 124837 - RNA, 48 nt, Homo sapiens
uccauucaugccuuaaugaaugaggccuguguuuauuucauuuugaga

SEQ ID NO: 124838 - RNA, 70 nt, Homo sapiens
aaacuuauuaaaggaagugaccauaauacuuuguacaguagcauagcacauuuauaaugcacauugaacu

SEQ ID NO: 124839 - RNA, 47 nt, Homo sapiens
aagacauuuuaaauagcuauuuaacagcaccacaaaacuuggaauaa

SEQ ID NO: 124840 - RNA, 46 nt, Homo sapiens
ccacggcccgggcaugggcugcaagggagacgcgagcggugcgugu

SEQ ID NO: 124841 - RNA, 44 nt, Homo sapiens
gaaggggcagggggcgagaagccgggcuccccggaccaucggcg

SEQ ID NO: 124842 - RNA, 24 nt, Homo sapiens
gcccucuuccccugacgcucccca

SEQ ID NO: 124843 - RNA, 36 nt, Homo sapiens
ccuggguggccccggagggggcgggcugccgggagg

SEQ ID NO: 124844 - RNA, 37 nt, Homo sapiens
uuacuccgggacaggcucugcugguaggugagcuguu

SEQ ID NO: 124845 - RNA, 45 nt, Homo sapiens
ggcuggccacacaccacuaccuguaccagcgcagccagccggugg

SEQ ID NO: 124846 - RNA, 59 nt, Homo sapiens
ugacgggaaagguaaucuggccgcaucuguuucucuccuugccacuccucccagggcag

SEQ ID NO: 124847 - RNA, 46 nt, Homo sapiens
aggagcagagcccauggcuccccaggcuggggggcauuuuucucca

SEQ ID NO: 124848 - RNA, 50 nt, Homo sapiens
uggcccccaggagaguagcugccuguugcaccugcuccacaccuccccac

SEQ ID NO: 124849 - RNA, 64 nt, Homo sapiens
gaggauuucuggaacuuuucucaaaggaauuuggacccuuauaaaugggacugaaggucaaaac

SEQ ID NO: 124850 - RNA, 55 nt, Homo sapiens
aacagugauauccuugcuuagaaauuguccucaaggaauaaacucugagagcaag

SEQ ID NO: 124851 - RNA, 42 nt, Homo sapiens
uguuagcuguguccugggagauggguggccagccauagaaag

SEQ ID NO: 124852 - RNA, 45 nt, Homo sapiens
aggucaguggucuguggucauugugugagaugaacaaaaaaggug

SEQ ID NO: 124853 - RNA, 32 nt, Homo sapiens
acacgucaagggagaaagacagaugagccauu

SEQ ID NO: 124854 - RNA, 55 nt, Homo sapiens
uuagcggcaugaagguuucagugguuggcccgccaacguggcacaaaaagccuca

SEQ ID NO: 124855 - RNA, 41 nt, Homo sapiens
caaaaguuuuuuucaggcaaccguguuaaauuauuguacau

SEQ ID NO: 124856 - RNA, 45 nt, Homo sapiens
aucauuuauugaggggaagccacuuaauaaggagucagaccuaaa

SEQ ID NO: 124857 - RNA, 61 nt, Homo sapiens
ucaauaaaugaugagcaucaacccuuucccacccagggugccgaggguagagggaggagca

SEQ ID NO: 124858 - RNA, 54 nt, Homo sapiens
gugggagcugcuggcugccccuugcagcccacuccccaaacuggcuacccaggc

SEQ ID NO: 124859 - RNA, 47 nt, Homo sapiens
gcaaaacuuucuagugcccaaggagggcggggcauguugggagaggg

SEQ ID NO: 124860 - RNA, 42 nt, Homo sapiens
ucuaugagggcuuugccaugccucacuccaucaugcgggugg

SEQ ID NO: 124861 - RNA, 46 nt, Homo sapiens
ccugugcuccucacggaggccccgcucaacccgaguaagaaccggg

SEQ ID NO: 124862 - RNA, 46 nt, Homo sapiens
agucucgcaccacgccgugcuccaugggguagcggauggucagcag

SEQ ID NO: 124863 - RNA, 47 nt, Homo sapiens
cccacacaugcucuccugagggucugaucaggccaugcagccccuug

SEQ ID NO: 124864 - RNA, 45 nt, Homo sapiens
uucccugggggugggguccucaguugcaggaacauggcauguguu

SEQ ID NO: 124865 - RNA, 47 nt, Homo sapiens
cuguaugguacuggugggggcgggaauaagaauugcaaacccagaga

SEQ ID NO: 124866 - RNA, 46 nt, Homo sapiens
gggucccuggcuuccuccuuggccugccuugacggggcagccagcu

SEQ ID NO: 124867 - RNA, 61 nt, Homo sapiens
uggucuucuccagcaggcccuguaggucguccauguuccaugccuucuggguucuuggggg

SEQ ID NO: 124868 - RNA, 52 nt, Homo sapiens
gcuuccaggugggggcagcgauaggaccaaguucuccuaguagucucuggga

SEQ ID NO: 124869 - RNA, 60 nt, Homo sapiens
auguuuguuucugcugcagacucagaggguugcgaugaagaguggugggacugaguugag

SEQ ID NO: 124870 - RNA, 51 nt, Homo sapiens
auaaggagguuagcacugagcuuggggacgugcugucacaccagcaggacg

SEQ ID NO: 124871 - RNA, 36 nt, Homo sapiens
cucccacaugaccccguggggucccugaaugacugu

SEQ ID NO: 124872 - RNA, 46 nt, Homo sapiens
gcugucuugguuuaaaagcagauuacagaaauguaagucaacuuaa

SEQ ID NO: 124873 - RNA, 46 nt, Homo sapiens
uaccaaguuugguuuuuaauaauuucucaauauuaugcgccaagau

SEQ ID NO: 124874 - RNA, 51 nt, Homo sapiens
aaaaaacaaacaaacauagugggcccucgucuagaucaugaugugccaguu

SEQ ID NO: 124875 - RNA, 48 nt, Homo sapiens
cagcuccauuugguccagcaaccuuagcagcgcccuucccuucaccac

SEQ ID NO: 124876 - RNA, 46 nt, Homo sapiens
caugcaagguuuuauaacagauauuucaacuuuacagauuccaaag

SEQ ID NO: 124877 - RNA, 42 nt, Homo sapiens
ucaggccucacagaggagcuggaacgaguuuaauaguggccc

SEQ ID NO: 124878 - RNA, 66 nt, Homo sapiens
gaucccugcccuggucucuuucauagugaucuuuuguuuucuuaccuuucuccagaaagcccucua

SEQ ID NO: 124879 - RNA, 46 nt, Homo sapiens
cucugcaaacccucaacgcagacauuuucuuaaaacaacgccagac

SEQ ID NO: 124880 - RNA, 47 nt, Homo sapiens
cuccuccaccggagugggauuccguuccaguucacaaaccuggcagc

SEQ ID NO: 124881 - RNA, 46 nt, Homo sapiens
guacaaguaaguuaguggauaacagaccaccugcccuagcaaaauu

SEQ ID NO: 124882 - RNA, 46 nt, Homo sapiens
gaacuaccauauacucccccuuuggaaaguaagcaacguagaaauc

SEQ ID NO: 124883 - RNA, 41 nt, Homo sapiens
agagaccuccaacccugacacagaaccgcuccucaaggagg

SEQ ID NO: 124884 - RNA, 45 nt, Homo sapiens
cuccccagcccuagaaguguuuacagagcagccuccaucgccauu

SEQ ID NO: 124885 - RNA, 45 nt, Homo sapiens
aaaggggcaaagcagagccagcacggcagccagcaccaugcccac

SEQ ID NO: 124886 - RNA, 65 nt, Homo sapiens
gcagcuucuucacagucugcuaacaaaacaagcccccuugucuuagauucgaacacagugacuca

SEQ ID NO: 124887 - RNA, 71 nt, Homo sapiens
ucaucuuugcucaggagaaaaaaaaucuuaauucugauuacuuaauaacacccuguauggaacucugagug

SEQ ID NO: 124888 - RNA, 63 nt, Homo sapiens
uagaaaccauugaaaucaguggauacucaugugaaggauauggcuuuaaaguuguuaauuguc

SEQ ID NO: 124889 - RNA, 69 nt, Homo sapiens
uaagagaaccaaauuucacauugaaaagaacauuuaagguagagaauacaggacaacuucaaauucaca

SEQ ID NO: 124890 - RNA, 44 nt, Homo sapiens
uacgcuuuaaaaucacggaagcauuguuaaaagauuguacagau

SEQ ID NO: 124891 - RNA, 45 nt, Homo sapiens
aaauacagaccuucaaaaaaauauaauaucaaaaaucacugcuga

SEQ ID NO: 124892 - RNA, 46 nt, Homo sapiens
aaagugcagccugguguagccaugcaggaagauaugugggaugcug

SEQ ID NO: 124893 - RNA, 101 nt, Homo sapiens
auguaagugaccuugcuguucucucucaugucuucacuucccccaaaauacucuuuuaguaagaggccgccacuuuuaaaguacauugcugucuuuuguua

SEQ ID NO: 124894 - RNA, 61 nt, Homo sapiens
acagcaaauacgaucuuugucagaagaugugcgauuuuacuauaaacgauuacggggcaau

SEQ ID NO: 124895 - RNA, 55 nt, Homo sapiens
aaauaguucaucaaaguuuaaauauuaugaauuccuucucacagaagguaaaaau

SEQ ID NO: 124896 - RNA, 48 nt, Homo sapiens
uuagaggggauucaugauggagccauccagaucacaacagacuaugag

SEQ ID NO: 124897 - RNA, 46 nt, Homo sapiens
ccccccaaaauagaggaacguuucauagauuuuggaguacugagug

SEQ ID NO: 124898 - RNA, 45 nt, Homo sapiens
aaucaguauuagcaauagaaaagcacuagcaaauacauuaggauu

SEQ ID NO: 124899 - RNA, 50 nt, Homo sapiens
auuacauuaaaagcaucagaaaguaaauacaccaagguugcaagcauuag

SEQ ID NO: 124900 - RNA, 44 nt, Homo sapiens
ucuccaugcucuucucaggugcuuaucgcaccuucaagagacug

SEQ ID NO: 124901 - RNA, 52 nt, Homo sapiens
gguuggaaaacaaggccaugggauaauuuaagucaucuaaauggaagauuga

SEQ ID NO: 124902 - RNA, 46 nt, Homo sapiens
uuccucaacugaaauguuagauuuugguacacuaagaacacaaggu

SEQ ID NO: 124903 - RNA, 42 nt, Homo sapiens
ggccguuccuuggggccagagucccugugaauagcaguuucu

SEQ ID NO: 124904 - RNA, 134 nt, Homo sapiens
caucuuuuuuucccuacaauaagacacugacuuaagcucgagacguagaggggagagauagaaugaacucuugggggaagaaauaaccuauuuccucuccacuucagcuuuaugccaacaauaagagccuuggg

SEQ ID NO: 124905 - RNA, 46 nt, Homo sapiens
aaaauuuuauuuguaauuuucauaggaaguauguaaacucauuauu

SEQ ID NO: 124906 - RNA, 45 nt, Homo sapiens
uuggaaugccaaaaauggaaaaagucuacuuacauaauccuaguu

SEQ ID NO: 124907 - RNA, 47 nt, Homo sapiens
uagcaaucagaaacagaaaugucagguauuugagguaagggagauau

SEQ ID NO: 124908 - RNA, 73 nt, Homo sapiens
auugacacuucagaacauguguaaucauugcagaaagcauaaaauaaugcaauaugcuaucauaaugucucag

SEQ ID NO: 124909 - RNA, 57 nt, Homo sapiens
ugaauugucuucuugcccuuugcuuacauuucagucacaacauugguuuucccauuu

SEQ ID NO: 124910 - RNA, 56 nt, Homo sapiens
uucuugaggacaugcuaugccagauugccuuagauuuuuaggucacagauuuucuu

SEQ ID NO: 124911 - RNA, 46 nt, Homo sapiens
ccuuuguugaaacaaaauauugagcaaguguaacuguaaaagagau

SEQ ID NO: 124912 - RNA, 57 nt, Homo sapiens
cuuuauuauuauuauuuugucuggggacauaggagauuucuugagaaagaccuuuaa

SEQ ID NO: 124913 - RNA, 43 nt, Homo sapiens
aaaaaacaaccuaaaaaaaguggcguaagacaucccaacagga

SEQ ID NO: 124914 - RNA, 55 nt, Homo sapiens
aaauaauacaggcaguuaggugucugcagccagagaguuagagaaggaaagaagu

SEQ ID NO: 124915 - RNA, 41 nt, Homo sapiens
caucaacaaggagaauggaauggaauggaauguugccaggg

SEQ ID NO: 124916 - RNA, 47 nt, Homo sapiens
ugugccuggagugaguggugaauagaugaggucaaggcuuugcaaau

SEQ ID NO: 124917 - RNA, 51 nt, Homo sapiens
guauggcaagggcccuacauggauuuucuuuuuagagcaugauuaaacugg

SEQ ID NO: 124918 - RNA, 46 nt, Homo sapiens
guauuacauuuggaucaaaggaugugcuaguuaaaaacugucuugg

SEQ ID NO: 124919 - RNA, 40 nt, Homo sapiens
cauguuuuauuaauuggcaauuaaauggcaggguaacguu

SEQ ID NO: 124920 - RNA, 52 nt, Homo sapiens
uauuauaaaugagaagcuauaguuuauguaucuaguaaauauaaauucgaau

SEQ ID NO: 124921 - RNA, 57 nt, Homo sapiens
aaagguaccuuugagaugguuuuggcugugauguaaaguuuguaaggacuuugaaag

SEQ ID NO: 124922 - RNA, 49 nt, Homo sapiens
gcaaaaucuuuaaaagacaauaaaacucauugucuccugaagaaaagcu

SEQ ID NO: 124923 - RNA, 68 nt, Homo sapiens
aagguaucuccagaaauggcuucuccuuuaaaacugaucauauuccaguauuguuucugaguaaguag

SEQ ID NO: 124924 - RNA, 123 nt, Homo sapiens
cugggugaaucagauauccuuuguggcccaugcuuuucuguaugaacaauuugugugugcgguuauccaagauauuaauggagaugaugcugauauagaacauaggccucuacccaucauaaa

SEQ ID NO: 124925 - RNA, 48 nt, Homo sapiens
cucucuaauacccauaaauguguguaaggauuggaugaggagaauacu

SEQ ID NO: 124926 - RNA, 56 nt, Homo sapiens
ugauuuuuccaacagccauuuuauaugcuaauaaaaacuuuacucuggguaaaguu

SEQ ID NO: 124927 - RNA, 45 nt, Homo sapiens
ucuaccuguucacauccccacagagaguuuacagaaauuuucauu

SEQ ID NO: 124928 - RNA, 40 nt, Homo sapiens
uuucuccuuuuuacugaagccucaaaaaaucucacaggaa

SEQ ID NO: 124929 - RNA, 50 nt, Homo sapiens
cuggaugaagggcaggggauguggcuagcgaucucaguagaggaccagug

SEQ ID NO: 124930 - RNA, 45 nt, Homo sapiens
guagaggaggcccagauaguaugguggugauaggaauagagagga

SEQ ID NO: 124931 - RNA, 33 nt, Homo sapiens
uugaguucagggagcuuccugaagagugaaaag

SEQ ID NO: 124932 - RNA, 80 nt, Homo sapiens
gcacuccacaugggcacgugugagcaggcgggcacuccacaugggcacgugugugagcaggcgggcacuccacaugggca

SEQ ID NO: 124933 - RNA, 94 nt, Homo sapiens
cgugugagcaggcgggcacuccacaugggcacgugugagcaggcgggcacuccacaucggcaugugugugagcaggcgggcacuccacaauggc

SEQ ID NO: 124934 - RNA, 79 nt, Homo sapiens
acgugugagcaggcgggcacuccauaugggcacgugagcaggcgggcacuccacgucggcacgugugagcaggcgggca

SEQ ID NO: 124935 - RNA, 59 nt, Homo sapiens
uauaaguacagagugaaauaaaaagugagaagaagauucaaucguaacugugucaacag

SEQ ID NO: 124936 - RNA, 50 nt, Homo sapiens
aauuugcaggauccagggccacgcggcuuuuugugcccagacucuuggag

SEQ ID NO: 124937 - RNA, 45 nt, Homo sapiens
uaggaguucagagaagagacacgcuuccagcuuucagagaucucu

SEQ ID NO: 124938 - RNA, 47 nt, Homo sapiens
uuucagaaguguuuuucccccuuuaauaauuguauacauugucgguu

SEQ ID NO: 124939 - RNA, 41 nt, Homo sapiens
uccacuccggcuuuugccuugcaguagcugccggcggcugc

SEQ ID NO: 124940 - RNA, 57 nt, Homo sapiens
auugcuugucaauggcgcucguggccccagccccucuauucggucucucacagaccc

SEQ ID NO: 124941 - RNA, 42 nt, Homo sapiens
acuauaauaauuacuguacuuuugaucauaaaacuuccaaau

SEQ ID NO: 124942 - RNA, 46 nt, Homo sapiens
uuuuuuaggaaguuuguuaaaaucaucaucaucaucacucccagag

SEQ ID NO: 124943 - RNA, 41 nt, Homo sapiens
aggaggcgucaucaucuucauucccacuuucuauguuagga

SEQ ID NO: 124944 - RNA, 46 nt, Homo sapiens
ucucucuucugucuuucuucuuccucuuuaagcuuagccagagcuu

SEQ ID NO: 124945 - RNA, 42 nt, Homo sapiens
ugagcuuguagcaguuuaagaguagcuucggcucuggcucug

SEQ ID NO: 124946 - RNA, 41 nt, Homo sapiens
ucuucuuuggcaaagagucuuuugauggcacuucaacaccu

SEQ ID NO: 124947 - RNA, 46 nt, Homo sapiens
uuguuccauaacuucuacagcagcacauaauuccauugauucagac

SEQ ID NO: 124948 - RNA, 49 nt, Homo sapiens
uuuuagaaaaaaguaaaaaauuaugcucugacauaaaaaaagaauguuu

SEQ ID NO: 124949 - RNA, 46 nt, Homo sapiens
aagaggaacauugguggccccaauuuguugugugauaccaccugcu

SEQ ID NO: 124950 - RNA, 28 nt, Homo sapiens
aauggcucaucauuuugaaacuccucau

SEQ ID NO: 124951 - RNA, 46 nt, Homo sapiens
gagucacauggcgacaaaaagaaagaaccaguaaauggcuguaaua

SEQ ID NO: 124952 - RNA, 47 nt, Homo sapiens
guacuauguucucaaugcuagaaacacuucaacacaagagcaugaag

SEQ ID NO: 124953 - RNA, 46 nt, Homo sapiens
ugauuguggcaaaucacuuaaacagauacaaaaaggaggucucugu

SEQ ID NO: 124954 - RNA, 37 nt, Homo sapiens
agcucaaaacagaaucaaaggguggagaaagcaagcc

SEQ ID NO: 124955 - RNA, 332 nt, Homo sapiens
gguacacgguuugcccacaguauuaggaggagcuuugggauucccagcacuuugggaggcugagacgggcggaucaccugaggucaggaguuggagaccagccuagccaacauggcaaaaccccaucucuacuaaaaauauaaaaaguagccaggcguggugguguacgccuguaaucccagccacuugggaggcugaggugggagaaucgcuugaaccuaggagguggagguugcagagaacugagaucauggcacugcacuccagccugggcaacagaaugagacucugucucaaaaaaaaaaaaaaaaaaaaaggcggggguggggugg

SEQ ID NO: 124956 - RNA, 47 nt, Homo sapiens
cagcuauuuaccaugugaugcuagacugcaguuuuccuuuaucucaa

SEQ ID NO: 124957 - RNA, 29 nt, Homo sapiens
guuucaaguguauuuuucagaguauuuuu

SEQ ID NO: 124958 - RNA, 77 nt, Homo sapiens
ugcgaggcuugcucacuggugacaauggacaagaaaggcagucagcuuaugcccuuguguagcguauagccuaaugu

SEQ ID NO: 124959 - RNA, 71 nt, Homo sapiens
gugaagcuuuaugauuucaauucagaugcucuagaugaggcauagauauauguggagcagugaacagucug

SEQ ID NO: 124960 - RNA, 47 nt, Homo sapiens
agauugucuuaugagcaauaucuggaauaauauuugguaaacagcug

SEQ ID NO: 124961 - RNA, 65 nt, Homo sapiens
agugagauauuucuaaccauucucuaaucauacuggaaaaugggacuuuguagucccauuaguau

SEQ ID NO: 124962 - RNA, 73 nt, Homo sapiens
gcuggcuuucaaagugugaaauucuuuuugcauuauuuuguauaagcaagggcuuugucagucaucaacucca

SEQ ID NO: 124963 - RNA, 35 nt, Homo sapiens
gcugaaaauauauucuuauuguuauaugaaaaaag

SEQ ID NO: 124964 - RNA, 44 nt, Homo sapiens
uuuuuuuuuuuuuugcuuuuuaaugauuccuuuugcugacuuau

SEQ ID NO: 124965 - RNA, 57 nt, Homo sapiens
acuuucaguugggacuguagucuuucugaggcucacaggauguugauguaggaagag

SEQ ID NO: 124966 - RNA, 43 nt, Homo sapiens
cauuucaguuuguaguacauuuccugaacaaaaguaaguguuu

SEQ ID NO: 124967 - RNA, 40 nt, Homo sapiens
ggcaagcuuuuugguucuugauuauguggucucucuugca

SEQ ID NO: 124968 - RNA, 25 nt, Homo sapiens
aauuacagacaugguuaggacucuc

SEQ ID NO: 124969 - RNA, 36 nt, Homo sapiens
aaaauagaaauggaaguagauagaaggguauaaaug

SEQ ID NO: 124970 - RNA, 45 nt, Homo sapiens
uugcuguuagucauuguugucucauuugauggaucagagugugag

SEQ ID NO: 124971 - RNA, 42 nt, Homo sapiens
cagaauugauaguuacugccuuugggagucgauuuguagagu

SEQ ID NO: 124972 - RNA, 48 nt, Homo sapiens
ucacuucaggcugggugcucuuaggaaugccacgcugcugugcuagau

SEQ ID NO: 124973 - RNA, 51 nt, Homo sapiens
uuugggcuggugggggcugggguguuaugugugugguggugaauuugagug

SEQ ID NO: 124974 - RNA, 48 nt, Homo sapiens
ccacaaaugugcacaaguccuccuugcaucuucuagcaaaaggaagug

SEQ ID NO: 124975 - RNA, 46 nt, Homo sapiens
aaaaacuaucauaaaguuaaauugacuuaguuuucuuuugauauac

SEQ ID NO: 124976 - RNA, 46 nt, Homo sapiens
aaaacgggucaguuggcagccaucaaaguuauggaugucacugagg

SEQ ID NO: 124977 - RNA, 68 nt, Homo sapiens
aagaauugcagcaggugugggaaauugaaugguguggcugcucuucucccgagcugucagcuguuggc

SEQ ID NO: 124978 - RNA, 47 nt, Homo sapiens
cugcaaggcaacuaaaaacucaucuccuagucagguccuggccugag

SEQ ID NO: 124979 - RNA, 82 nt, Homo sapiens
agacauugguuugugucacuaaaagaaaaaaauauaaauggaaccuagucgaauuauuuuauaauucuuaauuauugcucag

SEQ ID NO: 124980 - RNA, 56 nt, Homo sapiens
cuggcagagugugauagggaacaaugacccuggaaauaguuuagccacugcaggga

SEQ ID NO: 124981 - RNA, 46 nt, Homo sapiens
aaggaugaagaggaagaaaucaaacuggagauaaauaugcuaaaga

SEQ ID NO: 124982 - RNA, 20 nt, Homo sapiens
ggcuaucacauuauuuaaac

SEQ ID NO: 124983 - RNA, 51 nt, Homo sapiens
uuacuugguugcauuucauuuaccuaccacauuuaaaaaaaaagauuauga

SEQ ID NO: 124984 - RNA, 44 nt, Homo sapiens
uucagggacuggcacaucuucacauucaucaugugauucaccgg

SEQ ID NO: 124985 - RNA, 38 nt, Homo sapiens
agagugaucuuuggucuuguggcauuacagccauugag

SEQ ID NO: 124986 - RNA, 42 nt, Homo sapiens
cugugacaugcauccaaugagagcacuguuucucauucccag

SEQ ID NO: 124987 - RNA, 53 nt, Homo sapiens
aaguuagaauccagcuuaaggaucauauagaucguaccaggaagaagagaggc

SEQ ID NO: 124988 - RNA, 43 nt, Homo sapiens
gaguacagugggagugaggaagaagaggaggaagugccugaac

SEQ ID NO: 124989 - RNA, 42 nt, Homo sapiens
caguuacuacaggagcaacagcuccgggagcaggaagaauau

SEQ ID NO: 124990 - RNA, 35 nt, Homo sapiens
cuuguuuagaaaaaucagugccugcugaacuaagg

SEQ ID NO: 124991 - RNA, 44 nt, Homo sapiens
aguuuguguuaauauuauuggcucucugugucugggaaauuuga

SEQ ID NO: 124992 - RNA, 84 nt, Homo sapiens
agcgggaagcuagaaggcagcaggaacgugaacagcgaaggagagaacaagaagaaaagaggcgucuagaggaguuggagagaa

SEQ ID NO: 124993 - RNA, 64 nt, Homo sapiens
ggcgcaaagaagaagaggagaggagacgggcagaagaagaaaagaggagaguugaaagagaaca

SEQ ID NO: 124994 - RNA, 151 nt, Homo sapiens
gccauagaguuuagcuaauuaucugguuucuucauuuucuaacuaggaaauugaauuucagaggaguggagggccuugcccaagguuucauauucagucagugcuuuuuccauaaaggaccagagugccucaguuaacauaucccagaaga

SEQ ID NO: 124995 - RNA, 55 nt, Homo sapiens
gaugagggaaagaguggucugaugaacuauucugccaagcuaguauaaagcuaaa

SEQ ID NO: 124996 - RNA, 74 nt, Homo sapiens
acuggcuucuuggaugcuugugacuaaauuuucucuccgauuguaucaguguaggaccagggaaggaguugggg

SEQ ID NO: 124997 - RNA, 46 nt, Homo sapiens
acagagaaacuccaccagguaaaagacaagugagcacugagaacag

SEQ ID NO: 124998 - RNA, 38 nt, Homo sapiens
ugguugagaggccugcagucuuuucugcgagggccccu

SEQ ID NO: 124999 - RNA, 45 nt, Homo sapiens
aagaaaagaaacauucucaacuaugaagaaaauagaaaaccaagu

SEQ ID NO: 125000 - RNA, 46 nt, Homo sapiens
ggacuacuccucauccagugaggagucggggacgacggaugaggag

SEQ ID NO: 125001 - RNA, 80 nt, Homo sapiens
aaaaccaugauuguccaugaugauguagaaagugagccggccaugaccccauccaaggagggcacucuaaucguccgcca

SEQ ID NO: 125002 - RNA, 41 nt, Homo sapiens
ugagucucacagucuaugucugagcgggagagaagccacag

SEQ ID NO: 125003 - RNA, 46 nt, Homo sapiens
caucaugagagcaauggcuuugccggucgcauucaccucuugccag

SEQ ID NO: 125004 - RNA, 61 nt, Homo sapiens
acuuccuccaccuccuccuccccauccuccagccagccgacacccaccauguccccacaga

SEQ ID NO: 125005 - RNA, 45 nt, Homo sapiens
aaacacaaaucuuccuccuccuuuacaccuuuuauagaccccaga

SEQ ID NO: 125006 - RNA, 51 nt, Homo sapiens
caaugugaauccuaccaacacuaggccacagagugacaccccggagauucg

SEQ ID NO: 125007 - RNA, 41 nt, Homo sapiens
aagauagucaugacgugaguauuuuagcaagauuaggauug

SEQ ID NO: 125008 - RNA, 66 nt, Homo sapiens
gucucuauccgucacuuaaaagguugccaaaggcugaacaauugugagagcagaggaaagggaaag

SEQ ID NO: 125009 - RNA, 60 nt, Homo sapiens
acaggugggugggugucaccagauggacagcaguggaaaugucuccacugaggaagcaga

SEQ ID NO: 125010 - RNA, 46 nt, Homo sapiens
cgauuucaacaaauggacguacuugagggcuugaaugucuugguga

SEQ ID NO: 125011 - RNA, 55 nt, Homo sapiens
aauaaaauacuucacaaugauccagaaguugagaagaagcagggauggacaaccg

SEQ ID NO: 125012 - RNA, 46 nt, Homo sapiens
caguaaaauaugaaagaaucaaauuucuggugauugcuuugaagag

SEQ ID NO: 125013 - RNA, 46 nt, Homo sapiens
ucacuauuuuacuuugcaugauuuucugaucaaggcagccaaaagc

SEQ ID NO: 125014 - RNA, 45 nt, Homo sapiens
auuuggagaauugguacauaagccauuacugguggaucucacugu

SEQ ID NO: 125015 - RNA, 45 nt, Homo sapiens
aacacauauggaaggaucaccaaggauguaguucuacagugggga

SEQ ID NO: 125016 - RNA, 48 nt, Homo sapiens
ucagauucuaccaucaggugcuauaaguguuugggauugagcaucaua

SEQ ID NO: 125017 - RNA, 46 nt, Homo sapiens
auuuaauugacauuucuuuuuuguaaugugacgauauguggacaaa

SEQ ID NO: 125018 - RNA, 51 nt, Homo sapiens
uuaaaccuagacgugcaacaaaaguuuuaccacagucugcacuugcagaag

SEQ ID NO: 125019 - RNA, 46 nt, Homo sapiens
gguguaauaucgaaguccuggcuuuucucguuuucucacuugcucu

SEQ ID NO: 125020 - RNA, 44 nt, Homo sapiens
ggcacuaaagaagaauggaaauaaugguguggcuguuagguaaa

SEQ ID NO: 125021 - RNA, 94 nt, Homo sapiens
cuacucuucccaacucagucuugaagaguaucaccaacugccucauguguggugaccuucacugucguaugccagugacucaucuggaguaauc

SEQ ID NO: 125022 - RNA, 95 nt, Homo sapiens
ucaacaacgaguuaccaauacuugcucuugauugauaaacagaaugggguuuuggaucuuagcaauucucacaauucucauguauuccacagcag

SEQ ID NO: 125023 - RNA, 61 nt, Homo sapiens
aaacaaucauggggccuggaaaaugaggcuuuaauuguaagauguccuagacaaggaaaac

SEQ ID NO: 125024 - RNA, 83 nt, Homo sapiens
caaacaaacaaaaguauucccacucaggaaagaaaucguguguuugccucaggccaacuucugaaguuucuaccagcugcagu

SEQ ID NO: 125025 - RNA, 58 nt, Homo sapiens
uaggacuggauaugcgaaugucaccauauauaaaaaacaaucagauugcaauguucca

SEQ ID NO: 125026 - RNA, 56 nt, Homo sapiens
gauuauuugauguauucaacaguaucuggaucagaaaaaaauuccaaaauuuauug

SEQ ID NO: 125027 - RNA, 59 nt, Homo sapiens
cugaggacgcaggugauuacaccuguaaauuuauacacaaugaaaauggagccaauuau

SEQ ID NO: 125028 - RNA, 46 nt, Homo sapiens
gcuuuucucuguuuccaguaaucggagccccugcacaaaaugaaau

SEQ ID NO: 125029 - RNA, 105 nt, Homo sapiens
uuguuuuggaaaaggcacucaguucuuggcugccguccuguggcagcuuaauggaacaaaaauuacagacuuuggugaaccaagaauucaacaagaggaagggca

SEQ ID NO: 125030 - RNA, 81 nt, Homo sapiens
gugaaggaagaggauuuauugcugcaguacgacugucuggcccugaauuugcauggcuugagaaggcacaccguaagacua

SEQ ID NO: 125031 - RNA, 70 nt, Homo sapiens
aucaccugaacuuucucuagcaaguguaagcagaauggagugugguuccaagagauccaucaagacaaug

SEQ ID NO: 125032 - RNA, 45 nt, Homo sapiens
uguugucuuggaaaacagcuuuccaagcauuucacuccugagcac

SEQ ID NO: 125033 - RNA, 100 nt, Homo sapiens
gcuguacaaucauguagaaauuguuuaaugugccugucaaauagccaaagaguguuaaacccugaguucccacccaugugugugguaugguuaggauuca

SEQ ID NO: 125034 - RNA, 55 nt, Homo sapiens
aaguuuuucauaaaauaaacagaaucauaacucauguagauggcuauaagugccg

SEQ ID NO: 125035 - RNA, 47 nt, Homo sapiens
guugcaucuacauuuugugaagcaaggaguacuaggaaaaauuucug

SEQ ID NO: 125036 - RNA, 45 nt, Homo sapiens
uguucuggauugaggccacucugcucuggagagacauagcuaaac

SEQ ID NO: 125037 - RNA, 45 nt, Homo sapiens
gauggaaagcucuaugaugcuuauguugucuacccacggaacuac

SEQ ID NO: 125038 - RNA, 46 nt, Homo sapiens
cgcuucaggacucccuccagcaucuuaugaaaguacaggggaccau

SEQ ID NO: 125039 - RNA, 46 nt, Homo sapiens
aaaaggucccugaauucuaaauucuggaagcacgugagguaccaaa

SEQ ID NO: 125040 - RNA, 64 nt, Homo sapiens
cucaaucuuuaugcuuucuaauuuuauuuuuauuucuucacuuguugcaaagcaguugucccag

SEQ ID NO: 125041 - RNA, 59 nt, Homo sapiens
uuucacuauuaugaggucaccuguagguuucuuauagauguucuuuaucagauuaagaa

SEQ ID NO: 125042 - RNA, 46 nt, Homo sapiens
ggaucaaguagaacugguggacuuugauccaaaucaggaaagaugg

SEQ ID NO: 125043 - RNA, 47 nt, Homo sapiens
uucgggucacacucaggccugaauuguccugaucuggagaguaggca

SEQ ID NO: 125044 - RNA, 41 nt, Homo sapiens
ucccugguauggaaugguuuuggcgcugugauugagguuuc

SEQ ID NO: 125045 - RNA, 56 nt, Homo sapiens
gaaggcaugguugggaugcgcagcccucccacgaggcccauggcgccccagggccc

SEQ ID NO: 125046 - RNA, 362 nt, Homo sapiens
uguaaguuuuuugggcccugccuacaucccagacccuggcaaggacugguucaggcaaacugggacagagaugaaggggcacguuuccauugugggccugaggcugauugauuucacccaguaauaacuuuaggguuuauagguuuagagaucuacuugagauacagaguguuuugcauuuaguaguaaggguuucccauaucucaaguguagcugcuguaggaaguguugguucucccagacuugccagcugugauguuggguggucuuauuagaggaaaguucuuuguuggcuuaauucccuuuuuuucucccacagcccgaaaauggcacagaaaugguaucaagaaaccccgaucaca

SEQ ID NO: 125047 - RNA, 46 nt, Homo sapiens
cguacccaggccccuacaaaggcuucagaguagauaucucugccaa

SEQ ID NO: 125048 - RNA, 66 nt, Homo sapiens
auuaauuuagacuaggacucgugugcugaugcucaggacaucgcaagagauuuagugugagagcaa

SEQ ID NO: 125049 - RNA, 52 nt, Homo sapiens
gucugugccuucaagaagccuacuguuccugagugacagauaugagaagaga

SEQ ID NO: 125050 - RNA, 182 nt, Homo sapiens
aucaggccugccgggcagccagugucaaauggucaugggaacacagccccccugccgcaucuaugggcaucgaugccccaucuaugggcuggcccccccucucuagaagcaggagugcccaugggaccaggccccagccacuuaccuuguguguucuggaaguaguggcgccacaggggccg

SEQ ID NO: 125051 - RNA, 35 nt, Homo sapiens
guuggcgaacaccaggaggacagcaucccggagcu

SEQ ID NO: 125052 - RNA, 66 nt, Homo sapiens
uaauguuuagggaucgggagauuugguuuggggaagaauaguuugucuuuaagcacgaaagcuggg

SEQ ID NO: 125053 - RNA, 60 nt, Homo sapiens
aaaaaucguugauaucauugauacaacaggaaguggcgaugugaauacugcuacagaagu

SEQ ID NO: 125054 - RNA, 41 nt, Homo sapiens
gagucaggaaucuggguguggcuuaacgggguuccagucgc

SEQ ID NO: 125055 - RNA, 47 nt, Homo sapiens
cuuccuuuuacagaugaaguagaagccuguggguuccuucuaguuag

SEQ ID NO: 125056 - RNA, 46 nt, Homo sapiens
aaggaaaaaaucugggacccuguucacagaguggcccuugcagaag

SEQ ID NO: 125057 - RNA, 42 nt, Homo sapiens
cuaaauucuuuugagaagaaauacagcgauccuggcccugua

SEQ ID NO: 125058 - RNA, 40 nt, Homo sapiens
aaguguucggaauauaauuuaaaaacuauuuuaguuagua

SEQ ID NO: 125059 - RNA, 46 nt, Homo sapiens
gacuugaguaaaucuaccguguugagaaacuacaaagaagcccaag

SEQ ID NO: 125060 - RNA, 45 nt, Homo sapiens
guuacaugugcacacauuuugguauuguguguaccuagagguagg

SEQ ID NO: 125061 - RNA, 46 nt, Homo sapiens
gaaguuauaaaucauaagugugaucuugucaacuacaguuacggag

SEQ ID NO: 125062 - RNA, 44 nt, Homo sapiens
gaguuucaaaugccauuuuaguaugaugggacuccagagguggg

SEQ ID NO: 125063 - RNA, 53 nt, Homo sapiens
guuucaguguaaaguuuuuugaggacauaacuaguaacugaguauguuugaag

SEQ ID NO: 125064 - RNA, 45 nt, Homo sapiens
uuuaggucugaaagcuaauaacauugacuacacaguucauucagu

SEQ ID NO: 125065 - RNA, 43 nt, Homo sapiens
acuacaagcaaaaaggauacacaaacaaauuuuguaguuaaga

SEQ ID NO: 125066 - RNA, 48 nt, Homo sapiens
uaaagccuaugacuaccucguucagaauacaucauuugcuaauaaauu

SEQ ID NO: 125067 - RNA, 44 nt, Homo sapiens
uuaugugaccuagugucaggaaauuggugucaaccucugguuaa

SEQ ID NO: 125068 - RNA, 54 nt, Homo sapiens
acuagauuuuguauucuuagcaacugacuagguucugagagcucucugcacacc

SEQ ID NO: 125069 - RNA, 35 nt, Homo sapiens
cacugacugaagcuuuuccuguccuaguaaguuua

SEQ ID NO: 125070 - RNA, 46 nt, Homo sapiens
aaaaccuuuaggaucaagagauguuuugccaaauaaccgucaacuu

SEQ ID NO: 125071 - RNA, 68 nt, Homo sapiens
uguguguguguguguguguguguguguguguguguguauuuguccuagauauucuauggugccucaau

SEQ ID NO: 125072 - RNA, 123 nt, Homo sapiens
uugucauucucaagcagacacugaguuuugcuaaaagugugggaguauucugucguucuggaaagaaugagggcuuugaagucagaccugacuucagcucucuuauacuuuacucugugugau

SEQ ID NO: 125073 - RNA, 54 nt, Homo sapiens
aagaauuaauuccacauuucagaauggauaaaagagaagauauacucuugggga

SEQ ID NO: 125074 - RNA, 42 nt, Homo sapiens
uacagaccuaucucauuggaauuucacaugguuaaguaggaa

SEQ ID NO: 125075 - RNA, 37 nt, Homo sapiens
aagguaacuuucacuucacuuugacuuucacaguaac

SEQ ID NO: 125076 - RNA, 42 nt, Homo sapiens
guuuacuguuacaucauuuuauaccccgaaauuguguuggug

SEQ ID NO: 125077 - RNA, 28 nt, Homo sapiens
uauuuuccaaauagaauacaaaccaaaa

SEQ ID NO: 125078 - RNA, 32 nt, Homo sapiens
aaacaugcauuaguaaauaaaauguaugggag

SEQ ID NO: 125079 - RNA, 48 nt, Homo sapiens
auucaauuaaggggaaaaaguagaaccagcacaaaugaguggcaguug

SEQ ID NO: 125080 - RNA, 56 nt, Homo sapiens
aauguaaaacacaugaauaaauuugcaaaaccaagaucacaguacaccauaugcac

SEQ ID NO: 125081 - RNA, 41 nt, Homo sapiens
uggaagcugcuggagugcuccgggcggcaggucagccccga

SEQ ID NO: 125082 - RNA, 64 nt, Homo sapiens
ucucaucugcaaaguagagguggugauaguaucuacacacaggauuggaaugaggaauaaagaa

SEQ ID NO: 125083 - RNA, 62 nt, Homo sapiens
caguggccugagagcagccaggucaggucccuguucaccauccugagcagggucugcauaau

SEQ ID NO: 125084 - RNA, 47 nt, Homo sapiens
uacuuuccagagaugaagcacuacccagucuuacccaaguucgaaga

SEQ ID NO: 125085 - RNA, 42 nt, Homo sapiens
gaacauguccaaaaggaaaugaaucagcaacauucaggacac

SEQ ID NO: 125086 - RNA, 46 nt, Homo sapiens
ugaagugcuugagcagcagaacgaacuuugcccauaugagaguaaa

SEQ ID NO: 125087 - RNA, 45 nt, Homo sapiens
gaggcaguagauaauguggaaaauguggugucauuuaaugcuaaa

SEQ ID NO: 125088 - RNA, 57 nt, Homo sapiens
ccaggauuuaauuuccauuccaaaggccguggaaccaauggaaauugacucggaaga

SEQ ID NO: 125089 - RNA, 41 nt, Homo sapiens
ugaaaaggcuuguuuugaaguuacaggcauuugugauuaca

SEQ ID NO: 125090 - RNA, 47 nt, Homo sapiens
caagcagaauucccugaaacuuccaaaccucccucagaacaaggcga

SEQ ID NO: 125091 - RNA, 54 nt, Homo sapiens
guccgagagccuccugagggacaacucugagagggacgacguggauggugagcc

SEQ ID NO: 125092 - RNA, 41 nt, Homo sapiens
aggcuuuacucguguaacuucaaggcagggaccugcaggaa

SEQ ID NO: 125093 - RNA, 51 nt, Homo sapiens
gugagaggaggagggaggaaauggcaaggguuaaucuuagagaauaggaag

SEQ ID NO: 125094 - RNA, 51 nt, Homo sapiens
ggagaagaaugaagucgaggaggauuccagauacugagcagcuggucgagu

SEQ ID NO: 125095 - RNA, 71 nt, Homo sapiens
auagugaugacgauggagggaaagagaagaugguccucgugaccgccagaucuguguuugggaagaaaaga

SEQ ID NO: 125096 - RNA, 43 nt, Homo sapiens
ugagcuuugugcaaaaggggagcuggcuacuucucgcucugcu

SEQ ID NO: 125097 - RNA, 52 nt, Homo sapiens
uucagcauuacaagaaaagaaagcaaauccacuggaacaauucugggaaaga

SEQ ID NO: 125098 - RNA, 46 nt, Homo sapiens
uuaaccaccagaguuucagucugugucuaaugaaaacacagcagaa

SEQ ID NO: 125099 - RNA, 52 nt, Homo sapiens
cuucuuacacucagaucuucuuuuucacccugacuguguaaccuugggaaaa

SEQ ID NO: 125100 - RNA, 46 nt, Homo sapiens
uuggucaguccuaugcggauagagaugucuggaagccagaaccaug

SEQ ID NO: 125101 - RNA, 59 nt, Homo sapiens
auccguucucugcgaugacauaauaugugacgaucaagaauuagacugccccaacccag

SEQ ID NO: 125102 - RNA, 46 nt, Homo sapiens
aagguccagcugggauaccuggauucccugguaugaaaggacacag

SEQ ID NO: 125103 - RNA, 46 nt, Homo sapiens
ugguccuccuggaacugccggauucccuggauccccuggugcuaag

SEQ ID NO: 125104 - RNA, 48 nt, Homo sapiens
gugagccugguaagaauggugccaaaggagagcccggaccacguggug

SEQ ID NO: 125105 - RNA, 68 nt, Homo sapiens
gugaggcugguauuccagguguuccaggagcuaaaggcgaagauggcaaggauggaucaccuggagaa

SEQ ID NO: 125106 - RNA, 45 nt, Homo sapiens
gcccugcagggcccagaggagcugcuggagaaccuggcagagaug

SEQ ID NO: 125107 - RNA, 45 nt, Homo sapiens
gccugguggugacaaaggagacacaggacccccugguccacaagg

SEQ ID NO: 125108 - RNA, 42 nt, Homo sapiens
gacuuagagguggagcuggucccccuggucccgaaggaggaa

SEQ ID NO: 125109 - RNA, 46 nt, Homo sapiens
gggccaccuggugcugcugguacuccuggucugcaaggaaugccug

SEQ ID NO: 125110 - RNA, 83 nt, Homo sapiens
ugaaccuggugguaaaggagaaagaggggcuccgggugagaaaggugaaggaggcccuccuggaguugcaggacccccuggag

SEQ ID NO: 125111 - RNA, 42 nt, Homo sapiens
caggcaugccagguccuaggggaagcccuggcccucagggug

SEQ ID NO: 125112 - RNA, 46 nt, Homo sapiens
cccuggaccccagggucuuccuggucuggcugguacagcuggugaa

SEQ ID NO: 125113 - RNA, 30 nt, Homo sapiens
aggcccaccugguccugucgguccagcugg

SEQ ID NO: 125114 - RNA, 46 nt, Homo sapiens
aaaggguccucaaggcccacguggugacaaaggugaaacaggugaa

SEQ ID NO: 125115 - RNA, 48 nt, Homo sapiens
guggacauccaggucccauuggaccaccagggccucgagguaacagag

SEQ ID NO: 125116 - RNA, 91 nt, Homo sapiens
guccuugcuguggugguguuggagccgcugccauugcugggauuggaggugaaaaagcuggcgguuuugccccguauuauggagaugaacc

SEQ ID NO: 125117 - RNA, 104 nt, Homo sapiens
aauggauuucaaaaucaacaccgaugagauuaugacuucacucaagucuguuaauggacaaauagaaagccucauuaguccugaugguucucguaaaaaccccg

SEQ ID NO: 125118 - RNA, 42 nt, Homo sapiens
ggagaauacuggguugacccuaaccaaggaugcaaauuggau

SEQ ID NO: 125119 - RNA, 68 nt, Homo sapiens
uccuuugaauguuccacggaaacacugguggacagauucuagugcugagaagaaacacguuugguuug

SEQ ID NO: 125120 - RNA, 86 nt, Homo sapiens
ucuccagccgagcuucccagaacaucacauaucacugcaaaaauagcauugcauacauggaucaggccaguggaaauguaaagaag

SEQ ID NO: 125121 - RNA, 76 nt, Homo sapiens
gcccugaagcugauggggucaaaugaaggugaauucaaggcugaaggaaauagcaaauucaccuacacaguucugg

SEQ ID NO: 125122 - RNA, 76 nt, Homo sapiens
ggggaauggagcaaaacagucuuugaauaucgaacacgcaaggcugugagacuaccuauuguagauauugcacccu

SEQ ID NO: 125123 - RNA, 43 nt, Homo sapiens
ccauauguguuccucuuguucuaaucuugucaaccagugcaag

SEQ ID NO: 125124 - RNA, 44 nt, Homo sapiens
uuuuuaccaauuccaauuucaaaaugucucaauggugcuauaau

SEQ ID NO: 125125 - RNA, 37 nt, Homo sapiens
uggaagauugguuuaaaaagaaaaguguaaugcaaga

SEQ ID NO: 125126 - RNA, 31 nt, Homo sapiens
ccaucagaaagauucauuggcaugccacagg

SEQ ID NO: 125127 - RNA, 45 nt, Homo sapiens
auuuugcuuggcugcaguugaaaaauagaaauuagugcccuuuug

SEQ ID NO: 125128 - RNA, 49 nt, Homo sapiens
auccucaaguuuuaauugauuuuaaauauuuuucaauacaacaguuuag

SEQ ID NO: 125129 - RNA, 53 nt, Homo sapiens
augaccaccgccauucacaagaacuuugacuguuugaaguugauccugagacu

SEQ ID NO: 125130 - RNA, 62 nt, Homo sapiens
cguugaaauugggccaguuuguuuuguguaaaguaagccaagacacaucgacaaugagcacc

SEQ ID NO: 125131 - RNA, 45 nt, Homo sapiens
gcaagacugucuuugaauauagaacacagaauguggcacgcuugc

SEQ ID NO: 125132 - RNA, 48 nt, Homo sapiens
agcugugguucucaaaggggcaaaugacuuagauaucaaagcagaggg

SEQ ID NO: 125133 - RNA, 82 nt, Homo sapiens
uggagaccaccaaucaccuaauacagccauuacucagaugacuuuuuugcgccuuuuaucaaaagaagccucccagaacauc

SEQ ID NO: 125134 - RNA, 45 nt, Homo sapiens
ggccaguaaaucuccugacaauaaaccuguuugguauggucuuga

SEQ ID NO: 125135 - RNA, 51 nt, Homo sapiens
cuguugaagaugcaaucaaaguuuacugcaacauggaaacaggagaaacau

SEQ ID NO: 125136 - RNA, 66 nt, Homo sapiens
uggcucgaaaaagcacccagcccgcacgugugaugaccuaaagcuuugccauuccgcaaagcagag

SEQ ID NO: 125137 - RNA, 67 nt, Homo sapiens
cggacccagggguucaugcuacccugaagucacucaguagucagauugaaaccaugcgcagccccga

SEQ ID NO: 125138 - RNA, 41 nt, Homo sapiens
uuggggauaucauggggcacuaugaugaaagcaugccagau

SEQ ID NO: 125139 - RNA, 46 nt, Homo sapiens
aaacccugggccacuugggccaauuggaccuccagguguacgaggc

SEQ ID NO: 125140 - RNA, 42 nt, Homo sapiens
aaggaccucguggugacaaaggugaucauggagaccgaggug

SEQ ID NO: 125141 - RNA, 45 nt, Homo sapiens
cccuggaacuccuggcccugugggugcuccaggagaugcaggaca

SEQ ID NO: 125142 - RNA, 46 nt, Homo sapiens
cagcuggcaaugaugguaccccaggacgggauggugcuguuggaga

SEQ ID NO: 125143 - RNA, 44 nt, Homo sapiens
agggaacaccaggaaaaguaggaccaacuggugcaacaggagau

SEQ ID NO: 125144 - RNA, 99 nt, Homo sapiens
cuccaggucuucguggggacccuggcucucaugggcgugugggagaucgaggaccagcuggccccccugguggcccaggagacaaaggggacccaggag

SEQ ID NO: 125145 - RNA, 36 nt, Homo sapiens
gaaaaaggaaaauagugcccuuccuaccaguuaauc

SEQ ID NO: 125146 - RNA, 42 nt, Homo sapiens
ggaguaaaaggugaaccuggagagccaggacagaagggagau

SEQ ID NO: 125147 - RNA, 46 nt, Homo sapiens
aggguucucgaggugaaaaugggccaacuggagcuguugguuuugc

SEQ ID NO: 125148 - RNA, 45 nt, Homo sapiens
cagguccuuugggcccuccagguccggcagguccuacuggagaaa

SEQ ID NO: 125149 - RNA, 44 nt, Homo sapiens
agaaaaaggugcugaaggcacagcuggaaaugauggugcaagag

SEQ ID NO: 125150 - RNA, 46 nt, Homo sapiens
agauacaggcccaccaggucuucaagguaugccgggagaaagagga

SEQ ID NO: 125151 - RNA, 96 nt, Homo sapiens
aacgaggaaauccuggggaaagaggagaaccugggauaacuggacucccuggugagaagggaauggcuggaggacaugguccugauggcccaaaag

SEQ ID NO: 125152 - RNA, 45 nt, Homo sapiens
uuccuggagaucccggagcaguuggcccguuaggaccuagaguaa

SEQ ID NO: 125153 - RNA, 45 nt, Homo sapiens
ccugguccuccagggccuccuggagaagguggaaaaccaggugau

SEQ ID NO: 125154 - RNA, 27 nt, Homo sapiens
uagcuggugaaagaggagaacaaggac

SEQ ID NO: 125155 - RNA, 46 nt, Homo sapiens
cugggaaaccuggagaagcaggaaaugcuggaguuccugggcagag

SEQ ID NO: 125156 - RNA, 45 nt, Homo sapiens
gggcagcccgggagcaugggccuuccaggccccaaagguagcagu

SEQ ID NO: 125157 - RNA, 46 nt, Homo sapiens
acgggguccuguagguucuucaggacccaaaggaagccagggggau

SEQ ID NO: 125158 - RNA, 45 nt, Homo sapiens
ucgugguuuuccaggcucugaugguuuaccugggccaaaggugag

SEQ ID NO: 125159 - RNA, 42 nt, Homo sapiens
ggaacaguugguccuccagggccagugggagaaaggguaaau

SEQ ID NO: 125160 - RNA, 48 nt, Homo sapiens
ccacaugguauucaggguccgauaggcccacccggugaagaaggcaaa

SEQ ID NO: 125161 - RNA, 42 nt, Homo sapiens
ccuacaggggcgcgaggcccugaagguccucaggggcagaga

SEQ ID NO: 125162 - RNA, 36 nt, Homo sapiens
uguaauuuuaaagugaaaggcagguuauucuuaugu

SEQ ID NO: 125163 - RNA, 41 nt, Homo sapiens
gaggggaaugccaggagagagagggagacuugggccacagg

SEQ ID NO: 125164 - RNA, 46 nt, Homo sapiens
aggucuugaaggcccuaaaggugaaguuggagcaccugguuccaag

SEQ ID NO: 125165 - RNA, 46 nt, Homo sapiens
gcucguggauuuccuggggcuccuggucuuccaggucugaaggguc

SEQ ID NO: 125166 - RNA, 44 nt, Homo sapiens
cuaauuuuggcugaaauucuugauuaauguucuggguccuaaaa

SEQ ID NO: 125167 - RNA, 48 nt, Homo sapiens
cugacauuaauaaaggucuaucuguacauuuuauuuaauauuggaaga

SEQ ID NO: 125168 - RNA, 45 nt, Homo sapiens
cagccguuuucagcucaaauggcuggguuggaugaaaaaucugga

SEQ ID NO: 125169 - RNA, 54 nt, Homo sapiens
augcuguccugucuguucacaaacaccuggagguggcaauaccaauuuugguaa

SEQ ID NO: 125170 - RNA, 85 nt, Homo sapiens
agauguacuuaaacagggacauuuggaaaccugccccuugucagaucugugucugugacaauggagccauucucugugacaagau

SEQ ID NO: 125171 - RNA, 27 nt, Homo sapiens
uagaaggauauggugaagaaauagccu

SEQ ID NO: 125172 - RNA, 26 nt, Homo sapiens
auaaaagaccaaugauaauucacuca

SEQ ID NO: 125173 - RNA, 53 nt, Homo sapiens
uucaaacucaaaaauguuuacaugcuuuuuuuuuuuaaguuuaggauuaagaa

SEQ ID NO: 125174 - RNA, 45 nt, Homo sapiens
ccucuccucauucuuauuguuuuauuagggcaauuugucucaaua

SEQ ID NO: 125175 - RNA, 77 nt, Homo sapiens
gacugucgcuugauuuuaaaaaauacacaaaaacccauauuucugaaauaaugcugauuccugagauaagaaagugg

SEQ ID NO: 125176 - RNA, 68 nt, Homo sapiens
acaugcugcagugacaaaaacuaagauaauuuuaauauugauccugccuucgaggagcuuacagucua

SEQ ID NO: 125177 - RNA, 45 nt, Homo sapiens
uuggcuuuuuuccucucucuuuuaguuaaaacuugaaauggaugg

SEQ ID NO: 125178 - RNA, 65 nt, Homo sapiens
gcaaaguuaaauacauuuaccuagcgauuccauuccuacauaaagagaugaaaacauaaccacaa

SEQ ID NO: 125179 - RNA, 46 nt, Homo sapiens
uaaaugucaguggcuuccauagauaaauuauuaugguagaauauua

SEQ ID NO: 125180 - RNA, 39 nt, Homo sapiens
ccuucaacccgauuaugguuuggggaguaaugacuagug

SEQ ID NO: 125181 - RNA, 42 nt, Homo sapiens
ugcugaguggcggucgugaaucuguacuuguagaguggcgcg

SEQ ID NO: 125182 - RNA, 78 nt, Homo sapiens
uuuucuucuucuugguaaauaggauuuuugucagaugacuguacguuucauguacauuuucucuguuagauguaaauu

SEQ ID NO: 125183 - RNA, 49 nt, Homo sapiens
gaguguuuguuccacgagaugucccugaauccuucaccucagaagcuua

SEQ ID NO: 125184 - RNA, 46 nt, Homo sapiens
caguacaaagucuccagaagaaaaacucacaccaacaagcaaacag

SEQ ID NO: 125185 - RNA, 35 nt, Homo sapiens
uucuuuuagugcauuggaggucaauuuaagaccuu

SEQ ID NO: 125186 - RNA, 44 nt, Homo sapiens
aguaaaauauggaguagagaaggugguaagaauugugguggggu

SEQ ID NO: 125187 - RNA, 45 nt, Homo sapiens
ugcucuccaguuuccaacauguuacuguuaaggccuuuucccuca

SEQ ID NO: 125188 - RNA, 42 nt, Homo sapiens
cagaaaacauacccgcaauuagugagguaaguaauuaugaaa

SEQ ID NO: 125189 - RNA, 54 nt, Homo sapiens
ggaccugguguagggauaggggugguuguuggcauaaauguaggaagguagaaa

SEQ ID NO: 125190 - RNA, 46 nt, Homo sapiens
ccugaagauguagauauggaagaagaaaaagaaagugaagauucag

SEQ ID NO: 125191 - RNA, 50 nt, Homo sapiens
aauggcugaggaccuucccagucuccccagaguccgugccuuucccugug

SEQ ID NO: 125192 - RNA, 139 nt, Homo sapiens
gcugaaauccggcauguucuugucacacuggguaagguucuguguccuuguccuugagcugagauggcacccugagguaccucacuugucacccaauuccaaaaaugcuuucuuucccccugcaggugagaagaugaca

SEQ ID NO: 125193 - RNA, 45 nt, Homo sapiens
cccaugacggugccauuuccuuccuugucaaacacccgaaguccu

SEQ ID NO: 125194 - RNA, 31 nt, Homo sapiens; identical to SEQ ID NO: 22720

SEQ ID NO: 125195 - RNA, 46 nt, Homo sapiens; identical to SEQ ID NO: 22721

SEQ ID NO: 125196 - RNA, 49 nt, Homo sapiens
ugauguuuuauccuuacaaugugaauaauggcacugaccggugcuuuua

SEQ ID NO: 125197 - RNA, 46 nt, Homo sapiens
acagggcgggguugaggggcuuggggaugaggaggacgggcagcag

SEQ ID NO: 125198 - RNA, 42 nt, Homo sapiens
ucugccgggcagggccuucaccaaggcugccgggcaccgcug

SEQ ID NO: 125199 - RNA, 52 nt, Homo sapiens
uccucauauauuuaagaaaaaagacuucagaagaccuuuaacagagcuacaa

SEQ ID NO: 125200 - RNA, 50 nt, Homo sapiens
aacauggaggcugaauuaccuuacaccccuagagaggauggcuccuccag

SEQ ID NO: 125201 - RNA, 73 nt, Homo sapiens
aggacaauaaagacgacauuuaaguuuuucaguccgggcuuaauaucucuuauaaaaauaagugggucguuga

SEQ ID NO: 125202 - RNA, 79 nt, Homo sapiens
ggagacgcgagugggcagggcggggucaaagcuucccacccucccgggacaggggcgaaggcagaggggcgaccuuggg

SEQ ID NO: 125203 - RNA, 46 nt, Homo sapiens
caaaccaguccacaagcacagggagaugcgugggcugacaucugca

SEQ ID NO: 125204 - RNA, 48 nt, Homo sapiens
cguguucgccgugguggccgaaaacgcccaguuccuaagggugcaacu

SEQ ID NO: 125205 - RNA, 24 nt, Homo sapiens
uuaggcaaagaagucaacgcugau

SEQ ID NO: 125206 - RNA, 26 nt, Homo sapiens
guguguuuuuuccuucauuuggcugu

SEQ ID NO: 125207 - RNA, 25 nt, Homo sapiens
uguauucugugaaguuugcuuuaga

SEQ ID NO: 125208 - RNA, 51 nt, Homo sapiens
ugaacucacugaguuucaauaaugcuugaaacuaccuaaucaauuuuagac

SEQ ID NO: 125209 - RNA, 84 nt, Homo sapiens
gcaaguguagaguuuuuuaauccuccagaauuucuagaguagaagauacuuagguauaguuaaauauucuguauuuuuagucaa

SEQ ID NO: 125210 - RNA, 31 nt, Homo sapiens
uuuguguauguauaugcacauauauguagaa

SEQ ID NO: 125211 - RNA, 93 nt, Homo sapiens
cauuuucucaauauucauugaagcauauuuauaauagcaaaaugcuagaagcuucaaugggcaucugguuaaauaaauuaugguguauccaua

SEQ ID NO: 125212 - RNA, 43 nt, Homo sapiens
ggcauauugugugaaaucaacaaauuagauuaugcauaugaaa

SEQ ID NO: 125213 - RNA, 54 nt, Homo sapiens
uauguaaguguacaaguugaauguuuguguauaaaggauuuguacauaaggaaa

SEQ ID NO: 125214 - RNA, 29 nt, Homo sapiens
auuaaguaaaugauaccucuguagaacua

SEQ ID NO: 125215 - RNA, 23 nt, Homo sapiens
aauguuuaaguagauuaauguau

SEQ ID NO: 125216 - RNA, 52 nt, Homo sapiens
augaauauacauaagaacauugacuauuuucauaaaauccucuuuugggggu

SEQ ID NO: 125217 - RNA, 43 nt, Homo sapiens
uccuggcuuuuucacguugcagauguuggaugcagccuuucuu

SEQ ID NO: 125218 - RNA, 31 nt, Homo sapiens
aaagaaauguucuuaaggagacagggugggu

SEQ ID NO: 125219 - RNA, 24 nt, Homo sapiens
cagaaaaugaaauuaagccacuua

SEQ ID NO: 125220 - RNA, 82 nt, Homo sapiens
accugucuuuguuuuugauguuaaacaguaaaugccaguagugaccaagaacacagugauuauauacacuauacuggaggga

SEQ ID NO: 125221 - RNA, 46 nt, Homo sapiens
aacuugcuuugauuuggugauguaaacuuuuaaacauugcagauca

SEQ ID NO: 125222 - RNA, 46 nt, Homo sapiens
uacauugguucccaggacgcucucauagcacauuacccaagaaucu

SEQ ID NO: 125223 - RNA, 42 nt, Homo sapiens
uuuccaauauacaucucugacuuuccgggcugggugaaacag

SEQ ID NO: 125224 - RNA, 46 nt, Homo sapiens
auggcccaauguauuugagacaucuccucauguaauucaggcaguu

SEQ ID NO: 125225 - RNA, 31 nt, Homo sapiens
gcucccauaacugccugaauuacaugaggag

SEQ ID NO: 125226 - RNA, 54 nt, Homo sapiens
cguuacuugaagaugcuuuaauggauagguaagugacuugaacuaaauacaaga

SEQ ID NO: 125227 - RNA, 45 nt, Homo sapiens
aucuucaaguaacgguguuacggcauaaauguagucuuuucccau

SEQ ID NO: 125228 - RNA, 84 nt, Homo sapiens
uucaaaauggaguguuaaaaucgcuuuccuucuuguuugaauauauuggugaaaugggaaaagacuacauuuaugccguaacac

SEQ ID NO: 125229 - RNA, 45 nt, Homo sapiens
aacauucaguucaggaacucuguauucauucauuaaggcagggag

SEQ ID NO: 125230 - RNA, 31 nt, Homo sapiens
ccuuucuugaacuuugagguuguucagaagu

SEQ ID NO: 125231 - RNA, 34 nt, Homo sapiens
ccacagucaacacauuugguuauauugcaaaggc

SEQ ID NO: 125232 - RNA, 46 nt, Homo sapiens
cuuuuucaugucuguucuuuaagaugggggugagucuaggcagcag

SEQ ID NO: 125233 - RNA, 42 nt, Homo sapiens
cuccaccaauuaaagaucugcugccuagacucacccccaucu

SEQ ID NO: 125234 - RNA, 46 nt, Homo sapiens
ccaauacuucaggguacucuucacccaaauacucauacaauacaac

SEQ ID NO: 125235 - RNA, 42 nt, Homo sapiens
ugauggagacaauugagaaaauuauggguaauuugggagcag

SEQ ID NO: 125236 - RNA, 46 nt, Homo sapiens
guuaguugauacuacuguggaguuggcaaacaaaguaggugcagca

SEQ ID NO: 125237 - RNA, 42 nt, Homo sapiens
agagauucuuccucccuuuuuuaaacacuucuggcagcacag

SEQ ID NO: 125238 - RNA, 46 nt, Homo sapiens
ugcccugggcauuccuucuuuauugcccuucuuaaaagcugugugc

SEQ ID NO: 125239 - RNA, 46 nt, Homo sapiens
uauugauugaugaagauuacuaugcuagaguggaaggccgagagau

SEQ ID NO: 125240 - RNA, 35 nt, Homo sapiens
guuuaaucagauucuuccucugcugaugucuccua

SEQ ID NO: 125241 - RNA, 93 nt, Homo sapiens
gauguugaugaaucaacacuuaguccagaagagcaaaaagagagaaaaauaaugaaguugcuuuuaaaaauuaagaauggaacaccaccaaug

SEQ ID NO: 125242 - RNA, 46 nt, Homo sapiens
uuaaaaccugaugauauucaauacuuugauaaacuauugguaagug

SEQ ID NO: 125243 - RNA, 44 nt, Homo sapiens
aaucgcccacuuucugaugaggaauuagaugcuauguucccaga

SEQ ID NO: 125244 - RNA, 46 nt, Homo sapiens
ucuguuuuggggguuucaucccaucuguuuuuacgagcacuggaag

SEQ ID NO: 125245 - RNA, 45 nt, Homo sapiens
gcauggccugguguaucaccucguccaggaguagcagcucccgcu

SEQ ID NO: 125246 - RNA, 46 nt, Homo sapiens
cgagacuccuggagcaaccccaggcucaaaaauaugggauccuaca

SEQ ID NO: 125247 - RNA, 29 nt, Homo sapiens
ugucaaggcugaaaaaagcaagaaaaaga

SEQ ID NO: 125248 - RNA, 45 nt, Homo sapiens
cgagaaauuaggcaacagcuagcagaaaaagcuaaagcuggagaa

SEQ ID NO: 125249 - RNA, 56 nt, Homo sapiens
uccuaaaaugaaugcuaggacuuacauggauguaaugcgagaacaacacuugacua

SEQ ID NO: 125250 - RNA, 42 nt, Homo sapiens
agcuagugucagaaagaaugacacuaccaauugggcaugauc

SEQ ID NO: 125251 - RNA, 37 nt, Homo sapiens
uacauacuagacuuuucagccugcaugaauuaguagg

SEQ ID NO: 125252 - RNA, 46 nt, Homo sapiens
uuuggcaugcuucugaauuugcuuuucuuuuuaaaaaucccccuua

SEQ ID NO: 125253 - RNA, 57 nt, Homo sapiens
cagaccgggaagaugaauacaaaaagcauaggcggaccaugauaauuuccccagagc

SEQ ID NO: 125254 - RNA, 82 nt, Homo sapiens
uuuauauuuaacauuuaucugugaaacgguacagaauauuaguaggcauguauuaaacauuugugcuuuaugguguucugau

SEQ ID NO: 125255 - RNA, 20 nt, Homo sapiens
ugcucucucaaaaaaauaac

SEQ ID NO: 125256 - RNA, 50 nt, Homo sapiens
ugcaccaggucauuucuuuguaggugguccuuauacuagacuaaugcugu

SEQ ID NO: 125257 - RNA, 41 nt, Homo sapiens
gaccguguuuuaaaaggaucagucaguuuuaaaucgggaag

SEQ ID NO: 125258 - RNA, 41 nt, Homo sapiens
gggaauagacuggaguucauuaggaaguauccagagaugac

SEQ ID NO: 125259 - RNA, 44 nt, Homo sapiens; identical to SEQ ID NO: 22816

SEQ ID NO: 125260 - RNA, 46 nt, Homo sapiens
cccucacaauuaccccgugagauaggcaaggcaggcauuguauuag

SEQ ID NO: 125261 - RNA, 68 nt, Homo sapiens
gugcggaauggcagguaaucaacagcgggggcgcugagacgagaguaguuuucgauuuuggcugccga

SEQ ID NO: 125262 - RNA, 47 nt, Homo sapiens
gauuagcaccuuugcuaaucuucucgaagccuuccuuggcuauagag

SEQ ID NO: 125263 - RNA, 46 nt, Homo sapiens
ucuuuuguuacuuugggacuuccccaacucugcucaauaaucacug

SEQ ID NO: 125264 - RNA, 44 nt, Homo sapiens
acaugcccaccugugcaacagagcaagcaacgugagaugcugag

SEQ ID NO: 125265 - RNA, 46 nt, Homo sapiens
ccaaaaacgaguuaaucuuucaccgcgaaaacggccuugugggcag

SEQ ID NO: 125266 - RNA, 58 nt, Homo sapiens
cccaaauucaaaccccacgaguugucccucccgcgcccagccgagguccaggauccgc

SEQ ID NO: 125267 - RNA, 46 nt, Homo sapiens
uggcuaagcugauggaagcuaucaggaccaauuacaaugacagaua

SEQ ID NO: 125268 - RNA, 41 nt, Homo sapiens
gagcagauugcuccaauauugacaaaauucuugaaccaccu

SEQ ID NO: 125269 - RNA, 47 nt, Homo sapiens
ggucaugacuucagucauaucucccacuagcucauauugagucuuaa

SEQ ID NO: 125270 - RNA, 46 nt, Homo sapiens
agagauaaaucaggauucuucuugucuguaauuguuguuuucuugu

SEQ ID NO: 125271 - RNA, 50 nt, Homo sapiens
uaauaaaccuuacuuauuaauauaacauuauauuuuacaagcauucggaa

SEQ ID NO: 125272 - RNA, 46 nt, Homo sapiens
aaucaucuguagcgaaacuaggaucaguaugccguaggauuuacag

SEQ ID NO: 125273 - RNA, 59 nt, Homo sapiens
aaguuugugaugaaauacaauuugauguccaaggauaaccugauuguaccaauuuuaga

SEQ ID NO: 125274 - RNA, 43 nt, Homo sapiens
ccaacccacaacuaucuuuuaagaagucuuaguucacagugaa

SEQ ID NO: 125275 - RNA, 46 nt, Homo sapiens
guuggaccaggugugaucagacugcuaucugaauaaaauaagauuu

SEQ ID NO: 125276 - RNA, 45 nt, Homo sapiens
gguuugguggccacugaggugucgacgugguuuuaugucagagag

SEQ ID NO: 125277 - RNA, 42 nt, Homo sapiens
cgaugaugcuugugaugugcgcgccuacuucacuacacccau

SEQ ID NO: 125278 - RNA, 84 nt, Homo sapiens
aagaguaucuuauucuuucuggagacaggacaggagaagcccugguuaaacuuccuuccuaugucaccaauaacuacuuugagc

SEQ ID NO: 125279 - RNA, 47 nt, Homo sapiens
agguagucuuggguuacccagaauagauccucugaauuaaaggaacu

SEQ ID NO: 125280 - RNA, 33 nt, Homo sapiens
cagcuagggcauaagcaugaaaaucuauuuggu

SEQ ID NO: 125281 - RNA, 48 nt, Homo sapiens
auuuuuccagacucucaaagcuagggccagcacgccugcagaagacug

SEQ ID NO: 125282 - RNA, 50 nt, Homo sapiens
guuggagggcucacauuuccccauuucaguacuuacuacagagcuacaau

SEQ ID NO: 125283 - RNA, 50 nt, Homo sapiens
guaucgcuaagauaauuaaggucuuugagaaauacaaguaagaauuuaaa

SEQ ID NO: 125284 - RNA, 366 nt, Homo sapiens
agcuugaccuuauaaugaaaucuauuuuuauuuuuaaguuuauuuuuuuaagacaagaucuugcuuugucacccaggcuggagugcaguggcacaaucucggcucacugcaaucucugccccccagauucaagcgauucacuugccucagccucccuaguagcugagaucacaggcaugugccaccacgcccggcuaauuuuuguauuuuuuuaauagagacaggguuucuccauguugaccaugcugguugcgaacuccuuacuucaggugaucuacccgccucggccucccaaagugcugggauuacaggcaggagccaccaugcccugccuuaaugaaaucuauucuuauugaagagagugga

SEQ ID NO: 125285 - RNA, 36 nt, Homo sapiens
ugugguuagauaugaagcuaauucaucucuguuugg

SEQ ID NO: 125286 - RNA, 62 nt, Homo sapiens
auuuuuauauugccauguuuauuuuguuuggguaauuugguucauuaaguacauagcuaagg

SEQ ID NO: 125287 - RNA, 46 nt, Homo sapiens
gucucuuugaccucauucagaaaauguuggaguaugauccagccaa

SEQ ID NO: 125288 - RNA, 92 nt, Homo sapiens
gauaccuuugcuagcuguuuuaaguuuucaguguuauaaacaugaauggauauugacuuauuuuuaggaaacguaaauauuuucaccacgau

SEQ ID NO: 125289 - RNA, 45 nt, Homo sapiens
augacgaacaucacaguacauugguaucuacaagacauuauagag

SEQ ID NO: 125290 - RNA, 46 nt, Homo sapiens
uuugcacaguaauaaguugacucacacagacuuaaagccugaaaac

SEQ ID NO: 125291 - RNA, 47 nt, Homo sapiens
guaaaaauaguuaaaaauguggauagauacugugaagcugcucgcuc

SEQ ID NO: 125292 - RNA, 45 nt, Homo sapiens
ucuuuuuuguuuuuguuuuauuuuuccauuucuuuuggugggggg

SEQ ID NO: 125293 - RNA, 94 nt, Homo sapiens
cgcccacuugacguuuccagaagagucaccgaaggaaaagaaccaggaguguagaggaugaugaggagggucaccugaucugucagaguggaga

SEQ ID NO: 125294 - RNA, 47 nt, Homo sapiens
guaugaacguuuuuaaaacauuuuggaaauuuuauaucccaugugga

SEQ ID NO: 125295 - RNA, 54 nt, Homo sapiens
ugaaagccgguaucagaaccauaguagcaagucuucugguagaaguggaagaag

SEQ ID NO: 125296 - RNA, 29 nt, Homo sapiens
uauaaaugagaaagauuaucauagucgac

SEQ ID NO: 125297 - RNA, 53 nt, Homo sapiens
ggauugggauuauggaaaauggaggagcagcagcagucauaaaagaaggaaga

SEQ ID NO: 125298 - RNA, 50 nt, Homo sapiens
gugaggaacauuuaugauugcauuugaguuggagacuaguuucugguaca

SEQ ID NO: 125299 - RNA, 39 nt, Homo sapiens
ggaacccuccaaauuguuuucucccucucuggaauacag

SEQ ID NO: 125300 - RNA, 46 nt, Homo sapiens
gauaggaagaugaggggaggaaggaggugaggcgguaaggggcguu

SEQ ID NO: 125301 - RNA, 62 nt, Homo sapiens
uccugcccaccccuucaacgggaggaaauaaaauccucuaaugcagaacgggucuccccaaa

SEQ ID NO: 125302 - RNA, 49 nt, Homo sapiens
accuguucuauuuugcguuuuuuagaacagguuggaaguguggagucac

SEQ ID NO: 125303 - RNA, 42 nt, Homo sapiens
gauccagucaaggaagaggauuuguuguuuucgaaaucagag

SEQ ID NO: 125304 - RNA, 52 nt, Homo sapiens
cguuuggagggccgcggcaccccguccgaggcgaaggaacccccccagccgc

SEQ ID NO: 125305 - RNA, 52 nt, Homo sapiens
cauuuguccuuucaaacuguauugugauacgggcaggaucaguccacgggag

SEQ ID NO: 125306 - RNA, 46 nt, Homo sapiens
gauucuuggcuggcccagggaugacuuccucgcugcagcggcccug

SEQ ID NO: 125307 - RNA, 51 nt, Homo sapiens
aaauaauauuuuaaucaccagugaacagugcuuauuaugagaucucuggaa

SEQ ID NO: 125308 - RNA, 33 nt, Homo sapiens
gcaaacaguuuugaacaaaaaugauaauuccag

SEQ ID NO: 125309 - RNA, 68 nt, Homo sapiens
aaucaagaacggcuaugugcguuuaaagauccguaucagcaagaccuugggauaggugagaguagaau

SEQ ID NO: 125310 - RNA, 60 nt, Homo sapiens
cucucaugaaaaugggacaauauuaugcucgaaagguagcaccugcuauggccuuuggga

SEQ ID NO: 125311 - RNA, 46 nt, Homo sapiens
ugaacaugauggaggcagcagcauccgaacccucucuugaucuaga

SEQ ID NO: 125312 - RNA, 40 nt, Homo sapiens
uuucuuuuuuuuaaauuuuguccagcauuuauaaauguuc

SEQ ID NO: 125313 - RNA, 46 nt, Homo sapiens
ugauuggccgaggucgauauggagcaguauauaaaggcuccuugga

SEQ ID NO: 125314 - RNA, 84 nt, Homo sapiens
gagcguccaguugcuguaaaaguguuuuccuuugcaaaccgucagaauuuuaucaacgaaaagaacauuuacagagugccuuug

SEQ ID NO: 125315 - RNA, 45 nt, Homo sapiens
guuacuagaggacuggcuuaucuucacacagaauuaccacgagga

SEQ ID NO: 125316 - RNA, 69 nt, Homo sapiens
ugcaauuucccaucgagauuuaaacagcagaaauguccuagugaaaaaugauggaaccuguguuauuag

SEQ ID NO: 125317 - RNA, 68 nt, Homo sapiens
ugacuuuggacuguccaugaggcugacuggaaauagacuggugcgcccaggggaggaagauaaugcag

SEQ ID NO: 125318 - RNA, 45 nt, Homo sapiens
auauggcaccagaagugcuagaaggagcugugaacuugagggacu

SEQ ID NO: 125319 - RNA, 58 nt, Homo sapiens
gccauuuugcuuacaggaagucugaaacacagaauaguuaaaugacuuuuccaagguc

SEQ ID NO: 125320 - RNA, 46 nt, Homo sapiens
uucucgugucuagggaaaaacagagacccaaguucccagaagccug

SEQ ID NO: 125321 - RNA, 45 nt, Homo sapiens
ucuuucuuguaaacgauuguuuuuuugaugaaguuccuccuuaag

SEQ ID NO: 125322 - RNA, 60 nt, Homo sapiens
aggucacucaaggagacaaucgaagacuguugggaccaggaugcagaggcucggcuuacu

SEQ ID NO: 125323 - RNA, 48 nt, Homo sapiens
gcacagugugcugaggaaaggauggcugaacuuaugaugauuugggaa

SEQ ID NO: 125324 - RNA, 46 nt, Homo sapiens
cuuccuccucauacauugaagacucuauccaucauacugacagcau

SEQ ID NO: 125325 - RNA, 46 nt, Homo sapiens
uuaacuaugaacgacagcaagcacaagcucgaauccccagcccuga

SEQ ID NO: 125326 - RNA, 46 nt, Homo sapiens
gucugcuuacagcugacagaagaagacuuggaaaccaacaagcuag

SEQ ID NO: 125327 - RNA, 46 nt, Homo sapiens
uccugauguucugccuacucagaucuauccucuccccaagcagcag

SEQ ID NO: 125328 - RNA, 43 nt, Homo sapiens
gucgaaacuggaguugccaagaugaauacaaucaaugcagcag

SEQ ID NO: 125329 - RNA, 42 nt, Homo sapiens
aagguguucuggaucgucuuguggacaggagggaacggccac

SEQ ID NO: 125330 - RNA, 42 nt, Homo sapiens
aacaagauguucuugcacaggguguuccaagcacagcagcag

SEQ ID NO: 125331 - RNA, 42 nt, Homo sapiens
uucucuggaucuuucagccacaaauguccuggauggcagcag

SEQ ID NO: 125332 - RNA, 46 nt, Homo sapiens
uaaaauuacccuuacuguuuauuauaacuucagaaguaauuuauag

SEQ ID NO: 125333 - RNA, 48 nt, Homo sapiens
acacaguucuggauucauagaauuaagaauaucuuguuagugcccagg

SEQ ID NO: 125334 - RNA, 67 nt, Homo sapiens
uauaucauuuuuauaaauuuuaaauuguacaucagacuuuuaaaaucuguaauauacaagcaagcaa

SEQ ID NO: 125335 - RNA, 52 nt, Homo sapiens
cuacaaguuuccagauuaacauaaagaaaagagggaaucacagggcauuuaa

SEQ ID NO: 125336 - RNA, 369 nt, Homo sapiens
ccauuacuuuccuuaaaucaccucauaguuaggcugggcgcgguggcucacgccuguaaucccagcacuuugggaggccgagacgguggaucacgaggucaggggacugagaucauccuggcuaacacgaugaaaccucaucucuacuaaaaauacaaauaauuagccaggcaugguggcacgcgccuguagucccagcuacucgggaggcagagacaggagaaucguuugcacccgggaggcggagguuguugcagugagccgagaucgcgccaaugcacuccagccugggcuacagagugagacuccaucucaaaaaaaaacaaaaaaaaucaccucauaguuuaugucugacuuacuccaaaccuc

SEQ ID NO: 125337 - RNA, 56 nt, Homo sapiens
agaaucgagaguuaagauguuucuauuugaaaguggauucaaccaucagaccacca

SEQ ID NO: 125338 - RNA, 49 nt, Homo sapiens
acuuucauuuaacuuuuaggugacugauuuaaguugagugugcauauag

SEQ ID NO: 125339 - RNA, 50 nt, Homo sapiens
uacaugauaugggacaaauuguuucauuuuguuuguuuuuuaauaaggga

SEQ ID NO: 125340 - RNA, 48 nt, Homo sapiens
uuuguauaagcugucugaagccuugcuaugcuguauaaguuguguuug

SEQ ID NO: 125341 - RNA, 46 nt, Homo sapiens
auaaagcaaaucacuuuucuuuuguauuaucuauggaugccacuau

SEQ ID NO: 125342 - RNA, 37 nt, Homo sapiens
auauaaaaugaguagagugugacuugagauaggagaa

SEQ ID NO: 125343 - RNA, 64 nt, Homo sapiens
agaaaagccagugaagaaaccugugaaaugugguaggaggagaaaugguagaauaguguugaga

SEQ ID NO: 125344 - RNA, 65 nt, Homo sapiens
agucaaugaucugugagagaaaguaguuugagaagcauguugggggcacaaaucaaaguggagga

SEQ ID NO: 125345 - RNA, 40 nt, Homo sapiens
gaaugacaguagaacugaagaaauaaccacaaacauagau

SEQ ID NO: 125346 - RNA, 56 nt, Homo sapiens
ugcaaaauuacgccagcaguugcagagaaguaaacacagcagucggcaucaucgag

SEQ ID NO: 125347 - RNA, 56 nt, Homo sapiens
auaaagaaagacagucuccauuucauggcaaccaugcagcuauuaaccagugucag

SEQ ID NO: 125348 - RNA, 47 nt, Homo sapiens
cuuaaggcuccuguuccaaagagugcacuuauuccuguaauucccau

SEQ ID NO: 125349 - RNA, 52 nt, Homo sapiens
aauagcguggaaggauugaaucaggagauugaaauaauaauuaaagagacug

SEQ ID NO: 125350 - RNA, 41 nt, Homo sapiens
auggcccucauuuauaauuuuuaaaauaacccuuagcacac

SEQ ID NO: 125351 - RNA, 71 nt, Homo sapiens
auuccagauggccaucgugcuccacccccccuuguacagagaaguagcagcacgcgcagcauugacacaca

SEQ ID NO: 125352 - RNA, 41 nt, Homo sapiens
ggaguguaaacagguuugacugucaugcucaguugaugguc

SEQ ID NO: 125353 - RNA, 36 nt, Homo sapiens
gcuuucugccucgucagcauccucaagccacuccuu

SEQ ID NO: 125354 - RNA, 45 nt, Homo sapiens
cucugcugcagccuauugcuguggccucccugucuacaaacacag

SEQ ID NO: 125355 - RNA, 84 nt, Homo sapiens
agaaaaguuguagucugaagacaagugcuuuaauauguucucacccauauuggaacuugauuuaaaagucagugagccaaaagg

SEQ ID NO: 125356 - RNA, 47 nt, Homo sapiens
uggggaaaauacacaagaagaacuugaguaugaacgauaagcaccuu

SEQ ID NO: 125357 - RNA, 368 nt, Homo sapiens
agcagcuuuuuuuuuuuuuuuuuuuugagacggaguuucacucuuguugcccaggcuggagugcaauggcgcaaucucggcucacugcgaccucugucucccagguucaagcaguucuccugccucagccucccaaguagcugggauuacaggcaugcaccaccacacccagcuaauuuuguauuuuuaguauauaugggguuucaccauguuggucaggcuguucuugaacuccuggccucaggugaucugcucgucuuggccucccaaagugcugggauuacaggugugagccaccacgcccauccaggagcagcucuuuuuuuaaaagugaguuucagcaaacaguauugaauaaaagcauccuu

SEQ ID NO: 125358 - RNA, 55 nt, Homo sapiens
uccuauacauauuauaagguagaaaaaaguuuuuaaauccuuauaaagaggaugc

SEQ ID NO: 125359 - RNA, 42 nt, Homo sapiens
ucagaaguucagaagaaaagguaaaacugaaaucagaauggg

SEQ ID NO: 125360 - RNA, 46 nt, Homo sapiens
guaaggagaaugugaauuugcagguaaaugaauuguauggcaacca

SEQ ID NO: 125361 - RNA, 53 nt, Homo sapiens
aaauaaaagaaaauuugccacuacugcauuuacuuuacuauuguaaacuuaag

SEQ ID NO: 125362 - RNA, 46 nt, Homo sapiens
uggaagugcugaauuugcaaaauaaagcuaagaaugcuuaacucug

SEQ ID NO: 125363 - RNA, 45 nt, Homo sapiens
cagagcagcccugaacagcauuuuguuuauacagucuuguuuaag

SEQ ID NO: 125364 - RNA, 42 nt, Homo sapiens
uaauuauaguugauugguuaggaaaacagcagaaaguuaaag

SEQ ID NO: 125365 - RNA, 44 nt, Homo sapiens
auaacaauccuuagauauggaauccaucugaucuuugcccuuuu

SEQ ID NO: 125366 - RNA, 48 nt, Homo sapiens
aggagaaaugcuuguuaauauacaaacucuagucaguuaccugugagg

SEQ ID NO: 125367 - RNA, 60 nt, Homo sapiens
auuaagaucuaagucccaaaaucaagacuaagugguuaccccuagaagcaggauauaggg

SEQ ID NO: 125368 - RNA, 52 nt, Homo sapiens
caucuguauuuauuuucuauuccauacuuuugccccacguuguuuucucuca

SEQ ID NO: 125369 - RNA, 78 nt, Homo sapiens
ggacagcgaggagcugaccauggccucugaugaccagcagguauuagauggaagugaaugagagagagagagagagag

SEQ ID NO: 125370 - RNA, 34 nt, Homo sapiens
uguguguucgaacacauaugauugccaguaugga

SEQ ID NO: 125371 - RNA, 43 nt, Homo sapiens
uauuuguaggauaaaggaaaugacacuuugaggaacuggagag

SEQ ID NO: 125372 - RNA, 40 nt, Homo sapiens
uccagcaagaauagaggugaagacaagccaccaggacuca

SEQ ID NO: 125373 - RNA, 43 nt, Homo sapiens
aacacaaagauuuaaacaagaaaccuacgaacccagcucugga

SEQ ID NO: 125374 - RNA, 39 nt, Homo sapiens
cugcuaggagugugugugugugugugugugugugugugu

SEQ ID NO: 125375 - RNA, 28 nt, Homo sapiens
uauggaggaaaugggugaaagaaaggcg

SEQ ID NO: 125376 - RNA, 46 nt, Homo sapiens
cguccagcggcuggguggcgggcgccgguagcccuaguguuuggag

SEQ ID NO: 125377 - RNA, 47 nt, Homo sapiens
ucaaacuuacauuuuaccgauuaaaugaggcuucauuuuuagaaucu

SEQ ID NO: 125378 - RNA, 42 nt, Homo sapiens
ggugaaagguauucacaaaauaguugcagaaugaagucuuuu

SEQ ID NO: 125379 - RNA, 46 nt, Homo sapiens
uccauucgguguauaaugaaauaauaaaucaaauuugugguauaua

SEQ ID NO: 125380 - RNA, 77 nt, Homo sapiens
uaaucucuuccaccgaaugaguaaguagguuagucuucuggacugccauaaaaggucuguaaaauaguuuuaaucag

SEQ ID NO: 125381 - RNA, 50 nt, Homo sapiens
uaauucucuguuccuccccccauuucucccccacuccccauuucucucuc

SEQ ID NO: 125382 - RNA, 32 nt, Homo sapiens
uuuuggggggucaucugcugggaaacugaggu

SEQ ID NO: 125383 - RNA, 46 nt, Homo sapiens
aagagauuucuuaaguguugcuuuaacagguugaugcaaaauaaau

SEQ ID NO: 125384 - RNA, 45 nt, Homo sapiens
ggacugccagagcacauaccggggcuggaaaaugugugucuguca

SEQ ID NO: 125385 - RNA, 42 nt, Homo sapiens
cgggauggggacagugaauccgcagaccuccugggcaaacac

SEQ ID NO: 125386 - RNA, 27 nt, Homo sapiens
gaagcaggauuucaaaugaagcaacaa

SEQ ID NO: 125387 - RNA, 46 nt, Homo sapiens
caauguuccucugggcauggagucuggccggauugcuaaugaacag

SEQ ID NO: 125388 - RNA, 64 nt, Homo sapiens
caucugcuuccacaguccaaggcaggccaucauuuacuaagaagggauuauagcucuagauguu

SEQ ID NO: 125389 - RNA, 52 nt, Homo sapiens
caaugauugagaaaaaucgaguauugucccuucauauuugcaaaagagagaa

SEQ ID NO: 125390 - RNA, 49 nt, Homo sapiens
guucaggaguuaccgagcucuggaaaugaaagggcacaaauccugagag

SEQ ID NO: 125391 - RNA, 36 nt, Homo sapiens
agcuucuuugccuaccggcaucccuaccuucucuua

SEQ ID NO: 125392 - RNA, 47 nt, Homo sapiens
cagguagcaucuacacuguccugggcacauggguauugauagcaaag

SEQ ID NO: 125393 - RNA, 81 nt, Homo sapiens
guccucagcuaugucagucacugcauauucuucaaagacaacuuaaggaggggucagcaaagaagaggugacugugacuag

SEQ ID NO: 125394 - RNA, 44 nt, Homo sapiens
ggggagaugcagggagaaaaauagagaccuuguaaaaccauugg

SEQ ID NO: 125395 - RNA, 41 nt, Homo sapiens
gccucauugcagacucccagaucuccgccucuuccacccag

SEQ ID NO: 125396 - RNA, 46 nt, Homo sapiens
acacagacuccaagcccacgguagagacgcugggacccacugugaa

SEQ ID NO: 125397 - RNA, 46 nt, Homo sapiens
caccgaagaggaggccacagaguguggggagaacugcagcuuugag

SEQ ID NO: 125398 - RNA, 48 nt, Homo sapiens
gaaccugcaagcacagccguuugacaguuagaggaacuacacugaugg

SEQ ID NO: 125399 - RNA, 44 nt, Homo sapiens
cauuugagguuucuuugaugguuccucccuuuucuuuuugcaaa

SEQ ID NO: 125400 - RNA, 40 nt, Homo sapiens
cuggauucccauagggaaagcauucucuaccucccggggu

SEQ ID NO: 125401 - RNA, 46 nt, Homo sapiens
agcaaacaagccuuccuuguuucugaggucacuuucuccucacugg

SEQ ID NO: 125402 - RNA, 46 nt, Homo sapiens
gcagcucccuucgggauucaauugcaacuucgauuuccucgaggag

SEQ ID NO: 125403 - RNA, 56 nt, Homo sapiens
aaguggcuccggaccaccugggccagcagcuccagcccaaacgaccggacguuucc

SEQ ID NO: 125404 - RNA, 46 nt, Homo sapiens
gagcaacugcuaauggguucagagcggcuggcgcccacagagucag

SEQ ID NO: 125405 - RNA, 46 nt, Homo sapiens
auccagagacagaacuuccugggcucuggaccaugauagauaauua

SEQ ID NO: 125406 - RNA, 31 nt, Homo sapiens
cuucacaagugaaaaugucucuaaguuggaa

SEQ ID NO: 125407 - RNA, 41 nt, Homo sapiens
gguaaguagaacagacccagauacaauccauucagcccagu

SEQ ID NO: 125408 - RNA, 167 nt, Homo sapiens
auuaccugcugaaauccauggaaaauggccugccugaaguccuuuuaaaaacauaaaaucagcaguacagucaguaaaugcuagaguuguugagaaaagaagcggauuaauguugcaugugccagaauaguuaggagaagaacuagccaaagggacgggguagaugg

SEQ ID NO: 125409 - RNA, 45 nt, Homo sapiens
gcaagaaugagcuuuaauuauuaucauuaacagcaguaauaguaa

SEQ ID NO: 125410 - RNA, 43 nt, Homo sapiens
ugccagaugacaggaauuucuugcggcugcagagugacagcca

SEQ ID NO: 125411 - RNA, 92 nt, Homo sapiens
gagagcaaguugcugugggucauccgugaggaccagggcggcgaguggaagcacgggcggaucauccugcccagcuacgacauggaguacca

SEQ ID NO: 125412 - RNA, 39 nt, Homo sapiens
ugugucucagccauuagaugggugagcuucucugggcag

SEQ ID NO: 125413 - RNA, 64 nt, Homo sapiens
cuaggagacucaguuaaccauggcucuuauucuuccggcuucuagauuguguucgagggaguga

SEQ ID NO: 125414 - RNA, 45 nt, Homo sapiens
ggacugaaaaucagaaaggacguguucucccccgagaaagcagag

SEQ ID NO: 125415 - RNA, 67 nt, Homo sapiens
acuuuucucuccaagaacacagggacaagacucaguuuacagaaaguagcauaagugccaccaaaga

SEQ ID NO: 125416 - RNA, 41 nt, Homo sapiens
cucuagaggagccaaccuuuuucguuuguuuaaucucacaa

SEQ ID NO: 125417 - RNA, 49 nt, Homo sapiens
agcacuucauuuuuaaccuguacagaaaggacugugcagacaggccagu

SEQ ID NO: 125418 - RNA, 46 nt, Homo sapiens
gacucccccagguccagaugauauuucauaaagcagcuauaguaua

SEQ ID NO: 125419 - RNA, 48 nt, Homo sapiens
ggauucauacagcaggagaaagcagugauuaagagcuaagaaguugag

SEQ ID NO: 125420 - RNA, 73 nt, Homo sapiens
auuagaaggucugacccaccucccaccuauuccccagaucaaagagaggaguucugauguucaggcugcagga

SEQ ID NO: 125421 - RNA, 63 nt, Homo sapiens
cagaaguaaagaucaugucugguuuuggcaagcucaaaagcuccuagucccuuucugggccag

SEQ ID NO: 125422 - RNA, 42 nt, Homo sapiens; identical to SEQ ID NO: 23083

SEQ ID NO: 125423 - RNA, 46 nt, Homo sapiens
cggggccccucuggcgguggagcccacccuaaccauuaagcuagag

SEQ ID NO: 125424 - RNA, 26 nt, Homo sapiens
aaucugucucauguugccuuauaaaa

SEQ ID NO: 125425 - RNA, 52 nt, Homo sapiens
uuggaauaagucauagagaauaacaagucugggacugacguaggaaaaacag

SEQ ID NO: 125426 - RNA, 46 nt, Homo sapiens
augccccaaguggcaucaucuuuauguacaugccuuaguugagaau

SEQ ID NO: 125427 - RNA, 28 nt, Homo sapiens
gacaaagagaugauagcaacuauuaaaa

SEQ ID NO: 125428 - RNA, 54 nt, Homo sapiens
aaaaagucucaaauuugagaggccuuggaccacaggcccccacacuggccccaa

SEQ ID NO: 125429 - RNA, 41 nt, Homo sapiens
ggcuauauagguccagugugugcuuucccugaccugccaaa

SEQ ID NO: 125430 - RNA, 46 nt, Homo sapiens
cuccugguagcaucuuaccugccacaccuugccuauucuuugcuag

SEQ ID NO: 125431 - RNA, 53 nt, Homo sapiens
guggggucuuggcaaguuguuuugugcaucccuuacuagggaccgagggggau

SEQ ID NO: 125432 - RNA, 44 nt, Homo sapiens
uucuucugcaaccucagggucuggcgcccccucgaccgacaaag

SEQ ID NO: 125433 - RNA, 30 nt, Homo sapiens
cucuacgauggccuuaagcacaaggucaag

SEQ ID NO: 125434 - RNA, 52 nt, Homo sapiens
auccagaauaccgaagguauggacaggacagaaaagcgagucgcaggaggaa

SEQ ID NO: 125435 - RNA, 26 nt, Homo sapiens
aagaggagaaugacuuuuccagaaua

SEQ ID NO: 125436 - RNA, 41 nt, Homo sapiens
aaauaaaacucaaaaaagccguccagcuuaucccauccucu

SEQ ID NO: 125437 - RNA, 46 nt, Homo sapiens
auuuaaguaggauguuguugccuuuaacuuuucuuauccaggggaa

SEQ ID NO: 125438 - RNA, 109 nt, Homo sapiens
gagggaaaaauagagacuauugguauguucuccccaucagcgaguuauuguaacuggucaccacuggacgggaaggagaacagaggagagggaaagagaagcccaaccu

SEQ ID NO: 125439 - RNA, 46 nt, Homo sapiens
agugaauaucuuaugaauuaaggcauuccucuuucccuaaccccga

SEQ ID NO: 125440 - RNA, 42 nt, Homo sapiens
ggcuccggcgagagccuuucccugucaagcaagaggggugag

SEQ ID NO: 125441 - RNA, 46 nt, Homo sapiens
uacagcaccacuacaggcacugcgaggacauaacaccagagagcug

SEQ ID NO: 125442 - RNA, 79 nt, Homo sapiens
aguccacaccggccgucuacacccgcgccugggggagaaagcagggaagaaacggggggugcaugagaaacguuuucau

SEQ ID NO: 125443 - RNA, 39 nt, Homo sapiens
acggccccuguuucuggaaauucuguuaugcugcccaua

SEQ ID NO: 125444 - RNA, 43 nt, Homo sapiens
ucugugguuuucuuccucuuuguuugguggaaaaaguuaagua

SEQ ID NO: 125445 - RNA, 39 nt, Homo sapiens
uguaaauagaacauagcuucacaauugagguuuccaaga

SEQ ID NO: 125446 - RNA, 55 nt, Homo sapiens
auauuguaguaauagccuuagagaaaauuaaaaugacuuaugauuauguaaauau

SEQ ID NO: 125447 - RNA, 47 nt, Homo sapiens
aacaucauucuggacagggcaacaggaagcaucuguauaucuuacca

SEQ ID NO: 125448 - RNA, 29 nt, Homo sapiens
ggaacaugugcauucuuuuaagcugucug

SEQ ID NO: 125449 - RNA, 32 nt, Homo sapiens
aaaaugaaaaacacccuaaaaaggggcagaaa

SEQ ID NO: 125450 - RNA, 56 nt, Homo sapiens
agaaaggcauauguucuauuauuauuuaacuuuauccacauaacgauauaccucag

SEQ ID NO: 125451 - RNA, 37 nt, Homo sapiens
cuauuugaaaaugauauuaguuaucaacuuugcaguu

SEQ ID NO: 125452 - RNA, 53 nt, Homo sapiens
ccaaaugugucaaagcugucacagagggugcccaggcaguagaggaaccaucc

SEQ ID NO: 125453 - RNA, 46 nt, Homo sapiens
acuaagguagcagugacaccuccuggcuuggcaagagaagacugga

SEQ ID NO: 125454 - RNA, 46 nt, Homo sapiens
cucccauagcugauguuauucucccaggagcugcuuacacagagaa

SEQ ID NO: 125455 - RNA, 37 nt, Homo sapiens
agacaaaccagacuauauagucauugcacuuaugacu

SEQ ID NO: 125456 - RNA, 41 nt, Homo sapiens
ucuggagucauacauuacaauuaguuucaugacucuucugg

SEQ ID NO: 125457 - RNA, 85 nt, Homo sapiens
cuaugaugggcuaaaacgucaaagacuuaccgagccaauggucagaaaugaaaaagggcuuuuaaccuauacuucuugggaggau

SEQ ID NO: 125458 - RNA, 42 nt, Homo sapiens
gaugauuugggaacaacaggcagaggaaaugauaugcaaguu

SEQ ID NO: 125459 - RNA, 88 nt, Homo sapiens
aggaccaguccaugauguuuggaaaugauaggagccgauuuuuagaggggaagcgugcuguggaagacaagaacauugggccauuggu

SEQ ID NO: 125460 - RNA, 42 nt, Homo sapiens
agcaaaucacccauuggacuguccuauuugugaccagggagg

SEQ ID NO: 125461 - RNA, 29 nt, Homo sapiens
aauguaaugaaagaaucaaguaaagucau

SEQ ID NO: 125462 - RNA, 38 nt, Homo sapiens
gccaguuguauuuuucucuaauuugaucuuuccucuaa

SEQ ID NO: 125463 - RNA, 48 nt, Homo sapiens
gcgaggaccccuggacuccucugcgucccgccccgggaguggcugcga

SEQ ID NO: 125464 - RNA, 46 nt, Homo sapiens
cgaggcggcgagcggaggcagcaggagaaggacgagaagcaggcgg

SEQ ID NO: 125465 - RNA, 49 nt, Homo sapiens
ugucauuauaaugaacaauuaauauaauaccaucuucuauauauugaug

SEQ ID NO: 125466 - RNA, 46 nt, Homo sapiens
ucaagacucauauauuacaucaaccaagacucggaaagcccuuauc

SEQ ID NO: 125467 - RNA, 51 nt, Homo sapiens
aaaaaauuuucuguuguauuuucaauagguaaacaauuugacauuuaaaaa

SEQ ID NO: 125468 - RNA, 42 nt, Homo sapiens
caguugcuuuacuuucagguuaguucagaaaguggaacugau

SEQ ID NO: 125469 - RNA, 47 nt, Homo sapiens
gauggagaaucugcagaauuacuugguguguggggaaaacccuccca

SEQ ID NO: 125470 - RNA, 38 nt, Homo sapiens
cauguuauaaucaaacuaaaauucaaaaggacccucaa

SEQ ID NO: 125471 - RNA, 39 nt, Homo sapiens
ggauccuugucuuugauuauucucuuccauaaagucuag

SEQ ID NO: 125472 - RNA, 51 nt, Homo sapiens
uagucgcugauuaagucuugacgugucucccaugacuccaucccuccccuc

SEQ ID NO: 125473 - RNA, 46 nt, Homo sapiens
cacuuauuucaucaugugacucccuuuauccacauucagcaagcau

SEQ ID NO: 125474 - RNA, 49 nt, Homo sapiens
cugccaaccuggucuaacccacuaucucucacaugcaccauuagaguau

SEQ ID NO: 125475 - RNA, 49 nt, Homo sapiens
uugcauauuuuaucucauaaguuucuuuaaaagggagaccagacuauga

SEQ ID NO: 125476 - RNA, 39 nt, Homo sapiens
aaugaccacagcaaauucaaaauaaguaaggaagaaaaa

SEQ ID NO: 125477 - RNA, 46 nt, Homo sapiens
uccugcuuggcauacaaagccucagaagguugauggugagggaugg

SEQ ID NO: 125478 - RNA, 48 nt, Homo sapiens
auugcauauuuccugcucuguuauuuuuuuuuaaaguuaagaaggggc

SEQ ID NO: 125479 - RNA, 46 nt, Homo sapiens
uuaauaagaucauuauggcagcucucuggaagacggacuggauggg

SEQ ID NO: 125480 - RNA, 44 nt, Homo sapiens
ggugggcccaguguaaucacaagggcccugauacagucagagag

SEQ ID NO: 125481 - RNA, 53 nt, Homo sapiens
augauaauuuauguuguuuuaagcccugacauccagggaaauuuguuagggua

SEQ ID NO: 125482 - RNA, 46 nt, Homo sapiens
ugcugucauuuggugacuuaaguagcagcucggagaacagauguag

SEQ ID NO: 125483 - RNA, 43 nt, Homo sapiens
cucuaucagacaguaaguuauccacagaauuauauacccuccu

SEQ ID NO: 125484 - RNA, 50 nt, Homo sapiens
gcugcuuuacccauuuuaaauagcaagugcuccaaaggcuuguaauucag

SEQ ID NO: 125485 - RNA, 45 nt, Homo sapiens
aagaccaaagcaucaacaaagcacacucuucucacaacccacgau

SEQ ID NO: 125486 - RNA, 50 nt, Homo sapiens
uccaaauuugguaauuaaucaugcuuauauugugugugguaucuuuacaa

SEQ ID NO: 125487 - RNA, 229 nt, Homo sapiens
caauuaaauaagaaucguuauuguuguuguuguuguuguuauuauuauuauuauuauuauuauuauuuuagagaugggucucacuguguugccccagcuggucuugaacuccuggccuccucaagcaauccucccaucuuagccacccaaaaugcugagauuacaggugugagccacuaccccuggcauaaauauuauuuguaaagauaccacacacaauauaagcaug

SEQ ID NO: 125488 - RNA, 41 nt, Homo sapiens
auuguuuuucuuuucagagcuccuguaauuucccugugcca

SEQ ID NO: 125489 - RNA, 45 nt, Homo sapiens
gcagcagcuguucucaguccuucagggugguaauucugagcccag

SEQ ID NO: 125490 - RNA, 54 nt, Homo sapiens
aauggauuucagugaugcuggucaguucauuaucucuaaaaucuguuaaaucaa

SEQ ID NO: 125491 - RNA, 37 nt, Homo sapiens
agaaucuguacugucuaagcacuugcagaauguauag

SEQ ID NO: 125492 - RNA, 41 nt, Homo sapiens
gaaacuaauuccauuugauacauugacaaagaagaugaaua

SEQ ID NO: 125493 - RNA, 27 nt, Homo sapiens
gaaagacuucaugaaaagcauugcagg

SEQ ID NO: 125494 - RNA, 59 nt, Homo sapiens
ggggaaggagggaauagaaaguacugggagggagaugccugguguguucaugcuggugu

SEQ ID NO: 125495 - RNA, 44 nt, Homo sapiens
gguguuucauuuagccuuguucuuuuuuuuuuuuuuuccugaua

SEQ ID NO: 125496 - RNA, 42 nt, Homo sapiens
aaaacuuuauugauuuguuaauuugcaauauucaagaugcuu

SEQ ID NO: 125497 - RNA, 45 nt, Homo sapiens
ccuauuuugagaagauucuuugcuuuauaauuugcucuaauaugg

SEQ ID NO: 125498 - RNA, 46 nt, Homo sapiens
caugcugugucagcaguuugucugccuaagggacuugucuugccaa

SEQ ID NO: 125499 - RNA, 48 nt, Homo sapiens
agaggucuggaaaugugccagaaguuaucaguaacauuuagcaugcaa

SEQ ID NO: 125500 - RNA, 176 nt, Homo sapiens
auugguugguugguuugagggugaugucuagcugaaaugggcaguaccagggaacaaacagguuaaauggugaagggaagagaauguggcaucagaagagacaugauagauuugaggggcuuugggacauacauguggccaugucuaggagguagcuggauauaaccucaggggag

SEQ ID NO: 125501 - RNA, 58 nt, Homo sapiens
agguuaccgagggaggguagguagaguaaggagacagaagcugagaagacagguaaga

SEQ ID NO: 125502 - RNA, 61 nt, Homo sapiens
ccauuugagcagucaccggugguuggaaagcagcaguuucaaugaaacucugggguggagg

SEQ ID NO: 125503 - RNA, 84 nt, Homo sapiens
ggaucaaggcagggcuuuuuaaugaugacagagcaaguuggcagagcaaguuaacagagcaaguuugguggacugagagacgga

SEQ ID NO: 125504 - RNA, 47 nt, Homo sapiens
agagcugcucaccagacauccauuaaagaacaugacacgacuugcag

SEQ ID NO: 125505 - RNA, 63 nt, Homo sapiens
augcccagggagaacuccgggugaaaucaguguaagacauccacauuggguggcugacuccaa

SEQ ID NO: 125506 - RNA, 45 nt, Homo sapiens
gaaacaggccuccugccucauuuuucucuuguggucgaguaagac

SEQ ID NO: 125507 - RNA, 45 nt, Homo sapiens
aagucuuuaaaaagguaauuaaguuaaaaugaaaucuuuugggug

SEQ ID NO: 125508 - RNA, 46 nt, Homo sapiens
aaaguuuggacacagacacuaguguguuggaggaaagaccauguga

SEQ ID NO: 125509 - RNA, 31 nt, Homo sapiens
aacuugggacauggagugagagaaaauggag

SEQ ID NO: 125510 - RNA, 76 nt, Homo sapiens
ugucaaagccuuggagaguugagacauuaucuaauucguuugugcugcuauaacaaaaugccauggacugggcaau

SEQ ID NO: 125511 - RNA, 39 nt, Homo sapiens
ucugaugguucuggaggcugggaaauccaagaccaagcc

SEQ ID NO: 125512 - RNA, 46 nt, Homo sapiens
cucuugguucuccauagauuuauauaaaguaagggcuugacaucac

SEQ ID NO: 125513 - RNA, 60 nt, Homo sapiens
uuuugaaggaugacuaauuugagggugaguaguucaguacuuuuggguguggugagggac

SEQ ID NO: 125514 - RNA, 57 nt, Homo sapiens
aauguuuguauaaugagugaauuaauagugugguaugguagauguuuuagauuuaua

SEQ ID NO: 125515 - RNA, 47 nt, Homo sapiens
accaaaauuaguagcauuuuauguuagucauggguuaguaaccuuga

SEQ ID NO: 125516 - RNA, 56 nt, Homo sapiens
auuugauugcuauaagacuuccucuccugacuuugguaagagccaaguggccuaua

SEQ ID NO: 125517 - RNA, 42 nt, Homo sapiens
aucagugagaccaaacaaaaguauuagacuacggcuuaaaaa

SEQ ID NO: 125518 - RNA, 44 nt, Homo sapiens
aaaucuccagcuuaagcugagccauuucuauaaagucccaggga

SEQ ID NO: 125519 - RNA, 25 nt, Homo sapiens
auuugcucagugagugugaggccac

SEQ ID NO: 125520 - RNA, 46 nt, Homo sapiens
uccuuuuacaaaagagguucuuucuauaauuucuuugagaucagag

SEQ ID NO: 125521 - RNA, 46 nt, Homo sapiens
gcuagcuauuucaaaaauguccucugguuuuagauacuauaaucag

SEQ ID NO: 125522 - RNA, 43 nt, Homo sapiens
ugcuuuggcauccuccaagaacuuuuuccuuucuaaguuuuac

SEQ ID NO: 125523 - RNA, 47 nt, Homo sapiens
gcuauuuuuagagaaggagaaaguugccuuuuguucucucugugcuu

SEQ ID NO: 125524 - RNA, 28 nt, Homo sapiens
aaaagaaagaaaaagccaaguagugaua

SEQ ID NO: 125525 - RNA, 103 nt, Homo sapiens
gcuagaccacaagcuucuggauuuuuccuggaguggccacuucauuuuucuaccccugucaugaguuaccaaccuugguguggcuuuccuggaugugaaucag

SEQ ID NO: 125526 - RNA, 46 nt, Homo sapiens
cauucuugguuuuuguaagggagaagacuaguuggacaauguuagu

SEQ ID NO: 125527 - RNA, 51 nt, Homo sapiens
aagcuacaaaugacugauaguuuuuccaauauauucuguaauuuucagagg

SEQ ID NO: 125528 - RNA, 58 nt, Homo sapiens
gauuuagguaagcaaagcacaaucaugacuuuuuuuuaaacaaucgaagucccaguga

SEQ ID NO: 125529 - RNA, 50 nt, Homo sapiens
ucauuuuucuaaaugauaacuuaaaaaaauaguugccacuuuguaugaua

SEQ ID NO: 125530 - RNA, 46 nt, Homo sapiens
cuguggcuuuaacuguccuccacucauucaauuaacggccgaagau

SEQ ID NO: 125531 - RNA, 44 nt, Homo sapiens
ucuagucauuuccucaggaaacccuuaugaguggaacuugugga

SEQ ID NO: 125532 - RNA, 50 nt, Homo sapiens
uauaaugaggacaggaaacauaggcaggccugcaagcuaauuguagagug

SEQ ID NO: 125533 - RNA, 46 nt, Homo sapiens
auaauuauagguugcauagaggcuuugcguuaagucagacaaagau

SEQ ID NO: 125534 - RNA, 45 nt, Homo sapiens
guaacagaagacuuuaaaaguauaacaauuuuucaaccauuacuu

SEQ ID NO: 125535 - RNA, 45 nt, Homo sapiens
uuaaugguugaaaaaaaucaaaagaaggauaauauuccauaacac

SEQ ID NO: 125536 - RNA, 46 nt, Homo sapiens
gcccgcauggcccacaaaaccuaaaauaucuacucccuggccuuua

SEQ ID NO: 125537 - RNA, 37 nt, Homo sapiens
caccguuggauugucugugucuugucuuuuuuuuuuu

SEQ ID NO: 125538 - RNA, 46 nt, Homo sapiens
uauguggagauucacuacgaaaaugggaaaccacaguacucuaagg

SEQ ID NO: 125539 - RNA, 36 nt, Homo sapiens
guauguaagaaacagugaccuccgucagucagggug

SEQ ID NO: 125540 - RNA, 42 nt, Homo sapiens
uuaaauguagcaaaauuuuaaauauuuuagcauauauuaagu

SEQ ID NO: 125541 - RNA, 49 nt, Homo sapiens
acagcucaguucaagcucgcuucuaagagugaaggguuuuuggcagcag

SEQ ID NO: 125542 - RNA, 47 nt, Homo sapiens
aaaucacuuaaauuagauccaggauuaucaguuauuugaauuuugag

SEQ ID NO: 125543 - RNA, 76 nt, Homo sapiens
acauucggaguacauuauagaauaugaaaggagcacgggguuaaaaaaugccccaagaaaucaagauagcagauga

SEQ ID NO: 125544 - RNA, 20 nt, Homo sapiens
aaauguucuugcaguaguuu

SEQ ID NO: 125545 - RNA, 110 nt, Homo sapiens
guauaauuuaugugaacuauuaaaaauuuacauagcauugguacagccaaacuguucuaauacuuuauuaaacuacugcaagaacauuuuccccauuaaauuuaaugaag

SEQ ID NO: 125546 - RNA, 46 nt, Homo sapiens
cuuguggaguguucagcuaugugcaaguagcaggcugagaaaggua

SEQ ID NO: 125547 - RNA, 42 nt, Homo sapiens
ucugaggucuuccuaacuggagaaagaaacauggacuugaga

SEQ ID NO: 125548 - RNA, 49 nt, Homo sapiens
gacaggagaagagaaaacaagcaggugagauguagccauaaaauuucag

SEQ ID NO: 125549 - RNA, 53 nt, Homo sapiens
auaagacuaggcaauuuuucaacuuuuuuauaacaagcauguguguguuaaau

SEQ ID NO: 125550 - RNA, 41 nt, Homo sapiens
caccuuggagucuuugacgccucugaugcuuccaugguagu

SEQ ID NO: 125551 - RNA, 49 nt, Homo sapiens
gcacaaggagggcaaugucccuguccucuugaacacuuaguguuugcag

SEQ ID NO: 125552 - RNA, 83 nt, Homo sapiens
cuuuuauaauuuuuauagccuccaugcugccuaauagagugcuggggccacacugggacuccaugcagauaugugaauuaaac

SEQ ID NO: 125553 - RNA, 42 nt, Homo sapiens
uucguguauaugauagagccacuagagcugguucaugaugag

SEQ ID NO: 125554 - RNA, 85 nt, Homo sapiens
ugaaaucuacacucuuuucucuuuucuucucaaagacaaaguugcuggaggaguagaacgccaucaggcaacugauggcauagac

SEQ ID NO: 125555 - RNA, 47 nt, Homo sapiens
ggcuggcuaauacaaaacaaaauauccucucugcucuuuucauagac

SEQ ID NO: 125556 - RNA, 46 nt, Homo sapiens
cucuccacucuccuggcuucacuuuuucuccuuaccauguaucacu

SEQ ID NO: 125557 - RNA, 54 nt, Homo sapiens
aaagcacaggucgaccacauauaauccagaaaaccuuggcaggacaguauucua

SEQ ID NO: 125558 - RNA, 51 nt, Homo sapiens
aauagcgauuauauuuuauguaguaugagcuuuuaucugguggagcucagu

SEQ ID NO: 125559 - RNA, 51 nt, Homo sapiens
gaggugaccaguggcccuuucucucugaauuacagugguugaaaagaagga

SEQ ID NO: 125560 - RNA, 83 nt, Homo sapiens
uuaaagaauuaucuaguuaauuuagaagacuuuagacuguaauaauugccaauauuuuuuccuuugagaaauugagcaguuaa

SEQ ID NO: 125561 - RNA, 45 nt, Homo sapiens
guauauuugaagaaaugaaauauuuggaacuuaugauuguuaaug

SEQ ID NO: 125562 - RNA, 47 nt, Homo sapiens
aagcccagaagagucuuggucaguaggcuauauacuaguacacccaa

SEQ ID NO: 125563 - RNA, 47 nt, Homo sapiens
guucaaucacauaacuacaacagagauuacaauuggccuaaacaguc

SEQ ID NO: 125564 - RNA, 23 nt, Homo sapiens
uaagcagcucaaagacauguuug

SEQ ID NO: 125565 - RNA, 42 nt, Homo sapiens
cucauagaguugugaggagcaaauauuuguuuuaggcgaaac

SEQ ID NO: 125566 - RNA, 38 nt, Homo sapiens
cagcaauauuggacacaguugauuacccucuuuuuuug

SEQ ID NO: 125567 - RNA, 24 nt, Homo sapiens
uagucuuuaaaaucugaccucugg

SEQ ID NO: 125568 - RNA, 32 nt, Homo sapiens
aguaguacgcuuugcuuaaugucuucaagagg

SEQ ID NO: 125569 - RNA, 42 nt, Homo sapiens
guugaccacggacuuugcaaaguuguugguaugugcaugaga

SEQ ID NO: 125570 - RNA, 46 nt, Homo sapiens
caugcacauaccaacaacuuugcaaaguccguggucaaccuugugg

SEQ ID NO: 125571 - RNA, 375 nt, Homo sapiens
uuccccuucuucaguguguucaaagaucauccauugguuuuuguuuguuuguuuguuuguuuguuuguuuguuuuucuuugagacagagucuugcucuguugcccaggcuggagugcaguggcacgaucucagcucacugcaagcuccgccucccagguucacgccauucuccugccucagccucccgaguagcugggacuacaggcgcccaccaucacacuuggcuaauuuuuuguauuuuuaguagagacgggguuucaccguguuagccaggauggucuugaucuccugacccugugaagcacccgccucggccuuccaaagugcugggauuacaggcgugagcuaccgcgccuggcccauuguuuucuuaa

SEQ ID NO: 125572 - RNA, 49 nt, Homo sapiens
guugcuuaauugugugaauuguuuagcuacugggccaaaaauagagaga

SEQ ID NO: 125573 - RNA, 38 nt, Homo sapiens
aacaaucacacaauuugguuucaacucuccuauagggu

SEQ ID NO: 125574 - RNA, 48 nt, Homo sapiens
aggaaaacacugggucaaacaugcacgaucagugagucagagucagug

SEQ ID NO: 125575 - RNA, 46 nt, Homo sapiens
uuuagagcccauaacuuccauccucaagaucaacucacaaucuagg

SEQ ID NO: 125576 - RNA, 50 nt, Homo sapiens
guuuccugaaagcuugcacauguauguuucaugaacaaaucauuugcuag

SEQ ID NO: 125577 - RNA, 36 nt, Homo sapiens
acuacuaaggaaaaaggguucuauacuuucuuuuua

SEQ ID NO: 125578 - RNA, 73 nt, Homo sapiens
cuuccuguuuuuucagucuuuaaucagcaauuuuuaauaaucagcaauauuaauucuuuuuaaucacugcuag

SEQ ID NO: 125579 - RNA, 63 nt, Homo sapiens
aucauacccaguuucuccgggaaugagucagcucuuucucacacugcagaauguggggcuggg

SEQ ID NO: 125580 - RNA, 55 nt, Homo sapiens
uauagaaugauauuaagguagauuuuuccuuuucuucucuagggagguuggggug

SEQ ID NO: 125581 - RNA, 22 nt, Homo sapiens
guggaaaauugaaacaaauuau

SEQ ID NO: 125582 - RNA, 48 nt, Homo sapiens
cuagaaauagaguuuaaaacgugaaacccuuagcuuccacgguucccu

SEQ ID NO: 125583 - RNA, 41 nt, Homo sapiens
cucagggugucccauucucgaaaauuuucaaagugcagcau

SEQ ID NO: 125584 - RNA, 61 nt, Homo sapiens
aaaaucacccaagguauuuauggauaccauaaauacacauacguguuuauaaugcauuguc

SEQ ID NO: 125585 - RNA, 83 nt, Homo sapiens
ucuuuaccuggagagggccacauugucaauuggcaucucgucaaacuuuguguauauagugucacaaucccuuauucguguau

SEQ ID NO: 125586 - RNA, 45 nt, Homo sapiens
uuugacaguaaaacuuguccuaaacugaaaauauuuauaccucau

SEQ ID NO: 125587 - RNA, 45 nt, Homo sapiens
cguacuucucuaaacuucagcaaagcuggaagucucaaacucacc

SEQ ID NO: 125588 - RNA, 46 nt, Homo sapiens
gaaguugcucagcaggcaaaagauaggaucaaugcuaauuagcaga

SEQ ID NO: 125589 - RNA, 35 nt, Homo sapiens
agaaucuuaguauggcuguggaaaaaagaaacagg

SEQ ID NO: 125590 - RNA, 27 nt, Homo sapiens
uucuauugcccuaggaaugacugagag

SEQ ID NO: 125591 - RNA, 45 nt, Homo sapiens
auuuauacccaacuaauugaguuuucuuuucugguccuuauaucu

SEQ ID NO: 125592 - RNA, 78 nt, Homo sapiens
uaaggcaaaguggaaagaguauaggguaggaugugauagauagggugaucaaauauuucuuucuggaggacauggcau

SEQ ID NO: 125593 - RNA, 51 nt, Homo sapiens
aggggagcugggguuacacugaguuccuuaaccagaagaaaaaaugaggag

SEQ ID NO: 125594 - RNA, 40 nt, Homo sapiens
uucugcuuuuuacugcugaucccuugaauacucaccagau

SEQ ID NO: 125595 - RNA, 49 nt, Homo sapiens
guaaaacuuaugaauugucaguuggugauaagugcuuuggaaaagaaaa

SEQ ID NO: 125596 - RNA, 52 nt, Homo sapiens
uauaaaggccucuuugggaugaugauauuugagcaaagcucuaacaaaggug

SEQ ID NO: 125597 - RNA, 69 nt, Homo sapiens
aucagccaugggugaacagaaaaugaugucacagagaugacggggugagaaaguauaggagcagaucau

SEQ ID NO: 125598 - RNA, 41 nt, Homo sapiens
gauggaggaagagugagagaggaggggaauagaagaugacu

SEQ ID NO: 125599 - RNA, 42 nt, Homo sapiens
ugcauguguuuuucucaauguuucuaguuauauauauccacc

SEQ ID NO: 125600 - RNA, 46 nt, Homo sapiens
ugcaugcauauccgucuugcuuaugaagauuuggugggcacugcaa

SEQ ID NO: 125601 - RNA, 44 nt, Homo sapiens
caccaaaucuucauaagcaagacggauaugcaugcaaucaaaau

SEQ ID NO: 125602 - RNA, 50 nt, Homo sapiens
aauggcgagugcaagaccagagacaaccagugucaguacaucuggggaac

SEQ ID NO: 125603 - RNA, 46 nt, Homo sapiens
aguuucccuucucagugccuucuguauucagcuuuucauagcagaa

SEQ ID NO: 125604 - RNA, 64 nt, Homo sapiens
acaaguucugcuaugaaaagcugaauacagaaggcacugagaagggaaacugcgggaaggaugg

SEQ ID NO: 125605 - RNA, 48 nt, Homo sapiens
uaccaucaguauuauguauauaagaauuuuauuguaccauauuucacc

SEQ ID NO: 125606 - RNA, 29 nt, Homo sapiens
auucgguccacauugauucaaauuuuuaa

SEQ ID NO: 125607 - RNA, 66 nt, Homo sapiens
cacguauuggucaacuucagggugagaucauuccaacuuccuucuaccaucaaggccgggugauug

SEQ ID NO: 125608 - RNA, 47 nt, Homo sapiens
ucuucuaauauuuaauauguuaccugcagucaaucacccggccuuga

SEQ ID NO: 125609 - RNA, 52 nt, Homo sapiens
aagaccuaauaagccaugagaauuacaaauuucacaaaaugaaauuucaaaa

SEQ ID NO: 125610 - RNA, 45 nt, Homo sapiens
ugcagcuuacauuugcucaaaauuauacuaguuaguaguaauaug

SEQ ID NO: 125611 - RNA, 48 nt, Homo sapiens
uauaauuuaacaaggcuauuuuaucuaaaggcaugaaaacacacauuc

SEQ ID NO: 125612 - RNA, 48 nt, Homo sapiens
auauuguuguauauacuaaacuagcauauuuguuaaauauucagcaag

SEQ ID NO: 125613 - RNA, 35 nt, Homo sapiens
uauagcauuaucauucaaauucaaauuauaccuaa

SEQ ID NO: 125614 - RNA, 44 nt, Homo sapiens
caucgucugcuuuuuucuaccaugcuacaucugaaagccuugga

SEQ ID NO: 125615 - RNA, 57 nt, Homo sapiens
cacguguuuucaagacccaacauuaagacuaaaggagagaaguaucuauaugagaac

SEQ ID NO: 125616 - RNA, 60 nt, Homo sapiens
aaagguagggaaaggggaagaagaagaggaguaagaaaaugcuaggagaaauccacaucc

SEQ ID NO: 125617 - RNA, 47 nt, Homo sapiens
acccauauaacuauuugcaccacacuuagaacaucauuccaugaaug

SEQ ID NO: 125618 - RNA, 46 nt, Homo sapiens
uauguagaagauggaacgccauguggcccgucuaugauguguuuag

SEQ ID NO: 125619 - RNA, 46 nt, Homo sapiens
auuaauuuauugaaguaaguguauauguuuuuaaaguggguuccua

SEQ ID NO: 125620 - RNA, 98 nt, Homo sapiens
uaaugaagccaccugcauuugugauuucaccugggcagggacagauugcaguauccgggauccaguuaggaaccuucacccccccaaggaugaaggac

SEQ ID NO: 125621 - RNA, 45 nt, Homo sapiens
augugucuccucuuaagucaauuagaauguuauacuggugcauug

SEQ ID NO: 125622 - RNA, 45 nt, Homo sapiens
uugacuuaagaggagacacauaagaauaucuguuuuugccuuuaa

SEQ ID NO: 125623 - RNA, 42 nt, Homo sapiens
uggaaucucuccggaaggaaguugucaccuuacaagcucuuu

SEQ ID NO: 125624 - RNA, 45 nt, Homo sapiens
aggaccacucucuauuuucgcagaugagaaggcccagacccugag

SEQ ID NO: 125625 - RNA, 661 nt, Homo sapiens
cuacauuauaagaugauguaagaggccaggcgcgguagcucacaccuguaaucccagccaagguggguggauuaugaggucaugaguucaagaccagccuggccaagaugaugaaaccccaucuccacuaaaaauacaaaaauuagccaggcgcaguggcaggugccuguaaucccagcuacucaggaggcugaggcaggagaaucucuugaacccaggcagcagagguuacgaugagccaagaucacaccgcugcacuccagccuggucgacagagucggacucugucucaaaaaaaaaaaaaaaaaaagaugauguaagaggggcgggugcagugguucacaccuauaaucccagaacuuugagaggccaaggcgggaggaucacuugaggccaggaguucaagaccagccuggacaacauagugacaccuugucucuacaaaaaauaaaaaauuagccaggcaugguggcaggauucuugggccuugcaguuugaggcuucagugagccaugauugugccacuacacucuuaccugggugacagagcaagauccugucucaaaaaaaaaaaaaaaaaaaaaaaaaagaugauauaauggaugggaagagaacaagagucugagaucaggcacuuaggacuuagguccugauccuggcc

SEQ ID NO: 125626 - RNA, 48 nt, Homo sapiens
ucauuuuucauuauucucccgauucucaaccccucauacaauuuucaa

SEQ ID NO: 125627 - RNA, 45 nt, Homo sapiens
cugauggguuuucuagaucuuugaaaauuguaugagggguugaga

SEQ ID NO: 125628 - RNA, 46 nt, Homo sapiens
ugaacuucaguauaguuuauaugggaaaagaugauuucagaugcag

SEQ ID NO: 125629 - RNA, 94 nt, Homo sapiens
cucuuguuagagcuuaaaucuucucuaaaucuaacuucagaagguggauccaagaauuuuuuguucuaguuuuaaaguaacaaaagacuaagug

SEQ ID NO: 125630 - RNA, 45 nt, Homo sapiens
gauccaccuucugaaguuagauuuagagaagauuuaagcucuaac

SEQ ID NO: 125631 - RNA, 47 nt, Homo sapiens
ccaaacuauugaaagacaagaaauaagaucucaaagcacaaaccaug

SEQ ID NO: 125632 - RNA, 46 nt, Homo sapiens
gcuuacuauagaauacaguggaacuuuucucauuugauaguuuaca

SEQ ID NO: 125633 - RNA, 41 nt, Homo sapiens
gauauguaugggcagauauuccugggaagcuuuggucagac

SEQ ID NO: 125634 - RNA, 51 nt, Homo sapiens
cuagaccccuuguuuuacaaaugaagaaacuaaguuaguuuucaggguuaa

SEQ ID NO: 125635 - RNA, 47 nt, Homo sapiens
uuaacccugaaaacuaacuuaguuucuucauuuguaaaacaaggggu

SEQ ID NO: 125636 - RNA, 45 nt, Homo sapiens
uuuaguauuuuuaaaauaauaguuuugaagucuuauuuucugagg

SEQ ID NO: 125637 - RNA, 58 nt, Homo sapiens
ggguuuuuuuccuuauuuuuagagaguuucucaaauaagaagaugcauuauuuccccc

SEQ ID NO: 125638 - RNA, 51 nt, Homo sapiens
uuagcacaaguaaaccuagguagcagggaccaagacugaaaauaauaauaa

SEQ ID NO: 125639 - RNA, 51 nt, Homo sapiens
acuuuucaguauaauguguuuguggaaucuguuuauuaccuagcagaaugu

SEQ ID NO: 125640 - RNA, 55 nt, Homo sapiens
auaaacagauuccacaaacacauuauacugaaaaguaaguguaucaaagaguuag

SEQ ID NO: 125641 - RNA, 52 nt, Homo sapiens
guaggaugagaaggaaaauaagauauaucaucguguguccagcauaguuccu

SEQ ID NO: 125642 - RNA, 58 nt, Homo sapiens
uuaaugaauaaauuacagaauagauaaauuaguguagaaguagaauuuuuuucaauga

SEQ ID NO: 125643 - RNA, 74 nt, Homo sapiens
uucuuuguagcuaugaaaagcagcugcaaccuuuguuuucaaauauguccccuauaaaaauccacccacccgug

SEQ ID NO: 125644 - RNA, 43 nt, Homo sapiens
cuuacaauuucuaaaaaauuaacacucauuuaguaucacaauu

SEQ ID NO: 125645 - RNA, 56 nt, Homo sapiens
ggggacacaacagagaacagaaaagucccccgagaguguugaaggcuaagggaaga

SEQ ID NO: 125646 - RNA, 46 nt, Homo sapiens
aaucuuauagcaaaaaaauucaauauuuagccaacuuucaaagcau

SEQ ID NO: 125647 - RNA, 41 nt, Homo sapiens
uccccacccugugccuccaaaaaucacccccagggccagaa

SEQ ID NO: 125648 - RNA, 46 nt, Homo sapiens
uccugugguuuucuugugucauguagaaccuucuccugucuggaac

SEQ ID NO: 125649 - RNA, 43 nt, Homo sapiens
guuuaaaaaaaagucuguauuuuaaaauuacuucuacaaagug

SEQ ID NO: 125650 - RNA, 86 nt, Homo sapiens
aaaaauaggaaggcaguaugcuaaauaucuucuuuuuaaaaaauuaagcugcagccuccuauaucauucuaaauaaaugaagaaaa

SEQ ID NO: 125651 - RNA, 48 nt, Homo sapiens
augcuccuugcuuccaaauauuuauguagacuucaauuuugaauuauu

SEQ ID NO: 125652 - RNA, 49 nt, Homo sapiens
agugaacagcugcaaaucaccugguggguucgucuuaaaaguagccagg

SEQ ID NO: 125653 - RNA, 47 nt, Homo sapiens
cuccugaugcuuugauuuagggugcucuguacuugauccacauccuc

SEQ ID NO: 125654 - RNA, 46 nt, Homo sapiens
uauucugaggauguggaucaaguacagagcacccuaaaucaaagca

SEQ ID NO: 125655 - RNA, 49 nt, Homo sapiens
cuguagauuaaaauauuaucaugauuuuuuucuucucucucuaauuaga

SEQ ID NO: 125656 - RNA, 65 nt, Homo sapiens
aguucacaccuuguguugaagaugacaugagccuucuuucuccuggauucaaggacuuugaccag

SEQ ID NO: 125657 - RNA, 43 nt, Homo sapiens
ugcauuuuuuaacauuauacauuggcuguaacuuugguguccu

SEQ ID NO: 125658 - RNA, 45 nt, Homo sapiens
aaguuucucuaaaacagaaguuagcaaacuucuguaaaaggccag

SEQ ID NO: 125659 - RNA, 68 nt, Homo sapiens
auagccaugcacauucauuuacauauuguuuauggcugcuuucaugcuaagacagcauuguugagaag

SEQ ID NO: 125660 - RNA, 46 nt, Homo sapiens
cuauguuccgauaaaacuuuuuugcaaaagcagacaguggggcuag

SEQ ID NO: 125661 - RNA, 52 nt, Homo sapiens
ugcucucaaagauacacuucuucacuauccuuacagugguaaagaccaaaau

SEQ ID NO: 125662 - RNA, 54 nt, Homo sapiens
gggcauuguagcagaauguguuuccuuuccuccaugcccccauuugugagucag

SEQ ID NO: 125663 - RNA, 54 nt, Homo sapiens
uugcuucaaauucugugaaaggugaauuuaauggaacuuaauugucaauggugc

SEQ ID NO: 125664 - RNA, 25 nt, Homo sapiens
aaaagagaaaugccagagccacuga

SEQ ID NO: 125665 - RNA, 89 nt, Homo sapiens
aauuauaaacuuuauauguuuuauauuugggauuuugaauucaauauguuucagccaguuaaaguguuauuuuuagaagcugauuaaag

SEQ ID NO: 125666 - RNA, 56 nt, Homo sapiens
gacucacuaugugggcaauauuuuauuaauaccaaaacaauaaauuuaaauaugag

SEQ ID NO: 125667 - RNA, 73 nt, Homo sapiens
auguuuucguuugggcggaccuaauucaagcaaaacuuuucuuaguguuccacugcuacaaaaaagucauuga

SEQ ID NO: 125668 - RNA, 50 nt, Homo sapiens
gggggaucagcacuuagugagaugagaaacagccuuugcugacugcugcc

SEQ ID NO: 125669 - RNA, 53 nt, Homo sapiens
uggguuugaguucaauguaaauguuuaaaaagaaauuccuuuagaaucagaag

SEQ ID NO: 125670 - RNA, 45 nt, Homo sapiens
gguaggaaaagaaaugaagguaauagugacaugguuuguugaaaa

SEQ ID NO: 125671 - RNA, 60 nt, Homo sapiens
gccuggcauagcuacuccuuacauuaaaaguguuaauuuaauauuaauaagucuguguaa

SEQ ID NO: 125672 - RNA, 36 nt, Homo sapiens
cuggguuaggcacuuucucuuucaugguaccaggcu

SEQ ID NO: 125673 - RNA, 39 nt, Homo sapiens
ggagcucacuuucccccugcugggacaucaguggaagag

SEQ ID NO: 125674 - RNA, 44 nt, Homo sapiens
uggcugcaaugguuaccugcuaggccaaugagucacacacuuag

SEQ ID NO: 125675 - RNA, 31 nt, Homo sapiens
ucuuuaaagacuuuuauguugauauuucaaa

SEQ ID NO: 125676 - RNA, 44 nt, Homo sapiens
gcauuuagucugcauacugggcgggugcaacgcuacugccaccg

SEQ ID NO: 125677 - RNA, 44 nt, Homo sapiens
ccuuguagugucuugcugguucuuucuuuucucuuuaaacauag

SEQ ID NO: 125678 - RNA, 46 nt, Homo sapiens
uuuggagacugccuccaugugaguuaauuacuuugcucuggaacua

SEQ ID NO: 125679 - RNA, 41 nt, Homo sapiens
ugucaagaagagaagguucgauccuacucagcaaggcccca

SEQ ID NO: 125680 - RNA, 46 nt, Homo sapiens
uuuccaaaagagacaguuuucuuuuaccccauccuugucaccccaa

SEQ ID NO: 125681 - RNA, 46 nt, Homo sapiens
gcuaaaguuggggugacaaggaugggguaaaagaaaacugucucuu

SEQ ID NO: 125682 - RNA, 72 nt, Homo sapiens
aacuguuccagaaucuuuuuuuucccuaauggacgaaggaacaacacacacacaaaaauuaaaugcaauaaa

SEQ ID NO: 125683 - RNA, 79 nt, Homo sapiens
ggaaucauuaaaaaaaauaguaaaugauuuuuuuucccucagccugcuggcacuuaauaucuucuaaaugauuuggcau

SEQ ID NO: 125684 - RNA, 43 nt, Homo sapiens
ggggggacauaaacaacaaaauaacccauaucaaagacacaaa

SEQ ID NO: 125685 - RNA, 55 nt, Homo sapiens
gccccuacuucucuaaugcccccccccuuuuuuuuuuaggaaaagaacaugcagu

SEQ ID NO: 125686 - RNA, 48 nt, Homo sapiens
aaccauaucaauuguaaaaauggauuauaauuauuuuugaugguauua

SEQ ID NO: 125687 - RNA, 55 nt, Homo sapiens
uuuacuaugcaaagaugggaaaugcacaaacuuuucaaagacuagugucugaaga

SEQ ID NO: 125688 - RNA, 47 nt, Homo sapiens
ccgugaacgaaagcagugacggaggagcuuguaccaccgguaagagg

SEQ ID NO: 125689 - RNA, 41 nt, Homo sapiens
ugguguuugaaaacaguuucgguuuuaacccuuuuuaauaa

SEQ ID NO: 125690 - RNA, 60 nt, Homo sapiens
ucacuguaugauugcauugugauugauacguacaaaccuucugguuaagaacaaauauug

SEQ ID NO: 125691 - RNA, 351 nt, Homo sapiens
gugucaagugcucaaguguugacaaggcuuuuuucuuuuguuuuaauuuuuuuuugagacggagucuugcucuguugcccaggauggugugcagugaugcagucucagcucacggcaaccucugcuuccuggauucaagugauucuccugccucagccucccuaguagcuggaacuacaggcaugcaccaccacgcccggcuaauuuuuguguuuuuaguagagacaggguuucaccauguuggucaggcuggucuugaaugccugggauuauaggcgugagccaccacgcccagcuggucuguuacuuuuuaaauuauuuauuauuacuauauguaauacagugggucag

SEQ ID NO: 125692 - RNA, 37 nt, Homo sapiens
augugucaaaagaaagcagucaaaggaaaaagggauc

SEQ ID NO: 125693 - RNA, 44 nt, Homo sapiens
guuuuauauuuuguaccuaaauuuaaaaauagugagauucaccu

SEQ ID NO: 125694 - RNA, 373 nt, Homo sapiens
acagcauugagcuacaauacuuuuuuauuuauuuauuuauuuauuuauuuuuauuuauuuauuuuuuugaggcaagguuuggcucuaucacccaggcuggagugcaguggcacacacuuggcucacugcaaccucuguuuccuggcucaagccauccucccauuucagcuuccugagugagugggacaacaggcgcgcaccaccaggcccggcuaauuuuuuguagagacagaguuucgccauguugcccaggcuggucucaaacucaugagcucaagccauccaccugccucagccucccaaagaguugggauuacaagcgugagccaccaugcccgaaugcuguaguacauuuuaaauauacaugcuguuu

SEQ ID NO: 125695 - RNA, 346 nt, Homo sapiens
aauguuuacaaagugcuuuguuguuguuguuguuguugagacggagucuuucucuguugccaggcuggagugcaguggugcgaucucagcucacugcaaccuccgccuccuggguuaaagcgauuccccugccucagccucccaaguagcugggauuacaggcgccugccaccaugcccagcuaaagagacaggguuucaccauguuggccaggauggucucgaucuccuugaccucgugauccacccaccucugccucccaaaguggugggauuacaggcgugagccacugcgccuggccuacaaagugcuugucuuuacauauuuggggaugggggugggguag

SEQ ID NO: 125696 - RNA, 48 nt, Homo sapiens
aauuaccuauaauuuaauacgugcauuauacaucuccagugaugaaaa

SEQ ID NO: 125697 - RNA, 23 nt, Homo sapiens
aguuucauguaagagaagguaag

SEQ ID NO: 125698 - RNA, 41 nt, Homo sapiens
uauucacaaaguugugcaucuauuaccaccaucaguuuagg

SEQ ID NO: 125699 - RNA, 46 nt, Homo sapiens
gagaaauagcgugagauuguaguaaucaaaaugaccuuaccagaaa

SEQ ID NO: 125700 - RNA, 52 nt, Homo sapiens
ucaaugaaagugugcuauauuuaacaccaauagacuauuauuagcaucagaa

SEQ ID NO: 125701 - RNA, 47 nt, Homo sapiens
gcuuuaauuuguaauuugaugaagauuuuuguuaacuugcuauaggu

SEQ ID NO: 125702 - RNA, 47 nt, Homo sapiens
agcuguaacagaagcugaaaaccaacaaaugacaguucaagcccagc

SEQ ID NO: 125703 - RNA, 42 nt, Homo sapiens
accguaacucuaguacagcugcccaaugggcagacaguucaa

SEQ ID NO: 125704 - RNA, 36 nt, Homo sapiens
ugaucaaacaaggagaggaucuucuagaugggagac

SEQ ID NO: 125705 - RNA, 41 nt, Homo sapiens
auucauuccuacaacaaauguuuauuggugacaugcuaugu

SEQ ID NO: 125706 - RNA, 65 nt, Homo sapiens
ucugugugaauugacaaaaucuuacaggucagagaaaggcaaccuuuuuuuuuuuuuucauuaag

SEQ ID NO: 125707 - RNA, 27 nt, Homo sapiens
cuccccucaagaaauuuucaacgccag

SEQ ID NO: 125708 - RNA, 45 nt, Homo sapiens
ccagccucuugagcugaaguaaugugugggccgcaugcauaaagu

SEQ ID NO: 125709 - RNA, 50 nt, Homo sapiens
ugcccauugcacuuacauaccaccaccaagaaagccuucaagaugucaaa

SEQ ID NO: 125710 - RNA, 46 nt, Homo sapiens
caagcuuugauaauguuuaacugaaaaguggcuuagaaagggcuag

SEQ ID NO: 125711 - RNA, 51 nt, Homo sapiens
uaaugagacuuuauccucaucacaacauuaauacuguacauaguaugccaa

SEQ ID NO: 125712 - RNA, 49 nt, Homo sapiens
auuuauuuuuuaaaaaaagaaaaauuuaaaaaauauauaaauaaaauag

SEQ ID NO: 125713 - RNA, 56 nt, Homo sapiens
gugcaggucccagcuggguaugacaugauacauuuuuaauuauucucaccagcaag

SEQ ID NO: 125714 - RNA, 53 nt, Homo sapiens
uuccaagcuuuugucugaggagcaucucagagaagugagaguaaaucugaguu

SEQ ID NO: 125715 - RNA, 45 nt, Homo sapiens
auauuaaaagugggaaauaauugucaacauuuuuuuugaguauag

SEQ ID NO: 125716 - RNA, 43 nt, Homo sapiens
acaguuacauuuuuauuucaauuugucucaaaauuuauuuuug

SEQ ID NO: 125717 - RNA, 55 nt, Homo sapiens
gggagcuagggauagauaauacaugaauaaucaagaauguuagguggugaggugc

SEQ ID NO: 125718 - RNA, 53 nt, Homo sapiens
uuacgugaccugugagcaguccuaaagugagaagggagccuugugaggauggu

SEQ ID NO: 125719 - RNA, 40 nt, Homo sapiens
uuguguuauggaccguaagacuaauacagugugcaguaug

SEQ ID NO: 125720 - RNA, 93 nt, Homo sapiens
aagucccaaaauuauguucauauaagauucuaaccaaauuacuuggaagagagaaaaggauucuagguagauaaauuugugaaaugcugaguu

SEQ ID NO: 125721 - RNA, 30 nt, Homo sapiens; identical to SEQ ID NO: 23545

SEQ ID NO: 125722 - RNA, 44 nt, Homo sapiens
guaucagaauugaucagcuaauuuuuuuuauucuuagugcgaga

SEQ ID NO: 125723 - RNA, 43 nt, Homo sapiens
cugccuuaaauauuuuugccuaaaguuuuuaaucuuuuuaaaa

SEQ ID NO: 125724 - RNA, 351 nt, Homo sapiens
aauauggcuugcuauggaccuuuucuuuuuuccuuuuuuuugagacggagucuugcucuguugccaggcuugagugcaguggcgugaucucagcucacugcaauccccaccucccaaguucaagcaauucuccugccuuagccucccaaguagcugggacuacaggggcgugccaccaagccugacuaauuuuuuuguauuuuuaguaaagaagggauuuuaccauguuggccaggauggucuugaucuccugaccuugugaucugcccgccucggcgucccaaaguguugggauuacaggcaugagccaccgcacccggccuagaccuuuucuuuuuauugggaccaaua

SEQ ID NO: 125725 - RNA, 77 nt, Homo sapiens
ccgcccccaccccaccccccccacccccccgcacucucccauuuucuaguuagucuuuuguucuacuucuugggcau

SEQ ID NO: 125726 - RNA, 46 nt, Homo sapiens
uccugaauuuucaccacucccaugcauuccuuuuuccuauuguuuu

SEQ ID NO: 125727 - RNA, 58 nt, Homo sapiens
aggacauuggaggccaagcuagccuuuaauuuagaagaccucagucuguuaucuggug

SEQ ID NO: 125728 - RNA, 74 nt, Homo sapiens
aaggaaggcucaucugaauuaguuuuuuuuuuaaguguuaaaauuauuaguauucugugguuuuaaaaaaaaau

SEQ ID NO: 125729 - RNA, 81 nt, Homo sapiens
ggcaaagggaucccagaaggcagauggggucaggcuuaucgggauaaggaggaagaacaagguauuccaggcagagcagca

SEQ ID NO: 125730 - RNA, 37 nt, Homo sapiens
agucaugucacucaaccagaauuauuuuaagggguac

SEQ ID NO: 125731 - RNA, 45 nt, Homo sapiens
guguguguguguguguucaaggaacaaacagcaaggugucccgug

SEQ ID NO: 125732 - RNA, 54 nt, Homo sapiens
guaaacagaguuacaaaaaccacuccaaagugaaggcucccauccuacacacag

SEQ ID NO: 125733 - RNA, 66 nt, Homo sapiens
uguaggugucccauuaaguccugcuauuuaagaaauacuuacauaacccuuaggaacucuucaggc

SEQ ID NO: 125734 - RNA, 45 nt, Homo sapiens
ccaugagguuuucuccuggcagccggugucaggauuagcgcagcu

SEQ ID NO: 125735 - RNA, 47 nt, Homo sapiens
uacgagguuuuguagaauccacugaaauuuuaauucagaggauaaau

SEQ ID NO: 125736 - RNA, 50 nt, Homo sapiens
cuuuccugccuuauuuagaccugggccgaggauucguggaaucugcuuga

SEQ ID NO: 125737 - RNA, 48 nt, Homo sapiens
cacacacaacuuagggcggggaguggacuuaagucugacggugcccga

SEQ ID NO: 125738 - RNA, 45 nt, Homo sapiens
aagcagcucaaauuaugagagaggcccacaaauaagaaaaaaagg

SEQ ID NO: 125739 - RNA, 46 nt, Homo sapiens
ugaguuggagcagauugaguuacauaacaguaucagggacaagcag

SEQ ID NO: 125740 - RNA, 58 nt, Homo sapiens
uucucugagccccacuguuaacugacuauaaaaaucauaaauaccauuaucuugagug

SEQ ID NO: 125741 - RNA, 45 nt, Homo sapiens
ugggacgauuucacauuaauacugcauuucugacuuuugggggaa

SEQ ID NO: 125742 - RNA, 56 nt, Homo sapiens
aggggcagccucaccuuuagucaugugggguguacuucauuuggccccuuucccua

SEQ ID NO: 125743 - RNA, 45 nt, Homo sapiens
aaauuguauccuuguauuacaaaaaauuauaguguaauuccagua

SEQ ID NO: 125744 - RNA, 47 nt, Homo sapiens
guuuucauauugaguagaaauaaaugucuaagaaauacagugauggg

SEQ ID NO: 125745 - RNA, 33 nt, Homo sapiens
augcuucccugaccucugacugguguaucuccu

SEQ ID NO: 125746 - RNA, 61 nt, Homo sapiens
auuuuacuuacuuauuuuguuuauuguuugacucucgcauuaagaauguaaucccuaugac

SEQ ID NO: 125747 - RNA, 77 nt, Homo sapiens
aacccuaggaccuagaauaauuaaugaugcagcaauagcucgauaaauugaaagaauaaaugaaaaggaucacuuaa

SEQ ID NO: 125748 - RNA, 53 nt, Homo sapiens
accuggaccuagauuuccugauuuuuagauguuaacuuuuuauauacagcacu

SEQ ID NO: 125749 - RNA, 62 nt, Homo sapiens
aauaagaggaaacuaccuauacugaauuagaacuauuuaaauaaugauuugugugauggcca

SEQ ID NO: 125750 - RNA, 44 nt, Homo sapiens
uacagguuggcuuccaauaacaugagccagguauuuuucaguaa

SEQ ID NO: 125751 - RNA, 48 nt, Homo sapiens
acaguguguucauucaguaagcauuuauugaaaggcuuguauauuuag

SEQ ID NO: 125752 - RNA, 43 nt, Homo sapiens
gaccuaauuauuacauuauucuuuagaaccuacauauuauuua

SEQ ID NO: 125753 - RNA, 44 nt, Homo sapiens
gcaaagauaccauguagauuauuaagaguugguuuaccagaaag

SEQ ID NO: 125754 - RNA, 46 nt, Homo sapiens
acaugauugugucuggcagugcuauuaugaggagugaagaccccag

SEQ ID NO: 125755 - RNA, 64 nt, Homo sapiens
uugaagccguacugcuuuuuugagcaguuauucauuccagugauuaaaacugauugugcagaau

SEQ ID NO: 125756 - RNA, 52 nt, Homo sapiens
agcuuuuuacuuaacguugucuuauuuccagucuaauuuuacgcuguagcag

SEQ ID NO: 125757 - RNA, 61 nt, Homo sapiens
acuuugauaguacuuccacucucuaauagauaaauaaguacuuggaaguucguauugacuu

SEQ ID NO: 125758 - RNA, 36 nt, Homo sapiens
ucuucuagagaccaucaccuuggaauuaguuugguu

SEQ ID NO: 125759 - RNA, 28 nt, Homo sapiens
ucagucaauuuaagugaaacauuuuaua

SEQ ID NO: 125760 - RNA, 45 nt, Homo sapiens
cauggccuaccagcugacaaggagugucugguuucaagauggcaa

SEQ ID NO: 125761 - RNA, 64 nt, Homo sapiens
ucauucuuacccauuauaggucauaguuugcuuuuguuagcuguuuucccuucgaagcuuuaac

SEQ ID NO: 125762 - RNA, 40 nt, Homo sapiens
auaacuacuuagguaauccacagaaucaugaaagauaaua

SEQ ID NO: 125763 - RNA, 36 nt, Homo sapiens
aaacuguugaugaucucagucaacugugcacucugc

SEQ ID NO: 125764 - RNA, 46 nt, Homo sapiens
auuuuaacaggugugagacgguaucucauuauaguuuuaauuggua

SEQ ID NO: 125765 - RNA, 49 nt, Homo sapiens
ucuuauguugaagucuuuaaucaccuuaaguugaugugggaauaaggag

SEQ ID NO: 125766 - RNA, 43 nt, Homo sapiens
auggucgaggaaaagguaucaaguuuuugccacuaaauuggau

SEQ ID NO: 125767 - RNA, 46 nt, Homo sapiens
auuuuuucuaaggguauauucauccaaaucgucaucagagcugcua

SEQ ID NO: 125768 - RNA, 26 nt, Homo sapiens
ucaacucugagcguugagauuagauu

SEQ ID NO: 125769 - RNA, 47 nt, Homo sapiens
uucuucucgccacccuucuuugcgggagacauucugccgggucuaag

SEQ ID NO: 125770 - RNA, 42 nt, Homo sapiens
ugucggauguggcgcguggaggagucgcuggagaaaugccgg

SEQ ID NO: 125771 - RNA, 43 nt, Homo sapiens
cagaucauacaaaaggccauacaguaaguauagaaguagguau

SEQ ID NO: 125772 - RNA, 45 nt, Homo sapiens
agugggcgggaccuagggguggggcuggaggcugaaacuugccaa

SEQ ID NO: 125773 - RNA, 47 nt, Homo sapiens
uucucagucagugugcuaaagugcaauaauguucuacagcuugauac

SEQ ID NO: 125774 - RNA, 46 nt, Homo sapiens
acuacuugggugcuaugauucaccaaaacaacuuguuauugaaaac

SEQ ID NO: 125775 - RNA, 41 nt, Homo sapiens
ugugcagugaccuccacauaugaaauaggaaacccuccaga

SEQ ID NO: 125776 - RNA, 53 nt, Homo sapiens
ugauuauuuuuuauacuguaugugccaaagcuuuacuacuguggaaagacaac

SEQ ID NO: 125777 - RNA, 46 nt, Homo sapiens
uauccacaguacucacuuuuuccaaaugauccuaguaauugccuag

SEQ ID NO: 125778 - RNA, 51 nt, Homo sapiens
uauuuaaaauaucacaguaacaagaucaugcuuguuccuacaguauugcgg

SEQ ID NO: 125779 - RNA, 87 nt, Homo sapiens
gcaaauguuuugaaaugauaugaccaaaauuuuaaguaggaaagucacccaaacacuucugcuuucacuuaagugucuggcccgcaa

SEQ ID NO: 125780 - RNA, 29 nt, Homo sapiens
cauuugcaucuugguuggcugcauaugcu

SEQ ID NO: 125781 - RNA, 39 nt, Homo sapiens
auuuuaaaugaagugauucuaagauuugguuugggauca

SEQ ID NO: 125782 - RNA, 26 nt, Homo sapiens
agaacaggcaaugugcagcccucauu

SEQ ID NO: 125783 - RNA, 57 nt, Homo sapiens
cuuccuccagagcaaagggcuuaagaaagaaagaagaacucuaagcugggucugcua

SEQ ID NO: 125784 - RNA, 113 nt, Homo sapiens
ugcccaauugagugcuucaugccuuuagauguacaggcugacagagaagauucccgagaguaaaucaucuuuccaauccagaggaacaagcaugucucucugccaagauccau

SEQ ID NO: 125785 - RNA, 42 nt, Homo sapiens
cgggaaucuucucugucagccuguacaucuaaaggcaugaag

SEQ ID NO: 125786 - RNA, 52 nt, Homo sapiens
ccagucccgaaggcacuacuggccaguccuacaaccaguauucucagagaua

SEQ ID NO: 125787 - RNA, 61 nt, Homo sapiens
gacuggccaguagugccuucgggacuggguucacccccaggucugcggcaguugucacagc

SEQ ID NO: 125788 - RNA, 38 nt, Homo sapiens
ucuagugcagagaacuuguugaggaaguugggauugga

SEQ ID NO: 125789 - RNA, 55 nt, Homo sapiens
uacuggaaaugggaggacacacauguucucuuucacuacuguucuuaagcuggca

SEQ ID NO: 125790 - RNA, 44 nt, Homo sapiens
ccccaaauccuggugggugaggggcaugcuucacacucaagggu

SEQ ID NO: 125791 - RNA, 46 nt, Homo sapiens
cugcuuucuccccucccaacuaaaccuuagucaucguaaaccucag

SEQ ID NO: 125792 - RNA, 45 nt, Homo sapiens
uuaugaugaugggaagacauaccacguaggagaacaguggcagaa

SEQ ID NO: 125793 - RNA, 51 nt, Homo sapiens
gucacacuugaauucuccuuuuccguucccaagacaugugcagcucaucau

SEQ ID NO: 125794 - RNA, 49 nt, Homo sapiens
agggagaaaauggccagaugaugagcugcacaugucuugggaacggaaa

SEQ ID NO: 125795 - RNA, 41 nt, Homo sapiens
cuccaaucuuguaguucacaccauugucauggcaccauccu

SEQ ID NO: 125796 - RNA, 46 nt, Homo sapiens
aaucuuuguuuugauaucacaguugucuaauuauuuuacuuuguag

SEQ ID NO: 125797 - RNA, 45 nt, Homo sapiens
uuuuugagucuaaauguucaccucugaucucauucaacacugaag

SEQ ID NO: 125798 - RNA, 46 nt, Homo sapiens
aaaauauuacuucgagucaaacaguauucucuuguuugcuucaugu

SEQ ID NO: 125799 - RNA, 60 nt, Homo sapiens
cuuuaaacuguugugccagugcuuaggcuuuggaaguggucauuucagaugugauucauc

SEQ ID NO: 125800 - RNA, 59 nt, Homo sapiens
cuuccaaagccuaagcacuggcacaacaguuuaaagccugauucagacauucguuccca

SEQ ID NO: 125801 - RNA, 51 nt, Homo sapiens
ugcuuugaccccuacacaguuucccauuaugccguuggagaugagugggaa

SEQ ID NO: 125802 - RNA, 33 nt, Homo sapiens
ucuguugaaacuacuucauagaacauggaacag

SEQ ID NO: 125803 - RNA, 46 nt, Homo sapiens
cugcuggucuuucagugccuccacuaugacguuguagguggcaccu

SEQ ID NO: 125804 - RNA, 53 nt, Homo sapiens
cuacaacgucauaguggaggcacugaaagaccagcagaggcauaagguucggg

SEQ ID NO: 125805 - RNA, 47 nt, Homo sapiens
cugacaguaucaauuuuuauuguguuguuacuuuuagaaaguggcag

SEQ ID NO: 125806 - RNA, 32 nt, Homo sapiens
uauggcucuacuuuggaggacauaccagagag

SEQ ID NO: 125807 - RNA, 54 nt, Homo sapiens
ccccauuccaggacacuucugaguacaucauuucaugucauccuguuggcacug

SEQ ID NO: 125808 - RNA, 47 nt, Homo sapiens
uggauugagucccggaccguguggguacaggugauagucuacaucuu

SEQ ID NO: 125809 - RNA, 97 nt, Homo sapiens
uaggugaggaaauccaaauuggucacauccccagggaagauguagacuaucaccuguacccacacgguccgggacucaauccaaaugccucuacagg

SEQ ID NO: 125810 - RNA, 46 nt, Homo sapiens
uucggcggguauggucuuggccuaugccuuauggggguggccguug

SEQ ID NO: 125811 - RNA, 67 nt, Homo sapiens
guauucagcuuccuggcacuucuggucagcaacccaguguugggcaacaaaugaucuuugaggaaca

SEQ ID NO: 125812 - RNA, 52 nt, Homo sapiens
cgaaaggggucuuuugaacuguggaaggaacauccaagaucucugguccaug

SEQ ID NO: 125813 - RNA, 76 nt, Homo sapiens
ccccaacugguaacccuuccacaccccaaucuucauggaccagagaucuuggauguuccuuccacaguucaaaaga

SEQ ID NO: 125814 - RNA, 66 nt, Homo sapiens
uaaaaaagaaagagagaaagagaaagacugcacauuucaguuccauuaggucuaauuugagcagag

SEQ ID NO: 125815 - RNA, 47 nt, Homo sapiens
gaaccgggaaccgaauauacaauuuaugucauugcccugaagaauaa

SEQ ID NO: 125816 - RNA, 47 nt, Homo sapiens
ugauuauucuucagggcaaugacauaaauuguauauucgguucccgg

SEQ ID NO: 125817 - RNA, 71 nt, Homo sapiens
auuccuugcugguaucauggcagccgccacgugccaggauuaccggcuacaucaucaaguaugagaagccu

SEQ ID NO: 125818 - RNA, 43 nt, Homo sapiens
caugauaccagcaaggaauugggugugguggccaggaaacgca

SEQ ID NO: 125819 - RNA, 74 nt, Homo sapiens
ugacuacaagaucuaccuguacaccuugaaugacaaugcucggagcuccccuguggucaucgacgccuccacug

SEQ ID NO: 125820 - RNA, 43 nt, Homo sapiens
uucugacaucuggcuugaugguucucuggauuggagucuggcc

SEQ ID NO: 125821 - RNA, 50 nt, Homo sapiens
uggcuuccaaguugaugccguuccagccaauggccagacuccaauccaga

SEQ ID NO: 125822 - RNA, 61 nt, Homo sapiens
gugaucgucucagucuugguucuccagcuaauggugaugguggucucaguagcaucuguca

SEQ ID NO: 125823 - RNA, 49 nt, Homo sapiens
ucgugugacagaugcuacugagaccaccaucaccauuagcuggagaacc

SEQ ID NO: 125824 - RNA, 34 nt, Homo sapiens
gaccagcucagggaguugucaccacucuggagag

SEQ ID NO: 125825 - RNA, 35 nt, Homo sapiens
uugucaaaguguccuuaagagcauagacacucacu

SEQ ID NO: 125826 - RNA, 62 nt, Homo sapiens
uuaccauaaguccugauacaaccacggaugagcugucaggagcaagguugauuucuuucauu

SEQ ID NO: 125827 - RNA, 49 nt, Homo sapiens
acuggauaucgagugcgggugacccccaaggagaagaccggaccaauga

SEQ ID NO: 125828 - RNA, 51 nt, Homo sapiens
gguccggucuucuccuugggggucacccgcacucgauauccagugagcuga

SEQ ID NO: 125829 - RNA, 45 nt, Homo sapiens
ccugaaguucacucaggucacacccacaagccugagcgcccagug

SEQ ID NO: 125830 - RNA, 41 nt, Homo sapiens
gggccauugcuuauuuuuccauacaaaaguaaaauaaauca

SEQ ID NO: 125831 - RNA, 46 nt, Homo sapiens
cauuacagagagaacgucaaauuuagcagccauaucugccauaggg

SEQ ID NO: 125832 - RNA, 52 nt, Homo sapiens
uucugaguacacagucagugugguugccuugcacgaugauauggagagccag

SEQ ID NO: 125833 - RNA, 51 nt, Homo sapiens
uccauaucaucgugcaaggcaaccacacugacuguguacucagaacccggu

SEQ ID NO: 125834 - RNA, 46 nt, Homo sapiens; identical to SEQ ID NO: 23691

SEQ ID NO: 125835 - RNA, 32 nt, Homo sapiens
aguguaauauaaaugcuuaauagagaggggaa

SEQ ID NO: 125836 - RNA, 74 nt, Homo sapiens
cagaaaugacuauugaaggcuugcagcccacaguggaguaugugguuagugucuaugcucagaauccaagcgga

SEQ ID NO: 125837 - RNA, 43 nt, Homo sapiens
uaccuggaccugcaguuuuaguuuuuguugguccugguccauu

SEQ ID NO: 125838 - RNA, 47 nt, Homo sapiens
ucccaaaaauggaccaggaccaacaaaaacuaaaacugcagguccag

SEQ ID NO: 125839 - RNA, 45 nt, Homo sapiens
caucccagaugcaagugaccgauguucaggacaacagcauuagug

SEQ ID NO: 125840 - RNA, 35 nt, Homo sapiens
cuugcggggcugucuccacggccagugacagcaua

SEQ ID NO: 125841 - RNA, 79 nt, Homo sapiens
aggaaauagcccuguccaggaguucacugugccugggagcaagucuacagcuaccaucagcggccuuaaaccuggaguu

SEQ ID NO: 125842 - RNA, 45 nt, Homo sapiens
gaugguagcuguagacuugcucccaggcacagugaacuccuggac

SEQ ID NO: 125843 - RNA, 44 nt, Homo sapiens
uguaccugucucuccguaagugauccuguaauaucucacuguga

SEQ ID NO: 125844 - RNA, 47 nt, Homo sapiens
uccgagggaccuggaaguuguugcugcgacccccaccagccuacuga

SEQ ID NO: 125845 - RNA, 45 nt, Homo sapiens
auaaaauucugcuaauuacacguaguauuuacaugauuguaugga

SEQ ID NO: 125846 - RNA, 95 nt, Homo sapiens
gaucgggugccccacucucggaauuccaucacccucaccaaccucacuccaggcacagaguauguggucagcaucguugcucuuaauggcagaga

SEQ ID NO: 125847 - RNA, 50 nt, Homo sapiens
acucugugccuggagugagguuggugagggugauggaauuccgagagugg

SEQ ID NO: 125848 - RNA, 55 nt, Homo sapiens
ggauugcuccucgagccaccaucacuggcuacaggauccgccaucaucccgagca

SEQ ID NO: 125849 - RNA, 54 nt, Homo sapiens
agugaugguggcucgaggagcaauccagugcacaguaaaagaguuggcaguaau

SEQ ID NO: 125850 - RNA, 52 nt, Homo sapiens
ugccugguacagaauauguagugagugucuccagugucuacgaacaacauga

SEQ ID NO: 125851 - RNA, 43 nt, Homo sapiens
gauucuacauaagggaaaaauagcuuacauuuagguacauuac

SEQ ID NO: 125852 - RNA, 88 nt, Homo sapiens
gauuuaaccaacuuccuggugcguuacucaccugugaaaaaugaggaagauguugcagaguugucaauuucuccuucagacaaugcag

SEQ ID NO: 125853 - RNA, 53 nt, Homo sapiens
agcuguuccuccucccacugaccugcgauucaccaacauugguccagacacca

SEQ ID NO: 125854 - RNA, 35 nt, Homo sapiens
acuguguguaguguuuuauuuuuaacaguaguaca

SEQ ID NO: 125855 - RNA, 45 nt, Homo sapiens
caucaaaauuuaggguagaguggaugggcauuguuuugagguagg

SEQ ID NO: 125856 - RNA, 56 nt, Homo sapiens
uacagaugucugcucuguuaaauauaaaauagcaaauguucauucaauuugaagac

SEQ ID NO: 125857 - RNA, 45 nt, Homo sapiens
acacagucacagggcuggagccgggcauugacuaugauaucagcg

SEQ ID NO: 125858 - RNA, 43 nt, Homo sapiens
uccaccauuauuggguaccgcaucacaguaguugcggcaggag

SEQ ID NO: 125859 - RNA, 57 nt, Homo sapiens
auucauaaucaaaacauguaauuagcguuaguaaaagcauucuacugaagaguccaa

SEQ ID NO: 125860 - RNA, 96 nt, Homo sapiens
ugaucagagcuccugcacuuuugauaaccugagucccggccuggaguacaaugucaguguuuacacugucaaggaugacaaggaaagugucccuau

SEQ ID NO: 125861 - RNA, 50 nt, Homo sapiens
ccgggacucagguuaucaaaagugcaggagcucugaucagcauggaccac

SEQ ID NO: 125862 - RNA, 48 nt, Homo sapiens
gacauuacugguuauagaauuaccacaaccccuacaaacggccagcag

SEQ ID NO: 125863 - RNA, 46 nt, Homo sapiens
gggguugugguaauucuauaaccaguaaugucuggagaaaaaagaa

SEQ ID NO: 125864 - RNA, 49 nt, Homo sapiens
uuuuauuugaaugucucucaucccucucaacucuuuuacugcccaauuu

SEQ ID NO: 125865 - RNA, 42 nt, Homo sapiens
aggguaaacacuaauguggcaaauacaaggaaacccaacuga

SEQ ID NO: 125866 - RNA, 43 nt, Homo sapiens
agcuggaaauuguauagcuuuggcuuaaacaauguuuccgcag

SEQ ID NO: 125867 - RNA, 42 nt, Homo sapiens
gggggacaagacagauccucacacagcuguagggcugaagaa

SEQ ID NO: 125868 - RNA, 43 nt, Homo sapiens
ggagugcucacagucuccugggagaggagcaccaccccaggua

SEQ ID NO: 125869 - RNA, 47 nt, Homo sapiens
ucccaggagacugugagcacuccagugucaggguuugccuccagaug

SEQ ID NO: 125870 - RNA, 44 nt, Homo sapiens
uuaaugauuuugcaauacuauugaaauuauuuucaucuugccag

SEQ ID NO: 125871 - RNA, 47 nt, Homo sapiens
accacuuuguuuacaauuggcgcaucucuuuccuguccaucucucag

SEQ ID NO: 125872 - RNA, 46 nt, Homo sapiens
guccugagagauggacaggaaagagaugcgccaauuguaaacaaag

SEQ ID NO: 125873 - RNA, 46 nt, Homo sapiens
acgaccaagccagggaggagaggcaccacgagaagugacuucagac

SEQ ID NO: 125874 - RNA, 46 nt, Homo sapiens
aacaccgaggugacugagaccaccauugugaucacauggacgccug

SEQ ID NO: 125875 - RNA, 41 nt, Homo sapiens
uuaagaugaugcucucugccugggaaggccauuaugggaaa

SEQ ID NO: 125876 - RNA, 83 nt, Homo sapiens
ucugucuccaaguacccacugaggaaucugcagccugcaucugaguacaccguaucccucguggccauaaagggcaaccaaga

SEQ ID NO: 125877 - RNA, 41 nt, Homo sapiens
cuuuauggccacgagggauacgguguacucagaugcaggcu

SEQ ID NO: 125878 - RNA, 57 nt, Homo sapiens
uaaggcccacggucagucgguauccuguuaucugggcccgagguggaguccaucuca

SEQ ID NO: 125879 - RNA, 96 nt, Homo sapiens
cuaaccuccaguuugucaaugaaacugauucuacuguccuggugagauggacuccaccucgggcccagauaacaggauaccgacugaccgugggcc

SEQ ID NO: 125880 - RNA, 54 nt, Homo sapiens
ccgggcuguccccuggggucaccuauuacuucaaagucuuugcagugagccaug

SEQ ID NO: 125881 - RNA, 56 nt, Homo sapiens
gccuggcgagcacgggcagaggcugcccaucagcaggaacaccuuugcagaaguca

SEQ ID NO: 125882 - RNA, 42 nt, Homo sapiens
uggugaccuucacgucugucacuuccacaaacugcagguccc

SEQ ID NO: 125883 - RNA, 47 nt, Homo sapiens
aaaguacaccuguugucauucaacaagaaaccacuggcaccccacgc

SEQ ID NO: 125884 - RNA, 53 nt, Homo sapiens
cuuccacagcauagauagugauguuauacugaacaccagguugcaagucacug

SEQ ID NO: 125885 - RNA, 24 nt, Homo sapiens
ucaaccuuccugaaacugcaaacu

SEQ ID NO: 125886 - RNA, 44 nt, Homo sapiens
uugaugacaccucaauuguuguucgcuggagcagaccccaggcu

SEQ ID NO: 125887 - RNA, 45 nt, Homo sapiens
uccagcgaacaacaauugaggugucaucaacuugguccacagucg

SEQ ID NO: 125888 - RNA, 85 nt, Homo sapiens
cacuucugugaacaucccugaccugcuuccuggccgaaaauacauuguaaaugucuaucagauaucugaggauggggagcagagu

SEQ ID NO: 125889 - RNA, 67 nt, Homo sapiens
gauaucugauagacauuuacaauguauuuucggccaggaagcaggucagggauguucacagaagugg

SEQ ID NO: 125890 - RNA, 56 nt, Homo sapiens
gcaucagggaccaggaacaugugacaguggcuugggaaaaacccggccacuucuua

SEQ ID NO: 125891 - RNA, 117 nt, Homo sapiens
ggccacuucugaaucugugaccgaaaucacagccaguagcuuuguggucuccugggucucagcuuccgacaccgugucgggauuccggguggaauaugagcugagugaggagggaga

SEQ ID NO: 125892 - RNA, 46 nt, Homo sapiens
gagacccaggagaccacaaagcuacuggcugugauuucggucacag

SEQ ID NO: 125893 - RNA, 45 nt, Homo sapiens
ccucaggagagccuagcucuaggaaccucggggguaggaggcaug

SEQ ID NO: 125894 - RNA, 53 nt, Homo sapiens
ggccugaagccuggugugguauacgagggccagcucaucagcauccagcagua

SEQ ID NO: 125895 - RNA, 41 nt, Homo sapiens
gaugagcuggcccucguauaccacaccaggcuucaggccuu

SEQ ID NO: 125896 - RNA, 61 nt, Homo sapiens
uucuguaggccguuggaaggaagcuaccauaccaggccacuuaaacuccuacaccaucaaa

SEQ ID NO: 125897 - RNA, 43 nt, Homo sapiens
aucuucaaagaaaaaugacuuaagcaggacuuaggcagcucca

SEQ ID NO: 125898 - RNA, 44 nt, Homo sapiens
acccacugaauuuauuuagauagaaggaaaagagaugaugggag

SEQ ID NO: 125899 - RNA, 39 nt, Homo sapiens
ugaugguuucuuuuuuucccagcuuuugagccaacaacu

SEQ ID NO: 125900 - RNA, 105 nt, Homo sapiens
gcucaagugguccugucgaaguauuuaucacugagacuccgagucagcccaacucccaccccauccaguggaaugcaccacagccaucucacauuuccaaguaca

SEQ ID NO: 125901 - RNA, 42 nt, Homo sapiens
gcugacucggagucucagugauaaauacuucgacaggaccac

SEQ ID NO: 125902 - RNA, 59 nt, Homo sapiens
ucauaagcuuguccccccucaaaaucaugauugacaagacuaaauaaaguguauaucag

SEQ ID NO: 125903 - RNA, 68 nt, Homo sapiens
cagauaccagugcuacugcuauggccguggcauuggggaguggcauugccaaccuuuacagaccuauc

SEQ ID NO: 125904 - RNA, 45 nt, Homo sapiens
agcacugguaucugacaccaugcacauacuucucccaugaaucuc

SEQ ID NO: 125905 - RNA, 46 nt, Homo sapiens
gauucagagacugggacguuuuaucaaauuggagauucaugggaga

SEQ ID NO: 125906 - RNA, 46 nt, Homo sapiens
cgacgggaucacacuuccaccugccccgacccugaccgaagcaugu

SEQ ID NO: 125907 - RNA, 90 nt, Homo sapiens
aucacuuacaaugugaacgacacauuccacaagcgucaugaagaggggcacaugcugaacuguacaugcuucggucagggucggggcagg

SEQ ID NO: 125908 - RNA, 46 nt, Homo sapiens
augugucguucacauuguaagugaugucaucaacaaugcacugauc

SEQ ID NO: 125909 - RNA, 57 nt, Homo sapiens
acaugggucacaugaugaggugcacguguguugggaauggucguggggaauggacau

SEQ ID NO: 125910 - RNA, 74 nt, Homo sapiens
aagcugcgaguaggcaaugcauguccauuccccacgaccauucccaacacacgugcaccucaucaugugaccca

SEQ ID NO: 125911 - RNA, 59 nt, Homo sapiens
cugcacaaccaaugaaggggucauguaccgcauuggagaucagugggauaagcagcaug

SEQ ID NO: 125912 - RNA, 49 nt, Homo sapiens
cccacugaucuccaaugcgguacaugaccccuucauugguugugcagau

SEQ ID NO: 125913 - RNA, 47 nt, Homo sapiens
agacaacaugaaguggugugggaccacacagaacuaugaugccgacc

SEQ ID NO: 125914 - RNA, 45 nt, Homo sapiens
uucuguguggucccacaccacuucauguugucucuucugcccuca

SEQ ID NO: 125915 - RNA, 46 nt, Homo sapiens
aauuccaauggugccuugugccacuuccccuuccuauacaacaacc

SEQ ID NO: 125916 - RNA, 51 nt, Homo sapiens
uguauaggaaggggaaguggcacaaggcaccauuggaauuuccuccucgag

SEQ ID NO: 125917 - RNA, 28 nt, Homo sapiens
gaaagaguauuucugguccugcucauaa

SEQ ID NO: 125918 - RNA, 101 nt, Homo sapiens
cauucaccuacaauggcaggacguucuacuccugcaccacagaagggcgacaggacggacaucuuuggugcagcacaacuucgaauuaugagcaggaccag

SEQ ID NO: 125919 - RNA, 44 nt, Homo sapiens
agcuguaacccagacuuacgguggcaacucaaauggagagccau

SEQ ID NO: 125920 - RNA, 109 nt, Homo sapiens
gucacagacagugguguggucuacucuguggggaugcaguggcugaagacacaaggaaauaagcaaaugcuuugcacgugccugggcaacggagucagcugccaagaga

SEQ ID NO: 125921 - RNA, 46 nt, Homo sapiens
gccccuucaccgauguucgugcagcuguuuaccaaccgcagccuca

SEQ ID NO: 125922 - RNA, 46 nt, Homo sapiens
ggcugcgguugguaaacagcugcacgaacaucggugaaggggccag

SEQ ID NO: 125923 - RNA, 46 nt, Homo sapiens
agggggaaaaaagccagauuuaucuccaaaagauaaaacugaguuu

SEQ ID NO: 125924 - RNA, 49 nt, Homo sapiens
gcucgauguggucugcacagaggugugccucucacacuuccacucuccu

SEQ ID NO: 125925 - RNA, 48 nt, Homo sapiens
aucgaggaaaccugcuccagugcaucugcacaggcaacggccgaggag

SEQ ID NO: 125926 - RNA, 45 nt, Homo sapiens
cuugcuccaggugucuccaauucuauaggauguccuuguguccug

SEQ ID NO: 125927 - RNA, 53 nt, Homo sapiens
ucaggacacaaggacauccuauagaauuggagacaccuggagcaagaaggaua

SEQ ID NO: 125928 - RNA, 29 nt, Homo sapiens
gauaaaugaaaauguuauuugacagagag

SEQ ID NO: 125929 - RNA, 44 nt, Homo sapiens
gauacuaccaccuucuuauagcuucuuuguagccauuggugaag

SEQ ID NO: 125930 - RNA, 52 nt, Homo sapiens
ucaucucccugacccccuaaguacucuuugaaggcugggcuaauguucauuu

SEQ ID NO: 125931 - RNA, 34 nt, Homo sapiens
ucaguauuucuguugaaaucuuuaauacuguguu

SEQ ID NO: 125932 - RNA, 126 nt, Homo sapiens
agagugggaucaacauaaaaugauaauuuguaacuaaaugaccauuagucuaugcgugcauuuaucugguaaauagauuauuuaaauuauaauccaaauuugcucugugccacgaugugaguauag

SEQ ID NO: 125933 - RNA, 24 nt, Homo sapiens
gaaauuuaaauagggcacauucac

SEQ ID NO: 125934 - RNA, 54 nt, Homo sapiens
agauuguacuugccugggagaaggcagcggacgcaucacuugcacuucuagaag

SEQ ID NO: 125935 - RNA, 46 nt, Homo sapiens
acaaucuaccaucauccagccuugguagggcuucucccacguuucu

SEQ ID NO: 125936 - RNA, 78 nt, Homo sapiens
guguuuugaucaugcugcugggacuuccuauguggucggagaaacgugggagaagcccuaccaaggcuggaugauggu

SEQ ID NO: 125937 - RNA, 36 nt, Homo sapiens
ucauuucuuuucaaauuaaaaguuguugagcuucuu

SEQ ID NO: 125938 - RNA, 42 nt, Homo sapiens
ccuccuucgucaagauauaauuuauuuaaaagaaaaaaaaau

SEQ ID NO: 125939 - RNA, 49 nt, Homo sapiens
gagugugugugucuugguaauggaaaaggagaauggaccugcaagccca

SEQ ID NO: 125940 - RNA, 28 nt, Homo sapiens
ucuccuuuuccauuaccaagacacacac

SEQ ID NO: 125941 - RNA, 72 nt, Homo sapiens
caugaagggggucaguccuacaagauuggugacaccuggaggagaccacaugagacuggugguuacauguua

SEQ ID NO: 125942 - RNA, 41 nt, Homo sapiens
gucucuacuuuagccaaccuaaguaccuaccauggguggaa

SEQ ID NO: 125943 - RNA, 45 nt, Homo sapiens
aaacacacacacucauaaaugcacacacacucauaaacgcacaca

SEQ ID NO: 125944 - RNA, 45 nt, Homo sapiens
cggaauauccagucauggauaacagaaaaugacagugaugguaac

SEQ ID NO: 125945 - RNA, 45 nt, Homo sapiens
cuguuaccaucacugucauuuucuguuauccaugacuggauauuc

SEQ ID NO: 125946 - RNA, 49 nt, Homo sapiens
uaaagacuccaugaucugggacuguaccugcaucggggcugggcgaggg

SEQ ID NO: 125947 - RNA, 50 nt, Homo sapiens
uauucucccucgcccagccccgaugcagguacagucccagaucauggagu

SEQ ID NO: 125948 - RNA, 58 nt, Homo sapiens
uuguuaugacaauggaaaacacuaucagauaaaucaacagugggagcggaccuaccua

SEQ ID NO: 125949 - RNA, 42 nt, Homo sapiens
uuugacuauuacuccaaaagaauauuuaaguuccuugcaugu

SEQ ID NO: 125950 - RNA, 43 nt, Homo sapiens
ccagugccuggggacagcggugcccuccacgggagccucgaag

SEQ ID NO: 125951 - RNA, 45 nt, Homo sapiens
agacggugggggagagacgcccgcaccgggaggcaaguugccacc

SEQ ID NO: 125952 - RNA, 52 nt, Homo sapiens
ggguucccucuccucccccugugcagcacagccggcgcgggcguccgagcgc

SEQ ID NO: 125953 - RNA, 42 nt, Homo sapiens
gcgcucggacgcccgcgccggcugugcugcacagggggagga

SEQ ID NO: 125954 - RNA, 45 nt, Homo sapiens
aagagccgagauagcuuccugaaacgugugaaggaaaaugaucag

SEQ ID NO: 125955 - RNA, 50 nt, Homo sapiens
acaggaggcuuuccacuucuuuaacagaucaugacaacuggcccaaggga

SEQ ID NO: 125956 - RNA, 46 nt, Homo sapiens
cagcuuccuucaucacuggacagucgguggauguggaugggggccg

SEQ ID NO: 125957 - RNA, 28 nt, Homo sapiens
uucuuuaaaguauuccucuuacguagug

SEQ ID NO: 125958 - RNA, 49 nt, Homo sapiens
cugauguucagauuaaacuggaugucuuguguuuucuugggcaacucua

SEQ ID NO: 125959 - RNA, 32 nt, Homo sapiens
aagucaacaugucuuuauuuagagaucucagg

SEQ ID NO: 125960 - RNA, 51 nt, Homo sapiens
uuucuuuccccugcugaacacaucaguucuaagggauggcacgcugugcuu

SEQ ID NO: 125961 - RNA, 48 nt, Homo sapiens
guauugggugcugguacauuacucauugguguaggauuuuuagucuua

SEQ ID NO: 125962 - RNA, 46 nt, Homo sapiens
caaagcaggcacgagucauucccauacaaugcaacauccggaauga

SEQ ID NO: 125963 - RNA, 61 nt, Homo sapiens
augccugguaguucuuuuuguuggaugccauauacugaauuugaccuugauggauguuggc

SEQ ID NO: 125964 - RNA, 42 nt, Homo sapiens
ugggguaaccuggagacgggagccaggagcucucggcggggc

SEQ ID NO: 125965 - RNA, 45 nt, Homo sapiens
aauuucgaugccauuggggaggguggaagggaaaugcaaaaaaaa

SEQ ID NO: 125966 - RNA, 52 nt, Homo sapiens
gccggggucggacgucggcgaugcuguggcuccaggugcugugugccgcugg

SEQ ID NO: 125967 - RNA, 31 nt, Homo sapiens
acucuuuauaagacauagguagacgucaggu

SEQ ID NO: 125968 - RNA, 46 nt, Homo sapiens
gucacgcccagaauccaucaucaucuaccgcucagacaaugagaaa

SEQ ID NO: 125969 - RNA, 51 nt, Homo sapiens
ggugagaggaggacaggaagguaggcagaggcuggaucaugguggcccuug

SEQ ID NO: 125970 - RNA, 47 nt, Homo sapiens
aauaagguauaaagaaagccauggacuugggcuuuacccggacuggg

SEQ ID NO: 125971 - RNA, 57 nt, Homo sapiens
cuggguucuuaagaucucuaugagaaugaaaauuagcugugauaaagcaacuauccc

SEQ ID NO: 125972 - RNA, 55 nt, Homo sapiens
ggacggaucuaaaccuuuuauucuuaucucauuuaaucuucacaaccccuugaag

SEQ ID NO: 125973 - RNA, 80 nt, Homo sapiens
aauuacaaugaauuuuaaagugauuuuuuuuuuucaacauaaaagagugguaguugucucugaagggucacuagagggag

SEQ ID NO: 125974 - RNA, 49 nt, Homo sapiens
aguggaggagcuguuuguugcagaugaacuggaaguaaaauucuaacag

SEQ ID NO: 125975 - RNA, 48 nt, Homo sapiens
cauuugaacaagcaaagaaggugauaaccauguuuguacagcgacagg

SEQ ID NO: 125976 - RNA, 47 nt, Homo sapiens
gcuuggguuuguauccuugcucugccaugucauuuacuaaccuucug

SEQ ID NO: 125977 - RNA, 58 nt, Homo sapiens
gcucccagcccuccacucacuucccuguucucugcaugggugauacugagagguuggg

SEQ ID NO: 125978 - RNA, 45 nt, Homo sapiens
agaauguaaucacauuuauuaacucuagauccauuucuaagcuuc

SEQ ID NO: 125979 - RNA, 45 nt, Homo sapiens
gagaaugauuucuuaauaugauaacucucucuuuuagaggaaaga

SEQ ID NO: 125980 - RNA, 42 nt, Homo sapiens
ugucauucgaaagagcuacucuuuuuuuccaugagcaauaca

SEQ ID NO: 125981 - RNA, 46 nt, Homo sapiens
agguggccaugggccuuccuuuccacuaaaaggaauuaccgaacag

SEQ ID NO: 125982 - RNA, 46 nt, Homo sapiens
uguuuuagcauuucgacgcuacuuugauuuuaggucugccaugaag

SEQ ID NO: 125983 - RNA, 45 nt, Homo sapiens
aaugaaaugcauuaagcuguguuauuguaguaucauagcagaaau

SEQ ID NO: 125984 - RNA, 47 nt, Homo sapiens
auuauucaagguaugucaguaagaguuuucacuguugccuaaaagac

SEQ ID NO: 125985 - RNA, 41 nt, Homo sapiens
uuuauccagaggacuuagaaacuagcugaggauaucuguau

SEQ ID NO: 125986 - RNA, 43 nt, Homo sapiens
auuaauacccuacaauuucuaccaguucuugaauucaauucug

SEQ ID NO: 125987 - RNA, 37 nt, Homo sapiens
caguuuugaggaagagaaugucacuggggcuauauuu

SEQ ID NO: 125988 - RNA, 44 nt, Homo sapiens
ccugguuaucuuaggcaaaaaggaaauuuauugcuggggcaaug

SEQ ID NO: 125989 - RNA, 57 nt, Homo sapiens
ugaggacuuccaguaaaacaaaacaaaagaaugccuggagaagacuuguguagguag

SEQ ID NO: 125990 - RNA, 42 nt, Homo sapiens
aacuuugauaagguuaaccgugauagugagagaaguacauag

SEQ ID NO: 125991 - RNA, 359 nt, Homo sapiens
aaggugagggaugaggcccagcacuuugagaggccaagguagguggaucacuugaggucaggaguucgagaccagucugggcaacauggcaaaaccccaucucuacuaaaaauacaaaaaguuagcugggcaugguggcgcgugccuauaauuccagcuacucgggaggcugaggcacaaacauugcuugaacgggggacacagaagcugcagugagccgagauugugccacugcacuccagccugggggacagagugagacucugucucaaaaaaaaaaaagugaaggaugagaauggugcgguggcauuaucaaagaccgggguuuccagugugguugauuaggcaaugauguuaau

SEQ ID NO: 125992 - RNA, 50 nt, Homo sapiens
uuuuagguuacaaguuuauauauaaugucugugucuguguuaagauuagg

SEQ ID NO: 125993 - RNA, 32 nt, Homo sapiens
aggaaugcaaugccaggaugaucuggccuccu

SEQ ID NO: 125994 - RNA, 19 nt, Homo sapiens
cuggaaccuaaucagucag

SEQ ID NO: 125995 - RNA, 35 nt, Homo sapiens
auuuuucuuucggcuucucuguuuaagaggcacag

SEQ ID NO: 125996 - RNA, 48 nt, Homo sapiens
aaaaaauugauaauuuuagauaaugauggagccuauaaaaaauauaaa

SEQ ID NO: 125997 - RNA, 46 nt, Homo sapiens
acuggggugguagaaugggguggaggggcuacuucauauagagugu

SEQ ID NO: 125998 - RNA, 46 nt, Homo sapiens
gggagccucuacccccaauucagcagcauauuuggaauaugcugaa

SEQ ID NO: 125999 - RNA, 31 nt, Homo sapiens
auuugucuuggacuuguugaauaccuagugu

SEQ ID NO: 126000 - RNA, 55 nt, Homo sapiens
acuucagcuucuccaaauuuuucuuuuucaaucuuuggcagcucccucucagauu

SEQ ID NO: 126001 - RNA, 57 nt, Homo sapiens
agcucaggagacucaggauuagagaagaugagaaacuugcccaagauuguaguuggu

SEQ ID NO: 126002 - RNA, 62 nt, Homo sapiens
aaaagcccuucucuuugucuuugguuuuauuuuauaagagcacacuuauuacauuaagccau

SEQ ID NO: 126003 - RNA, 38 nt, Homo sapiens
gcauuagcaguucugcaaaaucuugugaagaaaugaag

SEQ ID NO: 126004 - RNA, 47 nt, Homo sapiens
ggaaaauaugucuuaccccuggccaugggauuggggauucagagcag

SEQ ID NO: 126005 - RNA, 68 nt, Homo sapiens
agagaaaaaguuuaaaaauaacucccaagauuuuuagucugagcaacuggacgaauugccauuugcug

SEQ ID NO: 126006 - RNA, 105 nt, Homo sapiens
gagacuuuaagacaugagacuggaagagauccuugaguaacggagaggcaugggaucuagggcacagguggaagggguaacuuagauaacacacagacaguucag

SEQ ID NO: 126007 - RNA, 39 nt, Homo sapiens
uuuaaaaaaauggccauucuuaucuuuacccccaaaucc

SEQ ID NO: 126008 - RNA, 77 nt, Homo sapiens
ccuuccauaucauucuuccuguggcuacaaacuaggauucacagcuagcucaaauaaaaacagaaauaaaaggagag

SEQ ID NO: 126009 - RNA, 120 nt, Homo sapiens
agaucucauagucugcaggaauggauucugacaauaaagaccuugcauuuacucuguuccuugugccugggguuuuuaauuuaacacaucaaugaaaaggcaccauuuaaaaaagggggg

SEQ ID NO: 126010 - RNA, 48 nt, Homo sapiens
cugcacuuaaugagaaaaucauuaagcaugaaaaaaugggcucugacu

SEQ ID NO: 126011 - RNA, 47 nt, Homo sapiens
uauaaugugugacagaugagggaaccuacugcuuuuugggcucuguc

SEQ ID NO: 126012 - RNA, 42 nt, Homo sapiens
aguagaauuaggggagggacuagaggaucuguuuucugugaa

SEQ ID NO: 126013 - RNA, 56 nt, Homo sapiens
aaauucugggggaaaauaaaauaacaacaacagcaguuuuaaaaauaacuacaacc

SEQ ID NO: 126014 - RNA, 56 nt, Homo sapiens
caguggagcuaaaaaugacuuaaauucauguuacuaucacugucauuucugagaug

SEQ ID NO: 126015 - RNA, 66 nt, Homo sapiens
ggaaauauauauugguauaauuauugagaaagauuuuaugaagacaggaguagggaucuaaauguc

SEQ ID NO: 126016 - RNA, 46 nt, Homo sapiens
caaauuauguauaggcuuuuauaucucuagguaagaagugagcaag

SEQ ID NO: 126017 - RNA, 89 nt, Homo sapiens
ggagugucuuauaacaccucugugcaugguugccacccaguguccuuaaaaauacuaggucacauuauaucucuuaaaaaaaauaaaag

SEQ ID NO: 126018 - RNA, 45 nt, Homo sapiens
aagccucuggaaguucugucacagcugaggaagccaaaaagguau

SEQ ID NO: 126019 - RNA, 50 nt, Homo sapiens
cuucaguaccccuagagcaugcuguugaaccccauagugcgcaaacuuag

SEQ ID NO: 126020 - RNA, 69 nt, Homo sapiens
gcucgggcaguuaaaauggagcagagggaagcaacggagacucagaaaauaacuauacacacuaaggga

SEQ ID NO: 126021 - RNA, 95 nt, Homo sapiens
gagcuuggucuggggcuggugaauaggaaucuguuagggaagugacagaugcaaagcuggaaauguuaaucagauggcuaaauucaggccaaaau

SEQ ID NO: 126022 - RNA, 59 nt, Homo sapiens
uuaaauaucuucaauuuucaacucaagaaaggcauuuggcagaaaccauguuuggaaaa

SEQ ID NO: 126023 - RNA, 44 nt, Homo sapiens
aguccugauaucacgaaaaucaugcagggguuaaugacaaugag

SEQ ID NO: 126024 - RNA, 53 nt, Homo sapiens
guaugauaauaacccggaaaaccccaaauaaaaacccauuugagaaucuagga

SEQ ID NO: 126025 - RNA, 48 nt, Homo sapiens
ugaaagauuuccauaaaaggaaucaaacaaccuuccaagcucacucau

SEQ ID NO: 126026 - RNA, 46 nt, Homo sapiens
uucauggugucggcuauauuguucauucagauuaauccucucccuu

SEQ ID NO: 126027 - RNA, 44 nt, Homo sapiens
ucuguggaaugaauacacacauauauauuacaagggauaauuua

SEQ ID NO: 126028 - RNA, 44 nt, Homo sapiens
caagugaguagcgaaccauuuucacagauuaccucaggcugcuu

SEQ ID NO: 126029 - RNA, 86 nt, Homo sapiens
caccgaccuuguguccagccccacugcuuggccugcgcacaccugccaacuccaccauuguaacgucggaaugguacacacuguuu

SEQ ID NO: 126030 - RNA, 49 nt, Homo sapiens
aggcggaggggcgggggcgccuuggcugggccuggcgcgcuccagccgg

SEQ ID NO: 126031 - RNA, 45 nt, Homo sapiens
ccaacgaaaccagugcccagggcuggccgcgcgcuccgaaggccc

SEQ ID NO: 126032 - RNA, 67 nt, Homo sapiens
cgguaaauacgggacccgcuauggggccucccuccggaaaauggugaagaaaauugaaaucagccag

SEQ ID NO: 126033 - RNA, 46 nt, Homo sapiens
cuggcugauuucaauuuucuucaccauuuuccggagggaggcccca

SEQ ID NO: 126034 - RNA, 50 nt, Homo sapiens
agacguuuuucauuuaaagaaaaccgcuuaaacguuaauggguaaaauaa

SEQ ID NO: 126035 - RNA, 55 nt, Homo sapiens
ggaguuggugcagaaacaucaguagacaaaacugauggaaucauuucccacaaag

SEQ ID NO: 126036 - RNA, 46 nt, Homo sapiens
ggaaguguguggaccacauaggcccaaauuccagguugcugcugga

SEQ ID NO: 126037 - RNA, 53 nt, Homo sapiens
ugaaggaguugaaagaccaguagacgcuccucuacucuuugagacaucacugg

SEQ ID NO: 126038 - RNA, 43 nt, Homo sapiens
uuuagcauuuuguacuuaaggaaauaaaaaaccaacaaaggau

SEQ ID NO: 126039 - RNA, 40 nt, Homo sapiens
ugcuauccaugugggcuacggugugacaguggcgguagag

SEQ ID NO: 126040 - RNA, 46 nt, Homo sapiens
cugguggaguggggugagcgggcacagggaagcugggguccccuuc

SEQ ID NO: 126041 - RNA, 81 nt, Homo sapiens
ccaccucuguggccuccaugguacccccacagggcuggccuccccuagagggugggccucaaccaccugcucccgccacgc

SEQ ID NO: 126042 - RNA, 80 nt, Homo sapiens
uggcgggagcaggugguugaggcccacccucuaggggaggccagcccuguggggguaccauggaggccacagagguggug

SEQ ID NO: 126043 - RNA, 68 nt, Homo sapiens
aucagaaaagggccucccuggaccucgugcgccugccuuccuccccucauggggccaguguccccagg

SEQ ID NO: 126044 - RNA, 48 nt, Homo sapiens
aggaaggagggucaguccuggcugggcuucccuaucuccuggcagucg

SEQ ID NO: 126045 - RNA, 51 nt, Homo sapiens
cuccaccagugaggaagaugccucugucuuucccacgacugccaggagaua

SEQ ID NO: 126046 - RNA, 42 nt, Homo sapiens
ggggagauccugggaagggaggcacuggaggaagacggcacc

SEQ ID NO: 126047 - RNA, 46 nt, Homo sapiens
ugggcagcuggucacuccccagagaagcugggccuucauggacaca

SEQ ID NO: 126048 - RNA, 57 nt, Homo sapiens
ggugggggauuagagccugguguaagugcgccagacucuuccgguuuccaaaguucg

SEQ ID NO: 126049 - RNA, 44 nt, Homo sapiens
cagcaugccccaucucucugcacagcuguccccuaaacccaacu

SEQ ID NO: 126050 - RNA, 47 nt, Homo sapiens
uugcucauggcaugacacagcggagaccgccuccaacaacgaauuug

SEQ ID NO: 126051 - RNA, 45 nt, Homo sapiens
gucccugcauccucccugggguggaggauggaaggaaagcuggga

SEQ ID NO: 126052 - RNA, 55 nt, Homo sapiens
ccccaccauauguauuuucuaggauuugagaggaaagagaggaaaaugggggaau

SEQ ID NO: 126053 - RNA, 48 nt, Homo sapiens
cacucuccaugcuggcagagcaggagggagacugaaguaagagauggc

SEQ ID NO: 126054 - RNA, 49 nt, Homo sapiens
ccuguugggcucauguggugugguguccggagacugugacuuccugagg

SEQ ID NO: 126055 - RNA, 108 nt, Homo sapiens
gaggccagcccuccguggugcacacagcacgcgccucaguccaucccauuuuagucuuuaaacccucaggaagucacagucuccggacaccacaccacaugagcccaa

SEQ ID NO: 126056 - RNA, 45 nt, Homo sapiens
guuugcauuaacuuuucaaaguaguuccuauaggggcauugagga

SEQ ID NO: 126057 - RNA, 46 nt, Homo sapiens
caacacucugcccagguaagaggagaggaaguucagggguccagcu

SEQ ID NO: 126058 - RNA, 67 nt, Homo sapiens
cacguccagcccuggccuggggucgggagaggugggcgcuagaagaugcagcccaggauguggcaau

SEQ ID NO: 126059 - RNA, 45 nt, Homo sapiens
ggcaaguuggaugaacagagaagggaagagaggaagaacgagagg

SEQ ID NO: 126060 - RNA, 41 nt, Homo sapiens
uggugccccgugcuguguaccugcccaauugugaccgcaaa

SEQ ID NO: 126061 - RNA, 40 nt, Homo sapiens
cacguaccagguaccugggcccugcagcuguguccagucc

SEQ ID NO: 126062 - RNA, 49 nt, Homo sapiens
ggaaguuucuggcaugcuuggagucaagcagagagugcaggcagggagg

SEQ ID NO: 126063 - RNA, 46 nt, Homo sapiens
ggcaggaggaagggagaagcauggcugguuuggggacuuuguacaa

SEQ ID NO: 126064 - RNA, 49 nt, Homo sapiens
aucagaacaguucuacccccuuagacugaguuucuuuuuggaaagaguu

SEQ ID NO: 126065 - RNA, 51 nt, Homo sapiens
gcggugagcaacaccaucuucucuuagucgcccccuuuaccucgggguggg

SEQ ID NO: 126066 - RNA, 61 nt, Homo sapiens
gcuuucuaacccucagcugccagcggugcgcggcgccgcagaacagguaagaggcguuggc

SEQ ID NO: 126067 - RNA, 31 nt, Homo sapiens
agggagaggaaggagaaguugggagccaagu

SEQ ID NO: 126068 - RNA, 44 nt, Homo sapiens
uggggaaagggguuugugggaggggccugggcugggggcccggg

SEQ ID NO: 126069 - RNA, 42 nt, Homo sapiens
ugagacuguggccucccagcccagccugggagaaggggagga

SEQ ID NO: 126070 - RNA, 26 nt, Homo sapiens
agagcugugguaggcuaugaagaugg

SEQ ID NO: 126071 - RNA, 35 nt, Homo sapiens
cgggaggcgguaagagguacggagagaagcaugag

SEQ ID NO: 126072 - RNA, 40 nt, Homo sapiens
gcuggccagagaccgugcgguaagggagggccaaggggau

SEQ ID NO: 126073 - RNA, 77 nt, Homo sapiens
guucuaccaccucgauaaucucuucaucaccauggaagcuuagggucuccagugggggggugucagcagcagccccg

SEQ ID NO: 126074 - RNA, 30 nt, Homo sapiens; identical to SEQ ID NO: 24000

SEQ ID NO: 126075 - RNA, 45 nt, Homo sapiens
gcucugcgggcuucugggagauguaguuucuggucuguaggcagg

SEQ ID NO: 126076 - RNA, 31 nt, Homo sapiens
aauaaagagaaucaaagaagguauucagggu

SEQ ID NO: 126077 - RNA, 45 nt, Homo sapiens
agggauacaacuauaaauguaauaaaguuuaugucuagaaguuaa

SEQ ID NO: 126078 - RNA, 46 nt, Homo sapiens
agucugucgggugggggcagaaaucaaaucagcccaaggauauagu

SEQ ID NO: 126079 - RNA, 104 nt, Homo sapiens
acugugguacugaagacuucuggguucuuuccuucugcuaacccagggaggguccuaagaggaaggugacuucucucuguuugucuuaaguugcacugggggau

SEQ ID NO: 126080 - RNA, 47 nt, Homo sapiens
aggggcagagucauacguguggccaggaaguagccagggugaagaga

SEQ ID NO: 126081 - RNA, 35 nt, Homo sapiens
cccgccaccuacuguaugacaccacauucuuccua

SEQ ID NO: 126082 - RNA, 27 nt, Homo sapiens
ugggggaucgcaauuaaggagcaagcc

SEQ ID NO: 126083 - RNA, 53 nt, Homo sapiens
ggggaaccggaagcacaccaucagccccgaggacuacaucacuggcgcccugc

SEQ ID NO: 126084 - RNA, 75 nt, Homo sapiens
uucucggaggcagacugggagaggaacccagaggacugagaugaugggccuagguggaagggaccuugcgggggu

SEQ ID NO: 126085 - RNA, 50 nt, Homo sapiens
ggggaguggccaugguggccucugccagagcuggggaacgccaccaaguu

SEQ ID NO: 126086 - RNA, 36 nt, Homo sapiens
augauguuccaugggaaacggcgucugaagggaaag

SEQ ID NO: 126087 - RNA, 50 nt, Homo sapiens
uggaggguaacaaagacagaaacagagggagagaucucaacagagaagau

SEQ ID NO: 126088 - RNA, 64 nt, Homo sapiens
uccuccugcuuuccuauggcuggggagcugcacagugagaggccuguggacaagaagcaggcgc

SEQ ID NO: 126089 - RNA, 37 nt, Homo sapiens
auacccccaggagagccccagccggggccucaguagg

SEQ ID NO: 126090 - RNA, 25 nt, Homo sapiens
guagugacccccugguguagguucu

SEQ ID NO: 126091 - RNA, 45 nt, Homo sapiens
cuaucaguaucauguauugccuuuaaauccgaaaauaccccugug

SEQ ID NO: 126092 - RNA, 49 nt, Homo sapiens
cuccaggucugucuggguuuucuggauuaaacccagauucagguauugg

SEQ ID NO: 126093 - RNA, 53 nt, Homo sapiens
gcgcgcugggagaggggacugggaggcgggggcuggagcugggggugggcgug

SEQ ID NO: 126094 - RNA, 48 nt, Homo sapiens
agaagccacugaguuggggggccugagggauuuggggggcuggacaau

SEQ ID NO: 126095 - RNA, 62 nt, Homo sapiens
ugccacagaaugggcuggagaccaggaagcuggacagggggauagugcaggagccagggcug

SEQ ID NO: 126096 - RNA, 52 nt, Homo sapiens
aacuucucugugccuuaguuguuugcaucuauaaagugggguuggggaugcc

SEQ ID NO: 126097 - RNA, 79 nt, Homo sapiens
uaccucauagggcuccugugaagaucaaaugaaaccgcaucuaaaauacacagggccuggcucaaaaagaguguucagg

SEQ ID NO: 126098 - RNA, 51 nt, Homo sapiens
ccgcccuuucacucuugggagcacgggauuaucacugggcgguacaggagg

SEQ ID NO: 126099 - RNA, 42 nt, Homo sapiens
cggaaucgcuacccuaaaggccacucgaaaacccagccccgc

SEQ ID NO: 126100 - RNA, 45 nt, Homo sapiens
ucaucgacacccaggcccagcuggcuguggcuguggacccuucag

SEQ ID NO: 126101 - RNA, 39 nt, Homo sapiens
uagccuggggaagggggguacagggcauggcugggcaga

SEQ ID NO: 126102 - RNA, 28 nt, Homo sapiens
aauuaguuuccccuggguggagacuggu

SEQ ID NO: 126103 - RNA, 46 nt, Homo sapiens
acugccuggcgcuacaggaggcucuggggccggggccgggccccac

SEQ ID NO: 126104 - RNA, 45 nt, Homo sapiens
aaggauaugcacaagagcaagugaugcccccagcgcccccagccc

SEQ ID NO: 126105 - RNA, 53 nt, Homo sapiens
ccacacugcucaggggaggggagggaucaggcgaugagacugugaggccaaaa

SEQ ID NO: 126106 - RNA, 43 nt, Homo sapiens
cugcccucaguuuccccucaugaucuggccucugcccccuucu

SEQ ID NO: 126107 - RNA, 51 nt, Homo sapiens
cacuuuagcaauaccaccagacuaguuagaguuccccacucaccaagcaag

SEQ ID NO: 126108 - RNA, 36 nt, Homo sapiens
caucaagguacuucccagggccccagccuugaccca

SEQ ID NO: 126109 - RNA, 46 nt, Homo sapiens
accuauguaagggguccccuugggcaggggacuuggcuugggagcg

SEQ ID NO: 126110 - RNA, 66 nt, Homo sapiens
cuuccuagcuugcagacaagugccuucucaauguguccucacauggccuuucuuccgugcaugagu

SEQ ID NO: 126111 - RNA, 45 nt, Homo sapiens
ccccugguaugggaggaggauauggagcucuauucgaaguuccug

SEQ ID NO: 126112 - RNA, 46 nt, Homo sapiens
gcaggacuugguggggggaacagggaauuggggaugggagggaggc

SEQ ID NO: 126113 - RNA, 46 nt, Homo sapiens
gaggcacccaaagggaggggagugccacgccccuaaagguacccgu

SEQ ID NO: 126114 - RNA, 77 nt, Homo sapiens
aaucagcaaagguugggcgaaacccagaaagcuaugcuagauccccccaagcccagucgaggucccuggcgacagcc

SEQ ID NO: 126115 - RNA, 43 nt, Homo sapiens
aggguccuucccucugaaguugaaguauuggaguccaucuauc

SEQ ID NO: 126116 - RNA, 45 nt, Homo sapiens
gcagcugucgcagacgguccguacggcgggcgugugggguggagc

SEQ ID NO: 126117 - RNA, 45 nt, Homo sapiens
cacucagcuucugguguccugggaggaacugaaacagggcagggg

SEQ ID NO: 126118 - RNA, 42 nt, Homo sapiens
caagugaaccagaggagacccuaagccgggaccuaggggagg

SEQ ID NO: 126119 - RNA, 42 nt, Homo sapiens
gcacccugucaccuccacuuugccuuguuggaagugacccag

SEQ ID NO: 126120 - RNA, 46 nt, Homo sapiens
ccuaccacucugggguggggcaguguguggggaagcuggcugucgg

SEQ ID NO: 126121 - RNA, 44 nt, Homo sapiens
aauuuuccauuuggguuaguggaugugaacagggcuagggaagu

SEQ ID NO: 126122 - RNA, 47 nt, Homo sapiens
cccugccucaucucuauucucauuccacuaugccccaagcccuggug

SEQ ID NO: 126123 - RNA, 42 nt, Homo sapiens
acuaacaucugugcagguguugacuugaaaaauaaaguguug

SEQ ID NO: 126124 - RNA, 45 nt, Homo sapiens
ugcuuguagaagccacagcuugugcucuggagauggcagcaaguc

SEQ ID NO: 126125 - RNA, 44 nt, Homo sapiens
cagacauugaagagguggaggucagaggugugaaggggaaaaag

SEQ ID NO: 126126 - RNA, 47 nt, Homo sapiens
caacgcuauauuuugacacuaaaaaagaagguuucuaaauuguagga

SEQ ID NO: 126127 - RNA, 52 nt, Homo sapiens
gguugguaauggagauagucuucagcuucugguugauaccugcuagccccau

SEQ ID NO: 126128 - RNA, 31 nt, Homo sapiens
gugggcaagggagccuuuuacugagagugau

SEQ ID NO: 126129 - RNA, 45 nt, Homo sapiens
cauuuucagggagcagacccccuugggcgaggcuagcagcugcuc

SEQ ID NO: 126130 - RNA, 46 nt, Homo sapiens
uguucauuuuggaagaguugcugagccccauugucacaccccucau

SEQ ID NO: 126131 - RNA, 88 nt, Homo sapiens
uagguccuuuaucccggaccagcacaugguguucugcccugagcagcugcuccgcgugauccucgcucacauccacuacaugccugac

SEQ ID NO: 126132 - RNA, 48 nt, Homo sapiens
gaagauguguuggcuguggaacaugugcugaccaccgucacacuccug

SEQ ID NO: 126133 - RNA, 47 nt, Homo sapiens
cugcagucccgccucaaccguggcuacaagcccgccuccaaguacau

SEQ ID NO: 126134 - RNA, 44 nt, Homo sapiens
aucgcuaacuuccugcugugcccccucauccucauauggcaaau

SEQ ID NO: 126135 - RNA, 47 nt, Homo sapiens
ccuggcucucuguuucucaaugaauggagccucaaggccgaguacaa

SEQ ID NO: 126136 - RNA, 45 nt, Homo sapiens
gccuugaggcuccauucauugagaaacagagagccagguccccag

SEQ ID NO: 126137 - RNA, 43 nt, Homo sapiens
ccaccuuccguaccuugucucuuccccaccccaccccgcaguc

SEQ ID NO: 126138 - RNA, 45 nt, Homo sapiens
cuuagacuaugggcuaacugcccaacuucccagucuuaccauagg

SEQ ID NO: 126139 - RNA, 46 nt, Homo sapiens
cucugccagacgccuuuuugccugcucaagucuguagugccaggua

SEQ ID NO: 126140 - RNA, 41 nt, Homo sapiens
ccccaccucccaccagagccccggcuuagagagacauuaaa

SEQ ID NO: 126141 - RNA, 41 nt, Homo sapiens
gacucuucuguccguuaaauagaagaugaaacagcccccaa

SEQ ID NO: 126142 - RNA, 23 nt, Homo sapiens
gccugacaucuucuccuccagca

SEQ ID NO: 126143 - RNA, 23 nt, Homo sapiens
guggaucuuggcccagccuggcc

SEQ ID NO: 126144 - RNA, 46 nt, Homo sapiens
ggccccgugucuggccuugcccaggggugccugcggagcccuaagu

SEQ ID NO: 126145 - RNA, 47 nt, Homo sapiens
gcugcugguggcucuggcuguggcucugugugugcggcagcaugcgc

SEQ ID NO: 126146 - RNA, 46 nt, Homo sapiens
cagagggaggaggcagcugcaguccuuccccaaacugcgcacagca

SEQ ID NO: 126147 - RNA, 42 nt, Homo sapiens
cagcccgcacaucccccaugccuggacaccccacugccagcc

SEQ ID NO: 126148 - RNA, 45 nt, Homo sapiens
ggagcaaggggguaggguggcaagcuuaggaguuagaucaggaaa

SEQ ID NO: 126149 - RNA, 46 nt, Homo sapiens
gggccccgugaucaaggugaacagcaagcaacgcuaugcuucaaac

SEQ ID NO: 126150 - RNA, 47 nt, Homo sapiens
cuauugcuagaggcugcccggaacccuguguguggaaugacucugaa

SEQ ID NO: 126151 - RNA, 46 nt, Homo sapiens
ucaugaucagcgcagacauggcccaugcugugcaucccaacuaccu

SEQ ID NO: 126152 - RNA, 42 nt, Homo sapiens
gcccauucuucgcaucccacaccuggccauccaucugcagcg

SEQ ID NO: 126153 - RNA, 52 nt, Homo sapiens
ggaggaggguggaggcugaugcgcccuucaccagcuuccaucgcugugagag

SEQ ID NO: 126154 - RNA, 55 nt, Homo sapiens
uuccacacacauuuagaggcacaguguuggguggcuuuggguuauuuguuuuucg

SEQ ID NO: 126155 - RNA, 50 nt, Homo sapiens
uccccucccagcgaagccgggcagggaugaggggucugagaugagggagg

SEQ ID NO: 126156 - RNA, 43 nt, Homo sapiens
uggccaguggcaggugcagggucucuggcugccgccagggcuc

SEQ ID NO: 126157 - RNA, 49 nt, Homo sapiens
aggguuuauuggacagagucaguugugggguucagagggucagcaauca

SEQ ID NO: 126158 - RNA, 53 nt, Homo sapiens
uuugcuguccaauauucaggguucacuauugggguucagggcuuaauaucuag

SEQ ID NO: 126159 - RNA, 36 nt, Homo sapiens
uugggaauuugaggcuucaguauuuugagguuuggg

SEQ ID NO: 126160 - RNA, 45 nt, Homo sapiens
caaaccauuguuuccuguggcaggggucccuaugauccaacacca

SEQ ID NO: 126161 - RNA, 40 nt, Homo sapiens
aguggcagagcugcaugccaggugcuguagcggagggaaa

SEQ ID NO: 126162 - RNA, 42 nt, Homo sapiens
gcccccucggcuguggugagcacuggucccagccccagggag

SEQ ID NO: 126163 - RNA, 50 nt, Homo sapiens
ggccuggggacuccuggguuuucucccucccgacucccuaauaaaccccg

SEQ ID NO: 126164 - RNA, 44 nt, Homo sapiens
ugggaggggaggauccaagacagugaggagaagaguggacagag

SEQ ID NO: 126165 - RNA, 35 nt, Homo sapiens
agagagaagucauuucacuuucucaaaguggguga

SEQ ID NO: 126166 - RNA, 45 nt, Homo sapiens
ugccggggacuguggcaacacugcgguuccagcugcugcccccug

SEQ ID NO: 126167 - RNA, 41 nt, Homo sapiens
gugcuagagacacagcugagugcuggggcgagcgcgggcau

SEQ ID NO: 126168 - RNA, 56 nt, Homo sapiens
gacaugagaggaguggguggccagggauggguugggggccaagugacuggggagug

SEQ ID NO: 126169 - RNA, 43 nt, Homo sapiens
uggacaagaggaaucuggaagccuagagccacaggugggauga

SEQ ID NO: 126170 - RNA, 49 nt, Homo sapiens
auaaucauuauuguguagcaagguacuaaauacaguagauagaagcacg

SEQ ID NO: 126171 - RNA, 87 nt, Homo sapiens
augucagaggaggucagggcggagccacaggaggaggaagaggagaaggaggggaaggaggagaaggaggagggggagaugguggaa

SEQ ID NO: 126172 - RNA, 47 nt, Homo sapiens
ggaaaguggcucuguguaggggagugugaagggggagcccuagggag

SEQ ID NO: 126173 - RNA, 73 nt, Homo sapiens
ccaagucuguaagagggcauaagagcagguccugguuguguuuggcccagucugagagggccuagaguuagaa

SEQ ID NO: 126174 - RNA, 46 nt, Homo sapiens
cugcucuucuacgaugagguguguauguguaucuccagugagaggg

SEQ ID NO: 126175 - RNA, 45 nt, Homo sapiens
uggaguuagacauagauuuucuauuuuguuuuaauuugucaaggu

SEQ ID NO: 126176 - RNA, 46 nt, Homo sapiens
agaaaugagguugacucuucugagcaguucaucuuuuccagaggua

SEQ ID NO: 126177 - RNA, 61 nt, Homo sapiens
ggagauggaaugugucugguaaccccaaauggaguacaaguagccuuuguuuuccugcaua

SEQ ID NO: 126178 - RNA, 43 nt, Homo sapiens
gacuaaauaugagcugacuaucucuuuugauguguguacauag

SEQ ID NO: 126179 - RNA, 46 nt, Homo sapiens
uuuauuuauauguauuuccauauuucauuccugugugucacugcug

SEQ ID NO: 126180 - RNA, 41 nt, Homo sapiens
cuuggccucacagcccuuccuguugauuacaaagcccgugg

SEQ ID NO: 126181 - RNA, 22 nt, Homo sapiens
ugguugacaguuggcucgcaau

SEQ ID NO: 126182 - RNA, 43 nt, Homo sapiens
cuguccugcuccaggaaacuccauccccaaacagggccaaaga

SEQ ID NO: 126183 - RNA, 46 nt, Homo sapiens
uucagugcucaagccgccugguggauuccuaugacacagggggccu

SEQ ID NO: 126184 - RNA, 74 nt, Homo sapiens
uuugagcaguguccaggcaaugcgaacccaaaugcagcagaugcacggcagaaugguucccgucugagccagua

SEQ ID NO: 126185 - RNA, 73 nt, Homo sapiens
aggaaauagaauuaagaaaaaauaggaugauugauacaugcuuuagcagcuuugugaaguuaagagcaaaaua

SEQ ID NO: 126186 - RNA, 45 nt, Homo sapiens
ucaacauguuggacaaacucauccgcaaccccaacagcuugaaga

SEQ ID NO: 126187 - RNA, 58 nt, Homo sapiens
guaguuacuguaauuauucgauacuuaagcuuucuuuuucuuccguugaaaucauggc

SEQ ID NO: 126188 - RNA, 19 nt, Homo sapiens
ugacaguuagagccacgug

SEQ ID NO: 126189 - RNA, 46 nt, Homo sapiens
aauaagauuccagaguaauagaauuuaauuacaaacaucuccagug

SEQ ID NO: 126190 - RNA, 42 nt, Homo sapiens
uuuaaagcuggcaucguuguaauuagagcucaccccuugagg

SEQ ID NO: 126191 - RNA, 66 nt, Homo sapiens
cuagcaagcuaguucaacauuacaaccaaugacuauugauuucaaggacaagaauuaaauggccua

SEQ ID NO: 126192 - RNA, 64 nt, Homo sapiens
augauggagugggcacgggguuugaaaugauacauuaaacucaaauuucuuaauacagauauau

SEQ ID NO: 126193 - RNA, 80 nt, Homo sapiens
uacugcaauguaucaaagcaauuuccaguacaauuuauuguccuguuucguagcccuaccuaagaaagcaaagaaaccuu

SEQ ID NO: 126194 - RNA, 31 nt, Homo sapiens
aaaaacucaagcaaucaagaaauaucacaaa

SEQ ID NO: 126195 - RNA, 65 nt, Homo sapiens
uuucucuuucaguuuucucaucuguaaaauggagguaaaaagagcauuugccuuauaagguuauu

SEQ ID NO: 126196 - RNA, 50 nt, Homo sapiens
aagaaauugacgcauccugcauuaagauugaaaaaguuauaggaguuggu

SEQ ID NO: 126197 - RNA, 43 nt, Homo sapiens
agacuauuuauguuuauuagugguuccuuagaaguauucagcc

SEQ ID NO: 126198 - RNA, 45 nt, Homo sapiens
uuaaaaaucuuguccuugaagugugaagacauuccaggaagucag

SEQ ID NO: 126199 - RNA, 54 nt, Homo sapiens
uuuaaaaaaauuuuaauagacggaguaaauacaguaaagccaaacaagaagcgg

SEQ ID NO: 126200 - RNA, 46 nt, Homo sapiens
ggguuuccauuuauguuaggguuauaaaguaccccuuuuaccugga

SEQ ID NO: 126201 - RNA, 43 nt, Homo sapiens
uuauucaaaugugaaaaacaauuuuaagaaaagucuagaauac

SEQ ID NO: 126202 - RNA, 46 nt, Homo sapiens
aggacuguucacagugacauccuaaaauacaauuauaaggucauaa

SEQ ID NO: 126203 - RNA, 46 nt, Homo sapiens
ucauuuauuucauuguacacaugcagcuuauagggagaagccugag

SEQ ID NO: 126204 - RNA, 46 nt, Homo sapiens
ggugcuggugguaauucucauugcagcuuuugucaucagccggagg

SEQ ID NO: 126205 - RNA, 48 nt, Homo sapiens
aggcuauuuuuauaauacagcugaaucccauuacagugaaaucuaagg

SEQ ID NO: 126206 - RNA, 46 nt, Homo sapiens
agaagucacaagauacaguguggcacuggcuuggcuggaaccagau

SEQ ID NO: 126207 - RNA, 50 nt, Homo sapiens
guguguguguugggagaagggggccuuaaugaauguaaugagcacauuuc

SEQ ID NO: 126208 - RNA, 45 nt, Homo sapiens
ucuccauuuuuaugacagcugugucaagguacacucuguugguuu

SEQ ID NO: 126209 - RNA, 46 nt, Homo sapiens
agucauuggagauuuugcuguaaagguuugaaaauuaaggacucca

SEQ ID NO: 126210 - RNA, 39 nt, Homo sapiens
ggucauuaaccucccucuggcuuguggguucaagaaaau

SEQ ID NO: 126211 - RNA, 43 nt, Homo sapiens
uuuauuuuuuguuguuguugcuaguuucaccccauuuucuuac

SEQ ID NO: 126212 - RNA, 60 nt, Homo sapiens
auuggcuaugaaaauuauuacuuuucauuuguuuguguguuuggagguugauuaccuagu

SEQ ID NO: 126213 - RNA, 80 nt, Homo sapiens
ucaccccaauggccuucuuccuguuucucucucucucucucucucucccccccgcccuuucucucucugucucucucccc

SEQ ID NO: 126214 - RNA, 23 nt, Homo sapiens
uaauuuaacccaaaggucucuau

SEQ ID NO: 126215 - RNA, 40 nt, Homo sapiens
cuaagaaaaugaagucuuuauuuauacacccaggacugag

SEQ ID NO: 126216 - RNA, 29 nt, Homo sapiens
uuugcgcauccucaguuguuaguagggaa

SEQ ID NO: 126217 - RNA, 42 nt, Homo sapiens
uggcccacaguuagguaugaggggcaccucuggaguggaccu

SEQ ID NO: 126218 - RNA, 45 nt, Homo sapiens
ggaguuuaaagcuuaaacaacuauugugugauuaagggugaaaac

SEQ ID NO: 126219 - RNA, 45 nt, Homo sapiens
cugccaucuuuuaauuagacauauuauguuauuugagugggauaa

SEQ ID NO: 126220 - RNA, 47 nt, Homo sapiens
uguacaguuccaucuguuuguugauuaacauuuauuuacaguaaaau

SEQ ID NO: 126221 - RNA, 46 nt, Homo sapiens
ggauuugagccaagaaguuaugucaacaccuacuggggcaaaaggu

SEQ ID NO: 126222 - RNA, 64 nt, Homo sapiens
uugcuauaauugaaauagaaucaaucaagccugggagcugcguuauaauguaaaagauacuuag

SEQ ID NO: 126223 - RNA, 42 nt, Homo sapiens
agaccaccaaagucuccaucacugaccuccuagcucauacca

SEQ ID NO: 126224 - RNA, 46 nt, Homo sapiens
aaaugucaacgagacaucugugaacuuggaauggaguagcccucag

SEQ ID NO: 126225 - RNA, 40 nt, Homo sapiens
ugggaacuagaaucacuuucauuuuuuuagaugauaagau

SEQ ID NO: 126226 - RNA, 46 nt, Homo sapiens
uuaauuuuauuugcuauugaugacaugcuguacuuaggaauuauaa

SEQ ID NO: 126227 - RNA, 26 nt, Homo sapiens
uuuuuccucucuccucuaaagcaggu

SEQ ID NO: 126228 - RNA, 81 nt, Homo sapiens
uugauaaaaccuuauuugauagaacccacauuucaaauucccagccgucgcugguuacacagcuguaaaaacaggacaagg

SEQ ID NO: 126229 - RNA, 46 nt, Homo sapiens
uuuagugaggugacagcagugcuuaaauacaucgaucaugggagag

SEQ ID NO: 126230 - RNA, 46 nt, Homo sapiens
cagccauaaacaagucauccuaauaaaaagaaaccaaaccccuaau

SEQ ID NO: 126231 - RNA, 56 nt, Homo sapiens
uauggaagcaccaucggaacauuuucuggaaaauagcccauaacuauuuagaacag

SEQ ID NO: 126232 - RNA, 46 nt, Homo sapiens
uuagaccaggugaauaaaaguagcauuggcuaauuuagaaggaaac

SEQ ID NO: 126233 - RNA, 49 nt, Homo sapiens
uguugcuggaacauuugauguauguguaauaaggcugugguaguugagc

SEQ ID NO: 126234 - RNA, 45 nt, Homo sapiens
ggcacuugagaucaaacauucauccuuucucaaucauagcagggg

SEQ ID NO: 126235 - RNA, 51 nt, Homo sapiens
uagguccuucuccccacugcuguuucugauaguauagacaaguccuaagga

SEQ ID NO: 126236 - RNA, 42 nt, Homo sapiens
gcucacaaagucauuaguauucaaaaauacagcauagcaguu

SEQ ID NO: 126237 - RNA, 46 nt, Homo sapiens
cucuaauggaagaauuagaacaaagguuagaauaagaauaagggau

SEQ ID NO: 126238 - RNA, 48 nt, Homo sapiens
aaaaguuaauuuuaaauuuugauaauggucaguaaacgaaaugggaga

SEQ ID NO: 126239 - RNA, 45 nt, Homo sapiens
cuuuuuuucucucuccagcacuccuuccagguaaauaagacaaua

SEQ ID NO: 126240 - RNA, 44 nt, Homo sapiens
uuuuuuuaucuagaaaauaaaaugggaaacacaguaucuaauag

SEQ ID NO: 126241 - RNA, 30 nt, Homo sapiens
uuaauaagaauccucuaaaccaagagaaca

SEQ ID NO: 126242 - RNA, 49 nt, Homo sapiens
uucucuccccuucuucuuaauauuuucugaugagagacucggcagguga

SEQ ID NO: 126243 - RNA, 65 nt, Homo sapiens
aacaacagauaagguuugucugcugugugcacagagaaggaaggggaggggaaacggcgggguug

SEQ ID NO: 126244 - RNA, 55 nt, Homo sapiens
uguggugauucaaagggaauaagauuaaggugagcaguugguggcugggauuuau

SEQ ID NO: 126245 - RNA, 46 nt, Homo sapiens
cccccaaacccaaaucauauacccaaagcccucagcccucagauuu

SEQ ID NO: 126246 - RNA, 74 nt, Homo sapiens
ucuuuaaagacucucacguucucugagaaaaaaaucauggccuucgcacaaaaacaagaagauucuauuuagau

SEQ ID NO: 126247 - RNA, 46 nt, Homo sapiens
uucaaauauuagcaaagguccacaaacagaaauagagaaaccagau

SEQ ID NO: 126248 - RNA, 47 nt, Homo sapiens
ggcuauugaguuugauuaugggcauaaaauuaaauuuucagcuaaau

SEQ ID NO: 126249 - RNA, 49 nt, Homo sapiens
uaugcuuagauuggaugcugugaauauaugcuuucuggucaacaaaaaa

SEQ ID NO: 126250 - RNA, 30 nt, Homo sapiens
gcccacaccacuaaggcugacucuggauga

SEQ ID NO: 126251 - RNA, 47 nt, Homo sapiens
auugacagcuucaggaaagcuuuagccguucauguaauuauggagag

SEQ ID NO: 126252 - RNA, 50 nt, Homo sapiens
cugucucccuccuccccacuccccccagugucuccaaauuuacuuauuuu

SEQ ID NO: 126253 - RNA, 35 nt, Homo sapiens
aaauuguaaaguaaaagauacaauucuuugaaaaa

SEQ ID NO: 126254 - RNA, 47 nt, Homo sapiens
uugucuguuuagugacagcuucagcuggaaucuugcuguucuuucug

SEQ ID NO: 126255 - RNA, 44 nt, Homo sapiens
acauguugguacugcuuacaacucccuuuggagaccucagccuu

SEQ ID NO: 126256 - RNA, 30 nt, Homo sapiens
uuuaaaaaugaaaaugaaaucaagcccuaa

SEQ ID NO: 126257 - RNA, 77 nt, Homo sapiens
uacacaacugcaaccaaccacuuuacaggguuucccuucucuguuaauuuuacagaggccuauccuuuccccuaguu

SEQ ID NO: 126258 - RNA, 45 nt, Homo sapiens
agcuuuuuaaagaaagaacaagauagaaauguuccaaugguuuua

SEQ ID NO: 126259 - RNA, 82 nt, Homo sapiens
aaaauaauaccaauaaaaacauucuuuuggagucacucuuaaggccaaaugauuacaacuaugacaaaauuaagcuagguaa

SEQ ID NO: 126260 - RNA, 55 nt, Homo sapiens
gaaacaaaauccacuucagacaucuccuuccggacagacauaccccuaaugaaga

SEQ ID NO: 126261 - RNA, 56 nt, Homo sapiens
agcaucucucuccuuugcccuaacaaauaauaauauacguuuucacacuuuguauu

SEQ ID NO: 126262 - RNA, 23 nt, Homo sapiens
ugcguccucgaaggggaggaauu

SEQ ID NO: 126263 - RNA, 46 nt, Homo sapiens
guacugaauugguaacccaaaguauauucugguauuaauauaagaa

SEQ ID NO: 126264 - RNA, 48 nt, Homo sapiens
aauggcugguacccauuggcaacugccuaugcaacgcugggcaugagg

SEQ ID NO: 126265 - RNA, 63 nt, Homo sapiens
uucccugguggaaguucgaggcuccugugucaacaacucagaagagaaagaugugccaaaaau

SEQ ID NO: 126266 - RNA, 54 nt, Homo sapiens
uucacccaaguggacauuggugacagaaucaugaagcugaacaccgagauccgg

SEQ ID NO: 126267 - RNA, 68 nt, Homo sapiens
acgacaaagagcguuucaucagagagaaccaguuugucaaaauugacaccauugcugcugaugagagc

SEQ ID NO: 126268 - RNA, 77 nt, Homo sapiens
gagccuuauuuuucuuacuggcugcuuuuaaguuugaagagaguauauacaucuaaucaaauuuugaaccugacuug

SEQ ID NO: 126269 - RNA, 74 nt, Homo sapiens
caaaucauccuaccuucacaggcuugauaguuuauggcugaguccauugauuaaaaacaaugggggugaaagau

SEQ ID NO: 126270 - RNA, 72 nt, Homo sapiens
gaaagaaaacaguacaacauguaacugacuucugccaaacugaaauaacucucaaauccuuuuaaaauuaaa

SEQ ID NO: 126271 - RNA, 20 nt, Homo sapiens
uuacuaggucaacggccaca

SEQ ID NO: 126272 - RNA, 45 nt, Homo sapiens
auuuaugccuauuacugugauggccaugaaguccugacaagguua

SEQ ID NO: 126273 - RNA, 48 nt, Homo sapiens
cacagacuuagaugccuauuuaaaacuaaaauaccaacaggaaauaug

SEQ ID NO: 126274 - RNA, 44 nt, Homo sapiens
uccuaauggcuugauucuuguugauuguggugagggggucagau

SEQ ID NO: 126275 - RNA, 46 nt, Homo sapiens
uguucagggagaacuuggguggauagcaagcccucuggaaggaggg

SEQ ID NO: 126276 - RNA, 47 nt, Homo sapiens
aagcaaguugaauaaauaagaaccugcagauuuaaagagggggagaa

SEQ ID NO: 126277 - RNA, 44 nt, Homo sapiens
agugguuccuuugaggugggccuuucgacccccaggacugcaga

SEQ ID NO: 126278 - RNA, 47 nt, Homo sapiens
uuaacuccauugacuuugaggugaaaugagagggaaagugggcagaa

SEQ ID NO: 126279 - RNA, 43 nt, Homo sapiens
gacguccccugagaccucucucgccccagauguagagacuguu

SEQ ID NO: 126280 - RNA, 50 nt, Homo sapiens
cacccccgggaccccugccgguggcuccaucagccagcaaccuuagagag

SEQ ID NO: 126281 - RNA, 62 nt, Homo sapiens
cucccggacuccuuggaggugcugguuccggcugagccuagucccccaccccaccccgaauc

SEQ ID NO: 126282 - RNA, 50 nt, Homo sapiens
gguuugcacccaccacugaaaaagccgcggagaugcgcagcgcguacacu

SEQ ID NO: 126283 - RNA, 46 nt, Homo sapiens
aggaaugccacagguacacaguagagauacuuacagccaaucagau

SEQ ID NO: 126284 - RNA, 24 nt, Homo sapiens
gacuuaugccaaagggggcuguuu

SEQ ID NO: 126285 - RNA, 283 nt, Homo sapiens
augacgaugugaguguucuugggauccggaagcauuccugggaauaggaaagagaugcuuuuaccaaaaagcagaguuuuacugacuuccuuuccccacauccccuaaacacgucaucuguacacaaggguugcauuggaugaucuuggcuuccuuuagcaauuaaaaaaacaacucuuuagcucuuggacuguuagguugguacaaugcucuuuuaaacugucuccuaagaacacaacguuaaagcccacagcaaacuuacccuuugcagugucauagauac

SEQ ID NO: 126286 - RNA, 65 nt, Homo sapiens
cgaaguaggcggcucgguagaugauaauacccugcacagacacguuaaagccuugguacaggccc

SEQ ID NO: 126287 - RNA, 44 nt, Homo sapiens
gguacgggcaaaaucaagaggguacacaaaacacagggaugugg

SEQ ID NO: 126288 - RNA, 42 nt, Homo sapiens
cgucauugaauuucucuuggacaaaucugcagaaaaggcucu

SEQ ID NO: 126289 - RNA, 39 nt, Homo sapiens
aauugcuggccgcuucacuccuggaaccuucacuaacca

SEQ ID NO: 126290 - RNA, 48 nt, Homo sapiens
gucaugccugaucuguacuucuacagagauccugaagagauugaaaaa

SEQ ID NO: 126291 - RNA, 40 nt, Homo sapiens
acacgaaaaaucaccuuuaaucucauaugauucaucaguu

SEQ ID NO: 126292 - RNA, 47 nt, Homo sapiens
uuuggguguuucaugucagugaauuaucuuuucucuuggacuuaaca

SEQ ID NO: 126293 - RNA, 50 nt, Homo sapiens
ccaaguucgaagucacuauguagacuggagaauguggcgcgaugugaaga

SEQ ID NO: 126294 - RNA, 44 nt, Homo sapiens
aacccaaauuggguucaugcuccuuugaccugacccaaugagug

SEQ ID NO: 126295 - RNA, 48 nt, Homo sapiens
uuaacuugcgugaauuuauacagcacaaaagguccuuuuauagcaaga

SEQ ID NO: 126296 - RNA, 54 nt, Homo sapiens
gguaucaaaucuacagcccuugugugacucccagucacaugugugacucccagu

SEQ ID NO: 126297 - RNA, 42 nt, Homo sapiens
ccgcugugguggcugcggugguggcuguggugguggcugugg

SEQ ID NO: 126298 - RNA, 32 nt, Homo sapiens
guggccggccugguuccaccccugcccaggag

SEQ ID NO: 126299 - RNA, 40 nt, Homo sapiens
agcaacccauggcgucaguagagaaaucucaggugaagug

SEQ ID NO: 126300 - RNA, 42 nt, Homo sapiens
ccacagcaacccauggugucaguagagaggacugaggagaag

SEQ ID NO: 126301 - RNA, 42 nt, Homo sapiens
acagcaacccauggugucaguagagaggacugaggagaagcg

SEQ ID NO: 126302 - RNA, 86 nt, Homo sapiens
ccuuuggcuuuggcuuucuugguagcaaaaugguggacugguacagcugaauaggccacguauugccuauggccauguugucuuuc

SEQ ID NO: 126303 - RNA, 57 nt, Homo sapiens
aguaaaggcccuuugccagcagcaaguauuuucugagagccacccacaucagaaggc

SEQ ID NO: 126304 - RNA, 98 nt, Homo sapiens
agcauuuuuucaggaaguggucaccccagugguccccggcuuucucagacuuccugcagcucucuacacagugaaucacagugagacacuggcagcag

SEQ ID NO: 126305 - RNA, 33 nt, Homo sapiens
ucacuuuaacaguggggaucuuuucugccagug

SEQ ID NO: 126306 - RNA, 46 nt, Homo sapiens
aguuggcauuggugauuucauuggucucauuggggucuaaccagau

SEQ ID NO: 126307 - RNA, 46 nt, Homo sapiens
augccugcccuuccggcaggccaagguguuuuuccggcaucaagcg

SEQ ID NO: 126308 - RNA, 45 nt, Homo sapiens
gcgaucaaucuucuuagauucacgguaucuucugagcagccggug

SEQ ID NO: 126309 - RNA, 47 nt, Homo sapiens
auugugguuuauagcagcugugauguuaagccugcagaggaaggcag

SEQ ID NO: 126310 - RNA, 85 nt, Homo sapiens
uuagcuugggggaacaaauuaccguuuagguccacuaaauguugggcaaaccucuuagguaguauuguccccaacaucauugaug

SEQ ID NO: 126311 - RNA, 54 nt, Homo sapiens
aucaguuucguugucacaauuguguuguaaaguugggcgaguuguguguuuuag

SEQ ID NO: 126312 - RNA, 55 nt, Homo sapiens
aauuuuuucuguuuaucuuuuuaucucagcuauauuugugcuuauuugaaaguga

SEQ ID NO: 126313 - RNA, 25 nt, Homo sapiens
ggaaugagaucaguuagaucagccu

SEQ ID NO: 126314 - RNA, 49 nt, Homo sapiens
aaauggcaacuaguugcccaccuggccugggucagugugguuaguggga

SEQ ID NO: 126315 - RNA, 50 nt, Homo sapiens
ggcauaauccccaauaaaucuugagaauuguagauauuuacugauuugaa

SEQ ID NO: 126316 - RNA, 50 nt, Homo sapiens
agcaaguuuuccaguuugacuauauuaugaugucaacacuuaccuggaaa

SEQ ID NO: 126317 - RNA, 47 nt, Homo sapiens
uuucaccuucugccugcuuuuucacccgauacuuuauuacccaucag

SEQ ID NO: 126318 - RNA, 89 nt, Homo sapiens
ugccuuucuccccagcuguauucuaaguccugaaacaccuagcgaauauguaccacuuaucauucaugccauuuaguucucaucuuuug

SEQ ID NO: 126319 - RNA, 23 nt, Homo sapiens
aggaucaaggcuucauaugccag

SEQ ID NO: 126320 - RNA, 53 nt, Homo sapiens
aagauggcagaucuguauugauaaaagaccuuuaacauauucagagaaaucag

SEQ ID NO: 126321 - RNA, 47 nt, Homo sapiens
gaggugacagccaagaguggaaccuugaaggacaucaacauuggagu

SEQ ID NO: 126322 - RNA, 347 nt, Homo sapiens
uuauuuaaauuuaagucagggccuuacucugucacucaggcuggagugcagugguacagucaccaccucuuaggcucaagugaugcuccagccucagccuuccaaguagcuggcugggaccacaggcaugcaucaccaugcccaccuaauuuuuaaauuuuuuguagagacagggucucccuauguugccgaggcuggucucaaacuccugaccucaagcaauucaccccaccuuagacucccaaagugcugagauuacagacgugagcugccucaccuggccuguauuucuguagaauacagucuuacuaguucauauguucuguaaaaucuuagcuggcugguau

SEQ ID NO: 126323 - RNA, 68 nt, Homo sapiens
ugacugaaccacauuaacaucuacuaacucagaggguaauagcacauaacuugaccucccucucacag

SEQ ID NO: 126324 - RNA, 48 nt, Homo sapiens
agacuuuugcuuaaauguucauagcggccuuauuuguaaauggcccag

SEQ ID NO: 126325 - RNA, 74 nt, Homo sapiens
uuacgaugaaugcuuguguucacaggguugaauagcuauauucacucauuucaugagaggaguaaguuugcuga

SEQ ID NO: 126326 - RNA, 53 nt, Homo sapiens
aauuucugacguguaguaacaucaucagugguaucauuacaugaaacggaaca

SEQ ID NO: 126327 - RNA, 110 nt, Homo sapiens
uagggcgagaucuugaguucuauuuuagauguauucgauuugagguaccuugagacauuacgaguggagacauuuugagaaggcugcccagugguacugauaaggccugg

SEQ ID NO: 126328 - RNA, 67 nt, Homo sapiens
ggcaucugcauuuaacuguuaauuaaagcaguggguguggaugagaucacuuaagagucuagagaau

SEQ ID NO: 126329 - RNA, 65 nt, Homo sapiens
uacccugccuugcgggauucccuguguuuaaauggccuagccaaggugaaugaggcaaaaaggag

SEQ ID NO: 126330 - RNA, 37 nt, Homo sapiens
ugacuagccaaaaggauugggcugaagagugagugag

SEQ ID NO: 126331 - RNA, 42 nt, Homo sapiens
auugguacgagaacuccuacuguugaauacaucugcacccaa

SEQ ID NO: 126332 - RNA, 43 nt, Homo sapiens
auuucacuaguguguugggaaauggaauaugacuagaggagaa

SEQ ID NO: 126333 - RNA, 39 nt, Homo sapiens
uaaguauggugauuuuuaacaacaguuuuuauuagguaa

SEQ ID NO: 126334 - RNA, 42 nt, Homo sapiens
cacgcagguguuuguagccaauccuaacaagacgcagcccau

SEQ ID NO: 126335 - RNA, 48 nt, Homo sapiens
ugcuacgggaguucugaacauggcuggguucaugaaggcaaauguaug

SEQ ID NO: 126336 - RNA, 45 nt, Homo sapiens
agcuauccaaaaugggaguuugggggcagcuaaaguugacaugcg

SEQ ID NO: 126337 - RNA, 49 nt, Homo sapiens
uuuguuaauuuuacuuuucaaagauacuuuaaaacaguagagcuagcaa

SEQ ID NO: 126338 - RNA, 48 nt, Homo sapiens
cuauggggaaauuuauuuuuuuuaauguccuguuccuuaaugcugcaa

SEQ ID NO: 126339 - RNA, 48 nt, Homo sapiens
uggccgugaugugguguccuggcuuugugguguagugcuguguguaug

SEQ ID NO: 126340 - RNA, 33 nt, Homo sapiens
uuuggcagugaggucguagccuuuuagguggaa

SEQ ID NO: 126341 - RNA, 60 nt, Homo sapiens
cauucgaauaccuuaaaauuuaaccagagugcuggauuguuuucauuuguagcuauauaa

SEQ ID NO: 126342 - RNA, 47 nt, Homo sapiens
aggugauucguaugcaaauuaacauuugagaagcagugcuuuggaag

SEQ ID NO: 126343 - RNA, 29 nt, Homo sapiens
auuaaauacaugugaaguguuuagaacag

SEQ ID NO: 126344 - RNA, 234 nt, Homo sapiens
auaguaaaaguguuuggggcuauaaaauauuuuauuuuguaauuagaaauuaacaaacaugagccaggcaugguggaaugugccuguaauccuagcuacuuaagaggcugaaggcagaggaucacuugaacccaggaguuugaggccagcccaggcaacauugccagacuccaucucuauuaaaauaaauaaauaaaaauaaauuuaaaguuaauaaacauuuggaagaaugaa

SEQ ID NO: 126345 - RNA, 60 nt, Homo sapiens
ccucaguuucccgggggcggaugggcgggcgggcgcggcggcggcggcgggagauguucg

SEQ ID NO: 126346 - RNA, 51 nt, Homo sapiens
gcggcugggaccccaggucuugccggcagcuggguccccucucccuuccag

SEQ ID NO: 126347 - RNA, 54 nt, Homo sapiens
cccagggccucgccgccuucccggugcaccccccgaccucccccgucccggccu

SEQ ID NO: 126348 - RNA, 38 nt, Homo sapiens
cacccaacaaagagcagcccucaugguugauggaggcc

SEQ ID NO: 126349 - RNA, 48 nt, Homo sapiens
cugaccaggggugagacugcguuggaacaccgucacggccacgagcag

SEQ ID NO: 126350 - RNA, 58 nt, Homo sapiens
ccacccuggagccacagaaggcccagaagccaaauggacagcuggugaaccccaacaa

SEQ ID NO: 126351 - RNA, 46 nt, Homo sapiens
cuggugguugucaagucggucaucacgcagcacgaccgccgcgagg

SEQ ID NO: 126352 - RNA, 45 nt, Homo sapiens
aaaggcgacgaugacgucuucgucaaccccaccaaccugcuagaa

SEQ ID NO: 126353 - RNA, 46 nt, Homo sapiens
caggcauggugcaggcgccgggccaggcugccggccaugaggaagc

SEQ ID NO: 126354 - RNA, 45 nt, Homo sapiens
ucagguaccugggcuaggccuggccugaugggucuguggccgccc

SEQ ID NO: 126355 - RNA, 44 nt, Homo sapiens
agaccaggguguggacuggggggugccugugagcccgcacaggg

SEQ ID NO: 126356 - RNA, 84 nt, Homo sapiens
ggagcgcugcucuucugcccugugucggggugggguagggcugcagccccagggagauucugaggggcgcugagguagucagag

SEQ ID NO: 126357 - RNA, 42 nt, Homo sapiens
cccucagaaucucccuggggcugcagcccuaccccaccccga

SEQ ID NO: 126358 - RNA, 42 nt, Homo sapiens
aggccuggcucccuggcuggaaagcagccgguuuggcccugg

SEQ ID NO: 126359 - RNA, 44 nt, Homo sapiens
aguccuuucuuucaaauggaaaagggaaagcagagggacagaag

SEQ ID NO: 126360 - RNA, 42 nt, Homo sapiens
uuccaucaauuucaccgucuuccauggccuccuuggcagcuu

SEQ ID NO: 126361 - RNA, 49 nt, Homo sapiens
cuauagucuugauuuugaccuuucucuccaguauaguacagggaaauag

SEQ ID NO: 126362 - RNA, 46 nt, Homo sapiens
agugacuuuguaagggagauuuuuagccaaaaguguucucgcaucu

SEQ ID NO: 126363 - RNA, 36 nt, Homo sapiens
uuuaaaaagcaccccuaguauuagcaaaacaaaguc

SEQ ID NO: 126364 - RNA, 50 nt, Homo sapiens
ucaucuucaucaucuucgucgucgucgucauccucguccucaucauccuc

SEQ ID NO: 126365 - RNA, 47 nt, Homo sapiens
cuucgucauccucaucguccucauccucugaggcaggggcagcagcu

SEQ ID NO: 126366 - RNA, 49 nt, Homo sapiens
uuccuucuuggcauucuugccauucuuugcccccuuggcugggauggca

SEQ ID NO: 126367 - RNA, 46 nt, Homo sapiens
aacugucuucuuggcagguguugcugcugccuuuuugccuggagug

SEQ ID NO: 126368 - RNA, 66 nt, Homo sapiens
uuuccucaucuucacuaucuucuucuaccuccuuuggaggaggagccauuuucuuggggucaccuu

SEQ ID NO: 126369 - RNA, 47 nt, Homo sapiens
cggggcccaccacgugucggcuugccaggccggggcggagacauccg

SEQ ID NO: 126370 - RNA, 37 nt, Homo sapiens
uucaccaugauggcggcggagugugaagcggacaagu

SEQ ID NO: 126371 - RNA, 97 nt, Homo sapiens
ugucuucccgaggcagcccgagaagcuucaccuguucacccagagguagagucagcccguugccaacaacugcaggccccugagccugcuggaggag

SEQ ID NO: 126372 - RNA, 35 nt, Homo sapiens
ggagaaggccgggcguccuccuggagggugccgcc

SEQ ID NO: 126373 - RNA, 48 nt, Homo sapiens
acgagugaaagugacaauacauggguaaacugaggcaggcggcaucag

SEQ ID NO: 126374 - RNA, 40 nt, Homo sapiens
caggcugucagaaggcagucacugacuguugaggagagac

SEQ ID NO: 126375 - RNA, 45 nt, Homo sapiens
cggcgagcaaggaggcggaugaggaacaaugcaaagauggcuuuu

SEQ ID NO: 126376 - RNA, 49 nt, Homo sapiens
gugucuacggcugcgucugacaugguggggcacgccggugauccgaugc

SEQ ID NO: 126377 - RNA, 40 nt, Homo sapiens
cgggccucucuacucgaaggugaccacguuuagauucuga

SEQ ID NO: 126378 - RNA, 40 nt, Homo sapiens
ccuccccuguugcaaauucucaugguuuggguuggguggu

SEQ ID NO: 126379 - RNA, 83 nt, Homo sapiens
aaugcaguaucagaaagucagucggaucuauaagcacccugugugcagagcacucuacuaagggcuuuagaguguaccaagga

SEQ ID NO: 126380 - RNA, 55 nt, Homo sapiens
guguuauuacacacaugaugauuccagucagcuguguuguuuaggguucuucacu

SEQ ID NO: 126381 - RNA, 24 nt, Homo sapiens
gagggcucugacauaagugguauu

SEQ ID NO: 126382 - RNA, 51 nt, Homo sapiens
ucuuccucagucaggaggugcugggaagcaaauaaaagugcaaagggagcc

SEQ ID NO: 126383 - RNA, 44 nt, Homo sapiens
uaaaauguauuaccaacuugguuucugauuauagcaaagcaauu

SEQ ID NO: 126384 - RNA, 49 nt, Homo sapiens
cgcugggacuccuagccgaggugucuuugcucgcuccugucggugcggu

SEQ ID NO: 126385 - RNA, 45 nt, Homo sapiens
gggacccggcgcgagaggcgccccaaggggcguccugagggagga

SEQ ID NO: 126386 - RNA, 45 nt, Homo sapiens
gguaaggcugcaaacaacaaacaaaaacacugauuaaaccgugaa

SEQ ID NO: 126387 - RNA, 48 nt, Homo sapiens
aaauugaggcccagagaggcgaagggauuggccacagaucacagcaag

SEQ ID NO: 126388 - RNA, 43 nt, Homo sapiens
agaugggugaaaguggggacaggcagaggaaggaaggccaaga

SEQ ID NO: 126389 - RNA, 59 nt, Homo sapiens
cgaaaaggcccuuccaagaggacccgugugaagagacagauggggaucucugcaaagag

SEQ ID NO: 126390 - RNA, 37 nt, Homo sapiens
gagaaggggagaggauacgaggaagaaggaaaggagu

SEQ ID NO: 126391 - RNA, 46 nt, Homo sapiens
agcaguuuauuuuacuagccaaagguaccaguggcucagcccucac

SEQ ID NO: 126392 - RNA, 41 nt, Homo sapiens
ggcucuguggaagcugccaugcauagaucugggugauggua

SEQ ID NO: 126393 - RNA, 46 nt, Homo sapiens
uuuuccggcuaguuuuguuaauuauguuucugaaaaggggggcuag

SEQ ID NO: 126394 - RNA, 39 nt, Homo sapiens
uuugccaguuccugguacaccacauuuuuuucugaccuu

SEQ ID NO: 126395 - RNA, 49 nt, Homo sapiens
ggcauauacucaguaguucccuuucucuccacugguacaaguuuuuagg

SEQ ID NO: 126396 - RNA, 47 nt, Homo sapiens
cuuaucuacaguguauccccuacuccguguugcugaaagaccuggag

SEQ ID NO: 126397 - RNA, 45 nt, Homo sapiens
cagcugcuggaaguggauuucugcauuggccgugacauccgaaag

SEQ ID NO: 126398 - RNA, 48 nt, Homo sapiens
uaaauuauuuggggcuuauaaagccagauggacugauuggagaaguuu

SEQ ID NO: 126399 - RNA, 48 nt, Homo sapiens
gaacaguaccaacaggguggggaggcgcuggugaggggacgggcaggu

SEQ ID NO: 126400 - RNA, 42 nt, Homo sapiens
agcugcccacuggaacugccggcuaaugcuugcucucccaag

SEQ ID NO: 126401 - RNA, 44 nt, Homo sapiens
augccaccaucccuacccaggugcagccaggaggaguuaaagau

SEQ ID NO: 126402 - RNA, 26 nt, Homo sapiens
gagagggacagaaaggguagacaacu

SEQ ID NO: 126403 - RNA, 33 nt, Homo sapiens
cugcuggcugugcugcugcugcuaccccuccca

SEQ ID NO: 126404 - RNA, 37 nt, Homo sapiens
cgcuaggcuuggggcauggccugugcaaaggcaggga

SEQ ID NO: 126405 - RNA, 47 nt, Homo sapiens
aagcccggggucuacacccgcguggcaguguucaaggacuggcucca

SEQ ID NO: 126406 - RNA, 90 nt, Homo sapiens
gggucgccucugccccagcucuggggguagguagaggguccgaggggaagggaguggggccugcggagugugagccaggccacugggggu

SEQ ID NO: 126407 - RNA, 338 nt, Homo sapiens
guucagaguagaaugauuugggauggggaggggaccaauagaaugagugauauuuuggccaggcauggugucucacgccuguaaucccggcacuuugggagcccgaggcgggcgggucauuugaggucaggaguuugagaccagccuggccaacaucaugaaaccccgucucuacuaaaaauacaaaaauuagcugggucugguggcacaugccuguaaucccagcuacucaggaggcugaggcaggagauugcagugagccaaguuuguagcacugcacuccagccugggcaacagaggaagacuccaucucaaaaaaaaaaaaaaaaaaaaaagug

SEQ ID NO: 126408 - RNA, 45 nt, Homo sapiens
cugugaaacuggugauauacuugacacagauagugugguuuucag

SEQ ID NO: 126409 - RNA, 48 nt, Homo sapiens
cucaggcuguauuucucuaaaaucaagaguaaauuaguaagcucuuaa

SEQ ID NO: 126410 - RNA, 45 nt, Homo sapiens
gauuugagcuaauggaacacugggaugauuguucaguuuauuuag

SEQ ID NO: 126411 - RNA, 40 nt, Homo sapiens
uccuucugggaagcugggagcagagcaguuucccagcagg

SEQ ID NO: 126412 - RNA, 62 nt, Homo sapiens
gaacaggguguggcuuaggacugccucagugcucacuuccugguuuugauagcugacucugg

SEQ ID NO: 126413 - RNA, 383 nt, Homo sapiens
auuuuuuauugagguguaacauauaugcaguagggcacacaaaucuuuuguuuuguuuuguuuugcuuuguuuuuguuuuuagacagagucucgcucuguugcccaggcuggagugcaauggcgcgaucucggcucacugcaaucucugccugcuggguucaagugauucuccugccucagccuccugacuagcugggauuacaggcgcacgcuaccaggccuggcuaauuuuuguauuuuuaguagagacaggguuucaccauguuggucaggcuggucucaaacuccugaccucgugauccaccuaccucggccucccaaagugcugggauuacagguguaagccaccgagcccggcggcacacaaaucuuuuguguauag

SEQ ID NO: 126414 - RNA, 45 nt, Homo sapiens
ccgggcuccgccucgggcucgcugucggacgacuccucgggcggc

SEQ ID NO: 126415 - RNA, 41 nt, Homo sapiens
cuggagcaaaaaccguaagcuguuuucaauaggaagcacaa

SEQ ID NO: 126416 - RNA, 42 nt, Homo sapiens
cuuucuuccuucugcauguccuacgguagugaugggacaggc

SEQ ID NO: 126417 - RNA, 46 nt, Homo sapiens
gugaaagagucuuuuguuagucucgggcauaauguuuuugagaaug

SEQ ID NO: 126418 - RNA, 42 nt, Homo sapiens
uccagagaagaaagcuauggcaauugcugaugcuuugggcaa

SEQ ID NO: 126419 - RNA, 46 nt, Homo sapiens
aucgaaucuugcgaacaacacgauacuuguuaaguggcuaccccaa

SEQ ID NO: 126420 - RNA, 57 nt, Homo sapiens
ugcugacaguggccuucaucaccuuuaaauguugugcuuauggcuaccggaaaugcu

SEQ ID NO: 126421 - RNA, 46 nt, Homo sapiens
ccacaaauccaagacccauugagaagugggugggaaauaagguaaa

SEQ ID NO: 126422 - RNA, 27 nt, Homo sapiens
agugcaaccagggcagagagaugcacc

SEQ ID NO: 126423 - RNA, 65 nt, Homo sapiens
guucuugcaaucucuuaaugccccugucccuuucacaggcucagagcaggguaugaaguucuccu

SEQ ID NO: 126424 - RNA, 45 nt, Homo sapiens
ugcaugaugaacguuuugguggagaugaugcuugauggcuuugug

SEQ ID NO: 126425 - RNA, 48 nt, Homo sapiens
uagguacuaaggccaugucuguggaggaaggaugcaaaggaucccauu

SEQ ID NO: 126426 - RNA, 49 nt, Homo sapiens
cucgcugggcuggcacgugaccuuggggaggguuacccaacuggcccag

SEQ ID NO: 126427 - RNA, 40 nt, Homo sapiens
aaugcuucuaaauccuuaaaaacagaaagaguauaaucau

SEQ ID NO: 126428 - RNA, 45 nt, Homo sapiens
aauauuaaaaccaagccagguuucugauacccugcgauuguuccu

SEQ ID NO: 126429 - RNA, 72 nt, Homo sapiens
gcagcguacccagcaucggacccagccaguacccaagcgccaacccggacugcagggccucgcgcgccacaa

SEQ ID NO: 126430 - RNA, 23 nt, Homo sapiens
aucccauugguucuacuccccag

SEQ ID NO: 126431 - RNA, 46 nt, Homo sapiens
cguaaaauaagacccauggcacacuucauaucuggaaggaauuaaa

SEQ ID NO: 126432 - RNA, 43 nt, Homo sapiens
aacaagcuacauguuucuagggaguguguuaauccagcugguu

SEQ ID NO: 126433 - RNA, 46 nt, Homo sapiens
uaaacaauuucagucuugugaauaauaaaaaggagagaggggggga

SEQ ID NO: 126434 - RNA, 46 nt, Homo sapiens
cucauuccagaagaaaacaaaaccucugcuguaaucugcgcgguua

SEQ ID NO: 126435 - RNA, 42 nt, Homo sapiens
gagagcuucucgcuggagagcgauguggacuacagcucggau

SEQ ID NO: 126436 - RNA, 45 nt, Homo sapiens; identical to SEQ ID NO: 24477

SEQ ID NO: 126437 - RNA, 24 nt, Homo sapiens
ggucaccgcggagcggcagaggcg

SEQ ID NO: 126438 - RNA, 45 nt, Homo sapiens
cggcagcacuaccggccgguagggcaugaacaugggguagccggu

SEQ ID NO: 126439 - RNA, 57 nt, Homo sapiens
gacggcgggaacgcugcgcucauagacgcgcucgguagaggccagcgagaggcgaaa

SEQ ID NO: 126440 - RNA, 31 nt, Homo sapiens
cggacggacggcagcuuaccggggccgaggg

SEQ ID NO: 126441 - RNA, 46 nt, Homo sapiens
cccuguucucgacaacgguaaagacccccaaauuugaaaguaaggg

SEQ ID NO: 126442 - RNA, 48 nt, Homo sapiens
agaaggaaagaagggcauuguuaguucggucauuaaaaaucagcucac

SEQ ID NO: 126443 - RNA, 50 nt, Homo sapiens
ucuuuaucucccaauuaaaugugcuuguaagugauacauaacacacgucc

SEQ ID NO: 126444 - RNA, 50 nt, Homo sapiens
ccguguuggacguguguuauguaucacuuacaagcacauuuaauugggag

SEQ ID NO: 126445 - RNA, 19 nt, Homo sapiens
gggagggaggaggcgagga

SEQ ID NO: 126446 - RNA, 45 nt, Homo sapiens
gccuaaugguucuucagagguaguguggauucuccugaucuaacu

SEQ ID NO: 126447 - RNA, 58 nt, Homo sapiens
uugcugcagcacggucguugucaaggauacuugguugaugaauaaaacaucccagaaa

SEQ ID NO: 126448 - RNA, 62 nt, Homo sapiens
guucucucccugucacugcaacgugcgacagggccgcuaaaaaggugaccccuguacgaagg

SEQ ID NO: 126449 - RNA, 51 nt, Homo sapiens
uccagaggcuuuaugacugcacacuggggccgccugagacccagguuuaua

SEQ ID NO: 126450 - RNA, 45 nt, Homo sapiens
gcucacgugcaaagucacacaccucaucuucuccaucaaccucuu

SEQ ID NO: 126451 - RNA, 22 nt, Homo sapiens
uugcaacaggcagagcuguguc

SEQ ID NO: 126452 - RNA, 32 nt, Homo sapiens
gggugaacaucuugggaaacaugaucuuaaga

SEQ ID NO: 126453 - RNA, 43 nt, Homo sapiens
ugauuuucugucucuuauucaggacgcuugauguaaugggcag

SEQ ID NO: 126454 - RNA, 44 nt, Homo sapiens
uaagugcugcaguguugaaguaauaaaucagugguguguguuua

SEQ ID NO: 126455 - RNA, 72 nt, Homo sapiens
uccugcuguggaggaagucagugagcaggaauuuuuuuaauaacuguucaucacucugcuaagggauaucag

SEQ ID NO: 126456 - RNA, 46 nt, Homo sapiens
cgcgccuuugcccuggucucucaagcguauacuucaaucaucgccg

SEQ ID NO: 126457 - RNA, 42 nt, Homo sapiens
aagcugauuccaccacaagaaugguucugcccagaaagccag

SEQ ID NO: 126458 - RNA, 42 nt, Homo sapiens
aguucccccaauacccaaugaacagcaguuagccagacugac

SEQ ID NO: 126459 - RNA, 50 nt, Homo sapiens
uauacuauauacauuuuguccauaaacguuaugcugaauaguuguugaaa

SEQ ID NO: 126460 - RNA, 49 nt, Homo sapiens
ucugaauauuugaaguuguuuguuguaacuuaagguuauaacagcccuu

SEQ ID NO: 126461 - RNA, 45 nt, Homo sapiens
uuaaaaaaguuguaauagagaauauuuuuggcauuccucuaaugu

SEQ ID NO: 126462 - RNA, 80 nt, Homo sapiens
ugguucauuuuuuuucccuuuuaguuaagcaugacuuuagaugggaagccuguguaucguggagaaacaagagaccaacu

SEQ ID NO: 126463 - RNA, 45 nt, Homo sapiens
gguguuuaugugaacauuccuaucaauccaaauucccucuggagu

SEQ ID NO: 126464 - RNA, 44 nt, Homo sapiens
uaacuguuacacaacauucaaaguauucgagagaacugccugga

SEQ ID NO: 126465 - RNA, 41 nt, Homo sapiens
uaaugugucuguggacccucgcucucugucuccaggcaguu

SEQ ID NO: 126466 - RNA, 86 nt, Homo sapiens
aaccuaagcguggguggccaacaucauauaccucuugaagaagaaggagucagccaucgccaacuugucucuguagaagcuccggg

SEQ ID NO: 126467 - RNA, 45 nt, Homo sapiens
ccaucacacugaugacuccggguuuggcgagcacugagcgucgag

SEQ ID NO: 126468 - RNA, 82 nt, Homo sapiens
auauuaaaaugguacuaugauccaaacaccaaaagcugugcaagauucugguauggagguugugguggaaacgaaaacaaau

SEQ ID NO: 126469 - RNA, 34 nt, Homo sapiens
gugguugcuaacgaugcccuagguauauuaaugg

SEQ ID NO: 126470 - RNA, 25 nt, Homo sapiens
aauagucacaggcuuuguuguggug

SEQ ID NO: 126471 - RNA, 60 nt, Homo sapiens
agccggugacuacgacgaagccggugaccaccacaacaaagccuguaaccaccacaacaa

SEQ ID NO: 126472 - RNA, 50 nt, Homo sapiens
ggcuucgucguagucaccggcuucguugucgucacuggguuggauguagg

SEQ ID NO: 126473 - RNA, 24 nt, Homo sapiens
caaggagaaaacagaagaaccacc

SEQ ID NO: 126474 - RNA, 84 nt, Homo sapiens
ugaaaaugcuuuuuacuuguccccagauaucaggaaacagugugauugguuccaaggggaccaacccacaaagaaccuugugaa

SEQ ID NO: 126475 - RNA, 46 nt, Homo sapiens
ucuuuguggguugguccccuuggaaccaaucacacuguuuccugau

SEQ ID NO: 126476 - RNA, 167 nt, Homo sapiens
auaacauuuauuuagcccauaauuauuguugaauuaacuauaucagacaaacuauguccagugauuuuaaacauaaaguaugauggcauuggauccauaaaacaugguaagccaauauguucuauuuggcaauauuugggugauuaaguuaaagauauauuuaucca

SEQ ID NO: 126477 - RNA, 42 nt, Homo sapiens
augcgcuucgggaggcuguugccauccuucgucagcaguaag

SEQ ID NO: 126478 - RNA, 46 nt, Homo sapiens
cgaagguguauaccuccuugauguucaccuuccugccaaugcccag

SEQ ID NO: 126479 - RNA, 46 nt, Homo sapiens
uucgugguccugggcauuggcaggaaggugaacaucaaggagguau

SEQ ID NO: 126480 - RNA, 42 nt, Homo sapiens
gcaucaggaccacaauuuucaggucccguggguuuggggcac

SEQ ID NO: 126481 - RNA, 81 nt, Homo sapiens
aauacaccauagagaaugucuuugaaagugccccaaacccacgggaccugaaaauugugguccugaugcugacgggcgagg

SEQ ID NO: 126482 - RNA, 88 nt, Homo sapiens
gacuauggcuccaaggagaagcugguggacuuccucagcaggggaaugacacaguugcagggaaccagggccuuaggcagugccauug

SEQ ID NO: 126483 - RNA, 55 nt, Homo sapiens
ggcuuucaucuuagacagcgcugagaccaccacccuguuccaguucaaugagaug

SEQ ID NO: 126484 - RNA, 75 nt, Homo sapiens
auccuguggauuuggcaguuggaggccuuccuucagggacaggagagcggcagggagcgauguggacaucgacau

SEQ ID NO: 126485 - RNA, 83 nt, Homo sapiens
acacagcaguggggcaugcgcuuguccugccugcagggagagaccucacagacuuccuggagaauguccucacgugucauguu

SEQ ID NO: 126486 - RNA, 45 nt, Homo sapiens
uccuuacaaggcaggaagaccggcagcucaucaacgcuuugcagg

SEQ ID NO: 126487 - RNA, 46 nt, Homo sapiens
cacgcuuaaauguguuccuggccacaaacgacauggcagucuccag

SEQ ID NO: 126488 - RNA, 68 nt, Homo sapiens
aagaaccuucagguggcucugacauccaaacagcagagucuggagacugccaugucguuuguggccag

SEQ ID NO: 126489 - RNA, 46 nt, Homo sapiens
cagccacccgggccccccgugggcaguugcucucagcaauggucag

SEQ ID NO: 126490 - RNA, 94 nt, Homo sapiens
gagggagucaaccaagacacuuucggccggaugcgagauguggucuugaguauugugaaugaccugaccauugcugagagcaacugcccacggg

SEQ ID NO: 126491 - RNA, 41 nt, Homo sapiens
aaauucgggaccuccagggauaguuggacagaagggagacc

SEQ ID NO: 126492 - RNA, 34 nt, Homo sapiens
auuauguuucuuuuuaaacuacauuucaggcuga

SEQ ID NO: 126493 - RNA, 47 nt, Homo sapiens
ccaggugaaccugggcuaaauggaacaacaggacccaaaggcaucag

SEQ ID NO: 126494 - RNA, 47 nt, Homo sapiens
agaugacgggagagacggaguuggcagugaaggacgcagaggcaaaa

SEQ ID NO: 126495 - RNA, 45 nt, Homo sapiens
accaaaaggaggaaucgggaaccggggcccucguggggagacggu

SEQ ID NO: 126496 - RNA, 45 nt, Homo sapiens
gcggaggugccgcuggugcuccuggagaacgaggcagaaccgguc

SEQ ID NO: 126497 - RNA, 43 nt, Homo sapiens
guccuccagggcugauaggagaacaaggcauuucuggaccucg

SEQ ID NO: 126498 - RNA, 46 nt, Homo sapiens
ccagaaaugccuuguucuccuaucagcccuggaggaccagcaggac

SEQ ID NO: 126499 - RNA, 73 nt, Homo sapiens
uuucaggguaacccaggacaagacagccaggagagaggacccaaaggagaaaccggugaccucggccccaugg

SEQ ID NO: 126500 - RNA, 44 nt, Homo sapiens
ggugauaaaggaccucgaggagagaaaggagaaagaggagaugu

SEQ ID NO: 126501 - RNA, 49 nt, Homo sapiens
aaaggauugccugguucuucuggagagaaagggaauccuggaagaaggg

SEQ ID NO: 126502 - RNA, 44 nt, Homo sapiens
ccuucuuccaggauucccuuucucuccagaagaaccaggcaauc

SEQ ID NO: 126503 - RNA, 45 nt, Homo sapiens
ggcgaaguaggagaaauuggacuggauggucuggauggugaagau

SEQ ID NO: 126504 - RNA, 43 nt, Homo sapiens
auucaguucuaguuuuaguuuuaaaacaucgcacgugguggug

SEQ ID NO: 126505 - RNA, 44 nt, Homo sapiens
gaacggcacucaagguuuccagggcugcccgggccagagaggag

SEQ ID NO: 126506 - RNA, 45 nt, Homo sapiens
uggaaaccuugagugccguucacaccaggcggaccacgcucaccc

SEQ ID NO: 126507 - RNA, 44 nt, Homo sapiens
aggguauuccuggagaagacggcuaccgaggcuauccuggugau

SEQ ID NO: 126508 - RNA, 46 nt, Homo sapiens
uccacccucaucaccaggauagccucgguagccgucuucuccagga

SEQ ID NO: 126509 - RNA, 44 nt, Homo sapiens
ugggcccgcggucuccccucugcccagagcacuugcagggaacc

SEQ ID NO: 126510 - RNA, 47 nt, Homo sapiens
ccgagaaagcuugcugugggguucccugcaagugcucugggcagagg

SEQ ID NO: 126511 - RNA, 27 nt, Homo sapiens
ggacuuggauuaugaacuagcggagca

SEQ ID NO: 126512 - RNA, 35 nt, Homo sapiens
gcaaguuaagccucaggggccugucauacauaaac

SEQ ID NO: 126513 - RNA, 45 nt, Homo sapiens
uugacgaguaccagccagagaugcucgagaaguuccggaacaugc

SEQ ID NO: 126514 - RNA, 85 nt, Homo sapiens
auucugggguuugaugguucuagagaccagaauguuuuuguggcccagaagggcuucgaguccaagguggacgccaucuugaaca

SEQ ID NO: 126515 - RNA, 45 nt, Homo sapiens
gaaccaucaaaccccagaaucacauccagauuacaagcuggaaag

SEQ ID NO: 126516 - RNA, 46 nt, Homo sapiens
cguuccgcgugggcaacguccaggagcuguccgaacugagcgagca

SEQ ID NO: 126517 - RNA, 89 nt, Homo sapiens
cuggaccagcgggucccucagauugccuuugugaucacgggaggaaagucgguggaagaugcacaggaugugagccuggcccucaccca

SEQ ID NO: 126518 - RNA, 113 nt, Homo sapiens
uggggcuuguccaguacaacucugaccccacugacgaauucuuccugaaggacuucucuaccaagaggcagauuauugacgccaucaacaaaguggucuacaaagggggaaga

SEQ ID NO: 126519 - RNA, 113 nt, Homo sapiens
uguguuccuguuggaugguuccaucaacuucaggagggacaguuuccaggaagugcuucguuuugugucugaaauaguggacacaguuuaugaagauggcgacuccauccaag

SEQ ID NO: 126520 - RNA, 45 nt, Homo sapiens
ucguuuggacccuccgcagccacuccugcaccuccagggguggac

SEQ ID NO: 126521 - RNA, 44 nt, Homo sapiens
caggugauccguuccucgggcauugugaguuuagggguaggaga

SEQ ID NO: 126522 - RNA, 45 nt, Homo sapiens
ccuaccccuaaacucacaaugcccgaggaacggaucaccugggcg

SEQ ID NO: 126523 - RNA, 46 nt, Homo sapiens
augaugucuucccagaauucuaucugaaaaccuacagaucccaggc

SEQ ID NO: 126524 - RNA, 45 nt, Homo sapiens
auuuuguuagcaggauuguucgaagacucaacaucggccccagua

SEQ ID NO: 126525 - RNA, 45 nt, Homo sapiens
uggagguggauagcgagugcuggcuaagagcuucuggaucugcuc

SEQ ID NO: 126526 - RNA, 50 nt, Homo sapiens
gaaacugcugacgcccaucacgacccugaccucagagcagauccagaagc

SEQ ID NO: 126527 - RNA, 45 nt, Homo sapiens
ccagcuccuccuggucugcguuccuggcgaucgugaaaggggcca

SEQ ID NO: 126528 - RNA, 47 nt, Homo sapiens
aagcaguuuggcguggccccuuucacgaucgccaggaacgcagacca

SEQ ID NO: 126529 - RNA, 46 nt, Homo sapiens
guacguguccaggaacaucuucaagaggccccuggggagccgcauu

SEQ ID NO: 126530 - RNA, 42 nt, Homo sapiens
guggucuuucucaucgaugggucccaaagugccgggccugag

SEQ ID NO: 126531 - RNA, 45 nt, Homo sapiens
ucaggugggucaggagaggugugagagaagccuccgaauggggag

SEQ ID NO: 126532 - RNA, 46 nt, Homo sapiens
accguccaacaggucaucucugagagggugacccagcucacccgcg

SEQ ID NO: 126533 - RNA, 49 nt, Homo sapiens
gcccauuggcauuggcaucgggaacgcugacaucacagagaugcagacc

SEQ ID NO: 126534 - RNA, 46 nt, Homo sapiens
aacagaaggugugccccagcugcugaucguccucacggccgacagg

SEQ ID NO: 126535 - RNA, 46 nt, Homo sapiens
aaggacgugguguuucugcuugauggcucugagggcgucaggagcg

SEQ ID NO: 126536 - RNA, 46 nt, Homo sapiens
ugcugucuccagcguuuauccuggcugcagagucgcuucccaagau

SEQ ID NO: 126537 - RNA, 85 nt, Homo sapiens
agaugaaaggcacaaccccacucugcuucagguuacuugcuggcccauccacacggucagaugaccuuccugcgaccagcagcac

SEQ ID NO: 126538 - RNA, 90 nt, Homo sapiens
uggucgcaggaaggucaucugaccguguggaugggccagcaaguaaccugaagcagagugggguugugccuuucaucuuccaagccaaga

SEQ ID NO: 126539 - RNA, 91 nt, Homo sapiens
ggcuacgcgcuggacuaugcacagagguacauuuuugugaagucugcuggcagccggaucgaggauggagugcuucaguuccuggugcugc

SEQ ID NO: 126540 - RNA, 46 nt, Homo sapiens
gauucaggaucucaggcuuacucuggugcucaucaaaacgggacuc

SEQ ID NO: 126541 - RNA, 45 nt, Homo sapiens
agcgaugaugucaagguggagucccguuuugaugagcaccagagu

SEQ ID NO: 126542 - RNA, 45 nt, Homo sapiens
augugguuaggggcugaaucagcugcugaggcaaagcuggcaggg

SEQ ID NO: 126543 - RNA, 45 nt, Homo sapiens
gggccugaacacaggcucagcccuaagcuaugucuaugccaacca

SEQ ID NO: 126544 - RNA, 46 nt, Homo sapiens
uuaugugcgcgacuuuguaaugaaccuaguuaacagccuugauauu

SEQ ID NO: 126545 - RNA, 41 nt, Homo sapiens
gccuggcuugcuggcaccucucaggacccucucuggaaccc

SEQ ID NO: 126546 - RNA, 46 nt, Homo sapiens
ggcucggaacucagcugggaugaacaccagggaggagucgaaagcg

SEQ ID NO: 126547 - RNA, 68 nt, Homo sapiens
acccauccaacaaaaagggaagucauaaccgcugugcggaaaaugaagccccuggacggcucggcccu

SEQ ID NO: 126548 - RNA, 371 nt, Homo sapiens
uagaacauauuuuuauuuuuauuuuuauuuuaggacagaaucucacucuaucacccaggcuggagugcaguggcaugaucucagcucacugcaaccuccgcuuccuggguucaagcgauucucccaccucagccuccugaguaguugggauuacagguaugcacgaccacgcccggcuaauuuuuguuuuguuuuguuuuguuugguagagaugggguuucaccaugcuggucaggcuggucucaaacuccugaccuugagugauccaccugccucagccucccacagugcugggauuacaagggugagccaccacauccagccuagaacacauuuuugaaaugcaguucauuucuaguuguuuggaccag

SEQ ID NO: 126549 - RNA, 45 nt, Homo sapiens
ucuuccuucugccuggaccacucuucccccugcucuccgcaugcu

SEQ ID NO: 126550 - RNA, 46 nt, Homo sapiens
cugagcaugauaaguugcauuggggcauucaacagggcugugauag

SEQ ID NO: 126551 - RNA, 46 nt, Homo sapiens
cccaaaggcacauugucuugaaaccgccaaccauugucacacaagg

SEQ ID NO: 126552 - RNA, 42 nt, Homo sapiens
uucucauucggccuuggagcccaggccgccuccagggcagag

SEQ ID NO: 126553 - RNA, 42 nt, Homo sapiens
guccucauaagugccgggccuucuagugacgagauucgcuac

SEQ ID NO: 126554 - RNA, 46 nt, Homo sapiens
ccucagcauaucaagacguuuaaaagaaggauuaaauaugaucaau

SEQ ID NO: 126555 - RNA, 55 nt, Homo sapiens
ugcuuguguacagcaaggcggaccaaugaccaauguuaauguuacaaggaaucag

SEQ ID NO: 126556 - RNA, 46 nt, Homo sapiens
uccugugugcauucauccgugaguccagaaagggcuggggacacgg

SEQ ID NO: 126557 - RNA, 46 nt, Homo sapiens
aucagacuggaaaaggauuagaauacauaaugcaaagccaccucac

SEQ ID NO: 126558 - RNA, 42 nt, Homo sapiens
gaguuucuauaugauguuguaaaauccuuagcugugggagaa

SEQ ID NO: 126559 - RNA, 46 nt, Homo sapiens
agaggagagucuguccggcugaugagugauguaacuuugccaugaa

SEQ ID NO: 126560 - RNA, 44 nt, Homo sapiens
guaugcauccuauucaaaccuaauugaaucgaggagcccaggga

SEQ ID NO: 126561 - RNA, 46 nt, Homo sapiens
cuuuuucuuuuugcagccuuucuccaccaaaaaaguggagacucag

SEQ ID NO: 126562 - RNA, 34 nt, Homo sapiens
cgcagcucugagucuccacuuuuuugguggagaa

SEQ ID NO: 126563 - RNA, 40 nt, Homo sapiens
agccuggucgcucgagaaccuggcaggaacggggugcgcg

SEQ ID NO: 126564 - RNA, 45 nt, Homo sapiens
ugcaaggccaguacuguauacaccagcaugcuuuaugacacaguc

SEQ ID NO: 126565 - RNA, 1085 nt, Homo sapiens
ucaucacagaaacaagccuguauaggagaagcaaaauaaaguaaauaaauaaaaauguaaaaauauacaaaaagacaguauucaguguuuuaaagauauagcuuuauuaaggcagugagauuaacaauuuuguugggagcagucacacuucucauuucauuuucuuaacagaaaugguuuuugucaggacccuucugaacaaugaucuaacaaaaggcagacuauauugaguaugacauguaaguacauuuagcuguucacaaauauuucaguacucauaaggucccugaugaaaugaaauaauggugaacagccuauuuacucucacacaguguauggucuaacuagggauggagacagugaaaaggcaauuacaagacacuaagcacugaacgggaagugcagagggaagggcacuaaagcagacaugggauuugggaaaggcaucuuagagacacgaagucuuaauagccauaugaagaaugggagggcaauaggguaagccaagauggaaaaguauuccagacaaagaaaacacagauaaugccugaacaccauuugguaaaacuagaacagaguuggaagauaaauaagacauaggguuaggaauauaagaacuagagaaacgcuucugagaggaagggcauuggcugcaucuguuuaguaaucuuugacgaacgaaugcuagagacuaggccuaaggacacagaaaaauuuggaaaucuuuacccaaacucuucuaagcagguauauuuugacauuaauuaaaauagacucucaucaucuuggucagaauguucuccacuaaaaacacagagccaggauuccagagaaaugugcacuagccacagcucuacuaaaaggugacuggaugaccauuggaaagucauguaagcuuucucaacuucaauuccacagucucaaaaauaaaagaauuagacuacauaauuuuaaggucccuuauaaauuaauuauagcugcauauaagccaaggacugguggagggguauagagauuaaaaacaaaaucuaaaaagaaaaaaacgcauugguauaccuuacaacggagacaugagugcugaccaa

SEQ ID NO: 126566 - RNA, 1118 nt, Homo sapiens
ccagucugccugccaaauuucagggagcgugcuauagaagacagacaaguacaaggcauuuuguuaguuccaguucucuacauucucaucuuccucuauaaaauuucauggauuucauuggcugcuucaaucccaaaugaaaaaauaggucacauuuuccuaauuuuuucaccugagucuauauacaacaccauaaaaaauaaaaauuacaguguaauuucauuaaaucuagaaaacaaauuagaccaacagaccacuccaaagguauuaaggcauguuuaaaacaaaaauaccuuccguuuggccacugacaguuuauuuucaaaucacauaaaucacagaauacagcugauuucguaucaguacauuuuucuuaagacagcuauuuuacaaugcagaugcccuuaaaaacaaagccugucauuucuucugccuuaauagugacacaaaguucagugcagaagaucagcaaaaucaucagucucaccucaccaugcaacuacaucugugauuaaacaaagcagucagucacuuagaauuaugguuccauucugauauguuugguuaagagucaaacuucucuuuaacaaaauugcgagcugcauuacuauaagcaugcuuauuccuucacaaaaaaaguuacauaaaaaccauaaaauaauuuccuauaguagugcuauauuacauaaauaaacauaggugcucaaauaucacacaccuaagauagcuucagagugaauuugacuucuagguacuuaaaauuaccaccacuuuaauauuaaggaauuauagcuacucaacuauuuaacaaggaagacucaacaaaaauaaaaaaaaaucacucuuuaucuuaaauuucaguauuugcugucauuaacuaaggcaaauaccaaauaucaaaaugaauauuggucuauuuaaguaaaacugaaaaacuuuacccacauauuuuccuaagcuguaaaauuccacuugcuuaaaagaacacauucaucuuuucaaauaagaagaggcaauaagaaaaauagaccaaaaaaaaaaaagauaaacuuugucuaaguaugaaagcaaaaaucacuuccuuaguaucuuaagggccuuacuugacaugcuaaggu

SEQ ID NO: 126567 - RNA, 64 nt, Homo sapiens
caucaagcacacacacucacuccugcuccucucacacacggccaccagagcagcuccccuaguu

SEQ ID NO: 126568 - RNA, 90 nt, Homo sapiens
gacuccccuggagccagaaguuauccaggccaugaccaaggccaugugggaagccuggggaaaucccagcagcccguauucagcagguaa

SEQ ID NO: 126569 - RNA, 69 nt, Homo sapiens
cugaguuggauuaugcucuuugcugaggcuuaaggcugcauguuuuugacucuccucauuauaacgaca

SEQ ID NO: 126570 - RNA, 41 nt, Homo sapiens
agcagaacacucugcagcaaccccagaagaaagguuucaac

SEQ ID NO: 126571 - RNA, 26 nt, Homo sapiens
uguccaucaaaaacagcaaaauauga

SEQ ID NO: 126572 - RNA, 55 nt, Homo sapiens
gccagacagaaacacagcuguagacuguuggaaaaagucacuaguagacugggcu

SEQ ID NO: 126573 - RNA, 48 nt, Homo sapiens
cacagcagaacacuuagugagcccacaaaaaauauguaagacuuaagu

SEQ ID NO: 126574 - RNA, 35 nt, Homo sapiens
accuaugagauucugaguugccagguuuuuuguca

SEQ ID NO: 126575 - RNA, 79 nt, Homo sapiens
cggcagccgggcgcggcgagcgcucgggcuccggcagguccccgaagagguccauggcggaggcuggguggaggcggca

SEQ ID NO: 126576 - RNA, 72 nt, Homo sapiens
agcgcuucggccggaagcggcgcuacagcaagaagucgagcgaagauggcagcccgaccccgggcaagcgcg

SEQ ID NO: 126577 - RNA, 42 nt, Homo sapiens; identical to SEQ ID NO: 24637

SEQ ID NO: 126578 - RNA, 46 nt, Homo sapiens
gagacagaacacugggcaagaagcgaugagcgggauggccccuaga

SEQ ID NO: 126579 - RNA, 47 nt, Homo sapiens
ccaaaugcugggggacacauugguguuugccagguagugggggauga

SEQ ID NO: 126580 - RNA, 81 nt, Homo sapiens
gggccuuaugugcucuuucucaaagcuuaggggcugcagagguggucagaggcagcccuugugcuuguggagguaauagca

SEQ ID NO: 126581 - RNA, 26 nt, Homo sapiens
gccgccugugccgucacagaacuggg

SEQ ID NO: 126582 - RNA, 44 nt, Homo sapiens
gcaggcacccagaggccugaggggcaccgggagcgcacaggagg

SEQ ID NO: 126583 - RNA, 40 nt, Homo sapiens
gggcuucgggcagacggcagggguguggggaggggaggga

SEQ ID NO: 126584 - RNA, 41 nt, Homo sapiens
cugcggaucuguccccagggcuacaccugcugcaccagcga

SEQ ID NO: 126585 - RNA, 79 nt, Homo sapiens
ccaggcuccugggcaagucaugccuugguuuccucagcggcaugcgggugaggauauucuugccucccugugacccucg

SEQ ID NO: 126586 - RNA, 42 nt, Homo sapiens
cugcgggaaccccaaggucaacccccagggccccgggccuga

SEQ ID NO: 126587 - RNA, 45 nt, Homo sapiens
cguccaggacuucuggaucagccucccagggacacugugcaguga

SEQ ID NO: 126588 - RNA, 48 nt, Homo sapiens
cuccccgaggucaugggugacggccuggccaaccagaucaacaacccc

SEQ ID NO: 126589 - RNA, 42 nt, Homo sapiens
acccaugcccucccaggccugucagagcaggaaggacagaag

SEQ ID NO: 126590 - RNA, 60 nt, Homo sapiens
gcccuuacaguagccaggccccgguggcgguaacugccccaaggccccagggacagaggc

SEQ ID NO: 126591 - RNA, 46 nt, Homo sapiens
caccuccggcugccuagcccuccccccagcucccugcaccgccgca

SEQ ID NO: 126592 - RNA, 63 nt, Homo sapiens
agcgcaggcugcagagcccggccccaccucccugcgcccuugaggggccccagcgucugcagg

SEQ ID NO: 126593 - RNA, 70 nt, Homo sapiens
cugcugaggagucugaggacuguccucccacagaccugcagugaggggcccuccaugcgcagaugagggg

SEQ ID NO: 126594 - RNA, 145 nt, Homo sapiens
gaggaccccgagggcugaggagcagccaggacccgccugcucccauccucacccagaucaggaaccagggccucccuguucacggugacacaggucagggcucagagugacccucagcugucaccugcucacagggaugcuggug

SEQ ID NO: 126595 - RNA, 48 nt, Homo sapiens
ggggaccuggauaguuaagggcuuuuccaaacaugcauccauuuacug

SEQ ID NO: 126596 - RNA, 49 nt, Homo sapiens
caucaccgucccgcacaguggacggagguccccgguugcuggucagguc

SEQ ID NO: 126597 - RNA, 46 nt, Homo sapiens
aagggcuggugcgccugcagcucgggcggcagcgugacggugagcg

SEQ ID NO: 126598 - RNA, 62 nt, Homo sapiens
gggacuaugccacucucccugcccagaguacccaagggccacccaguaggccauaggaagcc

SEQ ID NO: 126599 - RNA, 47 nt, Homo sapiens
ggugcugaugggcugguggaaaaggaacaaggcugaagggcuccaga

SEQ ID NO: 126600 - RNA, 50 nt, Homo sapiens
gugucagguagccgauaggggcaucucccagcuaacgccaaggcgaaaaa

SEQ ID NO: 126601 - RNA, 45 nt, Homo sapiens; identical to SEQ ID NO: 24674

SEQ ID NO: 126602 - RNA, 62 nt, Homo sapiens
caccaucaagcaugguuaagaaacaggaaagggguccucccaaggcuggagccccaggccac

SEQ ID NO: 126603 - RNA, 30 nt, Homo sapiens
uugcggaacaggugcaugggcugcacucca

SEQ ID NO: 126604 - RNA, 81 nt, Homo sapiens
gagagcagcugcugcuccggggacccaccugggguggccaugagagcugguggcuggaggccgggaggacccgugaccaga

SEQ ID NO: 126605 - RNA, 45 nt, Homo sapiens
aagguccuccaggccuggggacaggaaagccacugacccagcccg

SEQ ID NO: 126606 - RNA, 64 nt, Homo sapiens
caggcaauucgcgaaguuucaccuguacucccgagcuguuccccaggcuccagacccacuugag

SEQ ID NO: 126607 - RNA, 45 nt, Homo sapiens
uucuacuuaguccuccgacuggguacaacaacagccuagguucua

SEQ ID NO: 126608 - RNA, 50 nt, Homo sapiens
uaccaucugaaguugucacgagugaacagucacauuacuguuguggacca

SEQ ID NO: 126609 - RNA, 177 nt, Homo sapiens
uggcucgggaggaggaggagucugagagcagcacaucugaugacaaaagggcaagucuggaugaggaugaggaugacgaugaugaggaggacaaugaugaggaugacaaugaugaggaugacgaugaugaggacgacgacgaggcggaggacaaugaugaggaugaggacgacgacg

SEQ ID NO: 126610 - RNA, 42 nt, Homo sapiens
cagccuccaauggaggggucauugaggaguuaucuuguguua

SEQ ID NO: 126611 - RNA, 45 nt, Homo sapiens
gggccuguauggcuaggcagacuccucaucuuggagaacagagaa

SEQ ID NO: 126612 - RNA, 42 nt, Homo sapiens
augauccuuacggaaaaggaacagauuguuccuaaaccagaa

SEQ ID NO: 126613 - RNA, 68 nt, Homo sapiens
cauuuugggggggagauuaaguugauugccaaggaaucggguggggauaguuuauaaaagugagggac

SEQ ID NO: 126614 - RNA, 42 nt, Homo sapiens
ugaccuugcacauacaguugccugcuccacuuccccaccugc

SEQ ID NO: 126615 - RNA, 335 nt, Homo sapiens
aaauuaaucacccuggccagugcgguagcucauaccuguaaucccagcacuuuagaggcugagucaggaggauugcuugagcuuaggaauugaagaccagccugggcaacauagugagaccuugucucuacugaaaaguauuuagccagguguggugacacaugccuguagucccagcuacucgagaaacugaggugggaggauugcuugaacccagggagggccaaggcuacagugagcugugaucauaacacuguacuccagccugggugacagagugagaaccugucucaaaaaaaaaaagaaaaaaauuagucacccaauauuacugaaaa

SEQ ID NO: 126616 - RNA, 69 nt, Homo sapiens
acuuagggauggguaagccugcuuucagugucuugggccaaaacaugaaaauuuaaauuucuugcagga

SEQ ID NO: 126617 - RNA, 47 nt, Homo sapiens
cuuuuacuuucuucugagacgugaucuuucauaguggaacuacaauu

SEQ ID NO: 126618 - RNA, 75 nt, Homo sapiens
cacuccuacugcuucuccucccggcagaacaagagccaggugugcugccugcgggagcagguggagaagaagaac

SEQ ID NO: 126619 - RNA, 51 nt, Homo sapiens
aagccuucccagagccccucugccccuccugccgacgucaccccaaagcca

SEQ ID NO: 126620 - RNA, 71 nt, Homo sapiens
cccccgagagcccauugaccgcaagaggcugaagaaagauguggaaccaagcugcagugggagcagccugg

SEQ ID NO: 126621 - RNA, 46 nt, Homo sapiens
gcaagcugcucugcaaggugaagccacacccagggcggcccaggag

SEQ ID NO: 126622 - RNA, 27 nt, Homo sapiens
gacugcauggaggcagcccuggcugug

SEQ ID NO: 126623 - RNA, 28 nt, Homo sapiens
acaguucuguguuccuguugcaugccca

SEQ ID NO: 126624 - RNA, 47 nt, Homo sapiens
uguucagaaaggagguuagaagguccuguugcuuagaacggcccagu

SEQ ID NO: 126625 - RNA, 70 nt, Homo sapiens
ccgucccguagacucuccgcgcguacccgcguccugggcucgggggcccagucccggaaagcccucucgg

SEQ ID NO: 126626 - RNA, 26 nt, Homo sapiens
ggucacccagggugugaaugugggug

SEQ ID NO: 126627 - RNA, 49 nt, Homo sapiens
aaaacugguggcugugccccauuucaugggugaggagacugaggcugga

SEQ ID NO: 126628 - RNA, 22 nt, Homo sapiens
cucugcuaagguauggggacag

SEQ ID NO: 126629 - RNA, 45 nt, Homo sapiens
gcuguauuuucuacccaguauccaaacgggcucugaggucucagg

SEQ ID NO: 126630 - RNA, 45 nt, Homo sapiens
gaucuugucugauguggcaucuagacuuugguuuacauacaggaa

SEQ ID NO: 126631 - RNA, 46 nt, Homo sapiens
ccagaaagauggacaacaugcaccauggaacugcgcggcaugugac

SEQ ID NO: 126632 - RNA, 45 nt, Homo sapiens
caccgcagcaugcagccccagccuguguccgagguggggccuguc

SEQ ID NO: 126633 - RNA, 45 nt, Homo sapiens
cucagcuccggcagggaauccguugcagugccggucggaaucugc

SEQ ID NO: 126634 - RNA, 29 nt, Homo sapiens
ugaccugacagggcagaagcgauggagac

SEQ ID NO: 126635 - RNA, 35 nt, Homo sapiens
ccuccugugcagccuucauggccuucgaguggccc

SEQ ID NO: 126636 - RNA, 52 nt, Homo sapiens
cugcauaaaucacacaccaaaaaucacaacuagguaaucaaaauggaaaaac

SEQ ID NO: 126637 - RNA, 45 nt, Homo sapiens
agcucucaccuagggacagguucaggacgucggggcaggccagau

SEQ ID NO: 126638 - RNA, 25 nt, Homo sapiens
uacgaucugugcccuugcuucccca

SEQ ID NO: 126639 - RNA, 56 nt, Homo sapiens
auccccgaggacgcgcgccggacagucggcacugaccggcccaccugguagcagag

SEQ ID NO: 126640 - RNA, 23 nt, Homo sapiens
cgcugugcugggagcugcagugg

SEQ ID NO: 126641 - RNA, 40 nt, Homo sapiens
cccccgucgcgcccggccgcgcccgccgcccucccgagcc

SEQ ID NO: 126642 - RNA, 45 nt, Homo sapiens
uuuggguccacgggcauguccagcacaucagaggggugcacggac

SEQ ID NO: 126643 - RNA, 44 nt, Homo sapiens
ccagguggaaagguuuuuuguucagcuucaggcauucuacaaac

SEQ ID NO: 126644 - RNA, 26 nt, Homo sapiens
agagcugaagcauuucacucaucucu

SEQ ID NO: 126645 - RNA, 100 nt, Homo sapiens
ugaagacuuucauaguuguaacauaaaggcaaauccugaggaacucacugauggagaugugaaauggcaguaaggaagaaaacagaauaacugaacaaau

SEQ ID NO: 126646 - RNA, 46 nt, Homo sapiens
ugaaaaugagccauuugcugguguaucugaaucauauaauggguaa

SEQ ID NO: 126647 - RNA, 41 nt, Homo sapiens
cacuuuccauggauuuauaauuuuugguuuuguucuaagua

SEQ ID NO: 126648 - RNA, 52 nt, Homo sapiens
agaugacaggagaggaauguaggauugagcuaaauuccccaggccagaagau

SEQ ID NO: 126649 - RNA, 43 nt, Homo sapiens
ugauuucuacaggugugagaauaacacaaaagaacguuaagaa

SEQ ID NO: 126650 - RNA, 64 nt, Homo sapiens
gaagaaaacuuaggaaaaggaaacugcaaaaagaaaacagauuaguugaaagcuuccuguaaau

SEQ ID NO: 126651 - RNA, 59 nt, Homo sapiens
aaguaugggaaucuauaacgaaaaaucugaauuauuugucaaacuuuagggagaguaga

SEQ ID NO: 126652 - RNA, 36 nt, Homo sapiens
ugaccagaggugaagcuaagauugcugaagccagau

SEQ ID NO: 126653 - RNA, 49 nt, Homo sapiens
uacuucuuccaguacaaagccugaucugucuuccacgaucuucucagcu

SEQ ID NO: 126654 - RNA, 32 nt, Homo sapiens
accuuucaguugcucagaugccuugcuuguuc

SEQ ID NO: 126655 - RNA, 60 nt, Homo sapiens
uuuacaucucuuccacaccucacugguuuguucauugugugaacuguaugagauaggaga

SEQ ID NO: 126656 - RNA, 42 nt, Homo sapiens
cugcaacacaccuggaggcuuucugcuucacuacugccucuu

SEQ ID NO: 126657 - RNA, 45 nt, Homo sapiens
agaugaaauggacaccugcggccccaucaugaaucgugcagucag

SEQ ID NO: 126658 - RNA, 46 nt, Homo sapiens
accucaauguaccggugucccaugcuuucccugucuuuuuucaggg

SEQ ID NO: 126659 - RNA, 48 nt, Homo sapiens
uucccuagagccuucucagcuaacuccugcgaggcaaacugcacgaac

SEQ ID NO: 126660 - RNA, 45 nt, Homo sapiens
uguacuccucguagcccccguagccugugcuguaggcaccaggcc

SEQ ID NO: 126661 - RNA, 43 nt, Homo sapiens
cugaaaauaguuuuaguuuacucauuaucacaugcuagaagaa

SEQ ID NO: 126662 - RNA, 42 nt, Homo sapiens
ccaggggguguagagaugauccaauuggguauggaaagaaaa

SEQ ID NO: 126663 - RNA, 46 nt, Homo sapiens
auuuuuuuauuguguguuauuuaaaauauuacauaugcagcuggga

SEQ ID NO: 126664 - RNA, 38 nt, Homo sapiens
cuuuuugagauuuuccaccuuacuuucuagcagcugua

SEQ ID NO: 126665 - RNA, 47 nt, Homo sapiens
aacaggaauuauaacaacauaaaagcagguagugguaaugaguagga

SEQ ID NO: 126666 - RNA, 44 nt, Homo sapiens
ggcaucaguuuauucaccuauugaauagaccugacuucaaaaaa

SEQ ID NO: 126667 - RNA, 44 nt, Homo sapiens
uaauguucugucaugcuuugguuugcaccugaaaaucagacaua

SEQ ID NO: 126668 - RNA, 47 nt, Homo sapiens
gcuuuuuaaauugcugcgcuaacccuuucauugugcauuaaaggaaa

SEQ ID NO: 126669 - RNA, 47 nt, Homo sapiens
uuuuugcuuguauuauacauggaaugaagauacuuuuaucccuggaa

SEQ ID NO: 126670 - RNA, 24 nt, Homo sapiens
ugccauuacaacuucuaacauaga

SEQ ID NO: 126671 - RNA, 30 nt, Homo sapiens
ugaggcugaauaggaaaguguuucaugacc

SEQ ID NO: 126672 - RNA, 43 nt, Homo sapiens
uacuugaggaucucucuuuaauuucauauagcuuguaaugaua

SEQ ID NO: 126673 - RNA, 57 nt, Homo sapiens
uugcacaauucuuuagugucucggguugaaaaauucacccaaaauagcacaaaaucu

SEQ ID NO: 126674 - RNA, 85 nt, Homo sapiens
caucaaauuauucagaauuucaccauuaaacccucuccucugcccuccaaaaagccuauauaacacugaauacagcaaaauguau

SEQ ID NO: 126675 - RNA, 48 nt, Homo sapiens
uuuuaauaaaacagaaaagaaaauacagcuuuaauuguggagcuuggg

SEQ ID NO: 126676 - RNA, 45 nt, Homo sapiens
uauucuagagguguucugucuccugaacgucauguucguacuaga

SEQ ID NO: 126677 - RNA, 46 nt, Homo sapiens
agaaagacuuuaaaacaaagaauggaagauaugauauuaguaaaau

SEQ ID NO: 126678 - RNA, 46 nt, Homo sapiens
uaaaguuuauuccuuaauucagaguuugacuucucaaaucagacau

SEQ ID NO: 126679 - RNA, 45 nt, Homo sapiens
auuauuaguuugguaucauuuaggaaaguacuaaguuuuaucaau

SEQ ID NO: 126680 - RNA, 46 nt, Homo sapiens
guuuauacaguggguccagauuaugcccaugcugaagcucgaaaau

SEQ ID NO: 126681 - RNA, 44 nt, Homo sapiens; identical to SEQ ID NO: 24841

SEQ ID NO: 126682 - RNA, 44 nt, Homo sapiens
aguuuuagggacuuaauuucuaauauuuuaauguugaccuagca

SEQ ID NO: 126683 - RNA, 45 nt, Homo sapiens
guauauuugauaaaacucucaagcacuuaaaugcaaagaucacca

SEQ ID NO: 126684 - RNA, 43 nt, Homo sapiens
uacauuagaccaauauuuuucuuacucaucauuuaauuuuuua

SEQ ID NO: 126685 - RNA, 37 nt, Homo sapiens
guccucauuuuugcucuuuaguauaauggccuuuggu

SEQ ID NO: 126686 - RNA, 46 nt, Homo sapiens
aaucccauuuuacagaugaugacuagagagguucaauaacuugacu

SEQ ID NO: 126687 - RNA, 42 nt, Homo sapiens
ugaccaguaaagguauggaagagaugauuaucccaggcagua

SEQ ID NO: 126688 - RNA, 45 nt, Homo sapiens
gggggaucugaauacuaggugggacugauggaugauccagggugu

SEQ ID NO: 126689 - RNA, 40 nt, Homo sapiens
aaguuggggaggaaaaaacccaacccugauggaaacagau

SEQ ID NO: 126690 - RNA, 125 nt, Homo sapiens
ggaggaacuggagaccccaaccccuacccagagaggaggugagcuuggaggacagaggagggggcaguggguaggaagugagacacuggaggccaaauggcuuugccuguuauuuuagaagcaga

SEQ ID NO: 126691 - RNA, 41 nt, Homo sapiens
gacaggcagauauacccaaagagggagaaaauacuuaauaa

SEQ ID NO: 126692 - RNA, 45 nt, Homo sapiens
agucagggaggcgcccacacuccugacaggauaagauggcggcga

SEQ ID NO: 126693 - RNA, 46 nt, Homo sapiens
aauaggacacacugcugcugucuccgaaaagucagauguacuuaag

SEQ ID NO: 126694 - RNA, 54 nt, Homo sapiens
agcauuaguacccuugauucuuuagacuuugcaagauauucagaugaugguaac

SEQ ID NO: 126695 - RNA, 72 nt, Homo sapiens
acaaaagggaugccacaugggacacacacggucugugaaaaaaauauggggucagagaauacccauaaugug

SEQ ID NO: 126696 - RNA, 48 nt, Homo sapiens
ucuuaaguuuggagaaauaaaauaaccuuuaauugcuguacugugcuc

SEQ ID NO: 126697 - RNA, 41 nt, Homo sapiens
cuauuagcaguacauuuugauuuucuugauuuaaaccauau

SEQ ID NO: 126698 - RNA, 46 nt, Homo sapiens
aaggagaccauucaggcccuccgagccaaccugacaaaggccgcag

SEQ ID NO: 126699 - RNA, 46 nt, Homo sapiens
uuucuagauuccuuuuuacuacuccucagugacuauauaguccacu

SEQ ID NO: 126700 - RNA, 46 nt, Homo sapiens
aagauacaaauuucauacuuccucugguuuucucuaaagcccccac

SEQ ID NO: 126701 - RNA, 57 nt, Homo sapiens
uuucaaaaauacaguuguccucuggugauuucucuuaauuucucuuucuacagugaa

SEQ ID NO: 126702 - RNA, 46 nt, Homo sapiens
caguugccccacaaagacucugaggacaguggacagcauccagaug

SEQ ID NO: 126703 - RNA, 47 nt, Homo sapiens
gcauccuauauuuugaaaugcaucuuucagcuauuuaguacauguca

SEQ ID NO: 126704 - RNA, 44 nt, Homo sapiens
ucauccaagacuugaagacuauguaagaguuaacaagcaaagag

SEQ ID NO: 126705 - RNA, 46 nt, Homo sapiens
cgagaucagcuucuccacauacuuuucaauuugaucaagaggccag

SEQ ID NO: 126706 - RNA, 54 nt, Homo sapiens
cucucaagaugcuuuugaacagcaacugcuuucuuaauuaaaugguagagaucu

SEQ ID NO: 126707 - RNA, 48 nt, Homo sapiens
gauaucggggaucuaucuagccgccuaccuccaguuuguugcccagua

SEQ ID NO: 126708 - RNA, 46 nt, Homo sapiens
gguucuuucaauguugcaacaaauguuaauggaagauaaggcagau

SEQ ID NO: 126709 - RNA, 46 nt, Homo sapiens
acuuggaaauuuacagucucaucuuauacuuacacuacugaacaag

SEQ ID NO: 126710 - RNA, 56 nt, Homo sapiens
ccaguaguucauuucucauuuuuaaaaugaacuuuuaauuuuucccacauacaaga

SEQ ID NO: 126711 - RNA, 51 nt, Homo sapiens
uuguccuuuauuuuucauucuuguugacuuaguuuaacuuucugacuuuua

SEQ ID NO: 126712 - RNA, 46 nt, Homo sapiens
gcugcugcaacuuuaugacuaccagcuagaacaagaggguacaaca

SEQ ID NO: 126713 - RNA, 55 nt, Homo sapiens
aaugaauaguaguagcaacaguaguaaacauuucauuuaaucaauuugcccauug

SEQ ID NO: 126714 - RNA, 53 nt, Homo sapiens
uaaauauaaguagccacauguggcuaguggcuacuacuauauuagaccacagg

SEQ ID NO: 126715 - RNA, 40 nt, Homo sapiens
gaaguacagauuugaagaaaauuuaguuucccagaacuga

SEQ ID NO: 126716 - RNA, 35 nt, Homo sapiens
guguaucuacauuuauguaaccaaucuuagagugg

SEQ ID NO: 126717 - RNA, 55 nt, Homo sapiens
uuuccugauaccuuuuaaugucaagauaaucaacuaaaacucaaagaugacugag

SEQ ID NO: 126718 - RNA, 46 nt, Homo sapiens
caucuucauuucuucauaacuauuuuauuucauucuauuugucucc

SEQ ID NO: 126719 - RNA, 42 nt, Homo sapiens
gaaagaauaaugcagacuuuuuauuguuucuuaacugacuag

SEQ ID NO: 126720 - RNA, 85 nt, Homo sapiens
uacuucagaugcguagggaauguuacucauccacccuucuucagccauuucauuacugaaguacuguuaaguuuaugccacagcc

SEQ ID NO: 126721 - RNA, 46 nt, Homo sapiens
uccagacauaggaacacuguggccaaaauaacccaaaaaugcacga

SEQ ID NO: 126722 - RNA, 101 nt, Homo sapiens
uguauucauuaaaguggacauuuuguguaauauauauccuauaagauugugagguaauucuguuuugaauguagagaauuacugugucaucucuacuccug

SEQ ID NO: 126723 - RNA, 31 nt, Homo sapiens
gaaacuuuaaauucuuuucauugucacagag

SEQ ID NO: 126724 - RNA, 68 nt, Homo sapiens
uucaguuuuugccacuuuuaucccauucacuugaugauuugcgccagcauucuagcuuaccauccagu

SEQ ID NO: 126725 - RNA, 39 nt, Homo sapiens
uugugauuaaguaauauacuaguaaauaguauagucaaa

SEQ ID NO: 126726 - RNA, 47 nt, Homo sapiens
aacugggaaggauuuccauuuuauagguucagccuugguuacugaau

SEQ ID NO: 126727 - RNA, 48 nt, Homo sapiens
caagugacugaaucucucagaaccagcgucccccaucucuaaaauaga

SEQ ID NO: 126728 - RNA, 34 nt, Homo sapiens
aaucugaugauccugaaaaaaagaaacuacagaa

SEQ ID NO: 126729 - RNA, 45 nt, Homo sapiens
caucacguuuaaauguugcaauguauccugucauaugcuaguccc

SEQ ID NO: 126730 - RNA, 32 nt, Homo sapiens
agguuuuauauucucuguucaagaugugaucg

SEQ ID NO: 126731 - RNA, 66 nt, Homo sapiens
agcaaaguaucagggcaaaguguacagaauaucuugauagagcagaaaaacuaaaggaguaccuga

SEQ ID NO: 126732 - RNA, 39 nt, Homo sapiens
guuaacauuaacuuaauauacccugcugucuugcuuagg

SEQ ID NO: 126733 - RNA, 47 nt, Homo sapiens
cuuuguguaguaaaauuuacgauguugguauuacacagaauauaugg

SEQ ID NO: 126734 - RNA, 41 nt, Homo sapiens
ugcagcugaacucauuguuaaguuaaauuucaugcccagga

SEQ ID NO: 126735 - RNA, 45 nt, Homo sapiens
uucuuauguaaucuugucaaugaaaacacucugaaggcaauaaaa

SEQ ID NO: 126736 - RNA, 73 nt, Homo sapiens
cuccccagaaauccaccguauuaaccaauggagaagcagcaaugcagucuccuaauucagaaucaaaaaagaa

SEQ ID NO: 126737 - RNA, 45 nt, Homo sapiens
uugaaacucgacaucuuccugcggauuaagcgacaggauuggccc

SEQ ID NO: 126738 - RNA, 46 nt, Homo sapiens
guaguuguucauuguuucagcaacuauuuuggcaacauccucagac

SEQ ID NO: 126739 - RNA, 45 nt, Homo sapiens
ccucuccaaaaauguugguguacaaacugguguggggcccuggau

SEQ ID NO: 126740 - RNA, 41 nt, Homo sapiens
guguuugagucucuuguauuucuucuuuuacacaggauaug

SEQ ID NO: 126741 - RNA, 47 nt, Homo sapiens
augucaaguuaauaauccacggacugcugccuuuaaauuuuuuaaac

SEQ ID NO: 126742 - RNA, 37 nt, Homo sapiens
gagccuucuccaucagcagcaggguccugauccacac

SEQ ID NO: 126743 - RNA, 33 nt, Homo sapiens
guaggcaucaggcaccaagauaagcuaauaaug

SEQ ID NO: 126744 - RNA, 45 nt, Homo sapiens
ugggcaauuaagaaccaaagguuuccaauagauucgggguuaaga

SEQ ID NO: 126745 - RNA, 51 nt, Homo sapiens
ggggcaaugucuacauccacggggauccacagggcugggagcuggagacag

SEQ ID NO: 126746 - RNA, 70 nt, Homo sapiens
ccaacucccagaggaggagguaaagguaccagcuuccagggugaagcagagcuuucucuggaggcaggag

SEQ ID NO: 126747 - RNA, 47 nt, Homo sapiens
gaagcaaaccugaaacaggagaaugagggcaaacugcucccaucaag

SEQ ID NO: 126748 - RNA, 64 nt, Homo sapiens
aucuaccaugccaaugcgccagugcagagacaggagcacaucuuuggguuccgcagcagcagau

SEQ ID NO: 126749 - RNA, 78 nt, Homo sapiens
ggggcggccccucaaaaccaccaagcugaggccacugugagcaguccccuuuguagcaggaagagcagcuggacacau

SEQ ID NO: 126750 - RNA, 52 nt, Homo sapiens
ccggagcccugccuuucuuucuuccuuccucaauccuuccucccccucgccc

SEQ ID NO: 126751 - RNA, 24 nt, Homo sapiens
ggggcucuggacgagcagggcggg

SEQ ID NO: 126752 - RNA, 62 nt, Homo sapiens
uuccaucuggcuucagcggcucgaguggagucucuaaaacacacaacacaacaaaacaaaaa

SEQ ID NO: 126753 - RNA, 42 nt, Homo sapiens
auuucauauauaggugccaaaagugaaucggggugcggagag

SEQ ID NO: 126754 - RNA, 42 nt, Homo sapiens
uucccacucuccccgacuucauucacucaaacuucuuuaaau

SEQ ID NO: 126755 - RNA, 80 nt, Homo sapiens
cacccccagguguucuuugaccuaaugagagaaaucagaacaaagaagaugucagaaaacaaagacaagaauggcaagaa

SEQ ID NO: 126756 - RNA, 43 nt, Homo sapiens
ggaggcaggugccuguggaggaggccaggaguaaagccgaaga

SEQ ID NO: 126757 - RNA, 48 nt, Homo sapiens
ucuggacaccgcugggcaagaggacuacgcagccauucgagauaacua

SEQ ID NO: 126758 - RNA, 46 nt, Homo sapiens
uuuguagaagacuaugaaccuaccaaagcugacaguuauagaaaga

SEQ ID NO: 126759 - RNA, 42 nt, Homo sapiens
ucaugguuggcagcggaggcguuggcaagucagcccugacgc

SEQ ID NO: 126760 - RNA, 45 nt, Homo sapiens
cggaacuugcacgcgccgugaacugggcgguguuccuaaagggcu

SEQ ID NO: 126761 - RNA, 40 nt, Homo sapiens
acaaagaaauucuggauguuaaaauaauauauacucauca

SEQ ID NO: 126762 - RNA, 58 nt, Homo sapiens
auuuagagcuuucaaacuggaaaaaaaaaugaaacaaaacaaauacaccaagaccaaa

SEQ ID NO: 126763 - RNA, 38 nt, Homo sapiens
gagggccuguagcuggaauacgcaucucuccagcauuc

SEQ ID NO: 126764 - RNA, 29 nt, Homo sapiens
agaauaauuagaacauuuuuauguuaaga

SEQ ID NO: 126765 - RNA, 41 nt, Homo sapiens
gcagcauuccucugaauauugauuugcugaauagcccagac

SEQ ID NO: 126766 - RNA, 48 nt, Homo sapiens
uauuaaauaaucauauugagauggggaaaauaaggauguuggugauaa

SEQ ID NO: 126767 - RNA, 29 nt, Homo sapiens
ucauuaagacuuaggaucauggguauucu

SEQ ID NO: 126768 - RNA, 37 nt, Homo sapiens
uacaggcuuaauaugcagucuugaagacaggaaagag

SEQ ID NO: 126769 - RNA, 38 nt, Homo sapiens
uucuuuaagauguucugaaacacauuucugguaaaaua

SEQ ID NO: 126770 - RNA, 68 nt, Homo sapiens
aaaaggaggcugggauauggaauauuagagcuuaaaguaaaaagugaguaccugcuaaaguuagcaga

SEQ ID NO: 126771 - RNA, 46 nt, Homo sapiens
gggaaaacagaguaucagaccacaaaaaccaauaaagcaagaagau

SEQ ID NO: 126772 - RNA, 46 nt, Homo sapiens
cagauuggauuuuaagaagaauaaauuaaccuuggugguuguagaa

SEQ ID NO: 126773 - RNA, 67 nt, Homo sapiens
ugucucagaguucagauucgugccuauucagacugaagagauggaacuggcuauuuuugagaaaugg

SEQ ID NO: 126774 - RNA, 42 nt, Homo sapiens
uauguaggauuuggaauggggagagauugaagucagggaaag

SEQ ID NO: 126775 - RNA, 46 nt, Homo sapiens
aauauuuacucucaaauaauugggauuagguagucuucaagcaggg

SEQ ID NO: 126776 - RNA, 54 nt, Homo sapiens
aaaagauauuaacaacaugaaacaagaacaaaaacuuacuuaauaggaccaaag

SEQ ID NO: 126777 - RNA, 45 nt, Homo sapiens
uuuugaauauagaaucuucugaagccuuuaauacgugaggcagaa

SEQ ID NO: 126778 - RNA, 389 nt, Homo sapiens
aaaauguuccucaguaauugcgguuuuuguuguuguuguuguuucugagauggagucucacucuguugcucagguuggagugcagugacaugaucuuggcucacugcaacaucugccuccccaguucaagcaguucuccugccucagccucucaaguagcugggauuacagguggcccaccacuaugcccagcuaauuuuuguauuuuuaguagagauuuuuaguauuguauauacaauauacaaauuuuguauuucguauauuggucaggcuggcuucgagcuccugaccugaagugauucaccugccucaaccucccaaagugcugggauuauagguaauugguuuuauauacauagguagagaugggaggaagaacauucuaggag

SEQ ID NO: 126779 - RNA, 106 nt, Homo sapiens
auagucugcugucaugaagagagaaaaaggauggaagugaagcaaagaguuuuggugggaugguguguuugaaagccagauuuuagagggcuaaaggaauuauugg

SEQ ID NO: 126780 - RNA, 224 nt, Homo sapiens
uacgguaauacagauacaagaugaugaggcugcagacuuacagugacagugaggcugcauaggaaagagugccugcuuaguacauggauaugguuggcgggaggggagugaggacuagugcuuacuacuuggauauagcguggggagggaauaaagaugaguaaaauacaguucuaacucugaugggaggggcgcauaucaauuaugucaaagaucaugagaag

SEQ ID NO: 126781 - RNA, 54 nt, Homo sapiens
uagaggugauaugcuugauuuguuacagaagaaaaaaucaugccuggagacugc

SEQ ID NO: 126782 - RNA, 44 nt, Homo sapiens
gcuugcuuagggcagccugagugagugggaacugacaggguggu

SEQ ID NO: 126783 - RNA, 26 nt, Homo sapiens
acccaauuuaaaaaugggcaaaggau

SEQ ID NO: 126784 - RNA, 63 nt, Homo sapiens
uucaggguuguugauggacaagcugauaguaggagaguagaauuuguaaaaaaaaaaaaaaga

SEQ ID NO: 126785 - RNA, 46 nt, Homo sapiens
uggauauguggugaaaagccugagauugcuguguaagagacuggaa

SEQ ID NO: 126786 - RNA, 46 nt, Homo sapiens
cuuuuuggcuuauuuguuggcuuauguguacuuaaacucucuuugu

SEQ ID NO: 126787 - RNA, 55 nt, Homo sapiens
guccagaauuaaaaagacucuccggccgagcagcaagaguacaagagcagagcaa

SEQ ID NO: 126788 - RNA, 47 nt, Homo sapiens
acgaagucuuuguccuugugugugagugggggaaguagucaguaaaa

SEQ ID NO: 126789 - RNA, 52 nt, Homo sapiens
ucgagcuaaccuguauuugagaaaaacuucagucucuugggaaaggagaggc

SEQ ID NO: 126790 - RNA, 48 nt, Homo sapiens
auggcauuuuacaaaaaaaaaaugaagaacucaaaaaaacuuugaaaa

SEQ ID NO: 126791 - RNA, 27 nt, Homo sapiens
uccuuucuaagggugaacauaccacau

SEQ ID NO: 126792 - RNA, 45 nt, Homo sapiens
uauacaguuuagcaguguuaaguauacuuacauuuuuuugcaacc

SEQ ID NO: 126793 - RNA, 45 nt, Homo sapiens
acacugccuauaucuucaggaagaugacccuauuuaaccaagagg

SEQ ID NO: 126794 - RNA, 59 nt, Homo sapiens
aaaaaaucuuaagauuuaaugaggauuuuugcugccucaaaauauagccagauuacuua

SEQ ID NO: 126795 - RNA, 43 nt, Homo sapiens
caaugacuacuaauugguauaggguuuauuuuggguguaaugg

SEQ ID NO: 126796 - RNA, 64 nt, Homo sapiens
augaaguagaucagugguggucuagaucugggguaaggaugggggaacggaugaggaagaauga

SEQ ID NO: 126797 - RNA, 46 nt, Homo sapiens
caccuaggcucuuuuguauauuuucauuuaauccucauagacaucc

SEQ ID NO: 126798 - RNA, 44 nt, Homo sapiens
aaaaacaguuggaaccaaauucauuauucacauucgcaacaaga

SEQ ID NO: 126799 - RNA, 33 nt, Homo sapiens
ucucccaaauccacgacuucuguggaugcauac

SEQ ID NO: 126800 - RNA, 42 nt, Homo sapiens
aucuccgucaucaacacaagcuaauagcauuguucuggaauc

SEQ ID NO: 126801 - RNA, 46 nt, Homo sapiens
cgaaauucuacauucacgcaggaaggaacccgguuacgaccaucuu

SEQ ID NO: 126802 - RNA, 46 nt, Homo sapiens
gaaacacaaagucuuccaucacgaucuccaccgggaacuccuaauc

SEQ ID NO: 126803 - RNA, 48 nt, Homo sapiens
uccaaaaguggaaauugcuuuuuuccccuaguaauauaagugauagcu

SEQ ID NO: 126804 - RNA, 63 nt, Homo sapiens
gaacugaaguccaaucaguucaguauggcaaagaaaaggcaaauaaagacaggguauuugcaa

SEQ ID NO: 126805 - RNA, 41 nt, Homo sapiens
uauuguuggauuuuguuuccuuucuuuaaaauaaagaugua

SEQ ID NO: 126806 - RNA, 46 nt, Homo sapiens
agcacuuguuaucugcauuuuuauuauaaccauucuagugaguaua

SEQ ID NO: 126807 - RNA, 46 nt, Homo sapiens
acguaccuuagaacucuauggaguugaauuccacuaugcaagggua

SEQ ID NO: 126808 - RNA, 48 nt, Homo sapiens
uaauaacagauaacuaagguuguaaaaacuauaugugaaauaggagua

SEQ ID NO: 126809 - RNA, 48 nt, Homo sapiens
ccgccaaucaaagagagacuuccuuaauucacauggaaguguauaggu

SEQ ID NO: 126810 - RNA, 43 nt, Homo sapiens
uaaccugaaugacaaccuuguguguugccugaaagacagaauu

SEQ ID NO: 126811 - RNA, 51 nt, Homo sapiens
uauacaagguggguuuauggauauauuuuucuugaaaauauugucaaaacu

SEQ ID NO: 126812 - RNA, 29 nt, Homo sapiens
uggcuguggggaaugaagaaaagaagaug

SEQ ID NO: 126813 - RNA, 27 nt, Homo sapiens
gcaguuucauuauuuaaauauuuggaa

SEQ ID NO: 126814 - RNA, 30 nt, Homo sapiens
gaaaucuguuuauaaggcuauauuaauaga

SEQ ID NO: 126815 - RNA, 46 nt, Homo sapiens
cuuguuggaugucgucuucaagcaucuagauuugacugagcaggac

SEQ ID NO: 126816 - RNA, 60 nt, Homo sapiens
agccaaauaugucacuuuccagucacaauuuaaauauaagaauaaaaggcauaacaaaau

SEQ ID NO: 126817 - RNA, 38 nt, Homo sapiens
uaauaugcagcucugggaguuacagcgacucacacaau

SEQ ID NO: 126818 - RNA, 40 nt, Homo sapiens
uccacagugucugcuugcucauuggcaauggcuggggguu

SEQ ID NO: 126819 - RNA, 50 nt, Homo sapiens
uccagcuguaauccuuuuccuguuaaugucaccaacauacaugagcaggg

SEQ ID NO: 126820 - RNA, 47 nt, Homo sapiens
gcuacaugguucaaguuucaaaauaauauaaaaaggcauauaaugag

SEQ ID NO: 126821 - RNA, 53 nt, Homo sapiens
ucgagaaguuugccauagagguaaaagaucucaggucauggaagaauagggga

SEQ ID NO: 126822 - RNA, 48 nt, Homo sapiens
ugagagaggagugugguuguguguuagaugauggugaaguaaggaauu

SEQ ID NO: 126823 - RNA, 43 nt, Homo sapiens
accaucacugaaagauuaagggcucuccgaaaucaagaagcca

SEQ ID NO: 126824 - RNA, 47 nt, Homo sapiens
cuauguaccguguguauacacagcucaagaugagccuggaacaccuc

SEQ ID NO: 126825 - RNA, 42 nt, Homo sapiens
uaauugacaaauaucauagaaauauuuuuugcacuguuaguu

SEQ ID NO: 126826 - RNA, 37 nt, Homo sapiens
cuuuugcaugaauggggaaaaagaggaggggaaauuu

SEQ ID NO: 126827 - RNA, 67 nt, Homo sapiens
aauuugccaguuuacuagaauaagcugugaagccuugaaguuuggcuuagcauucugaaaauccuuu

SEQ ID NO: 126828 - RNA, 54 nt, Homo sapiens
agauaaaaggccaauguguccgacuugcaaaagacaauuagaguagaaagaaga

SEQ ID NO: 126829 - RNA, 61 nt, Homo sapiens
cuugaacuguaaaguggagaugauguaaaccgccuugcaagauuguagaguuggguaaggu

SEQ ID NO: 126830 - RNA, 46 nt, Homo sapiens
ugagucuggagggcccuguuggagccuuuggaccuauagcucacgg

SEQ ID NO: 126831 - RNA, 46 nt, Homo sapiens
uccgggaagaggugguacgagauuggaacuccaaacaggccugcac

SEQ ID NO: 126832 - RNA, 24 nt, Homo sapiens
ccccuguggcggaccgcagcauuu

SEQ ID NO: 126833 - RNA, 45 nt, Homo sapiens
ggggaccugccaugaguguagucacugcggacaaucugggccaag

SEQ ID NO: 126834 - RNA, 57 nt, Homo sapiens
ccuguguucaaaucccagcuccgucucugugcgucaauuuccccaugugccaaacag

SEQ ID NO: 126835 - RNA, 48 nt, Homo sapiens
uuuguuugcggcaacucauucguugcucauuaagcacuuuucacggac

SEQ ID NO: 126836 - RNA, 47 nt, Homo sapiens
cuuccaaggaagaugccaugaaagcuuacaucaacaaaguagaagag

SEQ ID NO: 126837 - RNA, 112 nt, Homo sapiens
aaggauacauaaaagaagggaaugagcuaaugcauggccugccgcuggcaucguaggcucagugaauggagccauuauaugcuaagcaccagcagccaagaaguauccaagc

SEQ ID NO: 126838 - RNA, 46 nt, Homo sapiens
gucugcaacucccucuccccuacaaggccaggcggugacccccuaa

SEQ ID NO: 126839 - RNA, 42 nt, Homo sapiens
ggccacugaaaaauaguuugggaaaugauguaguuggcguag

SEQ ID NO: 126840 - RNA, 42 nt, Homo sapiens
gggcaaggccaagugggaugccuggaaugagcugaaagguaa

SEQ ID NO: 126841 - RNA, 24 nt, Homo sapiens
acugugccccgucuguccucaggc

SEQ ID NO: 126842 - RNA, 38 nt, Homo sapiens
gucaggggaaguacggggccggcugcucagagugcggg

SEQ ID NO: 126843 - RNA, 61 nt, Homo sapiens
cuguguagcgggagaggggugggagucgagggugcuugauggagagaugggggaagggguu

SEQ ID NO: 126844 - RNA, 48 nt, Homo sapiens
ggaagggcgucccaguaagaggaacagcauaugugaagguccuguggu

SEQ ID NO: 126845 - RNA, 42 nt, Homo sapiens
gaugaugguucccugucccuggaagagcuuucucuggaagag

SEQ ID NO: 126846 - RNA, 42 nt, Homo sapiens
caagaguuugagagauccaaggggaagaauccagcugcccau

SEQ ID NO: 126847 - RNA, 42 nt, Homo sapiens
gcgaggagguggugguggauuuggcuaccagaaaaccaagaa

SEQ ID NO: 126848 - RNA, 59 nt, Homo sapiens
acgucuggaggcaaacauuaaggaaaucaagcaaaaaagauaaugaacuccaaucuaac

SEQ ID NO: 126849 - RNA, 47 nt, Homo sapiens
gaaauugauugaaaagaauuacuuucuucauaagucagcccaggaag

SEQ ID NO: 126850 - RNA, 38 nt, Homo sapiens
cauuagauaacuagaaaagcaacaggccugugccaggu

SEQ ID NO: 126851 - RNA, 55 nt, Homo sapiens
ggguagaagaacagguuuaagguugaaguuacuuuuuuacagugagaaauuugag

SEQ ID NO: 126852 - RNA, 79 nt, Homo sapiens
ggaauauauucaucguguggguagaacagccagaggccuaaaugggagagggcaugccuugcucauuuugcgcccagaa

SEQ ID NO: 126853 - RNA, 46 nt, Homo sapiens
ucgacuggauuguucaguaugacccuccggaugacccuaagguaac

SEQ ID NO: 126854 - RNA, 42 nt, Homo sapiens
aggauuucucugaaaaaggagccauuguauguuggcguugau

SEQ ID NO: 126855 - RNA, 46 nt, Homo sapiens
acuuuaccauagccaagugagguaguugugccaauuaacccgaaag

SEQ ID NO: 126856 - RNA, 42 nt, Homo sapiens
cugcaguugaacucauuguuaaguuaagguucaugcccagga

SEQ ID NO: 126857 - RNA, 46 nt, Homo sapiens
uucucuauguaaucuugucaaugaaaacacucugaaggcaauaaaa

SEQ ID NO: 126858 - RNA, 67 nt, Homo sapiens
agcaaaaacugaaaacaaagggaaaucugaagaagaaagugccgagacuacuaaagaaacagaaaau

SEQ ID NO: 126859 - RNA, 46 nt, Homo sapiens
ucuguacccuggguuuuuaaauacaaccacucauuuuucaccaaac

SEQ ID NO: 126860 - RNA, 55 nt, Homo sapiens
uaaccaauggagaagcagcaaugcagucuuccaauucagaaucaaaaaagaaaaa

SEQ ID NO: 126861 - RNA, 57 nt, Homo sapiens
cucaagaagcagugggaaauauaaaaguuacaaagucuccccagaaauccacuguau

SEQ ID NO: 126862 - RNA, 26 nt, Homo sapiens
ugagaaagugcuacgagaacgugugg

SEQ ID NO: 126863 - RNA, 44 nt, Homo sapiens
cguaagccuagaagugaacggggaguccucccgcucuaacguug

SEQ ID NO: 126864 - RNA, 62 nt, Homo sapiens
cuuacgcaggaguuucaucggcaggugugacauucugcccaacaagugccuagaauaaggcg

SEQ ID NO: 126865 - RNA, 62 nt, Homo sapiens
uauucuaggcacuuguugggcagaaugucacaccugccgaugaaacuccugcguaagaagau

SEQ ID NO: 126866 - RNA, 45 nt, Homo sapiens
uuucagccgggcaucuacaguucuuuucaaaucucuuugcaagcg

SEQ ID NO: 126867 - RNA, 77 nt, Homo sapiens
ucucucagcaguugcugaauaaaauauguuauaucucguccugcgauuggaauguguuuaauacagcugccaaucac

SEQ ID NO: 126868 - RNA, 45 nt, Homo sapiens
guguugauguucuugagagcaucagccagggcguucaugcauucc

SEQ ID NO: 126869 - RNA, 70 nt, Homo sapiens
gucuauuaccguaccggucaacguccguucuccuacuugucuugagguccaagaugcagcuaaggcaaga

SEQ ID NO: 126870 - RNA, 68 nt, Homo sapiens
gccuggaacauugaaggacucaaacauuauuucagcaguauauucccuguuuucuggaguauucaaug

SEQ ID NO: 126871 - RNA, 58 nt, Homo sapiens
uuuaaagaucacuugcuccauaaaccuuuccauuaagucccaaucuucaacuauacca

SEQ ID NO: 126872 - RNA, 44 nt, Homo sapiens
accuuucaucacccuccuuugagcuugaucacccacuuuugcug

SEQ ID NO: 126873 - RNA, 63 nt, Homo sapiens
cugcugcugccgccgucugcuccgugcugcuaggggccagagauuggcggcgggagacaaggg

SEQ ID NO: 126874 - RNA, 47 nt, Homo sapiens
cuaucugaccauccacagcugggccgccuucaccguccgggggguag

SEQ ID NO: 126875 - RNA, 44 nt, Homo sapiens
ucuuccccucacgccgccuuuccccgggaagccaagauggccgc

SEQ ID NO: 126876 - RNA, 78 nt, Homo sapiens
gucuuacuuuauuuuguugcugcuguuauuauuguuguugcuggauuggaaugagaagaucugaguugaccuugacca

SEQ ID NO: 126877 - RNA, 46 nt, Homo sapiens
cauuaucuuguacaagaguccacugauaaagaaggaaaggaugagu

SEQ ID NO: 126878 - RNA, 47 nt, Homo sapiens
ucaaggaaaagcugcuguaguaaagaggcuuagaaucagugcucuga

SEQ ID NO: 126879 - RNA, 46 nt, Homo sapiens
ugcuggguaugaauaaugacuuuccuccaagagcacauugccuggu

SEQ ID NO: 126880 - RNA, 46 nt, Homo sapiens
ucuuuuauucaacaaauauaauuuuuaaacauuuacugugauccag

SEQ ID NO: 126881 - RNA, 45 nt, Homo sapiens
ugccucugcauaacuaauuuugauuucagggcuaggaggguggag

SEQ ID NO: 126882 - RNA, 49 nt, Homo sapiens
gauauggcaacugaaugagaaguuuuaauuaauguagaugucauagcaa

SEQ ID NO: 126883 - RNA, 68 nt, Homo sapiens
gugaguucguggugauugccccugcugcacacagugacgcuguucucagcgaaucuaagugcaaccuu

SEQ ID NO: 126884 - RNA, 46 nt, Homo sapiens; identical to SEQ ID NO: 25214

SEQ ID NO: 126885 - RNA, 99 nt, Homo sapiens
uuugaaggauugcuuugacaacaguugagagaaagcuuuuagugagaaugagagggagaugaauagagagcuaagguggcuccuagguauaacagagug

SEQ ID NO: 126886 - RNA, 46 nt, Homo sapiens
auacaaaguacuuuuaauuauguugcuauauuuguacaggaaaaau

SEQ ID NO: 126887 - RNA, 54 nt, Homo sapiens
aaaagcaggagaccaguuggugccagauaaucuaaaagaaacagauaaggaaaa

SEQ ID NO: 126888 - RNA, 66 nt, Homo sapiens
gauuagcuuuuaucuguucaaaaauaguuugaagucauauacaccauuaggauguagaacagcaau

SEQ ID NO: 126889 - RNA, 57 nt, Homo sapiens
guaccuugcacugugacuagaugaguuaagaaauacaguguuuacccucaguuacag

SEQ ID NO: 126890 - RNA, 34 nt, Homo sapiens
agaagccugggaaacagcuaagccaauuccugcu

SEQ ID NO: 126891 - RNA, 46 nt, Homo sapiens
agaaagucucgaaaacauuucuucaguuaagaagaucauaaagcag

SEQ ID NO: 126892 - RNA, 45 nt, Homo sapiens
ucggucacuaaaagccaaguuuggaacugagaaaugugaacagga

SEQ ID NO: 126893 - RNA, 44 nt, Homo sapiens
uuugugaguugccugcuggagcagccugaaguguuagucaccgg

SEQ ID NO: 126894 - RNA, 47 nt, Homo sapiens
aagcuggcagggagucaguuagcaauggccagugcugugcuguggga

SEQ ID NO: 126895 - RNA, 150 nt, Homo sapiens
ccuccuccugagggagggaagguaccagggagaaccugggagguccuggagagggcccuguccaguugggugaucaggaaucaaaccagcaucggaaagacuucccagcaccaagcuugagcugugucguuucguggagggggcagcgag

SEQ ID NO: 126896 - RNA, 80 nt, Homo sapiens
aaaauaaaggaccuguuaacucagauuucuggauauuuuggugguagcuucuagucccagaaucuguguuuuuaaaauac

SEQ ID NO: 126897 - RNA, 84 nt, Homo sapiens
agauaguauaauuugguauaugugcuaaugcauugaguagaggauuauuuuaacacacuauuuugcuuuuguauuuuaguuaaa

SEQ ID NO: 126898 - RNA, 67 nt, Homo sapiens
gauggccucugcuugguaaucuuauuuuuaggccuaaaauucccacuuaaauccaaaguaaaaaugg

SEQ ID NO: 126899 - RNA, 62 nt, Homo sapiens
uuauacugaagcauaaaccuugccuguguaauuuuaaaaaauuaauagagcugugcaaaccc

SEQ ID NO: 126900 - RNA, 49 nt, Homo sapiens
ugcagaugcgcggacaugguggcggcuccucucgcaguggcggccugag

SEQ ID NO: 126901 - RNA, 46 nt, Homo sapiens
ccggcuccacgcccacagucuuguggugaaucagcccguuguagcg

SEQ ID NO: 126902 - RNA, 46 nt, Homo sapiens
uggguugggcuuggaccgauguccccauauguacagaacugaauaa

SEQ ID NO: 126903 - RNA, 47 nt, Homo sapiens
cagggauguguucaguccugugcugguucuggccuggaauguaggaa

SEQ ID NO: 126904 - RNA, 52 nt, Homo sapiens
ccauggguuaaauaugaauaacuacuaaaacaauuugaugugguagacauag

SEQ ID NO: 126905 - RNA, 46 nt, Homo sapiens
accuuggauuauuuuauuuuauuuuugugggacaccacaaucccaa

SEQ ID NO: 126906 - RNA, 85 nt, Homo sapiens
aaaaucuuaucaaaucagaaaacuaugggaagauuuugguagagaagaaugaacauuguauugagaacaauauagauuugcaggu

SEQ ID NO: 126907 - RNA, 53 nt, Homo sapiens
gugacaugcuuacuagcugguuuuggagccaguuggauuagcuugcugugagu

SEQ ID NO: 126908 - RNA, 86 nt, Homo sapiens
aauuaccagugcugugagaguuuugaacucucacaguuaaauuuugaguuuaaccuaagagcucuuaaaggaaagacaaauagaau

SEQ ID NO: 126909 - RNA, 49 nt, Homo sapiens
uuggcaaaaacagcccucaggggguuccucagucacucaaccugacuga

SEQ ID NO: 126910 - RNA, 46 nt, Homo sapiens
augacuuagagcuagccacugagaaggcuucuaauuccaggcauaa

SEQ ID NO: 126911 - RNA, 39 nt, Homo sapiens
acuugggucauaugcacauaugguaguucuuuuaagcac

SEQ ID NO: 126912 - RNA, 45 nt, Homo sapiens
guuagaugugaguuacaguuaauuagaaauccucuugaacaaguu

SEQ ID NO: 126913 - RNA, 41 nt, Homo sapiens
gauagauacuuuugccguguacuauuugguguuggguuugg

SEQ ID NO: 126914 - RNA, 40 nt, Homo sapiens
agcaaaacaaauguuauuucaagacaugguggaacuggag

SEQ ID NO: 126915 - RNA, 46 nt, Homo sapiens
caaaagaugaagcagaaaaagaaaaggccagugauaaguugcccag

SEQ ID NO: 126916 - RNA, 26 nt, Homo sapiens
guauuauaaauaguauaaagauacua

SEQ ID NO: 126917 - RNA, 46 nt, Homo sapiens
caaucccagguaaaaauuaaauuuauaagguuuccauugcuucuag

SEQ ID NO: 126918 - RNA, 56 nt, Homo sapiens
uggaggguggucaaacagaagcauuacuauuuucuucuuuuuuuauuugccacugg

SEQ ID NO: 126919 - RNA, 51 nt, Homo sapiens
gauaagcuacaauguggaauaaaaggcagaagguauaaaucuuaagaccuu

SEQ ID NO: 126920 - RNA, 53 nt, Homo sapiens
aauauaagaauauuucagcaaaggggaacagcauguucaaaguaccugagaaa

SEQ ID NO: 126921 - RNA, 63 nt, Homo sapiens
acuuacuuaggucuucauguuagaguauauucuaauuacguuguagggucucagucucccuuu

SEQ ID NO: 126922 - RNA, 50 nt, Homo sapiens
gucaucauaacagaaaaagcuauuuauguaucaugagaaaauuauguaga

SEQ ID NO: 126923 - RNA, 46 nt, Homo sapiens
ccaguauaaguacuuggaauauauuucaugguaucucugucccuug

SEQ ID NO: 126924 - RNA, 76 nt, Homo sapiens
ggaguccaguuguguauaauccuccuaugacucaacaaccaguuagaucccaagugccuggaccuccacagccacc

SEQ ID NO: 126925 - RNA, 40 nt, Homo sapiens
uuuucuagcauugcuccaaguucagguaaugcaucaucag

SEQ ID NO: 126926 - RNA, 27 nt, Homo sapiens
agaugcaugaauauacauuuuaacuaa

SEQ ID NO: 126927 - RNA, 53 nt, Homo sapiens
uuaucuuccuuauauaaaagagguguuugugugugugugcaugugucuguaug

SEQ ID NO: 126928 - RNA, 40 nt, Homo sapiens
uuauaauuuaguguuauacugcaaaauagggcaacccuuu

SEQ ID NO: 126929 - RNA, 46 nt, Homo sapiens
cucugcaguccucuucacagccuguucaguacucuacagccccuua

SEQ ID NO: 126930 - RNA, 56 nt, Homo sapiens
uauauuucaugucaaauuuucaaaauguacgugguguuuguaagagagugcgugug

SEQ ID NO: 126931 - RNA, 52 nt, Homo sapiens
uuugauuggcuugguauuuggagcuucuguuaacauuauagagacuccuagg

SEQ ID NO: 126932 - RNA, 45 nt, Homo sapiens
acuuaaaauuugggggaaaaagaaugcaggagugaaauaaccaag

SEQ ID NO: 126933 - RNA, 50 nt, Homo sapiens
cucuuccuuguagggcccuuuccuuauucauuuagguagugugaacauua

SEQ ID NO: 126934 - RNA, 50 nt, Homo sapiens
ccuaagcaauuaggauauaacaaaacuacuuaaccauuuuugcaaccauu

SEQ ID NO: 126935 - RNA, 48 nt, Homo sapiens
uguauuugugaacucaucugugggaggaguaaagaaaauccaaaagca

SEQ ID NO: 126936 - RNA, 60 nt, Homo sapiens
uuuaaugauuauuguccauugagccuguacucugcuuuccauaccaaguaaauaugaaau

SEQ ID NO: 126937 - RNA, 103 nt, Homo sapiens
agauuuauaucuaaaagcuguauuuacuuuaaaagaagugcauaauuaccaaaauuguauguacuauuguacauuuuuacaacagcauuuucuuaaacauaau

SEQ ID NO: 126938 - RNA, 48 nt, Homo sapiens
auuagcaucauuaaagacgaucuagaagauauaaagcuggucgaacau

SEQ ID NO: 126939 - RNA, 53 nt, Homo sapiens
ugucucaaaucaggaugcagaaucauuuuggagcagucagaucugaagaaagg

SEQ ID NO: 126940 - RNA, 6499 nt, Homo sapiens
uagaacuuuacagguaguaauuuggauuuucccccccaguguuuauaagacuaugugugugaaauaauguacuaaauauagauuuuuaaaauagaaaaaaaaauacuaaaaugaaagaauaaugugaaauuacaaguaccgaauucuuucaguaaaacuuugaaauuggaaaacaagucucauagguuugagugaggagaauaaaaauauccuaaaguucguauuuuagugacaguuugagggaaagcagugaagaaauaaagcaucuuagugcaagggaagcuucugugagauuauugaugucucauaaauuucauaaaauaguuucauaaaauaguucagaaaauuuuuugagugcuagaaaaaggaguguaaccauaauggucgaaaaacaauagaauuuccaaauuaacaggaggaauuaaaagaauaauaacaacugaaauuauaaacuaucaugaaaacagaaauauuacauaccagaaccagugggaaacagcaaaaucuguacucagaggaaaacuuacagccauaaaaaauucucauuuaaaaaaaucaaaugugaaaaauaaaggaacuuaguacucauguuaaauuagaaaaggaauaucaagauaagccaaaagaaacuaaaaagaaagaaagauaaaugugaaauuagugaaagacuaaaaaauguaauaguggaaagaauaaauuaaaaaacuguuucuuugaaaagaccguuaaaauuacuaagcaucucaucagcuggaagaagggaaaaacagaguaaaauauacaaaauuaguagugggaaaagaggcaucaccguagauauacaaaacagaauaagaagauacugcaugggccgggcacagugucucacucuuguaauccuagaacuuugggaggccgaggugaguggauugccugagcucaggaguucaagaccagccugggcaacacggugaaaccccaucucuacuaaaauacaaaaaaaucagccaggcaugguugcuugugccuguaguuccaguuacuugggaggcugaggcacgagaauugcuugaaccugggaggcggagguugcagugagccgagaucacgccacugcacuccagccuaggcuacagagcaagacuccaucucagaaaaaaggagaaaaaaaaaagaagaugcugcauguacuuuaggguaacagauuuggaacucagaggaaguuuuauuuugauuuuucuaugaaaaugaaaauuaccaaaaucuacagagaaguaagaaaacaaauaccacagaaacaguuggaaaaaugaaagaugaaacaugaaaaaggccuuagggacagauaguuucauugccaaauuuugucuaaccacaaaagagcuaauccaguguuauuuugauuauucuagacaauugaggaauaauuuauacagcuucauuuguucuuuuuucacagcuuaagauaauuugcauaccauacuauuuacucauuuaaaguguacaauucaauggcuuuuaguauauucagagacuuguauaaccguuauuaccacaaucaauuuuagaacauuucugucacccuacagacaaaucccguacccauugucagucacuuccccguuucacugcaaaucugucaguccuaugcaaccaguuuugccuauauggguuugccuguucuggaaaccucauauaaauggaaucauaacgauauauggucuuuugugacuggcuuuuacuuagcauaauguuuucaaaguucaacuguguuguaccauguaauaguacuucagguacuaauaaaugauuauuauucauuuauugcugaauauuccaucauauggcuauaccacauuuuacucaauugauggacauuuuggugguucuccuuuuuggcuauuaugaauaauauugcuauuaaaauuuauuuacaaguguuuguuuggacauauacuucuauuucucuuggguauaaaccuaggagugaaauugcugugucauaugcacacuauguuuaacuuuuugaggaacuacguaaacuguuuuccaaagcaacuguaccauuuuacauuucuguuuguagcaucucaaaaaaagaaauuauaaacagcuauuuuaaagagaugcaaauuaugcuaagugaaaaaagccagacuuaaaggcuguguaaggcaugauucuauuuauauaacauuauacaaaagaaaauuagggacagauaacagauuaguaguugccagggacuguagaugaagagagaagugugacuacaaggggcuuggggugauggaaauauucuguaucuuaaucacuguggugguuacacgacuguauguauuugccagauucauagaacugaacaccuaaaacaggugaauugucauauguagaguauaccucaaaucggaccaaaaaaccacauucuaaaugaaguauaagcaaagagaauccagcuauuuaucaauuucuuaaaaaauauacuaugaccaaguaaaguuuauuucaggaaugcaagguugguuuuaauaacaggacaucuaucaacaugacuuauuauagcaacacauuaaaggaaaauauauaauagaaacuguaaccaaaaaugaauagcaaauacuccaaaaggcaaaacacuaaaaucgcauuuagaaacuagacaacggacacccaauauuaucaucauuauuuguugcuaucuuggagguuuucauaaauaaaacaagcaaagaaauaauauaaacauugggaagaugauuaagugaucuauuuuugcugauaugauuguauaucuggaaaacccaagggaauaaaccauagaauuaauguaguaagcuggcuagauauaaaaguacaaaaaucaacuuuccuuuuuacuaucuggaaauaggaaaauguuccauucacuauggugacaaaacuguaaaauaggaauauauuucugaggaaaguauagguauuuacaaauagauaaacuauauucuuagaugagaauacuuaauacccacuuuacaaaauuaaaaaugaauuacagcuuuuuaaaaauagauuaagcugggugugaugacauggcaccuauagucacagcuacucagaaggcugaggcaggagaagcaccugagcccaggaguuugaggcucuagugagcuaugauugugccuaugaauagccacugcacucuguugccugggcaacauagggagacccugucucuaaaaaaauuuugauuaaaauuucuuuaaguuuauaaagaaggauaaguguuugagacuagcuuguucaggaacaaaaaagaaauagugaaggggacuucuuuaccagauuucagaaccuauuuuaaaccucuuauaauugaaucaauauagugucugcaugggauuggacagaacaaugcauggaacagaguagggaauuuacaaauagaugcaagugugcugaaaauuuaauauaugagaaaggugguauuucaauucaguggguuuauuuaauaaauaaugcuggaguauaacuauccauaaggaagaaaagaaaauuagaccauugcauuguauaaaaauaaaguggacuaaagacuuuaagaaacuuucaaagcuguauguacagccugggauuugagagacauugaucaaaaagcuagaaacuauaaaccaacauuggccacauaaaaaauuguguagcaaaagauaccagaagccauuugucaauagucaugugauagaguuuaggaaaaggaaauuuugcaaacagcauucauuuuagauuuaguguucauauucauauuauacaaagagauccuauaauuugacaguaaaacccaauugaaauuugggcaaaagauguguaaaggcaguucauagaaaaagcaaaugcaaaauaguucuuagucauuaaaagauggucccuuuaauuuacuaggaaucugggaauugcagauuaaagaaaaaaaaugagauccuggccgggcgcaguggcucacgccuguaaucccagcacucugggaggccgaggcggguggaucacgaggucaggaguucaagaccagccuggcgaagauggugaaaccccgacucuacuaaaaauacaaaaauuagcugggcaugguggcaggugccuguaaucccagcuacuugggaggcugaggcagagaauugcuugaaccugggagguggagguugccgugagccaagaucacggcacugcacuccagcuugggugacagagugcaacuccaucuggggaaaaaaaaaaaaaaaaaaaaaaagagaucccuuuacacucaugcgguugggaaaaauuuaaaccaccaccaccuguucuugacaggaauguggggaaaggguauucugauguguggccuaugaaucuaaaucauuaggauauuuugaaaaagcaaucuagcagcuuuagaacugaaaacguacauacuuuaaaacucagccucauuguuaaagaucuauaccaguuaaauagauauaugcaccaaaauguuuauuauagcauuguagugucaaagcuacaaaauuuauuacagcauuguuuauagagucaaagcuacaaaaauguuuauuauggcauuguagugugaaaacaaaauguauauccaucaagacaauaauuauugauuauugguuaauaacauuuaaaaagcauacagccauuaaaaauaacaaauuagagcuauacuucuuaaggcauuucaugagauuuugauaauaaaauuauuuuaauuauaaaauuuaaugguuaauauugauaauaaaauuuuguuaauuuuauauaauccauuuuuaaaaacuuagaugaguaaaaagcagucggucuauguguguguuuaugaaaaagauaugguuauaggagcauggaugagaguauggaaggauuugcacuguuuuuaacagaguaagcugggcuuggagaguagcagcaaaccaagagucugccuuuagaggccacugcuuuagacccuuucccccgaugcauuguuaaauuggaaagaaagagaagcagccuggcacaguggcccacgccuguaaucccagcacuuuaagaggccgaggcagaaggaucauuugaguuuaggaguuugagaccagccugggcaacaucgggagaccucaucucuacuaaaaaaaaaaaaaaagaaaaaaaauuagccaggcaugguggugagcaccuguaauuccagcuacuugggaggcugaggugggaggauugcuugagccuaggagaucgaugcugcauugagcugcccuccagccugggcaagaaagcaaggucgucucagaaaaacaaaaacaacaaccaaaaaaaggaaccaugucacagagugauauauacaguuuaguuuuauuuuggaucugugugugugugcucucucuguaugaugagcaaggagaaagguacaggggaauaaacaucaguuagcacuauuugucuuggggguaugagagaaaauuugucuuuuacauucucguauuguuucuuaacaaguacauuuugcuuuuguaaucucaaaaaaaauccaagaaauaauuuuuagaccuaaauauuauaaacucaucuuuaaagaacacuuuauuuggaaaggcugugaguaaaugucugaaacugguauuauguugucuauuuuuuuguacugcuuuuaagccauaccauaguuuuuguuugucuguuuuuugagacagagucucgcucuguugcccaggcuggagugcaguggcgcgaucuaggcucacugcaagcucugccucccggguuuuccgccauucuccugccucagccucccgaguagcugggacuacaggcgugcaccaucaacguccggcuaauuuuuuguauuuuuaguagagacgggguuucaucauguuagccaggauggucucaaucuccugaccucuugauccacccgccuuguccucccaaagugcugggauuacaggugugagccaccgcgcccggccaagccauaccauaguuuuaaaauuguuggcuuggcaaaguggcucacaccuguaaacccagcacucugggaggccaaggcuagaggaucacuuaauuaagcccaggaguucaagaccagccugggccacauagugagacccccccccccaccccgccacaaaaaaauuaaaaaauguaaccaggugcgguggugcacaccuguggucccagcuacucaggagcugaggcaggaggaucacuugagccacagaggucaaggagugagcuguguuuacgccacugcacuucagccugggagacagagcaagacccugucucaaaaaaaacaauuaagucuauaucauuguauuuauaugauaacuuuugccuaguuaaaauggacagaaacauaauucaaauccugaacuguugaacccuacuguuguuugauuuucagcugauuucuuucaguaacuaauuguacuacuacuacuugcauaacuaaaaagagaugauucuguuguuauuggugguuuuuauuuguauagguccuaaucaaacaggaaauucaaaggaagag

SEQ ID NO: 126941 - RNA, 46 nt, Homo sapiens
uuucuugagcauauaugcuacccacgcggagggcaccucacucgcu

SEQ ID NO: 126942 - RNA, 66 nt, Homo sapiens
gagauugaguauuauaaacuagcacccagcagcuuuaacuuguagaagaaagcaucacauuuuggg

SEQ ID NO: 126943 - RNA, 153 nt, Homo sapiens
aaggccuccugugaguccacugggcauacgauugagauugaguauuauaaacuagcacccagcagcuuuaacuuguagaagaaagcaucacauuuuggguaauguggaaggccuccugugaguccacuggacauuuaccacagugucuccagu

SEQ ID NO: 126944 - RNA, 39 nt, Homo sapiens
acucccagagguuuccgagcacugcccauaacccaaccc

SEQ ID NO: 126945 - RNA, 31 nt, Homo sapiens
cgugugugugugugugugugcacgugccugu

SEQ ID NO: 126946 - RNA, 25 nt, Homo sapiens
gcugcaaaaaaccacagguauauug

SEQ ID NO: 126947 - RNA, 34 nt, Homo sapiens
guggcugcaccgaguugccucugucucuuuaaga

SEQ ID NO: 126948 - RNA, 14 nt, Homo sapiens
aaugaggaaggaca

SEQ ID NO: 126949 - RNA, 46 nt, Homo sapiens
cucuccuccauccccuagaaguacacccccgucuuauuaaggagcu

SEQ ID NO: 126950 - RNA, 46 nt, Homo sapiens
aucuuguuuugggaacugauuauagagaaucauauauaguccaguc

SEQ ID NO: 126951 - RNA, 41 nt, Homo sapiens
ucccaaaaccuugagaaugaagcccuugguaucgccucucc

SEQ ID NO: 126952 - RNA, 42 nt, Homo sapiens
ucugucaagauggcugccccggucaaaccaccagccacacgg

SEQ ID NO: 126953 - RNA, 61 nt, Homo sapiens
gagccccucaaaaccuccccagugguggcccccacgucagagcccuccagcccucugcaca

SEQ ID NO: 126954 - RNA, 46 nt, Homo sapiens
ggauauugaggcaacaaugaacucggcccugaaugagcuacgggaa

SEQ ID NO: 126955 - RNA, 59 nt, Homo sapiens
aaaauccgacuaccggggccacuccaagcaguucacucagacgucucucccaacuauau

SEQ ID NO: 126956 - RNA, 100 nt, Homo sapiens
acagcaugagucuacauucaucacuaccacuuagugccacccaccuaauuaugacaggacuugaaacagaaugauuauuuuguaugugauauacugagua

SEQ ID NO: 126957 - RNA, 46 nt, Homo sapiens
agcgggaaggucaaaaagcuucaauaaccaucggcccauggacccu

SEQ ID NO: 126958 - RNA, 45 nt, Homo sapiens
cauccucccagcccaucaugagccagagccuccccaaagaagggc

SEQ ID NO: 126959 - RNA, 64 nt, Homo sapiens
gcacuguccccaccucacagaccagcuccuuaucuucagagucuaaccccuucccuccuuccac

SEQ ID NO: 126960 - RNA, 45 nt, Homo sapiens
gggucauguagccgauauuuaucuugcaaacaucaacaaguaagc

SEQ ID NO: 126961 - RNA, 66 nt, Homo sapiens
augauguuggucccuuaucauagccuagacuccugccagacagcuggagaacaaagugaaggaaag

SEQ ID NO: 126962 - RNA, 53 nt, Homo sapiens
gaguuuagauaaaaggcauaauuuccugaccgugaguuuguaagcuggcacuu

SEQ ID NO: 126963 - RNA, 50 nt, Homo sapiens
uuaaaaacugccaacugcuuuguggagaaguuacuggaaagggucaugaa

SEQ ID NO: 126964 - RNA, 37 nt, Homo sapiens
gaguaaagagaggggaaagaguaaaggggucugaaug

SEQ ID NO: 126965 - RNA, 46 nt, Homo sapiens
aaaguccuccuaguccugcccaaaaccacucugauuaucaugagau

SEQ ID NO: 126966 - RNA, 45 nt, Homo sapiens
ccccagugaaauuucuccucagccucacuccuucauccccuggug

SEQ ID NO: 126967 - RNA, 60 nt, Homo sapiens
cauggauuccauagcugguguccugaagcuuuacuuccgggggcuggaacacccucucuu

SEQ ID NO: 126968 - RNA, 62 nt, Homo sapiens
gacauuauuauuucugaggaccaaguaauuuauuucugugaaagcauugauuagcagcaguc

SEQ ID NO: 126969 - RNA, 52 nt, Homo sapiens
caagaugaugacgcucuuucaagaauuugugcaauggcuucaccaacuagaa

SEQ ID NO: 126970 - RNA, 41 nt, Homo sapiens
aagugcagagauccuugccauaugcaggaagccagcguagc

SEQ ID NO: 126971 - RNA, 59 nt, Homo sapiens
cuguguuauacuguauagguacuuguagcucuaaauguuuaaaguaacuaccaccuaac

SEQ ID NO: 126972 - RNA, 46 nt, Homo sapiens
uaauuuugagaaggcuuauuuuauuuuggaugaguuucuuuuggga

SEQ ID NO: 126973 - RNA, 26 nt, Homo sapiens
gagagucaacaguguuacaaagagcu

SEQ ID NO: 126974 - RNA, 46 nt, Homo sapiens
auguccaacaccaugccagcagccacggucccaaagccugccagga

SEQ ID NO: 126975 - RNA, 46 nt, Homo sapiens
ugaaacugagcuuucuacuauggguauccuugaaaccccaaaugca

SEQ ID NO: 126976 - RNA, 43 nt, Homo sapiens
agcuagauucucgucugcuggaacccugacugauacagaaacc

SEQ ID NO: 126977 - RNA, 45 nt, Homo sapiens
acagcugaugguguagaggaacaccagguguccugggaccacgag

SEQ ID NO: 126978 - RNA, 40 nt, Homo sapiens
caggggaacaaaagaaaaauuucaaauagaaagugcagag

SEQ ID NO: 126979 - RNA, 48 nt, Homo sapiens
cauugaaaauaaugagaauuugguaucaaagugaaguccuagaaagag

SEQ ID NO: 126980 - RNA, 46 nt, Homo sapiens
auucuccacauacccaugaccugacccuaaucucaaaacccaaccu

SEQ ID NO: 126981 - RNA, 69 nt, Homo sapiens
ugccuguacaagaagaaucuguguguaaguauuuuuugagguggaggaaaagaugaaaaaaguccagag

SEQ ID NO: 126982 - RNA, 56 nt, Homo sapiens
uucguccccaagacccaagccagaauugggaggggagggggcugaggccaagccgg

SEQ ID NO: 126983 - RNA, 64 nt, Homo sapiens
cccgggaaggcgcgaggcuguggagguggcucguggggccauggagggaguggggggcggcgag

SEQ ID NO: 126984 - RNA, 45 nt, Homo sapiens
aagcugagcccuccgcccccuccccggcucccuuagcaccgcguc

SEQ ID NO: 126985 - RNA, 69 nt, Homo sapiens
ugacucacugccccauuuuugccagaggugcaaggguuggaggaccccaggagaguaucuggcacagag

SEQ ID NO: 126986 - RNA, 53 nt, Homo sapiens
cucuaacagggucucuaaaaggguccucacuguaaggugcacaacuccaugcc

SEQ ID NO: 126987 - RNA, 88 nt, Homo sapiens
aaggacccuggggaggaacgggucauuuaaggggguauauucugcuguuuuuaagaaagaacagucauugaaaaggaaguggggugaa

SEQ ID NO: 126988 - RNA, 46 nt, Homo sapiens
caggucaaggugcagcucagggucucuggccccagagugcaucgau

SEQ ID NO: 126989 - RNA, 37 nt, Homo sapiens
uggggagaaauugacaggcacaacaaggcuaaucugg

SEQ ID NO: 126990 - RNA, 55 nt, Homo sapiens
gguuguccagaccaguggaacuguccagagagccaccaucugggccaugccacau

SEQ ID NO: 126991 - RNA, 78 nt, Homo sapiens
uggucugaaucacuccucucuccaggaagaacaugggggcaagcaggugagugaagcccaagugcugcggggaaggag

SEQ ID NO: 126992 - RNA, 128 nt, Homo sapiens
agauuugggaagggccagugccuuuaucaggaaagcaaaagugcucccagaagcucucaccuugcuuuucguuggcccaaacugugucauguggcuacuccuagcugcaaggggagucugaugaagca

SEQ ID NO: 126993 - RNA, 101 nt, Homo sapiens
ccacaagaugacaugguugacgaugagggucugcacacagaugguggagcccaagggacaggccugggaacuugaaggucuauggagccaccaaaccaguu

SEQ ID NO: 126994 - RNA, 83 nt, Homo sapiens
gaaagacacucauuuggauagcuuguucugauguguaugcuaaagaauuggucacauuacuaugucacaagguuugcucauag

SEQ ID NO: 126995 - RNA, 60 nt, Homo sapiens
uuaaaauaauucaaguuaaucuuccuuuuuuuagacuuuaguauuuguuuuauuugguga

SEQ ID NO: 126996 - RNA, 45 nt, Homo sapiens
uggaaaaagaagguggcgucagccuugggaauaggaauugccauu

SEQ ID NO: 126997 - RNA, 53 nt, Homo sapiens
cuucccugcccauuggguacccaggaaacugcaagcauugccuguguuccugg

SEQ ID NO: 126998 - RNA, 52 nt, Homo sapiens
acuccccucaacaaucaguucucuuuuguuggucagaauuaaguccagaaca

SEQ ID NO: 126999 - RNA, 46 nt, Homo sapiens
agcugccaacaccaagacuggcccccgccgcauccacacaguccgu

SEQ ID NO: 127000 - RNA, 45 nt, Homo sapiens
ccacuaugcgccgccccugggcugcaagaagggagccaagcugac

SEQ ID NO: 127001 - RNA, 101 nt, Homo sapiens
gugcuagagggcaaagaguuggaguucuaucuuaggaaaaucaaggcccggaagggcaaauaaauccuuguuuugucuucacccauguaauaaagguguuu

SEQ ID NO: 127002 - RNA, 41 nt, Homo sapiens
gaccagauggcuagauuuugcuggagucuacagcgcccuga

SEQ ID NO: 127003 - RNA, 46 nt, Homo sapiens
aagugcuuuggacccugcagcacaggcuuuucucuuagagcagcag

SEQ ID NO: 127004 - RNA, 47 nt, Homo sapiens
aucacuguucugauagcugacuucuagccuaggaaagcaguccaggu

SEQ ID NO: 127005 - RNA, 46 nt, Homo sapiens
agugauggaaauagcgagguagucggcuuccagacacuaaccccag

SEQ ID NO: 127006 - RNA, 50 nt, Homo sapiens
gaauuccuucaacaggcuaacaaggggcaagauuuacccaccccugacca

SEQ ID NO: 127007 - RNA, 45 nt, Homo sapiens
uuuggauccauccggagaaggcuguguuccuccuccaggcugugg

SEQ ID NO: 127008 - RNA, 45 nt, Homo sapiens
aggaggaacacagccuucuccggauggauccaaaacacugcagag

SEQ ID NO: 127009 - RNA, 87 nt, Homo sapiens
aaaauagaauuauuaacuacagagguuccacuugcuuuggaagaagagagcccuucugagggcuguccaucuagugagauaccuaug

SEQ ID NO: 127010 - RNA, 42 nt, Homo sapiens
auauaaucuaucaguuuguuacuacaagcuggucuggcagaa

SEQ ID NO: 127011 - RNA, 32 nt, Homo sapiens
ugauaucaucaucccuuuggguuguaauggac

SEQ ID NO: 127012 - RNA, 48 nt, Homo sapiens
ccuuccuugaagaaguuacugaguauuauauaaguggugaugaggauc

SEQ ID NO: 127013 - RNA, 47 nt, Homo sapiens
gacauuugaacacagagaaagaauguuuaauagacuccagggaacau

SEQ ID NO: 127014 - RNA, 51 nt, Homo sapiens
aaaagacaccucucagguaagagguaguguaugcuagcuaggacuacaggc

SEQ ID NO: 127015 - RNA, 49 nt, Homo sapiens
cagcuguccuuugacauuuuuuuuuuuagaggaaauguaacuuggaucu

SEQ ID NO: 127016 - RNA, 44 nt, Homo sapiens
aaugaccagguagauuguaaacugagguaguaacccuguaagca

SEQ ID NO: 127017 - RNA, 138 nt, Homo sapiens
cucaguuuacaaucuaccuggucauuauuuuauuucuauccaguucuaagaacugccuccacuguuuauauauucauaauuaaacacauugagaaugcaacacuauaaaagcuggucaaauuuuugcagagcccuuau

SEQ ID NO: 127018 - RNA, 84 nt, Homo sapiens
cuaauaacaugaaaacaggcuaguuucaagcaacagcaaugucgguuggaaagcaggcgucauuugccuugaaaaaagccuuuu

SEQ ID NO: 127019 - RNA, 122 nt, Homo sapiens
aaacauuuuauuuccgagacuuaacguuguguuuccuguuucuuaaaccuagcaccucuguguauuugaaaauaaugagacaucuuucauuggauuuuggaaaauuguuccccaugggauuc

SEQ ID NO: 127020 - RNA, 144 nt, Homo sapiens
aaugagugaaagcuugauuaagaguucuuccauauacuagccuccuuggaagaagugaucagaaggugauaagaaggacagaaaggacuauuuuaaaguuggacugaaggagaaaaaagcaaaauucuuguuucaucccaauuc

SEQ ID NO: 127021 - RNA, 48 nt, Homo sapiens
augaaauguaacacuucuucaucuuuaacuugaaaucaaaacuaucag

SEQ ID NO: 127022 - RNA, 45 nt, Homo sapiens
ucuaaauuggcuucuacagaucaauaauuuaaauguaacuaguug

SEQ ID NO: 127023 - RNA, 45 nt, Homo sapiens
gugggcaggaacugcaguauggccaugggcugagcaggcugagca

SEQ ID NO: 127024 - RNA, 33 nt, Homo sapiens
gcgaggacgaggacucggagggcgaagagaaga

SEQ ID NO: 127025 - RNA, 386 nt, Homo sapiens
uaaacaggacaucucccagggcauuuaaaauauacaauuucugccugguauagugacacacgccuguaaugccaacacuuugggaggcugaggcaggaggaucccuugagcucaggaguuugagaccagccugggcaacauagugaaaccucaucuuuaaauaaaauuagccagguguggugguucacaccuguagucccagcuacucaggaggcugaggcaggcucaggaggaucacuugagccugggaggcugacgcugcagucagcugugauuguaccacuguucuccagcaugggugacagagcaugacccugucucuaaauauaaguaaacaaaacauaaaauauacaaguucuaaaaacuggauucacacaugauccucc

SEQ ID NO: 127026 - RNA, 42 nt, Homo sapiens
ggcaacacgugcuagaucauccucccuguuccacaggcgaga

SEQ ID NO: 127027 - RNA, 112 nt, Homo sapiens
ggcuagguuugugugcgccuguggguuggugggguucagaggggccgugacagggcugguuguggggaggagagaggaagaggaucggcaccugcagcgggcuuugucauau

SEQ ID NO: 127028 - RNA, 43 nt, Homo sapiens
auuuuuuguagggugggggaaggcugucguuguggagggagga

SEQ ID NO: 127029 - RNA, 49 nt, Homo sapiens
uggucagaugacucccuacguagccuuggaaacugcccaaauaagaaag

SEQ ID NO: 127030 - RNA, 54 nt, Homo sapiens
cagggucagagaauagagaaaggggaccugugucaaaucuugacuuggguagag

SEQ ID NO: 127031 - RNA, 44 nt, Homo sapiens
cuccagggagacagugaggacauuagacggaugucaagaaggaa

SEQ ID NO: 127032 - RNA, 46 nt, Homo sapiens
aucaggaugaaaaggauuuaaaauaaaucuaauauuuccagauagu

SEQ ID NO: 127033 - RNA, 85 nt, Homo sapiens
ccaugggcaaaccaaagcugcaggaugugcuguguguguggccugguaucucagaguccugggugugcacagggugugcacagcu

SEQ ID NO: 127034 - RNA, 57 nt, Homo sapiens
cccuuugcuaguccccuuucuggaacccggaugugucagccagggaggccaucacag

SEQ ID NO: 127035 - RNA, 27 nt, Homo sapiens
uacacauggcuaucaugcacacacgca

SEQ ID NO: 127036 - RNA, 51 nt, Homo sapiens
ccaaaaccucccaaaaacgugguuaacaaagaacaguuuauaaccuggaaa

SEQ ID NO: 127037 - RNA, 53 nt, Homo sapiens
acgguaaucauaguugccccaagggagggaaaugguggcugagggaugggaug

SEQ ID NO: 127038 - RNA, 87 nt, Homo sapiens
gcccacuucuggagaggaggagaucuuguacucucucccacccuugccugauuccagccccucagaucaaacguauccuucuuacuc

SEQ ID NO: 127039 - RNA, 79 nt, Homo sapiens
gccauuauuacuuaacugaccuuguacagagcccagaagagcacuuggugauugugcucaacuaaucaauuauaacauu

SEQ ID NO: 127040 - RNA, 27 nt, Homo sapiens
agugcuagguaaauaugagcuauuauu

SEQ ID NO: 127041 - RNA, 33 nt, Homo sapiens
aggguuaauaugaacgcuucaugggguugucuu

SEQ ID NO: 127042 - RNA, 44 nt, Homo sapiens
ggcagauuaggaauucugccugauggguaagcuuccaguauugg

SEQ ID NO: 127043 - RNA, 58 nt, Homo sapiens
gaacauuuauucauauuguuuugauuacccucguguuacuacaagauggcaauaaaua

SEQ ID NO: 127044 - RNA, 74 nt, Homo sapiens
gauaauauuacucugcuacaaagugucuccaacuagaaaugaucaaugaagugagaaauuguugagaaggauac

SEQ ID NO: 127045 - RNA, 49 nt, Homo sapiens
acauacgacucauuuccaaacuuuuauuacaaauucagcauugggaaau

SEQ ID NO: 127046 - RNA, 45 nt, Homo sapiens; identical to SEQ ID NO: 25449

SEQ ID NO: 127047 - RNA, 42 nt, Homo sapiens
cgacaauguuaguauggagaggggggacaaaauaaaugaaau

SEQ ID NO: 127048 - RNA, 48 nt, Homo sapiens
gcggauucagguguggcucuaugagcaagugaauaugcggauagaagg

SEQ ID NO: 127049 - RNA, 52 nt, Homo sapiens
guuugcguaagcaccagaccucgcguuuaguaaacaaaggugagacgggaau

SEQ ID NO: 127050 - RNA, 41 nt, Homo sapiens
agcccccggggcuaccaagacuggaagaaagcgcggguagu

SEQ ID NO: 127051 - RNA, 46 nt, Homo sapiens
aaaagggauaauuuguuggagccaauaaagcuuuuugcugaugaac

SEQ ID NO: 127052 - RNA, 41 nt, Homo sapiens
augguaccacgggcugcuucaauuguaaggcaaaggaagca

SEQ ID NO: 127053 - RNA, 34 nt, Homo sapiens
gauaaaacaauggcugguucuagcccugagugac

SEQ ID NO: 127054 - RNA, 46 nt, Homo sapiens
uuuuuauauaaguuuuuucuauucaguuucacugauccaacuggca

SEQ ID NO: 127055 - RNA, 46 nt, Homo sapiens
uuguuuaaaggauuuaaaauaaagugccgucauguagcccugugga

SEQ ID NO: 127056 - RNA, 45 nt, Homo sapiens
uaaaaaguagacacaagcccucaaggguaaccugucaggcaccau

SEQ ID NO: 127057 - RNA, 53 nt, Homo sapiens
gagcuuugaaggcuauuuuaccauuccuguucacaaaagguucucauggugcc

SEQ ID NO: 127058 - RNA, 61 nt, Homo sapiens
uguuagguuucacauauauauucaucaacuauuuuagaagauuuaauucuaucaaaucuug

SEQ ID NO: 127059 - RNA, 32 nt, Homo sapiens
gaagcccccucuugcaccagcuggagcccagg

SEQ ID NO: 127060 - RNA, 49 nt, Homo sapiens
ggggagauugccuaggcuggcuguggggguggagggccucuggcugcaa

SEQ ID NO: 127061 - RNA, 58 nt, Homo sapiens
cuccuucucaccuuucuuuuuugcuaauuauggaaaauagggcccauuucaucauagc

SEQ ID NO: 127062 - RNA, 47 nt, Homo sapiens
cccacccuccauugccuggcccaggugagcagcuuggcaggucucca

SEQ ID NO: 127063 - RNA, 48 nt, Homo sapiens
cucgaaugcaggacaaguccuaaauauuugccccuucccuugcaguaa

SEQ ID NO: 127064 - RNA, 41 nt, Homo sapiens
aggcugggcucauucccaucgugagugagcccaggugagga

SEQ ID NO: 127065 - RNA, 45 nt, Homo sapiens
ggguccccaccgccauucaccagcucuaccuggacaguaacaaga

SEQ ID NO: 127066 - RNA, 42 nt, Homo sapiens
ugucuucagcaagcuggagaaccugcugcuccuggaucucca

SEQ ID NO: 127067 - RNA, 51 nt, Homo sapiens
agccgcaaccugcgaaaggucccugucaucccgccccgcauccauuaccuc

SEQ ID NO: 127068 - RNA, 98 nt, Homo sapiens
ugaugaaccagcagagccaacagaccugccuccuccccucccuccaggcccuccaucuaucuucccugacuguccccgcgaaugcuacugccccccug

SEQ ID NO: 127069 - RNA, 45 nt, Homo sapiens
cuccucccacuucucaucuuggccucaguggcccaaggccagcca

SEQ ID NO: 127070 - RNA, 48 nt, Homo sapiens
gaggacuaaacucagagcugagaggagaggcaggugugugcagguaag

SEQ ID NO: 127071 - RNA, 41 nt, Homo sapiens
guggaaaaaucuuugguuuggaaauucagcugacugcccuc

SEQ ID NO: 127072 - RNA, 44 nt, Homo sapiens
cgaugugucaggcagagugcuguccugggggcacagacaggacc

SEQ ID NO: 127073 - RNA, 44 nt, Homo sapiens
caacaggccaccacauaccucaaccuggggaacuguauuuuuaa

SEQ ID NO: 127074 - RNA, 46 nt, Homo sapiens
ccccacuggccgccuccugugggcuccucaccugcaagaaccaagu

SEQ ID NO: 127075 - RNA, 43 nt, Homo sapiens
gaugccuuauggcuuagcgcugugcuaugaagaggaagaagga

SEQ ID NO: 127076 - RNA, 45 nt, Homo sapiens
acaaacaaggauuucucagguugggaucucugcgaggcauccauc

SEQ ID NO: 127077 - RNA, 58 nt, Homo sapiens
ccagggcuuaaagcccgcugcuccuuuucgguagaggagaggcccaucacuggugugg

SEQ ID NO: 127078 - RNA, 86 nt, Homo sapiens
ccgcccagcugccaccauuuucauugcuuuccccagcagcaugaugggaacccaagcugagggauacagguccugauuugguagga

SEQ ID NO: 127079 - RNA, 55 nt, Homo sapiens
ggcccugggugcccuguggcagagaugguuauuuuggagacauggcuggcauggg

SEQ ID NO: 127080 - RNA, 50 nt, Homo sapiens
ggagccuguuggccugaccccggguccuguaaacuggcagggauggagug

SEQ ID NO: 127081 - RNA, 33 nt, Homo sapiens
gcaggaaucucugaguccuucauaugaaaagcc

SEQ ID NO: 127082 - RNA, 42 nt, Homo sapiens
ucguuccugcuaggacagugaggagggcagcugggcucaggu

SEQ ID NO: 127083 - RNA, 54 nt, Homo sapiens
cacauuugccccaccucaacgcaaacaugggugcacacaccaaccuuguguucu

SEQ ID NO: 127084 - RNA, 46 nt, Homo sapiens
gugccaucauguccgcucugucggacacagagauccagcgggagau

SEQ ID NO: 127085 - RNA, 43 nt, Homo sapiens
ccugguuggagguaagccugagcaaagggaguccacucagggg

SEQ ID NO: 127086 - RNA, 26 nt, Homo sapiens
gaaguccaggguggggagcaaggguu

SEQ ID NO: 127087 - RNA, 31 nt, Homo sapiens
ggucccgucaggccauggguuguccucugcc

SEQ ID NO: 127088 - RNA, 25 nt, Homo sapiens
aggaggcucagagacacagcucuca

SEQ ID NO: 127089 - RNA, 43 nt, Homo sapiens
uugaugaauuucgugcaggggaggaacucaucaacuagaauaa

SEQ ID NO: 127090 - RNA, 56 nt, Homo sapiens
gaagaagagacaauuccagaacaaccuauugauagagaugugcccagggugcuugu

SEQ ID NO: 127091 - RNA, 31 nt, Homo sapiens
aaggaagagcuuaggcaagcguggcaucguu

SEQ ID NO: 127092 - RNA, 24 nt, Homo sapiens
gauuauggggagacccgaggaaaa

SEQ ID NO: 127093 - RNA, 47 nt, Homo sapiens
cauggcaacauugaggagcaccugcggcagcuggagggacagcugga

SEQ ID NO: 127094 - RNA, 50 nt, Homo sapiens
aagcuggagaaugagcuggccaacaaggagucccugcaccgccagguacc

SEQ ID NO: 127095 - RNA, 102 nt, Homo sapiens
gcucuggcccagaaggaggacauggaagagcggauuacuacacuggagaagcgcuaccuggcugcucagcgugaggcaacauccauccaugaccucaaugac

SEQ ID NO: 127096 - RNA, 45 nt, Homo sapiens
gggagcgacuggucacccuaacaacaaccgugacugaacucgagg

SEQ ID NO: 127097 - RNA, 46 nt, Homo sapiens
uuaacccgggagcugagcaugugucgggagcagcuucuagagcggg

SEQ ID NO: 127098 - RNA, 45 nt, Homo sapiens
guccuuugaucugcuuauuucacccgcuacuugcaguuugcaaag

SEQ ID NO: 127099 - RNA, 46 nt, Homo sapiens
gucucuguguuucuaucuuggggcaugugugugugcaugcccacgu

SEQ ID NO: 127100 - RNA, 61 nt, Homo sapiens
ccaaggacgagggcuccgaagagugucuguuucugcagcgccuaugggaguggggggcagu

SEQ ID NO: 127101 - RNA, 44 nt, Homo sapiens
ucagcuguagcguggaauagccaucugccuuucacuugguggcu

SEQ ID NO: 127102 - RNA, 54 nt, Homo sapiens
ugagugugugugcuugugcauguguuggagaggaggagaggugaggagcaggga

SEQ ID NO: 127103 - RNA, 48 nt, Homo sapiens
uugauggugggugggaagagagaggucgggcuggaggacuuggagaca

SEQ ID NO: 127104 - RNA, 47 nt, Homo sapiens
aggccgagcagagugaccagccccacccccagggaggccagcaggac

SEQ ID NO: 127105 - RNA, 45 nt, Homo sapiens
cuggugacaggaguguauggccugaugaccaggcugccaucaauu

SEQ ID NO: 127106 - RNA, 42 nt, Homo sapiens
uguaagugagcaacccgcuuggcccccgaaacuccaccacau

SEQ ID NO: 127107 - RNA, 27 nt, Homo sapiens
acaaaugcagaguugaaaauaugccug

SEQ ID NO: 127108 - RNA, 31 nt, Homo sapiens
aggggcugagagagacacacacagaaauaug

SEQ ID NO: 127109 - RNA, 46 nt, Homo sapiens
uuuggcaggucaaguccugacagugcccucacuuugaugggguggg

SEQ ID NO: 127110 - RNA, 33 nt, Homo sapiens
auugccgguugcuuucaacugugcuuguggguu

SEQ ID NO: 127111 - RNA, 43 nt, Homo sapiens
auuggggcugccuccuugucuucaccuuccugcuuccagguaa

SEQ ID NO: 127112 - RNA, 45 nt, Homo sapiens
ucugcccccuggggcugagagaccccaaccuuuccccaagcugaa

SEQ ID NO: 127113 - RNA, 68 nt, Homo sapiens
guauucccccaaugcuagucucugugacaguccuucuuuuacgcacugcauagaauguucacuccagc

SEQ ID NO: 127114 - RNA, 112 nt, Homo sapiens
ggguuuuucugggucucucugcucuggaauaguacaauuuaugagaugacucccuggauuguuguggguuuuuucccccauaggcugaagaagagcaaacaugcccagugcc

SEQ ID NO: 127115 - RNA, 46 nt, Homo sapiens
gugcggguacugacacuuccccugcaagcccaccacgccauggaga

SEQ ID NO: 127116 - RNA, 66 nt, Homo sapiens
ggagggucaucccauaugaugugcucccugacuggcuaaaggacaacgacuaucugcuacaugguc

SEQ ID NO: 127117 - RNA, 62 nt, Homo sapiens
guuucucuuuuugggaaucuugaccaugcucagaccaaauauguacuucauggccccucuac

SEQ ID NO: 127118 - RNA, 44 nt, Homo sapiens
cccuggcucuauuauuccuucuacugcuccccacagccacggcu

SEQ ID NO: 127119 - RNA, 43 nt, Homo sapiens
uguggcgcagugggaccgguuugccacuccuaagcaccggcag

SEQ ID NO: 127120 - RNA, 45 nt, Homo sapiens
cuauucauccaaaaauagcuaauuaucauaaacauugaaauucca

SEQ ID NO: 127121 - RNA, 46 nt, Homo sapiens
acuugggaaguuccuccuccaccccgcaggugggaaggcucagaga

SEQ ID NO: 127122 - RNA, 42 nt, Homo sapiens
cuuuucuucuggaagaaaaugucccucccuuacccccauccu

SEQ ID NO: 127123 - RNA, 43 nt, Homo sapiens
caaguaacuugaguuuuaauuuuuuuuuuuucuuggcagagua

SEQ ID NO: 127124 - RNA, 33 nt, Homo sapiens
cgcuggcugggggcggggaggagccgcgggucc

SEQ ID NO: 127125 - RNA, 44 nt, Homo sapiens
ggggagucagguuccugggagguguccuccauguugguauugug

SEQ ID NO: 127126 - RNA, 46 nt, Homo sapiens
aauugccuuuuucucacucugaaugucagacagacaugauggccac

SEQ ID NO: 127127 - RNA, 49 nt, Homo sapiens
caaguguaaaacugcccuuaaauguuuuaauacagucaccauuuuugag

SEQ ID NO: 127128 - RNA, 96 nt, Homo sapiens
agaauaguuacuuuagcuauuuuccuggauagaagagcagaaaguggaguagcagcauuggaguugagacaaaacuagggaucuucauuuguaaag

SEQ ID NO: 127129 - RNA, 46 nt, Homo sapiens
cuucagucagugauggucauuuugcccaauuagguuggggauagua

SEQ ID NO: 127130 - RNA, 46 nt, Homo sapiens
uuucuuuaucuguucauuuuuguauuggccagacuuuaucugaacu

SEQ ID NO: 127131 - RNA, 31 nt, Homo sapiens
ggacuauggcaauaaauuugaaagaaauaaa

SEQ ID NO: 127132 - RNA, 44 nt, Homo sapiens
gccaccauuugcaugugauguugauaaacuucauuuuacgccac

SEQ ID NO: 127133 - RNA, 62 nt, Homo sapiens
uuuaggcccaaacucguguaaaauugaauuucuuggaccagauugcaaaguacugggaguua

SEQ ID NO: 127134 - RNA, 69 nt, Homo sapiens
cagggaaguacucugaaaauuccacauguggagaggaagaucuuggacuuauuucagcuuaauaaggua

SEQ ID NO: 127135 - RNA, 48 nt, Homo sapiens
auuugcaguuguuugcaaggauagaaaauggaccaaaauugcuaccaa

SEQ ID NO: 127136 - RNA, 46 nt, Homo sapiens
uccuggcugucauaugaagguauaagcugugaaauaacuugccuac

SEQ ID NO: 127137 - RNA, 85 nt, Homo sapiens
ccucuucuaguaauuccuauguagccaaguucauuucugacaaaaugguauuugugaaauuauucacuuaaaaacuuuuagguaa

SEQ ID NO: 127138 - RNA, 67 nt, Homo sapiens
aaggacaaggaguacaaaccccaugauauuccccagaggcagucugugcagccuucggaaacgugcc

SEQ ID NO: 127139 - RNA, 39 nt, Homo sapiens
auuguggaagcaaaauuuucuguaaauacugacagaccu

SEQ ID NO: 127140 - RNA, 46 nt, Homo sapiens
ccaugaauauuaaaauagaacccgaggagacaacggaagccagaac

SEQ ID NO: 127141 - RNA, 57 nt, Homo sapiens
gaaaaucuuaauauaucaacaguguccuuguucucauaauuaacugacuagugggag

SEQ ID NO: 127142 - RNA, 50 nt, Homo sapiens
ugaagaguagcaucaagcaagaaccuauugagaggaaagauuauauugua

SEQ ID NO: 127143 - RNA, 46 nt, Homo sapiens
ccagccggaucuccuccaucagcuugugaccaucaugaaccccaau

SEQ ID NO: 127144 - RNA, 48 nt, Homo sapiens
guaguggcuucaacuguucagaaagacauggccauuaugauugaggau

SEQ ID NO: 127145 - RNA, 39 nt, Homo sapiens
gagaucucccuagacaaaugaacuugccuguauuugcua

SEQ ID NO: 127146 - RNA, 42 nt, Homo sapiens
gagugauugauucggaaagaauggauuuugagcuguugccag

SEQ ID NO: 127147 - RNA, 55 nt, Homo sapiens
ccugcaucauguaaaagaauuguguuccuguccuccuuacaaauauaaauugcgg

SEQ ID NO: 127148 - RNA, 44 nt, Homo sapiens
acaacgaaugggccuugaaugugaaugaagcuuuggaggcaaag

SEQ ID NO: 127149 - RNA, 47 nt, Homo sapiens
caagccacaauaagauuuauauuuacuuugcuuucauaagucaguug

SEQ ID NO: 127150 - RNA, 46 nt, Homo sapiens
uuugcgacaccuucgccuagucacacaggaugcagagaagugugcc

SEQ ID NO: 127151 - RNA, 46 nt, Homo sapiens
uccggcaguuuguaacacagcuguaugcucuuccauguguccucag

SEQ ID NO: 127152 - RNA, 40 nt, Homo sapiens
ccuauugagugguauauguauauaaagagauuauaguaga

SEQ ID NO: 127153 - RNA, 46 nt, Homo sapiens
ucucauagaccuagggguagggcuggccccguauucagcaguggag

SEQ ID NO: 127154 - RNA, 42 nt, Homo sapiens
ucauugaauagccuugcuacggcaguaaaggaaaucgaagag

SEQ ID NO: 127155 - RNA, 46 nt, Homo sapiens
guucaggcuuggaaagaaugugcuguuaauacauucuugacugaga

SEQ ID NO: 127156 - RNA, 47 nt, Homo sapiens
aguuaaaggagcccuugccaaauggaaagaaaaaaagcaccaaauua

SEQ ID NO: 127157 - RNA, 31 nt, Homo sapiens
aaagacuuuuugaaaauugucaaguguuaag

SEQ ID NO: 127158 - RNA, 71 nt, Homo sapiens
cuaagggaaauggaagccuugcagucucucagacucgccaaugaagggaaauugcugucgccucuccaaga

SEQ ID NO: 127159 - RNA, 90 nt, Homo sapiens
cacuucgauauaugauugaaagaaccgugaacuggcagcacagagcccagcaacugcuuucgucagggaaucuuaaauuugugcaagauc

SEQ ID NO: 127160 - RNA, 158 nt, Homo sapiens
uggucuuugggaagauaugaguugauuuggccaguucugaaaugccaggagacucuucaguaggggaaaaucaaguuguuuuuuuuuuuuuuuccccugguugccugccuggguaaugcaagcuacugucauuggacuaaugggaguauuuuuaaucc

SEQ ID NO: 127161 - RNA, 57 nt, Homo sapiens
aucauuuucuuugccugaugacugggacaacagaaccucauauuugcacucccccuu

SEQ ID NO: 127162 - RNA, 65 nt, Homo sapiens
aguaaugagugaucuuguauuacuagguuuuuauuauagaugaucaaguaccauaaaaaggacuu

SEQ ID NO: 127163 - RNA, 43 nt, Homo sapiens
uaugcugaaauguaggauauaggcuauuauguauuugcaaaau

SEQ ID NO: 127164 - RNA, 45 nt, Homo sapiens
cccugcucagcagacugaccgaagcucaccagugagacccagcag

SEQ ID NO: 127165 - RNA, 81 nt, Homo sapiens
aacauuccuuuuuccagugauccuuugguagcauuaacagugauaggggaaggaaguauguuaaacccaaacugguugucu

SEQ ID NO: 127166 - RNA, 61 nt, Homo sapiens
gggaucaucugauuucuaauuuacauguucucuuuagcuucauuaguuuuaguaauaggug

SEQ ID NO: 127167 - RNA, 50 nt, Homo sapiens
cagugagcggugggaacgaguuaagaaaaugcggacccccaaaaagaaga

SEQ ID NO: 127168 - RNA, 46 nt, Homo sapiens
uuauuuaucugagcaauaacuucuauguugguuucaguggcuggaa

SEQ ID NO: 127169 - RNA, 72 nt, Homo sapiens
acaggggaacuugguuuaggguuaagacguuggaaggaaaucuaaggaaaauuaauccucacagagguccgg

SEQ ID NO: 127170 - RNA, 56 nt, Homo sapiens
cagacuaacuacauacuaguccaugcuagugucagccuauauuaaaauagucuuuc

SEQ ID NO: 127171 - RNA, 154 nt, Homo sapiens
uccuguuuccgccuaauaugggaguuuucgucuccucugaaaggagagccuuagaaaagccacuguugagcggagggucucaccguaucuuugcaugaaaucguggucagagcucccccgagccguccuccugccacagcagggagaaauuugc

SEQ ID NO: 127172 - RNA, 94 nt, Homo sapiens
uaaggagaagaaacugucaggugaauuagaacacgaugcaaauagauguagacgcacagagggugacguuggaaaggugugagugguggggagg

SEQ ID NO: 127173 - RNA, 47 nt, Homo sapiens
uuggguccuguuuugaaaaacccagcaauaaaaaaaaaaaacugggg

SEQ ID NO: 127174 - RNA, 44 nt, Homo sapiens
cacugagaagaaucuauauuugcagggacuaguugcagagaugg

SEQ ID NO: 127175 - RNA, 45 nt, Homo sapiens
gucugagugcaccguggaugucuuuaacguggcccugcagcaguc

SEQ ID NO: 127176 - RNA, 50 nt, Homo sapiens
ggguggccacagggcuacaagagggaccaggaaagagagcucauggggca

SEQ ID NO: 127177 - RNA, 47 nt, Homo sapiens
agguacagagaagguuaagggcuuaucugaggcugcacagugaggga

SEQ ID NO: 127178 - RNA, 37 nt, Homo sapiens
acaaaaucagaguuaggaucuuguaaaggaaaaaaaa

SEQ ID NO: 127179 - RNA, 68 nt, Homo sapiens
auagcugcaaguguaucuccuuuuaucuggugccuccucaaacccagucucagacacuaaaugcagac

SEQ ID NO: 127180 - RNA, 45 nt, Homo sapiens
cagauggccccuccacuggggaaugcucccagcugugcuguggag

SEQ ID NO: 127181 - RNA, 59 nt, Homo sapiens
uguagaagguggagucaccuuuuguuugaguaaccguuucacccacccuggcugagggu

SEQ ID NO: 127182 - RNA, 102 nt, Homo sapiens
auccaccgccucccagcuccacagcaauguugucaacuauguccagcagaucguggcacccaagggcaguuagaggcucgugugcauggccccugccucuuc

SEQ ID NO: 127183 - RNA, 48 nt, Homo sapiens
cgcuguaccacgcaaugauggguggcagugagguggcccagacccucg

SEQ ID NO: 127184 - RNA, 59 nt, Homo sapiens
ucguccuuaagaacgaccaccaggaagauuucuggaaagugaaggaguuccugcauaac

SEQ ID NO: 127185 - RNA, 53 nt, Homo sapiens
cccaaguaucucaaaugcccggaaugcagagcuccggcugcgauggggccaaa

SEQ ID NO: 127186 - RNA, 56 nt, Homo sapiens
gcuuuaugucaggggcuagagggaggcucacaaaaaguagugaugcuugccccuag

SEQ ID NO: 127187 - RNA, 66 nt, Homo sapiens
augaaggccauugaagccguggccaucucucccuggaagaccuaccagcuggucuacuuccuggau

SEQ ID NO: 127188 - RNA, 34 nt, Homo sapiens
caggaggcuccucugucugacacccacuccccuc

SEQ ID NO: 127189 - RNA, 31 nt, Homo sapiens
acaaauuuccuuacacauaaaugucuauuca

SEQ ID NO: 127190 - RNA, 69 nt, Homo sapiens
ggaacuccaugugauggagcugauaauacauuuaucaccuccaccccugcuuggaaggagagagggaaa

SEQ ID NO: 127191 - RNA, 19 nt, Homo sapiens
uuguccuaagucccgaggc

SEQ ID NO: 127192 - RNA, 45 nt, Homo sapiens
ugcgacuugcccaaggugacacacaguucuaacaacuggccuauc

SEQ ID NO: 127193 - RNA, 50 nt, Homo sapiens
ucgcuaaaggaaaauacaguaagugcuugaaagaugaaggaccaaaaggc

SEQ ID NO: 127194 - RNA, 43 nt, Homo sapiens
auaaagagacauuuagcacuuuuuucuauuuaaaggaacaagc

SEQ ID NO: 127195 - RNA, 44 nt, Homo sapiens
uggugccuuaacgggagccauacuggcagcaagaaguaaguagu

SEQ ID NO: 127196 - RNA, 45 nt, Homo sapiens
gggaguuugacagcuauuaaaaccagggcuccacaguuaggaggu

SEQ ID NO: 127197 - RNA, 45 nt, Homo sapiens
ggugguaucuuucaagcaaucaaagguuuucgcaauucuccagug

SEQ ID NO: 127198 - RNA, 99 nt, Homo sapiens
uuuccuucuuggaauucuuucuugaggguagagggggacaaaaauuaccugggaaauaggaagagguaauagcauguguucucugaaaagccauggaca

SEQ ID NO: 127199 - RNA, 35 nt, Homo sapiens
ugaauggaacauagauuuuagccaaggggucugga

SEQ ID NO: 127200 - RNA, 45 nt, Homo sapiens
ucgccgcccccuucggucaccagcgugaaguagauguggcgcccg

SEQ ID NO: 127201 - RNA, 43 nt, Homo sapiens
cugaacgugcagcucccgggaccucuuaauuacuagaccucag

SEQ ID NO: 127202 - RNA, 48 nt, Homo sapiens
auaugauguauuuacuuauuuuaaaaaaaagaauaggaaugagauguc

SEQ ID NO: 127203 - RNA, 56 nt, Homo sapiens
ugugacaaauguguaaacuagcgggggaagacaguauuguaucauaaaugagaugc

SEQ ID NO: 127204 - RNA, 66 nt, Homo sapiens
gggguuuauucuaagauaccuuuguauuuuauuucauguggagaucaugaaaguaggaaauauacc

SEQ ID NO: 127205 - RNA, 42 nt, Homo sapiens
aucuuuccugccuauagaaaaucuuucuaauugccaacaaga

SEQ ID NO: 127206 - RNA, 45 nt, Homo sapiens
cagagucuguagaaggcuucuuaucuccaagucguuguggcaguc

SEQ ID NO: 127207 - RNA, 48 nt, Homo sapiens
auggcaaugaaacgggcagcuuuguuggagaaaagauuaagaagggaa

SEQ ID NO: 127208 - RNA, 23 nt, Homo sapiens
acuguaaguuauuaaauuagggu

SEQ ID NO: 127209 - RNA, 46 nt, Homo sapiens
aaucuugggugauuucaccuccacaacccucuccacagaaacagau

SEQ ID NO: 127210 - RNA, 42 nt, Homo sapiens
acaaaaaacugauggacaaaggagcaagucacuggcagauau

SEQ ID NO: 127211 - RNA, 47 nt, Homo sapiens
gaaaaagaaaauggaagcugcuuuuaccaaacagagacagaaaaugg

SEQ ID NO: 127212 - RNA, 43 nt, Homo sapiens
agcuguuggccucugaaauggugcaucuuaggaugaaacuaga

SEQ ID NO: 127213 - RNA, 58 nt, Homo sapiens
ggaaacugaaucauaccgauggaaaaaguaguggaagcaguucucaaaaaacuacacc

SEQ ID NO: 127214 - RNA, 46 nt, Homo sapiens
ucuaaauuucuucaggauuaugauauucgaacuggcaacaccaggg

SEQ ID NO: 127215 - RNA, 58 nt, Homo sapiens
caaauaauucaugauacugaaaaaucuccucauacaccucagccagaccaaauugcua

SEQ ID NO: 127216 - RNA, 59 nt, Homo sapiens
gaauacuucuugacgaguuuggcaaucagaucgagacaccaagcauugaagaagcauua

SEQ ID NO: 127217 - RNA, 48 nt, Homo sapiens
cuaaacacauuaggaaaaauuuguccuucaagccaauaaauggagaag

SEQ ID NO: 127218 - RNA, 71 nt, Homo sapiens
uaguuauugaguaaagguuuuguuucauuuauuuugaugggagggauuugagcauguuuaaaagccaaaua

SEQ ID NO: 127219 - RNA, 75 nt, Homo sapiens
agugccaagacugaaguagauuagagaguaaaagugaugaaauggaaaaugucaguagaggccugcuccuaaaag

SEQ ID NO: 127220 - RNA, 45 nt, Homo sapiens
ugccaagaauacuugaaccaguguugccauuucacucuggaagau

SEQ ID NO: 127221 - RNA, 55 nt, Homo sapiens
uucuuucuuccuuccucuucccuccccaugguugauuuuaagcuguuucuuagcu

SEQ ID NO: 127222 - RNA, 32 nt, Homo sapiens
aaaauauaggggguucuuucuaaaugccaaac

SEQ ID NO: 127223 - RNA, 30 nt, Homo sapiens
uuaaauauggggauggguguguuaaaccac

SEQ ID NO: 127224 - RNA, 46 nt, Homo sapiens
aauggaacaagaacaaaaacugaaagaacaucacacaguugaagcu

SEQ ID NO: 127225 - RNA, 46 nt, Homo sapiens
aauugcgugugcucagcaguauucagcuuuuuuucaagccacagau

SEQ ID NO: 127226 - RNA, 45 nt, Homo sapiens
acugguuggagaugauaaaaauauaacccuuguaacacagauaua

SEQ ID NO: 127227 - RNA, 41 nt, Homo sapiens
aacugaguuuugaaggaugcggaggaauuuaccacauagag

SEQ ID NO: 127228 - RNA, 48 nt, Homo sapiens
cugauuguguuacucauguuucuuucacacuuuauugauccugcugau

SEQ ID NO: 127229 - RNA, 40 nt, Homo sapiens
auuuauuguuucugaaaaaguccucaagugggaugggcuu

SEQ ID NO: 127230 - RNA, 43 nt, Homo sapiens
uugagauuuggugacugacaggcugaauugagaugccauugac

SEQ ID NO: 127231 - RNA, 44 nt, Homo sapiens
ugcuauucaggcuccguuggauguaagguggccugugucgagug

SEQ ID NO: 127232 - RNA, 39 nt, Homo sapiens
gcaaauaagaauucagugaccccaaaaauguaucggauu

SEQ ID NO: 127233 - RNA, 55 nt, Homo sapiens
uucucucgccaaacccugcccuugucccuuguauggaucuauugcaaggugaaaa

SEQ ID NO: 127234 - RNA, 41 nt, Homo sapiens
cccggaggaggccuggcugaagaaaggaggaggaagaggga

SEQ ID NO: 127235 - RNA, 34 nt, Homo sapiens
ugaugcuaaccaaagacugcaagaacccccagga

SEQ ID NO: 127236 - RNA, 55 nt, Homo sapiens
uuacuuaaaugacgaaaugucuaucagcccagauagagcaauuugaaauguuuuc

SEQ ID NO: 127237 - RNA, 45 nt, Homo sapiens
aaauauagguagccaacaaucucagaauuuuggaucagcccagau

SEQ ID NO: 127238 - RNA, 45 nt, Homo sapiens
acacaauaaaaguuaaagaaauucaaaaccuguauaaaacaaacu

SEQ ID NO: 127239 - RNA, 52 nt, Homo sapiens
aaugggugugauguaguaggcagaggaguagccuuuuccauacugccagcag

SEQ ID NO: 127240 - RNA, 42 nt, Homo sapiens
aaagaacuuuguuaggaaagauguucagauuaauaacacaaa

SEQ ID NO: 127241 - RNA, 43 nt, Homo sapiens
ccacaugcacauguguaggugaccugacauuaaacauagggaa

SEQ ID NO: 127242 - RNA, 42 nt, Homo sapiens
gguucuaaauguuaacauuuuuccucuguauugagguagcac

SEQ ID NO: 127243 - RNA, 38 nt, Homo sapiens
uuuggcucucuuugguuucugaguaacuuagcaacgcu

SEQ ID NO: 127244 - RNA, 42 nt, Homo sapiens
gcuguauuuuuugcucacuuuuuggaaugguuugaaucugaa

SEQ ID NO: 127245 - RNA, 37 nt, Homo sapiens
uucaaauaauaacgucaguaaugauaaaauuucaaua

SEQ ID NO: 127246 - RNA, 42 nt, Homo sapiens
ccucuugcugcaacauggaaaauggauuugagauagaccugg

SEQ ID NO: 127247 - RNA, 26 nt, Homo sapiens
uuuuuuuucccccaacacacuacuaa

SEQ ID NO: 127248 - RNA, 57 nt, Homo sapiens
gugggcuggaacaacuccaccuucgccuaagagccgcagggacccacgcugucugcg

SEQ ID NO: 127249 - RNA, 246 nt, Homo sapiens
uggcgcaggccaccggcaagcccccccagguuugccgggaggggacaggaagaggggggugcccaccggacgagggguuccgcgcugggagcuggggaggcgacuccugaacggagcuggggggcggggcggggggaggacgguggcucgggcccgaaguggacguucggggcccgacgaggucgcuggggcgggcugaccgcgcccuuuccucgcaguacaucgcggugcacguggucccggacc

SEQ ID NO: 127250 - RNA, 243 nt, Homo sapiens
ugcaccgcgauguacugcgaggaaagggcgcggucagcccgccccagcgaccucgucgggccccgaacguccacuucgggcccgagccaccguccuccccccgccccgccccccagcuccguucaggagucgccuccccagcucccagcgcggaaccccucguccggugggcaccccccucuuccuguccccucccggcaaaccugggggggcuugccgguggccugcgccagcugcugggug

SEQ ID NO: 127251 - RNA, 39 nt, Homo sapiens
uuuacgaugaacaucggcaugauggcagaaggaccagga

SEQ ID NO: 127252 - RNA, 23 nt, Homo sapiens
cuccugguccuucugccaucaug

SEQ ID NO: 127253 - RNA, 48 nt, Homo sapiens
aaaaacgggaaucucauuuagacuuuaauuuuuuugagauuaucggcg

SEQ ID NO: 127254 - RNA, 52 nt, Homo sapiens
cuaggagcucugcuuucaaaacaaaaagagauugggggaguggggaggggga

SEQ ID NO: 127255 - RNA, 59 nt, Homo sapiens
ugauuucuuuuuaaaagugaacuuuguucguaugaaaagaacgaacauguucugcaacu

SEQ ID NO: 127256 - RNA, 44 nt, Homo sapiens
aagcauguuaagaauguuuuguaaacuacaaagcaccaaucagu

SEQ ID NO: 127257 - RNA, 46 nt, Homo sapiens
cauaugauaacguugguuuauucauagucuugacuugccaccugaa

SEQ ID NO: 127258 - RNA, 38 nt, Homo sapiens
auuaugauuauaauuauuucauucccuaaucauguaag

SEQ ID NO: 127259 - RNA, 51 nt, Homo sapiens
uagacaucuauacaucuaguagcuguuuaauacauuuuuuaaaacagguau

SEQ ID NO: 127260 - RNA, 46 nt, Homo sapiens
agguuuuccauauguuacuguuaugauccaaguccaaacuccaguu

SEQ ID NO: 127261 - RNA, 32 nt, Homo sapiens
gggacucucaaggccucagaaguucucuagca

SEQ ID NO: 127262 - RNA, 164 nt, Homo sapiens
aacagaauuugauaauugauugaaaaucauuaccagauuauuagccuagauuauuagcagauucucccuuuccuaauauugccagcaucaaacucaauggagugaaagaagaaggaaugaagauuaaaacaugaauuuguguacguuuuuaaguauuuuaagaa

SEQ ID NO: 127263 - RNA, 40 nt, Homo sapiens
gaacgucuuucuccuugucuguuuuucuuuaaaagaggac

SEQ ID NO: 127264 - RNA, 41 nt, Homo sapiens
gaacaaaacugauugaagaguugcuuguuucauccacaggu

SEQ ID NO: 127265 - RNA, 36 nt, Homo sapiens
ucuguuaguuguuaguuuuaauguuuucuuuacauu

SEQ ID NO: 127266 - RNA, 55 nt, Homo sapiens
ugagcagacaucaguuggguaagcuggucaagaaaggaaauaaguaaaaaaugcc

SEQ ID NO: 127267 - RNA, 58 nt, Homo sapiens
ucugguuuauguuaagaucuuagucuuuuaaacuagugcauuugaucacuaauuaaau

SEQ ID NO: 127268 - RNA, 44 nt, Homo sapiens
augaagcacuguauugaggccauguuguugauaucaugggaaaa

SEQ ID NO: 127269 - RNA, 48 nt, Homo sapiens
ugcuuccagucugcugggacugaaaguccugcuuacaaggguccgaag

SEQ ID NO: 127270 - RNA, 47 nt, Homo sapiens
ggggaacugagcagaggaauucucccaggagccuuuguacccagaga

SEQ ID NO: 127271 - RNA, 43 nt, Homo sapiens
aaauuguuguuuaccuagacuuaaucuuucuguaguuuagggc

SEQ ID NO: 127272 - RNA, 47 nt, Homo sapiens
caguagaccacaguccuguggguuauaucaaugccuaaagcagagau

SEQ ID NO: 127273 - RNA, 46 nt, Homo sapiens
gugauacuagcuuugucagagagagaaugcuuauuuuauggcaagc

SEQ ID NO: 127274 - RNA, 66 nt, Homo sapiens
uaaauugucccauauugagaauaacugaauaaauguuuacauaauugcucccacuuuugcugaauc

SEQ ID NO: 127275 - RNA, 41 nt, Homo sapiens
uuaauguucuuugauuucuaaaucaaauguaccagaccaaa

SEQ ID NO: 127276 - RNA, 54 nt, Homo sapiens
gcauaauaacuuuuaaucaaaaaucuguuccaaccccccagccccauccccccc

SEQ ID NO: 127277 - RNA, 53 nt, Homo sapiens
aaaacuauugcacuggcugcagaugggaaaaaaguugaagggaagcaagagag

SEQ ID NO: 127278 - RNA, 35 nt, Homo sapiens
aguggcauuuuccaagggugagugcagagggagua

SEQ ID NO: 127279 - RNA, 48 nt, Homo sapiens
ggcaacucguucccuacaagucugagaauggguggagcaggcaagaga

SEQ ID NO: 127280 - RNA, 32 nt, Homo sapiens
gagagugguuuuucguaaguuuacccgaagau

SEQ ID NO: 127281 - RNA, 54 nt, Homo sapiens
accuuucccaaugcaggccuauaaucucagacuuuauugaaucugccccaauuu

SEQ ID NO: 127282 - RNA, 133 nt, Homo sapiens
agcauauacaauaaaauuggaaagauacagagauuagcaugacccccugcacaaagaugacacaggcauucaugaaacuguccauaaaaaagagaacacaggaugguaaccgggugauaggugagccacuaau

SEQ ID NO: 127283 - RNA, 100 nt, Homo sapiens
aaacaguccuuugccagugaagcuaaagcaaaucucuagguuaucagaagcccaucacuaccauccaauuaccaaaucacuaauaaucagugagacagau

SEQ ID NO: 127284 - RNA, 87 nt, Homo sapiens
cccccccagcaugcacacgcacacacacacacacacacacacacacacacacacacaaagaggcaguguaaucuuugacuccaaaga

SEQ ID NO: 127285 - RNA, 45 nt, Homo sapiens
aaauaauggcuugagaaagaugaaauuaauacucugaaacuugua

SEQ ID NO: 127286 - RNA, 64 nt, Homo sapiens
acagaagggccaggaaauuugguagguuguuuuguuuuucuauacaucuacaaggugcaaaaaa

SEQ ID NO: 127287 - RNA, 373 nt, Homo sapiens
cucacucucuuuuuuuuuuugagacggagucuugcuuugucgcccagguuggagugcaguggugcgaucuuggcucauugcaagcuccgccucuuggguucacgccauucuccugccucagccuccugaguagcugggacuacaggugccugccaccacgccggcuaauuuuuuguauuuuuaguagagacgguguuucaccguguuagccaggauggucuugaucuccugaccuugcgauccgcccgccuuggccucccaaaguucugggauuauaggcaugagccaccgcacccggccuaccucuugcucacucucucaggacaaauuacacucucuaccacauaggaaaaaaagagaauuucauuuguuu

SEQ ID NO: 127288 - RNA, 48 nt, Homo sapiens
accugaccauuuccucugcaauucaaaacauccacucugccuccaaag

SEQ ID NO: 127289 - RNA, 45 nt, Homo sapiens; identical to SEQ ID NO: 25821

SEQ ID NO: 127290 - RNA, 78 nt, Homo sapiens
cccgaucccggcagugagccgcgccgcgcgucguggcggccugauuucuguuuaacuuuaauagggcgaucucgaggu

SEQ ID NO: 127291 - RNA, 45 nt, Homo sapiens
uucacaacuccacacuugcgauagugagcaagagagaggcagaga

SEQ ID NO: 127292 - RNA, 44 nt, Homo sapiens
ugaaauaaacugauuuucaaaguucacgagcaaagcagggcaac

SEQ ID NO: 127293 - RNA, 51 nt, Homo sapiens
ucugggaaaggugcuguaucauaagugcacccauaaauucuucgcauugcu

SEQ ID NO: 127294 - RNA, 44 nt, Homo sapiens
ggaagggcgagcccuggagaccugucucgucggaaagaaggagg

SEQ ID NO: 127295 - RNA, 41 nt, Homo sapiens
aggaaauucagagcauguacuuguuauagagucagugagua

SEQ ID NO: 127296 - RNA, 25 nt, Homo sapiens
cuccugguauugcagccccgcaggu

SEQ ID NO: 127297 - RNA, 50 nt, Homo sapiens
gacuaugaccuucuuuccauaaccucccucacuagaaacucuuucaggga

SEQ ID NO: 127298 - RNA, 62 nt, Homo sapiens
uguuauuugauuuauaauccucacuauuauucugugaaguggacaaggcaccucauagguaa

SEQ ID NO: 127299 - RNA, 42 nt, Homo sapiens
ucuauuuagagccagaaaguuucuuuuuucaaauccccuaga

SEQ ID NO: 127300 - RNA, 68 nt, Homo sapiens
uuaagccucacaaaaaucuuaugauauaggaaaugcuuguuuccauuuggcacaugaagaaacugaag

SEQ ID NO: 127301 - RNA, 77 nt, Homo sapiens
aacagagaaaugaugaaacuugcgcaggguagucuguccagagucuguauuuuaacuacugcuguguugccucccau

SEQ ID NO: 127302 - RNA, 39 nt, Homo sapiens
auuacugaguuuuuucuuugugguugcagagccuaacuc

SEQ ID NO: 127303 - RNA, 80 nt, Homo sapiens
auauauauaaauauauuuaacauauaauggcauagugucacaguauaucagugaggacuucugacuccaaagcuaggaga

SEQ ID NO: 127304 - RNA, 45 nt, Homo sapiens
gccugaugccauuggugaaaaagauuuuuugguuuuacuauacau

SEQ ID NO: 127305 - RNA, 49 nt, Homo sapiens
aaggaagcuguuuucagaaugagugguauaacaaaaaucugaauagcag

SEQ ID NO: 127306 - RNA, 51 nt, Homo sapiens
uccuuagauaaucuaaugaacagaaaggguugagaacugcuauguagauau

SEQ ID NO: 127307 - RNA, 108 nt, Homo sapiens
uauuuuauauucucuacugcuaaaauuuuaaaauuuuaaugcaaacagggaaacuaauuuggaaaaacauagugauauuuuaugaacuuugcuuuauaguugaaguau

SEQ ID NO: 127308 - RNA, 65 nt, Homo sapiens
uugcuuuaaaaugacuuuuaggggaauuuuucuaauuuuuuuuuagcaaaauaaggcuaaguuga

SEQ ID NO: 127309 - RNA, 43 nt, Homo sapiens
aauugaugugaaauauauuacuaauuuguguauuuagagggag

SEQ ID NO: 127310 - RNA, 63 nt, Homo sapiens
acuuacagaggaaauguaaauaauauaugcagcuaugcaugaugcucagcauugcugagggua

SEQ ID NO: 127311 - RNA, 45 nt, Homo sapiens
auagacuugauagauaauuauugaauaaauaaaugaauaaugcag

SEQ ID NO: 127312 - RNA, 41 nt, Homo sapiens
aagucaggugaucauggugacauagcagaauuaagaaugga

SEQ ID NO: 127313 - RNA, 48 nt, Homo sapiens
acauuuugugucaauuuuccagacagaaaaacagccucuagacauuag

SEQ ID NO: 127314 - RNA, 46 nt, Homo sapiens
caaacuuaaaauuggaaggguuuaccaaaauguuacuuuaaagaau

SEQ ID NO: 127315 - RNA, 48 nt, Homo sapiens
ccuuaugugauucagauauuaaauaauuuuggagauuaauaugaacag

SEQ ID NO: 127316 - RNA, 53 nt, Homo sapiens
auagauaaucaaagcucucaggugacauaauggauccuaaaguauugacugcu

SEQ ID NO: 127317 - RNA, 60 nt, Homo sapiens
guuuuauuuugcagaaaguccuguuuagggaaaagaaagcaagagaauaagcauaaggca

SEQ ID NO: 127318 - RNA, 47 nt, Homo sapiens
cuuucuuuuagauuauaggaaauauacuaaucuugaauaacuugaau

SEQ ID NO: 127319 - RNA, 45 nt, Homo sapiens
uauauauacaguauauaaaauauaucugcuauaaauuccaugcau

SEQ ID NO: 127320 - RNA, 47 nt, Homo sapiens
ccucauguuuuuaaagcugcagcagaguggugcaguuaaaaauuguu

SEQ ID NO: 127321 - RNA, 39 nt, Homo sapiens
uuauauuguuaagugucacacacacaagucuaagaauaa

SEQ ID NO: 127322 - RNA, 58 nt, Homo sapiens
aaagaggauuaucuguuugcauuaacagaaaaagagugucauaauagagcacaaagau

SEQ ID NO: 127323 - RNA, 50 nt, Homo sapiens
uaaauuuucuuaauuuuguaucucauaacuuuaugagauguaacagugag

SEQ ID NO: 127324 - RNA, 48 nt, Homo sapiens
ucuccucuuuuucaccuuugccacugugaguaggaauuucuaguggaa

SEQ ID NO: 127325 - RNA, 24 nt, Homo sapiens
caaagcugggacuaaaggaaguga

SEQ ID NO: 127326 - RNA, 50 nt, Homo sapiens
uuaaaauguuuagcucugcugaacaauacuaguauauuaauaacauauaa

SEQ ID NO: 127327 - RNA, 43 nt, Homo sapiens
cccuauauucuguccuauuugacuuuguuuuuuuucccuguug

SEQ ID NO: 127328 - RNA, 43 nt, Homo sapiens
cuugauuaaauuaacaacaguucucuauuccaaaagugccuac

SEQ ID NO: 127329 - RNA, 37 nt, Homo sapiens
guguuucauuuugaauaauuucuauugaccugucuua

SEQ ID NO: 127330 - RNA, 60 nt, Homo sapiens
agugucaaaggcuugacuuaauuuaacuucguaguaucuguguguaugugagaguguuuu

SEQ ID NO: 127331 - RNA, 56 nt, Homo sapiens
auaagaagacaauucuuguuucccuuauaaguauggacuguauacauuaaggaaaa

SEQ ID NO: 127332 - RNA, 76 nt, Homo sapiens
guucuugucaaauuuugccuuuauaagcuuauuacaaaauuacaacuuacuuuacugaaguuuauaauggaagaag

SEQ ID NO: 127333 - RNA, 46 nt, Homo sapiens
gguuguuaaucugcuuggcaaauauuccuucauaauuugugaaaag

SEQ ID NO: 127334 - RNA, 48 nt, Homo sapiens
ugacuuuuuguaccagucauaugcaggguacaguaacugaggauaugg

SEQ ID NO: 127335 - RNA, 46 nt, Homo sapiens
uguguuuugccuggaaguuauuagcugagauucuaacacacaaaaa

SEQ ID NO: 127336 - RNA, 69 nt, Homo sapiens
ucagauaaccaggcugcacagggcucucuauaauggaaugaugcuccuuuucaauacuuagagccacug

SEQ ID NO: 127337 - RNA, 49 nt, Homo sapiens
uuuuagaagaaaaagaguaauucagcuauagaaggcuccuccagcauga

SEQ ID NO: 127338 - RNA, 74 nt, Homo sapiens
cauacugucuacauuaggaauauauauucuguuaaaucagagggaaagauauguauuuaaugcaaucugaacag

SEQ ID NO: 127339 - RNA, 68 nt, Homo sapiens
ucuccuuuaacuguucagauugcauuaaauacauaucuuucccucugauuuaacagaauauauauucc

SEQ ID NO: 127340 - RNA, 62 nt, Homo sapiens
uaucuacuaguaaaacuuuuuauaaaauaugacuaucuguauagcuggcggcuucagcuggg

SEQ ID NO: 127341 - RNA, 50 nt, Homo sapiens
cuuagagccuuuuuuugguucagaggagguggagagauuuuucauaauac

SEQ ID NO: 127342 - RNA, 43 nt, Homo sapiens
caacuucuuuugagguuauggagauuuuuaaauaggucaggaa

SEQ ID NO: 127343 - RNA, 51 nt, Homo sapiens
ggaauccacuuggcuaguguggagggagcaagaagagugagcaaugagggc

SEQ ID NO: 127344 - RNA, 91 nt, Homo sapiens
auggggagugaguggacaaagaagaauaucuaaggaaaccuaaagaaaaauagcaucuagagagaacaggaacacagaagaaauggauggu

SEQ ID NO: 127345 - RNA, 65 nt, Homo sapiens
cggcucggcaggcuggcuugacagggcggcgggagcugcgggagcugcggcagcugcggccucug

SEQ ID NO: 127346 - RNA, 53 nt, Homo sapiens
guaaaugcuguaguagaugguuuggguaugacaguuuaagugcuggaccugag

SEQ ID NO: 127347 - RNA, 36 nt, Homo sapiens
guuauaauguuuaauuccugucucuuacucuucuuu

SEQ ID NO: 127348 - RNA, 46 nt, Homo sapiens
acaucaucaucuuuggagaauuuagcgacggcgccugugaaccaga

SEQ ID NO: 127349 - RNA, 48 nt, Homo sapiens
gaaaaagaauugucccuuauauauuuaauaugcuuauucaauauccaa

SEQ ID NO: 127350 - RNA, 51 nt, Homo sapiens
ggacuuuuauacuaaauauuacuaguaaacacaagggaaucauaaaaauag

SEQ ID NO: 127351 - RNA, 46 nt, Homo sapiens
auuugaugaauauuuaaauuacacagaauaaugucuacauagaaua

SEQ ID NO: 127352 - RNA, 54 nt, Homo sapiens
aaagauuuuucccuuugcuucuguuuuauuuagcccugccaugcaccacauuaa

SEQ ID NO: 127353 - RNA, 50 nt, Homo sapiens
uuuauuaauacuuauauuauuuaguaaucuaucuuaugagaguguuagug

SEQ ID NO: 127354 - RNA, 50 nt, Homo sapiens
auuaaauuaugaaugaguuuuacaaauuccuuucagaguuuuacuaagau

SEQ ID NO: 127355 - RNA, 45 nt, Homo sapiens
ucauugggaaaggacagcuuugauaauguccaaauacucugaaau

SEQ ID NO: 127356 - RNA, 41 nt, Homo sapiens
guauaguaugugcauaauggaaaguuaccuuacugaaaaaa

SEQ ID NO: 127357 - RNA, 46 nt, Homo sapiens
auucgaaauuucacauuagauaugauuuaaccauaagcagcagcac

SEQ ID NO: 127358 - RNA, 88 nt, Homo sapiens
aaauugauuguuuguggaaugacaucaaaugguuucaccauugcagacccagaugauagaggcauguuggauaugugcggcuuugaua

SEQ ID NO: 127359 - RNA, 48 nt, Homo sapiens
aaagugugguuucccuaccagcagucuuagccucaccugcgaccguau

SEQ ID NO: 127360 - RNA, 55 nt, Homo sapiens
acuuaaaauaagaaaaaguauugauuacacacauaaaauuuauuuuaaccaguuu

SEQ ID NO: 127361 - RNA, 45 nt, Homo sapiens
uauuucuuaucuaaugaaaugagaagaauauuuacuguauuugcu

SEQ ID NO: 127362 - RNA, 46 nt, Homo sapiens
gagaaagugaagcgcacaagagaugagcuagaagucauucaucuaa

SEQ ID NO: 127363 - RNA, 46 nt, Homo sapiens
ucaaaugauggaaaaauugagggcuuaacagcugaauuugugaacu

SEQ ID NO: 127364 - RNA, 41 nt, Homo sapiens
ucuuuaacugugagguuacuaacaugaaugacuacugagag

SEQ ID NO: 127365 - RNA, 45 nt, Homo sapiens
cggaugaugaaggagaagaugauuaagaccccagaugaccugcag

SEQ ID NO: 127366 - RNA, 45 nt, Homo sapiens
aagcaucuaaaaagacugcaauggcuacugcuaaggcaccuacaa

SEQ ID NO: 127367 - RNA, 54 nt, Homo sapiens
gccauuacuggugcaucucuugcugauauaauggccaagaggaaucagaaaccu

SEQ ID NO: 127368 - RNA, 46 nt, Homo sapiens
uaaugacuguccugagaagaaauucaaacucugugaaaguugggga

SEQ ID NO: 127369 - RNA, 51 nt, Homo sapiens
agaucacauuugauugacaguccaccaacuuacaaugcugacuauggcuac

SEQ ID NO: 127370 - RNA, 48 nt, Homo sapiens
uuccugauucaaaugagauuguggaaaaauugcuucuaagaagaaagu

SEQ ID NO: 127371 - RNA, 45 nt, Homo sapiens
uaaacugcgccuuuucaaggauggaaaaaugaaauaucagguaug

SEQ ID NO: 127372 - RNA, 48 nt, Homo sapiens
uaugugcaacacuugaguggcuaucacuucaaacugaaauuugaccca

SEQ ID NO: 127373 - RNA, 35 nt, Homo sapiens
aaaguaucacaggcuuccauugaccagagcaggca

SEQ ID NO: 127374 - RNA, 88 nt, Homo sapiens
gcuguggagcuguauccugcccuucugguagaaaagccucggccagaugccaucuuuggugaaaccaugguagaaguuggagcaccau

SEQ ID NO: 127375 - RNA, 46 nt, Homo sapiens
acuuuugguggagaaguggguuuucaaaucaucaacacugccucaa

SEQ ID NO: 127376 - RNA, 47 nt, Homo sapiens
caauaacgugaagggcugucccuuuacuucauucaguguuccagauc

SEQ ID NO: 127377 - RNA, 50 nt, Homo sapiens
augaguuuugacgucuuuuuacuugaauuucaacuuauauuauaagaacg

SEQ ID NO: 127378 - RNA, 48 nt, Homo sapiens
uaaaguacuuuugguuauuuuucugucaucaaacaaaaacagguauca

SEQ ID NO: 127379 - RNA, 46 nt, Homo sapiens
uguaaaaucuauaucagcaaaagggucuaccuuuaaaauaagcaau

SEQ ID NO: 127380 - RNA, 48 nt, Homo sapiens
ugaccucauaaaauaccucuucaaaaugcuuaaauucauuucacacau

SEQ ID NO: 127381 - RNA, 44 nt, Homo sapiens
aaacaaaaccaaaugauaucuaaguaguucucagcaauaauaau

SEQ ID NO: 127382 - RNA, 53 nt, Homo sapiens
ucuuuuccacaucucauugucacugacauuuaaugguacuguauauuacuuaa

SEQ ID NO: 127383 - RNA, 45 nt, Homo sapiens
guuaccucucugaauauuauguaaacaauccaaagaaaugauugu

SEQ ID NO: 127384 - RNA, 47 nt, Homo sapiens
uaggccuaugugcuagcccacaaagaauauugucucauuagccugaa

SEQ ID NO: 127385 - RNA, 47 nt, Homo sapiens
cugacaaaaccugggaauuuggguuguguaugcgaauguuucagugc

SEQ ID NO: 127386 - RNA, 51 nt, Homo sapiens
ucgaugggccauaccuaauaggcauauugagcacaaugaagcgagagauga

SEQ ID NO: 127387 - RNA, 47 nt, Homo sapiens
gccugcuccccuccuucguuuucuuguugggcauuuuccccguugag

SEQ ID NO: 127388 - RNA, 69 nt, Homo sapiens
ccuaggaguaauggaguccaaagaggaacuagcggcaaacaaucucaacggggaaaaugcccaacaaga

SEQ ID NO: 127389 - RNA, 46 nt, Homo sapiens
aaaaagaucagugaaagcaagacagucaaauacuuaguaggcuucc

SEQ ID NO: 127390 - RNA, 50 nt, Homo sapiens
gaauauuuuauuagacucagcugaagagacaagugaacuaaacuauaagc

SEQ ID NO: 127391 - RNA, 45 nt, Homo sapiens
guuucugauuaaaaugaaaucacaagcugccuuguuuagccugcu

SEQ ID NO: 127392 - RNA, 45 nt, Homo sapiens
cuuauauccacagcaguaaacccaaaguuaaagaugcugugcagg

SEQ ID NO: 127393 - RNA, 45 nt, Homo sapiens
auuuuucucccuucuccacugcuagaguucagcaagaccagcaga

SEQ ID NO: 127394 - RNA, 53 nt, Homo sapiens
uguuuaguucaaccuauagucuuuugaucaaggguuuagccauauauguuaga

SEQ ID NO: 127395 - RNA, 45 nt, Homo sapiens
gaaauaucaaucuaaaauaaaacuucauuuuauuuagcugauggu

SEQ ID NO: 127396 - RNA, 87 nt, Homo sapiens
gauaacuaugauauaagacuaugugauaaaauccaugggaaaacuacaccaaagcccugucggaguucagagaugaaaagaucagag

SEQ ID NO: 127397 - RNA, 407 nt, Homo sapiens
aaauccaugugguauuaagaacuagccacaaucaugugaagggaaauacagauauggagauaucaugguaguauguaucaaaaaccuuaaaaauauguauaacuucuuaaaccaguuauccaccucaagggauuuguccuaaacaaauaauucuaugaaugcagaaagauguacuaggauuuuuaaucaauauuauuuuaagguaaaauuagauauagcaaagaugcccaguaucaguaagugggcuuaaaaauuugagguuaaucuaugcaauagaaaauaauggauuuucaagucagacucccucuguucaaauuccagaucuaguaugcugcuaaaaauagggauacagagguagaauuacuuauucccuuaaggagcucccugaccaacuaguaggguucaca

SEQ ID NO: 127398 - RNA, 45 nt, Homo sapiens
gugugugugugugugugugugugugugcucucuuuucaagagaaa

SEQ ID NO: 127399 - RNA, 45 nt, Homo sapiens
ucuaccccgucggccgcugccacuggggucccuggccccaccgac

SEQ ID NO: 127400 - RNA, 45 nt, Homo sapiens
uuccuugcugaucagcaauccgagaucgauggccugaaggggcgg

SEQ ID NO: 127401 - RNA, 45 nt, Homo sapiens
cguccggcagacgggaaacagacuugauagagucugcgaacccau

SEQ ID NO: 127402 - RNA, 53 nt, Homo sapiens
uaacugagaaaaacaaagaacuugaaauugcucaggaucgcaauauugccauu

SEQ ID NO: 127403 - RNA, 43 nt, Homo sapiens
ugugauacaguugggaauuugggugaauccacauugguaguca

SEQ ID NO: 127404 - RNA, 65 nt, Homo sapiens
ccagauacaacuuuauacuuuugccauugcuuuuuuaaaauuugcauuuuauuugguguuaaaag

SEQ ID NO: 127405 - RNA, 46 nt, Homo sapiens
uagaggauguuaaacgucugaaugaaaaacuuaaagaaagcaauac

SEQ ID NO: 127406 - RNA, 45 nt, Homo sapiens
auggcugaauacagaguugaaaaccaaaacugaugaacuucuggc

SEQ ID NO: 127407 - RNA, 45 nt, Homo sapiens
gcauuacauuuggcguaaaaaaucaaccaauugcguuuacauaaa

SEQ ID NO: 127408 - RNA, 44 nt, Homo sapiens
uugggacagaauuagguacagaagaaagaacuuuggauuaggaa

SEQ ID NO: 127409 - RNA, 47 nt, Homo sapiens
aaagaucaaauggaaaaagaaaugcuugagaaaauagggagauugga

SEQ ID NO: 127410 - RNA, 45 nt, Homo sapiens
aauagugaaagaaguggaagccaaagcaccaauuuugaaacgcca

SEQ ID NO: 127411 - RNA, 44 nt, Homo sapiens
auaaucgaagaauggaaauacaaguaaaagaucuuucacaacag

SEQ ID NO: 127412 - RNA, 53 nt, Homo sapiens
accuauguaagaauuagucagagguuuuuucaaaauacauguauaaugucuuc

SEQ ID NO: 127413 - RNA, 45 nt, Homo sapiens
cagauugcauugguaaguauaaguaccugaguccugugugguggg

SEQ ID NO: 127414 - RNA, 46 nt, Homo sapiens
acagaaucacugagcuucagcucaaacuugagagugcccuuacuga

SEQ ID NO: 127415 - RNA, 50 nt, Homo sapiens
agcagaaaaugaaaaaauacaaaaugagcagcuugagaaacuucaagaac

SEQ ID NO: 127416 - RNA, 85 nt, Homo sapiens
agagaaaucagaaacucacugccacaacucaaaagcaagaacagauuaucaauacgaugacucaagauuugagaggagcaaauga

SEQ ID NO: 127417 - RNA, 28 nt, Homo sapiens
uagguaagagcagaaaauuugaagaagg

SEQ ID NO: 127418 - RNA, 59 nt, Homo sapiens
acagaaaccaaacaaaggcuuaguagccagauagaaaaacuggaacaugagaucucuca

SEQ ID NO: 127419 - RNA, 53 nt, Homo sapiens
ucuaaagaagaaguuggaaaaugagguggaacaaaggcauacacuuacuagaa

SEQ ID NO: 127420 - RNA, 106 nt, Homo sapiens
cuucaucuuaacacaaaagaacuauuaaaaaaugcucaaaaagaaauugccacauugaaacagcaccucaguaauauggaaguccaaguugcuucucagucuucac

SEQ ID NO: 127421 - RNA, 45 nt, Homo sapiens
gcuaagacagacagaagagcaggugaaugacuuaaaggagagacu

SEQ ID NO: 127422 - RNA, 67 nt, Homo sapiens
auugaaguucguuuaaaagagucagcugaauuucagacacaguuggaaaagaaguugauggaaguag

SEQ ID NO: 127423 - RNA, 44 nt, Homo sapiens
auugaugcugcaugcugcugauguugaagcucuacaagcugcga

SEQ ID NO: 127424 - RNA, 45 nt, Homo sapiens
aaagcagaaucacaguuguuggaguguaaagcaucuugggaggaa

SEQ ID NO: 127425 - RNA, 44 nt, Homo sapiens
uggagaaacaaaacagauuacuucaugaucagaucgaaaaauua

SEQ ID NO: 127426 - RNA, 54 nt, Homo sapiens
agguggcucagguugagagucugcguuaucgacaaaggguugaacuuuuagaaa

SEQ ID NO: 127427 - RNA, 57 nt, Homo sapiens
cugaugaagaaaacugaaacaaugaauguaguuauggagaccaauaaaaugcuaaga

SEQ ID NO: 127428 - RNA, 48 nt, Homo sapiens
ugagcugagugagaaaagcgguauguugcaggcagagaagaagcucuu

SEQ ID NO: 127429 - RNA, 46 nt, Homo sapiens
ucaacagaaagauccagauacagaagaauaucggaagcuccuuucu

SEQ ID NO: 127430 - RNA, 46 nt, Homo sapiens
aggaaaccauccagaaggacuuagaugccaaaauaauugauaucca

SEQ ID NO: 127431 - RNA, 46 nt, Homo sapiens
gaugaauuggauguucgcauuacugcgcuaaagucccaauaugaag

SEQ ID NO: 127432 - RNA, 46 nt, Homo sapiens
guauccgcccaaugguuacaccugcaacuguuacaaaucccacuac

SEQ ID NO: 127433 - RNA, 46 nt, Homo sapiens
cagaagggccuguggaacauguuccaguuuuuggaagcacaagugg

SEQ ID NO: 127434 - RNA, 46 nt, Homo sapiens
acaggcuacagcuuuugugcaacccacucaacagagucauccucag

SEQ ID NO: 127435 - RNA, 48 nt, Homo sapiens
uaugguuaauauauuaguguauuaugauacaggaagaaguuauggcag

SEQ ID NO: 127436 - RNA, 63 nt, Homo sapiens
ucagaucagcagacgacaacuucaucccaggauggucaaggcaaaggagaugaugucauugua

SEQ ID NO: 127437 - RNA, 55 nt, Homo sapiens
auugacagugaugaugaagaagaggaugaugaugaaaaugauggagaacaugagg

SEQ ID NO: 127438 - RNA, 78 nt, Homo sapiens
augaggaagaugaugaugaugaugaagaugacacagggaugggagaugagggugaagauaguaaugaaggaacuggua

SEQ ID NO: 127439 - RNA, 47 nt, Homo sapiens; identical to SEQ ID NO: 26041

SEQ ID NO: 127440 - RNA, 45 nt, Homo sapiens
guugagucccucucuacuauguacuaauaaguacuugggguaggu

SEQ ID NO: 127441 - RNA, 68 nt, Homo sapiens
uuuguuauguuuuauguugaguuuguguugcuuucaguuuaucuaugugaggauaucugagacauuca

SEQ ID NO: 127442 - RNA, 42 nt, Homo sapiens
cuuaguauuaguucagaagcaggccuagaaauugauagccag

SEQ ID NO: 127443 - RNA, 45 nt, Homo sapiens
uuuucuuagauacuaguaguagucaaccaaagccuuucagacgag

SEQ ID NO: 127444 - RNA, 42 nt, Homo sapiens
aaagcugagucugaucuggauuacauucaauacaggcuggaa

SEQ ID NO: 127445 - RNA, 32 nt, Homo sapiens
cguccucuuggccuggguuuccuuccuggagc

SEQ ID NO: 127446 - RNA, 41 nt, Homo sapiens
ccgugagucacuguggcauccuggcccaucagcccagggcu

SEQ ID NO: 127447 - RNA, 44 nt, Homo sapiens
uacaaaugggguuuuagauguaaagaucagguuugauggcaugu

SEQ ID NO: 127448 - RNA, 49 nt, Homo sapiens
ccugaugccuuuggaaggggcauuagggguuguuacuauaaugggggcu

SEQ ID NO: 127449 - RNA, 1552 nt, Homo sapiens
cacacacacacacacacacacacaaagcuggucucccguaccucugacuggaacuuggggagcuuccuuagucucaugccgaagaggagucaagcuuaggagaccucuggucugcuucuuggugcucccugaaugcuuguuagugacgucagcuuccaguuuacugguaacagcuggacugcugccggaggccaguaaccuggaguucucuugcuuggaagcaggugaugggaagugggaugugagugauggagggaaaaggaagcucaacuccaccgagccucaacacuugauggauggggcaaagugaggaaacagaccacagaagcacaggaguaagccacuguuucugccccucaagggucuccaggccaccaucaucccugccacuggcacugcccaaccugccacuuccuucuacaaagcugaaaugcaguaaucugauggaggacacaaaccuuuaacuuccucaguucacaucacguuacuaauccagccuccuacucuccagcagcacucagcuuccaucugcuggccagcucuuuacgugguccucuccugacacuaccacguuccuuugccuaugcuggcucuugcugucccuucgccaagaaaacucucccauuucuccuucccacugggaaccaagccuccucugaguuccaguuaauauugagcacucacaugaagucuccucaccguaugaccuaacauaugcccuucguuccugccaaagaacauucccuuuaggaggggccggguguggguggcaaggugggguaggaaucccugacaaggaugauccagggagaauucuggugaguaagaccuggucuucaagugcaacuuggucuucaagagccaaguugccaugcugaggaagggugaccccagagcagagccuaggccaggugaggagcaggucugagagacgcgaugaucacagagaguggaacaccuguguuuaaggacauggcuacagaacauacauuguaaauaauguuauagcauuauuucuaacaguaaaaaaugggacacaaucuuagcacccuucagaaaaagaaugaauaaauaaauaauaaugaaguugaucuuguaucaauagggauaaaccucagaaauacaacagugaaugaaaaacacacaaaggauacaguaugacaccauuuauauaaaguuugaaagcuugcaaaaccauaucuauuauguguggauacuuacauguauaguaaaaguauaaaaacauacauggaaaacauaaauaccaauuucagaagagcaggaagaaggcaggaaauggcacaggugaggguuaacaauguucuagucuuuuaaaacaucagcugaagaaaauauggagacauagggacaauauucucuauacuccugcgugcuuguacuauuuuaucauuuuuaaaggaacaaagagugcucuaggagcaacuucauguuggugauagacugcagcugguugagcuuugggugcugcagucagccacaggugagaacggugacggugugacagggaaugggcaccacuccucucagagcu

SEQ ID NO: 127450 - RNA, 46 nt, Homo sapiens
ugcucuugggaacagauugucuucaugauuuccaacugguguggug

SEQ ID NO: 127451 - RNA, 23 nt, Homo sapiens
aguaaaaauugcaagacggaaaa

SEQ ID NO: 127452 - RNA, 44 nt, Homo sapiens
cuccuccugggaaguaacaguucaggagaagcaaccucuuaagg

SEQ ID NO: 127453 - RNA, 35 nt, Homo sapiens
uagaggcaaaauuugguuuuaggauagaauaaaaa

SEQ ID NO: 127454 - RNA, 45 nt, Homo sapiens
uaggauuaccagaacuccagcucaucugccuuguugguacugaga

SEQ ID NO: 127455 - RNA, 64 nt, Homo sapiens
aaaaaaucuacucuuaaagugagaaagaguggguagagaggcuaggacugauacucuagcagau

SEQ ID NO: 127456 - RNA, 51 nt, Homo sapiens
cuuuuuaagacuuuaucuagauuuggugguguuauucaguuuauauacuug

SEQ ID NO: 127457 - RNA, 33 nt, Homo sapiens
gucacuuaucaaccuugugauuugggacaaguu

SEQ ID NO: 127458 - RNA, 51 nt, Homo sapiens
uccccuucauccucccaaaaggugagaaaaagaaacaauagcauggaaaua

SEQ ID NO: 127459 - RNA, 41 nt, Homo sapiens
cccagaacgguccgagccgcggcagucggcgacgccucaga

SEQ ID NO: 127460 - RNA, 48 nt, Homo sapiens
ggcccgcuuccggaagguggacguggaugaauaugacgagaacaaguu

SEQ ID NO: 127461 - RNA, 129 nt, Homo sapiens
aggccgggcccgacgagggcgagguggacuccugccugcggcaauauccuugcauucaccgcccuccccaccccagcccagcccagcccgcccuucuccugggacccgggagccugcaggauccgcggg

SEQ ID NO: 127462 - RNA, 29 nt, Homo sapiens
gggaagcccccguuuccuacccagucggc

SEQ ID NO: 127463 - RNA, 45 nt, Homo sapiens
uuuuugaucaguucaucuuaaaauauaaagauacugucucuucuu

SEQ ID NO: 127464 - RNA, 47 nt, Homo sapiens
gcccuacaggcagcucugaagaaccccccuaucaacaccaagaguca

SEQ ID NO: 127465 - RNA, 47 nt, Homo sapiens
uuguugggcaugaacaucaaacuuuuguuccacuaauauggcucugu

SEQ ID NO: 127466 - RNA, 40 nt, Homo sapiens
guuuucuggguuuuguuuuuuguuuuugucugugcaagac

SEQ ID NO: 127467 - RNA, 45 nt, Homo sapiens
caucucacucccaguaauacccagcuccuaucuaaagccccauuc

SEQ ID NO: 127468 - RNA, 53 nt, Homo sapiens
cuucagccccuucccuguguccaccuuucucuccucuucccaagccuuuuucc

SEQ ID NO: 127469 - RNA, 49 nt, Homo sapiens
ggggaaauuauggaaacaaucuaauuguucaauugcugugcuaguggua

SEQ ID NO: 127470 - RNA, 48 nt, Homo sapiens
acgaaagaaaggaaaauaaacucuuuguaugauauuuauuaggaggaa

SEQ ID NO: 127471 - RNA, 54 nt, Homo sapiens
ccaagaagcaacagcaugggguccagcaguuggggcccaaaagacagucugaag

SEQ ID NO: 127472 - RNA, 43 nt, Homo sapiens
agcagggaaugcccuucacucuguaggugcucgagccccaauc

SEQ ID NO: 127473 - RNA, 47 nt, Homo sapiens
ccccagccacaugggaagugaaagcugagaagggaaggcagauggga

SEQ ID NO: 127474 - RNA, 51 nt, Homo sapiens
cucuccguccccccggggcccuccggagggagagagagaggaacugcuguu

SEQ ID NO: 127475 - RNA, 44 nt, Homo sapiens
acggggacaaggcaccaugaacccuccacacugaggccaaagug

SEQ ID NO: 127476 - RNA, 46 nt, Homo sapiens
guuccaugaugcauccuggaccuucugcucuggagcagcuguuaau

SEQ ID NO: 127477 - RNA, 38 nt, Homo sapiens
accacauacagcugaguuucaguaaaaagacuugacau

SEQ ID NO: 127478 - RNA, 51 nt, Homo sapiens
acccuuagggcucucuuuuugagccaaauaaauuauucacauuuucaaccu

SEQ ID NO: 127479 - RNA, 82 nt, Homo sapiens
aaaaccuuaacagcuuucaugacauugcugccaucccuggcacuugaaguucccuuaagaauuugccuggguaguagcagua

SEQ ID NO: 127480 - RNA, 70 nt, Homo sapiens
cagaaugaguaaaaaugaagaggauucuauuuauaaacauugucagagugucauaaaugaguaaauauga

SEQ ID NO: 127481 - RNA, 94 nt, Homo sapiens
ugacugacauuacugaacaguauauggcucuuuuuuguuugguuaacuaaaugcagaaagagcccugaucuaaauucaaaguuggauucauaaa

SEQ ID NO: 127482 - RNA, 63 nt, Homo sapiens
cacacacacgaugugauggugacaaauuaacucacuuugcaggugacacuuccaucuggaccc

SEQ ID NO: 127483 - RNA, 44 nt, Homo sapiens
uccuuuucagaacuguaaaacauauuuucuaauugccuaaacca

SEQ ID NO: 127484 - RNA, 42 nt, Homo sapiens
aaagcuguguucuucuguuuugaaggguuuccgcccccaaca

SEQ ID NO: 127485 - RNA, 50 nt, Homo sapiens
uaaaacaaaugggcucuaagguccuuuacauuuuuggauuuuugugauca

SEQ ID NO: 127486 - RNA, 46 nt, Homo sapiens
agaagccagugguuaccuucaaagaaaacauuaagacacgagaagu

SEQ ID NO: 127487 - RNA, 46 nt, Homo sapiens
uuguuuaucacagaaaucccagaauuaauacuggaagaccccagug

SEQ ID NO: 127488 - RNA, 44 nt, Homo sapiens
cagcaacgacgaauacgacagcaacgcuugaucucuauaggcaa

SEQ ID NO: 127489 - RNA, 45 nt, Homo sapiens
cccugguugauuucucuucugaauaguuuccauccccaugaagag

SEQ ID NO: 127490 - RNA, 46 nt, Homo sapiens
gcuuucuagucauuugucccaacuuaauauuuuaauauguauacau

SEQ ID NO: 127491 - RNA, 46 nt, Homo sapiens
gacaggaaccagaaaagaauguagcaauaggcacacauaggcagaa

SEQ ID NO: 127492 - RNA, 72 nt, Homo sapiens
auaguaguuucaguagagugguaauggaugguugggugagaggagggagagggguuguguggaagccagaug

SEQ ID NO: 127493 - RNA, 67 nt, Homo sapiens
ugugaaguaaauauucuucacagugugaagaacugugugcggggcaagaaauaagcccuuggcaagc

SEQ ID NO: 127494 - RNA, 41 nt, Homo sapiens
uucuuggcauggaauaaagagcugaggagacaagagauagu

SEQ ID NO: 127495 - RNA, 42 nt, Homo sapiens
uuagcuuaaagguuggaaguuuaacuguaugaauauaaaagg

SEQ ID NO: 127496 - RNA, 32 nt, Homo sapiens
auuuggccauugguauuauuucaaauacaguc

SEQ ID NO: 127497 - RNA, 46 nt, Homo sapiens
ccuguaccagaaaaugcuaguuaccgauuuggaauacgcuuuagac

SEQ ID NO: 127498 - RNA, 39 nt, Homo sapiens
acagaagcauuguaaaccagacuuagucauuagucaaaa

SEQ ID NO: 127499 - RNA, 96 nt, Homo sapiens
gcucauuaaaauaauacugucauggcuuauucggucaauauauugagagaggaguaacugcagaauaccaaagcaacugcuagauaaucagcugau

SEQ ID NO: 127500 - RNA, 43 nt, Homo sapiens
aacuuuuaaguauuggcauuaauuugccaagaccuugugcuac

SEQ ID NO: 127501 - RNA, 47 nt, Homo sapiens
cugucauuuggaggugaggaagggacauaggaaucaguagcuugaga

SEQ ID NO: 127502 - RNA, 68 nt, Homo sapiens
aaugaagugagggaagucucaaaauuggugcaagggaagggguaaaucaaaggaacaguccuuaagaa

SEQ ID NO: 127503 - RNA, 141 nt, Homo sapiens
accucuugaacacaggcaauucuugaugaauuugagaggggaaaaaagaggcagcagcuagaggggaacguggggcagaagguuuuuaaaaugugugagauacuuggacauguuaaaaugcugaagagaaggaaagaucca

SEQ ID NO: 127504 - RNA, 55 nt, Homo sapiens
uuccacaauuggaaagcuaugaugcauuugcuaagaugaaacaaccuuacaaaga

SEQ ID NO: 127505 - RNA, 40 nt, Homo sapiens
gggaagucauuaaaguguuuuaaagggacaauugauagau

SEQ ID NO: 127506 - RNA, 68 nt, Homo sapiens
uuguuuaguauucuucauuuauguugcuaguucuuauagggcuuaugguuaccuccuuagcacuacau

SEQ ID NO: 127507 - RNA, 38 nt, Homo sapiens
gaacaaauuaacuuguggcuuuugguuaaauuucuuaa

SEQ ID NO: 127508 - RNA, 46 nt, Homo sapiens
gugaggggagggagggacaccugacuagccagucaguaaccagauu

SEQ ID NO: 127509 - RNA, 59 nt, Homo sapiens
aacaucagcuugcaguucuguaugucagcguggaugcaaucaagccucccaagugccug

SEQ ID NO: 127510 - RNA, 64 nt, Homo sapiens
aauaaaauuagaaacuuccugaaacauuugauuuuggccaagaucgggauggggcaugcuaaag

SEQ ID NO: 127511 - RNA, 26 nt, Homo sapiens
aggcacuacauaugcguaauugaaua

SEQ ID NO: 127512 - RNA, 60 nt, Homo sapiens
guaaugucaucccgucuuaugggcuuuaacgaauaucuguaugcugaugacucccaaaug

SEQ ID NO: 127513 - RNA, 53 nt, Homo sapiens
cuagcaauguaaccuugaagcucucuaguuuuuuaccuuggcuaccuguaaaa

SEQ ID NO: 127514 - RNA, 39 nt, Homo sapiens
ccuuccauaaaaugaccugcaccuaccucugccucauga

SEQ ID NO: 127515 - RNA, 46 nt, Homo sapiens
gggugucuuugaggaggugagauuugguuuguacauugaaagaugg

SEQ ID NO: 127516 - RNA, 25 nt, Homo sapiens
aggucaaagguauuauguaaguaua

SEQ ID NO: 127517 - RNA, 54 nt, Homo sapiens
gcuaagccuuauccuagccuggggagaggaacagagaagauagugggagcauug

SEQ ID NO: 127518 - RNA, 59 nt, Homo sapiens
aagauggcuguuucagaagggucagaaaugaagauaggaggcaagaagucccaguaaga

SEQ ID NO: 127519 - RNA, 39 nt, Homo sapiens
gguugggggguguagcaauuguuuucgugaccuugacuu

SEQ ID NO: 127520 - RNA, 44 nt, Homo sapiens
cccuuugggacuuugguccugaauaagguacuggcaguggaucu

SEQ ID NO: 127521 - RNA, 25 nt, Homo sapiens
uuuauaguuaaaauggguagacaau

SEQ ID NO: 127522 - RNA, 46 nt, Homo sapiens
acaacuccacccuccuuuuacagagcuuacacuuuguuagacuuca

SEQ ID NO: 127523 - RNA, 380 nt, Homo sapiens
guguaaguaccaugaaagauaccaaacguugccgggcacgggggcucacgccuguaaucccagcacuuugggaggccuaggcgggaggaucaccugaggucaggaguucaagaccagccuggccagcauggugaaaccacgucucuacuaaaaauacaaaaaauuagcugggcaugguggugggcgccuguaaugccggcuacucgggaggcugaggcaggagaaucgcuugaacccgggaggcagagguugcagugagccgagauggcgucauugcacuccagccugggcaacaagagugaaacuucgucucaauaaauaaguaaauacauaaauaaaaauaaaagauacgaaguguuuugaguccaaaggcaggagau

SEQ ID NO: 127524 - RNA, 85 nt, Homo sapiens
gguccuuuuugucuuucaggagcagaacuaagaaagggaggccuuauggaaagauguuuuuuaaaaaauuguuucauaccuugcg

SEQ ID NO: 127525 - RNA, 106 nt, Homo sapiens
agauguagauagguugaacuuaguaccugauggcgagaacauauugaauggaaggacaccagcuuuugugucagcugaaagguuccauggaagcugaguaagagcu

SEQ ID NO: 127526 - RNA, 32 nt, Homo sapiens
gugugugugcgagaugugugucuggggugggg

SEQ ID NO: 127527 - RNA, 88 nt, Homo sapiens
auagauggggaagugaggaaagagggaggcacuguggacaagguuggguuuuucagaagaaacuggguuagaaucaguguagucggaa

SEQ ID NO: 127528 - RNA, 103 nt, Homo sapiens
gagaccgcaggaaacuggagcuuguucuucauucucggguugggaguauugaggaauaaugucaucuguaguuaguuggcgguguggggaggcgugaagggga

SEQ ID NO: 127529 - RNA, 117 nt, Homo sapiens
gacucgugguguggcgugggauugguuggagcgaugcaugaguagaggacggggaggaagucugcacaccugggguguuggggcgggggaaccgcggagggcagacagggggagagg

SEQ ID NO: 127530 - RNA, 44 nt, Homo sapiens
ccggcucgucccggugcgaggagggagguuggggaagcgugaga

SEQ ID NO: 127531 - RNA, 40 nt, Homo sapiens
ggcgggggaguugcugcguccucuccucgccgggcagguc

SEQ ID NO: 127532 - RNA, 50 nt, Homo sapiens
gcgggaagacgcggcggcggcggcggaggaugagccugcagagcgcgcag

SEQ ID NO: 127533 - RNA, 74 nt, Homo sapiens
acagugcuacuuacugauggguagacugggagaggugguguaacuuaguucuugaugaucccacuuccuguuuc

SEQ ID NO: 127534 - RNA, 43 nt, Homo sapiens
uguaaauauacuuaguccuauuucuagaaugacacucuguuca

SEQ ID NO: 127535 - RNA, 61 nt, Homo sapiens
ccacacacccccuuccuccuaccaacccaccuuugagauucauauauagccuuuaacacua

SEQ ID NO: 127536 - RNA, 49 nt, Homo sapiens
cacucaccaauagaccaaaagacaucuuuugauauucuuauaaauggaa

SEQ ID NO: 127537 - RNA, 42 nt, Homo sapiens
ggcauaagcacaucgugugagcccauguaugcugggguagag

SEQ ID NO: 127538 - RNA, 46 nt, Homo sapiens
guuuuaucuaauaaagugucucuuccauucacguugcuaccuuacc

SEQ ID NO: 127539 - RNA, 42 nt, Homo sapiens
acuccucugcugcuguccaugacuguccuuuugaaccaggaa

SEQ ID NO: 127540 - RNA, 45 nt, Homo sapiens
gcaggaggcugccaucauggacuauaaccgagauaucgaggagau

SEQ ID NO: 127541 - RNA, 47 nt, Homo sapiens
ccugaauaagcuaaacgagauugaaggcacccuaaacaaagccaaag

SEQ ID NO: 127542 - RNA, 44 nt, Homo sapiens
cauuguacaacuaaacagugauuuuucuuaacucaucuugcugg

SEQ ID NO: 127543 - RNA, 46 nt, Homo sapiens
auauguugaagcaacugcaggaagcagaaaaagagcuaaagagaaa

SEQ ID NO: 127544 - RNA, 61 nt, Homo sapiens
auugaggaggggaacucaguaaaagggugcuuuacucuaaaauuucuacuaugucucagug

SEQ ID NO: 127545 - RNA, 46 nt, Homo sapiens
cggcggaugccacagaggccaagaacaaggcccaugaggcggagag

SEQ ID NO: 127546 - RNA, 48 nt, Homo sapiens
cacuaaggaagauuccugccaucaaccagaccaucacugaagccaaug

SEQ ID NO: 127547 - RNA, 54 nt, Homo sapiens
gaagggacgggauaccuuacaagaagcuaaugacauucucaacaaccugaaagg

SEQ ID NO: 127548 - RNA, 61 nt, Homo sapiens
ccgcagaccaacuccuagcccgagcugaugcugccaaggcccucgcugaagaagcugcaaa

SEQ ID NO: 127549 - RNA, 59 nt, Homo sapiens
cugagaaucuggaacaacugauugaccagaaauuaaaagauuaugaggaccucagagaa

SEQ ID NO: 127550 - RNA, 56 nt, Homo sapiens
agaucuaugccagcguggcucagcugagcccuuuggacucugagacacuggaggua

SEQ ID NO: 127551 - RNA, 73 nt, Homo sapiens
aucucacaggaucuggaaaaacaagcugcccgaguacaugaggaggccaaaagggccggugacaaagcugugg

SEQ ID NO: 127552 - RNA, 52 nt, Homo sapiens
ugaggacacuggcaggagaaaaucaaacagcauuugagauugaagagcuuaa

SEQ ID NO: 127553 - RNA, 49 nt, Homo sapiens
ucagccagaaucuacaggggacccaaacaacaugacucuuuuggcagaa

SEQ ID NO: 127554 - RNA, 54 nt, Homo sapiens
ggcugaacaagcgcgugcccauguagagaacacagagcgguugauugaaaucgc

SEQ ID NO: 127555 - RNA, 56 nt, Homo sapiens
agagugaauaacacucuguccagccaaauuagccguuuacagaauauccggaauac

SEQ ID NO: 127556 - RNA, 47 nt, Homo sapiens
gagauggugacagaucaagccuucgaggauagacuaaaggaagcaga

SEQ ID NO: 127557 - RNA, 47 nt, Homo sapiens
ugaaugcagagaaggcuuugugggaaaucgcugugaccagugugaag

SEQ ID NO: 127558 - RNA, 46 nt, Homo sapiens
ccucacgugacuggccaggacuguggugcuugugacccuggauucu

SEQ ID NO: 127559 - RNA, 46 nt, Homo sapiens
ucgaucccaaugcaguuggaaauugcaaucgcuugacgggagaaug

SEQ ID NO: 127560 - RNA, 47 nt, Homo sapiens
aaucuagcaccaaaaaugucuaaggccuuucuuucauaacaucagau

SEQ ID NO: 127561 - RNA, 46 nt, Homo sapiens
guuacagaagagaaacuccuaaucuuggaccauacaguccaugugu

SEQ ID NO: 127562 - RNA, 72 nt, Homo sapiens
gaguaaguaaaauaaagaauguucaguuaagaaguuuggcuauaaggaaaagacauggacuauaauuuggga

SEQ ID NO: 127563 - RNA, 269 nt, Homo sapiens
ggaaacaguuaaguccaugcucuaagacccaagggcaacauggcgaaaccacaucucuacuaaaaaguacaaaaauuagcacaguaugguggugcaugccuguagucccagcuucucuggaggcugaggugagaggaucacgugcacucaggaggucaaggcugcagugagugguaauugugccacuccacuccagccuggacaaugagugugacccugucugaaaaaaaaguaaaauaaauaaauaagagccaagggagaaaaagaau

SEQ ID NO: 127564 - RNA, 93 nt, Homo sapiens
aggcuccaugaagcaacagauuacccuuggaggccugcucuuaccccuuuugaauuucagaagcuccuaaacaacuugaccucuaucaagaua

SEQ ID NO: 127565 - RNA, 45 nt, Homo sapiens
aucuguacccuugaucgcucagggcaauuccuauccaagugagac

SEQ ID NO: 127566 - RNA, 44 nt, Homo sapiens
gcaaaguucuugggcaagcagguguugaguuauggucagaaccu

SEQ ID NO: 127567 - RNA, 72 nt, Homo sapiens
ucgagugguccucugagaggcaagauaucgccgugaucucagacagcuacuuuccucgguacuucauugcuc

SEQ ID NO: 127568 - RNA, 46 nt, Homo sapiens
cgcuguuggcuacaguguuuauucuaucuccucuaccuuucagauu

SEQ ID NO: 127569 - RNA, 47 nt, Homo sapiens
gcucuugugaucccucuggcagcauagaugaauguaauauugaaaca

SEQ ID NO: 127570 - RNA, 46 nt, Homo sapiens
aaaacaaagggcugacuugaagaguggaaguuuucucccuucucug

SEQ ID NO: 127571 - RNA, 78 nt, Homo sapiens
cacacagugugauaguuacggcagaugcagcuguaagccaggagugaugggggacaaaugugaccguugccagccugg

SEQ ID NO: 127572 - RNA, 61 nt, Homo sapiens
gugguggccugaguaaugguucugcaaauaauuagcagcaggaucauagagacaauuugaa

SEQ ID NO: 127573 - RNA, 46 nt, Homo sapiens
ggaagauggauugaaagacaaaaugauaguuccguggacccccgga

SEQ ID NO: 127574 - RNA, 58 nt, Homo sapiens
gccuuggcaacaaugaagccugcucuucaugccacuguaguccuguggguaagugaca

SEQ ID NO: 127575 - RNA, 44 nt, Homo sapiens
uaaaauggcacuuuguuuuuggaguugauacuagaauaaaggcu

SEQ ID NO: 127576 - RNA, 46 nt, Homo sapiens
auggaguagacugugaaaagugucuuccuuucuucaaugaccggcc

SEQ ID NO: 127577 - RNA, 23 nt, Homo sapiens
uaccugguuaaucccuaccccug

SEQ ID NO: 127578 - RNA, 42 nt, Homo sapiens
guccuauuauuaugccaucucugauuuugcuguagguggcag

SEQ ID NO: 127579 - RNA, 44 nt, Homo sapiens
ccaaugugugaaugaauggugauuuuauauuuuacccaugugaa

SEQ ID NO: 127580 - RNA, 46 nt, Homo sapiens
cauuuauguuccccagcagucagugcuugaauccaauucuaagaca

SEQ ID NO: 127581 - RNA, 74 nt, Homo sapiens
aacuccucuuuagucauggggagcuccuaagggaauuucuucuagguagguguuggauaccaagucucuggcau

SEQ ID NO: 127582 - RNA, 52 nt, Homo sapiens
auuguccagacuuauggaugccuugugauaacaugccugaggaguguguauu

SEQ ID NO: 127583 - RNA, 87 nt, Homo sapiens
gauggauagggcuuggaaggggugaagacuagagaauggcuuaaaggugagacguggcauauggauaauagggauggcaagacugga

SEQ ID NO: 127584 - RNA, 49 nt, Homo sapiens
auuuguaucuuaucucaucugucauauggaauuccuuuagggcagggac

SEQ ID NO: 127585 - RNA, 46 nt, Homo sapiens
gccaaguaguggugggaguucaguuuaguuccacuguuuuguaaau

SEQ ID NO: 127586 - RNA, 41 nt, Homo sapiens
aggggagcccuugaagggcacuaaguauaagcagacaauaa

SEQ ID NO: 127587 - RNA, 30 nt, Homo sapiens
ucaaccauuauaguuugaugccaguguuuu

SEQ ID NO: 127588 - RNA, 32 nt, Homo sapiens
auuuaaauuaguuugauuaucacaagucaguu

SEQ ID NO: 127589 - RNA, 32 nt, Homo sapiens
agugaacauuguuuuggagcaagauacuaggc

SEQ ID NO: 127590 - RNA, 46 nt, Homo sapiens
gggauuuguugugggagagaaagguaaguuaaacagaaagccugaa

SEQ ID NO: 127591 - RNA, 92 nt, Homo sapiens
aucguaauugauacggaucccuccauugccuuuggauaauguuuaccucgcacguaguucauucuguguuaugauaauuuacuuugaaugac

SEQ ID NO: 127592 - RNA, 43 nt, Homo sapiens
gcaauuaaauucucacuguacgucauugggacauggcagagaa

SEQ ID NO: 127593 - RNA, 42 nt, Homo sapiens
gagggcugccguaaccuacuuggccuacuggacaacgacgag

SEQ ID NO: 127594 - RNA, 45 nt, Homo sapiens
gguucuuuggacuucuuaauucucagaauccuuuucuaggaccac

SEQ ID NO: 127595 - RNA, 45 nt, Homo sapiens
cauugguaccacauacagugauuacauuauaaaaggccucuagau

SEQ ID NO: 127596 - RNA, 37 nt, Homo sapiens
aagcuuaaugcaaauaaaucccacuuuagaucuuaca

SEQ ID NO: 127597 - RNA, 35 nt, Homo sapiens
uuuuuuguuuuaaauguauauggccaguugauuag

SEQ ID NO: 127598 - RNA, 47 nt, Homo sapiens
aaaccuggcuauguuaaagccauuucauuugagauacauuuugaauu

SEQ ID NO: 127599 - RNA, 47 nt, Homo sapiens
cuuaugugccugguugaggcugggugauaggccccugugcuuuccaa

SEQ ID NO: 127600 - RNA, 60 nt, Homo sapiens
auggacacagaaugcagaugagugcaagaaacagcaauuuuguuuagguuuucccaugau

SEQ ID NO: 127601 - RNA, 39 nt, Homo sapiens
acggcauaauaccuuuuauaugguaguagggguucaaaa

SEQ ID NO: 127602 - RNA, 47 nt, Homo sapiens
aauuccucuguucccuccagagcacuugccuuuaugucauuugaugu

SEQ ID NO: 127603 - RNA, 50 nt, Homo sapiens
uuuuuaaaaaucaggguauuaaaucuucguaaaauagaaguggagggaaa

SEQ ID NO: 127604 - RNA, 41 nt, Homo sapiens
cagugucuuggauuaacuuucggagcaguccauacauaguu

SEQ ID NO: 127605 - RNA, 24 nt, Homo sapiens
gaaucccaauuagaggcaggaauc

SEQ ID NO: 127606 - RNA, 46 nt, Homo sapiens
ccuggucugucuucacauucuaguucuuuccuucucugcuccaagu

SEQ ID NO: 127607 - RNA, 46 nt, Homo sapiens
agcccggaaaagcuucccggaucuugaagaaaaguaauagacauga

SEQ ID NO: 127608 - RNA, 42 nt, Homo sapiens
auacacagucauccagggugcagggugcagugcauccucgga

SEQ ID NO: 127609 - RNA, 50 nt, Homo sapiens
augacaagugaguuucuuuaucacuagcugcuaagcuccaugcccuagag

SEQ ID NO: 127610 - RNA, 50 nt, Homo sapiens
agaaaugacauccuggaagaaaucaugcauaguggaggaggugggaaggg

SEQ ID NO: 127611 - RNA, 41 nt, Homo sapiens
auauguacuuuaaacuucuaguuuaaacuaacuugacuagg

SEQ ID NO: 127612 - RNA, 103 nt, Homo sapiens
uauguuaacuuugggucaugguugauuaaaaggucaaaagagaucuuagaguuuaccucuaacaucacuuuuuacuaugaaauguuuuaugcuuggacuuggu

SEQ ID NO: 127613 - RNA, 57 nt, Homo sapiens
uguuuaacuuuugacuuguuaaaguuucuguguucaaguuugaauacucuugaaguc

SEQ ID NO: 127614 - RNA, 78 nt, Homo sapiens
ugcaggcugcucccgggguaggugagggaagcgcggaggcggcgcgcgggggcaguggucggcgagcagcgcgguccu

SEQ ID NO: 127615 - RNA, 42 nt, Homo sapiens
augcagaacuuucucuuuugaauguuaagaauaacuaauaca

SEQ ID NO: 127616 - RNA, 45 nt, Homo sapiens
agggauucuggucacuggggucacacuugagcaugauuuucaacc

SEQ ID NO: 127617 - RNA, 45 nt, Homo sapiens
ugaaaaucaugcucaagugugaccccagugaccagaaucccugau

SEQ ID NO: 127618 - RNA, 45 nt, Homo sapiens
cgguggucaucucagagcccagccccacaagcacgagguucccac

SEQ ID NO: 127619 - RNA, 46 nt, Homo sapiens
uggggugcaagccggaagucaccaucgagugcacgggggcagaggc

SEQ ID NO: 127620 - RNA, 45 nt, Homo sapiens
auucaucauuuucucggggagcaccaggcucgauggcaacacgau

SEQ ID NO: 127621 - RNA, 46 nt, Homo sapiens
ugaggagaaccuggaauucugguuggccugugaggaguucaagaag

SEQ ID NO: 127622 - RNA, 47 nt, Homo sapiens
cauucuaaccagggccucccuccacagggcauuuguuuccuuaguag

SEQ ID NO: 127623 - RNA, 57 nt, Homo sapiens
aggcuccgcgugcgccaggaagcaaaggcgcgguagcaggugcuagucaacugcggu

SEQ ID NO: 127624 - RNA, 42 nt, Homo sapiens
ggugcggcacauggcugcgggcgcagggcagcacguaguagg

SEQ ID NO: 127625 - RNA, 39 nt, Homo sapiens
cugcgauacugggaguacuggcaaguucgaguggggcag

SEQ ID NO: 127626 - RNA, 49 nt, Homo sapiens
guucagugaggagaaccuggaguucuggcuggccugugaggaguucaag

SEQ ID NO: 127627 - RNA, 58 nt, Homo sapiens
accaagcuggccuccagggcacaccagaucuuugaggaguucauuugcagugaggccc

SEQ ID NO: 127628 - RNA, 65 nt, Homo sapiens
cuagacaaauauaugccaggugaugagcuaugcacucauaaaaauacagcaggaaaugagagaca

SEQ ID NO: 127629 - RNA, 40 nt, Homo sapiens
cugcgggaaggaggacacacacagggugaguuggggaaga

SEQ ID NO: 127630 - RNA, 47 nt, Homo sapiens
gcaggucaacauugaccaugagacccacgagcugacgaggaugaacc

SEQ ID NO: 127631 - RNA, 42 nt, Homo sapiens
gucgccugcuuaccgggaccuggcugcccaagccucagccgc

SEQ ID NO: 127632 - RNA, 52 nt, Homo sapiens
agaggacaaaaaaaaaaaaaaaaaaaaaaaaaaugcgcuccagcagccuguu

SEQ ID NO: 127633 - RNA, 45 nt, Homo sapiens
acagagagccccaccaacccucaucauuagcccuuauucacaggu

SEQ ID NO: 127634 - RNA, 40 nt, Homo sapiens
gcgagauauuuauaccucaaacacuggccugugagcccuu

SEQ ID NO: 127635 - RNA, 50 nt, Homo sapiens
guguggaggccucggggaguggcuuuuccagcucucaugccccgcagugu

SEQ ID NO: 127636 - RNA, 45 nt, Homo sapiens
acugaacaaacauuuccugauggcaacuccugcggcagagcccag

SEQ ID NO: 127637 - RNA, 52 nt, Homo sapiens
uguuauuguuggugcuguuguuauuuauuauuguaauuucaguuugccucua

SEQ ID NO: 127638 - RNA, 26 nt, Homo sapiens
uucucucuaccuuacagcuuccauuu

SEQ ID NO: 127639 - RNA, 43 nt, Homo sapiens
gacaacaucaucaauuauuguuggcauucugcagaauuguuuu

SEQ ID NO: 127640 - RNA, 43 nt, Homo sapiens
uuucauggaauccaguuagacgucgggcauuguccaggccucc

SEQ ID NO: 127641 - RNA, 41 nt, Homo sapiens
auauuccacccuuugaguuacaaucgggacaacugggagag

SEQ ID NO: 127642 - RNA, 53 nt, Homo sapiens
acaucaagauacaaaauuacaaguguuuugacuccagcccuguccccaucucc

SEQ ID NO: 127643 - RNA, 46 nt, Homo sapiens
guugugaagauuaauuucuugccauuuucuggauuagcacagaagc

SEQ ID NO: 127644 - RNA, 53 nt, Homo sapiens
cuacaaacucucaacuuucugcauuguauuuuaagucuauacaauguuagagc

SEQ ID NO: 127645 - RNA, 115 nt, Homo sapiens
guaguauugagucaugcagguaucagauuaacagacauucauugaagauaagugaaauaacuuuggagauagcagagaagagcaagaagauguuggacguuggcaguaagccgca

SEQ ID NO: 127646 - RNA, 103 nt, Homo sapiens
uccaccaugcuuugaccaaaguacauucacaguaacuagagaaagcagaucauccauuucuggauaggugaacuacggcaagguaagaacagaaaaaaguaaa

SEQ ID NO: 127647 - RNA, 46 nt, Homo sapiens
ucuauugcuuuuuuguguuuuguuaagcaugucccuuggcccaaau

SEQ ID NO: 127648 - RNA, 37 nt, Homo sapiens
aucgagguuuuuuuguuuuguuuuguuuucugaaaaa

SEQ ID NO: 127649 - RNA, 43 nt, Homo sapiens
caaggaaucccacacuucacaccaccggcugaauuucauggaa

SEQ ID NO: 127650 - RNA, 68 nt, Homo sapiens
auauaacuccugugcaaugaaggugauaacaguaaaagaaggcaggggaaacuuacguuggaugacau

SEQ ID NO: 127651 - RNA, 42 nt, Homo sapiens
accuuguuuugaagguugauggucauuauuaugaauaucagu

SEQ ID NO: 127652 - RNA, 46 nt, Homo sapiens
ugaaagaagagaaauugcauacaacugggaaucuuaguuauagaag

SEQ ID NO: 127653 - RNA, 102 nt, Homo sapiens
gauaaauuuccugaguuuguguaagcugaucuauuuagggaugaaguguuaugaugcguauaaguaauucuuaaggaauucagugaaaauaaauuuagaaaa

SEQ ID NO: 127654 - RNA, 50 nt, Homo sapiens
auugaguucuguuugacagcaaaucagggaaaucgagaaacacugguugg

SEQ ID NO: 127655 - RNA, 49 nt, Homo sapiens
uagucuguagaucauauauccucaauaggggugaaauuuuguuugagga

SEQ ID NO: 127656 - RNA, 63 nt, Homo sapiens
gucuuucaaaauuuaauagcuaugcauuguaucuguguuuuuaaaauuucacggggaggacga

SEQ ID NO: 127657 - RNA, 81 nt, Homo sapiens
ugcaaaaagacagagcuucucuauccauagcuuauuaucucuauauucagagacccuugaaaugugcauacaguuuuuuua

SEQ ID NO: 127658 - RNA, 41 nt, Homo sapiens
aagaaaaaugcuguuuguguuauuugcauaaugacaggcca

SEQ ID NO: 127659 - RNA, 31 nt, Homo sapiens
uauuuuuuauuuacauuuuaguuuuuaguuu

SEQ ID NO: 127660 - RNA, 50 nt, Homo sapiens
ucaugccugacguacucuagaaacugcaauaaggacugaauguauaugag

SEQ ID NO: 127661 - RNA, 66 nt, Homo sapiens
aaaguuagauagagacauuuuaaaguuuauuucuuuccccaucgcccuccccuccacuccugccaa

SEQ ID NO: 127662 - RNA, 68 nt, Homo sapiens
gguuuuuguuugaucauuuuuaugcuuaaauaaaaucuggaauuuaaaauuuuauuaccuuacaccua

SEQ ID NO: 127663 - RNA, 46 nt, Homo sapiens
uuaaauaucugauuuagggguaacuugaaguaauuuuuggaaauag

SEQ ID NO: 127664 - RNA, 44 nt, Homo sapiens
uaggucaauauuuuaaguccccacaucacaacaucuuguaucua

SEQ ID NO: 127665 - RNA, 44 nt, Homo sapiens
uggugggccaguuauuaguucucuauaucaugaagaaaccauca

SEQ ID NO: 127666 - RNA, 46 nt, Homo sapiens
ccuuccuccucucuaccucccuuucuuaugaaaaugauuccaguug

SEQ ID NO: 127667 - RNA, 52 nt, Homo sapiens
ggaaagcggaucugugcuuuuucugauacggcaacugauuuuccagagauuu

SEQ ID NO: 127668 - RNA, 64 nt, Homo sapiens
ggaaaacaacauugaccauauaaccaaagccaucaaaucgaaaaauguggaugugaaugugaaa

SEQ ID NO: 127669 - RNA, 43 nt, Homo sapiens
uaaaauauuacuggaagucaaauccacaugugaccuccacaaa

SEQ ID NO: 127670 - RNA, 42 nt, Homo sapiens
ccuuuacccucagccugccagaacguuguauuucaugaacag

SEQ ID NO: 127671 - RNA, 44 nt, Homo sapiens
gaagauauagcuuuaaugcacaccuaagucaugguuuuccuucu

SEQ ID NO: 127672 - RNA, 58 nt, Homo sapiens
ugggccugugaucgaggacauaaggaacuagucacaguguugcugcaacauagagcug

SEQ ID NO: 127673 - RNA, 45 nt, Homo sapiens; identical to SEQ ID NO: 26349

SEQ ID NO: 127674 - RNA, 36 nt, Homo sapiens
ugucuugaugugugcuggugauagaauguguuugug

SEQ ID NO: 127675 - RNA, 47 nt, Homo sapiens
cacaaugugucuaauaugguccucaucagcacuuuuucccuacucug

SEQ ID NO: 127676 - RNA, 35 nt, Homo sapiens
gaacacaaacauaauacaguuaaaagaugaaggag

SEQ ID NO: 127677 - RNA, 40 nt, Homo sapiens
gcaagcuucuaaauugucagauuaaucaucuauuauagag

SEQ ID NO: 127678 - RNA, 25 nt, Homo sapiens
guagaauccugaaauugcaguagau

SEQ ID NO: 127679 - RNA, 46 nt, Homo sapiens
ggucaguacuguucuuuugaaauugcccuuagcuuucccaaucaag

SEQ ID NO: 127680 - RNA, 91 nt, Homo sapiens
cuugcacgugcagucaugugauuucagagugggcaggcuuuguauccucaugagcccucagucuuccacgcaaagcaccaucuguucuguu

SEQ ID NO: 127681 - RNA, 91 nt, Homo sapiens
accuccacacuguuacagggcagugggaggaggcauuagagugaaaauaaauaaaauaaaaaaaaaaagaaauucauuaucaaaacccuga

SEQ ID NO: 127682 - RNA, 62 nt, Homo sapiens
uguuuugaaagggugggcagaguacacauuucugaaagaugacucuacauuaugacuugugu

SEQ ID NO: 127683 - RNA, 38 nt, Homo sapiens
aauucuugccugccucuauguuuucuccuauucuccau

SEQ ID NO: 127684 - RNA, 44 nt, Homo sapiens
agagcugcugcuccagucuggugcugaccccacucuccgagacc

SEQ ID NO: 127685 - RNA, 82 nt, Homo sapiens
uuuguccuuuuuuauuuuggucuccaagaugaaugcucaucuuuggagggugccagguagaagcuagggaggggagugucuu

SEQ ID NO: 127686 - RNA, 31 nt, Homo sapiens
auuugaaguccugccucauucucacuggagc

SEQ ID NO: 127687 - RNA, 46 nt, Homo sapiens
ccugaccccauucccuccccucccaccccuugcuccuugucuggcc

SEQ ID NO: 127688 - RNA, 46 nt, Homo sapiens
gaggucaggcgcgugggccgcagcuccaagcagcuggucgacaucc

SEQ ID NO: 127689 - RNA, 52 nt, Homo sapiens
ccaggccaggagccuccugagcacauggcagagcuucagaggaaugagcagg

SEQ ID NO: 127690 - RNA, 47 nt, Homo sapiens
ccacaugugccggcugagggaccugaggcaagucgacccccgaagcu

SEQ ID NO: 127691 - RNA, 48 nt, Homo sapiens
ggucagcugcccggagggaugugcagaauguggcagccgccccagagc

SEQ ID NO: 127692 - RNA, 41 nt, Homo sapiens
agauggcugcugccuccaugcaccggguggggagucccaac

SEQ ID NO: 127693 - RNA, 46 nt, Homo sapiens
gggcuggugcguggcaucuccucugcccuguagccaaggccaagga

SEQ ID NO: 127694 - RNA, 44 nt, Homo sapiens
gguggaagcaagucggacaggcagcaugagugggcaggggagga

SEQ ID NO: 127695 - RNA, 40 nt, Homo sapiens
agcgagcuuggaggcaagcaccagcagcccuggagccuga

SEQ ID NO: 127696 - RNA, 44 nt, Homo sapiens
gaacuuccugcacuccgugaaugaauggcucaagaggcagaaga

SEQ ID NO: 127697 - RNA, 43 nt, Homo sapiens
agcccuggcaaggggcacaagugcuccagccuuccucccagug

SEQ ID NO: 127698 - RNA, 46 nt, Homo sapiens
cagcgccugguggcccugaaaaaguuuguggcagugcuggccaagg

SEQ ID NO: 127699 - RNA, 46 nt, Homo sapiens
gcagagacucucugggcucaccagggaggcugcccagaccacaguu

SEQ ID NO: 127700 - RNA, 32 nt, Homo sapiens
acccgguggccuggcccccagauguucugcug

SEQ ID NO: 127701 - RNA, 47 nt, Homo sapiens
ucuuggcugccugggucuuuuagccuggcauuggccugaccccugcu

SEQ ID NO: 127702 - RNA, 45 nt, Homo sapiens
aggcuggaggagauugauggauucuuugcgagaaauaacgaagag

SEQ ID NO: 127703 - RNA, 48 nt, Homo sapiens
gcaaaucauuuggacaaagucauuggcuuuggcaagggagaaaugaua

SEQ ID NO: 127704 - RNA, 46 nt, Homo sapiens
agauuugaggaggagcaaaauguucagaccagaacugugccuuaga

SEQ ID NO: 127705 - RNA, 49 nt, Homo sapiens
uggcgggaguggagggcaaugugaggugaguuuggguuuggagccugga

SEQ ID NO: 127706 - RNA, 66 nt, Homo sapiens
gggguuuggcugggagagaggaggaaugugggcgggccuuauaggcaggcgagaaggugagagcca

SEQ ID NO: 127707 - RNA, 45 nt, Homo sapiens
gcagucugcagagacuucaacaucccuggcuucccgacugugagg

SEQ ID NO: 127708 - RNA, 43 nt, Homo sapiens
ugcugccucugaauggaguuacuuccugacucuggugcuaggu

SEQ ID NO: 127709 - RNA, 45 nt, Homo sapiens
uucuucgccuccuggugcggccacugcaucgccuucgccccgacg

SEQ ID NO: 127710 - RNA, 23 nt, Homo sapiens
gcugacgcugcugcaggcggaca

SEQ ID NO: 127711 - RNA, 42 nt, Homo sapiens
cuccucgcaccggcuccggggauccgccgguccgcugggaag

SEQ ID NO: 127712 - RNA, 41 nt, Homo sapiens
gucaggggcggcccagucgccauuacagcccaacaacugac

SEQ ID NO: 127713 - RNA, 42 nt, Homo sapiens
guuuuccaacuugaaagaacagaagucaagagaacuaaucaa

SEQ ID NO: 127714 - RNA, 26 nt, Homo sapiens
uugcugcacaggccgccgacgccgcc

SEQ ID NO: 127715 - RNA, 44 nt, Homo sapiens
cugucacuuuggcgacgcgcagcugggacagcuccaccuucagg

SEQ ID NO: 127716 - RNA, 41 nt, Homo sapiens
augcuuucaagauaagaaagaacaaaacccaggaccugauu

SEQ ID NO: 127717 - RNA, 41 nt, Homo sapiens
aauuuuuuguugauuaaauuucucauuuuaaauacaaggaa

SEQ ID NO: 127718 - RNA, 50 nt, Homo sapiens
aaaaaaaaaaccccaaaagaaauaucuaaugccuacuguguauuuaagac

SEQ ID NO: 127719 - RNA, 49 nt, Homo sapiens
uaaacaccgugcuuuugaggugauuuggaagaaacgcgagccacgagcg

SEQ ID NO: 127720 - RNA, 40 nt, Homo sapiens
aagaaagagaaauacaccuuagaaaaacaaaacccaagau

SEQ ID NO: 127721 - RNA, 44 nt, Homo sapiens
uuuucugaauguuaauccauuuuaucgagcagugauucccaaac

SEQ ID NO: 127722 - RNA, 28 nt, Homo sapiens
uacauagauacauaaaaaggcagucucu

SEQ ID NO: 127723 - RNA, 28 nt, Homo sapiens
uguugggauguucccaaaagaguggggu

SEQ ID NO: 127724 - RNA, 45 nt, Homo sapiens
uucuaaaccuugagucugugggaccauggugugagucugggccuc

SEQ ID NO: 127725 - RNA, 34 nt, Homo sapiens
cgauuuguaagggaguaagcagauaggagacgag

SEQ ID NO: 127726 - RNA, 37 nt, Homo sapiens
ugauaaaucaauuaaaaagaagugcugagaauugaag

SEQ ID NO: 127727 - RNA, 198 nt, Homo sapiens
ucaugcacaagaccccauagccucucucucuuuuuuuuuuuuuuuuuuaaauguuuuugguuuuuuuagggcuagucaagugaaaaagugggaguggagaaggaacaaauaaaucuguaacugguugugaucaauuaguuguaaacaccacugcacucgaaccagccuccauugccucuugccuacauaaagguacag

SEQ ID NO: 127728 - RNA, 46 nt, Homo sapiens
guaagugagccacuauguuggugagcauuuauagaaaugcucuuuu

SEQ ID NO: 127729 - RNA, 93 nt, Homo sapiens
cuucaucagcuucaggccaaguucgaagucacuauguagacuggagaauguggcgcgaugugaagagacgaaaaauggccuaugaauacgcag

SEQ ID NO: 127730 - RNA, 45 nt, Homo sapiens
guauguagcugcacuauuuauauucgcccaaaucguaagaugacc

SEQ ID NO: 127731 - RNA, 43 nt, Homo sapiens
uucauugcaugaguaccauaauucauuuauccauccuacauuu

SEQ ID NO: 127732 - RNA, 74 nt, Homo sapiens
aaccuauugagcuugcagggaagccaagcuugcaguuccagcaagcaaagauuuuuuuuaauagaccaaacccu

SEQ ID NO: 127733 - RNA, 71 nt, Homo sapiens
uuggguguuucaugucagugaauuaucuuuucucuuggacuuaacaaacauacuguucccauacauaguac

SEQ ID NO: 127734 - RNA, 28 nt, Homo sapiens
uagcuaucugucaaauuuauauaugcag

SEQ ID NO: 127735 - RNA, 48 nt, Homo sapiens
cauucaucaaucccucacuaggaucuguuucagugucauaggagggcu

SEQ ID NO: 127736 - RNA, 46 nt, Homo sapiens
ucacaaucauggaguaacucuucccauuuagauucuuuaccaaaag

SEQ ID NO: 127737 - RNA, 46 nt, Homo sapiens
gugaaaugcaccugcacauucucagugggaacuugaugaacuccag

SEQ ID NO: 127738 - RNA, 46 nt, Homo sapiens
cauaauuacugauuuucaccguauagcccguuguaaugggagcaac

SEQ ID NO: 127739 - RNA, 31 nt, Homo sapiens
gacugugaaguuaucuccuaggggcacauag

SEQ ID NO: 127740 - RNA, 44 nt, Homo sapiens
cauaguuuuucuucauuuaaagaaaagauuuugaguuuaaaaaa

SEQ ID NO: 127741 - RNA, 42 nt, Homo sapiens
ccuuccggcgguccaagacccugcgacuccagagacagccca

SEQ ID NO: 127742 - RNA, 49 nt, Homo sapiens
gauguggccaagggcaacacccugauucggccugauggagagaagaagg

SEQ ID NO: 127743 - RNA, 46 nt, Homo sapiens
gccugaggaagaggaaggggacgaggacaacgagcgacugggcggc

SEQ ID NO: 127744 - RNA, 41 nt, Homo sapiens
gagcaacaagauggccccugcugcaggagcagccucagcag

SEQ ID NO: 127745 - RNA, 44 nt, Homo sapiens
aaacuuaauuuuucaaggcuucuaccacauuuucuuacaaguga

SEQ ID NO: 127746 - RNA, 46 nt, Homo sapiens
uuuucucgucccacagcagauuaaaaggugcaaauuagauguugga

SEQ ID NO: 127747 - RNA, 36 nt, Homo sapiens
aaguaauucuucauaugccauucucauuuucuuccc

SEQ ID NO: 127748 - RNA, 46 nt, Homo sapiens
guugguaguugaaaacauaaaaacagaugaaauuacucagggaaac

SEQ ID NO: 127749 - RNA, 48 nt, Homo sapiens
agcuauuuaauagggcuauugcugugcucauagaacagauucgaauag

SEQ ID NO: 127750 - RNA, 16 nt, Homo sapiens
cauaccuuuuucugag

SEQ ID NO: 127751 - RNA, 41 nt, Homo sapiens
uuccaguggaaucuuugcuuuagauuuguguguguguuugu

SEQ ID NO: 127752 - RNA, 45 nt, Homo sapiens
ugccugaauaaacuccaccgcaaggcuugcccauuugaccagacc

SEQ ID NO: 127753 - RNA, 40 nt, Homo sapiens
acacgaaguugaauaccuugagucccuguccuguagcacc

SEQ ID NO: 127754 - RNA, 47 nt, Homo sapiens
cuauuacuuuguguagugggguugaagacacaaagcauuaugaggaa

SEQ ID NO: 127755 - RNA, 43 nt, Homo sapiens
auagugcagauugcuauggaagcaggcuuacgaauugcaccgg

SEQ ID NO: 127756 - RNA, 43 nt, Homo sapiens
uuuagaaccuaugaagcucugcggcgagaacaugacucccaga

SEQ ID NO: 127757 - RNA, 42 nt, Homo sapiens
gaugcuccuccuccuacuugggaacagcuggaaaaugggcug

SEQ ID NO: 127758 - RNA, 46 nt, Homo sapiens
auccagaaccacagcaaaaaaggagcagaucagcagcagguaagga

SEQ ID NO: 127759 - RNA, 46 nt, Homo sapiens
uuuuagccuccacagcauagcaaauacaaaacauacaugugucgag

SEQ ID NO: 127760 - RNA, 40 nt, Homo sapiens
guguuucaguauuuuaaaagguaaaaucuuacauagaaaa

SEQ ID NO: 127761 - RNA, 45 nt, Homo sapiens
uccgaccuccaccaucugcuccugaaccugcuccucccuacuugg

SEQ ID NO: 127762 - RNA, 56 nt, Homo sapiens
ucgagaguuacuauccaguggcuccucauccaacucagaucagaccuucguaccuc

SEQ ID NO: 127763 - RNA, 49 nt, Homo sapiens
uuccuccuccuccccagccucauccuagucuagaugaacuacaucgccg

SEQ ID NO: 127764 - RNA, 238 nt, Homo sapiens
aaccucaguucugauuauaaacaaccugaauacaaaaauuagccgggcaugauggugggcgccuguaaucccagcuacucgggagacugaggcaggagaauugcuugaacccagcaggcggagguugcagugagccgagaucgcaccacugcacuccagccuggaugacagaacaagacucguucucaacaaaaauuuaaaaauaaauaaauaaaacaaccuguguauaguuguacua

SEQ ID NO: 127765 - RNA, 46 nt, Homo sapiens
agacuugaagguagcugggaaauacaaaggaaaugauuauagccaa

SEQ ID NO: 127766 - RNA, 46 nt, Homo sapiens
gcuacgacuagaauugcagcaauugaaccaucagauuagccagcag

SEQ ID NO: 127767 - RNA, 44 nt, Homo sapiens
ggaugaucucaagugagcaguugagcuuggaacugcaccaggug

SEQ ID NO: 127768 - RNA, 72 nt, Homo sapiens
ggugaaaugaaaucuuucauguggcucuagaauuaucuagaggcacagaaucaucacuucaaggcacucuga

SEQ ID NO: 127769 - RNA, 49 nt, Homo sapiens
gguaaagaaaaggagauugucguagccauauuaaauuacacacaaaaga

SEQ ID NO: 127770 - RNA, 33 nt, Homo sapiens
uuacaaaacuuagauccaagguugaauuaucug

SEQ ID NO: 127771 - RNA, 41 nt, Homo sapiens
auguaaaaaaaaagaaaaaacaaaaaauaaagucacucccc

SEQ ID NO: 127772 - RNA, 33 nt, Homo sapiens
cccugaugauauauaacaaaaauuucuaaugcu

SEQ ID NO: 127773 - RNA, 55 nt, Homo sapiens
accaaauggaucagccuugacacaagagaauaucagccuccuaucaaacaagacc

SEQ ID NO: 127774 - RNA, 50 nt, Homo sapiens
acgcauaacuucuaaacuuuuucucuuaagagcggucagagaaauccagg

SEQ ID NO: 127775 - RNA, 40 nt, Homo sapiens
acugcaacauuugauuugaacuuaaaaugaauagagccac

SEQ ID NO: 127776 - RNA, 52 nt, Homo sapiens
gacuuaacuguccaauguugcaaauguuucuucaugaaaauauugaaaagag

SEQ ID NO: 127777 - RNA, 85 nt, Homo sapiens
accccagcuucugcuaucacuguggucaagucaugggucugaguaaaagaauucuugaguaugugacuggugagaaauaacuaac

SEQ ID NO: 127778 - RNA, 48 nt, Homo sapiens
ggugguggguagcagucucaccauuuuucuacucucuuuuugcucguu

SEQ ID NO: 127779 - RNA, 62 nt, Homo sapiens
aaaaagcaccuguaacgauuuauaugucauugaaaggaauggcccaguuacuuuuuaggaga

SEQ ID NO: 127780 - RNA, 113 nt, Homo sapiens
gguuacaguguugcaaggugaucucuuccccugaaaaaucugccuauccuuuuaagaaaaauuagaccuacuaaacuaaagcaaauuuuacuuucaucauuagcaccuaaaca

SEQ ID NO: 127781 - RNA, 48 nt, Homo sapiens
ggucccccaccccagugaguguaugaaagagucaagaaaaagauugga

SEQ ID NO: 127782 - RNA, 46 nt, Homo sapiens
uuuuggauagaauuuauacuccugcucuuauaaaucagugguagac

SEQ ID NO: 127783 - RNA, 47 nt, Homo sapiens
aucuguuuaauauuucugauuuuuaagcagcuuucaaaacaagugug

SEQ ID NO: 127784 - RNA, 47 nt, Homo sapiens
ugcuuuauaguuuuucaaaguacuuuuauucacuuuaucuuccauau

SEQ ID NO: 127785 - RNA, 44 nt, Homo sapiens
guagaacuggauguugauauagaagcuuugaacuuccgggaaga

SEQ ID NO: 127786 - RNA, 41 nt, Homo sapiens
aaguugguaaaucaacuagcuuccaauauguucaguuccua

SEQ ID NO: 127787 - RNA, 47 nt, Homo sapiens
gugauaaauacccuaaacugccuuuuuuucuuuuuugaggugggggg

SEQ ID NO: 127788 - RNA, 50 nt, Homo sapiens
uggaggcucaaggauagaugagcucugaguuucucaguacucccucaaga

SEQ ID NO: 127789 - RNA, 42 nt, Homo sapiens
acuguuuccauggggcucugggccuucaucacagcuggaggg

SEQ ID NO: 127790 - RNA, 46 nt, Homo sapiens
ucaucuugguccaugugaccgaccggucagaugcccggcuccagua

SEQ ID NO: 127791 - RNA, 48 nt, Homo sapiens
gccccuugaaaagagguccagaugagagcagagauacagugagaaauu

SEQ ID NO: 127792 - RNA, 59 nt, Homo sapiens
uuuugucuuuaaaaaauaauuggcagcaacuguauuugaauaaaaugauuucuuaguau

SEQ ID NO: 127793 - RNA, 40 nt, Homo sapiens
gugaguuugucaagcuuaaucuaauugguuaagucuaaag

SEQ ID NO: 127794 - RNA, 46 nt, Homo sapiens
uauuugauuucuuuuauaacuuuguuagguuuuugaagcugcaaac

SEQ ID NO: 127795 - RNA, 58 nt, Homo sapiens
cuucccauauuuaugugccuuuugucuauuuauaaugccacuggaagaggagggauaa

SEQ ID NO: 127796 - RNA, 51 nt, Homo sapiens
cuuuuuuguuguuguucuuugaagaacagucuguaguauuugaaggguuug

SEQ ID NO: 127797 - RNA, 45 nt, Homo sapiens
ucauugccgagccugcaugacauaaucaaaggaaacaaagagauc

SEQ ID NO: 127798 - RNA, 46 nt, Homo sapiens
uagccaauggcgacauaaaaggaagaaagcccuuuacgaaccagag

SEQ ID NO: 127799 - RNA, 32 nt, Homo sapiens
gaacauaacaauguauguguucugugcuguuu

SEQ ID NO: 127800 - RNA, 46 nt, Homo sapiens
agaauaagccuuguaugagaucuaguaagucgucuccugcugcacu

SEQ ID NO: 127801 - RNA, 45 nt, Homo sapiens
cagaggguagggaggggggcuuaguuuaauuagcaguugguagcu

SEQ ID NO: 127802 - RNA, 65 nt, Homo sapiens
auaugaauuugaaaagaagaacuucauucccacucaugagauccaagucucuacaguuaacuggc

SEQ ID NO: 127803 - RNA, 45 nt, Homo sapiens
cauuaaaaacaucauucgauaguaagaugguccuaugccuaaccu

SEQ ID NO: 127804 - RNA, 45 nt, Homo sapiens
uuauauuucaaaacuuccuaaaaguaaucaguauccaagcccuaa

SEQ ID NO: 127805 - RNA, 59 nt, Homo sapiens
uuccuaauaugauuuccuaugauuauuauuuaacccucuucucaucucagguuucagau

SEQ ID NO: 127806 - RNA, 47 nt, Homo sapiens
caugacacagcuuguuucaaauuuaucagcaacaguagcagaauuga

SEQ ID NO: 127807 - RNA, 45 nt, Homo sapiens
caauaaaacaaucgugaaacuucagaauacuucaagaauagcaga

SEQ ID NO: 127808 - RNA, 47 nt, Homo sapiens; identical to SEQ ID NO: 26527

SEQ ID NO: 127809 - RNA, 70 nt, Homo sapiens
auuucuaguuuuucagaauacauauauaaaugguguucaguuagaguugcucuuuaucggcagcgcagcc

SEQ ID NO: 127810 - RNA, 45 nt, Homo sapiens
uaaagauucagugaauauuuaugagaggaaaggaacacuacauuc

SEQ ID NO: 127811 - RNA, 47 nt, Homo sapiens
aauacucuguggaucgcuuuaggaagggagauuaagacagaaauaau

SEQ ID NO: 127812 - RNA, 37 nt, Homo sapiens
uauaucaauuaauuagacauagaaucuuguuuagaua

SEQ ID NO: 127813 - RNA, 58 nt, Homo sapiens
uggaagucuuuaaugaaauuguuguugauaggguauuuggcacuagcaugguggaaga

SEQ ID NO: 127814 - RNA, 44 nt, Homo sapiens
uauguuacuuagacauaaguaauguagaauuuuguaguuaauuu

SEQ ID NO: 127815 - RNA, 41 nt, Homo sapiens
caggagacauugacccuacaucaguagcaagucccaaagau

SEQ ID NO: 127816 - RNA, 44 nt, Homo sapiens
cguccaugucauuuaugguuaaccuaaccaaauguaucagcuuu

SEQ ID NO: 127817 - RNA, 43 nt, Homo sapiens
gauuucucuuggcucaacagauauuucacacuuggccacagac

SEQ ID NO: 127818 - RNA, 37 nt, Homo sapiens
caccucaguauguaguucaaacuaccccuauauauua

SEQ ID NO: 127819 - RNA, 53 nt, Homo sapiens
auggauggaaagagauuuaaggaagucauuuaaguggucaacaauauaaaaug

SEQ ID NO: 127820 - RNA, 44 nt, Homo sapiens
gcaaagggcuuggaaggggaaggagcuguuaguuggaggugaau

SEQ ID NO: 127821 - RNA, 46 nt, Homo sapiens
agaguuguugcucacauaaaauaauacauaaacaaggggaagagaa

SEQ ID NO: 127822 - RNA, 45 nt, Homo sapiens
uguaguguguguaguaguuuuugguaaugccccuuagugacggga

SEQ ID NO: 127823 - RNA, 55 nt, Homo sapiens
aacuuggggggcguguguguauguguguuaugaagcacuuuuucaauugguuugg

SEQ ID NO: 127824 - RNA, 56 nt, Homo sapiens
ggauaaagcacgucggaugugaugcguuccggacgugcgauuuuaaaacgugagug

SEQ ID NO: 127825 - RNA, 67 nt, Homo sapiens
accaccaagugccuuuguacucaguuccucuaccccuuggagacggugcaggguuuggggugggugu

SEQ ID NO: 127826 - RNA, 72 nt, Homo sapiens
ggagauuuucaugguguauuuuggaauuuacagagacucagugggagagagagaggugccaagguagaggga

SEQ ID NO: 127827 - RNA, 44 nt, Homo sapiens
aagcucugcugaaugaaggcaggauuguaguuuaugcgcuggua

SEQ ID NO: 127828 - RNA, 47 nt, Homo sapiens
uacuauuuuguaacuauauugcacuaacuauauccaaaacacauucu

SEQ ID NO: 127829 - RNA, 59 nt, Homo sapiens
uguccauaaacuaaguaugguuuucuaugucaugauuuuuuuuuuuuuuuuuuuuuuuu

SEQ ID NO: 127830 - RNA, 41 nt, Homo sapiens
gagggaucgaucuccacagcaucaaugcaggacuuuggaaa

SEQ ID NO: 127831 - RNA, 45 nt, Homo sapiens
cagucuuggugcugaacgguccggaccccaauguccccacccaca

SEQ ID NO: 127832 - RNA, 54 nt, Homo sapiens
ucacuuuuuuagcugcuacccuaugcugccucuccaaauuuugcagagaagcac

SEQ ID NO: 127833 - RNA, 45 nt, Homo sapiens
cgcgaugguuucacaguggggcuguccaccacguggaggguguag

SEQ ID NO: 127834 - RNA, 43 nt, Homo sapiens
gguucaaggaugcugacaucaauauuuaucugcucauucaucc

SEQ ID NO: 127835 - RNA, 42 nt, Homo sapiens
cagcaggaauuaauccucugaaaggcuggcuuacuugugcag

SEQ ID NO: 127836 - RNA, 57 nt, Homo sapiens
cacuuggugacugggcaguguuauaaaaauuugucugaccaggcuguuguacuuguc

SEQ ID NO: 127837 - RNA, 46 nt, Homo sapiens
aguucuugguguuggacaguuggaaaguugugaauagcaguaccag

SEQ ID NO: 127838 - RNA, 46 nt, Homo sapiens
ugagguuucacuuuacaaauauuuggaggguccgaugugguuguag

SEQ ID NO: 127839 - RNA, 45 nt, Homo sapiens
uauccuccaucuuuguauuauuaguagccacgguguuaggcaaag

SEQ ID NO: 127840 - RNA, 46 nt, Homo sapiens
cuuaccucugaugaaggagcugauccaaacgauguuaagggcuuau

SEQ ID NO: 127841 - RNA, 70 nt, Homo sapiens
gguggggcaggauuuggggcugagacugggguaggggcuggggcuggggcugaagcugaggcaggggcaa

SEQ ID NO: 127842 - RNA, 73 nt, Homo sapiens
gggaagaggcugcuggggcuggcguuggagcugaaguugaugcuagggcugaagcaagaaugggaauugaggc

SEQ ID NO: 127843 - RNA, 46 nt, Homo sapiens
aacugaggcaaggauggggguuggagcuggggcugaggcuggagcu

SEQ ID NO: 127844 - RNA, 108 nt, Homo sapiens
ggcuggaacuggagcugagguugaggccagaacuggagcuaaaguugaggcuggaaccggagcugagguugaggcuggaacuggaguuaagguugccggaaguggagc

SEQ ID NO: 127845 - RNA, 42 nt, Homo sapiens
guuuuuguuguuuuuuggauaccacuucaguaaaaccaucau

SEQ ID NO: 127846 - RNA, 45 nt, Homo sapiens
aggucaaccccaguugugccugcaggcuggucaucaaauggccua

SEQ ID NO: 127847 - RNA, 46 nt, Homo sapiens
ugacuagaaaaacuucucuuugcaauuucccucuuuggagguagaa

SEQ ID NO: 127848 - RNA, 45 nt, Homo sapiens
ugugcauucaagucagcauuuuuuuuuucaucccucucucgccuc

SEQ ID NO: 127849 - RNA, 49 nt, Homo sapiens
gguucuugagccacauuauuaacugugccauuugugggcacugcuacca

SEQ ID NO: 127850 - RNA, 44 nt, Homo sapiens
cgucuaaaucgagguggcuugucuugccuugguggucgaguagg

SEQ ID NO: 127851 - RNA, 41 nt, Homo sapiens
uaagcuggucuucguaaaguggaagggcgugauggacggcc

SEQ ID NO: 127852 - RNA, 46 nt, Homo sapiens
ggcaaaguugauucuuuuuuaacugcuggucuugaaucuggucgag

SEQ ID NO: 127853 - RNA, 43 nt, Homo sapiens
aacugacuguggcugaauuggugcugguggcugaggugguggu

SEQ ID NO: 127854 - RNA, 46 nt, Homo sapiens
augggaaacacuucuuuuccgggaaggcugacuuucuacagcugaa

SEQ ID NO: 127855 - RNA, 45 nt, Homo sapiens
ugcuuugggaguaguugcuuguugaggcucagcaugaggauaggg

SEQ ID NO: 127856 - RNA, 45 nt, Homo sapiens
uuuucucgcucccuuucccuaauuuccucuggagaugguuguuuu

SEQ ID NO: 127857 - RNA, 50 nt, Homo sapiens
cugauuguugucuucgucuuugcuuccauauuucaucuucaucagcuacu

SEQ ID NO: 127858 - RNA, 44 nt, Homo sapiens
uaccugcugugcaagcaacuuuggaggugguggcagaugugaag

SEQ ID NO: 127859 - RNA, 73 nt, Homo sapiens
aucagcuucagcaucuagguuaucaaauuuaucaagcuccuucaguucugaugcacuaagaauggaugggcgu

SEQ ID NO: 127860 - RNA, 46 nt, Homo sapiens
ggaucauugccuuuguuuucugcuuuaagacuugggagguuagcag

SEQ ID NO: 127861 - RNA, 35 nt, Homo sapiens
auacagucauauuaacaguucagaaacuggauuuc

SEQ ID NO: 127862 - RNA, 36 nt, Homo sapiens
ccccaggcccagagcuuuguuuucuuuuaggggaua

SEQ ID NO: 127863 - RNA, 47 nt, Homo sapiens
gcauaaccauauauagcagcccuguaccuucagauuguucacuggca

SEQ ID NO: 127864 - RNA, 47 nt, Homo sapiens
gaauacaaagacugguaguauacuggaugauuuuaagugauccacag

SEQ ID NO: 127865 - RNA, 42 nt, Homo sapiens
ccaaccaccauacaaggugaugaggacauggaaacagucuag

SEQ ID NO: 127866 - RNA, 54 nt, Homo sapiens
augaaaaggacuuauuacugugcucaguguauagcaaaaggucaccuaauggag

SEQ ID NO: 127867 - RNA, 42 nt, Homo sapiens
cccaaauaaugucaaaacacacauacaucccuuuaaauuaaa

SEQ ID NO: 127868 - RNA, 44 nt, Homo sapiens
gggugagugucaaguuugcgcacuucgagggucuccgccgaucu

SEQ ID NO: 127869 - RNA, 45 nt, Homo sapiens
agcugcggauggacaaaccgccaaagcacuuucgcagcuuuccga

SEQ ID NO: 127870 - RNA, 42 nt, Homo sapiens
gguuccugcuacaaggaacuuaaggacauccuccuccuucau

SEQ ID NO: 127871 - RNA, 45 nt, Homo sapiens
cugagcgagcucccugguuguugcauggaauggcaauguccacau

SEQ ID NO: 127872 - RNA, 44 nt, Homo sapiens
guucacgagaaauggugccacgcaugcgcagaacuucccgagcc

SEQ ID NO: 127873 - RNA, 45 nt, Homo sapiens
auaacgaugguuguggaucgguaggcacuuuaaauuuuguucuag

SEQ ID NO: 127874 - RNA, 45 nt, Homo sapiens
gcuuugaggaagaguggcaguacugccucacugcauaagggaugg

SEQ ID NO: 127875 - RNA, 33 nt, Homo sapiens
cuaugugagcaaagauauauuuuaucuuuaaag

SEQ ID NO: 127876 - RNA, 161 nt, Homo sapiens
gacuucuucaggugagggcaucugguguggugacgccagcugcuuccggaacacugcugccugcucuugugccuuggauaaguggcagugggggguuuuuggaggaccaaaugaugcaguuucuguuguuaauuauuaggagagauugaaucauguccaca

SEQ ID NO: 127877 - RNA, 45 nt, Homo sapiens
ucugcuuggaccagaggugguugugggaggagaacgaaccaagau

SEQ ID NO: 127878 - RNA, 61 nt, Homo sapiens
aggcuuggagucacuuccggcugcaggucccggaacaaauccgaccccagaaguggggacu

SEQ ID NO: 127879 - RNA, 44 nt, Homo sapiens
accaaaauaaugugcuuugcuggccaaaaguacacguccauuuu

SEQ ID NO: 127880 - RNA, 45 nt, Homo sapiens
uaggagguuuuuagaguuaggugguaagcaaaggucuucugagau

SEQ ID NO: 127881 - RNA, 49 nt, Homo sapiens
ugauuugagcaauuaauggucucucugaugcccccaguuacuuucuaug

SEQ ID NO: 127882 - RNA, 44 nt, Homo sapiens
uggaaaaacagccucaauguuuugguagcauuguaaauggagaa

SEQ ID NO: 127883 - RNA, 47 nt, Homo sapiens
auggaguuacaaaagaguucacaaaaggauuuucauuuccuccagga

SEQ ID NO: 127884 - RNA, 71 nt, Homo sapiens
uccagugguugcuguugaugaggccucuuggaccucugcucugaggcuuccagagaguccucuggauggca

SEQ ID NO: 127885 - RNA, 94 nt, Homo sapiens
ccagaggcugcagaaggccaagaaucaagcuagaaggccacaugucaccguggaccuuccugccaccagucacugucccucaaaugacccaaag

SEQ ID NO: 127886 - RNA, 45 nt, Homo sapiens
cacagaugucaaaacugaacagagagguacaguaacuugcccaag

SEQ ID NO: 127887 - RNA, 35 nt, Homo sapiens
uuuuaguguauaauauuaaccuuuuuaaaacucuc

SEQ ID NO: 127888 - RNA, 44 nt, Homo sapiens
aagggucaaaauauggucccuuuguuauggaauagugggacaag

SEQ ID NO: 127889 - RNA, 71 nt, Homo sapiens
uaagaacuauuuaauuaaauuaaauuguagguagaugaagggaauauaaggugggaaacauacucauuagg

SEQ ID NO: 127890 - RNA, 41 nt, Homo sapiens
uuggauguuaacuuccaugaauucuaguccaagaagcaaaa

SEQ ID NO: 127891 - RNA, 100 nt, Homo sapiens
uuucuccagaccucagccauacaacccuuucuuuagaccucagccagacaaaccucucuccagaacucagucagacaaaccuuucuccagcccucgguca

SEQ ID NO: 127892 - RNA, 101 nt, Homo sapiens
gaugccccuuucuccagaccucagccauacaacccuuucucuagacuucagccagacaaaccucucuccagaacucagccauaugacucucucuccagaac

SEQ ID NO: 127893 - RNA, 86 nt, Homo sapiens
ucuagacuucagccagacaaaccucucuccagaacucagucaaacaaaccuuuccccagcccucggucagaugccccuuucuccag

SEQ ID NO: 127894 - RNA, 44 nt, Homo sapiens
caaaccucucuccagaacucagucagacaaaccuuuccccagac

SEQ ID NO: 127895 - RNA, 48 nt, Homo sapiens
gaccagaugacacuuucuccagaccuuggugagacagaucuuucccca

SEQ ID NO: 127896 - RNA, 38 nt, Homo sapiens
agaccuuggucagaugccaucuccuucaucuccuacuc

SEQ ID NO: 127897 - RNA, 46 nt, Homo sapiens
cauggacuuuccuaugaaaaaucaucagagggaaagacuuaugaag

SEQ ID NO: 127898 - RNA, 45 nt, Homo sapiens
gaagaguaagguuuaaaugggaggaguauuuuacagcaccugggg

SEQ ID NO: 127899 - RNA, 45 nt, Homo sapiens
uuucauuaagcuucucugacuuuaaguuuuguuucuuuuggggca

SEQ ID NO: 127900 - RNA, 42 nt, Homo sapiens
aagaguaaguccauacuggauaaauuucauugaagaccuggu

SEQ ID NO: 127901 - RNA, 55 nt, Homo sapiens
augaugaauuuuuuuaaaauaacuuaaaauuagaaaugauacguacaccuuaaaa

SEQ ID NO: 127902 - RNA, 39 nt, Homo sapiens
aauauucaagaugaucuaccuuuagaaacaaaggcagau

SEQ ID NO: 127903 - RNA, 50 nt, Homo sapiens
acagguguauguuggaucagcgcucuucuauccaguugguuaccuucuag

SEQ ID NO: 127904 - RNA, 31 nt, Homo sapiens
aauggucauauacuuuuguggauaggggcag

SEQ ID NO: 127905 - RNA, 45 nt, Homo sapiens
caauuuaaauggauuagcugggaacauuuacuuuuauugcugguc

SEQ ID NO: 127906 - RNA, 30 nt, Homo sapiens
gaggaaguagaauaaauaucuuggccucuc

SEQ ID NO: 127907 - RNA, 56 nt, Homo sapiens
uuuuuaaaaccugauuugucuuaauaggggguuaaauugaaagaauauaguugcua

SEQ ID NO: 127908 - RNA, 34 nt, Homo sapiens
uuggucuggaugguguguguaugugcaugugugu

SEQ ID NO: 127909 - RNA, 38 nt, Homo sapiens
uuuacccaggggauggaucuguugaaaugguaaauaag

SEQ ID NO: 127910 - RNA, 45 nt, Homo sapiens
gagcugauccaguuuauuacaacugguccuauuauugccauggag

SEQ ID NO: 127911 - RNA, 45 nt, Homo sapiens
agaaaugcagcgcauggcccugauucuuuugcuucugcggccaga

SEQ ID NO: 127912 - RNA, 45 nt, Homo sapiens
aauuuaugauuugauggaagauaaguacccaaauaaccauaacuu

SEQ ID NO: 127913 - RNA, 45 nt, Homo sapiens
aauaguagaaauaauagcagugaaagcuuagagacaggaaagcau

SEQ ID NO: 127914 - RNA, 45 nt, Homo sapiens
uaaauuuacuaauuguaccuguugcauuguuaaaccccaugcugu

SEQ ID NO: 127915 - RNA, 45 nt, Homo sapiens
auggagccuguuuuuauuauuuucuacucacuuaauugcaucuug

SEQ ID NO: 127916 - RNA, 48 nt, Homo sapiens
acagcuuguucuuguuaggaaauugguaaggaaaaaugugaauuucag

SEQ ID NO: 127917 - RNA, 54 nt, Homo sapiens
guuuuaugaucaccugauggauuaauuugagauccauuaagaccuaagugccuu

SEQ ID NO: 127918 - RNA, 31 nt, Homo sapiens
aaaaaaagaaacuuagacuuuuauaggaaac

SEQ ID NO: 127919 - RNA, 49 nt, Homo sapiens
caggacuguugggaaagauccugauggcuauccgagaugcagguuuuga

SEQ ID NO: 127920 - RNA, 56 nt, Homo sapiens
uuuguugguugguuuaugguuuuguuuuguuuuauuuuuuaauauaguucaauaug

SEQ ID NO: 127921 - RNA, 45 nt, Homo sapiens
gauaggaauggagaagagagagcauaucuaaaaaauauucuucaa

SEQ ID NO: 127922 - RNA, 46 nt, Homo sapiens
ggacauggugacagaaauguauucuggcccuuguguagcaauggag

SEQ ID NO: 127923 - RNA, 41 nt, Homo sapiens
uuguuauuucaguaaaauccaaauguuggauuguguagcaa

SEQ ID NO: 127924 - RNA, 38 nt, Homo sapiens
agaaaagaucuaaagcaugugcaaaaacaccaaugaag

SEQ ID NO: 127925 - RNA, 41 nt, Homo sapiens
aauugguaaugaugcuguuuauugaaaauuaauuauaauaa

SEQ ID NO: 127926 - RNA, 347 nt, Homo sapiens
uuuuuguacuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccacugcgcccggcuaauuuuuuguauuuuuaguagagacgggguuucaccuuguuagccaggauggucucgaucuccugaccucaugauccacccgccucggccucccaaagugcugggauuacaggcgugagccaccgugcccggccuguacuuuuuuuuaagguaaguaaaac

SEQ ID NO: 127927 - RNA, 45 nt, Homo sapiens
ccaacauaaccuaacauguuuuaacacaauaaugcuggcuuccau

SEQ ID NO: 127928 - RNA, 40 nt, Homo sapiens
acaaauacuguucugugauaggccaaagagaaguuaagaa

SEQ ID NO: 127929 - RNA, 35 nt, Homo sapiens
auagguaucacauuucagggucaagaauuacgcau

SEQ ID NO: 127930 - RNA, 45 nt, Homo sapiens
gcagaagggauagccagaagcagugagcuucaaaagacauuuagu

SEQ ID NO: 127931 - RNA, 46 nt, Homo sapiens
ucugcuuuuuguuaucaccauaaacaggcaguuccaaacaacguca

SEQ ID NO: 127932 - RNA, 26 nt, Homo sapiens
ugaugaaguuuaaaagauagcucugc

SEQ ID NO: 127933 - RNA, 147 nt, Homo sapiens
ucacugccuuucugugugaucuuaaauguaacaaguauuauuucuuuagaguucaugauaggauggggagugagacuagaaaaacuaagcaugagggaagauauaauaggaaauagagucagaauauuuggccucccucaaaaguaa

SEQ ID NO: 127934 - RNA, 55 nt, Homo sapiens
aguaaguagugccuuggagagggaagacaaaaagggaaagggagcccagcaaagg

SEQ ID NO: 127935 - RNA, 47 nt, Homo sapiens
guguucauucuuuuauuguccguuguuuuaaccugacugaauacaag

SEQ ID NO: 127936 - RNA, 46 nt, Homo sapiens
ucacuugcuuacucagaucagcacagcaagugagucuugaugugag

SEQ ID NO: 127937 - RNA, 26 nt, Homo sapiens
ucuugggaucauuaggacgaaaggaa

SEQ ID NO: 127938 - RNA, 42 nt, Homo sapiens
ccauuuuaugaaugacaacacugcuugcacugaaagauuaac

SEQ ID NO: 127939 - RNA, 29 nt, Homo sapiens
aguguuuccaggcuugggaaagacaaggc

SEQ ID NO: 127940 - RNA, 41 nt, Homo sapiens
cucuucuuccuguggcuguauauucacuuucaggcaagcag

SEQ ID NO: 127941 - RNA, 49 nt, Homo sapiens
gggucuccucuggagaaaagcuuggcaggcgcuaacccaacaagcaugg

SEQ ID NO: 127942 - RNA, 51 nt, Homo sapiens
aauuuacaauuuucccucuuuaacuaaacaugaaaauggaggcuuuaaaga

SEQ ID NO: 127943 - RNA, 46 nt, Homo sapiens
cacugauggugagcagcaucacuuggaugguuccgaugaagaugcc

SEQ ID NO: 127944 - RNA, 99 nt, Homo sapiens
cgggccauggcgauggcgggucagcagcugccgcgguccggaggguggguggcugcggcgcgcgcccuggcguccucugcgccgcucggcuucuccggc

SEQ ID NO: 127945 - RNA, 42 nt, Homo sapiens
gagggagggacggcgcaggcugcgcggcuccgagccccgcac

SEQ ID NO: 127946 - RNA, 42 nt, Homo sapiens
accucugcagagacaggcccgggguaggagagucagagaggg

SEQ ID NO: 127947 - RNA, 66 nt, Homo sapiens
uugaaccggcaaggcuucagcuaccaguguccccaggggcaggugauaguggccgugaggagcauc

SEQ ID NO: 127948 - RNA, 97 nt, Homo sapiens
uucagcaagaaggaagguucugacagacaauggaacuacgccugcaugcccacgccacagagccucggggaacccacggagugcuggugggaggaga

SEQ ID NO: 127949 - RNA, 46 nt, Homo sapiens
gggcugguggcaggauuccagagccgcuacuucgagucagugcugg

SEQ ID NO: 127950 - RNA, 57 nt, Homo sapiens
acaugauuuccuacaauuaugauuacuauauccgaggagcaacaaccacuuucucug

SEQ ID NO: 127951 - RNA, 64 nt, Homo sapiens
aaugccaacuuccugggccuuucugacuaguaucacacuucuaauaaaauccacaauuaaacca

SEQ ID NO: 127952 - RNA, 46 nt, Homo sapiens
ugggaggugaaauggggaaauggaaggguuuggaggcagagcugaa

SEQ ID NO: 127953 - RNA, 44 nt, Homo sapiens
cucugauggggcugccuuuugccaccugggaaucacuugcaccc

SEQ ID NO: 127954 - RNA, 49 nt, Homo sapiens
agagaggaaacagguacaugaggaagauuccacuccacaagauacagaa

SEQ ID NO: 127955 - RNA, 43 nt, Homo sapiens
gcuuccaaaaguaacccucaaauguucgaaucacaagcaacac

SEQ ID NO: 127956 - RNA, 119 nt, Homo sapiens
uuugaguuucaaauuccucaucuguaagaggggauguccccacuuacccgacagucugauuaugggauuagccaucauaaucagagaaaaagauaacauagacugucagaaacuaagaa

SEQ ID NO: 127957 - RNA, 45 nt, Homo sapiens
aaaaaagcggaaaaccacaggaaugaugucccugaguaaacuaaa

SEQ ID NO: 127958 - RNA, 42 nt, Homo sapiens
gguggccgcagaaguugagaaggcucaaaucuggagaucagg

SEQ ID NO: 127959 - RNA, 85 nt, Homo sapiens
acugaacuguacacuguacauuacugaacuguaaaaaaugauugagaggguaaauuuuauaauaugugauuuuuuuaccacaauu

SEQ ID NO: 127960 - RNA, 44 nt, Homo sapiens
aaauggauauugcaaagcauucguuauucauucgacacccugag

SEQ ID NO: 127961 - RNA, 36 nt, Homo sapiens
ggagaaaauaaagcccaggaccugaagacagaaagg

SEQ ID NO: 127962 - RNA, 47 nt, Homo sapiens
ugaauuuagcaacacuuaugaaguuucuuaaaguggcucauacacac

SEQ ID NO: 127963 - RNA, 45 nt, Homo sapiens
uuugaagccauuuucguagagaaauauccuucacuauaaucaaau

SEQ ID NO: 127964 - RNA, 42 nt, Homo sapiens
uuuccaguggugcucuugaagaggaaugaguaccaguuuuaa

SEQ ID NO: 127965 - RNA, 72 nt, Homo sapiens
gggagaaaaaaaaaaaaaaaccacacacacccauacacacauaccagaaaaagaaagaaaggauggagacgg

SEQ ID NO: 127966 - RNA, 47 nt, Homo sapiens
gcaacccuguuagcuuggucucugccgccgcagcaucugcagggaac

SEQ ID NO: 127967 - RNA, 46 nt, Homo sapiens
ucuugcuucugguggcucucuuccaauaacaucacuugaugcaacu

SEQ ID NO: 127968 - RNA, 53 nt, Homo sapiens
uacccauagguaaaaucagguuagauaaggugagaaauuggucaaaaaaagau

SEQ ID NO: 127969 - RNA, 42 nt, Homo sapiens
gcuauggggaaacuauauggaaaugacuucagccaaacuacc

SEQ ID NO: 127970 - RNA, 45 nt, Homo sapiens
uuggcaugaccauuccuuauuuuucgaaaugacuuugagacagca

SEQ ID NO: 127971 - RNA, 23 nt, Homo sapiens
ucaucuaaauuugaagaagaaaa

SEQ ID NO: 127972 - RNA, 51 nt, Homo sapiens
auggauaaauuuaauuucauaaaaaucaaaagcuucucucaagugaaugaa

SEQ ID NO: 127973 - RNA, 51 nt, Homo sapiens
agggaaaaaaaauaaaaaaccuugacuauuauuucacaccauguacaaaga

SEQ ID NO: 127974 - RNA, 44 nt, Homo sapiens
uaaaacucaaguaaugaagacaguguaauacuggcauauggaua

SEQ ID NO: 127975 - RNA, 46 nt, Homo sapiens
cuaccucagcaaagccaagccaaccuccuacagucgcagccaagca

SEQ ID NO: 127976 - RNA, 41 nt, Homo sapiens
aacaagauugaauguaaggcaaauaagauaaauaagaguuu

SEQ ID NO: 127977 - RNA, 46 nt, Homo sapiens
caugacgcagaucccccugucucagcccauacagaucgcacaggug

SEQ ID NO: 127978 - RNA, 47 nt, Homo sapiens
uguuuacaguccugcacuguaauuaucucucaaugacuggcagaauu

SEQ ID NO: 127979 - RNA, 46 nt, Homo sapiens
aaacccaguugaauauggaccuaguaacacguaggaacaaggagag

SEQ ID NO: 127980 - RNA, 45 nt, Homo sapiens
aucagguuaugguaucgagguuaugcuggucucauaaaaugaguu

SEQ ID NO: 127981 - RNA, 38 nt, Homo sapiens
aaauaaagguuguauaggguuucaggugaguuuugauu

SEQ ID NO: 127982 - RNA, 55 nt, Homo sapiens
uagaugaaauaacccucagucuuuaaggaguuaacaauucauuaagagauaagac

SEQ ID NO: 127983 - RNA, 37 nt, Homo sapiens
auucuuuuuuugguaguuuaugaaagcaaguaaaaug

SEQ ID NO: 127984 - RNA, 61 nt, Homo sapiens
cuacuuuaaugcuacuacuguaauagcaguuucagcaguuaccauuuauugagcaacuaca

SEQ ID NO: 127985 - RNA, 46 nt, Homo sapiens
uguauuuggcaaauacagaccaauuugaguauugaguugucaaaua

SEQ ID NO: 127986 - RNA, 43 nt, Homo sapiens
gacaguaaacuuguuugaucauaaauauucuaaguuugaguuu

SEQ ID NO: 127987 - RNA, 57 nt, Homo sapiens
ucggguugacuaugcauaaaugcuuaaucgcauaugcagccuguggcgggggagggg

SEQ ID NO: 127988 - RNA, 46 nt, Homo sapiens
uguaccucccuucucccuugguacuaucuccaguuagguccaagaa

SEQ ID NO: 127989 - RNA, 44 nt, Homo sapiens
auaaaugcaaauaauaaauuuuaaauuucguaaaggcggaagag

SEQ ID NO: 127990 - RNA, 52 nt, Homo sapiens
cacuaaaaugguaguuuuaaaagaacaugacaauauauuuauaauaccacau

SEQ ID NO: 127991 - RNA, 22 nt, Homo sapiens
ugcaggcgaguucaaugagcua

SEQ ID NO: 127992 - RNA, 47 nt, Homo sapiens
aaacacccacguaagaguagguggugcuaagaucaauaccaacugca

SEQ ID NO: 127993 - RNA, 14 nt, Homo sapiens
ggaggcuagaaguc

SEQ ID NO: 127994 - RNA, 38 nt, Homo sapiens
uguguacaauaaagaugauuuucuggccuguggauuaa

SEQ ID NO: 127995 - RNA, 62 nt, Homo sapiens
agaagacaacauuuguacuucuuaaaaaauguuauuugaggauuaaaacaugaagacaaaag

SEQ ID NO: 127996 - RNA, 58 nt, Homo sapiens
gcuguaaggugcuugugagugaguuugguguacauuuacauggugcuguaagugcuga

SEQ ID NO: 127997 - RNA, 69 nt, Homo sapiens
cugcagaguugauuuaggacagauacucuucucaagaagguuguuccgaguaagcuucauggaagaagu

SEQ ID NO: 127998 - RNA, 34 nt, Homo sapiens
cuguuuugcuuugcuguuuuguugcaaguauaac

SEQ ID NO: 127999 - RNA, 46 nt, Homo sapiens
uuguuucuagucuuguaaaaucuuccuucauggcaccaugaacucu

SEQ ID NO: 128000 - RNA, 68 nt, Homo sapiens
acauuuuaauauaggcagugucaacauuuugugaauuuuaugucaauauuagauuauauuuuuccucu

SEQ ID NO: 128001 - RNA, 58 nt, Homo sapiens
auaguugcuuucucauuuggugacaugagacuagacuauuugcacuuuguggguagga

SEQ ID NO: 128002 - RNA, 30 nt, Homo sapiens
caaagaauuuucuuucucuuggccucaggc

SEQ ID NO: 128003 - RNA, 59 nt, Homo sapiens
gaaagaaaucggacaguuaauaagugguuugugguagaguugaaggaugucugagagau

SEQ ID NO: 128004 - RNA, 48 nt, Homo sapiens
uuucuauuguuguccacaugcccugcacauaagguaaauacagcagau

SEQ ID NO: 128005 - RNA, 60 nt, Homo sapiens
ugggaaaauuaaauuuauuucagcaguucauuacuuuccaacucccuuaaaauuccaaaa

SEQ ID NO: 128006 - RNA, 54 nt, Homo sapiens
uguugaauaucagacauuuucuuacuauuauuucaagaaauacauguagcagga

SEQ ID NO: 128007 - RNA, 106 nt, Homo sapiens
agaaacaacccaauaccuguauuaauaguauuaguauugugaucaguauuauugaucacaaaucauuaguauauccuugaaguaaaauacuauacaccaccaaaaa

SEQ ID NO: 128008 - RNA, 37 nt, Homo sapiens
aagcugagaacugacauaugagagcauguagguaggg

SEQ ID NO: 128009 - RNA, 46 nt, Homo sapiens
uugagguacuuuaagagaagauaaugggcaaagggaguacagcuaa

SEQ ID NO: 128010 - RNA, 56 nt, Homo sapiens
gaagguaggauuuugacagguggguuaaggauggagggugggguugcauuuaagaa

SEQ ID NO: 128011 - RNA, 55 nt, Homo sapiens
gaauagaauaguaauugaguuaaaaacucuugcaauacaggucuacuaaugagaa

SEQ ID NO: 128012 - RNA, 27 nt, Homo sapiens
uccuucauagcacuuacaaauugcaaa

SEQ ID NO: 128013 - RNA, 42 nt, Homo sapiens
aagguacuguuggcgauaagauuguuauuaaguuggguaggu

SEQ ID NO: 128014 - RNA, 40 nt, Homo sapiens
gaguaacugaaagucaugcagcugagaguagaauucagau

SEQ ID NO: 128015 - RNA, 56 nt, Homo sapiens
uccuuuccuacuuuuaguccgugcuuacggggugguguuuacuuugcuucaggauu

SEQ ID NO: 128016 - RNA, 69 nt, Homo sapiens
aggguuuuaaggggaugauuagguuuuaaaagaagauaaugcagaugggaggaggaaaugggaacaggg

SEQ ID NO: 128017 - RNA, 44 nt, Homo sapiens
caguguacgugccuggccccaaaucuaggagauucuuguuuggu

SEQ ID NO: 128018 - RNA, 43 nt, Homo sapiens
cuuuuuguuuuaauuuuauauaguuauaauguuacaaauauuu

SEQ ID NO: 128019 - RNA, 116 nt, Homo sapiens
gggaguggaaagucuugacaggaaugucauucauggacccuguggucucaguagaauuuagaaggaagugaagacgggagugaauugauggucuaggggaaaauggaagagcagga

SEQ ID NO: 128020 - RNA, 52 nt, Homo sapiens
guuuuucuaauagugcuugacaggucaagguguagaaguaggaguggagaug

SEQ ID NO: 128021 - RNA, 49 nt, Homo sapiens
uugcaauuaagauauuggucagagcuacagccucaucugaagguucaac

SEQ ID NO: 128022 - RNA, 42 nt, Homo sapiens
gugaagaaauuaaaauauuagaaaaaagaguaagaguugaau

SEQ ID NO: 128023 - RNA, 81 nt, Homo sapiens
ucauguagaauaagggcugugaagauaugaacccugacuagaagccucugcuguaaagacagaaccuucuuuaaguccgau

SEQ ID NO: 128024 - RNA, 44 nt, Homo sapiens
uagagggauaauuuuucuuacuauaucaaguucucuuagacauu

SEQ ID NO: 128025 - RNA, 47 nt, Homo sapiens
augguggagagauuaaagauuagacuguucaaagaaaaacucagaaa

SEQ ID NO: 128026 - RNA, 49 nt, Homo sapiens
aggugcuuggaaugauugaaauugauuuuuuagguagaagggccagaug

SEQ ID NO: 128027 - RNA, 44 nt, Homo sapiens
ugcacuguuaacuauuagucuuuuaaauuuuuccuagguugaug

SEQ ID NO: 128028 - RNA, 45 nt, Homo sapiens
uguauuguuauccuaucuuucagguuaggaaaccgaggcuuaaag

SEQ ID NO: 128029 - RNA, 41 nt, Homo sapiens
uuauccagaaaagagcauuaccauaagcagauguagggaug

SEQ ID NO: 128030 - RNA, 64 nt, Homo sapiens
guugaggauauuguccaauuacauuacauggaauaaggacguuugggagaaauucuuaccuggc

SEQ ID NO: 128031 - RNA, 79 nt, Homo sapiens
aauagggacugaugugauaaaaaugguguguuaggaguaauguggugugcaggaugguuugaaauaggaagggagagau

SEQ ID NO: 128032 - RNA, 60 nt, Homo sapiens
auagguaaagaaugaggaagcauuuguucuaucugcaggaaagcuguuggaggauuuuga

SEQ ID NO: 128033 - RNA, 45 nt, Homo sapiens
uucacaaugguuuagugacuugcucacagucacuuaacuauucag

SEQ ID NO: 128034 - RNA, 200 nt, Homo sapiens
uauucauuuauuuucucuuauuuuuaauuuuuuuuaagagauggggucuugcuauguugccuaggcuagucuaaaacuccugggcuuaagcaguccuacuguggccuccccaagugcugggacuacaggcaugagcuaccacaccuggcccagauuucuuuuaaacugcuggaacuccuggacauuuauccggagaggau

SEQ ID NO: 128035 - RNA, 46 nt, Homo sapiens
aaaaauugaaauauuugaccugcuucuugaaucuguauugcuucau

SEQ ID NO: 128036 - RNA, 59 nt, Homo sapiens
gacauauuaauagauuuucuuguaagacauuucucauauuuuuaauuauuaguuuauuu

SEQ ID NO: 128037 - RNA, 47 nt, Homo sapiens
guggaaaugauaauguugaaaauaagguagaauacucacaggaaagc

SEQ ID NO: 128038 - RNA, 55 nt, Homo sapiens
cuaauggagagaccauuugccuuagaauccauuucagugaauaaagcagaguuga

SEQ ID NO: 128039 - RNA, 55 nt, Homo sapiens
cuuugaguauuugugucaugauuaaaugagugaaaagagaagaauaaacauaggc

SEQ ID NO: 128040 - RNA, 47 nt, Homo sapiens
auuuauuuacuaauaaccaaaaugacuaccuccaccaacuuccacac

SEQ ID NO: 128041 - RNA, 41 nt, Homo sapiens
auuuauuaguacucaggauuauuauaauuaacggcggggag

SEQ ID NO: 128042 - RNA, 45 nt, Homo sapiens; identical to SEQ ID NO: 26894

SEQ ID NO: 128043 - RNA, 46 nt, Homo sapiens
guuggugggcacgugauucugugcugggcaggcuguggugggaggg

SEQ ID NO: 128044 - RNA, 28 nt, Homo sapiens
guguguaaguaagugugugugugugugu

SEQ ID NO: 128045 - RNA, 80 nt, Homo sapiens
cuaauuuaggauuggaauggcaacaggacccagggccacagagcagauggugggcgggccgcuuaucuugcaguugcauu

SEQ ID NO: 128046 - RNA, 33 nt, Homo sapiens
cugagggugagggacucugacauuucauggcag

SEQ ID NO: 128047 - RNA, 43 nt, Homo sapiens
aaauaaaugauuauuauuguuuuaagucacuaaauguuggagu

SEQ ID NO: 128048 - RNA, 64 nt, Homo sapiens
accuuggaagugggucuuccaaugccgguuaagccaacccagcauaaagcauaaagcaaagaca

SEQ ID NO: 128049 - RNA, 43 nt, Homo sapiens
gccugggaggggacccgagaggaggggaagggccagggcacag

SEQ ID NO: 128050 - RNA, 59 nt, Homo sapiens
aaguguuaaaguggaaguguuaagggagugagguguguaggggaggagcugaguuaaaa

SEQ ID NO: 128051 - RNA, 47 nt, Homo sapiens
aauccauuugauguuauuagaccugugaaggaagaaauagaaaugaa

SEQ ID NO: 128052 - RNA, 45 nt, Homo sapiens
cccugcgaagcccgaagaacguccugcggaguuuccacagagaug

SEQ ID NO: 128053 - RNA, 87 nt, Homo sapiens
gugggugaauggguccaucugggaucccagcacuuucaccucuuguaaucuccggcaucucucuuauccauuccauuuucuccauag

SEQ ID NO: 128054 - RNA, 49 nt, Homo sapiens
cagcaugaagcaugcuugagacuucaggucguguccuuggaggugagaa

SEQ ID NO: 128055 - RNA, 32 nt, Homo sapiens
ccaaacgagugauaaagcucuuccuggauuga

SEQ ID NO: 128056 - RNA, 56 nt, Homo sapiens
caaccccuacccaauccuguagcuugucgacaagccccugcugccaccucucucuc

SEQ ID NO: 128057 - RNA, 34 nt, Homo sapiens
ucgccucccuggagaguucugagugggagcgccc

SEQ ID NO: 128058 - RNA, 42 nt, Homo sapiens
ucugugaugagcuguguugauccuagacauguuaagccaaaa

SEQ ID NO: 128059 - RNA, 28 nt, Homo sapiens
agcuaagaauacaaacaccacuaguuca

SEQ ID NO: 128060 - RNA, 54 nt, Homo sapiens
ccacacauuacagggacuccugggaccauaacuguguguacugacaccugcgcu

SEQ ID NO: 128061 - RNA, 44 nt, Homo sapiens
gaguugcugugguagggcaggucgcggccgcgguaggacgggcc

SEQ ID NO: 128062 - RNA, 26 nt, Homo sapiens
aggguggaacgugaacucauuagcag

SEQ ID NO: 128063 - RNA, 61 nt, Homo sapiens
cccucuuuguguauucucaggccucucccccucuauguggacucucuguguggucuuuccu

SEQ ID NO: 128064 - RNA, 47 nt, Homo sapiens
aauaaauaauaagauuaguuuucaaagaugugaaagagacucugaaa

SEQ ID NO: 128065 - RNA, 43 nt, Homo sapiens
cuggagaugguagugaugaaugacgaauucagcaaaacuuaga

SEQ ID NO: 128066 - RNA, 45 nt, Homo sapiens
aacaugugcuugacaaguuugaggccagcauaaaggacuauaagg

SEQ ID NO: 128067 - RNA, 41 nt, Homo sapiens
uuauucuuucaugacuuccacuugaagguccuugcuuacug

SEQ ID NO: 128068 - RNA, 46 nt, Homo sapiens
ggcauaaccuggguccugguuuacaggacagacaaguacaagagac

SEQ ID NO: 128069 - RNA, 53 nt, Homo sapiens
agaaggaaacaauaacagagucagcuggucgacaacagaaaaagaaaauaggu

SEQ ID NO: 128070 - RNA, 666 nt, Homo sapiens
uuauuauaaaaguaaugcaggccagguacgguggcucaugccuguaauuccagcacuuugggaggcugagacaggcggaucacgaagucaagagaucgagaccauccuggccaacauggugauaccccgucucuacuaaaaauacaaaaaauuagcugggcaugaugaugugccccuguauucccugcuacucgggagguugaggcaggaggaucgcuugaaccugggaggcggagguugcagugagccaagaucgcaccacugcacuccagccuggcgacagagcgagacucugucucaaaaaaaaaaaaaguauugcaaaguaggccgggcauaguggcucaccccuauaaugccagcaccugggaggcugaggugagcagaucacuggagcccaagaguuugagaccagcguggccaacauggcaaaaccccaacucuauuaaaaaugcaaaaauuagcugggcaugguggcaugccuguuagucccagcuccucgggaggcugaggugggaagaaugcuugagcccgggaaguggagguugcagugagcugugaucacaccacugcacuccagccucagugacagagcaagaccacgucucagaaaaagaaauacaaagucugaucauucuccaucuuuacuaaggagagguauccuaaugu

SEQ ID NO: 128071 - RNA, 51 nt, Homo sapiens
agaacucuuuauuuucuaucauucuuucuagacacacacacaucagacugg

SEQ ID NO: 128072 - RNA, 49 nt, Homo sapiens
augcccugcaaguuggcugucuaugagcauuuagagauuuagaagaaaa

SEQ ID NO: 128073 - RNA, 23 nt, Homo sapiens
aucuggugacagauuuuuccauu

SEQ ID NO: 128074 - RNA, 36 nt, Homo sapiens
aaauauuucugcacauuaaucagaauugggaaagga

SEQ ID NO: 128075 - RNA, 27 nt, Homo sapiens
uuauuaauaacauuuuugauguaggau

SEQ ID NO: 128076 - RNA, 45 nt, Homo sapiens
aaaccuucucccuuuacaccuguuucugcauugcuacuggcugaa

SEQ ID NO: 128077 - RNA, 48 nt, Homo sapiens
cauaguaaaauagaacaaaaaugguuuuuuuuccggucuaggauccag

SEQ ID NO: 128078 - RNA, 53 nt, Homo sapiens
guccacucaucaaccgaccacaccuggagcgaguccuuggguuugucaaagug

SEQ ID NO: 128079 - RNA, 60 nt, Homo sapiens
cuaaucaagaaagcugugauucuccucaaagcguauuuuugugaaaucuuuuaagagcca

SEQ ID NO: 128080 - RNA, 41 nt, Homo sapiens
aggaguggaguugcuggcucgugauaacucuauguuuagau

SEQ ID NO: 128081 - RNA, 46 nt, Homo sapiens
cuaguucuggaccuucuacuaaguaguuauaagaccauagaaaagu

SEQ ID NO: 128082 - RNA, 45 nt, Homo sapiens; identical to SEQ ID NO: 26955

SEQ ID NO: 128083 - RNA, 35 nt, Homo sapiens
cuggucacccagucuaaaauuucaucaugccccuc

SEQ ID NO: 128084 - RNA, 43 nt, Homo sapiens
uucuguaugauuuuacuuucuucuguuucuuuccugaguauaa

SEQ ID NO: 128085 - RNA, 43 nt, Homo sapiens
cugcuucucgcacaucuuauucccccgacuugagcugcucuca

SEQ ID NO: 128086 - RNA, 52 nt, Homo sapiens
aaagcagcggcgguguuugcuucacugcuuggaagugugagugcgcgaagau

SEQ ID NO: 128087 - RNA, 57 nt, Homo sapiens
cauugugagcacuugauaaauauuugcugaauguuguuuuuuugaaugaacauaaga

SEQ ID NO: 128088 - RNA, 46 nt, Homo sapiens
ugaaacuccaguuuuguggauuacaguuuugaguuuuaugauugac

SEQ ID NO: 128089 - RNA, 48 nt, Homo sapiens
augguauagacuccuaauguuugauaaaauacuauuuucagaguggua

SEQ ID NO: 128090 - RNA, 122 nt, Homo sapiens
aaacaauccaagacaaacuuagaaagauuaggcaacacaaaacacaguaagaccuguucauagcuuguugucuagaaaaccagguagcaggauauucuagaugcuuccugcugcuucuacgu

SEQ ID NO: 128091 - RNA, 46 nt, Homo sapiens
auacuuuuaauucuugcugauuuguaaacuggccuugcuuggauac

SEQ ID NO: 128092 - RNA, 125 nt, Homo sapiens
aaauguuuucaagagcugaauugagaaggaaagagacuggagugguuaauggugauuugauuucuggcauucugaguuuucugcuacaauuagcugcauuacuuggugccaaagagcagugggga

SEQ ID NO: 128093 - RNA, 57 nt, Homo sapiens
uuauuuuugcugggaaauccuucuaaauagaaauguaacauuuuuauaaaaacagau

SEQ ID NO: 128094 - RNA, 57 nt, Homo sapiens
gaaacagaacagugaauguuuugcccaaaacuacaaaaauaaaagaaaaaaagaaaa

SEQ ID NO: 128095 - RNA, 76 nt, Homo sapiens
augaugugggucuaaaccauauguuuugaguaaaggagaauagaagaaggggaguguccgcaaaauggaaagagau

SEQ ID NO: 128096 - RNA, 59 nt, Homo sapiens
gagaugauaaaaauauuuauuaagaaaugaagucagguucaguguaugaaauggaaagg

SEQ ID NO: 128097 - RNA, 62 nt, Homo sapiens
cuagagccauugggaauccauuuugaaacaagaaggaguuuugaaagggaauaggaaaguaa

SEQ ID NO: 128098 - RNA, 63 nt, Homo sapiens
aggaaggucagggcuagaaaggaggcuacauaaaaaggggcaauggagaaugcacaggaaaga

SEQ ID NO: 128099 - RNA, 88 nt, Homo sapiens
caaaaugugguuuuaauguuguggaaagaucacuugcaaguauauaagacuguauaaagaagaggacugugugcaaguggggugaaaa

SEQ ID NO: 128100 - RNA, 48 nt, Homo sapiens
guguuuugggauugucagaucuaaacuuauauucuugcuggcuaaugu

SEQ ID NO: 128101 - RNA, 51 nt, Homo sapiens
auguuucagauggcugcccaauauguauuaucauguaauacauaucugugu

SEQ ID NO: 128102 - RNA, 99 nt, Homo sapiens
acaccaugacuucuuauagagcaagagaaaauaauauuauuauaucuuccuuugccuaaaaucucuccacuuauucuuuuuuaugauucugcaccaguu

SEQ ID NO: 128103 - RNA, 82 nt, Homo sapiens
cuugucacuggagagguuaagauagaggcucaagaacaaugcaaggaaaauggagguuuucaaacacaaaguggaugguggu

SEQ ID NO: 128104 - RNA, 108 nt, Homo sapiens
auaugaaacaacuggggauguagauaggaaagaaugucugcugcaagaguguaugaagggggauugucauuuacaaaaaaaaaguaccucauggauggaaggauucau

SEQ ID NO: 128105 - RNA, 41 nt, Homo sapiens
auuucuugaaauggguguucuguucauucaugggcaggggu

SEQ ID NO: 128106 - RNA, 76 nt, Homo sapiens
uacauuaaagaacuaaaaaaggaaaaaaaaaagccuagggcagauacaaucuaguaaaagaaaaucuuugauauac

SEQ ID NO: 128107 - RNA, 73 nt, Homo sapiens
gccacuccaucuggacauuuaaugaaacugagagacagaggcuuguuugcuuugcccucuuuuccuggucacc

SEQ ID NO: 128108 - RNA, 45 nt, Homo sapiens
gggagacuuucaccuuuugucaagaacagcccuauucccagcugu

SEQ ID NO: 128109 - RNA, 48 nt, Homo sapiens
ggcaugaaguaccuuuccucucuuaauuuuguucaccgagaucuggcc

SEQ ID NO: 128110 - RNA, 101 nt, Homo sapiens
uguaucacugaugacccucucuguaugaucacugaauacauggagaauggagaucucaaucaguuucuuucccgccacgagcccccuaauucuuccuccag

SEQ ID NO: 128111 - RNA, 48 nt, Homo sapiens
auuuucuuaaggagauaaagaucaugucucggcucaaggacccaaaca

SEQ ID NO: 128112 - RNA, 74 nt, Homo sapiens
acuugccacauauuuacuuccuaacccccugugcacaagcacuguacuuguucccaacauauacaacugucuaa

SEQ ID NO: 128113 - RNA, 48 nt, Homo sapiens
uccacuguuauccuuuuucuuauuccgauggggucggcaguccucauc

SEQ ID NO: 128114 - RNA, 70 nt, Homo sapiens
ugucagugccaaccagccuguccugguggcugugaaaaugcuccgagcagaugccaacaagaaugccagg

SEQ ID NO: 128115 - RNA, 58 nt, Homo sapiens
uucaucucugugaaguggagggaauggaaaaauucaaagacaaagauuuugcccuaga

SEQ ID NO: 128116 - RNA, 59 nt, Homo sapiens
uguggcuguggaggaguuccccaggaaacuccuaacuuucaaagagaagcugggagaag

SEQ ID NO: 128117 - RNA, 58 nt, Homo sapiens
caggaggcaacacauacucagugccugccgucaccauggaccugcucucaggaaaaga

SEQ ID NO: 128118 - RNA, 45 nt, Homo sapiens
gcuggaugaugaaaugacagucagccuuucccugccaagugauuc

SEQ ID NO: 128119 - RNA, 42 nt, Homo sapiens
cugaagcccugcccaccucuccuauggcacccacaaccuaug

SEQ ID NO: 128120 - RNA, 24 nt, Homo sapiens
uuagaaagaauguuuuuaaaugag

SEQ ID NO: 128121 - RNA, 45 nt, Homo sapiens
gugucaauaccauuuugcagauaccuggaugauguucagugagau

SEQ ID NO: 128122 - RNA, 63 nt, Homo sapiens
acguguggcccggcuaugacuaugugggcuggcggaacgagagugccaccaauggcuacauug

SEQ ID NO: 128123 - RNA, 46 nt, Homo sapiens
uucugucuaugauggagcuguuggauacagguaaauccugggaaac

SEQ ID NO: 128124 - RNA, 46 nt, Homo sapiens
ggcaucgaguuugcccccauguacaagaucaauuacagucgggaug

SEQ ID NO: 128125 - RNA, 46 nt, Homo sapiens
cugagauuccaguggaaccugaugaccugaaggaguuucugcagau

SEQ ID NO: 128126 - RNA, 46 nt, Homo sapiens
uugagggugcuuuaauuuuguccucuucauagcauaaggguacauu

SEQ ID NO: 128127 - RNA, 34 nt, Homo sapiens
ugagaugauccugauucccagaaugcucuuggug

SEQ ID NO: 128128 - RNA, 43 nt, Homo sapiens
ccccucaccucuccuacaaacucuagcaucucauuuuacagaa

SEQ ID NO: 128129 - RNA, 46 nt, Homo sapiens
agauguuaaguguuucagcccagguaaauaagugguucaaucagga

SEQ ID NO: 128130 - RNA, 92 nt, Homo sapiens
aaaauauuggauuuucuuuuccauguaaguaacaaagaacugcugcagauauuugagcagaguuguaaaaugauaugaauuuugcugugaga

SEQ ID NO: 128131 - RNA, 60 nt, Homo sapiens
gugaggacccagagugaucuggcgaacacagacugugcugggcauguggaguggagggga

SEQ ID NO: 128132 - RNA, 45 nt, Homo sapiens
aaaguuuauugagcaccugugauguguaagggacucuggaaguau

SEQ ID NO: 128133 - RNA, 44 nt, Homo sapiens
uuuuugaggauccugcuccacagagaaugcucugcacccguuga

SEQ ID NO: 128134 - RNA, 50 nt, Homo sapiens
uccgcauauacuucuuuugguguuucaggaaaaguuuuaaaaaggaaaca

SEQ ID NO: 128135 - RNA, 42 nt, Homo sapiens
ccaaacagagagcgaguuuggagcccggccaggcaucuugug

SEQ ID NO: 128136 - RNA, 26 nt, Homo sapiens
guagcuauucaauaaauauuagguga

SEQ ID NO: 128137 - RNA, 54 nt, Homo sapiens
cucccuuaauaaugauguugguuugcaaaaccuaaagaaauaauaacaacagac

SEQ ID NO: 128138 - RNA, 46 nt, Homo sapiens
aauuguaguuuuuauuuuaauguuuguaugcacaaggcccuuuagg

SEQ ID NO: 128139 - RNA, 34 nt, Homo sapiens
caaagggggucagggaguggguacaaauuugaga

SEQ ID NO: 128140 - RNA, 45 nt, Homo sapiens
ugugcuuauuugagaaaacacauuucaaaaccagaaaagccaaaa

SEQ ID NO: 128141 - RNA, 44 nt, Homo sapiens
guugucagcaccaucccugagucauuacaauagcacccugcagc

SEQ ID NO: 128142 - RNA, 50 nt, Homo sapiens
gaaguggaggaauuauguauucuauuggauuuaaaauagaauauaucauc

SEQ ID NO: 128143 - RNA, 36 nt, Homo sapiens
cucuuuuccugugcuccagaaugcagugacaccuuu

SEQ ID NO: 128144 - RNA, 43 nt, Homo sapiens
gacugaacuuuacaguugucugggguuugugaggcccagcuau

SEQ ID NO: 128145 - RNA, 43 nt, Homo sapiens
ccuaauuuuggccucccauagcucagucaaucucugucuaugu

SEQ ID NO: 128146 - RNA, 44 nt, Homo sapiens
cauugaaaauauaaaugcagauuguuaauuauauguuccugugu

SEQ ID NO: 128147 - RNA, 48 nt, Homo sapiens
cuuuuuucuguaacaguucauauguuuuugcuaggaagaagaggaguu

SEQ ID NO: 128148 - RNA, 98 nt, Homo sapiens
uuuucuuaguuuugcugauaaucacacuucauaaucauaucaacuuugaacuuugaaguuguguugaauuuuuauugcucucagcuguaucagauccu

SEQ ID NO: 128149 - RNA, 71 nt, Homo sapiens
uagagcuggacuggucaguacaguagucacuagucuugaaauguagcuaguccuaacugagaugugcugua

SEQ ID NO: 128150 - RNA, 41 nt, Homo sapiens
agaaugggaaagaaaaacaaugguuugguaaaucugacacu

SEQ ID NO: 128151 - RNA, 46 nt, Homo sapiens
ugaaggaaaauaaaucaacuuguuuauguuauuuuaaaaccuagag

SEQ ID NO: 128152 - RNA, 52 nt, Homo sapiens
aaaauauucuaacaguuucauuaaaaaggugaguggcaucauuucuugugca

SEQ ID NO: 128153 - RNA, 49 nt, Homo sapiens
cucagcugauggcuguucaauacacagaaaccacuaguaguaucaggua

SEQ ID NO: 128154 - RNA, 62 nt, Homo sapiens
agggauaguggugucccaaaauucaagcaaagaaaguuuuuaaagaaggggauguaacaguu

SEQ ID NO: 128155 - RNA, 46 nt, Homo sapiens
aaguuuaauuuguggugcuacuagcuagagagaaauaaagaggaaa

SEQ ID NO: 128156 - RNA, 28 nt, Homo sapiens
gugagagaaauuguugugguccauacug

SEQ ID NO: 128157 - RNA, 31 nt, Homo sapiens
ugaagaagcugaguacgacuggaaugcaggg

SEQ ID NO: 128158 - RNA, 48 nt, Homo sapiens
guagaaaggaccaagucaagaagaaugacaaauaaucaacagaaaacc

SEQ ID NO: 128159 - RNA, 42 nt, Homo sapiens
uuuccuuuccauugcuuaagccagaaauccugauuccugucu

SEQ ID NO: 128160 - RNA, 34 nt, Homo sapiens
uaauauuguauuagccuaucauuuaguaauuaac

SEQ ID NO: 128161 - RNA, 65 nt, Homo sapiens
agccgugauaccuauacauuuuuuuuaaugcagcuuacuuuauguuucuuuuucuaaggagagcu

SEQ ID NO: 128162 - RNA, 52 nt, Homo sapiens
gauuugggcuuuuaccaugauagaaaugggaagccaucagaagguuuugagc

SEQ ID NO: 128163 - RNA, 92 nt, Homo sapiens
uggcuuugcuaaagagagaguaguaggagaugaugucagagaggugagauacagggagaggucaauugagguaagacuucugucguuuuaaa

SEQ ID NO: 128164 - RNA, 47 nt, Homo sapiens
auucaaguuaaaaaaacauguuaaaaggcuuaacuugaagaaaagca

SEQ ID NO: 128165 - RNA, 40 nt, Homo sapiens
aaaugugccauaauuuagcaauucucuuuaggucuuggga

SEQ ID NO: 128166 - RNA, 44 nt, Homo sapiens
uucaagauguguaaagaguaaugagacaggagccaugccuucaa

SEQ ID NO: 128167 - RNA, 59 nt, Homo sapiens
gccaccucucucacuuccccaaagaaauuagacuaauguauaacaauaggcuucauaac

SEQ ID NO: 128168 - RNA, 51 nt, Homo sapiens
uguuggcagaucacuugguuggcuuuggcauacuucucuuucuaggaaaug

SEQ ID NO: 128169 - RNA, 43 nt, Homo sapiens
uuaugucccuguucaguguucuguguacuucagcacucuagua

SEQ ID NO: 128170 - RNA, 53 nt, Homo sapiens
caugcuuaucuuucuuuaaagggcuauuuaguguugccacacaucaaaccaag

SEQ ID NO: 128171 - RNA, 46 nt, Homo sapiens
ggaaaacuuuccgugacuaaaccuguccuacaaaguaccaugagaa

SEQ ID NO: 128172 - RNA, 37 nt, Homo sapiens
ugaauuuaguuggucacauuaaaaacauaacaaaguc

SEQ ID NO: 128173 - RNA, 45 nt, Homo sapiens
acaaccuugaugguuuugggugaccaggauauuauuuuauauuaa

SEQ ID NO: 128174 - RNA, 78 nt, Homo sapiens
uuuaaugaggguaaauuugauaaauuuaauuuccagauacucuuuuagcuuuguucuauuacauggucauagacaaua

SEQ ID NO: 128175 - RNA, 84 nt, Homo sapiens
cuucaauucagcccaagccuuuauugcuuccagcagcacccaagacucaaacaaacuccaguguuccagcaaaaaccaucauua

SEQ ID NO: 128176 - RNA, 37 nt, Homo sapiens
gcagguauuuaauuugacaagugcuuccauauuucuc

SEQ ID NO: 128177 - RNA, 61 nt, Homo sapiens
cucauucaaccgcugugccaggcacuguuccagaugcuggcagugaacaacagcagugaga

SEQ ID NO: 128178 - RNA, 65 nt, Homo sapiens
acagcaucuagaaugauugccuuaguuugggaaugccuagugcuaccuuuugaaggggcucacgu

SEQ ID NO: 128179 - RNA, 27 nt, Homo sapiens
uaaagauauuaaggcagaaccucagcc

SEQ ID NO: 128180 - RNA, 40 nt, Homo sapiens
acauuacagauauauauuuugagaacagagcugacagaau

SEQ ID NO: 128181 - RNA, 44 nt, Homo sapiens
uuccuuagguguucaguaaguaggauagauuuuguuggcaauag

SEQ ID NO: 128182 - RNA, 44 nt, Homo sapiens
aaaaggcuacaagcuauuuccugagugugaaaugugggcgguga

SEQ ID NO: 128183 - RNA, 45 nt, Homo sapiens
cagcgcuggacaaacccgagacggaccuacucagccaucuggacc

SEQ ID NO: 128184 - RNA, 24 nt, Homo sapiens
gcccucgcgggaagcaggaaggag

SEQ ID NO: 128185 - RNA, 43 nt, Homo sapiens
ccugggugaguccacagugaggcagcagaagagcuuugggugg

SEQ ID NO: 128186 - RNA, 43 nt, Homo sapiens
gaaauuuuccucuucauauuugguccacugcucuuuaggcaag

SEQ ID NO: 128187 - RNA, 46 nt, Homo sapiens
cauuuucgaauaccauccagccacuugccugaugcugcaacagccu

SEQ ID NO: 128188 - RNA, 60 nt, Homo sapiens
acuggaauagcccaagucauagaggaugagggcuuguccuaagacauuagugaugaucca

SEQ ID NO: 128189 - RNA, 39 nt, Homo sapiens
caacccauugaagaggguguugauaaaaggggugguuag

SEQ ID NO: 128190 - RNA, 37 nt, Homo sapiens
gaaggcaguuuuagcugggaguccuacauccucaaug

SEQ ID NO: 128191 - RNA, 44 nt, Homo sapiens
aaauugcacaagccaggaaaggacgcgucgaagcgcgggcggca

SEQ ID NO: 128192 - RNA, 47 nt, Homo sapiens
gaaaugguuuuuaaacaaccaaacaaaaagcaggaaaaacaaauggg

SEQ ID NO: 128193 - RNA, 49 nt, Homo sapiens
ccuagcuucuucauauuuucaucauauugauauuaucaaccaggugaau

SEQ ID NO: 128194 - RNA, 68 nt, Homo sapiens
agggagacccacagacacauaugcacgagagagacagaggaggaaagagacagagacaaaggcacagc

SEQ ID NO: 128195 - RNA, 58 nt, Homo sapiens
aagaaggcagagacagggcaggcacagaagcggcccagacagaguccuacagagggag

SEQ ID NO: 128196 - RNA, 43 nt, Homo sapiens
cugaccuuggcaggaguccaagcccccaggcuacagagaggag

SEQ ID NO: 128197 - RNA, 77 nt, Homo sapiens
gagcagagccuggcaccuaccugacuggcaccaucaauggagauccggagucgguggcaucucugcacugggauggg

SEQ ID NO: 128198 - RNA, 43 nt, Homo sapiens
cccaacuggcucaggugaggaguaggggggaugggagcccuug

SEQ ID NO: 128199 - RNA, 43 nt, Homo sapiens
gaaguggggcuuggaagggcaacucaauaagggggcagugggu

SEQ ID NO: 128200 - RNA, 82 nt, Homo sapiens
ggucacuauccccgcgggggccacccacauucuuguccggcagcagggaaacccuggccaccggagcaucuacuuggcccug

SEQ ID NO: 128201 - RNA, 46 nt, Homo sapiens
ccaguuguauuuauuuaguauuuauucacuuuuauuuagcaccagg

SEQ ID NO: 128202 - RNA, 44 nt, Homo sapiens
gaaauccagggugguggugauagguauaagugguguguguaugc

SEQ ID NO: 128203 - RNA, 45 nt, Homo sapiens
uuucucauuugccaauaauaauaccucccuuagaaguuuguugug

SEQ ID NO: 128204 - RNA, 48 nt, Homo sapiens
aaauaacaagaacaacugcaucaacacaaaugagugcuuaguaauaag

SEQ ID NO: 128205 - RNA, 55 nt, Homo sapiens
acucccacagaguuguucugggaacaaaugcuagaauauuuucaaaauaguaaag

SEQ ID NO: 128206 - RNA, 388 nt, Homo sapiens
uaaacccagcagaaugccuagaagaugugagauuagaauaaaauuucauaaaacaaaaacaaucgggcacgguggcucaugccuguaaucccagcacuuugggaggccgaaaugggcggaucacgaggucaggagauugagaccgaccauccuggcuaccacagugaaaccccgugucuacuaaaaauacaaaauauauauauauauauauauauauauuagccgggcauggugacaggugccuauagucccagcuacuugggagacugaggcaggagaaugacuugcacccgggaggcagagcuuacagugagucgagauugcgccacugcacuccagccugggagacagagugagacucgucucgauacaaaaacaaaaacaaaaa

SEQ ID NO: 128207 - RNA, 46 nt, Homo sapiens
gacgcaggacugcuagggauuggggaagguacuggaugugggguug

SEQ ID NO: 128208 - RNA, 24 nt, Homo sapiens
guucucacuggcauaaguaaguuu

SEQ ID NO: 128209 - RNA, 44 nt, Homo sapiens
ggcucacguugcuaguagguagggcaaaagcaagagacugggau

SEQ ID NO: 128210 - RNA, 45 nt, Homo sapiens
uggccgagaucagggaccgacauuugacuauucucacccucguga

SEQ ID NO: 128211 - RNA, 46 nt, Homo sapiens
cucuugacggaaggcuugggaggaaccagguggguaacguggccca

SEQ ID NO: 128212 - RNA, 47 nt, Homo sapiens
aacucuggugccgugcuaggggguaggggccucucccucacugcugg

SEQ ID NO: 128213 - RNA, 45 nt, Homo sapiens
cucugugaauauuuauucuauuuaugguucccgggaaguuguuug

SEQ ID NO: 128214 - RNA, 49 nt, Homo sapiens
aaucugcaguaccaaggagcccaucugccuguccagguaugauaaaggg

SEQ ID NO: 128215 - RNA, 39 nt, Homo sapiens
cuucuuguccauagauuuuuucaacucgggagggugagc

SEQ ID NO: 128216 - RNA, 46 nt, Homo sapiens
gaguugaaaaaaucuauggacaagaaguugucauugaaauuaaaug

SEQ ID NO: 128217 - RNA, 49 nt, Homo sapiens
uagaugaauguguggagauggcgacuggugggcaacagaacaauauugg

SEQ ID NO: 128218 - RNA, 54 nt, Homo sapiens
cucaggcguacugcccgccgcccgagcccugcgagggccgauagcgagggugug

SEQ ID NO: 128219 - RNA, 42 nt, Homo sapiens
guggcuccugcaucaguugguagaacagcacguagcccucgc

SEQ ID NO: 128220 - RNA, 50 nt, Homo sapiens
guuuacucccuucucccuacaagaccgaaccucagagcauccaggaaaug

SEQ ID NO: 128221 - RNA, 42 nt, Homo sapiens
agagagaaaucccauagccuccagcucucccaccuguaucca

SEQ ID NO: 128222 - RNA, 45 nt, Homo sapiens
agucccgaagaggucgagugcugcucagacacugcagcacagcau

SEQ ID NO: 128223 - RNA, 42 nt, Homo sapiens
ucuugagccguucaucaggcagaccuggccggggaggcagag

SEQ ID NO: 128224 - RNA, 42 nt, Homo sapiens
ccggguccgccccccucgagggcagaaaggccgagaccgcug

SEQ ID NO: 128225 - RNA, 45 nt, Homo sapiens
accugucccccagugaggcggcgggagaggccagccagggccagg

SEQ ID NO: 128226 - RNA, 45 nt, Homo sapiens
ucaugaacuugcccauuucagcagcaaccccucgggccuauagca

SEQ ID NO: 128227 - RNA, 48 nt, Homo sapiens
aaaguguuaaauuggaggugggagggggaagggccuaggggagaauuu

SEQ ID NO: 128228 - RNA, 44 nt, Homo sapiens
gggaggagguaauggagaaagugagagacugggaggaagaaagu

SEQ ID NO: 128229 - RNA, 46 nt, Homo sapiens
auauuggaacccuauaugcuaagguggaggcucuggaagucugagg

SEQ ID NO: 128230 - RNA, 46 nt, Homo sapiens
uggagagggcugccucuuaaccugcaugacaguauccucauauuuc

SEQ ID NO: 128231 - RNA, 53 nt, Homo sapiens
aaagguggcuaguguguuuguuuccucucaaauguagggaguuaacuucaaag

SEQ ID NO: 128232 - RNA, 44 nt, Homo sapiens
gaccacagugcuuuccuguauuuugccuuauuuuccauugcgag

SEQ ID NO: 128233 - RNA, 46 nt, Homo sapiens
ugugaaaccuacccaaucugcuuuaucugagagccucacaaucaac

SEQ ID NO: 128234 - RNA, 49 nt, Homo sapiens
uuauuuuccuuuagcaccuucauuuguacccaguaacagcaacagguga

SEQ ID NO: 128235 - RNA, 45 nt, Homo sapiens
uuuggguggggcaucugggcucucaaaacuauauauggauuacau

SEQ ID NO: 128236 - RNA, 42 nt, Homo sapiens
caaguaucuggaggagacaucaauucgcuaugugacccccag

SEQ ID NO: 128237 - RNA, 45 nt, Homo sapiens
uggaaacugaaguucugcugagggcugagcagcacuggcauugaa

SEQ ID NO: 128238 - RNA, 45 nt, Homo sapiens
ccugccugaggcauuugacuucauugcacgggacccugcagagac

SEQ ID NO: 128239 - RNA, 43 nt, Homo sapiens
ugcgagauucuggugaaaggggaaauaugcuucgagucaguaa

SEQ ID NO: 128240 - RNA, 60 nt, Homo sapiens
cuaaaugaauuccgggaaaagcacaacauucgucucaugggagaagaugagaagccagca

SEQ ID NO: 128241 - RNA, 46 nt, Homo sapiens
uuuucuacccugacucccacuucuaauuucucuuuauuguuauuau

SEQ ID NO: 128242 - RNA, 40 nt, Homo sapiens
ucgagaguguggaugagagugaaagguuuugggcggaggg

SEQ ID NO: 128243 - RNA, 45 nt, Homo sapiens
cugggccaggacgcaaaacugcccugcuucuaccgaggggacucc

SEQ ID NO: 128244 - RNA, 46 nt, Homo sapiens
uguggagguugacaaagaaguaguagaaggaaaaaaggaaccagga

SEQ ID NO: 128245 - RNA, 45 nt, Homo sapiens
cauagccuagaugagaaaacacuuguacaaauauuaacugagcca

SEQ ID NO: 128246 - RNA, 40 nt, Homo sapiens
aaauacagaugaaauaaagggucaccaucuccucaggcac

SEQ ID NO: 128247 - RNA, 54 nt, Homo sapiens
gucauccccuaauccggaaucuagguuuuuguuuuuuuuuuucucuagugacac

SEQ ID NO: 128248 - RNA, 42 nt, Homo sapiens
gcgcagaaucucaaucuuggagagcuucuugucggggggcag

SEQ ID NO: 128249 - RNA, 82 nt, Homo sapiens
ugaaaaagagaagagagaagugauagcagcggagggaggagggaaugcucagcucagaggugggaaagcagguuugagaugg

SEQ ID NO: 128250 - RNA, 35 nt, Homo sapiens
agagaggcagguggacagggugaaaggaagaggag

SEQ ID NO: 128251 - RNA, 41 nt, Homo sapiens
ucugucuucgaaauuuucagcccuugccauucccuggcccu

SEQ ID NO: 128252 - RNA, 48 nt, Homo sapiens
aggcgaaggagaccccgacuucccgggucagccccagagccacccccu

SEQ ID NO: 128253 - RNA, 42 nt, Homo sapiens
gacaucggagucggagaccugagagauguuaaccaaauucga

SEQ ID NO: 128254 - RNA, 46 nt, Homo sapiens
gcaggaaaauaauucuccagagaaggcaaauaaacaaggugagucc

SEQ ID NO: 128255 - RNA, 38 nt, Homo sapiens
uuggacacaaaauccgugugaugcuguaucccucaagg

SEQ ID NO: 128256 - RNA, 45 nt, Homo sapiens
agacaaaaagcaugacacagcuagauacagggcagcuguuauugg

SEQ ID NO: 128257 - RNA, 45 nt, Homo sapiens
acccuacuaaaaucucacagauaauuuacaguauggauuacugag

SEQ ID NO: 128258 - RNA, 60 nt, Homo sapiens
aucuuaguccuccugaaauuaguaauauuuaaauacuaaagcauuagaggcaagaagaga

SEQ ID NO: 128259 - RNA, 50 nt, Homo sapiens
uaucuuuauuuugagacaaggauuuaaauguuuagucuuauauagaggag

SEQ ID NO: 128260 - RNA, 53 nt, Homo sapiens
aauguagagaauggacuguaccugugagaccuauggaagcgcuucauguugga

SEQ ID NO: 128261 - RNA, 43 nt, Homo sapiens
aaaggucugaggaaaaaaaaccuguccccuggugcgguggaau

SEQ ID NO: 128262 - RNA, 48 nt, Homo sapiens
uaugccccuuauuguaucuggggcagaugaucgucaagugaagaucug

SEQ ID NO: 128263 - RNA, 46 nt, Homo sapiens
gguugauaccugccggggccauuacaacaauguaucuugugccguc

SEQ ID NO: 128264 - RNA, 47 nt, Homo sapiens
ggguucagacuuuccgcagagaccaugaucguuucuggguccuagcu

SEQ ID NO: 128265 - RNA, 41 nt, Homo sapiens
ccccaggccaugauggugguaugauuguguuuaagcuggaa

SEQ ID NO: 128266 - RNA, 56 nt, Homo sapiens
auauaucucuagugguuccaaguuuccaguauucaauaugucauacaauccagcag

SEQ ID NO: 128267 - RNA, 46 nt, Homo sapiens
uagcaaucuagagaauaguaccuaugaccuguacaccaucccuaaa

SEQ ID NO: 128268 - RNA, 28 nt, Homo sapiens
aaaaaauaauguauuaaggcccuuagag

SEQ ID NO: 128269 - RNA, 42 nt, Homo sapiens
acacagauucccuaauaauacaaggaaaugagggagaggggg

SEQ ID NO: 128270 - RNA, 45 nt, Homo sapiens
ggaugcuuuauguaacauucaugagaacauucgugucaagagugg

SEQ ID NO: 128271 - RNA, 46 nt, Homo sapiens; identical to SEQ ID NO: 27222

SEQ ID NO: 128272 - RNA, 52 nt, Homo sapiens
ucuggauuuacccaucuaugucacacgggugaagggcaacaauguauacugc

SEQ ID NO: 128273 - RNA, 50 nt, Homo sapiens
cuggaagcagccaaagcacuggaugacaagaacugcugggaaaagcuggg

SEQ ID NO: 128274 - RNA, 58 nt, Homo sapiens
cuuuccuuccuguaucuuaucacuggcaacuuagaaaaacuucgcaagaugaugaaga

SEQ ID NO: 128275 - RNA, 46 nt, Homo sapiens
augaagaagcugagagccuaaaggagacauuugacccagagaagga

SEQ ID NO: 128276 - RNA, 46 nt, Homo sapiens
ccagacauugacccuaaugccaagcugcuccagccaccugcaccua

SEQ ID NO: 128277 - RNA, 52 nt, Homo sapiens
aggagcacuggcugcugacauugacauugacacuguugguacagagggcugg

SEQ ID NO: 128278 - RNA, 48 nt, Homo sapiens
agguuugggggaugaugcucuuggcaagggacaggaagaaggaggugg

SEQ ID NO: 128279 - RNA, 65 nt, Homo sapiens
accauuugccgugaguacauuguggguuuguccguggagacagaaaggaagaagcugcccaaaga

SEQ ID NO: 128280 - RNA, 47 nt, Homo sapiens
uacauuucuucauccuacuuccucaucucaccaguccuccauaccua

SEQ ID NO: 128281 - RNA, 66 nt, Homo sapiens
gcagccugugcacaugauccuggugcugcguacagcccucaaucuguucuucaagcucaagaacuu

SEQ ID NO: 128282 - RNA, 47 nt, Homo sapiens
uagaaaggagcaggauguaauaaauacauuuuggugugacuaggcca

SEQ ID NO: 128283 - RNA, 25 nt, Homo sapiens
cccccuucuaccaccacggccccug

SEQ ID NO: 128284 - RNA, 27 nt, Homo sapiens
agguugggcaggccccuaugggccaga

SEQ ID NO: 128285 - RNA, 44 nt, Homo sapiens
uugugaaauaaggacuugagguugagugggggaaucucagaguu

SEQ ID NO: 128286 - RNA, 45 nt, Homo sapiens
aaggaaacacuaaguggauuagccaaaaaugccacugaccuucag

SEQ ID NO: 128287 - RNA, 43 nt, Homo sapiens
ugaugugggcuauuuugucuacucagagccugcagaaagagua

SEQ ID NO: 128288 - RNA, 341 nt, Homo sapiens
agcuuauaugugugguuguaucauuuuguuuugagacagggucuagcuccaguuggagcacaguggcacgaucuuggcucaccacagccuccccaucccaggcucaaguguuucucccaucucagccuccugaguggcugggacuacaggugugugccaccaugcuuggccaauguuuucaaaauuuuuuguagaguugagcucucacuauauugcucaggcuggucucaaacuccugagcucaagugauccucccaccucagccucccaaaaugcugggauuacaagugugagccaccacaccuggcuaaagaguguauaguuuuacuggagagauaaaa

SEQ ID NO: 128289 - RNA, 46 nt, Homo sapiens
ucaucgggaaucucuaccuccagagcaguuugaaaaauaucaggag

SEQ ID NO: 128290 - RNA, 45 nt, Homo sapiens
ugaacccuacuccauugugguuucugccacuaucaaaguuccagc

SEQ ID NO: 128291 - RNA, 53 nt, Homo sapiens
ucagacagaccauucugaauucucuaaagggaaagggcuuuugcaucuaauca

SEQ ID NO: 128292 - RNA, 50 nt, Homo sapiens
acauucuggcuuauuugagauacaugauucucuuagaauccugucccuug

SEQ ID NO: 128293 - RNA, 53 nt, Homo sapiens
ggaaaacacuguaguuaacuucuuucuggcuugggauguucuucaccaaggag

SEQ ID NO: 128294 - RNA, 43 nt, Homo sapiens
ugaguaccagcaggucccuuuuugucucucaugggccuagcau

SEQ ID NO: 128295 - RNA, 45 nt, Homo sapiens
accacucaacccccaccuggaaggggcaaagaaaagccagaguuc

SEQ ID NO: 128296 - RNA, 46 nt, Homo sapiens
aggaccugcauuuuccuacauugaggagcugacauagggguaaggu

SEQ ID NO: 128297 - RNA, 38 nt, Homo sapiens
aggaugagcuggacaccaagcuaacccguauccccagu

SEQ ID NO: 128298 - RNA, 46 nt, Homo sapiens; identical to SEQ ID NO: 27251

SEQ ID NO: 128299 - RNA, 47 nt, Homo sapiens
cagcaggguggaaucucuaggcaacccaggagagauucugggccugg

SEQ ID NO: 128300 - RNA, 41 nt, Homo sapiens; identical to SEQ ID NO: 27253

SEQ ID NO: 128301 - RNA, 120 nt, Homo sapiens
gggaugucuuccuugcaggccgacuugagcuguucuagaucuucaagggugauguuguuggucaggucuugcaggagggucccguacucagccaugacugggguugggaggcgacaaagg

SEQ ID NO: 128302 - RNA, 42 nt, Homo sapiens
gacccuccugcaagaccugaccaacaacaucacccuugaaga

SEQ ID NO: 128303 - RNA, 60 nt, Homo sapiens
guuuacucacuggcacuacccuccuacuccccacucugcccuaccaggcaugugccugga

SEQ ID NO: 128304 - RNA, 76 nt, Homo sapiens
ccuaggggaggcagucaggguagacgggaagcuaggagccaggcuggagccuagagugacaagucauaccuccuuc

SEQ ID NO: 128305 - RNA, 55 nt, Homo sapiens
aaccugcucccgacuuucucacccgcucucuccaaguccccccucagaaucgccc

SEQ ID NO: 128306 - RNA, 46 nt, Homo sapiens
gguuggaaguggguggggcgauucugaggggggacuuggagagagc

SEQ ID NO: 128307 - RNA, 43 nt, Homo sapiens
auuaauguguguaacacacucacccacaaagacuugggggcag

SEQ ID NO: 128308 - RNA, 37 nt, Homo sapiens
guugggagacagaaagagacuaaggcugcaaaugagg

SEQ ID NO: 128309 - RNA, 40 nt, Homo sapiens
ugcagcugccuaagccugaggggaggggccaucccagaca

SEQ ID NO: 128310 - RNA, 47 nt, Homo sapiens
aacccaagucagagagagaaugagaggaaugugugugagaagcagac

SEQ ID NO: 128311 - RNA, 47 nt, Homo sapiens
ggcgcgggcacuccugaguccccgguuccuaagcagcguccggaacc

SEQ ID NO: 128312 - RNA, 42 nt, Homo sapiens
ggagguuccggacgcugcuuaggaaccggggacucaggagug

SEQ ID NO: 128313 - RNA, 75 nt, Homo sapiens
cuagaggagaaucacaagaaagaguauggagagugauggaagagacacauaauagauacaaguaaguuaugggau

SEQ ID NO: 128314 - RNA, 45 nt, Homo sapiens
ccuuccuuucaucugccaaaggccagggaaacuguccaggugaag

SEQ ID NO: 128315 - RNA, 95 nt, Homo sapiens
cuguauauacugcaagggagcuugcagugauccaccacugcacgcuagccugggggacagagugauuggauauuuccagcuguggacuacuauga

SEQ ID NO: 128316 - RNA, 56 nt, Homo sapiens
aggaagggaccaggucagccaucgauucugggagaggaaacuggaggacagcuuca

SEQ ID NO: 128317 - RNA, 163 nt, Homo sapiens
aagcuuuuuuugguuggcaucaccaaaugacaggaggggaaaaaagagcuggacauuaagaggaguuggggcaaauggagaagacacgagggagcuggguaagaacaggagcuagggagggggggaaauggacuggaccaaagggaggugggagcccuuagga

SEQ ID NO: 128318 - RNA, 41 nt, Homo sapiens
gacgucuccccucccacggaccggaaaucccgccuccgcug

SEQ ID NO: 128319 - RNA, 83 nt, Homo sapiens
gcugcuggguuggcuccucacucccaacaucuaccucagcgagcucuuuggaaaguuucucuucaucagcugcgaccuccuca

SEQ ID NO: 128320 - RNA, 45 nt, Homo sapiens
aauguuaugguuuauagggcaggccauguggcuggcuccugccua

SEQ ID NO: 128321 - RNA, 14 nt, Homo sapiens
gauauguucauuug

SEQ ID NO: 128322 - RNA, 47 nt, Homo sapiens
gacugagccccacccgcgggcuccaucgcugaguccucacuggggcg

SEQ ID NO: 128323 - RNA, 47 nt, Homo sapiens
cacugcgugcccucugaguccccgaggccgcccuuuucauuccuguu

SEQ ID NO: 128324 - RNA, 124 nt, Homo sapiens
ccgugacccugccagcuguguccaggccccagcguugggcgguggaggggguuccucagcauccacuuuccacccaguggugggucugggaggccaaguuuguccugccuugggggguuggggg

SEQ ID NO: 128325 - RNA, 27 nt, Homo sapiens
gcagggagagcaggacuggguccagug

SEQ ID NO: 128326 - RNA, 64 nt, Homo sapiens
gcaguggaagacugaggugacacugaggaagaaugucucuaaggaaagaacugugggaggguau

SEQ ID NO: 128327 - RNA, 119 nt, Homo sapiens
auuagcaaggaaagacuaaacacuggcuuuucacucugggcucggaggaaggaggcuggcaagaaggacugugaggcuuacucuagugaaagaguccaagcugucuucaggcaagacag

SEQ ID NO: 128328 - RNA, 45 nt, Homo sapiens
gccccaguaaagaagauccaggccuccaccauggccuucaagcag

SEQ ID NO: 128329 - RNA, 56 nt, Homo sapiens
gcagaaggggcuguuuucuggcucccugcagagaaagagggguguguuuguguucc

SEQ ID NO: 128330 - RNA, 82 nt, Homo sapiens
caacagcaaagccugugcucuguccaaggaagggauuuacuagggcagccugugaucuccucuaaccaccacucccuuguca

SEQ ID NO: 128331 - RNA, 80 nt, Homo sapiens
cccaggaaauccaaggagaauccucggaacuucucggauaaccagcugcaagagggcaagaacgugaucggguuacagau

SEQ ID NO: 128332 - RNA, 69 nt, Homo sapiens
ccacgaaugguuaauauauauguagauauauauuuuagcagugacauucccagagagccccagagcucu

SEQ ID NO: 128333 - RNA, 69 nt, Homo sapiens
ccccaugcuuacuaauacauucccuuccccauagccaucaaaacuggaccaacuggccucuuccuuucc

SEQ ID NO: 128334 - RNA, 85 nt, Homo sapiens
gccuucugaugcuggacuggccuugcuucuacaaguaugcuucucccacagcuguggcugcaggaacuuaauuuauagggaggag

SEQ ID NO: 128335 - RNA, 44 nt, Homo sapiens
ccuggcaggggcccucguggcuucucauuuuccauucccuucac

SEQ ID NO: 128336 - RNA, 88 nt, Homo sapiens
agggguggggugaggggauggagagggagggcugccuaccauggucuggggcuugaggaagaugaguuuguugauuuaaauaaagaau

SEQ ID NO: 128337 - RNA, 57 nt, Homo sapiens
ccaggcgugcagaggcgugucuaggauaccagggcaaggcuggcccaaggaccuggg

SEQ ID NO: 128338 - RNA, 38 nt, Homo sapiens
aggcugcagauuuguuaaugucuuucucuuuggucuag

SEQ ID NO: 128339 - RNA, 25 nt, Homo sapiens
gcucaaggcaagccagggaugagcc

SEQ ID NO: 128340 - RNA, 43 nt, Homo sapiens
gugaaggcaugugguacacacagaguuguuaaaugcucugaua

SEQ ID NO: 128341 - RNA, 26 nt, Homo sapiens
cauauaacagcuauacauauagcugu

SEQ ID NO: 128342 - RNA, 46 nt, Homo sapiens
cuggcuugggucugaggcugcaaagcggacccucugcugcagaugg

SEQ ID NO: 128343 - RNA, 42 nt, Homo sapiens
cccagggggucucuuagcccuggaacacccaguggggaagau

SEQ ID NO: 128344 - RNA, 76 nt, Homo sapiens
ccgcggccgcuucccugcccggcagccccgcgccuagccagcgcuguuucaagcccuacccgcucaucacccccug

SEQ ID NO: 128345 - RNA, 44 nt, Homo sapiens
cuuuggggucuggaaucuucuaagagaaauagaaucaggcaucc

SEQ ID NO: 128346 - RNA, 44 nt, Homo sapiens
uuuugcauuugguggaaaaccucaagucagacucaguggcagaa

SEQ ID NO: 128347 - RNA, 59 nt, Homo sapiens
agagggggucuugguuucauaaauggguauauacagccugaacucaggaggcagaaauc

SEQ ID NO: 128348 - RNA, 93 nt, Homo sapiens
auggaaucugacaaaugugaaugagcugccauuggugggaaucaguaaacuuugaaaaccuuucacugaugauucccugguaagugcuccugu

SEQ ID NO: 128349 - RNA, 66 nt, Homo sapiens
uucacugccaugacacuaggcaaaaaauauuuccuguuaaaagaaagagaaaaagagagggauauu

SEQ ID NO: 128350 - RNA, 68 nt, Homo sapiens
gaagggcauucguugggaaauugaugaccggaaacuagaaagccccuauaauguggaauaugcauaug

SEQ ID NO: 128351 - RNA, 47 nt, Homo sapiens
gggagaugggaggagucgugauuuuuacuuugaauacuauuucacug

SEQ ID NO: 128352 - RNA, 29 nt, Homo sapiens
aaaaaaaaaugccuggucagcaauucacu

SEQ ID NO: 128353 - RNA, 49 nt, Homo sapiens
cucaaguccccaccgccucuucuuccucacuguccccgcccccuauuug

SEQ ID NO: 128354 - RNA, 44 nt, Homo sapiens
auagggggcggggacagugaggaagaagaggcgguggggacuug

SEQ ID NO: 128355 - RNA, 46 nt, Homo sapiens
uccuaauaaaccugauaccaagaagacaacuugagccacuuggauc

SEQ ID NO: 128356 - RNA, 41 nt, Homo sapiens
gaccucuggcugggagcgcucauucuugugacuggcaggcu

SEQ ID NO: 128357 - RNA, 62 nt, Homo sapiens
agggaccagcaggagaggucugaggggccgcucagaaaagugacgcauccuucacuucgcgc

SEQ ID NO: 128358 - RNA, 53 nt, Homo sapiens
ugcuggaaaaccaccaccgccacccagcagucagagaggaccuuucgagguga

SEQ ID NO: 128359 - RNA, 92 nt, Homo sapiens
acaggugggacccggggucggucaggaacacaucagcaaaagcuccacuugcgauccacgucugugacaaggacaccgucagcccuaagaga

SEQ ID NO: 128360 - RNA, 47 nt, Homo sapiens
ucacagacguggaucgcaaguggagcuuuugcugauguguuccugac

SEQ ID NO: 128361 - RNA, 135 nt, Homo sapiens
agugcuugcugcugagggggaacaccaggcagcgugacagugggcucggagggcagggacagaggcggcggcggcgccacccagcggccgggcgcgcgcggggcugagcugcguccggcccggcgcucacugcuu

SEQ ID NO: 128362 - RNA, 46 nt, Homo sapiens
gccccggccuggacccacccuuccgacucaagaaaauccagaaggu

SEQ ID NO: 128363 - RNA, 45 nt, Homo sapiens
ccacgaggacggaggugacgcgcuggggcuugcagaaggcgcagg

SEQ ID NO: 128364 - RNA, 53 nt, Homo sapiens
aggaguccuuccaguccugcgccuucugcaagccccagcgcgucaccuccguc

SEQ ID NO: 128365 - RNA, 51 nt, Homo sapiens
uugaggauggugcggcuccggcagcccuccucgcucaccgucugccgcagc

SEQ ID NO: 128366 - RNA, 49 nt, Homo sapiens
uccgaguuguugcugcugccguccuuguaaggcgaggggauggcgcccg

SEQ ID NO: 128367 - RNA, 46 nt, Homo sapiens
ccaccaggaacaaggacagggaaagcuuccagaacauccugcaaac

SEQ ID NO: 128368 - RNA, 60 nt, Homo sapiens
cagguccuagaucuuaucagagagaacagagcuaagacagagcugacagagcuaaaucag

SEQ ID NO: 128369 - RNA, 38 nt, Homo sapiens
accauuccugcacagcccagggcuaacuugauuugacu

SEQ ID NO: 128370 - RNA, 43 nt, Homo sapiens
aaccaccucagguaagaaucaucaucaucaucaccaucaccau

SEQ ID NO: 128371 - RNA, 206 nt, Homo sapiens
augugaaaaauaugggucaggaguuuaagacaaaauggcagcgggggcuguagaucuggaagccaucuguagaguuuaagacaaaauggcagcgggggcuguagaucuggaagccaucuguagaguuuaagacaaaauggcagcgggggcuguagaucuggaagccaucuguagaguuuaagacaaaauggcagugggggcuguag

SEQ ID NO: 128372 - RNA, 40 nt, Homo sapiens
aaggagcucaauucucaucuuccacguggggagugaguag

SEQ ID NO: 128373 - RNA, 49 nt, Homo sapiens
gucaucuccuuuguaaagcuuucccuucucuugugcuccccaugcauga

SEQ ID NO: 128374 - RNA, 45 nt, Homo sapiens
gauggaagccuccuccucgggucccuucucucucucucucucccu

SEQ ID NO: 128375 - RNA, 46 nt, Homo sapiens
gugaccuacaagcaaacuaaauagccaacauuucugaaccccuaag

SEQ ID NO: 128376 - RNA, 27 nt, Homo sapiens
acuuucucuugauuguugaaaaaucau

SEQ ID NO: 128377 - RNA, 46 nt, Homo sapiens
cuuucaguucucuaagaagauaagacaaucuauagauaagacagcu

SEQ ID NO: 128378 - RNA, 46 nt, Homo sapiens
gaaucucgauuuuauaaaggaaauacauuugaagugcuuauaaaaa

SEQ ID NO: 128379 - RNA, 56 nt, Homo sapiens
gcugagagcaauauuugaagaguaauagauaaagacacuuuuauuugaaaaagaua

SEQ ID NO: 128380 - RNA, 45 nt, Homo sapiens
accugaagcagagccaugagcugaggucauacuuuugaccuugga

SEQ ID NO: 128381 - RNA, 47 nt, Homo sapiens
ggcucagccucguagaacacgacuuggcucacugucagcucguagug

SEQ ID NO: 128382 - RNA, 47 nt, Homo sapiens
ugcuucugaaguauccacaacaaguucuacaucaaaaccucccacag

SEQ ID NO: 128383 - RNA, 24 nt, Homo sapiens
guggguucaagagcagauggucgu

SEQ ID NO: 128384 - RNA, 41 nt, Homo sapiens
uaaacuacgugaagauaauaaaacugaugaaggaccagaua

SEQ ID NO: 128385 - RNA, 42 nt, Homo sapiens
gauguuaaugcuaaagaagaaggaguagaggaagucuguuua

SEQ ID NO: 128386 - RNA, 46 nt, Homo sapiens
guuugggcuggguuuuucuauagugaagcucccuugucgcacuaau

SEQ ID NO: 128387 - RNA, 42 nt, Homo sapiens
ucuacaagcaaaggagacagaguggcacaaagugagagcaag

SEQ ID NO: 128388 - RNA, 46 nt, Homo sapiens
aaacuucuuugguaaagcaaacauuagcaaaacuucaacaacaaga

SEQ ID NO: 128389 - RNA, 45 nt, Homo sapiens
uuuucucuuuuccaggagcagagcugccuaagugaaguaggguuu

SEQ ID NO: 128390 - RNA, 91 nt, Homo sapiens
agauaggagaaaaacaagacacagaacuucaggagaaagaaacaccuacacagguauaccagaaagauaaacaagaugcugacagacccuu

SEQ ID NO: 128391 - RNA, 67 nt, Homo sapiens
uguuacaaccuuugcucuguggcucucaagagacuuuucuucauuuggaagcuggggaagaguucgu

SEQ ID NO: 128392 - RNA, 42 nt, Homo sapiens
agaaguacuggcucugcaacuuccuuggcuagccagggagag

SEQ ID NO: 128393 - RNA, 46 nt, Homo sapiens
acauaaagaucuaauaaaagauugggcucucaguucugcugcagca

SEQ ID NO: 128394 - RNA, 39 nt, Homo sapiens
uguuauuaggaguuuccacauuugaaucucuacauaaag

SEQ ID NO: 128395 - RNA, 70 nt, Homo sapiens
auaguuguuaauaugaaaaguauaguguuuaagaaacaucugauguuucuuaaugacugaucauaauggc

SEQ ID NO: 128396 - RNA, 45 nt, Homo sapiens; identical to SEQ ID NO: 27360

SEQ ID NO: 128397 - RNA, 46 nt, Homo sapiens
gugcaacucuugaggaacacuuaagacgccaccauucagaacacaa

SEQ ID NO: 128398 - RNA, 90 nt, Homo sapiens
acaaauugugauuacacguuuagcugaccauucuguuacuauauuaggaguuuuuguacuccuaacacuucaucuaguacuugagcaugu

SEQ ID NO: 128399 - RNA, 46 nt, Homo sapiens
cacaaaacaacccuccucaaaugcuaugggaaagaacagaagagga

SEQ ID NO: 128400 - RNA, 46 nt, Homo sapiens
aauuccagcaaccaucacaaauaacagaaagcacuauucaugaaau

SEQ ID NO: 128401 - RNA, 47 nt, Homo sapiens
aaaaaaaucucagucacugugacauuaaguggauauuuugggaagua

SEQ ID NO: 128402 - RNA, 25 nt, Homo sapiens
aaaaugagcuuaacauccugguuuu

SEQ ID NO: 128403 - RNA, 46 nt, Homo sapiens
cugacauuacaaaaacaauggaaguuuuuggcucuuuagcauagau

SEQ ID NO: 128404 - RNA, 69 nt, Homo sapiens
acccuagguuuaucucugucauggcaucuacuaccauucccugcaguagugaguuccuugaggcaagau

SEQ ID NO: 128405 - RNA, 50 nt, Homo sapiens
aaacagcuuuaugugacaaaaagauaaagaauaagaaagagacaaccgaa

SEQ ID NO: 128406 - RNA, 39 nt, Homo sapiens
ugaauuuggagaacacuguggcugaaggugagugaggaa

SEQ ID NO: 128407 - RNA, 44 nt, Homo sapiens
aggguuuugguacguuucgcuuccauuuuaugcaagcgaugaaa

SEQ ID NO: 128408 - RNA, 56 nt, Homo sapiens
cuugcugcugcuuccuggggcggccgcguccucucuucugaggcgcuggggcggca

SEQ ID NO: 128409 - RNA, 44 nt, Homo sapiens
gccuuugggucuuccccugggucucuuaggagagggcucaccgg

SEQ ID NO: 128410 - RNA, 64 nt, Homo sapiens
uaagagacccaggggaagacccaaaggcagcaaaaacaagagucccucuaaagcagcucaaaag

SEQ ID NO: 128411 - RNA, 47 nt, Homo sapiens
accaccgagccaaagaugcuuuuuugucuguuuucguuguuuaacag

SEQ ID NO: 128412 - RNA, 47 nt, Homo sapiens
ucauggcaaauuaacaaacuuagacgugggugauguagauggguagg

SEQ ID NO: 128413 - RNA, 46 nt, Homo sapiens
auccuucuuuuucauauuucuaccugagugaaguucauccuuagua

SEQ ID NO: 128414 - RNA, 51 nt, Homo sapiens
ugaauuaagccaucagggaaaaaacaacaaaaaaagagaacaccuccagcu

SEQ ID NO: 128415 - RNA, 51 nt, Homo sapiens
aguuguuaaggcaauuaagauaccacaaucacuguccacaucagcuguccc

SEQ ID NO: 128416 - RNA, 46 nt, Homo sapiens
ugaaggaauacaggauugggaaaugaaggaaaugggacauuucaga

SEQ ID NO: 128417 - RNA, 44 nt, Homo sapiens
ucaugcaaaagauaugauccuuuaacuaccuucaagcuuuuaag

SEQ ID NO: 128418 - RNA, 45 nt, Homo sapiens
gaaauuaugagacacaguuucuucucuggaguaaacuggcaagau

SEQ ID NO: 128419 - RNA, 41 nt, Homo sapiens
gauauucagguaucaguugacuguuuuccauuuuaauugug

SEQ ID NO: 128420 - RNA, 43 nt, Homo sapiens
cuauaucuaggagguagcuagagccaaggcaguaguggcaagg

SEQ ID NO: 128421 - RNA, 46 nt, Homo sapiens
cauaaaaauuacagauuuuggacuuugcaaagaagggaucacagau

SEQ ID NO: 128422 - RNA, 46 nt, Homo sapiens; identical to SEQ ID NO: 27407

SEQ ID NO: 128423 - RNA, 46 nt, Homo sapiens
ucagacaaugaaugauuuugacuauuugaaacuacuagguaaaggc

SEQ ID NO: 128424 - RNA, 40 nt, Homo sapiens
gugauauuucaucgugguuuugauuuguacuucccugaua

SEQ ID NO: 128425 - RNA, 52 nt, Homo sapiens
gaggguuagugugaguuagaaaaacucucuauuuuuaauauucugcccaguc

SEQ ID NO: 128426 - RNA, 47 nt, Homo sapiens
ggacuacuguuauagagagaacauuucauguagauacuccagaggaa

SEQ ID NO: 128427 - RNA, 45 nt, Homo sapiens
ugccuucuuguauguagggaaguuggaguauuguggaugggaagu

SEQ ID NO: 128428 - RNA, 45 nt, Homo sapiens
aucaugucagacauuguuuucucagggccacaguuaggcacuagc

SEQ ID NO: 128429 - RNA, 52 nt, Homo sapiens
gaagggaguuuugcaauuaauacaugcaguuacaauuuaggaaaaagaggua

SEQ ID NO: 128430 - RNA, 29 nt, Homo sapiens
ggaaaaauaggauuaauugccaaaaugaa

SEQ ID NO: 128431 - RNA, 41 nt, Homo sapiens
uauuaacagaagaguagauauaacguauuaaggguucaguu

SEQ ID NO: 128432 - RNA, 23 nt, Homo sapiens
caggauauuuugagcagaaaagu

SEQ ID NO: 128433 - RNA, 56 nt, Homo sapiens
gaacagcuaagaaaauuaagcugucuucuauuaagccagacauuaaauagauuugu

SEQ ID NO: 128434 - RNA, 40 nt, Homo sapiens
ugaagucuaaauaugucauuaauuggagaauuaauaccua

SEQ ID NO: 128435 - RNA, 44 nt, Homo sapiens
acuuugaacuuaaaugucguuaguugugaaacaaaguuauauag

SEQ ID NO: 128436 - RNA, 46 nt, Homo sapiens
ugugagccucagaugaacccccuucaauucacagggcuuuguuaag

SEQ ID NO: 128437 - RNA, 74 nt, Homo sapiens
uuagagauuuuguuauauaauauguagaaauuuaaaucugcuauaaaaguugaaaauuauuauaacgucuaugu

SEQ ID NO: 128438 - RNA, 51 nt, Homo sapiens
acguaacaccugcugugaccugcuaagcuguguaaauuuuaaugacuguaa

SEQ ID NO: 128439 - RNA, 55 nt, Homo sapiens
uauauguggcauauguauuguuuucauuaaaucgucgaaauuauauaagccaguu

SEQ ID NO: 128440 - RNA, 46 nt, Homo sapiens
uaauucucauagcaaccuuaugaggaaagcgcuaucacccccauuu

SEQ ID NO: 128441 - RNA, 48 nt, Homo sapiens
gucuagucauuguugcuuucuucuguuuuaacuucucugggccaggga

SEQ ID NO: 128442 - RNA, 46 nt, Homo sapiens
aagaugaugugaaugaucucuguuuuugaauauguucagucuaggu

SEQ ID NO: 128443 - RNA, 42 nt, Homo sapiens
uggaacauacaguuauauaugugaugaaguuaacauuaauga

SEQ ID NO: 128444 - RNA, 49 nt, Homo sapiens
aauuauccucuaauucccuuuuaauucucaaauucacuuugccguauaa

SEQ ID NO: 128445 - RNA, 51 nt, Homo sapiens
cacuagaugucacucugauucguaugguaaggcuaaccuugacacguacuc

SEQ ID NO: 128446 - RNA, 74 nt, Homo sapiens
cagaagaguuccacauaaaauggauuauaucauauaccuaggauggagacugauaagauguguauaaugaaaga

SEQ ID NO: 128447 - RNA, 43 nt, Homo sapiens
uuuuggaugggauguuuugagcauauucauagguugaaggaau

SEQ ID NO: 128448 - RNA, 305 nt, Homo sapiens
aggacaaaggcauugagcuugcuguccuuguaaaauaccgugugugcgugcgugcguguguguguguguguguguguguguauacgugcaugcaugugagaggggagagaaggugggagaaggaggcauacaguaguugcaaguuaacauaauagagaauuuuuaaaaccuuaggacacaucuaaagaugauacaaaauguauguuaaugcaagauaaaauuugguuuauuagggacagugaauuaugauuugaaauaauuggggcaaauuuaaccaaguaggguuaaagcauuacuuugaagga

SEQ ID NO: 128449 - RNA, 48 nt, Homo sapiens
cuacuccugguuuugaguaccacugcucacaguaaaaucaaaugcaga

SEQ ID NO: 128450 - RNA, 46 nt, Homo sapiens
cugagugacaccuuguucagccucaugugagaacaugggcaucagu

SEQ ID NO: 128451 - RNA, 41 nt, Homo sapiens
auauuauuuauuaauuaacauugaacucauggccaugaaca

SEQ ID NO: 128452 - RNA, 46 nt, Homo sapiens
cacccauuuuguaccaugugucaaaauuucuuuuuuuaagacugag

SEQ ID NO: 128453 - RNA, 41 nt, Homo sapiens
aauaccuugcuucugaaaaauguguguuagcuugaucaaau

SEQ ID NO: 128454 - RNA, 47 nt, Homo sapiens
guauacagaaugacauuuugaccuacugugugaaguugacagcaaac

SEQ ID NO: 128455 - RNA, 37 nt, Homo sapiens
ggggcgaugaaaaguucuggaauuaguagugguaguu

SEQ ID NO: 128456 - RNA, 40 nt, Homo sapiens
gagcaagcucuuuugggucucuucugauaagggcacuacu

SEQ ID NO: 128457 - RNA, 58 nt, Homo sapiens
uguuugacuauacuacuugauuauuauuagauauacgaauuccuuaagggcaccuuau

SEQ ID NO: 128458 - RNA, 36 nt, Homo sapiens
gucugaugguuuucuguuuauuucaccaaacauuuc

SEQ ID NO: 128459 - RNA, 39 nt, Homo sapiens
caggaugauuuuaugcuuuguguaaugucuuccaaaaaa

SEQ ID NO: 128460 - RNA, 44 nt, Homo sapiens
aauaugaccuuuuuaacuuaaaaaguaauagauacuuacuaaag

SEQ ID NO: 128461 - RNA, 40 nt, Homo sapiens
agagauaaggaaaaagaggaaacacagauuuucaggagau

SEQ ID NO: 128462 - RNA, 45 nt, Homo sapiens
acugcuggcagaacuaagaagucagacuguccuugaccccuagau

SEQ ID NO: 128463 - RNA, 44 nt, Homo sapiens
ggaagacuccaacauuaaaaaaaaaaaaaaguagacauagagag

SEQ ID NO: 128464 - RNA, 42 nt, Homo sapiens
ugaguaacuguuuccauaguuucuauacccuuugacauagag

SEQ ID NO: 128465 - RNA, 49 nt, Homo sapiens
uucuuucaaugucauucuccuguuauaaauuacgaaagcauuuucagau

SEQ ID NO: 128466 - RNA, 46 nt, Homo sapiens
agugaguggugucuuagaaguugaucuuuuuucugauacuguuaaa

SEQ ID NO: 128467 - RNA, 38 nt, Homo sapiens
uauggauuuuuaaaaauuuaugaugaggcucccaagac

SEQ ID NO: 128468 - RNA, 48 nt, Homo sapiens
augcuguuugaauguuuuaucuuccaauuaucaaacuuuugaggacau

SEQ ID NO: 128469 - RNA, 162 nt, Homo sapiens
auaauuuuucuucccuauauuagauaauuccuauauauauauggauggauuuaaaaaaauuuauaauuagggagauucccaagacagauuuuaggaggauuuuacauguauauuggaaucuauauuagaaagcuucugacuguauuugggggacuaggggau

SEQ ID NO: 128470 - RNA, 48 nt, Homo sapiens
gagaaaagcaagcaugugguagaaaacauggagaauaugucucauaaa

SEQ ID NO: 128471 - RNA, 49 nt, Homo sapiens
aacaucgaugacccuuguuucaccagcgcagcauucugagccccaggag

SEQ ID NO: 128472 - RNA, 83 nt, Homo sapiens
uggagaagccuaagaaauauaaucaaggucaucacuucaaacacaugaacaauuuacagcuccacaaaaagcuggugcaaaau

SEQ ID NO: 128473 - RNA, 54 nt, Homo sapiens
ggacacuuagcgggacuggugucaacaacuugguuugagugcuaauggcaagaa

SEQ ID NO: 128474 - RNA, 47 nt, Homo sapiens
auacgccugaaacaucacauaagaccagauuacagcgaugcucgaga

SEQ ID NO: 128475 - RNA, 45 nt, Homo sapiens
aguugaagugauaacuucagugcaggcauccauguuggcaucaug

SEQ ID NO: 128476 - RNA, 46 nt, Homo sapiens
accaccugacaucagagguuugcauccaaaaggccucaacagaaac

SEQ ID NO: 128477 - RNA, 43 nt, Homo sapiens
uguuaucuucuaugccuggggaugggaaaaugcaggcagguaa

SEQ ID NO: 128478 - RNA, 47 nt, Homo sapiens
gcauagaagauaacauauuaugccccaacugugcuaagaggaauaag

SEQ ID NO: 128479 - RNA, 46 nt, Homo sapiens
aaaugcagacugagauuuaguggguagccagugagcacuugcuagg

SEQ ID NO: 128480 - RNA, 52 nt, Homo sapiens
caaauuuggcaggcgacauaaaccuguagauuuaagaagcuaagcaaacccc

SEQ ID NO: 128481 - RNA, 70 nt, Homo sapiens
cccuucucauuugauuuuauugcaguauuuuacccauugagcaucuuuuuagcuuuuucugcaucucaac

SEQ ID NO: 128482 - RNA, 63 nt, Homo sapiens
guguguguguguguguguguguguguguaggcauuuccaccagagacaauucugcauauacag

SEQ ID NO: 128483 - RNA, 49 nt, Homo sapiens
aaaagaggcaugcccaacuuucugucgguuuaaauacuuuccucccagg

SEQ ID NO: 128484 - RNA, 51 nt, Homo sapiens
aaauaggggcagcuuauuuuuuccuuucuauucuauauccuguuauuuuuu

SEQ ID NO: 128485 - RNA, 46 nt, Homo sapiens
auuuuauuugguuucuuagaaaccaggaaguaacuaccaguccaug

SEQ ID NO: 128486 - RNA, 39 nt, Homo sapiens
aagcacgagcgcgcgugugugugugcacacgcacgugug

SEQ ID NO: 128487 - RNA, 50 nt, Homo sapiens
uuguugauacugcuguuuguggugagagaaaccaggccaacacuugugau

SEQ ID NO: 128488 - RNA, 55 nt, Homo sapiens
gccuccccucccuccuccaagaaaggcagugagcuuuaggaaacugauaucuguu

SEQ ID NO: 128489 - RNA, 43 nt, Homo sapiens
acauuuguuuguguugaccaguguguaugagcaauauauauga

SEQ ID NO: 128490 - RNA, 47 nt, Homo sapiens
gauuuucaggauuucauucaucauucuacuauuuuaaagccucauau

SEQ ID NO: 128491 - RNA, 46 nt, Homo sapiens
ucagauaguuuucugugcuuuguugucagaaaaaaugggggcaggu

SEQ ID NO: 128492 - RNA, 42 nt, Homo sapiens
gaggaagccaaacagccucugggugaguggauaaacuccauc

SEQ ID NO: 128493 - RNA, 42 nt, Homo sapiens
ucuuguggguucucggaaaauacgaaucgcauucaaagagau

SEQ ID NO: 128494 - RNA, 42 nt, Homo sapiens
auauaacaagaacauauauaaaauuucuauucggaucaaaaa

SEQ ID NO: 128495 - RNA, 47 nt, Homo sapiens
cuguuagugcagcuuuaaauaagcaggacuugcugagcaugcugaaa

SEQ ID NO: 128496 - RNA, 69 nt, Homo sapiens
ccuuaguuccacuuccguagugcugccugucacacagucuuacaugccaacagcacagaacccaaauca

SEQ ID NO: 128497 - RNA, 63 nt, Homo sapiens
caaaccccagcaaccuuccuaucagaauuucaggucuguuuucauggacaacauauacuuuac

SEQ ID NO: 128498 - RNA, 74 nt, Homo sapiens
agaaaacucaguuuaaaauagaaugaaggagggacaaaucagaacaaaggcauuuacaauuuguugcacaauca

SEQ ID NO: 128499 - RNA, 75 nt, Homo sapiens
cagacuacagacuuuucuuuuuuuguuuuagaauaauuggaggaacacuggcuuuuuuuccagugagauacaaaa

SEQ ID NO: 128500 - RNA, 45 nt, Homo sapiens
ugcaaaagcagagaacaugggagacagaacuguagauugagcaga

SEQ ID NO: 128501 - RNA, 44 nt, Homo sapiens
guguauuagggaugguaggugaccaaaugugguuccacuuucuc

SEQ ID NO: 128502 - RNA, 56 nt, Homo sapiens
aagcuacuuuaaggguucaauuagauaauuagauaauauauguauagauugggaga

SEQ ID NO: 128503 - RNA, 34 nt, Homo sapiens
aagccacaggauauuauacaaagaguacagaguu

SEQ ID NO: 128504 - RNA, 337 nt, Homo sapiens
uuauaaaaucuagugaaaauaaauuauuagaaaaaugaagggcugggugcaguggcuuacgccuguaauuccaugggaggucaaggaggaaggauugcuugagcccaggaguucaagaccagccuggguagcauggcgaaacuccaucucuacaagaaauacagaaaauuagccaguguggugguacaugccuguagccccagcuaccugggaagcugaggggugggaggaucacccaaaccugggagguugaggcugcagugaguugugaucaugccacugcacaccagccuugguggcacagugagacccugucuuuuuuuuuuuuuuuaaagcc

SEQ ID NO: 128505 - RNA, 44 nt, Homo sapiens
gggugauguaauaauccagggaagagauaacagugguagccuga

SEQ ID NO: 128506 - RNA, 80 nt, Homo sapiens
gauuggcuuggcucuuucuuaagcaacuacuaagaugcuccuacauuuggguuugaacguuuuuuauucucuuggcuaug

SEQ ID NO: 128507 - RNA, 45 nt, Homo sapiens
uauuugaaauaggcuguguagaauucaguaauugggggagggggc

SEQ ID NO: 128508 - RNA, 27 nt, Homo sapiens
aagcuagagggaaagaaaggaucaugu

SEQ ID NO: 128509 - RNA, 52 nt, Homo sapiens
aaucaucaaacccugauuccuuuagugaauauauucuguuuugcauuuagau

SEQ ID NO: 128510 - RNA, 43 nt, Homo sapiens
cugucuggccacgaaaccuaaaaucauauggcuuguuuaguug

SEQ ID NO: 128511 - RNA, 45 nt, Homo sapiens
uucguucagggaacaguaacuuucccauagguauuucccaggguu

SEQ ID NO: 128512 - RNA, 25 nt, Homo sapiens
cuaugaugcagaauauuaucaauga

SEQ ID NO: 128513 - RNA, 39 nt, Homo sapiens
gaagaaguuucaauuuucuucugaaguagcagaaaacca

SEQ ID NO: 128514 - RNA, 37 nt, Homo sapiens
gaauuauuauaaauggugguaaguggagggcaaauaa

SEQ ID NO: 128515 - RNA, 40 nt, Homo sapiens
ggaggucagggagacuuuuguuuauguuuuaagaugacaa

SEQ ID NO: 128516 - RNA, 43 nt, Homo sapiens
ggauggaagugguguauggagaacauucucuuaagaaccuaca

SEQ ID NO: 128517 - RNA, 53 nt, Homo sapiens
agacaguuaagagguggauuggacccaccucugaacugugauugugcuugaga

SEQ ID NO: 128518 - RNA, 42 nt, Homo sapiens
ucucaaguaucugcuucccucagcucccuucauucuucuaau

SEQ ID NO: 128519 - RNA, 52 nt, Homo sapiens
aaauacauguuuauuugcuguauccaccuauaccaguuuucuuuaaaaauac

SEQ ID NO: 128520 - RNA, 28 nt, Homo sapiens
aagaaucaugucucuguaggagcuauca

SEQ ID NO: 128521 - RNA, 46 nt, Homo sapiens
uuauuauuguuuccgucuucaaaccacagcucgcagagccagcgac

SEQ ID NO: 128522 - RNA, 45 nt, Homo sapiens
gcaaugaccccuguuugacuaucauuuguaguucaaaaagaggau

SEQ ID NO: 128523 - RNA, 46 nt, Homo sapiens
ggaugagaagucaacuuuuccccauuuuuccuugucuuuccuauuu

SEQ ID NO: 128524 - RNA, 37 nt, Homo sapiens
aaacuguuaaugccuccuggaaggugaaaucacaaac

SEQ ID NO: 128525 - RNA, 40 nt, Homo sapiens
cagcauuccaguuagcaagaaugacugcuuaggccucgau

SEQ ID NO: 128526 - RNA, 33 nt, Homo sapiens
ucucuaaagcucaguucaaaagucaugagauga

SEQ ID NO: 128527 - RNA, 32 nt, Homo sapiens
aacucuuuauauacagacgaggaaaccaagau

SEQ ID NO: 128528 - RNA, 41 nt, Homo sapiens
aaagcauguucuuguguauguauaaaauaacaucccaagaa

SEQ ID NO: 128529 - RNA, 46 nt, Homo sapiens
uuuuuaggaugcaaauccaugcugaaaccuccaaauuuccacgguc

SEQ ID NO: 128530 - RNA, 47 nt, Homo sapiens
uauuccuaaaggugaaugugcgaacaggcuucccuguaccuggagau

SEQ ID NO: 128531 - RNA, 48 nt, Homo sapiens
cuuuauucguagaacuguugaauuagaagaaaacuggaauauauaaua

SEQ ID NO: 128532 - RNA, 48 nt, Homo sapiens
auuucaaagugaaaagaacacuagcuuguaguuuauggcccuaaucuc

SEQ ID NO: 128533 - RNA, 23 nt, Homo sapiens
cugugaacuauuuuugugugugu

SEQ ID NO: 128534 - RNA, 49 nt, Homo sapiens
cuuugaaaugcauuuuaauuagccuugguuuuuuuuuccuguuaucuau

SEQ ID NO: 128535 - RNA, 41 nt, Homo sapiens
ccuuguacuggcuuuugaaagacaaucuuccaaauguuuga

SEQ ID NO: 128536 - RNA, 46 nt, Homo sapiens
gcauuuuaagugccauaaggaugcuuaggaauaugggucaaguguu

SEQ ID NO: 128537 - RNA, 47 nt, Homo sapiens
gaaagugccaugcuuucugagaacugcauuuaauaguucaguuugac

SEQ ID NO: 128538 - RNA, 50 nt, Homo sapiens
accucaggggaacccugcugaaguugugacauuuauucagucaagaagua

SEQ ID NO: 128539 - RNA, 41 nt, Homo sapiens
uaagcugccuuuuauuagcccgguuugaaugacuguguucg

SEQ ID NO: 128540 - RNA, 59 nt, Homo sapiens
uaaacuggaggaugcuuaguaagaccuauuuguucaggucucuaugucacugcauguuu

SEQ ID NO: 128541 - RNA, 42 nt, Homo sapiens
cgaagaagcaguuaaacgugagcuuguuucauaguagguuug

SEQ ID NO: 128542 - RNA, 50 nt, Homo sapiens
aaagguaugcuguggugggguguccauauaauuugugguccaaagcagaa

SEQ ID NO: 128543 - RNA, 47 nt, Homo sapiens
uuuucauggugugcaaaagaaauauaacaugaaaaucuggaucaagu

SEQ ID NO: 128544 - RNA, 47 nt, Homo sapiens
guguucucucuguuucuuccaugcccauuuaaugaccaacguucagc

SEQ ID NO: 128545 - RNA, 34 nt, Homo sapiens
guuugaagaagauggugcccgagcagaagaggau

SEQ ID NO: 128546 - RNA, 42 nt, Homo sapiens
cguuaggaucaucucaucagcuuccugaauguugcugcagau

SEQ ID NO: 128547 - RNA, 41 nt, Homo sapiens
uacuagucauuguacuguuaacaguuauuuaaugauuuaau

SEQ ID NO: 128548 - RNA, 58 nt, Homo sapiens
gagaaagaauuggcugcaccaacaggaggaggggaaaggaccuucugagaaagagaag

SEQ ID NO: 128549 - RNA, 57 nt, Homo sapiens
uaaaacaaacaaaccuggagaccaggagaucaauuaucaguaguuugguaauaauug

SEQ ID NO: 128550 - RNA, 45 nt, Homo sapiens
augucauuaugagccacgcauuaugccaagugcugaagauacaga

SEQ ID NO: 128551 - RNA, 78 nt, Homo sapiens
uuuugcaccuaauaggugauggguacauguuaggaaguuggcucuauucaaaccucgccuucuuuguggacagcaucu

SEQ ID NO: 128552 - RNA, 24 nt, Homo sapiens
ccaauauuguacuugcaacucauu

SEQ ID NO: 128553 - RNA, 48 nt, Homo sapiens
cauguaacuacugcuuuuaauccaaacagcauuuucuuuuugugauua

SEQ ID NO: 128554 - RNA, 46 nt, Homo sapiens
ugccuguguccaaguguuuuaucucuuuccauuaaagucagcaguu

SEQ ID NO: 128555 - RNA, 47 nt, Homo sapiens
acaccuuuuauaucuuacuuugccaaagguaucauucacuuaguaag

SEQ ID NO: 128556 - RNA, 52 nt, Homo sapiens
uauuccuuuuggguugccauuuugaaacaagaaacguauggaaauaagggac

SEQ ID NO: 128557 - RNA, 45 nt, Homo sapiens
uagguaauaaccggaauggauuuggaagaauggauucugucagcu

SEQ ID NO: 128558 - RNA, 44 nt, Homo sapiens
ucuuuuaaagaguaucuaaauuaauaaacauugaguacagaaac

SEQ ID NO: 128559 - RNA, 45 nt, Homo sapiens
uugacaaaaaugaacaagaaauguuaaugcccaaaucuuagggag

SEQ ID NO: 128560 - RNA, 45 nt, Homo sapiens
uuaaagagucaaauguuacuuuuuuguuacgguaucaauucaguu

SEQ ID NO: 128561 - RNA, 32 nt, Homo sapiens
auagagaagucgagagaugggaagauuaagug

SEQ ID NO: 128562 - RNA, 73 nt, Homo sapiens
guuauuaauuuaaaacagccagccaaauaguagaagcuucuuucucaucuguaauguccugaccucauuuuac

SEQ ID NO: 128563 - RNA, 24 nt, Homo sapiens
ccuuucacugucuuugagcuguac

SEQ ID NO: 128564 - RNA, 41 nt, Homo sapiens
cauuaaaaaucacuucuuuagccucuccugugucuuuaaaa

SEQ ID NO: 128565 - RNA, 83 nt, Homo sapiens
auaauccagguaugcgauguuguauuacagugaccugcagggucaugacuuagugagaggcauucuuugucaacacagggaaa

SEQ ID NO: 128566 - RNA, 28 nt, Homo sapiens
aguaugacugguguccuuguaggaagag

SEQ ID NO: 128567 - RNA, 30 nt, Homo sapiens
gugguacagccuauucauagagaauaggug

SEQ ID NO: 128568 - RNA, 47 nt, Homo sapiens
guccagucccugucucuuauuaaugugauuccugugaaaacuugaga

SEQ ID NO: 128569 - RNA, 48 nt, Homo sapiens
cauucuuggaugcuauggaagugccuguaacaccugaaugguucugcg

SEQ ID NO: 128570 - RNA, 47 nt, Homo sapiens
aaucaucauauauuauuugaccuuuagcugaauccaguaguaaagau

SEQ ID NO: 128571 - RNA, 58 nt, Homo sapiens
guguaauggagagcauccucuuaggacugugacucucaaacuuuagggcacauuggaa

SEQ ID NO: 128572 - RNA, 54 nt, Homo sapiens
cauuucaacuggaaugaacaaaaauagaaagcucagcagcagcauuuuuuagag

SEQ ID NO: 128573 - RNA, 31 nt, Homo sapiens
guuagcuaaauguuucuagugagaaagcuag

SEQ ID NO: 128574 - RNA, 79 nt, Homo sapiens
uuugguauguuuuuaacuuuacucaugucagaguguacguauucuugucuacuuucuuuuuuugaccuaguauucugag

SEQ ID NO: 128575 - RNA, 37 nt, Homo sapiens
gucaaaauagcagauucaacccuaugugaauugugau

SEQ ID NO: 128576 - RNA, 83 nt, Homo sapiens
uuugugaaaagaguaaugauaaaaguuuugacuucuucuuaucaaggaggauuucauaaauuaaggaaggauauauucaugaa

SEQ ID NO: 128577 - RNA, 56 nt, Homo sapiens
uaagggaagaguuaaugaagaaggaggaaaacagagaagggguaguaguccuacaa

SEQ ID NO: 128578 - RNA, 41 nt, Homo sapiens
agaaugcuuguaaauagaagaaucuaaauccucuuacagau

SEQ ID NO: 128579 - RNA, 85 nt, Homo sapiens
gaggacagaguccuuuugccagucuuguucucucugguaggcaguguaugaaaaaagauaaaacagaacccccaaagaaaccugu

SEQ ID NO: 128580 - RNA, 45 nt, Homo sapiens
guuuuaaauagugauuuuuauuuucaguccagugauccauuucau

SEQ ID NO: 128581 - RNA, 37 nt, Homo sapiens
cuauuagugaaauguuugacuuuuaguuuuuacuaag

SEQ ID NO: 128582 - RNA, 40 nt, Homo sapiens
gcaugcaucaaauccuauuuauaaagugguauuauccaaa

SEQ ID NO: 128583 - RNA, 39 nt, Homo sapiens
gaugguuucaaagcuauuuugccauuaauaaggcauuua

SEQ ID NO: 128584 - RNA, 39 nt, Homo sapiens
cagguucuuggucuauuuagccguaguggaauuuaugaa

SEQ ID NO: 128585 - RNA, 46 nt, Homo sapiens
acugaaaauaguguacugaauucagcuguuuucuucagguagcuau

SEQ ID NO: 128586 - RNA, 39 nt, Homo sapiens
auauguuucuucauacugcuuacugucuaugugaccuug

SEQ ID NO: 128587 - RNA, 49 nt, Homo sapiens
guacccagugauaaguuaauauguaauaaagucuugcuauaagugaauc

SEQ ID NO: 128588 - RNA, 71 nt, Homo sapiens
gcuaacacagaacagaagauucucaaacccaauagcuugaggagaaaauccaucuucucauuaacuggaag

SEQ ID NO: 128589 - RNA, 46 nt, Homo sapiens
aguugguccugguaggaugaauauaaaguugcccgauuaaaaaaag

SEQ ID NO: 128590 - RNA, 47 nt, Homo sapiens
uaccaaaacauucuauacucaauauauuaauacucuaauaauaauaa

SEQ ID NO: 128591 - RNA, 31 nt, Homo sapiens
cuuaaagaaugacaggauuucaacaggcaga

SEQ ID NO: 128592 - RNA, 52 nt, Homo sapiens
uaauuagauucaguuacgugcuuauuauucuuuacugauucuaauuuaguaa

SEQ ID NO: 128593 - RNA, 38 nt, Homo sapiens
agccaguuucagagaaaacaaaggaaacugggaggcuu

SEQ ID NO: 128594 - RNA, 66 nt, Homo sapiens
uauuuaccaugugcuaaucacuuuacacauacuggcuuauauguacaucuccauauuagacauaug

SEQ ID NO: 128595 - RNA, 54 nt, Homo sapiens
uuuuucacaucauuuggucuuguagauauguuacaaaaacagaaaggaauuuaa

SEQ ID NO: 128596 - RNA, 42 nt, Homo sapiens
uaacauauguugaagcagaagucucaucugcuagaagcaaca

SEQ ID NO: 128597 - RNA, 47 nt, Homo sapiens
ccucuaguuacuguaauuaaacauacacagguauauaugaaugagga

SEQ ID NO: 128598 - RNA, 45 nt, Homo sapiens
aggaacauuuaaggggcaagcugaaaaagagaagccagcaaaggc

SEQ ID NO: 128599 - RNA, 45 nt, Homo sapiens
ccauggaucuuuaaauguuggcaucucucaaagaugguccuuguu

SEQ ID NO: 128600 - RNA, 39 nt, Homo sapiens
agacacaucaguugcccuuggggaauucacaauacaaua

SEQ ID NO: 128601 - RNA, 43 nt, Homo sapiens
ucuauguuuaucauuuugcuauaaagauaauuagaaguaauua

SEQ ID NO: 128602 - RNA, 48 nt, Homo sapiens
aacagaaauauaaaauacaugcagacaagaaaauaaaagcaggcacuu

SEQ ID NO: 128603 - RNA, 44 nt, Homo sapiens
uuauucuaccaaguacuuuaauguguacuuucacauuaucuucu

SEQ ID NO: 128604 - RNA, 47 nt, Homo sapiens
auugcccucaaacuuuaaauuaugauuuggcuguuucuauugcaaau

SEQ ID NO: 128605 - RNA, 44 nt, Homo sapiens
acaugccacaucucucuacucugcucacaacagcugcuagaaua

SEQ ID NO: 128606 - RNA, 40 nt, Homo sapiens
acaugagccauaggaaggaggaauuuuucuaggggugggu

SEQ ID NO: 128607 - RNA, 55 nt, Homo sapiens
cccacuucuuagcaccaguguuagucugacucugacucuuagcaccaguguuaau

SEQ ID NO: 128608 - RNA, 46 nt, Homo sapiens
ucaggcaacucguaaugacauuucaacauuucaugagagaagaaau

SEQ ID NO: 128609 - RNA, 43 nt, Homo sapiens
aaucagagaagcuuuacucauuuuaugaucuggagucaaguaa

SEQ ID NO: 128610 - RNA, 45 nt, Homo sapiens
agacuccguucgacuucuuggcagaguugucuucaaacuugugag

SEQ ID NO: 128611 - RNA, 45 nt, Homo sapiens
auucagaaggcugucaucccuauuuugagucuucugaaccacguu

SEQ ID NO: 128612 - RNA, 42 nt, Homo sapiens
aacaaagagauuuuauauuuggggguguguuagcccuccuga

SEQ ID NO: 128613 - RNA, 59 nt, Homo sapiens
auccuguauuggaaguaauguaagaaaauaggaaaaaauguaaaucaggaagguugucu

SEQ ID NO: 128614 - RNA, 32 nt, Homo sapiens
auuugcugguuaaauuaucucagggaaaacac

SEQ ID NO: 128615 - RNA, 48 nt, Homo sapiens
gaugcucucagugccgcgucgccaaauacuguagugcuaagugucagg

SEQ ID NO: 128616 - RNA, 70 nt, Homo sapiens
uuuguuauugauguuuuccaggguggggaguggugauuagguuuuacuguccuacuuuuuuuuuaugggg

SEQ ID NO: 128617 - RNA, 34 nt, Homo sapiens
auaauggcuuugaaauaaaauguugaaaugcaag

SEQ ID NO: 128618 - RNA, 46 nt, Homo sapiens
ggaauuacuuucuaaucacuucauauucaauauuacauuagcccau

SEQ ID NO: 128619 - RNA, 42 nt, Homo sapiens
aaguggaaugauuaacuuucuaauugauguauggugguguag

SEQ ID NO: 128620 - RNA, 42 nt, Homo sapiens
uguaggcuguuccugugggaagcuguaggugagccaacuaaa

SEQ ID NO: 128621 - RNA, 33 nt, Homo sapiens
acuaauugauuuuauucugguuguggaaauaaa

SEQ ID NO: 128622 - RNA, 135 nt, Homo sapiens
uuuccaaacacaggucucacguucaaagagauuauagaacuugcauaagguaaucgcuggagaagucagauuuccaaacccaggucuuccuggcuccaaagcaggucccuccugccccauaucacacugucucag

SEQ ID NO: 128623 - RNA, 389 nt, Homo sapiens
uuaucaguugaaacucagucuuugggagucugggaugucccuauaguucuguugaugaguuuuuuuuuuuugagauagaguuucgcuuuuguugcccaggcuggagugcaauggugcgaugucggcucaccucaaccuccgccucccggaggcguucaagccauucuccugccucagccuccugaguagcugggauuacaggcaugugccgccacgcccggcuaauuuuguauuuuuagcagagaugggguugcuccauguuggucaggcuggucucgaacucccgaccucaggugaucugcccaccucggccucccaaagugcugggauaauaggugugagccaccaugcccggccuguugaugagauuuuacaugaacuaguuuggg

SEQ ID NO: 128624 - RNA, 50 nt, Homo sapiens
ggugacuacagagcucaaugugccuauuuucagucacaaacuugauuuca

SEQ ID NO: 128625 - RNA, 53 nt, Homo sapiens
acuuggacuugacugugucuuuauuuaaaaaaacaaacaaaaaaugcuggguc

SEQ ID NO: 128626 - RNA, 47 nt, Homo sapiens
uauauauaugcacauacauaugcacuauauauauacacacauaugca

SEQ ID NO: 128627 - RNA, 43 nt, Homo sapiens
gcccaaaaugaaauccgaguggaacaguaagcagagcgccagu

SEQ ID NO: 128628 - RNA, 30 nt, Homo sapiens
uaaaaggucagaaguucagguaguuauuag

SEQ ID NO: 128629 - RNA, 51 nt, Homo sapiens
agagcugaucaagugagagagagaauuacaguguaccagaagggcugaaau

SEQ ID NO: 128630 - RNA, 92 nt, Homo sapiens
aaucaggcuccccugcagaggccccgccgguaaagcaucaggcuugcagcagguggaagaaucuugaugucuacggugcaccucuguggucu

SEQ ID NO: 128631 - RNA, 28 nt, Homo sapiens
cuuccuuggugcggcuguggaaaucaca

SEQ ID NO: 128632 - RNA, 61 nt, Homo sapiens
cuuggcguacacggugugcaaggggagucguggcgucgucugcgaccgcugccuucucggg

SEQ ID NO: 128633 - RNA, 46 nt, Homo sapiens
gaggugccggagcugcgggaggauggagccgcugaagguggaaaag

SEQ ID NO: 128634 - RNA, 55 nt, Homo sapiens
uuuauucacaauugaauaaaaugaaaacuucaauuaauuguggauuugaucagau

SEQ ID NO: 128635 - RNA, 45 nt, Homo sapiens
acaugcacccucaagacuucaaaacacuuuuugaaacuauagagc

SEQ ID NO: 128636 - RNA, 46 nt, Homo sapiens
uagaaguaaauauguuuauuggugaaaaagaauuccagguauguua

SEQ ID NO: 128637 - RNA, 45 nt, Homo sapiens
aaccggauuucaggaauccgccaaggaaggcgucuaaggccagcu

SEQ ID NO: 128638 - RNA, 49 nt, Homo sapiens
ugcgcaggcucuaguguuuacuuccgcuugaccuggcccggacgccaga

SEQ ID NO: 128639 - RNA, 80 nt, Homo sapiens
cagcccgcgaaggcacucucgggggcguguggcucugagguggccggggaggucgcaggcggcggccggagcgcagagga

SEQ ID NO: 128640 - RNA, 82 nt, Homo sapiens
aggcagcguugcaaggggaaggacccagaagcgcggcgggagcagcgacugcguuuuagccgcugagcggucugcaggccua

SEQ ID NO: 128641 - RNA, 51 nt, Homo sapiens
gguuuauuuuuaaaaccauaccuuuuaaaauuuagguucagauaauaguaa

SEQ ID NO: 128642 - RNA, 44 nt, Homo sapiens
uuuuugucauuuaguauucuuuccuaucugcgaagcuaugggag

SEQ ID NO: 128643 - RNA, 172 nt, Homo sapiens
augauacugguuacuggcauucaugauggaauagcauaggagugaugcuguugauaaaauuacaucuaggaaaaauucccuauaaaguagagugaacuuagguauaaugaacuagugcuguuaaccccuaaagucuuugaaauacuugauguucauuaguaauuuuuuuguu

SEQ ID NO: 128644 - RNA, 57 nt, Homo sapiens
cuaagucuaaccagcauuuaaaaaaaauuaaagacuagaauagaaaauauaaaguac

SEQ ID NO: 128645 - RNA, 45 nt, Homo sapiens
gaagaggagacaugggggagggagaaaaagagaaugaguagggag

SEQ ID NO: 128646 - RNA, 56 nt, Homo sapiens
cuaucaagagcaaaagugggguagacuucuugguuuaguggcucuauaguauuauc

SEQ ID NO: 128647 - RNA, 24 nt, Homo sapiens
ugggaagugcagugaucuuaacaa

SEQ ID NO: 128648 - RNA, 29 nt, Homo sapiens
aaagucaauucaauaaauuuuuuaaaugu

SEQ ID NO: 128649 - RNA, 43 nt, Homo sapiens
uacaggcauggggaaccagccacaggagacugaccagcuggag

SEQ ID NO: 128650 - RNA, 56 nt, Homo sapiens
uuuguguaaaaccagagcagccaaucacgagaaagcguucuaaugauugauuaaaa

SEQ ID NO: 128651 - RNA, 45 nt, Homo sapiens
acaaaugcgauuacauagagaagacuuugaaauauuaaaggugau

SEQ ID NO: 128652 - RNA, 41 nt, Homo sapiens
guaacaauaauagguagucgagggaaugggguagacaggag

SEQ ID NO: 128653 - RNA, 49 nt, Homo sapiens
cuuauuuauguguuuaauguuuguguucaccaauaaagugcaaucucug

SEQ ID NO: 128654 - RNA, 37 nt, Homo sapiens
augggggugacguuuuuguucauauuuuuguucuugg

SEQ ID NO: 128655 - RNA, 45 nt, Homo sapiens
aaguaugcucuaaaaauuuucuuuuuguguuucagacagcauguu

SEQ ID NO: 128656 - RNA, 85 nt, Homo sapiens
uuaagaaacacccauuuuucaguggaauugauugggauaauauucggaacugugaagcaccuuauauuccagaaguuaguagccc

SEQ ID NO: 128657 - RNA, 26 nt, Homo sapiens
uagcuaauauugaaccauugcucuga

SEQ ID NO: 128658 - RNA, 72 nt, Homo sapiens
gaacagucacaauuuuuuuuuaaauauuucuuuuuggcauuuuauauuuauagccaagccuacagaucauau

SEQ ID NO: 128659 - RNA, 42 nt, Homo sapiens
aaauagcugacuauucuuacuggucuacuuuaaauucaugau

SEQ ID NO: 128660 - RNA, 44 nt, Homo sapiens
agacaaaucaaggcuuaugaaaaacaaaucaaaacguuacaaca

SEQ ID NO: 128661 - RNA, 46 nt, Homo sapiens
agacgcacacugucagaggaaacuggccaugcaggaauucauggag

SEQ ID NO: 128662 - RNA, 79 nt, Homo sapiens
guucauacagaagcucuagcugcugaagcaucuaaagacaggaagcuacgugaacagagugagcacuauucuaagcaac

SEQ ID NO: 128663 - RNA, 79 nt, Homo sapiens
cuauagcaaaaacaaauuaguuacucaccaggaguaugcagcauagaacaucagcaagagauaaccaaacuaaagacug

SEQ ID NO: 128664 - RNA, 72 nt, Homo sapiens
ugcaugauucagaaggucagcaacuugcucucaacaaagaaauuaugauuuuaaaagacaaauuggaaaaaa

SEQ ID NO: 128665 - RNA, 47 nt, Homo sapiens
cuaaaggagaccaaagucaggauuggcagauagaaaauuauaauaca

SEQ ID NO: 128666 - RNA, 83 nt, Homo sapiens
aaguaaaacauagaauacauuagauaaugauaaaugcuaagaacaaaaaaguaagaggaaauccguucuaugaagcauucaag

SEQ ID NO: 128667 - RNA, 56 nt, Homo sapiens
aaacaagaagagauguuuauacagaugugugaaaagagcauucuacauggagaaga

SEQ ID NO: 128668 - RNA, 50 nt, Homo sapiens
aagggaggaauuugaaagugaguucaaacaacaauaugaacgagaaaaag

SEQ ID NO: 128669 - RNA, 46 nt, Homo sapiens
acacaaccagcaguuagaagaagagguuaaagaucuagcagacaag

SEQ ID NO: 128670 - RNA, 42 nt, Homo sapiens
augacugaagaauuggaggcauuaagaaauuccagcuugggu

SEQ ID NO: 128671 - RNA, 45 nt, Homo sapiens
gccaaauuguuuuccacagugguuggaccaauuuucacuccccca

SEQ ID NO: 128672 - RNA, 45 nt, Homo sapiens
ucaguguauuucauauugcuuguuagauuuguuccuagguaccuu

SEQ ID NO: 128673 - RNA, 50 nt, Homo sapiens
aaguaauuuuuuaaauauuuacuaugucucauuaaaauugucauugguaa

SEQ ID NO: 128674 - RNA, 45 nt, Homo sapiens
uuuuacaagcugucagaaacuaaagggugucaaaccguaacuucu

SEQ ID NO: 128675 - RNA, 41 nt, Homo sapiens
uuugaaauaacccagaauuguuaucucauggucccccaaaa

SEQ ID NO: 128676 - RNA, 35 nt, Homo sapiens
ccccccuucccuucucccagguuacaaugcaccau

SEQ ID NO: 128677 - RNA, 45 nt, Homo sapiens
guccuggagauggaauacagauccugaaagaucugcccaugguaa

SEQ ID NO: 128678 - RNA, 84 nt, Homo sapiens
uuuaaguaacuggcaagaguauuacaaaauuuaacuuucuaagaccuaaaaguauuucauuaaggauucagcucugauaucaga

SEQ ID NO: 128679 - RNA, 63 nt, Homo sapiens
uauugccuuuuuucaucuuucuuuuguuuuugauagccagguuucccuuauccauccccucau

SEQ ID NO: 128680 - RNA, 50 nt, Homo sapiens
auuucucucuccugauuccauaaacccugaauauuccccgucucugcgcu

SEQ ID NO: 128681 - RNA, 51 nt, Homo sapiens
guuccagugucgaggaaaugccagcgagccugugacugcagcccaggggcu

SEQ ID NO: 128682 - RNA, 73 nt, Homo sapiens
ucucguaauauuguacaguuuugcauggccuggugugaucauuuuuugguuagaauauaaugcugacaaaugu

SEQ ID NO: 128683 - RNA, 46 nt, Homo sapiens
caaugauguggauucuuuugcacagaaauauuuaaggugggauggu

SEQ ID NO: 128684 - RNA, 40 nt, Homo sapiens
ugaggacuacuuuugauguucaauuuaauuuuaccuguuu

SEQ ID NO: 128685 - RNA, 55 nt, Homo sapiens
gagcacucauuaacaccagugacacagugcagcauggagcuguuuauaguuugga

SEQ ID NO: 128686 - RNA, 70 nt, Homo sapiens
gagaagacaaccaaucgagaagcuugucgggaucucaguggaaggagacuacgcgaugucaaucaugaaa

SEQ ID NO: 128687 - RNA, 45 nt, Homo sapiens
caagcacugcuucaccagccccgacuaccagcagcagugccauga

SEQ ID NO: 128688 - RNA, 52 nt, Homo sapiens
guuucagcagaaaucagugagaaucggaaacggcaauggccuacuaaaucuc

SEQ ID NO: 128689 - RNA, 94 nt, Homo sapiens
ugggaggcauauuuuagaagacucaugugcugagcugggggaguccaaagagcacauggaaagcaggaugguuacagaaacagaagagacccag

SEQ ID NO: 128690 - RNA, 46 nt, Homo sapiens
aaggacugauggggaaagaguugcugagguagcaccugaagaaagg

SEQ ID NO: 128691 - RNA, 91 nt, Homo sapiens
gauggcccuuggacugaaaugugggggcacucugcaggagcgggcagcaagacucuucucugucagaggacuggcaaaggagcaaauugac

SEQ ID NO: 128692 - RNA, 48 nt, Homo sapiens
uagagggggcucugcucuuuagauaguguugcaaccucugggaggcag

SEQ ID NO: 128693 - RNA, 38 nt, Homo sapiens
uucuuaaauuuaucaaaggugggaggagaauuuagaac

SEQ ID NO: 128694 - RNA, 35 nt, Homo sapiens
acacagcagcggagaugggaccguuccuuccucua

SEQ ID NO: 128695 - RNA, 49 nt, Homo sapiens
gcacucagcuggagcccaggucauuuccagacacagacaagggacaggg

SEQ ID NO: 128696 - RNA, 122 nt, Homo sapiens
ggcggcccugaccgaggagcagcuccugggcagccugcugcggcagcugcagcucagcgaggugcccguacuggacagggccgacauggagaagcuggucauccccgcccacgugagggccc

SEQ ID NO: 128697 - RNA, 46 nt, Homo sapiens
agcaggacuacauacugggcccucacgugggcggggaugaccagcu

SEQ ID NO: 128698 - RNA, 43 nt, Homo sapiens
cagccacggggaccgcucccgcggaaagagguucagccagagc

SEQ ID NO: 128699 - RNA, 45 nt, Homo sapiens
ugcaccaggcuagaccugcuggaaaaaccaagacuucagagaagg

SEQ ID NO: 128700 - RNA, 57 nt, Homo sapiens
gaauccuccugcagccucucgccucccuagcuccucagugcccagagcuagagccag

SEQ ID NO: 128701 - RNA, 46 nt, Homo sapiens
cccagauccaaggaagauuuguaaacuggguuugccccagagauag

SEQ ID NO: 128702 - RNA, 78 nt, Homo sapiens
uguucggcauggagcagcggcugccgcccaacagcgagcuggugcaggccgugcugcggcucuuccaggagccggucc

SEQ ID NO: 128703 - RNA, 41 nt, Homo sapiens
cgacggucacccgggccugggcgcugcgcggggacagccgc

SEQ ID NO: 128704 - RNA, 14 nt, Homo sapiens
cgcuugagggcggg

SEQ ID NO: 128705 - RNA, 42 nt, Homo sapiens; identical to SEQ ID NO: 27914

SEQ ID NO: 128706 - RNA, 46 nt, Homo sapiens
cccccugcgaggcaaagcggaccagcuugugggcgccggacgccag

SEQ ID NO: 128707 - RNA, 44 nt, Homo sapiens
uccggcgcccacaagcugguccgcuuugccucgcagggggcgcc

SEQ ID NO: 128708 - RNA, 52 nt, Homo sapiens
gcucucccuaccccuagcccaccgccaccauccggucccccagacaguccug

SEQ ID NO: 128709 - RNA, 42 nt, Homo sapiens
gaagcaccaaugaccgagggcacccgcugcugccgccaggag

SEQ ID NO: 128710 - RNA, 49 nt, Homo sapiens
augggcagcgaggcagucuccgaggcgauacacugucgcggccccagaa

SEQ ID NO: 128711 - RNA, 45 nt, Homo sapiens
aagugcagcugugccucggauggggcgcucgugccaaggaggcuc

SEQ ID NO: 128712 - RNA, 106 nt, Homo sapiens
uugggauggaguaacuugcuaaguauaaaguuaagaccuacauuaagaccaccucuaugcacacguucaguuagagggcucaauggauacaccaggcgccuauggc

SEQ ID NO: 128713 - RNA, 112 nt, Homo sapiens
aauguaggucuuaacuuuauacuuagcaaguuacuccaucccaauuuagugcuccugugugaccuucgcccuguguccuuccauuuccugucuuucccguccaucacccauc

SEQ ID NO: 128714 - RNA, 82 nt, Homo sapiens
uucuguuuccccaguucuaaucauaggguauuauuguuccagacucagugaagaauuugccagagaacagaaacucccagcu

SEQ ID NO: 128715 - RNA, 92 nt, Homo sapiens
cugagcaaugcacacauuuucagcugggaguuucuguucucuggcaaauucuucacugagucuggaacaauaauacccuaugauuagaacug

SEQ ID NO: 128716 - RNA, 45 nt, Homo sapiens
cguguucggauacaggaggccucaacugcauugaugagcagagag

SEQ ID NO: 128717 - RNA, 44 nt, Homo sapiens
gagaaacuggggccugcggaggucaccccacuguagauggugag

SEQ ID NO: 128718 - RNA, 45 nt, Homo sapiens
uacagaaaaagaugaaagcucagaaauggaagagaggucggaaaa

SEQ ID NO: 128719 - RNA, 47 nt, Homo sapiens
uuggggagagaaggggaaagccagaggggacagaaaagaacugagag

SEQ ID NO: 128720 - RNA, 48 nt, Homo sapiens
aagggacagccccacucugccucuugcuccuccagggcagcaccaugc

SEQ ID NO: 128721 - RNA, 46 nt, Homo sapiens
acacccagagugcccagcagagccacaggggcugcauggugcugcc

SEQ ID NO: 128722 - RNA, 42 nt, Homo sapiens
cuggucauccccacccacgugagggcccaguacguggcccug

SEQ ID NO: 128723 - RNA, 51 nt, Homo sapiens
gccuggugcaccuccccugggcuggaggggggccucagugcacagcuggag

SEQ ID NO: 128724 - RNA, 56 nt, Homo sapiens
gcccaggggaggugcaccaggcuagaccugcuggaaaaaccaagacuucagagaag

SEQ ID NO: 128725 - RNA, 78 nt, Homo sapiens; identical to SEQ ID NO: 128702

SEQ ID NO: 128726 - RNA, 55 nt, Homo sapiens
agccgucgucgcggacgcgcagccacucgacggucacccgggcccgggcgcugcg

SEQ ID NO: 128727 - RNA, 42 nt, Homo sapiens; identical to SEQ ID NO: 27914

SEQ ID NO: 128728 - RNA, 42 nt, Homo sapiens
gcccacaagcugguccgcuuugccucgcagggggcgccagcc

SEQ ID NO: 128729 - RNA, 52 nt, Homo sapiens
caccuacccauaguccccaagguccagggugugcagcuccagcuggggcucc

SEQ ID NO: 128730 - RNA, 41 nt, Homo sapiens
aagcaccaaugaccgagggcacccgcugcugccgccaggag

SEQ ID NO: 128731 - RNA, 46 nt, Homo sapiens
cagucuccgaggcgaugcacugucgaggccccagaaacggccacuu

SEQ ID NO: 128732 - RNA, 47 nt, Homo sapiens
cugauggauggagaaccaguucugggaguuuggggagagaucaaggc

SEQ ID NO: 128733 - RNA, 46 nt, Homo sapiens
cugggacucggggaccggcccaacgacuccuauugcuacaacucgg

SEQ ID NO: 128734 - RNA, 65 nt, Homo sapiens
caaggcuaugaaccuuguuggcuucagacugguugcuuuagauacugagggcuuucgucauccuc

SEQ ID NO: 128735 - RNA, 50 nt, Homo sapiens
uucugcguggggcuccaggauucucuguucaugucgccugaagggugaca

SEQ ID NO: 128736 - RNA, 46 nt, Homo sapiens
ugugucauccugccugucaaccucucaggggacuugcuggguaaug

SEQ ID NO: 128737 - RNA, 69 nt, Homo sapiens
agaguggcaguccuagggaaagggcucacugugguagaccagaaccccaggagucaugccccacuucag

SEQ ID NO: 128738 - RNA, 45 nt, Homo sapiens
aaagacccguauaguuuugggaggacaacaauagcaaaccuacag

SEQ ID NO: 128739 - RNA, 46 nt, Homo sapiens
aggugaggcggacccuguucaucacaggacuccccagagaugccag

SEQ ID NO: 128740 - RNA, 45 nt, Homo sapiens
gcagcugugcuacaacguggccaaacugaucuaccugugcaagga

SEQ ID NO: 128741 - RNA, 42 nt, Homo sapiens
uauuacacaaaccugcaggugaagacaggccagcggacccuc

SEQ ID NO: 128742 - RNA, 58 nt, Homo sapiens
aacuggaggguguggcuuucucuuuuauucuccucugccauggugggcacugugcgag

SEQ ID NO: 128743 - RNA, 45 nt, Homo sapiens
cccaaguucaugacuucuucccaucuguuuuaggucucacugcuc

SEQ ID NO: 128744 - RNA, 45 nt, Homo sapiens
acuuuucgccccccaaacugaugaguccgggagaauauauggaga

SEQ ID NO: 128745 - RNA, 45 nt, Homo sapiens
ugaauggccagggagggccucucucagggguacccuugaggcuga

SEQ ID NO: 128746 - RNA, 94 nt, Homo sapiens
agguguuuaugcccuagaugaaacagaauucuauuugggcaagagaugcacuuauguauacaaagcaaagaacaacacagugacuccuggaggc

SEQ ID NO: 128747 - RNA, 45 nt, Homo sapiens
acuggaguaggccugcugggaacaggacuuguuaaaagaacuaug

SEQ ID NO: 128748 - RNA, 51 nt, Homo sapiens
guguucagaguuaaauuguucucaguacuuucaauguaggggaauguaaua

SEQ ID NO: 128749 - RNA, 41 nt, Homo sapiens
uuguagcaguuggcuuaaccucaacuucuaaaacuacauug

SEQ ID NO: 128750 - RNA, 52 nt, Homo sapiens
aacacuguuccauuuaaaguacauuuauguuuuauucaguaagagaauagaa

SEQ ID NO: 128751 - RNA, 70 nt, Homo sapiens
aguaguugaucuuuuaauauagccguguuuacuuguauuaacuuacaguuaacauaggaaaaauacaagu

SEQ ID NO: 128752 - RNA, 47 nt, Homo sapiens
aaaacaaggaaaaaaauccgaaacuuucuuuuguugcacugacaggg

SEQ ID NO: 128753 - RNA, 46 nt, Homo sapiens
acauaauuuauuucaccauguugcuuguccaccgagaagcucguga

SEQ ID NO: 128754 - RNA, 44 nt, Homo sapiens
uaaaauuaagauuuaguuucaccagugguuuggauguccauguc

SEQ ID NO: 128755 - RNA, 45 nt, Homo sapiens
ugaaaugaaaauacaggaccgcgcuguuccauccuuggccaugau

SEQ ID NO: 128756 - RNA, 45 nt, Homo sapiens
uuaauaauuagccauuugacuuugugccugagaguuuggauugug

SEQ ID NO: 128757 - RNA, 29 nt, Homo sapiens
ucuauauauucacagauuaaagccuaaca

SEQ ID NO: 128758 - RNA, 52 nt, Homo sapiens
cauugcuaaguguaguuuuuucuucuuucaguagaauccuuuacuuggauau

SEQ ID NO: 128759 - RNA, 48 nt, Homo sapiens
uuuuugaugguacauuagaaauugguuucagacaguuagccagauaac

SEQ ID NO: 128760 - RNA, 65 nt, Homo sapiens
gugguugccacaaggugaacuggaaaggccucucugaagacaucugaggcaggcaagguaaugag

SEQ ID NO: 128761 - RNA, 89 nt, Homo sapiens
accuuugaagugacccccauccgggcaaaggacuuggaguuuggaggaguaccugguaggccucagagcugggcccagagagggcaggu

SEQ ID NO: 128762 - RNA, 51 nt, Homo sapiens
agaaagcaguuacauagcaacacaguauagccuucguccaagaagagaaga

SEQ ID NO: 128763 - RNA, 47 nt, Homo sapiens
auaauggggagccugagcauauugagagaaaugacgcaccucauaaa

SEQ ID NO: 128764 - RNA, 16 nt, Homo sapiens
aaucuaucaaugaaau

SEQ ID NO: 128765 - RNA, 43 nt, Homo sapiens
uacauauugccagauugcaucaagaaaguuuauaguaguauca

SEQ ID NO: 128766 - RNA, 63 nt, Homo sapiens
uucacuauuacaaacaaguauuuuuauguaacaucugauuauuuccuuaggauggauucuuac

SEQ ID NO: 128767 - RNA, 68 nt, Homo sapiens
uauacauguaacuuaaucguuaaagucagcucugucaaugauagacauuuaguguuuuuccuuccaua

SEQ ID NO: 128768 - RNA, 25 nt, Homo sapiens
uuaucacuuuaccuauucaaagaug

SEQ ID NO: 128769 - RNA, 30 nt, Homo sapiens
gcuucugcuucccaccaggccgacauuaag

SEQ ID NO: 128770 - RNA, 47 nt, Homo sapiens
ccagcuuuacacugugaaguauaaagauggaacagagcuugaauuga

SEQ ID NO: 128771 - RNA, 46 nt, Homo sapiens
uacaauuaaaugcauuuuuaaagccauuguaaauugauacgcaaau

SEQ ID NO: 128772 - RNA, 72 nt, Homo sapiens
ugacuucaucccgaaaacuugugggcuccuccccacuacuccaagcccaaacccauucauuaccccagugau

SEQ ID NO: 128773 - RNA, 42 nt, Homo sapiens
gauguugucaccuuccguuuuuaugccccugcucaugcagag

SEQ ID NO: 128774 - RNA, 49 nt, Homo sapiens
agagagaaggaggguacauuuccuuccucuuucuuuguacuuggaggcu

SEQ ID NO: 128775 - RNA, 48 nt, Homo sapiens
acgucauucgagcgucuugcucuaugccacguuuagaugaauuuggag

SEQ ID NO: 128776 - RNA, 47 nt, Homo sapiens
gcugccugggaagagggagaagaacgagcaggaggggaaugaugagc

SEQ ID NO: 128777 - RNA, 33 nt, Homo sapiens
cuacggagaagagcagagggauccuaauuuaga

SEQ ID NO: 128778 - RNA, 46 nt, Homo sapiens
uauucuccgggagccguccgugucaccgccggaaccuggcgcaggu

SEQ ID NO: 128779 - RNA, 44 nt, Homo sapiens
ugcaaaauagggaacuucaauggacugcuuuaaacucucgaccu

SEQ ID NO: 128780 - RNA, 68 nt, Homo sapiens
uccaggggccgaguggauggcgggaagacauccugggcuggggcccaaagcagcggccccgccagcga

SEQ ID NO: 128781 - RNA, 32 nt, Homo sapiens
agcuucagggccucacugggccgcuagaucag

SEQ ID NO: 128782 - RNA, 70 nt, Homo sapiens
gggggaggagcccuggcuucagggacucguaaaacaaccgaagccauaaaggaagcugagggacuggggc

SEQ ID NO: 128783 - RNA, 36 nt, Homo sapiens
uuugaacacugccaaacaggagcuucuggggcugca

SEQ ID NO: 128784 - RNA, 56 nt, Homo sapiens
agagccuuccaggaccagagacauggauuauuaaaccuagauuuuuggugcgugug

SEQ ID NO: 128785 - RNA, 39 nt, Homo sapiens
aacccuaaagaaguagagcuuuuucuuuucuuaucugug

SEQ ID NO: 128786 - RNA, 53 nt, Homo sapiens
cucuccacaguucaucugggguuguucaucuccacuucuuuuuguaucccagg

SEQ ID NO: 128787 - RNA, 41 nt, Homo sapiens
ggagcugcggccagcuaccuggcgccggccaaagucagggg

SEQ ID NO: 128788 - RNA, 43 nt, Homo sapiens
ggguugcgcgcugcuggcacggcgcggggacccagcgcgccag

SEQ ID NO: 128789 - RNA, 42 nt, Homo sapiens
ggcgcggaaguaggugagcagcagggcggcgcgcggcgguca

SEQ ID NO: 128790 - RNA, 51 nt, Homo sapiens
agaaaguuacuccgauacuuuugaucaucuguccauaguaaggaggaaaaa

SEQ ID NO: 128791 - RNA, 48 nt, Homo sapiens
uuuugauugguugccaaugacaucaccgcccguguuuuaacaccgagg

SEQ ID NO: 128792 - RNA, 40 nt, Homo sapiens
aaggaggguuuauccgaagcugcucuggguccucgguguu

SEQ ID NO: 128793 - RNA, 45 nt, Homo sapiens
aaugcggucaauuccaaauuugaggucuuugcuggagggggccgg

SEQ ID NO: 128794 - RNA, 42 nt, Homo sapiens
gcgccaccacuggggugggucgaagcggggaucuggccgccg

SEQ ID NO: 128795 - RNA, 51 nt, Homo sapiens
ggcugcgaacauccugccggggugagccgcgcggcugccgcaguccagccg

SEQ ID NO: 128796 - RNA, 51 nt, Homo sapiens
guuucucguggggagauggaggcagagcccaggguaggggacagagcugcu

SEQ ID NO: 128797 - RNA, 45 nt, Homo sapiens
uuuguccugggugggacauaggggcugagagagauggggggagac

SEQ ID NO: 128798 - RNA, 44 nt, Homo sapiens
cugcauggacauugauaucaccaagagugaugacagaaguugag

SEQ ID NO: 128799 - RNA, 41 nt, Homo sapiens
gcauguauguaagcuaaugggauccaauggagaggaagcga

SEQ ID NO: 128800 - RNA, 52 nt, Homo sapiens
agcaaagaaagcugaggaggagcucccuauuuagguaggggagaacuaagaa

SEQ ID NO: 128801 - RNA, 53 nt, Homo sapiens
gacugaguauugaacaacaccaacauuuuaaagucugguagaagggauaauuu

SEQ ID NO: 128802 - RNA, 28 nt, Homo sapiens
ggcucuugcaugcgaaugugggcggugc

SEQ ID NO: 128803 - RNA, 48 nt, Homo sapiens
uacuuggccuguucugaucaugugccuauucccgugguccugugucuu

SEQ ID NO: 128804 - RNA, 41 nt, Homo sapiens
aguccuugaaauuagacagauuaaaugucucuggcccuggg

SEQ ID NO: 128805 - RNA, 55 nt, Homo sapiens
uauucagaacauagauauguauucagcuugucuucaaauacggccaagcagaaaa

SEQ ID NO: 128806 - RNA, 44 nt, Homo sapiens
uuagguaaugaguggaugaguaaaugguggaggaugggagucaa

SEQ ID NO: 128807 - RNA, 46 nt, Homo sapiens
cuauaaaguaauugucaugccgacuacgaaagaaaaaugcccccgu

SEQ ID NO: 128808 - RNA, 43 nt, Homo sapiens
gaaugaauuaaugauggcuucugagucaacuuuacuggcucag

SEQ ID NO: 128809 - RNA, 46 nt, Homo sapiens
gagacucauuucuuggaagcaucccuggcaaaaaugcagcugagua

SEQ ID NO: 128810 - RNA, 42 nt, Homo sapiens
ugaccccaaacgacgcucuugucagacugcauuaguugaaau

SEQ ID NO: 128811 - RNA, 45 nt, Homo sapiens
uuauaccagagagcucucuaacuuuuauuucaguauaaucaaaga

SEQ ID NO: 128812 - RNA, 44 nt, Homo sapiens
agaccaguacaugcuacacuuacugcaggauuuggcaaacaagg

SEQ ID NO: 128813 - RNA, 41 nt, Homo sapiens
ucgcuuucuuuugggaaauguggcugauuucaacccagaaa

SEQ ID NO: 128814 - RNA, 45 nt, Homo sapiens
acagugauuguucauggauuuacccuuggagaaaagggagaaaag

SEQ ID NO: 128815 - RNA, 46 nt, Homo sapiens
ggggguugguuucagucauccuuauuaacaaguguggcagcaagga

SEQ ID NO: 128816 - RNA, 32 nt, Homo sapiens
aagaguauguuuuaggaaaagaaaguagaggc

SEQ ID NO: 128817 - RNA, 73 nt, Homo sapiens
gccauauugguguauaucaaggcaaagaguuugggguguuccaauuccuguguuucaucauaagaccaaggau

SEQ ID NO: 128818 - RNA, 45 nt, Homo sapiens
gugguuuauaaacaucacggauauuaagacugcagccaagguaua

SEQ ID NO: 128819 - RNA, 46 nt, Homo sapiens
uuguugaaagaggagaaauuggugcauagcuauccguaugacugga

SEQ ID NO: 128820 - RNA, 46 nt, Homo sapiens
gguccugaacuucaaaacaaggcuguccuugaagagggaacugaug

SEQ ID NO: 128821 - RNA, 360 nt, Homo sapiens
uuuggugauuuaaauguauaaaauucacaaauuccuauuuccuuuucuuuucuuuucuuuuuuuuuuuuuuugagagggagucuugcucugucgcccaggcuggagugcaguggugugguaugaucucggcucacugcaaccucuaccuccaggguucaagcgauucuccugccucagccucccgaguagcugggacuacaggugcacaccaccaugccuggcuaauuuuuguauuuuuaguggaaguggguuucaccauguuggccaggcuagucucaaauuccugaccucaagugaucugcccaccucgaccucccaaagugcugggauuauaggccugagugccgcgcccggccaag

SEQ ID NO: 128822 - RNA, 63 nt, Homo sapiens
ugcaaaucaugugaccauggcaaaaggaacgggauugguucacacagccccagcucaugguau

SEQ ID NO: 128823 - RNA, 65 nt, Homo sapiens
guagauuuggaaaaugguacuugcagucauccauuaauuccugauaaagccucuccucuuuuacc

SEQ ID NO: 128824 - RNA, 45 nt, Homo sapiens
gugaaauguucuaagucuggagaccucuacguacuggcggcagau

SEQ ID NO: 128825 - RNA, 46 nt, Homo sapiens
uaacuuaguuauuauguucauauagauuuuauuaaccuuuagguga

SEQ ID NO: 128826 - RNA, 86 nt, Homo sapiens
ugguucaucuccuguuaguauuuuggucuggaccacacaaccuuggacgauuccagccaaugaagcuguuugcuauaugccugaau

SEQ ID NO: 128827 - RNA, 76 nt, Homo sapiens
cuuaggacugcauuggcugaagcagaacuugaauauaauccugagcaugucagucguucaauauauguaaaauuuc

SEQ ID NO: 128828 - RNA, 46 nt, Homo sapiens
gggcuugguuuaucgaucuuacaaaccuguguuuuggucuccguca

SEQ ID NO: 128829 - RNA, 53 nt, Homo sapiens
augggaaguaugaagccaaacaguugagaacuuuuuaccaaauguaugauaag

SEQ ID NO: 128830 - RNA, 87 nt, Homo sapiens
uugcuaaagcagccauugagaaacagaaaucagcauuuauucguuggggaauaauggcagauuggaauaauugcuacuauacauuug

SEQ ID NO: 128831 - RNA, 36 nt, Homo sapiens
ugguagagaagcucagaaucuuucagcuauggaaau

SEQ ID NO: 128832 - RNA, 45 nt, Homo sapiens
auuuucagaacuuuauucauggcaaagagaaagaaaaguaaagac

SEQ ID NO: 128833 - RNA, 46 nt, Homo sapiens
gaagaggcuucuggugcggucggucuccggggccaguaaccaccag

SEQ ID NO: 128834 - RNA, 42 nt, Homo sapiens
ugggcugcagagccugugcccuuaagcacugugcuguuuuag

SEQ ID NO: 128835 - RNA, 37 nt, Homo sapiens
aaguaguugagucauuuaugaagccugacaaggguca

SEQ ID NO: 128836 - RNA, 46 nt, Homo sapiens
guucuucauuggcccggaaauuccccaaacucacaauuauagggga

SEQ ID NO: 128837 - RNA, 42 nt, Homo sapiens
ugaagacagucagugggaagaaauacugaagcaaccaugccc

SEQ ID NO: 128838 - RNA, 30 nt, Homo sapiens
uguaugugugugugcugaaaacaucuguag

SEQ ID NO: 128839 - RNA, 85 nt, Homo sapiens
gacaauguaacaguucuuauuggaauugcuuaugaaggaaaagccauagcaggaguuauuaaccagccauauuacaacuaugagg

SEQ ID NO: 128840 - RNA, 46 nt, Homo sapiens
uucuauuauacaucagauaaauugccuuccauagaagcaagggacu

SEQ ID NO: 128841 - RNA, 40 nt, Homo sapiens
gggaacagaggaagcacauuaacauauacugaguacccag

SEQ ID NO: 128842 - RNA, 46 nt, Homo sapiens
agguuuaggcgccuuuggguuucagcugaaagaagucccugcuggg

SEQ ID NO: 128843 - RNA, 46 nt, Homo sapiens
uuacugacuguguugcugcuaugaaccccgaugcugugcugcgagu

SEQ ID NO: 128844 - RNA, 24 nt, Homo sapiens
gcuuauguauuugcaaguccuggu

SEQ ID NO: 128845 - RNA, 50 nt, Homo sapiens
uaugaacucugcaggaguccuggccacacugaggaauuaugacuacuaug

SEQ ID NO: 128846 - RNA, 357 nt, Homo sapiens
auguucaaugaacauuccuaucuucuaaaccagauuucucuuuuuuuuuccugagacggagucucgcucuguagccuaggcuagaauguaguggcgugaucucggcucacugcaagcuccgccucccggguucaugccauucuccugccucagccucccgaguagcugggacugcaggcaccgccaccacgccuggcuaauuuuuuguauuuuuaguagagaagguguuucaccguguuagccaggauggucuugaucuccugacaucgugaucugucugccucggacucccaaagugcugggauuacaggugugagccaccgcaccuggccuaaaccagauuucuuuagggcacaa

SEQ ID NO: 128847 - RNA, 44 nt, Homo sapiens
auggacuaaccgcacaacaaaucaaugaacucuaaaaggaaugg

SEQ ID NO: 128848 - RNA, 42 nt, Homo sapiens
aggagcuuugcuggcaguagaacacgugaaagacgaugucag

SEQ ID NO: 128849 - RNA, 41 nt, Homo sapiens
uuggaguucagugcuacaaaauuaucuucaugugauuccuu

SEQ ID NO: 128850 - RNA, 41 nt, Homo sapiens
ggaaacuccuugaguuuagcagauuuauguguuugggccac

SEQ ID NO: 128851 - RNA, 46 nt, Homo sapiens
agaaaaagcaagauguugggaaauuuguugagcuuccaggugcgga

SEQ ID NO: 128852 - RNA, 34 nt, Homo sapiens
aggugaaauaaaggguagauagaaggagaugaaa

SEQ ID NO: 128853 - RNA, 51 nt, Homo sapiens
aacagcagaacaguguuuuuguagauucugauucauugaguguuggugcug

SEQ ID NO: 128854 - RNA, 58 nt, Homo sapiens
uaacuuuaaagggaaacugaucaugagauuugaugacacaaauccugaaaaagaaaag

SEQ ID NO: 128855 - RNA, 45 nt, Homo sapiens
ugauggucuauguuacauuugcuuaaaugcaguaucaaggguuga

SEQ ID NO: 128856 - RNA, 58 nt, Homo sapiens
ucggaucauuuugaaacuauaaugaaguaugcagagaagcuaauucaagaagggaagg

SEQ ID NO: 128857 - RNA, 57 nt, Homo sapiens
cuuauguggaugauacuccugcugaacagaugaaagcagaacgugagcagaggauag

SEQ ID NO: 128858 - RNA, 90 nt, Homo sapiens
uagcuauugagaagaaucuacaaaugugggaagaaaugaaaaaagggagccaguuuggucaguccuguuguuugcgagcaaaaauugaca

SEQ ID NO: 128859 - RNA, 46 nt, Homo sapiens
gaagguguuacacaugcccugagaacaacagaauaccaugacagag

SEQ ID NO: 128860 - RNA, 46 nt, Homo sapiens
uauccaaaagaaaacucacaugguuugucaaugaaggacuaguaga

SEQ ID NO: 128861 - RNA, 40 nt, Homo sapiens
cuucuuguuuuaaugccacaaauaauggagugcccacugg

SEQ ID NO: 128862 - RNA, 41 nt, Homo sapiens
cagggaugacccaagauuuccuacgguucgugguguacuga

SEQ ID NO: 128863 - RNA, 25 nt, Homo sapiens
acuaauuggaaagcagaugcuugga

SEQ ID NO: 128864 - RNA, 48 nt, Homo sapiens
acugaagaaagaagugaucccagugaauguaccugaagcucaggagga

SEQ ID NO: 128865 - RNA, 42 nt, Homo sapiens
uuuuucggagggugagaugguuacauuuauaaauuggggcaa

SEQ ID NO: 128866 - RNA, 33 nt, Homo sapiens
auacauguugcugacuaguaaaucugcccagac

SEQ ID NO: 128867 - RNA, 41 nt, Homo sapiens
uguauaacauaaucuuuuuacuaaaauuuacuuuaaaacug

SEQ ID NO: 128868 - RNA, 46 nt, Homo sapiens
guuaauauuucuuugaauacuuuuaaucuuauaucuagaaaugcag

SEQ ID NO: 128869 - RNA, 46 nt, Homo sapiens
cuaggaaaagacgaggacuuuaagcaguaugucaacaagaacagua

SEQ ID NO: 128870 - RNA, 51 nt, Homo sapiens
cuaaugcuaggggaucccugccuuaaggauuugaaaaaaggagauauuaua

SEQ ID NO: 128871 - RNA, 44 nt, Homo sapiens
acaaaggaaaugccaacaucagggucaaaggaaaagaccaaagu

SEQ ID NO: 128872 - RNA, 50 nt, Homo sapiens
ggcuguucaaggagaugugguucgugaauuaaaagccaagaaagcaccaa

SEQ ID NO: 128873 - RNA, 48 nt, Homo sapiens
gacccuucuaaaaaccaaggaggugggcucucaucaaguggagcagga

SEQ ID NO: 128874 - RNA, 76 nt, Homo sapiens
gagaucaagaaacuugguguugaaaacugcuacuuccccauguuugugucucaaagugcauuagagaaagagaaga

SEQ ID NO: 128875 - RNA, 58 nt, Homo sapiens
uucauacucugaguagaugcaucagauauaaauuaauucugcuucucauacauaacug

SEQ ID NO: 128876 - RNA, 46 nt, Homo sapiens
aauggguacagucacacagagaccugcccaucaagcucaaucagug

SEQ ID NO: 128877 - RNA, 42 nt, Homo sapiens
ugggaauucaagcauccucagccuuuccuacguacucgugaa

SEQ ID NO: 128878 - RNA, 51 nt, Homo sapiens
ggcaauuccuguuguuaaaggaagaaagacggaaaaggaaaaauuugcagg

SEQ ID NO: 128879 - RNA, 45 nt, Homo sapiens
gacaacauggguuuaguauuaccaccccguguagcauguguucag

SEQ ID NO: 128880 - RNA, 58 nt, Homo sapiens
gcaaaggagaagugaaguuugaagagaaggcaaaaagugacaaagcucgcugugacag

SEQ ID NO: 128881 - RNA, 43 nt, Homo sapiens
uucugaagaagacaaagaagcgcugauugcaaaaugcaaugau

SEQ ID NO: 128882 - RNA, 48 nt, Homo sapiens
guagccgucagacgagauacuggagaaaagcugacaguugcugaaaau

SEQ ID NO: 128883 - RNA, 47 nt, Homo sapiens
uaugccuaaguuaacaguggauaaaagacuuuucuguaaacaacucc

SEQ ID NO: 128884 - RNA, 46 nt, Homo sapiens
auugcagacauauaaggcuguuuggugguauucagaaacaucacag

SEQ ID NO: 128885 - RNA, 46 nt, Homo sapiens
ucuuaagagcucagcuuuacacuuuguuaagugaaauaaagcagca

SEQ ID NO: 128886 - RNA, 66 nt, Homo sapiens
cugguaaucuucucucggguauuuguguucugaguccaaaauaauauuaccugccuauuccagaua

SEQ ID NO: 128887 - RNA, 84 nt, Homo sapiens
uucagguggcucuuguccauggugggcuacugcuacgauaagaacuuauuauuucuugcugguauguugaaaaucacagauaac

SEQ ID NO: 128888 - RNA, 63 nt, Homo sapiens
agaugcuuaugcuuuuuucucccccaccaagcucauuuaugaacuucuaauuagauguaucua

SEQ ID NO: 128889 - RNA, 42 nt, Homo sapiens
gacuuuaaaggcucuggacuguuguucuaacaguuuuccaua

SEQ ID NO: 128890 - RNA, 46 nt, Homo sapiens
agcccagcugggagcuaaaacuucagaaugauagcauucuucuacu

SEQ ID NO: 128891 - RNA, 42 nt, Homo sapiens
aauauaagcauauuaucagaauuuugaagcagagagaaucaa

SEQ ID NO: 128892 - RNA, 45 nt, Homo sapiens
uagggaagggauucccaacuuagucuaggggauuaugaaguaguu

SEQ ID NO: 128893 - RNA, 25 nt, Homo sapiens
cugaacugucuguugagucaugaga

SEQ ID NO: 128894 - RNA, 87 nt, Homo sapiens
acugugcauuucugcgugucacguucuauaaauguuaaugguucaagguauuugaaagcauuacacaaauucuguauaugcuuagug

SEQ ID NO: 128895 - RNA, 45 nt, Homo sapiens
uucauuucauuauuauuagagaaaauauccuguaugauuuucuuc

SEQ ID NO: 128896 - RNA, 43 nt, Homo sapiens
cccaugaguuauuuagaaacauguuguuuccagauauuuggag

SEQ ID NO: 128897 - RNA, 31 nt, Homo sapiens
caguaacauaguacucuucccucauuaguua

SEQ ID NO: 128898 - RNA, 46 nt, Homo sapiens
cuucccuacauucaccccaaaaggaaacuuaauaacuccaacaagu

SEQ ID NO: 128899 - RNA, 45 nt, Homo sapiens
caaucuuuuauaacuauaaaccauuuaacguucuucaauaaaagc

SEQ ID NO: 128900 - RNA, 45 nt, Homo sapiens
ugccaguagaggcagggaugauguucuggagagccccguggccau

SEQ ID NO: 128901 - RNA, 46 nt, Homo sapiens
augagcuugaaaaagugguuguugagggcaaugacagccccagcau

SEQ ID NO: 128902 - RNA, 48 nt, Homo sapiens
gcggggugggcguguguguuucauaaagaauaaaacuguacggggcug

SEQ ID NO: 128903 - RNA, 39 nt, Homo sapiens
ggacagaucucucuuaaucaaaaucucagaaccgcccug

SEQ ID NO: 128904 - RNA, 46 nt, Homo sapiens
uguacaccuuggcauuuucuuuauggggauuuucgugaggaacaga

SEQ ID NO: 128905 - RNA, 46 nt, Homo sapiens
ccuguuuguuugagucuagaacucaguuccaguacuguaacuggag

SEQ ID NO: 128906 - RNA, 47 nt, Homo sapiens
augacauuuuaggaaugaguauuggaaaauauaaagaauuagaaaag

SEQ ID NO: 128907 - RNA, 45 nt, Homo sapiens
cucuucacuaagggguguucccagggguucucaacugggucagcu

SEQ ID NO: 128908 - RNA, 54 nt, Homo sapiens
agggggaggagggaaaguagugggggaaggagaagcacuaugcacugaggugac

SEQ ID NO: 128909 - RNA, 46 nt, Homo sapiens
gggcucagcagugaaaacauaagcuuuucaaaaacgaugagaagug

SEQ ID NO: 128910 - RNA, 48 nt, Homo sapiens
gaccagggaaagggaguggucgccugaggucaggaaggaagaccugca

SEQ ID NO: 128911 - RNA, 40 nt, Homo sapiens
ggcccugaggaagcccaagaaaaagagccagaacagaaga

SEQ ID NO: 128912 - RNA, 46 nt, Homo sapiens
uguuuucaggugaagaaaccaggacacaaaaagggcuuguuaucuu

SEQ ID NO: 128913 - RNA, 46 nt, Homo sapiens
aggacucuuacaagaaauaccugcacacagucaagaaggucaagau

SEQ ID NO: 128914 - RNA, 45 nt, Homo sapiens
cacguugugcuggggauuuacugcaauggccgcuauggcucauug

SEQ ID NO: 128915 - RNA, 48 nt, Homo sapiens
ggggaaucugcacuggaaaugcgaauuuaggagcugugauuaggaggu

SEQ ID NO: 128916 - RNA, 54 nt, Homo sapiens
cugcggggaccugcucccagcccccugcccacuggggccacugcacgaggaaga

SEQ ID NO: 128917 - RNA, 24 nt, Homo sapiens
agaaacacagaauacgcuuuacau

SEQ ID NO: 128918 - RNA, 56 nt, Homo sapiens
cuguuccuacugucccaugcugccuuucuuaguagcacccguaccaacccugccuc

SEQ ID NO: 128919 - RNA, 46 nt, Homo sapiens
cacccccacauacauccuccuucagcaaaagcuagagccaccaggu

SEQ ID NO: 128920 - RNA, 35 nt, Homo sapiens
acaagaagaaggagaagacggagugccugcagaaa

SEQ ID NO: 128921 - RNA, 53 nt, Homo sapiens
uccaguuaaaggaauacaugaguaaacuuucacuuucuugaaaaugaugaaac

SEQ ID NO: 128922 - RNA, 44 nt, Homo sapiens
uccuaguaacauaagaugguuagcaagcaaugcuuaguggaaag

SEQ ID NO: 128923 - RNA, 45 nt, Homo sapiens
uguugguugaucccuugaggcggucgauaccuauuggugauggag

SEQ ID NO: 128924 - RNA, 44 nt, Homo sapiens
cccucuaaguaaccaguccgccgaccccugacccaccccggauc

SEQ ID NO: 128925 - RNA, 43 nt, Homo sapiens
cucguuccagcccucccagugagcucugcacggccgggccggg

SEQ ID NO: 128926 - RNA, 45 nt, Homo sapiens
uggcgggguggggagggcggcaggauggacggggcuggccagagg

SEQ ID NO: 128927 - RNA, 43 nt, Homo sapiens
uccgugaccggguggcccagccagcccgucguccccacccaga

SEQ ID NO: 128928 - RNA, 44 nt, Homo sapiens
guucuggguggggacgacgggcuggcugggccacccggucacgg

SEQ ID NO: 128929 - RNA, 58 nt, Homo sapiens
gauggggagacgagacagaggagggggacagggagggccgagagggcgcguugcgugc

SEQ ID NO: 128930 - RNA, 26 nt, Homo sapiens
cgaacaggaacuggaugccaacucug

SEQ ID NO: 128931 - RNA, 58 nt, Homo sapiens
uggugugcuuaaugaaaaauuuaguuaugaaauagagaaaugaugugaaucaggacaa

SEQ ID NO: 128932 - RNA, 45 nt, Homo sapiens
cuauguguucuuaaaguuacccaacaaagugagaaacauuuggag

SEQ ID NO: 128933 - RNA, 41 nt, Homo sapiens
aauuuuuucugugauucauaguaaugauccuguggcaagag

SEQ ID NO: 128934 - RNA, 41 nt, Homo sapiens
uugaaaaucaucauaccaauauuuacugaugugggaaaaaa

SEQ ID NO: 128935 - RNA, 46 nt, Homo sapiens
agaaguugaagcugcuguuuuugcugcugcaaacuucucugcacag

SEQ ID NO: 128936 - RNA, 48 nt, Homo sapiens
agcaagauucuucacuuguggaaaugaugauuaaacaucuaaauuagc

SEQ ID NO: 128937 - RNA, 42 nt, Homo sapiens
ucccuccagugucuuccaguugcauuuagaaucaaauccaga

SEQ ID NO: 128938 - RNA, 65 nt, Homo sapiens
ugacuuauuuccuuuauagauucagcuucuguugcaguauuugaagaaugaucccaggaaggcag

SEQ ID NO: 128939 - RNA, 90 nt, Homo sapiens
aaugauggauauuuaaaaauuuuugagaguuaauaccaaugacucaccaaagagauuuacaccauuuuacucuucugacaacaaugagag

SEQ ID NO: 128940 - RNA, 40 nt, Homo sapiens
guccuuaauauauaauuuuucuaaaagccagaaaauguaa

SEQ ID NO: 128941 - RNA, 45 nt, Homo sapiens
uuugucugacaagaggccuauaaugauaccuguuuuaaucagaau

SEQ ID NO: 128942 - RNA, 44 nt, Homo sapiens
uucuacuacuuuucucugcuuuuuuaggaaaugugaguucuucu

SEQ ID NO: 128943 - RNA, 46 nt, Homo sapiens
agugcuguuaccauaauaacaggggcauugcagcucauggaguuag

SEQ ID NO: 128944 - RNA, 78 nt, Homo sapiens
agauggccaagaaagguuccuguaauagaggagcuucccaucuagaauaggcuacugauguuuauauaggggacuaua

SEQ ID NO: 128945 - RNA, 45 nt, Homo sapiens
aggauaucaaauaacaugguauuauggcuuugauucuauagguaa

SEQ ID NO: 128946 - RNA, 46 nt, Homo sapiens
gagaccuuguugacucaauugcacagugcucaagacgcugcccgga

SEQ ID NO: 128947 - RNA, 45 nt, Homo sapiens
auggagcaaaggguugaaccucauaaugauuacuucaguacucaa

SEQ ID NO: 128948 - RNA, 46 nt, Homo sapiens
cuucugugaaagaugccaaugguauaguauggaagacuggucccag

SEQ ID NO: 128949 - RNA, 50 nt, Homo sapiens
uaacaguauugaaacauccugcuguauuaguucaaccacauauuuaucuc

SEQ ID NO: 128950 - RNA, 47 nt, Homo sapiens
gaagaacacucauuuaauaucuucaauguuuuaaguuagaaggggug

SEQ ID NO: 128951 - RNA, 47 nt, Homo sapiens
cuuaacugcuuuuugauuggggaucauuuagggcuucaggaucacga

SEQ ID NO: 128952 - RNA, 48 nt, Homo sapiens
aaaaagaagcaaaucuuguaagccaucaauucccuuugagaacuuccc

SEQ ID NO: 128953 - RNA, 51 nt, Homo sapiens
cccagguucaggguacuggaaccugagcgaggaaugcgugugccggggaga

SEQ ID NO: 128954 - RNA, 49 nt, Homo sapiens
ucucauuggcuaagaagaacacaacaauacccuaggcauuuugggaaaa

SEQ ID NO: 128955 - RNA, 77 nt, Homo sapiens
cggccagucgccagagucgcgcugccucacgcagguugcgccgccaagugcggagcuccagggaccaggaacuccag

SEQ ID NO: 128956 - RNA, 44 nt, Homo sapiens
caccauuggcacaggcuccuacggccgcugccagaagauccgga

SEQ ID NO: 128957 - RNA, 43 nt, Homo sapiens
guaucauuauaaauuaugcuacauaauuuuccuuuucgagugc

SEQ ID NO: 128958 - RNA, 42 nt, Homo sapiens
agugaauggaaaucuugucagagaaccugaccauauggaacu

SEQ ID NO: 128959 - RNA, 45 nt, Homo sapiens
uuggagaugccuuggguucagugauuguaguaguaaaugccuuag

SEQ ID NO: 128960 - RNA, 59 nt, Homo sapiens
aauguaaucuuuuaaaccgggcguuugaaaaaaaauuuucaaggucauuucaugauaac

SEQ ID NO: 128961 - RNA, 45 nt, Homo sapiens
uggcuacguuuugggauuuaaaauaguucauuguuuaauggguug

SEQ ID NO: 128962 - RNA, 50 nt, Homo sapiens
uucguauguuaacugguguugaguugaagauuuuuacuguguauaagcag

SEQ ID NO: 128963 - RNA, 46 nt, Homo sapiens
auaaaaaugucauuaaccugcugucuuaagauguucacacaaauau

SEQ ID NO: 128964 - RNA, 41 nt, Homo sapiens
uccaccgccucucucuucuucaucuuguaaucugucaccuu

SEQ ID NO: 128965 - RNA, 222 nt, Homo sapiens
aagaccuucauugugggagaccaggugagcaucuggccccaugcuguuccuuccucgccacccucugcuuccagauggacacaggugugagccauuuguuuagcaaagcagagcagaccuaggggaugggcuuaggcccucugcccccaauuccuccagccugcucccgcuggcugagucccuggccccccugcccugcagaucuccuucgcugacuacaac

SEQ ID NO: 128966 - RNA, 43 nt, Homo sapiens
uggacauggugaaugacggcguggaggaccuccgcugcaaaua

SEQ ID NO: 128967 - RNA, 45 nt, Homo sapiens
uacauugacaagaaaugccccuucacuggugaugucuccauucga

SEQ ID NO: 128968 - RNA, 45 nt, Homo sapiens
caagaacaugucuguacaccuguuccccugcuucagggacgucca

SEQ ID NO: 128969 - RNA, 45 nt, Homo sapiens
agugcaccucaacgugcuccaggucaccaaggcugccagcaccaa

SEQ ID NO: 128970 - RNA, 42 nt, Homo sapiens
ggauagcucugcuguaagggaacugcagggaaguacgaugaa

SEQ ID NO: 128971 - RNA, 44 nt, Homo sapiens
aaaaucacugcgaauaccuaaaagcaauugcaccaaauucuuag

SEQ ID NO: 128972 - RNA, 47 nt, Homo sapiens
gggaggaacggggcuugucugguaggguugagacuagagucuuggaa

SEQ ID NO: 128973 - RNA, 51 nt, Homo sapiens
uggaaagccaggcucccggaggaaaugggacugugaacgaaccggagagca

SEQ ID NO: 128974 - RNA, 57 nt, Homo sapiens
uuaggaggagaguaaauaacauuuuacaaaugacuuuggaguugccuggguuuuuuu

SEQ ID NO: 128975 - RNA, 48 nt, Homo sapiens
gcccggcuugcucaucccugcugcaggucagagcacacccaagguuac

SEQ ID NO: 128976 - RNA, 49 nt, Homo sapiens
uuuuuucccagggguugccuuauugaaaggucuggcccugggauucuga

SEQ ID NO: 128977 - RNA, 49 nt, Homo sapiens
ucuauggggacagguagugaggcuccuggggucucuguggccagcugag

SEQ ID NO: 128978 - RNA, 70 nt, Homo sapiens
gaagcaguagcaaagacagggcuguggcuuccaagacuaaaaaguaugguagaagaauuaguaaagaaag

SEQ ID NO: 128979 - RNA, 48 nt, Homo sapiens
ugggaccgcgaaaaaucggggaaacugccuuuggcugugagggugcgg

SEQ ID NO: 128980 - RNA, 42 nt, Homo sapiens
aaacuagucuuccaaugucaucagguuuuaccaguuuaaguc

SEQ ID NO: 128981 - RNA, 46 nt, Homo sapiens
gauuggauaacuugguuugagcaucuuuuuugagagaagucugggc

SEQ ID NO: 128982 - RNA, 40 nt, Homo sapiens
cagcacucuuuuugggccaccgaccuuguguccagcccca

SEQ ID NO: 128983 - RNA, 41 nt, Homo sapiens
gucaagugaauagcgaaccauuuucacagauuaccucaggc

SEQ ID NO: 128984 - RNA, 44 nt, Homo sapiens
auaaaaauagaguaagcaacuuuucaucaaauuuaugaaagggg

SEQ ID NO: 128985 - RNA, 56 nt, Homo sapiens
auuauuuccuuaggauaaacuccuagaaagggaauuaccuggaccaaaggauauga

SEQ ID NO: 128986 - RNA, 42 nt, Homo sapiens
caguaucagccagggcugaguucugguuuucagggucaucaa

SEQ ID NO: 128987 - RNA, 83 nt, Homo sapiens
uuuggaaauaucagaaugugcuugucccacugcgguugacucugacuccucuuuggcugaaguaauugguguuucauccugug

SEQ ID NO: 128988 - RNA, 48 nt, Homo sapiens
aacucagacgucaacauuucgguggcuguuucuucuguacguacaaac

SEQ ID NO: 128989 - RNA, 36 nt, Homo sapiens
caggcucuaaauccucaauugcuacacucacuuuga

SEQ ID NO: 128990 - RNA, 45 nt, Homo sapiens
gugggcacagcaucuuccccuggaugagcggcaaagucuucauuu

SEQ ID NO: 128991 - RNA, 48 nt, Homo sapiens
ucugaacuugaauuuuggugcauacugccuccucuugaccuaggcagg

SEQ ID NO: 128992 - RNA, 49 nt, Homo sapiens
guuucgugcucaagcuucucuucauucacauggguuggcucugcuucug

SEQ ID NO: 128993 - RNA, 50 nt, Homo sapiens
cuucagugaccuuuucccgacugacuguuaugccugugucuauagacccc

SEQ ID NO: 128994 - RNA, 54 nt, Homo sapiens
uugauuguucuuuaguuucuuccuggaacacaaaacuggaaggugcuggaggcc

SEQ ID NO: 128995 - RNA, 46 nt, Homo sapiens
gauuuccacaaucucgucuuucuggguugugccuggugcgucaaag

SEQ ID NO: 128996 - RNA, 67 nt, Homo sapiens
uucugccucugcucucugcacaggcugaagcacaucuucuggcccaccggugccaggcagcugggau

SEQ ID NO: 128997 - RNA, 46 nt, Homo sapiens
gucagguacgccaccuuccaccuccugcaccggaguggccuccucu

SEQ ID NO: 128998 - RNA, 45 nt, Homo sapiens
cugcaauuacuucucuuuccaauaccuccucaguuaacagugcgg

SEQ ID NO: 128999 - RNA, 25 nt, Homo sapiens
uguuggcccugcgucuucaacaggg

SEQ ID NO: 129000 - RNA, 43 nt, Homo sapiens
gacuaaccuuuuaaaugacucccagguggaaacgcccuccccu

SEQ ID NO: 129001 - RNA, 46 nt, Homo sapiens
cuccggggaggaacuucccugcccuggaucauguucuugggaacca

SEQ ID NO: 129002 - RNA, 45 nt, Homo sapiens
uggaugaucccacacaaauuaaagcuucccaagauacugagguau

SEQ ID NO: 129003 - RNA, 45 nt, Homo sapiens
ucuugcauuucagaggcugugcucucgguggaagacaagguagcg

SEQ ID NO: 129004 - RNA, 27 nt, Homo sapiens
ucuucagcuuccccauccugcugcacc

SEQ ID NO: 129005 - RNA, 40 nt, Homo sapiens
uucuuuccagaaagcuuuuuuaagccagugcugguaaaaa

SEQ ID NO: 129006 - RNA, 46 nt, Homo sapiens
cuucucaucaggacugaggucagcucccuguguaggguccucuccg

SEQ ID NO: 129007 - RNA, 49 nt, Homo sapiens
ccaccuccguuuucugcucuucgguucucuccuccacggugcugacgug

SEQ ID NO: 129008 - RNA, 36 nt, Homo sapiens
uucucaucaaacacuucugucgccaacggagcaggu

SEQ ID NO: 129009 - RNA, 46 nt, Homo sapiens
aauuuuuugaagguugauccuguuucacuggucacgggacuagucg

SEQ ID NO: 129010 - RNA, 43 nt, Homo sapiens
uucucuucuccuuccucuuugcauuccuccacugcuuggccag

SEQ ID NO: 129011 - RNA, 33 nt, Homo sapiens
agggagaaaagcccaauucuacaguggagaaau

SEQ ID NO: 129012 - RNA, 24 nt, Homo sapiens
gaagaucuuguucauuauugcuug

SEQ ID NO: 129013 - RNA, 35 nt, Homo sapiens
cuaugagguucggaguuuacuuagggagguccggg

SEQ ID NO: 129014 - RNA, 43 nt, Homo sapiens
auaaagaucuaaauggacgagggccgccugugauuuuucuuuu

SEQ ID NO: 129015 - RNA, 47 nt, Homo sapiens
ucccaguuuguacugcagugcauaucaaguguaaguucaaaguagau

SEQ ID NO: 129016 - RNA, 49 nt, Homo sapiens
ccaacuuauuggaaucuuugcuguugaauauuucaucuagaaaggccuu

SEQ ID NO: 129017 - RNA, 96 nt, Homo sapiens
gacaauuaaggaauaaugugaagugugaggcuuuacuuaccaccagcauucaggucaucuaaucuucccgcacccugcaguugugaaacggccaug

SEQ ID NO: 129018 - RNA, 45 nt, Homo sapiens
cuuuugaaaagacauuuguguucaaagccugagugauaaauuugg

SEQ ID NO: 129019 - RNA, 45 nt, Homo sapiens
ccccggggaacggggggaaaugaggcuguuaccggaaaugugccc

SEQ ID NO: 129020 - RNA, 32 nt, Homo sapiens
ugcccagugaccgucagccagagaagcaggaa

SEQ ID NO: 129021 - RNA, 42 nt, Homo sapiens
ccugugccccucuguuuugguguggcgggccuccgaggaggg

SEQ ID NO: 129022 - RNA, 44 nt, Homo sapiens
aagaaacugaauuugaaaaaugucuguuaugcaaugcuggagac

SEQ ID NO: 129023 - RNA, 45 nt, Homo sapiens
cgcuuuguagcauuugcuaaucuguaacgcuugguuuucuccccc

SEQ ID NO: 129024 - RNA, 45 nt, Homo sapiens
cuuuuuacuagugugaccugggcaagugacuuagccucuccaaac

SEQ ID NO: 129025 - RNA, 39 nt, Homo sapiens
augauuguuguuuuuauaaaaucagaauauaaaauuuga

SEQ ID NO: 129026 - RNA, 58 nt, Homo sapiens
ggugaccacaaauaauaauaaauacuauuaacugguguaacagcuucacuagucuauu

SEQ ID NO: 129027 - RNA, 46 nt, Homo sapiens
gugccaagggacuucaucuuaccuaucagugacguccgggccagca

SEQ ID NO: 129028 - RNA, 45 nt, Homo sapiens
gaaaaacacguuuuaaagcaguuuuggguucuaucaggguuggga

SEQ ID NO: 129029 - RNA, 32 nt, Homo sapiens
ucuauauaucauuuccuuuauggguuauucua

SEQ ID NO: 129030 - RNA, 57 nt, Homo sapiens
uggcuuuugggauagaucuuagaaagcucagagaguuuuaacaaagauugguccuug

SEQ ID NO: 129031 - RNA, 34 nt, Homo sapiens
gguaggugcaggccagagacuggaugcaacagga

SEQ ID NO: 129032 - RNA, 27 nt, Homo sapiens
ucacacagucagcccggcaccuccuug

SEQ ID NO: 129033 - RNA, 48 nt, Homo sapiens
ugcaaaaugauugucacuaugauguaaguuucuagaaaugccuuauuu

SEQ ID NO: 129034 - RNA, 86 nt, Homo sapiens
ugaaaaugccagcuggaaccuacaccaguuguugguggggugugagaacuauccuuuacauggacuuggagcauuugcaacuagag

SEQ ID NO: 129035 - RNA, 44 nt, Homo sapiens
gguuaaagaggcagagaggggagagaggaauguuccacauggga

SEQ ID NO: 129036 - RNA, 47 nt, Homo sapiens
caggcuccuuccuccugcgugagccacugcaagcugucggcgccuca

SEQ ID NO: 129037 - RNA, 70 nt, Homo sapiens
uaucucagcacuucaguuuaacuauuuuucaaaguccaaggaggguuuuccccaguguaaaagcagaaau

SEQ ID NO: 129038 - RNA, 71 nt, Homo sapiens
uaccaugauuacuuaagauuguuccucuuucagagaaguaaagcagcauagcugaguucaguaucccaugc

SEQ ID NO: 129039 - RNA, 49 nt, Homo sapiens
aacaacaccaugaguaguuuaccagaauuacccccaucuugcaggugag

SEQ ID NO: 129040 - RNA, 67 nt, Homo sapiens
aauaaaaagaauacuucuguauuuuaaugaauaggaucaagugagaaacugcuuuguaaaauaugaa

SEQ ID NO: 129041 - RNA, 45 nt, Homo sapiens
guguguccccuguagacauucucaucugaaaaaugagaaguugga

SEQ ID NO: 129042 - RNA, 66 nt, Homo sapiens
aguuugacuaguugguagauuaugcuuucccgcucacaucugaacacaccugguuguuagucuggu

SEQ ID NO: 129043 - RNA, 47 nt, Homo sapiens
cgagaucauggcggugcuggcccugacggacagccucgcagacauga

SEQ ID NO: 129044 - RNA, 70 nt, Homo sapiens
ggaaucauugccaugaaguuuuagauaguucugaaaaauaggaagauggaauuagauugaugauuaaaag

SEQ ID NO: 129045 - RNA, 46 nt, Homo sapiens
uaaccaucgggcagggaaacacagagaagggccauuaccggcaggu

SEQ ID NO: 129046 - RNA, 33 nt, Homo sapiens
uggcauuguccuagcaugccuuacauaagaggc

SEQ ID NO: 129047 - RNA, 42 nt, Homo sapiens
acugggaauaaauaagacugauccgagcacacugacagaaga

SEQ ID NO: 129048 - RNA, 64 nt, Homo sapiens
aaucauuccuuagcucacuuuacaguggugguuauugcugcaauuacaguuuguccuuggcacu

SEQ ID NO: 129049 - RNA, 50 nt, Homo sapiens
uagcuuaugccuguccugugugaugugaguagaccauaauagcccgagaa

SEQ ID NO: 129050 - RNA, 43 nt, Homo sapiens
acgccucuaaagacauucuuucuuugugguuacauccuuaggu

SEQ ID NO: 129051 - RNA, 70 nt, Homo sapiens
agagaugaagucugacuggaucaucauuuuguccccagcgucuagcucagugccugguacauagcaguac

SEQ ID NO: 129052 - RNA, 58 nt, Homo sapiens
gauguucaaaucuaguuagauccuuuuuccauguacccucauaauucagucugacugc

SEQ ID NO: 129053 - RNA, 46 nt, Homo sapiens
caagaggacaaacuccaaaagcuguggauguccuugccaaggagau

SEQ ID NO: 129054 - RNA, 34 nt, Homo sapiens
ugaaacuucagccucucuccccugugccaaggua

SEQ ID NO: 129055 - RNA, 53 nt, Homo sapiens
gcaacaaggcauuuauuaucucacaguuucuucaagucagagauuugguagua

SEQ ID NO: 129056 - RNA, 46 nt, Homo sapiens
uggguguggcucuccaagaauacauuuugguggacucauugaggaa

SEQ ID NO: 129057 - RNA, 49 nt, Homo sapiens
auuuugugauuaaauucuggaaauaugcauuuauaaguugauaccagcu

SEQ ID NO: 129058 - RNA, 44 nt, Homo sapiens
uaaaguuuucauguaggacaguuuuggcagucauggcuggagau

SEQ ID NO: 129059 - RNA, 34 nt, Homo sapiens
auucauauaacuuuuuuuccccugaaaaaaaaaa

SEQ ID NO: 129060 - RNA, 67 nt, Homo sapiens
aaggcaucugcuuaugaaacagucugccugaaugaaaucuccauuugcaggcaacacagucuacagu

SEQ ID NO: 129061 - RNA, 62 nt, Homo sapiens
ugugggugagauggagaaaaaagcacuggacccuccugggcaucacagccuuguacuuagcg

SEQ ID NO: 129062 - RNA, 63 nt, Homo sapiens
accuuugaaggaucaaagugucuaggguuuuuugugguuuuuuuuuuuuuuuuuugaacaaag

SEQ ID NO: 129063 - RNA, 31 nt, Homo sapiens
gguaaccucuuccugaccccgaugauuucac

SEQ ID NO: 129064 - RNA, 30 nt, Homo sapiens
uuuugggcagggcuagggaaccccccgccu

SEQ ID NO: 129065 - RNA, 43 nt, Homo sapiens
caucuuuuccaggcuuggagaugcguugagcauuuccacggag

SEQ ID NO: 129066 - RNA, 33 nt, Homo sapiens
uaguuugcacuugagagcccagaaauuuugauu

SEQ ID NO: 129067 - RNA, 54 nt, Homo sapiens
aacuacauccauggauaucagucugcuuuggacuccucugcuaguguuaaagau

SEQ ID NO: 129068 - RNA, 88 nt, Homo sapiens
ggccacuucuggcuuuguuagcaauaacugaccuucaguuuacccuucugaaggagaagggacucagcacagaauucacuuuagacgg

SEQ ID NO: 129069 - RNA, 38 nt, Homo sapiens
ccacacgcccuccaguccucaguucccacugccuaaca

SEQ ID NO: 129070 - RNA, 46 nt, Homo sapiens
cagugccuccgugauucccugaagaacgcuaauacuugcccaacuu

SEQ ID NO: 129071 - RNA, 42 nt, Homo sapiens
cugccccaggaccaugcugacagcugcauggugagcagugac

SEQ ID NO: 129072 - RNA, 30 nt, Homo sapiens
agcacaaugaguacaagaaagcgucgaggu

SEQ ID NO: 129073 - RNA, 44 nt, Homo sapiens
aaauucuuuugcaagccagaugauuaaccagagggcacgaaagg

SEQ ID NO: 129074 - RNA, 49 nt, Homo sapiens
uguuagaacagaagaaagucuagaaauguauaagcuaagugcuuaauuc

SEQ ID NO: 129075 - RNA, 46 nt, Homo sapiens
guccaugacaaugagcauccaguggaaaacacgccagcuucaaagc

SEQ ID NO: 129076 - RNA, 46 nt, Homo sapiens
cuuaaaggaaggaucugaaguuuugaguauaauauugaauuuucau

SEQ ID NO: 129077 - RNA, 45 nt, Homo sapiens
aacuuguuuagcaacaaaguccucaaugccuugaaaccagaaaaa

SEQ ID NO: 129078 - RNA, 45 nt, Homo sapiens
uagauuauagaugaaaucuuaaagaucaaugaagauaccagagua

SEQ ID NO: 129079 - RNA, 35 nt, Homo sapiens
aggaaucauuuauuccguauuuuucuuugggaaaa

SEQ ID NO: 129080 - RNA, 40 nt, Homo sapiens
agagggggaaaagccagcucccagugcucaugugcugcug

SEQ ID NO: 129081 - RNA, 41 nt, Homo sapiens
gcugggucagcucuacggcugcgagguaccugggcgcgggg

SEQ ID NO: 129082 - RNA, 42 nt, Homo sapiens
auauaaauuacguacuggguggagcaaauggauuuaaagaaa

SEQ ID NO: 129083 - RNA, 77 nt, Homo sapiens
cuuggcacgaguguguuucgcuuccaacuuggcgagggcgcugcgggucucgagcgcucuggccaaggccggccccu

SEQ ID NO: 129084 - RNA, 72 nt, Homo sapiens
cucuagcuucuaccucuccucccucccucccucccuccugcuguucuucacuuuuuaucaugacauccaguc

SEQ ID NO: 129085 - RNA, 37 nt, Homo sapiens
cuauucagcaaacaagauaccucuccauaaauuagaa

SEQ ID NO: 129086 - RNA, 55 nt, Homo sapiens
uuguuauuguguuuuuagcaaagacucucucauucagcaauaaccaaaaauaaaa

SEQ ID NO: 129087 - RNA, 51 nt, Homo sapiens
ugagaacaugggccugaaggagagucagcuccggccacugggaagaagcag

SEQ ID NO: 129088 - RNA, 47 nt, Homo sapiens
ugccaagaaccacagggccgagugaagaugcagggggugacuccuug

SEQ ID NO: 129089 - RNA, 45 nt, Homo sapiens
aaaggcggaaugauuccucuucucuguguuugauaaugcaggugg

SEQ ID NO: 129090 - RNA, 45 nt, Homo sapiens
ccgccuuuuggggaccagagagucaaaucauuccugugaugccag

SEQ ID NO: 129091 - RNA, 54 nt, Homo sapiens
auccagaacuuaauagauguauaaauuauaaacaaaacaugucccugccccaag

SEQ ID NO: 129092 - RNA, 46 nt, Homo sapiens
uccaugcuguaaccuuucuucgaacuccugagauucuuacuguaaa

SEQ ID NO: 129093 - RNA, 45 nt, Homo sapiens
acaucccaaccaacagcauguuguagcuacugguggccaagaugg

SEQ ID NO: 129094 - RNA, 46 nt, Homo sapiens
uuucacccauccaacccagaacaucuuuuuaccugcucugaagaug

SEQ ID NO: 129095 - RNA, 91 nt, Homo sapiens
uuuucguagaaguacuauaauuauaagauuucagauagaacaugcaauuagccuuuugaaauccaacuucugugcaaaauuuuaguaucag

SEQ ID NO: 129096 - RNA, 30 nt, Homo sapiens
aucuggauauaaguugauagcugucacagg

SEQ ID NO: 129097 - RNA, 46 nt, Homo sapiens
uuauuaccacagcugcuccuguaauuccaaccaccaugauguucaa

SEQ ID NO: 129098 - RNA, 46 nt, Homo sapiens
agugguuuccacauuccugauaagauacuggcuagugguuugcagu

SEQ ID NO: 129099 - RNA, 47 nt, Homo sapiens
aguugcaaacuggaaccagaugucauaggccacucaugaacuaaaau

SEQ ID NO: 129100 - RNA, 40 nt, Homo sapiens
agccucgagccacuccacaccgacucuccggcggcccaag

SEQ ID NO: 129101 - RNA, 42 nt, Homo sapiens
acuguaaauguuugcaaguggcuguguuuuaaaugggauuau

SEQ ID NO: 129102 - RNA, 52 nt, Homo sapiens
aacaguaugcauuuaaaaagacagaauuaugaaauuauaugagugcuuagaa

SEQ ID NO: 129103 - RNA, 47 nt, Homo sapiens
ucaugucccuuuuuaagccuuaccugagaggaacaaugccuuaaaau

SEQ ID NO: 129104 - RNA, 53 nt, Homo sapiens
ugucuucccugaacgugucuccacucugugaagccagcaucuaggggcuaaag

SEQ ID NO: 129105 - RNA, 48 nt, Homo sapiens
cugagccaaauggcccuguaucuucucuaaaaccacaucuaaaguuca

SEQ ID NO: 129106 - RNA, 28 nt, Homo sapiens
auaaaauaauuuuuuucuuucuuacaga

SEQ ID NO: 129107 - RNA, 46 nt, Homo sapiens
ugacaauauuggauuuguagguccugugccaccaaaacccaaaggu

SEQ ID NO: 129108 - RNA, 45 nt, Homo sapiens; identical to SEQ ID NO: 28557

SEQ ID NO: 129109 - RNA, 46 nt, Homo sapiens
uucaaaagaaaaagcuggauaaauuaaaaucugagguuaaugaaau

SEQ ID NO: 129110 - RNA, 42 nt, Homo sapiens
uucucuuugaagucguuccauucuggccuucugguguaccaa

SEQ ID NO: 129111 - RNA, 29 nt, Homo sapiens
agccuugacuuugaaccuaaaauagaaau

SEQ ID NO: 129112 - RNA, 41 nt, Homo sapiens
cguguuucacuuauucuauccacaugugcuaauguaggguc

SEQ ID NO: 129113 - RNA, 45 nt, Homo sapiens
aacucugcaaccucuccucgagugguagucacucagcccaauacg

SEQ ID NO: 129114 - RNA, 45 nt, Homo sapiens
ggcaagugagcauggguccugccuuuauucaucaccauccuccca

SEQ ID NO: 129115 - RNA, 49 nt, Homo sapiens
cucacuugcccagacauguuccuggaggcagcagaugcuccagaguuug

SEQ ID NO: 129116 - RNA, 46 nt, Homo sapiens
uguggcagcauucgcugaaauauagaccuuagguugacuacgggac

SEQ ID NO: 129117 - RNA, 67 nt, Homo sapiens
ucgaaccuccagcacuuccucuucagucaauagccagaccuuaaacagaaaucagcccacuguuuac

SEQ ID NO: 129118 - RNA, 113 nt, Homo sapiens
cauagccaauauaacauucagaauauuucaacaggaccucgaaaaaaccagauugaaaucaaacuugaacccccacaaagaaauaauucuucaaaacugcguucuucuggacc

SEQ ID NO: 129119 - RNA, 42 nt, Homo sapiens
uccucugucacauaccucaucucaacagccaaaucagcaagg

SEQ ID NO: 129120 - RNA, 61 nt, Homo sapiens
gguacaacucgacagacacaacagcauucuggcuggguaucucaguuuaaucccaugaacc

SEQ ID NO: 129121 - RNA, 46 nt, Homo sapiens
uguaaggccuaauauagauagaauuucccuguggacuguuaaguac

SEQ ID NO: 129122 - RNA, 59 nt, Homo sapiens
uacuuaacaguccacagggaaauucuaucuauauuaggccuuacauuacaacuccuggu

SEQ ID NO: 129123 - RNA, 65 nt, Homo sapiens
cuuugauucuuccacaggcucacagugcuaugcauauaguauguguuuggcaaacauuuucgugg

SEQ ID NO: 129124 - RNA, 45 nt, Homo sapiens
uaaucuuccaggcuuauuugaauuguuucucucuuguggccaaau

SEQ ID NO: 129125 - RNA, 69 nt, Homo sapiens
gagauaguggggaaaaauagucuccccccuagaacccaaguaacuucucccuaacuuuucaaguaaaag

SEQ ID NO: 129126 - RNA, 27 nt, Homo sapiens
acauguaauaaagauggagucagaagu

SEQ ID NO: 129127 - RNA, 64 nt, Homo sapiens
gggcuuuguuacauugcauuuugaacagggaaagugaugacucugauuuacuuuucacaaagau

SEQ ID NO: 129128 - RNA, 48 nt, Homo sapiens
uuugaucaacauucuuaaugacauaagagaagggaguugcagguggau

SEQ ID NO: 129129 - RNA, 70 nt, Homo sapiens
cuuaaccauggaugggaaaugacagucagugaacuugaagacaaagcaauagaaauuauccaaucugaag

SEQ ID NO: 129130 - RNA, 40 nt, Homo sapiens
aguauaguaacacuaacaucuagguaacaugcagcuagua

SEQ ID NO: 129131 - RNA, 46 nt, Homo sapiens
aauuaggggagcguuuagaagaugauuggaaauacgauagugaaag

SEQ ID NO: 129132 - RNA, 44 nt, Homo sapiens
acuuccauguuaacuuuuuaaaacuuuuaaaaugaaguuguggc

SEQ ID NO: 129133 - RNA, 47 nt, Homo sapiens
uucagacaggccugcccagauuccuaaggguguggggacugcuggga

SEQ ID NO: 129134 - RNA, 56 nt, Homo sapiens
cauugaccuacagcuacauuaguaguuguaggaaaagauccaugugggcugaagca

SEQ ID NO: 129135 - RNA, 44 nt, Homo sapiens
uugccaaacagaugaucuucugugcuugauuuauugggggcacu

SEQ ID NO: 129136 - RNA, 50 nt, Homo sapiens
ucuaaauaaucuucaccuuuuucccuggggaaacggaccaaaagaggaua

SEQ ID NO: 129137 - RNA, 58 nt, Homo sapiens
ucuuagacuaauagcaauggaauucagugagcgagugagggaaggagggaggcggaag

SEQ ID NO: 129138 - RNA, 54 nt, Homo sapiens
acaccaacauaguaagaauguuuaagugcuuugcauuaagcaucucagggaaua

SEQ ID NO: 129139 - RNA, 54 nt, Homo sapiens
cauaaaaaucccgugcauguuuuguuagauuuauaccuagauauauauuuuuua

SEQ ID NO: 129140 - RNA, 56 nt, Homo sapiens
ucacgcaacccaacaacugcacucuugggaauuuauccuacagagaugaaaacgua

SEQ ID NO: 129141 - RNA, 58 nt, Homo sapiens
auggaagacaaguucuuaaauuaacauucuagaaagauucucuuguuguagugcacaa

SEQ ID NO: 129142 - RNA, 61 nt, Homo sapiens
auaugacagggaaaucuuccuaggaaaggugacacuuaaucugaguguauaucagauaggc

SEQ ID NO: 129143 - RNA, 47 nt, Homo sapiens
ugacuuuccauuccucaucaaugagagaaaaauacuugcuaaugcag

SEQ ID NO: 129144 - RNA, 47 nt, Homo sapiens
aagccagauaauaaaguagagguuggaaagguccugcagagagagag

SEQ ID NO: 129145 - RNA, 49 nt, Homo sapiens
guggcuucagaaaggaagucugauuuaccuacaaacaaguacaagagac

SEQ ID NO: 129146 - RNA, 26 nt, Homo sapiens
uuucugaagccacucaaacugacacc

SEQ ID NO: 129147 - RNA, 56 nt, Homo sapiens
auugaagaacagacaaaaauagcuguuuucauauaguuuacauuuagugguaaaag

SEQ ID NO: 129148 - RNA, 44 nt, Homo sapiens
ugcugaugcugugagauguucaggcacagucguacaccaaagug

SEQ ID NO: 129149 - RNA, 46 nt, Homo sapiens
gagcacugcuuuuauaaucuaguccuacuuucagauucagagagau

SEQ ID NO: 129150 - RNA, 54 nt, Homo sapiens
gaugugccagcacccggcuugggcuccgguuccggcuccggcgcgggcucgggc

SEQ ID NO: 129151 - RNA, 45 nt, Homo sapiens
gaaaguuaaucuuuaagcgacucccgcccaaaggcuucacaagua

SEQ ID NO: 129152 - RNA, 46 nt, Homo sapiens
auagcucuaauaaguuauuuuccuauucgaugacacaaagggauga

SEQ ID NO: 129153 - RNA, 83 nt, Homo sapiens
cccccugcccugcugcauucuaauuucacaggugcccccgccuuccgggcacaacaggaaaugagucaaggcaaugaugauaa

SEQ ID NO: 129154 - RNA, 45 nt, Homo sapiens
gggucuuacuccuuggaggccaugugggccaugagguccaccauc

SEQ ID NO: 129155 - RNA, 115 nt, Homo sapiens
ccagugaggguagaugaggaaaagaggcagcagcuucauuggaauaugcaugaggacagaaggaaugaaccuaucaucauaagugaugaugacgagcagcccugcccagguucag

SEQ ID NO: 129156 - RNA, 62 nt, Homo sapiens
aucauucuaagugauagucuaaaggaagaaguggcucacagagauaagaagagguguucaaa

SEQ ID NO: 129157 - RNA, 51 nt, Homo sapiens
ucuguaaaguuaaauauugugauuucucccuaucauuuugauaauuccugg

SEQ ID NO: 129158 - RNA, 66 nt, Homo sapiens
aguuccugauuuauguucauucaaaaggugaagauguagagaaacaaaaaaaagaaccgaugagua

SEQ ID NO: 129159 - RNA, 51 nt, Homo sapiens
gaagauuugggguggcuacaaaagaagagaagaauaaaacucuaucagaaa

SEQ ID NO: 129160 - RNA, 52 nt, Homo sapiens
acauuggcaguccaauuuuaaauuaacuugugagagaagucugaaaagccag

SEQ ID NO: 129161 - RNA, 68 nt, Homo sapiens
cuagcaaaacuagacuucuugagugaugcaaauucaagaaugaaaaaguucaaucagcucaugaagaa

SEQ ID NO: 129162 - RNA, 26 nt, Homo sapiens
caugggccagaaauucuuggcuggcg

SEQ ID NO: 129163 - RNA, 46 nt, Homo sapiens
guuggaagaggaugaagaugauccggagagugagccagagggacaa

SEQ ID NO: 129164 - RNA, 46 nt, Homo sapiens
aagacaguggagguuuuggcucugauucugacacauacucgacaag

SEQ ID NO: 129165 - RNA, 101 nt, Homo sapiens
ggguaaugauuuauauuagugguuaguuaacuucaagugggcagagagaaugggguguuugugacccagaagguuuauuuuugaaguaauguuggccaacu

SEQ ID NO: 129166 - RNA, 45 nt, Homo sapiens
acaaaaguacuguugacuccucaaauguuuugucacuaauaaagu

SEQ ID NO: 129167 - RNA, 45 nt, Homo sapiens
uagaacuuuguuaaagaacaaguagcuuaguaaauagauugcuaa

SEQ ID NO: 129168 - RNA, 75 nt, Homo sapiens
uuauuccgucacauuauuuuggaggaaaacugaaaaagacagaaauccagaauaucgaauuugaaccaaaagaaa

SEQ ID NO: 129169 - RNA, 62 nt, Homo sapiens
ggaguguccauccuuuccaucuauaaguaugucaguucuauauauagauacgauguucaacg

SEQ ID NO: 129170 - RNA, 55 nt, Homo sapiens
cagaucaaaggccaugguuuuucugggacuuuuacauugggaaagaauuacaagg

SEQ ID NO: 129171 - RNA, 48 nt, Homo sapiens
gggaguccaaggaaaauucagaaagaaacuagaaaaucagggaacaag

SEQ ID NO: 129172 - RNA, 49 nt, Homo sapiens
augaugaugauccuuacuauuauuauuauaaguccaggagaaaucgcag

SEQ ID NO: 129173 - RNA, 67 nt, Homo sapiens
aucccgauucacaaggucacuguccagcuacuagcgacucuggaauaacugauguugcuaugucuaa

SEQ ID NO: 129174 - RNA, 71 nt, Homo sapiens
aaguacauguaucucugaauucaaccaagaacaugaaacagaggacugugcugaaucucuaaaucaugcug

SEQ ID NO: 129175 - RNA, 46 nt, Homo sapiens
ucagauagaucguaagccucguguucaaugccugaagugucaccug

SEQ ID NO: 129176 - RNA, 46 nt, Homo sapiens
uuaugaugagaaaaaucugaagaucaagccuuuuuacugcccccac

SEQ ID NO: 129177 - RNA, 67 nt, Homo sapiens
auauaggucugaauuaaaauuagaguuccaaagucauagguagaaaacaaagaaucuaacccaaaaa

SEQ ID NO: 129178 - RNA, 49 nt, Homo sapiens
uggaaaguucuaugugcuguguaaugucuguagaaaagcuucugcaaac

SEQ ID NO: 129179 - RNA, 45 nt, Homo sapiens
uuacugcaagaagaauccucagcaucucuacagcuuuauugccaa

SEQ ID NO: 129180 - RNA, 45 nt, Homo sapiens
aaucuucucccuuauuuaaagggaauagaaauuggcugacuacag

SEQ ID NO: 129181 - RNA, 46 nt, Homo sapiens
auuaugaacaguagaaaacagcauacaucucagaccaugauuugug

SEQ ID NO: 129182 - RNA, 38 nt, Homo sapiens
uuggagugucuuaaauuuuuuuuuuaauaaauaaucua

SEQ ID NO: 129183 - RNA, 21 nt, Homo sapiens
uuccauggaauuaaaaaagga

SEQ ID NO: 129184 - RNA, 49 nt, Homo sapiens
uuaguuacagcuuuguuauauaaaugcauucaauaaauucccauuuauc

SEQ ID NO: 129185 - RNA, 45 nt, Homo sapiens
uacuaucauuugcaaaaucacauagguuugauguugaauuuguug

SEQ ID NO: 129186 - RNA, 46 nt, Homo sapiens
aaagccuaauccgccuguucuucauaucauugaaccacaugaggua

SEQ ID NO: 129187 - RNA, 46 nt, Homo sapiens
guuuccuauccucuauaauauuucuauccaccacaaguagacagag

SEQ ID NO: 129188 - RNA, 49 nt, Homo sapiens
aaguucuuuagugaauguaggguaggguucaauaaauuauagcaaaggg

SEQ ID NO: 129189 - RNA, 42 nt, Homo sapiens
agaacucugaugaaaauacagcuuagagauccaggggccaaa

SEQ ID NO: 129190 - RNA, 41 nt, Homo sapiens
gcugguaaggccaguauuuugaggaguuuugcugcagagaa

SEQ ID NO: 129191 - RNA, 32 nt, Homo sapiens
gaaaguaccucauaugccuucccuuuuauuac

SEQ ID NO: 129192 - RNA, 40 nt, Homo sapiens
caccuuggauaccugucuaauagguaucugauagguuuca

SEQ ID NO: 129193 - RNA, 46 nt, Homo sapiens
acacuugauucauuccauggacuuuaguguauuaauaaacuuucau

SEQ ID NO: 129194 - RNA, 43 nt, Homo sapiens
ggaauuaagagagguaauguguacuuuucuuaugauaagauca

SEQ ID NO: 129195 - RNA, 50 nt, Homo sapiens
gaacugaaguucagauauauugaaacuuucuuaggacauguagcaaguaa

SEQ ID NO: 129196 - RNA, 41 nt, Homo sapiens
cuaccucgaugaaaugcugcaacugcggguccacugcaccc

SEQ ID NO: 129197 - RNA, 1918 nt, Homo sapiens
gacugaacuuuguugggugaggagccuggggcugggaccugaacacuguaccuacuuucccucuguccuuguaccgcgggacucgcgacaacgucggggauucgggguggggggcgggcaccuggcagcaacccuugauuuucucagguuccuguggccuagccggaugggagaagggugacuccgcuucucuggggacugucauuccggaccucggcuuuguugguguagaggacuggguaucaaagaagacuuaugccacuggacacccagcacuuucaggcacccgagguugaagcugccuagugcuggucaccaagacugaucggagcccccaguacugggauuuuauuuuuggcagcccgagucccagagagucagugaaucagugaaucugcuauuccuggacuccucgggauuuaccuucauuacccaguucuaacccucuccgcugaaaaaugaguggcuccagcccaguaacuauaaaagugguguaaucucuuccaacguacauacuuauuugcuuucuuguuggauuguuguguaauaccaagccguuuugggucugaagguugaggaauugagccugcccugugaggggacuuuggcaaaaggguggaagguauuugcagcuugccaacaacguguucugcuugccaaggacagaucucccuuaauguacacaauucacagaauucagaggccaaggauaauuuuccuuggaauuagagggucugaggcuuguguacauggcagagaauaaugaacgaaauuuuugaaccacuuaacuugaacuauauacagucauugguuuccauaggcccuuucccauaaacuuacaguauugcuggacuaugacaccuaccagaugcuuacuuaacucuggucugccuuggaccagagugcuuugauucuuuuuuaaaaauaucugugauucguuacuuuggggcuaggagggcgugugguuaaguacuauugcaagaaucuguaagcugcccggcgcgguggcucaugccuguaaucccagcacuuugggaggcggguggaucacuugaggucaggaguucgagaccagucugggcaacacggcgaagcccugucucuacuaaaaauagaaaaaauuagcugggcgggguggcacccgccuguaaucccagcuacucaggaagcugaggcacgagaauggcuugaaccuggcggagguuacagugagaucaugccacugcacuccagccugggugacagagccagacucugucucaaaaaaaaaaaagaaaagaaaagaaaggaaaaaaaacuguaagcuaugaugaaccccuuaggaaaaugcauucaauuuuccauucaucaugacaggauucaagaaucucuagcuuaaguagacaagguuauagaaucucaagucauauuuuuuuucuucuuugguagguuuuaggguaccuugcugaaaugauuuauccuuucacccuuuuauucuguaguuaacuuaaaggcauuuaguucaaacagcauuguggaguuaaaaccaaauucauugaaagguuacuucacuuauauuuugccauuuucuugcucuggaauaucccagcucugccauuuucuggcccuaugauuuuggguaaaguaucucugugccacaguuuuccucuuuguaaaaugaggauuuauaauaguaucuauuccauaguauuguuguaagaauuuaauguaaggcuagagaacauugcuauauacuuggucagcugccaaaugugaacuaucaguaacauaucagauauuauuuuuagguaaaguuuuuuuuucucuaagcaacaaaaagggaccccugcccccaaccgucuuuuucuuuccaaguucccuuugugauucuguaucuuguccugagcaggagaagugcauggacaagccugggccaaag

SEQ ID NO: 129198 - RNA, 49 nt, Homo sapiens
cucuucauuucuugaacuaccuuccuuuuccaaagagguaaugcugaga

SEQ ID NO: 129199 - RNA, 51 nt, Homo sapiens
agccuuucugacugaucucagcauuaccucuuuggaaaaggaagguaguuc

SEQ ID NO: 129200 - RNA, 51 nt, Homo sapiens
gggacauccugucaucugagaaugaacaaagaccaauuuuuugugugugaa

SEQ ID NO: 129201 - RNA, 49 nt, Homo sapiens
guaaaaaucucucauuuguguggagucauuucugauuucaggggagauc

SEQ ID NO: 129202 - RNA, 39 nt, Homo sapiens
ucuuccccuacuucugcccuuucugauaaacacaaggau

SEQ ID NO: 129203 - RNA, 44 nt, Homo sapiens
uauaugaugauuugcuuaaauauccauauuaaguaagucucaag

SEQ ID NO: 129204 - RNA, 68 nt, Homo sapiens
aucuagccagugaacauaauucuuauuacuagacugccacaaggaagaaauuaacuuacccuguauau

SEQ ID NO: 129205 - RNA, 87 nt, Homo sapiens
uagguuggguggguuggggggcaagggugucuauuugcagcagagauauuuugaaaagaagaaaauuguuuuauauaaaaaggaaag

SEQ ID NO: 129206 - RNA, 49 nt, Homo sapiens
uucaccagccucauucgcucaccauugguaccuucagcagaaagaaaug

SEQ ID NO: 129207 - RNA, 45 nt, Homo sapiens
agggagugagguuggggaggaggugucagaagugcgaggagagac

SEQ ID NO: 129208 - RNA, 46 nt, Homo sapiens
ggaucuuaacuaaaagacaaggguaugugaaguaggcuaggggugu

SEQ ID NO: 129209 - RNA, 52 nt, Homo sapiens
uuaguaauaaugugccacaaagccacagcagcuuuggagaacauuuucuuuc

SEQ ID NO: 129210 - RNA, 52 nt, Homo sapiens
auugaccuaaaaaaaaaaugacugguaccacagaggugguuuuguuacuuug

SEQ ID NO: 129211 - RNA, 38 nt, Homo sapiens
augaucauguagcaaaagaggggacgaaaagcagaugc

SEQ ID NO: 129212 - RNA, 44 nt, Homo sapiens
ugcuagaugacuagggacaacuuuuauuugaccaagaacagauu

SEQ ID NO: 129213 - RNA, 46 nt, Homo sapiens
aggaccugcuggccccaccgcacgacaccagcacggaucucacgga

SEQ ID NO: 129214 - RNA, 53 nt, Homo sapiens
cagcauucugcacugagcuacucgcuugauccagaugccuccggcccacaguu

SEQ ID NO: 129215 - RNA, 45 nt, Homo sapiens
uguuuuaugggaguugcuugcaagcuuucuggaugauaagaaaua

SEQ ID NO: 129216 - RNA, 55 nt, Homo sapiens
aaacuccucaggcagcacaaaggucggcuggaggcuaggaugcagauuuuagaag

SEQ ID NO: 129217 - RNA, 115 nt, Homo sapiens
cuacagguggaguaugagcagcugaaggaccagcaccuccgaagggggcucccugucgguucaccgccagagucgauuauaucuccccaucacacgucugaggauucagaacuua

SEQ ID NO: 129218 - RNA, 47 nt, Homo sapiens
agugagccagccgcagagcccagcucagauccugaagucaguagaga

SEQ ID NO: 129219 - RNA, 30 nt, Homo sapiens
guucauaucuauaucuauauauuucuagag

SEQ ID NO: 129220 - RNA, 47 nt, Homo sapiens
guuuuauuuuauaucuaucuacuauaucuuuacgcuuuguccauuug

SEQ ID NO: 129221 - RNA, 400 nt, Homo sapiens
gguauguuauugauagguaucauagaacuaauuuuuuguuuguuuguuuuguuuguuguuuuguuuuguuuuugagacagagucucacucugucgcccaggcuggagugcaguggcacaaucucagcucacugcaaccuuggcuucccggguucaagugauucuccugccucagccucccgaguagcugggauuauaggugcccaccaccaagcccaacuaauuuuuguauuuuuaguagagaugggguuucaccauguuggucaggcuggucucaagcuccugaccucaagugaucugcccaucucgaccucccaaagugcugggauuacaggcgugagccaccgugcccagccaacuaauuguuuuuuuaacuaauauuagaauaaguuuaccucuau

SEQ ID NO: 129222 - RNA, 48 nt, Homo sapiens
uggaaaggacuaaugggucuuuucucacugauagcagcuccaccacag

SEQ ID NO: 129223 - RNA, 56 nt, Homo sapiens
ucacaaucuccucaacuguuucaugaugacacccauucaagaauagaacaauaugc

SEQ ID NO: 129224 - RNA, 47 nt, Homo sapiens
cacauuaugauucuaaucuauuuuuuauugaaaaugaagacagcaaa

SEQ ID NO: 129225 - RNA, 101 nt, Homo sapiens
uguacgagacuucacaaagguacuuaagaacaaguucaggucgaagaaguacuuugccaaacacccucgacuugguuaccugccuguccagacaguucuug

SEQ ID NO: 129226 - RNA, 46 nt, Homo sapiens
uaugagaggaaagacaaggaagugagggugccuaagaaccagauag

SEQ ID NO: 129227 - RNA, 72 nt, Homo sapiens
augcccacuuaucuguguagguucaguucuaaaauguuuuucacagugagucacugucauuagcuuuccaaa

SEQ ID NO: 129228 - RNA, 23 nt, Homo sapiens
gauaaaauggaagaaaauugaaa

SEQ ID NO: 129229 - RNA, 57 nt, Homo sapiens
gugauaaugaaauguaccgcuuagcaguaugcauguaccaguugggacuacugguuu

SEQ ID NO: 129230 - RNA, 47 nt, Homo sapiens
ccuuuccaccccugccagcaucaauguacuucguaagacuauaaaaa

SEQ ID NO: 129231 - RNA, 45 nt, Homo sapiens
ugccaauauaucugcuuaugauuuaugguaauguuuuccuuuagc

SEQ ID NO: 129232 - RNA, 55 nt, Homo sapiens
uuacucaacauuuccuaaagucguuucaugucugccuuagaaaaugaacucaagu

SEQ ID NO: 129233 - RNA, 63 nt, Homo sapiens
uuagcuugaagaaaccuuugcuugcucacucuugugccuaaaccagguaucaagucuggacau

SEQ ID NO: 129234 - RNA, 40 nt, Homo sapiens
gcagcuuauccugcauuauacaaggauagcuucauuuuuc

SEQ ID NO: 129235 - RNA, 49 nt, Homo sapiens
gaaguuuagaaaacugauuauaaaaugcuaguaucaaaauaucauaaag

SEQ ID NO: 129236 - RNA, 44 nt, Homo sapiens
uauaaaaacugaugucuaugagcagaccuuaaauuaauguggac

SEQ ID NO: 129237 - RNA, 47 nt, Homo sapiens
uaaaaauucaaaauuauuaguuauucagugguuacaaauggauaaau

SEQ ID NO: 129238 - RNA, 42 nt, Homo sapiens
acacacaaaagggauguuuggucugcgcaggaguccauggug

SEQ ID NO: 129239 - RNA, 44 nt, Homo sapiens
caaacaaaagacauagaacugguuugcuuaguuuguaaaaugag

SEQ ID NO: 129240 - RNA, 49 nt, Homo sapiens
cauuuaaaaguaguuaaauuucuaagggcaaugcaguaaacagguauug

SEQ ID NO: 129241 - RNA, 50 nt, Homo sapiens
acaguacuguugucguggggauugaaauucccugaaagagaagacaagag

SEQ ID NO: 129242 - RNA, 46 nt, Homo sapiens
uacuuuuauucuguuuugguugccuacucugggagaacuucaggca

SEQ ID NO: 129243 - RNA, 45 nt, Homo sapiens
cucucugcccuaguuuuuuccaucuguaagauggagacaauauug

SEQ ID NO: 129244 - RNA, 35 nt, Homo sapiens
uauuaaggcagagaaauaaaccaguuuggggagag

SEQ ID NO: 129245 - RNA, 78 nt, Homo sapiens
aauuggccuuuaauaagaagggggacaauuucucaguuaaaggggagauaggauaacagacuggcaguuggagggaag

SEQ ID NO: 129246 - RNA, 84 nt, Homo sapiens
aggaaguagauaugguacaguacucauuggugaauuuugccugugaaggagagaaaaaaggugauaacuagcagaaaauguaga

SEQ ID NO: 129247 - RNA, 93 nt, Homo sapiens
uggaguucauugcuaauaauuauaggaccaguuugagugcaggagaaaaguuggaagccaaacagaaguggcuggaguggugaaugggacacg

SEQ ID NO: 129248 - RNA, 46 nt, Homo sapiens
aauuuugcaugauugccaugcaaugagaauuuccuggagcaaauua

SEQ ID NO: 129249 - RNA, 42 nt, Homo sapiens
ggaagguaaaggaagcagacaugauccuuaaaugcaggcagc

SEQ ID NO: 129250 - RNA, 36 nt, Homo sapiens
aaucccaggggccuuuaaaaguggcaggggaggcag

SEQ ID NO: 129251 - RNA, 67 nt, Homo sapiens
acuuuuaaaaauagaauucaguccuauuaucugaaagaaacugugauauaguuaauauuaaaaagaa

SEQ ID NO: 129252 - RNA, 47 nt, Homo sapiens
auuacaucaaguaaguugauuuuaauucuccuuuaugauaccaagaa

SEQ ID NO: 129253 - RNA, 46 nt, Homo sapiens
gcaccaaucaacuuuaaaguuaaaacggugaaugauuuauccaguc

SEQ ID NO: 129254 - RNA, 52 nt, Homo sapiens
caaagaaaaaugggaaagucuaaaugcuguaacuagcaauuggcaaaagcaa

SEQ ID NO: 129255 - RNA, 46 nt, Homo sapiens
auuucccaauauuuuaaucagaaacaucuuuuggucaugaggaaag

SEQ ID NO: 129256 - RNA, 42 nt, Homo sapiens
acuccuacuguaguaauaaaaucucauuuaaauaaacaauag

SEQ ID NO: 129257 - RNA, 43 nt, Homo sapiens
gcccgaguuuucuuggcugaucagccaauugaggccccugaag

SEQ ID NO: 129258 - RNA, 45 nt, Homo sapiens
agauaguuaagcagaauaaugagaaugggaaauguaggggaugag

SEQ ID NO: 129259 - RNA, 47 nt, Homo sapiens
uacgcggagcugcuggcaucaucgaagagcuggggagggagaucaga

SEQ ID NO: 129260 - RNA, 45 nt, Homo sapiens
ugcuuggaggccaaaacuucacuuuauacaauuugucugggaggg

SEQ ID NO: 129261 - RNA, 43 nt, Homo sapiens
agaggagaacugguuugauguuuggguuagucaugccuagaag

SEQ ID NO: 129262 - RNA, 46 nt, Homo sapiens
ggcucugagauuucgccuuagaauagggauauaaagcaaugcuuua

SEQ ID NO: 129263 - RNA, 46 nt, Homo sapiens
aggagauguuccagccuuacagcuccaguaugaccauuguaaggua

SEQ ID NO: 129264 - RNA, 46 nt, Homo sapiens
gaggccagcgcugagaaguggaacagguugcugauguccuuagaag

SEQ ID NO: 129265 - RNA, 32 nt, Homo sapiens
gucaaauuuauuugcugcaaaauggcuuagaa

SEQ ID NO: 129266 - RNA, 43 nt, Homo sapiens
acacuauuuccuuuuauaucuguacacugggagaaggaauaau

SEQ ID NO: 129267 - RNA, 72 nt, Homo sapiens
gugcuccguaaauguuuacuugugcugaguaaaugaaaaacuguauuuuauuuuaaccaaugcuccuucuca

SEQ ID NO: 129268 - RNA, 337 nt, Homo sapiens
auaugcuagaucuacaauauuucaacuugauuauuuauuuauuuauggaacagagucuugcucugcugcccaggcuggagugcgauggugcaaucuuggcucacuacaaccuccaucucccagguucaagugaugcucaugccucagccucccauguagcuggaaauacaggcacgugccaccaugcccagcuaauuuuuguauuuuuaguagagacaagguuucgccauauuggcugggcugcucucgaacuccuggccucaagugauccacccuccucggccuuccaaagugcuaggguuacaggcgugagccacugcaccuggccccaacuuga

SEQ ID NO: 129269 - RNA, 52 nt, Homo sapiens
ugccaccuguucuagacuauucauaaauguucauauauuuuaaaucuaacaa

SEQ ID NO: 129270 - RNA, 35 nt, Homo sapiens
uggaagggguagauacuugugauuuuuguauauca

SEQ ID NO: 129271 - RNA, 49 nt, Homo sapiens
gcuacuaugcuucaacaucgacuggaugauaugaaccaaagauggaaug

SEQ ID NO: 129272 - RNA, 46 nt, Homo sapiens
uauaguaaacacauuucaaagucuccucauuuauucccuacuuagc

SEQ ID NO: 129273 - RNA, 41 nt, Homo sapiens
aagucagcugguaauuuaacugaaacuucuuuggagaaaaa

SEQ ID NO: 129274 - RNA, 52 nt, Homo sapiens
acuggucauuucugucaauugugaaucugcucauacuuguucuucaugaaac

SEQ ID NO: 129275 - RNA, 44 nt, Homo sapiens
aggggcauuaacaaagcuuugaaaugccaaagcagacuuuccag

SEQ ID NO: 129276 - RNA, 46 nt, Homo sapiens
acacacaauuucuuucagauagucaccagaguagucaucaaaagga

SEQ ID NO: 129277 - RNA, 55 nt, Homo sapiens
ucuuggcucaucauucuuuaaauuccaaaaaugacuaauuuguggggauacauaa

SEQ ID NO: 129278 - RNA, 69 nt, Homo sapiens
ccuuuguaauuuaauuuauuugugucauuuuaggcauauugcauaccugcuaauguagaauggagaucu

SEQ ID NO: 129279 - RNA, 47 nt, Homo sapiens
ccagguagauguuuuaugcuggguuccuaaagguagaaaugguggga

SEQ ID NO: 129280 - RNA, 45 nt, Homo sapiens
gauugcuuuuaauuucauuauggcacacagaauuuagugaagaaa

SEQ ID NO: 129281 - RNA, 56 nt, Homo sapiens
gcuugcauaguaagagcagcuccagugugguauuaguaggguuaaugauugagugu

SEQ ID NO: 129282 - RNA, 76 nt, Homo sapiens
auuaaggauuauuguaaagugaaauagcagcuuugaggucugaaacacugagggagaagaaggaaaagaagagaca

SEQ ID NO: 129283 - RNA, 56 nt, Homo sapiens
uuuucuuuuugaucuggcugccuucuuggugauauuacuaugagaaugaggaggga

SEQ ID NO: 129284 - RNA, 48 nt, Homo sapiens
ccaagauaauacugguuuucuuacuacuuuuuuuccaucucuuguaca

SEQ ID NO: 129285 - RNA, 45 nt, Homo sapiens
ccuuucuuauuucaaaaaaucacuuugaaaaaaagcauagcuucu

SEQ ID NO: 129286 - RNA, 43 nt, Homo sapiens
cucugaugccuggguaaauuaaucggggugugcaugccauugc

SEQ ID NO: 129287 - RNA, 49 nt, Homo sapiens
acuguaguugguuacauucagggucaauagaaaugauuucuugagauau

SEQ ID NO: 129288 - RNA, 37 nt, Homo sapiens
auauuaucuuaaaacagaaacaguaaagcauggagaa

SEQ ID NO: 129289 - RNA, 23 nt, Homo sapiens
ugugauucuuuuagcacacauac

SEQ ID NO: 129290 - RNA, 45 nt, Homo sapiens
cauuucugggcgagguaaaugaguccaaauaauugaaauuggaaa

SEQ ID NO: 129291 - RNA, 23 nt, Homo sapiens
ucaugagaaagucuugguuagau

SEQ ID NO: 129292 - RNA, 44 nt, Homo sapiens
aauggagauuuacuuuaacaugaucugauuguugagaugugugu

SEQ ID NO: 129293 - RNA, 30 nt, Homo sapiens
aaauacauguagagaccaaaaugaaugaga

SEQ ID NO: 129294 - RNA, 24 nt, Homo sapiens
agaagugcuuuuugggaagacuuc

SEQ ID NO: 129295 - RNA, 24 nt, Homo sapiens
gaagaauuuaauuucacuuggaug

SEQ ID NO: 129296 - RNA, 41 nt, Homo sapiens
aggugucuccagaagugugguaaacuuaaaaugauggcugu

SEQ ID NO: 129297 - RNA, 63 nt, Homo sapiens
aacaauccaagaugguauuuuguaaaaggaugaguggugguaccauucaccgaauugggaaag

SEQ ID NO: 129298 - RNA, 43 nt, Homo sapiens
ugauuauugacagucuucagugggaugaccauagggaggagac

SEQ ID NO: 129299 - RNA, 46 nt, Homo sapiens
gaggagaaauagaaagagagagaaggugauaaugagugaaaggaau

SEQ ID NO: 129300 - RNA, 37 nt, Homo sapiens
uuuuuccaucaccucucuuuuuguccaaaacuucuuu

SEQ ID NO: 129301 - RNA, 70 nt, Homo sapiens
ugucuuuuaacucaacccaaaauucaguccacaaauauuuauugagcaacuacuaugugcuuaugugacu

SEQ ID NO: 129302 - RNA, 42 nt, Homo sapiens
gcgccauccucagcuggauuauguuuuuacauuggcacagaa

SEQ ID NO: 129303 - RNA, 41 nt, Homo sapiens
cgugcucugcuuuaguagaagacuaggauggauuggaggca

SEQ ID NO: 129304 - RNA, 39 nt, Homo sapiens
ggagccaggaugaggaaggggaucacuucuccagugaug

SEQ ID NO: 129305 - RNA, 76 nt, Homo sapiens
aaggagaaaguaagcaggugaugaaguacaggcaucagcuagaugagauuaucuguugguuaacaaaggcugagca

SEQ ID NO: 129306 - RNA, 41 nt, Homo sapiens
cacuuacucagcugaaugcaaaaugggacagaauuaauaga

SEQ ID NO: 129307 - RNA, 46 nt, Homo sapiens
uagauggaugaggagagugcccagauugaggaaguucuacaaagag

SEQ ID NO: 129308 - RNA, 42 nt, Homo sapiens
uggugugccuuucucugacuuggaaaaauuagaaaaugacau

SEQ ID NO: 129309 - RNA, 45 nt, Homo sapiens
ccguggaagcucaagcagggagcuuguagaaccaaaguuagcuga

SEQ ID NO: 129310 - RNA, 46 nt, Homo sapiens
uauuggaugaaauugaaaagaaaccaacaaguaaacaggaagaaau

SEQ ID NO: 129311 - RNA, 50 nt, Homo sapiens
ugcguccuuaacgcuggguggagccgaguucguaccuggacugaagauug

SEQ ID NO: 129312 - RNA, 60 nt, Homo sapiens
ugaauggcuuucugcuacugaaacugaauugguacagaaguccacuucagaaggucugcu

SEQ ID NO: 129313 - RNA, 43 nt, Homo sapiens
auauuuaauucaggcuaauauuuauacuuucaauggcuacuga

SEQ ID NO: 129314 - RNA, 46 nt, Homo sapiens
aaacugugauuaaaacaggaagacauauuguccagaaacagcaaac

SEQ ID NO: 129315 - RNA, 44 nt, Homo sapiens
cguucucagccccugaccuccccagagaguaggacugccagagg

SEQ ID NO: 129316 - RNA, 47 nt, Homo sapiens
aaagcaacuccaggugcugcgggaaacugaccagaugcuucaagucu

SEQ ID NO: 129317 - RNA, 64 nt, Homo sapiens
uggccagacucugauugauggggggauccuggaugauauaaucagugagaaacuggaggcuuuc

SEQ ID NO: 129318 - RNA, 55 nt, Homo sapiens
cucuggaaucuguucugcgccacccggcagauaaucgcacccagauucgagagcu

SEQ ID NO: 129319 - RNA, 41 nt, Homo sapiens
cacggcauuucucuuugcugugaugaggccacacguguauu

SEQ ID NO: 129320 - RNA, 75 nt, Homo sapiens
aagucauuuuguauauucaaacuuuacuuuuuuuauaggugcaauccagguuuucauguaacagaugaucuguag

SEQ ID NO: 129321 - RNA, 28 nt, Homo sapiens
aaagagggguuaaaaacaggagaccaaa

SEQ ID NO: 129322 - RNA, 46 nt, Homo sapiens
cucugguggccaggaguugacgucugagcugaauguugugcuggag

SEQ ID NO: 129323 - RNA, 42 nt, Homo sapiens
caguaaacauacuuuggauaacuuacguuaacacugcuguua

SEQ ID NO: 129324 - RNA, 46 nt, Homo sapiens
acucaaaaaaguagguugucugaaagucaagaaaaagcugcgaacc

SEQ ID NO: 129325 - RNA, 62 nt, Homo sapiens
cuaaaggucuugguuuccaaagaucuacauuugcuugaggaaauugcucucacacucagagc

SEQ ID NO: 129326 - RNA, 54 nt, Homo sapiens
guagaaaaauuauauaagcaagaauuugaugaugugcaaggaaaguggaacaag

SEQ ID NO: 129327 - RNA, 46 nt, Homo sapiens
gaguugugugaccguauuuucucuuccuuagcgggaauugacaaau

SEQ ID NO: 129328 - RNA, 44 nt, Homo sapiens
uuauuucaagcagcuugaugagcuugaaaaggucaucaagacaa

SEQ ID NO: 129329 - RNA, 46 nt, Homo sapiens
cuacugaagaaauaaaaaauguucuggagaagguuucaucagaaug

SEQ ID NO: 129330 - RNA, 41 nt, Homo sapiens
aauuaaaccaaacuggacaaauccuuguggagcaaauggga

SEQ ID NO: 129331 - RNA, 78 nt, Homo sapiens
ggaaaacugccauucagaccacagagauaaaagaguauaugaagaugcaagacacuuccgaaaugaaaaagaaguuga

SEQ ID NO: 129332 - RNA, 27 nt, Homo sapiens
auuuugaaggaagacauggaaaugaag

SEQ ID NO: 129333 - RNA, 41 nt, Homo sapiens
aaaggaacuaagugucaguguucgacgucuggcuguaagug

SEQ ID NO: 129334 - RNA, 50 nt, Homo sapiens
aagaacgcuggaauagguuacaagaaaucaauauauuguggcaggaauua

SEQ ID NO: 129335 - RNA, 66 nt, Homo sapiens
acaggugaaaguaaauucacuaacucacaugguggucauuguugaugaaaacaguggugagagugc

SEQ ID NO: 129336 - RNA, 57 nt, Homo sapiens
gauucaggaacagaugacccugcugaaugcuagaugggaggcucuuaggguggagag

SEQ ID NO: 129337 - RNA, 55 nt, Homo sapiens
aggcaggcaaccaacugauaacacaaggaacucugucagacgaagaagaauuuga

SEQ ID NO: 129338 - RNA, 60 nt, Homo sapiens
gagcaggaugauauuucugaugauguugaagaagucaaagaccaguuugcaacccaugaa

SEQ ID NO: 129339 - RNA, 52 nt, Homo sapiens
ugcguuggaggaagugcugaccugguugcuuucugcugaggacacuuuccag

SEQ ID NO: 129340 - RNA, 64 nt, Homo sapiens
gcaagucaccauagacgccauccgugagguagagacacucccaaggaaauauaaaaaagaaugu

SEQ ID NO: 129341 - RNA, 61 nt, Homo sapiens
agcuuccugacaagaaauccauaauuauguauuuaacaucuuuguuugaggugcuaccuca

SEQ ID NO: 129342 - RNA, 78 nt, Homo sapiens
ugucaccaauugagagacuugaacaugccuucagcaaggcucaaacuuauuugggaauugaaaagcuguuagauccug

SEQ ID NO: 129343 - RNA, 50 nt, Homo sapiens
cacuuggcaucggagagggcaguggcugcagugaccugaguggggggagu

SEQ ID NO: 129344 - RNA, 40 nt, Homo sapiens
cgugaguucuucuuagugcaucauaucggggauaggugau

SEQ ID NO: 129345 - RNA, 50 nt, Homo sapiens
uuuccuuuuuuuaaaaaacacaauuaaaaauugaaauuguauaauuuuug

SEQ ID NO: 129346 - RNA, 41 nt, Homo sapiens
uuagaacauaaucaaugcuuugagcaauauuuuuucauagg

SEQ ID NO: 129347 - RNA, 47 nt, Homo sapiens
agcaaguucucuugguuaauaaauggcuuauguggccuugaucagau

SEQ ID NO: 129348 - RNA, 55 nt, Homo sapiens
agccacaggcaaauucuuguucuuuuacugaauuccugucuaguagaaaauaaga

SEQ ID NO: 129349 - RNA, 50 nt, Homo sapiens
augcuuaaaagaccagcaaauguucaagacaaaugagaggaagagcuauu

SEQ ID NO: 129350 - RNA, 33 nt, Homo sapiens
aaaacgcuagguuuugggguguccuuaggaagg

SEQ ID NO: 129351 - RNA, 355 nt, Homo sapiens
uuauaggacaugucaggcuuauuuuaucuuauuuucuuuuaugagacagguucucacucugucucccaggcuaaagugcaguggugugaucauggcucacugcagccucgaacucuuggguucaagugauccucccaccccacccucccaaguagcugggaccacaggcauaugccaccacacccagcuaauuuuuguacuuuuuguagagacaggguuuuaccauuuugcccaggcuggucucgaacuccugggcucaagugauccacucgccuuagccucccaaaguguugggauuacagacaugagucauugcgcccaggccauuucagccuguuuaacauuccuuuugcag

SEQ ID NO: 129352 - RNA, 29 nt, Homo sapiens
gaauuaagcagguugagaacagggugaag

SEQ ID NO: 129353 - RNA, 24 nt, Homo sapiens
gaauauuuucaaaggucugcauuu

SEQ ID NO: 129354 - RNA, 53 nt, Homo sapiens
uuuggagcauaagauauuuugugaucagaagaaggugaaucugucagaggugu

SEQ ID NO: 129355 - RNA, 35 nt, Homo sapiens
cacagacucacacacagagacacacacacacagac

SEQ ID NO: 129356 - RNA, 35 nt, Homo sapiens
uuauuuuacuugcugaggcuggauauuauauucuu

SEQ ID NO: 129357 - RNA, 51 nt, Homo sapiens
ccuguggaauucuuuuaguuuuucucuuccauguuuauauauuugauauga

SEQ ID NO: 129358 - RNA, 46 nt, Homo sapiens
uuaauuaaugaaacuugggcuucaucaagcucagguggaauggaua

SEQ ID NO: 129359 - RNA, 39 nt, Homo sapiens
cagcuucuuguugauggcguccuuggagcuggcauugau

SEQ ID NO: 129360 - RNA, 60 nt, Homo sapiens
aaaucuacuauauaugcugauauuucagaaauggugguucccuuaaccuucaagaaaaaa

SEQ ID NO: 129361 - RNA, 45 nt, Homo sapiens
uuaagugguagaagggcccuggaguucaguuaauaaagcugggau

SEQ ID NO: 129362 - RNA, 68 nt, Homo sapiens
cucuauuaguaauuucagcuucaacaaauaggauagaauaaaugcaaauuaaaaauaaauuaggagca

SEQ ID NO: 129363 - RNA, 24 nt, Homo sapiens
cuucuuugauaaaauaaccuucag

SEQ ID NO: 129364 - RNA, 39 nt, Homo sapiens
uguaaagauauucuccauguuguuaccucauuaugcuga

SEQ ID NO: 129365 - RNA, 53 nt, Homo sapiens
uuaggguauauccauaaaguagaagauuaagcauucauaaaaagugauacaga

SEQ ID NO: 129366 - RNA, 42 nt, Homo sapiens
cuguaaauauguagcaacuauuguguagcuugacgggucuuu

SEQ ID NO: 129367 - RNA, 46 nt, Homo sapiens
ccugacaaugggcagaacgaauucagugauaucauuaaguccagau

SEQ ID NO: 129368 - RNA, 46 nt, Homo sapiens
auauucacccauuucuuucuaucuacucuuguuuagaccacacuug

SEQ ID NO: 129369 - RNA, 87 nt, Homo sapiens
cgcaggucaguucuguuccuaauggcuaccucaaguuccuugacaaugucccucuugggccccucaucuauggcauuccaguuccac

SEQ ID NO: 129370 - RNA, 42 nt, Homo sapiens
uagugaacaacuaucagccugagguucuguggucggauggug

SEQ ID NO: 129371 - RNA, 45 nt, Homo sapiens
ucagcccaguucggggcacaguagucaccaaugaucguuggggag

SEQ ID NO: 129372 - RNA, 64 nt, Homo sapiens
ggcaccauuucuguaguuuuugaggagcgacugaggcaaaugggguccuggcuaaaagucaaug

SEQ ID NO: 129373 - RNA, 41 nt, Homo sapiens
gauuaaaaaugaaucaaaauagggaggguucagggaagaug

SEQ ID NO: 129374 - RNA, 42 nt, Homo sapiens
cugccucaucaaccacauguauuagaaaugaaaugcagaaaa

SEQ ID NO: 129375 - RNA, 41 nt, Homo sapiens
gcugaugcugcaaguuaugucuaaggcuaggaacuaucagg

SEQ ID NO: 129376 - RNA, 50 nt, Homo sapiens
aggguggggcccuaaagccaauaggauugauguccuuauaagaaggggaa

SEQ ID NO: 129377 - RNA, 110 nt, Homo sapiens
ggccaagaaggcaguguugaaagguguccacagccacaaaaagaagaagauccgcacgucacccaccuuccggcggccgaagacacugcgacuccggagacagcccaaau

SEQ ID NO: 129378 - RNA, 57 nt, Homo sapiens
gauauuugggcugucuccggagucgcagugucuucggccgccggaaggugggugacg

SEQ ID NO: 129379 - RNA, 45 nt, Homo sapiens
aacacacuuguguucauuguggauguuaaagccaacaagcaccag

SEQ ID NO: 129380 - RNA, 46 nt, Homo sapiens
gacauugauguggccaaggucaacauccugauucggccugauggag

SEQ ID NO: 129381 - RNA, 55 nt, Homo sapiens
cugaguccagcugccuaauucugaauauauauauauauauaucuuuucaccauaa

SEQ ID NO: 129382 - RNA, 42 nt, Homo sapiens
agccuaucaggaucacaguuuuaaggaagacuugguuuuguu

SEQ ID NO: 129383 - RNA, 59 nt, Homo sapiens
ggaaugcacaacgucaagaguaaacccuaacauagacucuggguaauacugauggauca

SEQ ID NO: 129384 - RNA, 44 nt, Homo sapiens
uagaagaucagcaguugccaagaguuagggggagagggagggau

SEQ ID NO: 129385 - RNA, 42 nt, Homo sapiens
agugcguuuuacaaauuuuaaucaugaaaaaauaaaggucuc

SEQ ID NO: 129386 - RNA, 45 nt, Homo sapiens
uugguaugcuaauggagaauaauuuauaucaaauuuuucauagcu

SEQ ID NO: 129387 - RNA, 46 nt, Homo sapiens
gaaggaaaacccggaggucuugauaaccaggaaagcaaguguaagg

SEQ ID NO: 129388 - RNA, 46 nt, Homo sapiens
aagucuuuugauagaugucauaacaguauuuggagaacucacugau

SEQ ID NO: 129389 - RNA, 53 nt, Homo sapiens
uuuggagaauuaugcuuugaaaauguuuuuguaugcagacaaugaagaucgug

SEQ ID NO: 129390 - RNA, 41 nt, Homo sapiens
uuuaucacuaucugcauuaaaugacagguaagauaaaugua

SEQ ID NO: 129391 - RNA, 51 nt, Homo sapiens
cugagaagccagauacuaaagagaagaaaccuaaggccaagaaagcugaug

SEQ ID NO: 129392 - RNA, 24 nt, Homo sapiens
gugcuuuuguuagcaugaugcauu

SEQ ID NO: 129393 - RNA, 45 nt, Homo sapiens
uaaccucaauuuauuauuguuucuacuuggugacccuuaacaagu

SEQ ID NO: 129394 - RNA, 46 nt, Homo sapiens
ucaaauucuuccuucuuggcaguccgauucuuauugugccaguuga

SEQ ID NO: 129395 - RNA, 78 nt, Homo sapiens
ugcuucucaucuucagcuuuuuaauucucagcuuccuggaccauacguucaaugucuuccuugcucaaauggcccuua

SEQ ID NO: 129396 - RNA, 46 nt, Homo sapiens
cuucaaucugaggaacaccuugggguucaggagguaugcccgugaa

SEQ ID NO: 129397 - RNA, 45 nt, Homo sapiens
gcacgcucaccuucauaaaccugaauaagcacaccaggcugguug

SEQ ID NO: 129398 - RNA, 45 nt, Homo sapiens
uuucaauaccaagggaaagaggagugacguccaagagcagcaaau

SEQ ID NO: 129399 - RNA, 46 nt, Homo sapiens
uuggagaagcuucugaaucuuggggauacuaauagaaccaccaacc

SEQ ID NO: 129400 - RNA, 45 nt, Homo sapiens
caauuccuacauagagagaaucgaucucaauacugacuugggugc

SEQ ID NO: 129401 - RNA, 49 nt, Homo sapiens
ucuacuuggaccuggggccugucagcaucauucacuaccaugaagggcc

SEQ ID NO: 129402 - RNA, 46 nt, Homo sapiens
uuuccgugcuggaaaacacccacguaagaguagguggugcuaagau

SEQ ID NO: 129403 - RNA, 50 nt, Homo sapiens
guccugccgagcugugagggcaacggaggggaaauaaaagggaacggcuc

SEQ ID NO: 129404 - RNA, 42 nt, Homo sapiens
agggcguugaaggcgugcuggggcugcugcugcuggugguga

SEQ ID NO: 129405 - RNA, 46 nt, Homo sapiens
ccuucaacgcccuaaugggcgagcacauacacuacggcgcgggcaa

SEQ ID NO: 129406 - RNA, 42 nt, Homo sapiens; identical to SEQ ID NO: 28998

SEQ ID NO: 129407 - RNA, 46 nt, Homo sapiens; identical to SEQ ID NO: 28999

SEQ ID NO: 129408 - RNA, 41 nt, Homo sapiens
auaaacuuguacaaauugguuuuaaaaaaaauugcugccac

SEQ ID NO: 129409 - RNA, 41 nt, Homo sapiens
gccaacuugaaagugaacaguaugacuuuccugauccagaa

SEQ ID NO: 129410 - RNA, 43 nt, Homo sapiens
uuuuguguccugguagcagcuguugaguaacuuucauuggagg

SEQ ID NO: 129411 - RNA, 52 nt, Homo sapiens
aauaauuuuacuauuucuuuuaaaaguauguuuuggaaaaucaaugauuuua

SEQ ID NO: 129412 - RNA, 38 nt, Homo sapiens
uccugugcauuuggguugggguucacucuuaccaagaa

SEQ ID NO: 129413 - RNA, 42 nt, Homo sapiens
ucuaauuuaaaggagaguuacuuuguuguaugugugccacua

SEQ ID NO: 129414 - RNA, 46 nt, Homo sapiens
cagagagauuacguaguuaaaagaguguuuaucucagguuacagaa

SEQ ID NO: 129415 - RNA, 45 nt, Homo sapiens
uccaaaugauaaaaucuuugcuuauaauugguagaugaaacauuu

SEQ ID NO: 129416 - RNA, 46 nt, Homo sapiens
guacauuucagccauaaauugaaugacacgagguugguuaguauaa

SEQ ID NO: 129417 - RNA, 52 nt, Homo sapiens
ugggcccaucuagcuguguauccucuuagauccuuauaaacauaacagugag

SEQ ID NO: 129418 - RNA, 60 nt, Homo sapiens
agggccacuugaagaaggacacagacugguaucaggugaagcggaugcaggacgagaaaa

SEQ ID NO: 129419 - RNA, 190 nt, Homo sapiens
augcgacuuuuuucagcacuggaguuuuacaaagccugggcccaguggugccggaaacacuaagaugaguaagaggcuuccucuccugagucgucagcugguggggauuaugaagaguccccaugaugagggacucaaguaagauuggggccagaccaucagggaggggaggagaaggguuggagucagg

SEQ ID NO: 129420 - RNA, 61 nt, Homo sapiens
uguagagagugggaugguacuuucccagcuaagaaggcuggcaccucccugggcuugggaa

SEQ ID NO: 129421 - RNA, 49 nt, Homo sapiens
gacaaaaguguaaguugggagagcaugcaaguggcaacauuuggcccaa

SEQ ID NO: 129422 - RNA, 693 nt, Homo sapiens
gguuuaaaaauacauauuguuacaggagagggguccugauccagacuccaagagaggguucuuggaucucgcacaagaaagaauucagggcgaguccgcagugcaaagugaaagcaaguuuauuaagaaaguaaaggaauaaaagaauggcuacuccauagacagagcagccccaagggcugcugguugcccacuuuaugguuauuucuugaugauacacuaaacaagugguggauuauucaugccuccccuuuuuagaccauauaggguaacuuccugacguugccauggcauuuguaaacuugucauggcacuggugggaguggagcagugagaaugaccagaggucacucucgucaccauuuuggguuuggucgguuuugaccggcuccuuuacugcaaucuguuuuuaucagcaaggucuuuaugauauguguuuugugccaaccuccugucucaucaugugacuuaacuaucugggaaugcagcccaguagguuucagccucauuuuacccagcuccuauuuaagauagaguugcucugguucacacgccucuugacaauauaacagaguacuuauuugucugacacugagaagaacaucuucaugggguuagaagaagauaauuuugaaggucuccuuuuccuucuacuucuuugacacuagucaguaaauauugagugaauuaucu

SEQ ID NO: 129423 - RNA, 57 nt, Homo sapiens
cgcucuuccuugguugcucuuggggaggggauuuauguuaauugaauucuuuuugag

SEQ ID NO: 129424 - RNA, 36 nt, Homo sapiens
caaauuacuuuugcuaaauuguacagaugaggauaa

SEQ ID NO: 129425 - RNA, 361 nt, Homo sapiens
uguaaaaauggguacaucuuccuuauauagaaauaaacgcugccaggcgugguggcucacaccuguaaucccagcacuuugggaggcugaggcaggcagaucacaaggucaggagaucgagaccacccuggccaacauggugaaaccccaucucuacuaagaauagaauaauuagcuggaugugguggcacgugccuguaaucccagcuacucgggaggcugaggcaggagaaucgcuugaacccaggagauggagauugcagugagccgagauugcgccacugcacuccagucuggugacagagcgagacucugucucaaaaaaaaaaaaaaaaaaagaaagaaagaaaugcaaguaagu

SEQ ID NO: 129426 - RNA, 94 nt, Homo sapiens
caugaacaacaacaauuaaggcaaggagaaaaagagaucuaagggaagaccugaacauguaugcugacagagggaaaggagucaauggaaagau

SEQ ID NO: 129427 - RNA, 38 nt, Homo sapiens
aacugaacuuggaugcugaggacuccugggugcaaaau

SEQ ID NO: 129428 - RNA, 45 nt, Homo sapiens
uuaugcucccaguucuuguuauuuuaaagguuacauauauaauga

SEQ ID NO: 129429 - RNA, 42 nt, Homo sapiens
cggucucguccacgcagggcgauaugaugcagaagaugcccg

SEQ ID NO: 129430 - RNA, 42 nt, Homo sapiens
cauauaucugucugugguuguaugaaaugaaaaaaggggcag

SEQ ID NO: 129431 - RNA, 42 nt, Homo sapiens
ucagacaugccauuuagaaagaccagucaucuuauaaaauag

SEQ ID NO: 129432 - RNA, 40 nt, Homo sapiens
cccaggaaaaauuggaccaccuaaacuggauaucagaaag

SEQ ID NO: 129433 - RNA, 46 nt, Homo sapiens
aaauggagacgagcaggaagucgauuaugaucccgaaacuaccugu

SEQ ID NO: 129434 - RNA, 46 nt, Homo sapiens
uuucagcagaaggagucuuacaugugugggguguuacaacugaaaa

SEQ ID NO: 129435 - RNA, 49 nt, Homo sapiens
gagacaaaaccugaaucaaaauauguaucacucaucacgucauaccagc

SEQ ID NO: 129436 - RNA, 61 nt, Homo sapiens
agccguugucuccagcaacaguuccaggcaugcauaccgaagacaauccaggaaaagugga

SEQ ID NO: 129437 - RNA, 44 nt, Homo sapiens
ucaaaacccauuuucaaaggaacaagcauuuuaaaggauguuca

SEQ ID NO: 129438 - RNA, 46 nt, Homo sapiens
gggucuuacuccuuggaggccaugugggccaugagguccaccaucc

SEQ ID NO: 129439 - RNA, 42 nt, Homo sapiens
uaguuacgaaccugaacuucauccugcugugugcuaucggau

SEQ ID NO: 129440 - RNA, 45 nt, Homo sapiens
cguuugccagaauucacaaagaacaauagaccucaugccagguaa

SEQ ID NO: 129441 - RNA, 46 nt, Homo sapiens; identical to SEQ ID NO: 29048

SEQ ID NO: 129442 - RNA, 48 nt, Homo sapiens
uaauuuauuuuucaagggauagugauuauaguugggucagguuuaaua

SEQ ID NO: 129443 - RNA, 55 nt, Homo sapiens
auguagaguguuccagucagagggaacaagauaugcugaguacuugcugugcugg

SEQ ID NO: 129444 - RNA, 45 nt, Homo sapiens
aacucuacauuuaauccaaugguuuaugcauuuuucuauccuugg

SEQ ID NO: 129445 - RNA, 46 nt, Homo sapiens
caacucuacuugcaacccucuuauucauggcuuuuuuaauccaugg

SEQ ID NO: 129446 - RNA, 50 nt, Homo sapiens
uccgggguaggugggugacggcggucggagguguaggagggagccgugga

SEQ ID NO: 129447 - RNA, 46 nt, Homo sapiens
auuuguuuggcucuuaucuguauacguuaauuuuuguuuaccucag

SEQ ID NO: 129448 - RNA, 45 nt, Homo sapiens
ccgcacaggcaauggcugaguucuuguagcuucacagacauguag

SEQ ID NO: 129449 - RNA, 46 nt, Homo sapiens
gaacuugguggagguucauaaaaggacaacucugcugauugagaga

SEQ ID NO: 129450 - RNA, 116 nt, Homo sapiens
gcaaggguuaugaggagaggagugcagugcuggugcagaggcagugcaauguuggacucaaccagaauuuuagauuuugucaagugguuaagaagggagagaggggcuuaagauau

SEQ ID NO: 129451 - RNA, 138 nt, Homo sapiens
augcaagagucuggauauggacugacuccagaguuuaaguugguuagggagugggugacgacauuggaggugaggaaauguggcagaguggcaggaucaauggauggcagguuggaguuggggccaggggagugagcu

SEQ ID NO: 129452 - RNA, 47 nt, Homo sapiens
cuguguauugaaaucacaaaaaaauuaagauaggagucauguuggac

SEQ ID NO: 129453 - RNA, 46 nt, Homo sapiens
cugauguguucugcgucugucuguuauugugcuucuugucaugggg

SEQ ID NO: 129454 - RNA, 43 nt, Homo sapiens
cuauacauggguuguauuuuucugguucacaacagcacaaagu

SEQ ID NO: 129455 - RNA, 48 nt, Homo sapiens
aucaucugguuuugugggccauuauuuaccuucccuuaugucuuauag

SEQ ID NO: 129456 - RNA, 39 nt, Homo sapiens
cugagaggagacagccagugcgacuccacccuccagcuc

SEQ ID NO: 129457 - RNA, 76 nt, Homo sapiens
cucgccgccaccgcgcccuccgcuccgcccgcagugccaaccaugaccgccgccaguaugggccccguccgcgucg

SEQ ID NO: 129458 - RNA, 46 nt, Homo sapiens
agacacguuuggcccagacccaacuaugauuagagccaacugccug

SEQ ID NO: 129459 - RNA, 41 nt, Homo sapiens
cgccugugcauggucaggccuugcgaagcugaccuggaaga

SEQ ID NO: 129460 - RNA, 44 nt, Homo sapiens
aaucuccaagccuaucaaguuugagcuuucuggcugcaccagca

SEQ ID NO: 129461 - RNA, 44 nt, Homo sapiens
agaaccaccacccugccgguggaguucaagugcccugacggcga

SEQ ID NO: 129462 - RNA, 55 nt, Homo sapiens
auggcaugaagccagagagugagagacauuaacucauuagacuggaacuugaacu

SEQ ID NO: 129463 - RNA, 47 nt, Homo sapiens
uaacugggggaaaagauucccacccaauucaaaacauugugccaugu

SEQ ID NO: 129464 - RNA, 45 nt, Homo sapiens
aucuuauacgaguaauaugccugcuauuugaaguguaauugagaa

SEQ ID NO: 129465 - RNA, 49 nt, Homo sapiens
accauagguagaauguaaagcuugucugaucguucaaagcaugaaaugg

SEQ ID NO: 129466 - RNA, 52 nt, Homo sapiens
cuuucauaagcauuaaguaaaauuuuauaaugacugcaguccaaggacauuu

SEQ ID NO: 129467 - RNA, 30 nt, Homo sapiens
uugaaacugaauguggugauuacacuucau

SEQ ID NO: 129468 - RNA, 59 nt, Homo sapiens
aaaacguuuccaagaaucagauaaaagaggacaaaccuuagggagaagaaggcagcugc

SEQ ID NO: 129469 - RNA, 42 nt, Homo sapiens
gaacaagugacaauuuucucugucuuagggagaagagacagc

SEQ ID NO: 129470 - RNA, 74 nt, Homo sapiens
auuuaacucaaagcaucuuagcagagcuuaauuaaauggauagaugucuguucccuuugcuggacgccaagaau

SEQ ID NO: 129471 - RNA, 85 nt, Homo sapiens
uugacauuuccagguugcugacuuuuucagcuccaaguuggaaauauaugagcugaaaagaaaauguagggaacucaucacagug

SEQ ID NO: 129472 - RNA, 61 nt, Homo sapiens
cagcauuugcugguauggguggggccaugguguuuuuccaugguguuugguuggaguacag

SEQ ID NO: 129473 - RNA, 53 nt, Homo sapiens
cuaaugcuaugggacagagugaccaggaagagcuucauuacaccaggugggaa

SEQ ID NO: 129474 - RNA, 43 nt, Homo sapiens
uuauucuucugucucgaagcucacugauucuuuauucugucua

SEQ ID NO: 129475 - RNA, 101 nt, Homo sapiens
ugccuagaaagacuucuagaaaauugacuuguuaaguuuuaacagaaaggaagcaaagauauuauuaaugaugcuucuuuaugucuaggaaacaugagcac

SEQ ID NO: 129476 - RNA, 107 nt, Homo sapiens
cuaggacaaaaucuauauaaauugacauuagugagaugcuaaaauuuaaaaaauuuaaaccuucugcguuuucagggaaaggauaguagaaagugcacuggggaagg

SEQ ID NO: 129477 - RNA, 55 nt, Homo sapiens
agaugaacuguaagcacuaaaauccuaugauuuuuuucccacuagauacugccua

SEQ ID NO: 129478 - RNA, 45 nt, Homo sapiens
uuuuuuuuuuuuuuuuugguguguguuugcuuguuuuuggugguu

SEQ ID NO: 129479 - RNA, 44 nt, Homo sapiens
ccuaaauuugaaaaaaucauaucccuuuuucauggcaaaagacu

SEQ ID NO: 129480 - RNA, 42 nt, Homo sapiens
aggcuugcugagugguuccuacugugggaaugaauagaaggg

SEQ ID NO: 129481 - RNA, 45 nt, Homo sapiens
uacuuaacaguacccauuaauuguuuauuuaaaauuauuuuucuu

SEQ ID NO: 129482 - RNA, 25 nt, Homo sapiens
auuaauugucuaaaaauaaaagaua

SEQ ID NO: 129483 - RNA, 44 nt, Homo sapiens
agauguuuagcuaccggaugcaucauauucagccucauuacaga

SEQ ID NO: 129484 - RNA, 57 nt, Homo sapiens
uucacugagugcaugugcuggagaauacaaagccuuuucaucuagucuggcaccacu

SEQ ID NO: 129485 - RNA, 46 nt, Homo sapiens
cucuaugcagggcuccccuccucucuuucuuugucuucucuggaaa

SEQ ID NO: 129486 - RNA, 37 nt, Homo sapiens
ugaagcaccuacucauuguauuuaauaaauauuugau

SEQ ID NO: 129487 - RNA, 68 nt, Homo sapiens
gguauuguguucccaugugcaugcacuccugugugugugcagcaucucugugugugugugcacaagug

SEQ ID NO: 129488 - RNA, 45 nt, Homo sapiens
gcacuuuuugcuuucauuuaaagugcaaauggcauucuccagggu

SEQ ID NO: 129489 - RNA, 56 nt, Homo sapiens
gggcuauuguuggucaguacugcugaguauagacuuuuguagguguuuauccugaa

SEQ ID NO: 129490 - RNA, 399 nt, Homo sapiens
uggagaaagugauuuaaaguguccuuucuuuaagaaggaaagagccagggcauaguggcucguaucuguaauccuagcacuuugggaggcugaggcaggaggauugcuucagucaggagguugagacuggccugggcaacauagugaaaccaugucucuacuaaaaaaaaaaaaaaaaaaaaaauuagcuucggagacugaggcgggaggaucccuugaacuccagagauggaggcuacagugagcuaugaucuugccacugcacuccagccuuggugacagagucacacacuaucucaaaaaaaaaaaaaaaagagagaaagaaaaauauaggcguagaucuuggcaaaacauuugauaaaguuuucaugguaucuuuauaucuuuauaaacaacuuu

SEQ ID NO: 129491 - RNA, 34 nt, Homo sapiens
aauuguaucagaaucuuagaaucauaguuggagg

SEQ ID NO: 129492 - RNA, 46 nt, Homo sapiens
uuccauuguuggauaaagggcucagaacaaucagaucuugcuuugg

SEQ ID NO: 129493 - RNA, 43 nt, Homo sapiens
uuccagggggagcuauaacagcuauguuggggccugucccugu

SEQ ID NO: 129494 - RNA, 70 nt, Homo sapiens
aaugaguuauguagauaaaacaaugacagaguaaguuuuagaccaguaacauguauuacaugcauugagg

SEQ ID NO: 129495 - RNA, 71 nt, Homo sapiens
cuaaaggaauauguaguaagggaagaagucugggaaacauugaugaauggggcuagaaaaggcgagggaag

SEQ ID NO: 129496 - RNA, 70 nt, Homo sapiens
gcugaaaaagucaugugcaaauaaguguuuagaacaaguguuauuuuaaauguaacuauaguggcuuucu

SEQ ID NO: 129497 - RNA, 43 nt, Homo sapiens
uuuccggauuucuucccuguguaaucuauaggauuuauuaugc

SEQ ID NO: 129498 - RNA, 51 nt, Homo sapiens
guuuuguuuuuguugaauuacaugaaagcauuaauuagacacuugaauuca

SEQ ID NO: 129499 - RNA, 33 nt, Homo sapiens
aaugcuaaaaaaucuaacucauggaacuuguaa

SEQ ID NO: 129500 - RNA, 82 nt, Homo sapiens
uccuaaaaguuauguguaaccauuacaaauuauauuugagggggugcagaagaaaacaauaagagcggauuucuuguuuuau

SEQ ID NO: 129501 - RNA, 49 nt, Homo sapiens
gccucaguugugagcuuuccuggauaggcacccuucgcuuuuccaggca

SEQ ID NO: 129502 - RNA, 51 nt, Homo sapiens
acugugcuauugaauuuauauguuccaauaugguuaaccuggaauuuuagg

SEQ ID NO: 129503 - RNA, 54 nt, Homo sapiens
gcugaacucaaacugcuugaacagagcuaguguaaaucaugggagugaggcuga

SEQ ID NO: 129504 - RNA, 46 nt, Homo sapiens
cccaaccccaaguuuuauucccgguauacuguggcuuaaagucggu

SEQ ID NO: 129505 - RNA, 42 nt, Homo sapiens
guagguauuguaucuaauaaaauaaauuuagucaagcccuug

SEQ ID NO: 129506 - RNA, 38 nt, Homo sapiens
uauggcccuuaaauauuuuucuuauauauagaaagaaa

SEQ ID NO: 129507 - RNA, 52 nt, Homo sapiens
aauuugaguaccuuuuccaagauuaacuuuugcauuggaacagugaugguga

SEQ ID NO: 129508 - RNA, 36 nt, Homo sapiens
ucuucucaucuuuccuuaccaugccccucgcaacca

SEQ ID NO: 129509 - RNA, 45 nt, Homo sapiens
cuaaagaaguagcagaaaaucagcagaaucagucuuccgauccag

SEQ ID NO: 129510 - RNA, 45 nt, Homo sapiens
cauggcuuaagaagcaaaagucauauaccuuaguaguggccaaag

SEQ ID NO: 129511 - RNA, 35 nt, Homo sapiens
ugaagaaauggcucagaagaaacaagagauuaaag

SEQ ID NO: 129512 - RNA, 72 nt, Homo sapiens
ugaauuaguaaguaaggagagagaagagaagguaaaagaaacacaggaagacaaauuagaaggaggagcagc

SEQ ID NO: 129513 - RNA, 50 nt, Homo sapiens
caugaggugauagcuuggcuuacagggaucuuauagagaguagggugagg

SEQ ID NO: 129514 - RNA, 52 nt, Homo sapiens
caaccuauucuuuaucuccuaaacuucaggaauuagauaaagacaacugucc

SEQ ID NO: 129515 - RNA, 47 nt, Homo sapiens
uagcuuuaguagcaucuguuuugacauaguucauuguuuucuugcag

SEQ ID NO: 129516 - RNA, 56 nt, Homo sapiens
uuacucuuuuucuuuuuaaaugaaaguucccaaaagcuagcauucuaauuuuugaa

SEQ ID NO: 129517 - RNA, 27 nt, Homo sapiens
auugcugugacaacuaaugaagcaacu

SEQ ID NO: 129518 - RNA, 28 nt, Homo sapiens
cucuggggucuuagggucuaacuuaaag

SEQ ID NO: 129519 - RNA, 44 nt, Homo sapiens
aggaaauugaggcuuaaagaagccaaggaaugugcccaaguuag

SEQ ID NO: 129520 - RNA, 40 nt, Homo sapiens
ucuuuucaauuuggcgccauucaauuucguuuuucuugcu

SEQ ID NO: 129521 - RNA, 30 nt, Homo sapiens
aagguguuucuggaaaagaagaaaugucaa

SEQ ID NO: 129522 - RNA, 48 nt, Homo sapiens
aucagguacugacaugccauggggaaugugaaaauuaaugggacauga

SEQ ID NO: 129523 - RNA, 51 nt, Homo sapiens
gaggcuggacuagccuacgggaaaagcucauuuuauuucccguaucuucag

SEQ ID NO: 129524 - RNA, 46 nt, Homo sapiens
aucguuuugcuuggccgaaaaucuuaaaaauuuccuauaaacgcag

SEQ ID NO: 129525 - RNA, 29 nt, Homo sapiens
cagggacguuacuuaaauaggaucaucag

SEQ ID NO: 129526 - RNA, 33 nt, Homo sapiens
ccaacuaaagccccacauuugcagcucauugaa

SEQ ID NO: 129527 - RNA, 34 nt, Homo sapiens
gaauauuucaauguaaguuauuuuaaugcaagua

SEQ ID NO: 129528 - RNA, 60 nt, Homo sapiens
agugcaugggggaauucagcucgggagugcauguuaccagccugacgguguuccuuucaa

SEQ ID NO: 129529 - RNA, 103 nt, Homo sapiens
aucaaguuuuuauccaguacucuugaaguuguucuacaaguaaaccuauucucuccuaaaggguuaacucuagggcaucaaccugagguaacacaaucucauc

SEQ ID NO: 129530 - RNA, 47 nt, Homo sapiens
ucuguuugagaauaugcuaauuaaagaaauuauuuuaauuagaaaga

SEQ ID NO: 129531 - RNA, 46 nt, Homo sapiens
caauuuuauggaauccacaccugagccgcgcccuaaugaaugggaa

SEQ ID NO: 129532 - RNA, 58 nt, Homo sapiens
gaaacuuccuuauaaugaaauguuagaauuguguuuuaaaaacguuuuuucaaucaua

SEQ ID NO: 129533 - RNA, 40 nt, Homo sapiens
cagaacuuuugaaaauauuaagacaugcuugguagagucu

SEQ ID NO: 129534 - RNA, 42 nt, Homo sapiens
cuggaucucauguuuuaggaauguacaguguaaaauaucuug

SEQ ID NO: 129535 - RNA, 57 nt, Homo sapiens
acccccacuuccccaagggacgauguaaucauagagaugguaaugaaguuaagucag

SEQ ID NO: 129536 - RNA, 37 nt, Homo sapiens
ugggguuuauuaggaauuauucucacacuucugacau

SEQ ID NO: 129537 - RNA, 66 nt, Homo sapiens
ggccucagggagguuagaaaacuggaaaggcccagaaugugcagauaagggcaaagaagggccuug

SEQ ID NO: 129538 - RNA, 42 nt, Homo sapiens
uuggacagcagagggcgcuguugugagcgcuaaugcaccuuc

SEQ ID NO: 129539 - RNA, 53 nt, Homo sapiens
gcuaauugagguuaagauauaacaauaauaauaauucacugaucuauaauaau

SEQ ID NO: 129540 - RNA, 48 nt, Homo sapiens
ugagaguuuuuucaguuuaauaucuagaaaccucugaguuuucaauaa

SEQ ID NO: 129541 - RNA, 42 nt, Homo sapiens
uuaauagccuucugaggcuaacuauaauuuugccaauuaaaa

SEQ ID NO: 129542 - RNA, 49 nt, Homo sapiens
gaagcgggcagagguugggaaagacgaaagaguaaucacagaagaaaug

SEQ ID NO: 129543 - RNA, 46 nt, Homo sapiens
ugggagaguaccguccccaccaccgagugaccgagggcaccaucag

SEQ ID NO: 129544 - RNA, 90 nt, Homo sapiens
aagauacccggagagaagaguguacacgaaggcgcucuuaagcaagacaugggagaagaagcagaggaagagccacagaaaguuaacgga

SEQ ID NO: 129545 - RNA, 46 nt, Homo sapiens
uauguguauguacacauacacacauucauauauauguacguaucua

SEQ ID NO: 129546 - RNA, 35 nt, Homo sapiens
uucacacauugguucuguaaagauuuggaauaagc

SEQ ID NO: 129547 - RNA, 23 nt, Homo sapiens
uugaucccacauaagcacaaaua

SEQ ID NO: 129548 - RNA, 52 nt, Homo sapiens
cacccugacaugucggucacaagaguggugguacacaaagaaacagaguugg

SEQ ID NO: 129549 - RNA, 49 nt, Homo sapiens
uuuucaccuauaaauuuggcaaaacuuauguuuuuaauaguguugggaa

SEQ ID NO: 129550 - RNA, 41 nt, Homo sapiens
gaaucggcuaugucuucauuaugagagcaggagagacggca

SEQ ID NO: 129551 - RNA, 30 nt, Homo sapiens
gaaguacuaaugaguaaugaaauaaccuaa

SEQ ID NO: 129552 - RNA, 42 nt, Homo sapiens
aaauugcagcaaauauacuguaugagaaaauauuaauacaga

SEQ ID NO: 129553 - RNA, 44 nt, Homo sapiens
cacacagguuugaggaugcuggggagagggggagggggcugugg

SEQ ID NO: 129554 - RNA, 45 nt, Homo sapiens
ccagacauagcgguggagaccugugcccuugggaggccccgagcc

SEQ ID NO: 129555 - RNA, 43 nt, Homo sapiens
uggucaggucucaccugugccaaggggggcaggaagaggagaa

SEQ ID NO: 129556 - RNA, 43 nt, Homo sapiens
caauuugaugaccccaucacaguaccaaaauaucccccaaaau

SEQ ID NO: 129557 - RNA, 63 nt, Homo sapiens
auggucaguuucacuguaauccucaggcccuuccagucacccguugccuuggcaaugucauca

SEQ ID NO: 129558 - RNA, 88 nt, Homo sapiens
ccaaccuuuuuuggagacagacccagggggccgaucuugggggccagggcagaaguggcaccgacuucaccuccggugcaccucaggu

SEQ ID NO: 129559 - RNA, 46 nt, Homo sapiens
cugccagcgagucccucuucgucucuaaccacgccuauuaagcgga

SEQ ID NO: 129560 - RNA, 51 nt, Homo sapiens
ucuacaaggcucugagugaccaccacaucuaccuggaaggcaccuugcuga

SEQ ID NO: 129561 - RNA, 372 nt, Homo sapiens
aaaaugccaauguucuggcccguuaugccaguaucugccagcaggugggccugcagguccucaauaggcaaccuccuaccucauuugguuccaguguuguuaauuugccuauuaccugccaugaugccuaccuccccaaaagcaagcauuagcuuuggcccguggaggacacucaagggcuguugaaggcagaggggccaaggagggaugguggguggaucugaggcggcucuugucuccuguaaucugagggcuuugaagccugagucccuggcaucaucaagauacggucuugaccaguggcuguggagagauguaggugggacucuggguuaggaggccucacagugacccugucccucgcccugcaga

SEQ ID NO: 129562 - RNA, 1025 nt, Homo sapiens
uuaucaaauccaagggcgguguugugggcaucaagguaaggggagggccuccggacgugagguuugagauggaaguggaggaaggaaauccagguuagugaggcagggaaugaaugcuggauugguggccuagagacuugcauggagccugcuucaggcuuagggcauuuacucgacauuuuuaauccucacaauucugagagaacaguaucauucccacuuuacacaugaaaaucucagaagcucagggaagugaaguguuuugcucagaguaaguggcagagccccagucugacacccaauucacucaacauuucuguugucaaauaacaucccaguguauccugucucagaggauuguuacuaagugaacuaagugaaaauauuuuaauuuaauuguaacuaaguauuugaguaacuaaacauuuuaaguaaauuuuuuuuuuuuuuuuuuuugagauggagucucgcugucucccaggcuggagugcaguggugcgaucucuuggcucacugcaaguuccgccucccagguucacgccauucuccugccucagccucccgaguagcugggacuacaggcgcccgccaccacccggcuaauuuuuuuuguauuuuuaguagacacuggguuucaccauguuagccaggauggucucgaucuccugaucucgugaucugcccaccucggccucccaaagugcugggauuacaggcgugagccaccaugcccggcuuaaguaacuaaauauuuuaauuguaacuaagugaaaauauuugccagcccugagaugcaguuuaagggauuaaguaaaugugggggaagacuggggcuaaagaagaggaaagaggggcacgcccagcuaccuaggaggcugaggcgggaggaucacuugaguccaggaaguggaggcuucagugagcugagauuccaccacuguacuccagccggggcgacaguggaaagggugcuagaggucauuuccugugucuuaauguuguuacccugaccccaacagguagac

SEQ ID NO: 129563 - RNA, 43 nt, Homo sapiens
ccagcaccaugcccuaccaauauccagcacugaccccggagca

SEQ ID NO: 129564 - RNA, 49 nt, Homo sapiens
cuggggagggcacacugugggccauggugcccacagcaccuccagcugc

SEQ ID NO: 129565 - RNA, 1858 nt, Homo sapiens
uuucagccaugccagagagaucugaaaacaacacacagcacacaugcacaugaaaauggccccauuuuucugguaugccguuagccaaagccuaacauauuaagcuacucugaccuaagaauuccacucuugagaacauauggcaaaaaaaacacaccgaaggggaaaaauaaaaggaauaguauaaaauguucauagugacauuacuuauaauuacuuaaaaaaacaaaaaacaaaaaacaaaaauggcaagacagggaaauagcaaaacaauaggauauacuuauacaaaagaacacuaaagccguuuaaaauggcaaauauggaaauguuaacacauggaccaguuaacacuaaaacaaacaaaaaaacagugagagcacuagaacacaguguuuccuucauaccagcaaagguaaaaucauuuuaagugaacuagaauagaugucuagagcaaaucuguggguccugaggccaguguaaacugccccauggucaccccuucucacgccaggagcugcugccuucccacugcacaccuccgagcuuguuuagaggucacguauucucacaggauuacucauuugcugaggacagaaucugccuaccucaugguagccaauuccaagaacuagaaaucucuucaccuggugaggaccagccaauaaaaacaacuuuuauggccaggugcaguggcucuugccuguaaucccagcacuuugggaggccgaggcgggcggaucaugagaccaagaguuugagaccagccuggccaacauagugaaacacugucucuacuaaaaauacaaaaauuagcugggcaugguggugggcaccuguauucccagcuacucagaaggcugaggcaagagaaucccuugaacccgggagguggagaucaugccacugcacugcagccuaggcgacagagcgagucuccaucuccaaaaaaaaaacaaaaacaaaacaaacaaaaaacacaacaaaaaaacuuuuacaauuuguagcuuucuuccucaucaaacccuguuuuaaggcacagaccaugccccaaacccuagugugcuauucuuuucccaaaggugcaaucuaaacugucaaacacugucagcauaaaaacuaagaccauucacuggccuaaaagucaaacagugaaacaugcucuuuagcaaaauauuuaguuuucuuuuuuuuuuuuuuuuuuuugagagggagucucacucuugucauccaggcuggagugcaguggcgugaucucagcucacuacaaucuuugccucccggguucaagaaauucuccugccucagccucccaaguagcugggauuacagacaccugccacuacacccggcuaauuuuuguauuuuuaguagagacaggguuucuacuaaaccauguuggccaggcuggucucgaacuccugaccucaggugauccacccgccucagccucccaaaguguugggguuauaggugugagccacuuuacccagacaaaauauuuacguuugaaaugaagagcuugaugcuucucaccagcuggacaaccaccauaugaagauggaaguuacauguugacaaaaagauuguguuuuuauguuuuaccaggccagucuuggagcucaacccagccuugggcacgagggcgaauguaucauuugaaugaucugcagccacauggagccucuucagaacaguucugaagucucuccgcgcagacaaucuggagguguauuagguuaggaguccucuugacaagaggaggcuagaaaggagcaccaagcauuaacaagagugcuaugcaaaaagacgcaacaaaaggcuuccgcuuacucacuucggucucuaagaaccaaug

SEQ ID NO: 129566 - RNA, 1858 nt, Homo sapiens
cauugguucuuagagaccgaagugaguaagcggaagccuuuuguugcgucuuuuugcauagcacucuuguuaaugcuuggugcuccuuucuagccuccucuugucaagaggacuccuaaccuaauacaccuccagauugucugcgcggagagacuucagaacuguucugaagaggcuccauguggcugcagaucauucaaaugauacauucgcccucgugcccaaggcuggguugagcuccaagacuggccugguaaaacauaaaaacacaaucuuuuugucaacauguaacuuccaucuucauauggugguuguccagcuggugagaagcaucaagcucuucauuucaaacguaaauauuuugucuggguaaaguggcucacaccuauaaccccaacacuuugggaggcugaggcggguggaucaccugaggucaggaguucgagaccagccuggccaacaugguuuaguagaaacccugucucuacuaaaaauacaaaaauuagccggguguaguggcaggugucuguaaucccagcuacuugggaggcugaggcaggagaauuucuugaacccgggaggcaaagauuguagugagcugagaucacgccacugcacuccagccuggaugacaagagugagacucccucucaaaaaaaaaaaaaaaaaaaagaaaacuaaauauuuugcuaaagagcauguuucacuguuugacuuuuaggccagugaauggucuuaguuuuuaugcugacaguguuugacaguuuagauugcaccuuugggaaaagaauagcacacuaggguuuggggcauggucugugccuuaaaacaggguuugaugaggaagaaagcuacaaauuguaaaaguuuuuuuguuguguuuuuuguuuguuuuguuuuuguuuuuuuuuuggagauggagacucgcucugucgccuaggcugcagugcaguggcaugaucuccaccucccggguucaagggauucucuugccucagccuucugaguagcugggaauacaggugcccaccaccaugcccagcuaauuuuuguauuuuuaguagagacaguguuucacuauguuggccaggcuggucucaaacucuuggucucaugauccgcccgccucggccucccaaagugcugggauuacaggcaagagccacugcaccuggccauaaaaguuguuuuuauuggcugguccucaccaggugaagagauuucuaguucuuggaauuggcuaccaugagguaggcagauucuguccucagcaaaugaguaauccugugagaauacgugaccucuaaacaagcucggaggugugcagugggaaggcagcagcuccuggcgugagaaggggugaccauggggcaguuuacacuggccucaggacccacagauuugcucuagacaucuauucuaguucacuuaaaaugauuuuaccuuugcugguaugaaggaaacacuguguucuagugcucucacuguuuuuuuguuuguuuuaguguuaacugguccauguguuaacauuuccauauuugccauuuuaaacggcuuuaguguucuuuuguauaaguauauccuauuguuuugcuauuucccugucuugccauuuuuguuuuuuguuuuuuguuuuuuuaaguaauuauaaguaaugucacuaugaacauuuuauacuauuccuuuuauuuuuccccuucgguguguuuuuuuugccauauguucucaagaguggaauucuuaggucagaguagcuuaauauguuaggcuuuggcuaacggcauaccagaaaaauggggccauuuucaugugcaugugugcuguguguuguuuucagaucucucuggcauggcugaaa

SEQ ID NO: 129567 - RNA, 45 nt, Homo sapiens
cugcuggccuccacgucaucaaggccacuccugauggcauccagg

SEQ ID NO: 129568 - RNA, 2464 nt, Homo sapiens
gaggaaggcucaugaaaagguaaagucacaaaccuuugcaugaacucauguuaagaaaucugaaauguacugaacaggacacggaaggccauccauauacacucaagaaaucugaaauguacuaagugacagaauuguugguauuuccacaggcaucccccugccaguaauacccauauuauguaucugguauauuuacauccuguuuucagguucuuuuuccugcagucauuuugccauuuuuuuuuuuuaauggagucucccucucacccaggcuggaguacaguggugcaaucucggcucacugcaaccucugcuucccuggcucaggugauccuccugccucagccccaccgaguagcugggauuacaggcgcccaccaccacacccggcuacuuuuuguauuuuuaggaaagaugggguuucaccacguuggccaggcuggucucgaacuccugaccucaaguuguccgccugccuuggccucccaaagugcugggauuacaggcaugagccaccaugcccggccuauuuugccaauuuuuaauuacucagaauaaagagaaaaagaagucguaucugaaauauaaaaucaugcuaaguucaaagaacagaucuagcucaggaccaugguaugucgucuguguguaugucucuaucacaugcagauacagcauccucccucccuggguucacacuuccucaugguugggauccagcuaggugaaguuuuggaagauuugagcccaaaucauagaaucugaggagccacuuguuggaagggccuuuuaaagucauuaaugucugcaguguuuugggaggcuuugccuuaugcuaggcccuaugcaugaugcagaggguacgaagcuggauaagaggcgggggagggccaggcauggugacucacaccuguaaucccagcacuuuggcaggccaaggcaggcagauugcuugaccccaggaguuugagaccagccugggcaacaugguaagauccccgucucuacaaaaaaaaaaaaauacaaacauuagccaggugugguggugcacaccuguagucccagcuacucggcaggacugaggugggaggaucacccgagccugggaagcagagguugcagugagccaagauugugccacugcacuacagccugggcaauaagagugagacccugucucaagaaaaauaauaauaaaaaaauuuaaaaaugccaggugugguggcuuggcuaacuuuuaaaauuuuauuuuauuuuggcugggcacaguggcucacgccuguaaucccagcacuuugggaggacgaggcaggcggaucacaaggucaggagauugagaccauccuggcuaacauggugaaaccccgucucuacuaaaaauacaaaaaguuaacugggugugguggcgggcgccuguagucccagcuacuugggaggcugaggcaggagaauagucugaacccaggagguggagcuugcagcgagcugagauugcaccaccgcacuccagccuggacgacagagagagacucugucucaaaaaaaaaaaaaaauuauuuuauuuuucagaggugaggucuugcuauguugcuuaggcuggucuugaacuccugagaucaagcaguccucuuaccauggccucccagaguaaugggauuacaggugugagccacugcaccuggccuaaggcauguuuaaauggacagcguauuccuagauaaucaagagguaaauuaguacugacuccauguggcagcggacaaggagacacucuccauugucuuccagggaagcagaggguuagagcugucuucuuuaugcaagugugugaggucucugcggugaguguuggcuugucucagaucuggacagacugagcuuacaagggcugggccuaggucuucucacucuugcucaaaugccagcacauagaaggaauucagggcaugccuagugaaugaaugaauucauugaaucauuuucuuggggagaaguggugcuucuuacauaggacuaggcugccagccucaagccucaugguaaggacgagucagcaucucugauguagacauggcucagagucgggggaaacagugcccagaggagcugggggacuagggccgcaguccuuacggacucugacuccacugcaguuuaaccuuuuuggaucuccguguucucaguccuaaauggguggugaccaugucaccuccuaggaaagcaaggggcuggaccagugaugguuugaaguccuuuguguggucugagggagaugucaguguccugacuugggggagccugggccuuugcucacagcagucgcugucaguguuccuuccugaucucagcuguggcaguguggcugcagcuacuccuagggcuccugccacuccucaguggcccacaaccaaagccuuccuuccugucugugcuucagaucugcauguugacguucgaacacgag

SEQ ID NO: 129569 - RNA, 46 nt, Homo sapiens
cgugugauaucagaguuuguaauuccaaguguguauuggguggaag

SEQ ID NO: 129570 - RNA, 44 nt, Homo sapiens
uguagaaguuaacgcaugagauggaaaaaacagagccaguuaaa

SEQ ID NO: 129571 - RNA, 54 nt, Homo sapiens
cauacuggcaguuucaccuuaaccugcucguuaaauaauguguuggugugagau

SEQ ID NO: 129572 - RNA, 30 nt, Homo sapiens
aaggcagggcuagaaaagcuagguucacug

SEQ ID NO: 129573 - RNA, 49 nt, Homo sapiens
aaugaagccuaccuccaccgaaggcuccuuuucauccuuccuuugagau

SEQ ID NO: 129574 - RNA, 44 nt, Homo sapiens
gauugacaacuucuucagugagccaacaaccaagagcugggagg

SEQ ID NO: 129575 - RNA, 47 nt, Homo sapiens
augucuauggaaaagaugccaaagagcaaggcuuuguggugguggag

SEQ ID NO: 129576 - RNA, 50 nt, Homo sapiens
auuuuuuuccucaaugaauacaaguauccaauaaaugaagacucaaugag

SEQ ID NO: 129577 - RNA, 45 nt, Homo sapiens
uguguagaguaggaaagaaaaaaagcuacaggugaguacggagcu

SEQ ID NO: 129578 - RNA, 52 nt, Homo sapiens
uagccuuucuuucaaugcauggauuaauguaauaauacuauauagaucauac

SEQ ID NO: 129579 - RNA, 41 nt, Homo sapiens
uccccuggauagucucaaggguuguauacuccuauaaaaaa

SEQ ID NO: 129580 - RNA, 53 nt, Homo sapiens
cuagggaaugaaagauuuauuguccuuauggagggagcaucuguagcucagca

SEQ ID NO: 129581 - RNA, 33 nt, Homo sapiens
uuuucuuuaaugccuuuauauucuguugcauaa

SEQ ID NO: 129582 - RNA, 31 nt, Homo sapiens
aaacagaauuaagugauggaaaaaguauuga

SEQ ID NO: 129583 - RNA, 40 nt, Homo sapiens
ggagaaguccacaggacauacaccuacaaagcccucaggc

SEQ ID NO: 129584 - RNA, 52 nt, Homo sapiens
ccaugaaacccagaaucaggguucaaggucagugacuuuauauggagcaguu

SEQ ID NO: 129585 - RNA, 52 nt, Homo sapiens
agaauaaaaucaaugaugggaaaaguugaacauauaaagauuaaaggagaaa

SEQ ID NO: 129586 - RNA, 89 nt, Homo sapiens
ugaaaaugggugugaggaguauggucucaucugccccauggaagagguuguuuccauugcgcucuacaaugacauuucucacaugaaga

SEQ ID NO: 129587 - RNA, 45 nt, Homo sapiens
acccauucuugucauuguugaaacaaaaagguacagucacuauac

SEQ ID NO: 129588 - RNA, 41 nt, Homo sapiens
ccuacuuuacuuaaaaacuaaaaauauuaaaaauaugguaa

SEQ ID NO: 129589 - RNA, 42 nt, Homo sapiens
aaaaaacaagccaaacaaaaugcagagacagccucagcugua

SEQ ID NO: 129590 - RNA, 92 nt, Homo sapiens
gaugaaagccugacaaagcagagauuaugaagagaagguaaacuggagugggaaagauaggauuagaagauagaauugacaagucuugacua

SEQ ID NO: 129591 - RNA, 47 nt, Homo sapiens
uuggcaggaggaagaugugagagucaaggaauggugaguuuuugaag

SEQ ID NO: 129592 - RNA, 43 nt, Homo sapiens
caaggagcgaaugaucagcagguuugcaaguagcugagaggua

SEQ ID NO: 129593 - RNA, 86 nt, Homo sapiens
auuaggaaauuucaacauuugguggucuaguacagaaagagaaguaggaugaaacucagaagagauagaaucacugcagcugagag

SEQ ID NO: 129594 - RNA, 43 nt, Homo sapiens
auguagagcagaguucucuggagcagcguacuuaagggcaguc

SEQ ID NO: 129595 - RNA, 29 nt, Homo sapiens
agagagauggagagaggagaauggagaga

SEQ ID NO: 129596 - RNA, 46 nt, Homo sapiens
auuagggaaggaagacaucaggcaucuaauggaugaggcaccagaa

SEQ ID NO: 129597 - RNA, 41 nt, Homo sapiens
ugauuugucucugauauauuuggaguuuuucugagaacugg

SEQ ID NO: 129598 - RNA, 41 nt, Homo sapiens
cuaugauacugcuguucacagcuuuucuugauaggccuagu

SEQ ID NO: 129599 - RNA, 65 nt, Homo sapiens
ccaaugaccuuagccgcauugcuccauucacucccaggugagaauucagguaaacguccacaaag

SEQ ID NO: 129600 - RNA, 46 nt, Homo sapiens
aacuuugggauugaccccaccaacaacugaacgcuuuggucaggcu

SEQ ID NO: 129601 - RNA, 46 nt, Homo sapiens
aggaaggauucaagggaaccuucccugaugugagagagcaggagau

SEQ ID NO: 129602 - RNA, 37 nt, Homo sapiens
ucaugcuaaugagacagaauuugaugaggcgccaaga

SEQ ID NO: 129603 - RNA, 90 nt, Homo sapiens
ggaaggcacucauugagauggagaagcagcagcaggaccaaguggaccgcaacaucaaagaggcucgugagaagccagagauggagaugg

SEQ ID NO: 129604 - RNA, 45 nt, Homo sapiens
ccucaggaaaaggcauuguugaguucucagggaagccagcugcug

SEQ ID NO: 129605 - RNA, 62 nt, Homo sapiens
ucccgacaucacugaggaagaaaugaggaaacuauuugagaaauauggaaaggcaggcgaag

SEQ ID NO: 129606 - RNA, 66 nt, Homo sapiens
gaauuuuagaaaaccaggagagaagaccuucacccaacgaagccgucuuuuugugggaaaucuucc

SEQ ID NO: 129607 - RNA, 45 nt, Homo sapiens
gcaaaaaugcagaguaauaaaacuuuuaacuuggagaagcaaaac

SEQ ID NO: 129608 - RNA, 48 nt, Homo sapiens
cguuacuccgaggagagaccagucgguagaggagaaguccagguuaga

SEQ ID NO: 129609 - RNA, 43 nt, Homo sapiens
aaaaaucaacuuauuaaacauaaauucuguguccagccuaaac

SEQ ID NO: 129610 - RNA, 48 nt, Homo sapiens
uaagauauuuagccauuaaaauaaugauuuugaacaauauuuaauuau

SEQ ID NO: 129611 - RNA, 77 nt, Homo sapiens
uaaaaccaaauaaaugaagccauugcacaauugaucucuggacacaguauguuuuugaugaacaaguuuaauggguu

SEQ ID NO: 129612 - RNA, 35 nt, Homo sapiens
uuaaaugccaaagaaaagcuuuacuuacccugaac

SEQ ID NO: 129613 - RNA, 70 nt, Homo sapiens
cauaugcccacacugagggauuuuauuaauacagucagaggaaacuuacuauuauguuacuuucgaaaug

SEQ ID NO: 129614 - RNA, 51 nt, Homo sapiens
aggccaugacgucaaccuauucccuuccaauacuagcuguuagaccagaag

SEQ ID NO: 129615 - RNA, 44 nt, Homo sapiens
ugcuaaauuugaucagaagcuuaauugagagaaaugauguuuac

SEQ ID NO: 129616 - RNA, 48 nt, Homo sapiens
acuuuccuauaaaaguuaauaagacugcaggaaccaacagugggaggg

SEQ ID NO: 129617 - RNA, 54 nt, Homo sapiens
gacuauuaauaagacuugcacuaagcauuuugcaucuugucaagcagaccauau

SEQ ID NO: 129618 - RNA, 54 nt, Homo sapiens
gaugacaggcagucaugugugcaggcuuggccaaauaaaaccugcaauggaaau

SEQ ID NO: 129619 - RNA, 47 nt, Homo sapiens
gcuuucagcaacguuggaacggccaucagcaagaaguucggagacau

SEQ ID NO: 129620 - RNA, 53 nt, Homo sapiens
uugucagcgaaagaaaggcaucuaguugagauaaaacaaaaacucggcaugaa

SEQ ID NO: 129621 - RNA, 46 nt, Homo sapiens
gcaguagccagugcugacuucucuagcaugcucucugaggaggaaa

SEQ ID NO: 129622 - RNA, 46 nt, Homo sapiens
augcggugucaaccacuggucgcuugcccuaaggaaucgugcggga

SEQ ID NO: 129623 - RNA, 26 nt, Homo sapiens
uuuucacugauuuuucucucugcaua

SEQ ID NO: 129624 - RNA, 45 nt, Homo sapiens
ggcaaaaaagaguugagagucguuccuguggguuaacaccuagaa

SEQ ID NO: 129625 - RNA, 42 nt, Homo sapiens
ccgaucgccccgagagucagguccuggggcgcgcauaaaggc

SEQ ID NO: 129626 - RNA, 47 nt, Homo sapiens
cuugaaaaagugguuguugagggcaaugacagccccagcauugaagg

SEQ ID NO: 129627 - RNA, 45 nt, Homo sapiens
uccuggauguccuucucgagaaaugcagaaauuauuaaagcaaga

SEQ ID NO: 129628 - RNA, 49 nt, Homo sapiens
aaaaucuuuugauaggucacagucgaacuguuauuggaauugaagagaa

SEQ ID NO: 129629 - RNA, 36 nt, Homo sapiens
aguuguacuuuaugugcugggcccugcagaugcaga

SEQ ID NO: 129630 - RNA, 54 nt, Homo sapiens
gcucaccagcuucagcaagaagaagacagaaagaggagaucugaagaaucaaga

SEQ ID NO: 129631 - RNA, 46 nt, Homo sapiens
uccugaauguccauucuguggaaaaauagaggagcacagugaagau

SEQ ID NO: 129632 - RNA, 46 nt, Homo sapiens
cugaaaaguagggaaaaacaguccagccugaccgaaauaaaaggau

SEQ ID NO: 129633 - RNA, 45 nt, Homo sapiens
ggcguggagcggcgcauucugggauuacuucuuuuccgugggagu

SEQ ID NO: 129634 - RNA, 42 nt, Homo sapiens
gcuaccuucagcugaguuuuuggaagacauaugcacaaaagg

SEQ ID NO: 129635 - RNA, 46 nt, Homo sapiens
cucagguacugagaugagauggcguacagaagccucagcuguggaa

SEQ ID NO: 129636 - RNA, 45 nt, Homo sapiens
ucaaugaggaaaacugccaugguuugggggaggacauaugcaaaa

SEQ ID NO: 129637 - RNA, 47 nt, Homo sapiens
uuuuaaauagccuucugugaaaaagugacuguacucucuagggagau

SEQ ID NO: 129638 - RNA, 46 nt, Homo sapiens
ugccuuggugggccucgaauuccucuacggggcccuucacccauca

SEQ ID NO: 129639 - RNA, 50 nt, Homo sapiens
gaauggcacaggcagguaagccaacaaucuugcaaccgauuacugaagau

SEQ ID NO: 129640 - RNA, 50 nt, Homo sapiens
uguaccauacugccuuucuuugcauggcuuggacccuaucugugaccaug

SEQ ID NO: 129641 - RNA, 49 nt, Homo sapiens
cugauacccauguacuuaugguaagcuauuuggguauuaccacugcaag

SEQ ID NO: 129642 - RNA, 50 nt, Homo sapiens
ucugccucaucaggaacuaucuguagacguagcucccagggagcucacag

SEQ ID NO: 129643 - RNA, 42 nt, Homo sapiens
auccccagcugaccucauccacagaagcaaaccagcuaagau

SEQ ID NO: 129644 - RNA, 42 nt, Homo sapiens
agagcauugguaucuugcaaaggcuguuccuagguggugggg

SEQ ID NO: 129645 - RNA, 52 nt, Homo sapiens
acuagauaugcauuauauaaguugauuugaaauuaugccaucguggaggggu

SEQ ID NO: 129646 - RNA, 38 nt, Homo sapiens
ugcauauuuuggguuauucuugcccugcauucccugau

SEQ ID NO: 129647 - RNA, 47 nt, Homo sapiens
auacuucugaaucauguuccuucuuuauacacuagaagaucaucaag

SEQ ID NO: 129648 - RNA, 44 nt, Homo sapiens
cuuaggcugaauguaaaaggugauuaaacauucuggaaugcaag

SEQ ID NO: 129649 - RNA, 46 nt, Homo sapiens
cauuccauaaauauggggaauacuuuccuggcacaggagacuugag

SEQ ID NO: 129650 - RNA, 56 nt, Homo sapiens
cuuuucaaaauguaguaaacaaaugccaaacuuuuuauuauagaauauucucuaag

SEQ ID NO: 129651 - RNA, 42 nt, Homo sapiens
uaucuggugauagacuggguuguuucaaucuaacagucaaag

SEQ ID NO: 129652 - RNA, 59 nt, Homo sapiens
aauguugcucgauguuggacauaugagacugcaguugcccuugauugugagauucccaa

SEQ ID NO: 129653 - RNA, 101 nt, Homo sapiens
cagcguuuguuugaaaauuugcgcauguuaccucaugcaccugguguccagaugcaagcuauuccagaagaugcuguucaugaagacaguggagaugaaga

SEQ ID NO: 129654 - RNA, 64 nt, Homo sapiens
acaagcggauagcuugugaugaagaauucucagauucugaggaugaaggagaaggaggucgaag

SEQ ID NO: 129655 - RNA, 66 nt, Homo sapiens
aaauguggcugaucauaagaaaggagcaaagaaagcuagaauugaagaagauaagaaagaaacaga

SEQ ID NO: 129656 - RNA, 33 nt, Homo sapiens
guuuaggaaacacccaacacaaagcuuauuuag

SEQ ID NO: 129657 - RNA, 50 nt, Homo sapiens
uaugugauaguauuuaaaauugaugugaguuauuaugucaaaaaaacuga

SEQ ID NO: 129658 - RNA, 45 nt, Homo sapiens
aauguuaauauggcuuuuuuguauuacuaaaaauagcuuugagau

SEQ ID NO: 129659 - RNA, 46 nt, Homo sapiens
gcaaacuguuauauauugcuaaguuuguucuuuuaacagcuggaau

SEQ ID NO: 129660 - RNA, 47 nt, Homo sapiens
agcucugaaauucauaauccgcagugucagauuacguagaggaagau

SEQ ID NO: 129661 - RNA, 45 nt, Homo sapiens
uaaauacuggagaagcuuugaccaauuugacuuagagauggaaug

SEQ ID NO: 129662 - RNA, 48 nt, Homo sapiens
aaaccauaggaacuuuucacuuaucucauguuagcuguaccagucagu

SEQ ID NO: 129663 - RNA, 37 nt, Homo sapiens
ugguaauaacuuuucuuuaaaaaaaaaaaaaaaagac

SEQ ID NO: 129664 - RNA, 47 nt, Homo sapiens
aggggucacaauggggaaauugaaguggugcauaacauugccaaaau

SEQ ID NO: 129665 - RNA, 41 nt, Homo sapiens
uuaagcaccaaauuuuguuguuuuuuuuuuuucuccccucc

SEQ ID NO: 129666 - RNA, 42 nt, Homo sapiens
uuuuauuacuucuuuuuuuuucgaacuacacuugggcuccuu

SEQ ID NO: 129667 - RNA, 44 nt, Homo sapiens
aaaaagaaguaauaaaaaaaucccagauuuguagccgcacugua

SEQ ID NO: 129668 - RNA, 46 nt, Homo sapiens; identical to SEQ ID NO: 29408

SEQ ID NO: 129669 - RNA, 41 nt, Homo sapiens
ccaaucaagaaaugcauuauuauuuucaagcagagagagac

SEQ ID NO: 129670 - RNA, 34 nt, Homo sapiens
auacacacacauacacauaaacacacggaaagau

SEQ ID NO: 129671 - RNA, 44 nt, Homo sapiens
aggaagcgucacaaaagcugaauauucuucuggagcccuuggag

SEQ ID NO: 129672 - RNA, 54 nt, Homo sapiens
aauggaaaauugggcggugauagcagcguuuucuuugaucaaacugaaaagagu

SEQ ID NO: 129673 - RNA, 51 nt, Homo sapiens
uguaggauugcguuuuaaguacagguauauauuuuuuaaacacaacuaugu

SEQ ID NO: 129674 - RNA, 50 nt, Homo sapiens
gcauauuccuauuuaaacuagugaauaugauuuugauaugaaccuugaaa

SEQ ID NO: 129675 - RNA, 49 nt, Homo sapiens
caccuauuugauuacaauuauuggagagauuuucaggaacgcuauggag

SEQ ID NO: 129676 - RNA, 47 nt, Homo sapiens
aagagaaacagacuaguaaaacuuauuuguauacuucacaaagggcu

SEQ ID NO: 129677 - RNA, 46 nt, Homo sapiens
ucucaauuucaaguaaguaauuuauuuugguuaauauauugggggu

SEQ ID NO: 129678 - RNA, 52 nt, Homo sapiens
cuuuuacccauuuuccuguugagacucuuggucuuuuccuuacugauuccaa

SEQ ID NO: 129679 - RNA, 39 nt, Homo sapiens
aggaaaagauccuggcauuaucaaaucuuuuguagagaa

SEQ ID NO: 129680 - RNA, 46 nt, Homo sapiens
uuugauaggcuuuuuaagcugugagguagcuuuauaaaaauucccu

SEQ ID NO: 129681 - RNA, 47 nt, Homo sapiens
uggguuucuuaucccucugcuccguggaagcuguuaaguggggagcu

SEQ ID NO: 129682 - RNA, 44 nt, Homo sapiens
cagcaacacaauuuguaauuuuucaaaagcacgacaguugguag

SEQ ID NO: 129683 - RNA, 46 nt, Homo sapiens; identical to SEQ ID NO: 29439

SEQ ID NO: 129684 - RNA, 44 nt, Homo sapiens
gauuaaacaagccaugcaaaaguccagagcggagcuuuccacuu

SEQ ID NO: 129685 - RNA, 46 nt, Homo sapiens
aguggaagaagcucuuauuaaugaagaagcaauuuugaaccuuaug

SEQ ID NO: 129686 - RNA, 45 nt, Homo sapiens
aaauagugaugaugaagaaaaugaaccacagauugaaaaagagga

SEQ ID NO: 129687 - RNA, 45 nt, Homo sapiens
ucaaaucccgaaaacgaagaaaaaugucuaaaaagcugcccccug

SEQ ID NO: 129688 - RNA, 45 nt, Homo sapiens
caaccaaauaucccauuuauccacuaacaccaaagaaaagucaca

SEQ ID NO: 129689 - RNA, 45 nt, Homo sapiens
agaugauuugcauccaucaguuguuuguaauucuauaggaccugg

SEQ ID NO: 129690 - RNA, 28 nt, Homo sapiens
aucggaaaguuaagugaauaucgcaauu

SEQ ID NO: 129691 - RNA, 46 nt, Homo sapiens
agucaaagcacagugaaacuuguucuccgggaaauacagcuucaga

SEQ ID NO: 129692 - RNA, 49 nt, Homo sapiens
caaaccaaagcacuuucucaguguaaaaaucgaaaugugucaacaccuu

SEQ ID NO: 129693 - RNA, 81 nt, Homo sapiens
ucuaaaagaauuguuacaaaaaagacagcagaaagcacaaaaugcaaauacuacacaagacccauuauccaauaaacauca

SEQ ID NO: 129694 - RNA, 63 nt, Homo sapiens
aucgguaacguccccaagaaaaccucgaacucccagaaguacaaaacaaaaagaaaaaauccc

SEQ ID NO: 129695 - RNA, 45 nt, Homo sapiens
uucuggaagucaguuugucccagcugaucagaauuugccucagaa

SEQ ID NO: 129696 - RNA, 46 nt, Homo sapiens
ccaaacaauucagacuggauucaaggucacaccagaaaagaaaugg

SEQ ID NO: 129697 - RNA, 92 nt, Homo sapiens
uucaugaauuuuucaaacuaguugcugucacuuuggcaguuggaaaucagucauagggugggggagggguccuuacaucaugaaauaggcca

SEQ ID NO: 129698 - RNA, 35 nt, Homo sapiens
gugucuaauuuuuuaaaugagugaaucuguacuua

SEQ ID NO: 129699 - RNA, 44 nt, Homo sapiens
uccagcuucauggauggaugacucaugaagaggauugggaauag

SEQ ID NO: 129700 - RNA, 40 nt, Homo sapiens
cuaccaguaagagggaauacuaaacuaaaauuagccaugu

SEQ ID NO: 129701 - RNA, 24 nt, Homo sapiens
uuuuucugggagaaugccaugcau

SEQ ID NO: 129702 - RNA, 46 nt, Homo sapiens
accuauauaacagaaagcaagucuuauguauugaaccuggggccag

SEQ ID NO: 129703 - RNA, 48 nt, Homo sapiens
caucuaggugaaggaacuauagccuauauaauuaauauaacuauagga

SEQ ID NO: 129704 - RNA, 27 nt, Homo sapiens
uguaaguaacagauuauuuagguaggu

SEQ ID NO: 129705 - RNA, 44 nt, Homo sapiens
gauacuugagcguucucuaaagcugcuauuugaaacgagagaua

SEQ ID NO: 129706 - RNA, 46 nt, Homo sapiens
auaguguguuguguuucuuaauagcuacaacaagaauggccaucca

SEQ ID NO: 129707 - RNA, 45 nt, Homo sapiens
ggcagggaugauguucuggagagccccguggccaucacgccacag

SEQ ID NO: 129708 - RNA, 47 nt, Homo sapiens
gaaaaagugguuguugagggcaaugacagccccagcauugaaggugg

SEQ ID NO: 129709 - RNA, 30 nt, Homo sapiens
auuuuuauaacaugauaauuuuacgauaua

SEQ ID NO: 129710 - RNA, 82 nt, Homo sapiens
caaacuacaaaccaggaaaaugaagggguugaagaagcgaccugcagaaaggauaacagaagaccacgagaaaaagucaaaa

SEQ ID NO: 129711 - RNA, 81 nt, Homo sapiens
gccaaagaagaagaaaaauauuucccaugauacuuuugguacaacuuauggaaggauucauaugcagaagcaagaccuaag

SEQ ID NO: 129712 - RNA, 45 nt, Homo sapiens
uguuuccagauccagagcuguuuagacauaggguauucagaaagu

SEQ ID NO: 129713 - RNA, 55 nt, Homo sapiens
caauaaguagaguugaaaauguaagaaagugggauauguuugcggggguauaggg

SEQ ID NO: 129714 - RNA, 55 nt, Homo sapiens
cuuaagguggacuuuguucguaaacaauaucccaauagauuuguugacuugaggu

SEQ ID NO: 129715 - RNA, 29 nt, Homo sapiens
aucaagugguuggaacacuguuugacuuu

SEQ ID NO: 129716 - RNA, 111 nt, Homo sapiens
uuguccagauuauucagauaaacaucauaaagcagaauacauuauaaauaaguagaauaugaauaaauagaauaauaaaauuccaaaauacucaaugggaaaugacuagua

SEQ ID NO: 129717 - RNA, 89 nt, Homo sapiens
caguaaaucaagucagcuuggaucauucaccuuaacuuuuccuuuagcagccauuuccacuaguuuccauuaaguaguguucuauaaac

SEQ ID NO: 129718 - RNA, 51 nt, Homo sapiens
uacuaacuuaguaguaguauaaaaucauuuuuauuuaguuaauuaccagag

SEQ ID NO: 129719 - RNA, 48 nt, Homo sapiens
uacuaauucuauaccccagauggggaaugggggagauggucccugggc

SEQ ID NO: 129720 - RNA, 49 nt, Homo sapiens
uggccucagccuaacccucuaggacuguucuauuaaauugcugccagaa

SEQ ID NO: 129721 - RNA, 69 nt, Homo sapiens
uuuuaccaguuuugcuaagaagcagcaacaacagcagaguugauuaagaaaaaugaagaaaaaacgcaa

SEQ ID NO: 129722 - RNA, 45 nt, Homo sapiens
ucgccccagaagauugaagguuuuaagcgucuugauugccagagu

SEQ ID NO: 129723 - RNA, 35 nt, Homo sapiens
aggcagcuaaaauaacucagaugucuuaguuucau

SEQ ID NO: 129724 - RNA, 49 nt, Homo sapiens
aauacaucuuaggccucacugucucauuuccuuuaagauuuuaaaaauc

SEQ ID NO: 129725 - RNA, 80 nt, Homo sapiens
guuagcuuugaaacaaacuuaagucagaccuccuaugaugaccugaucaggaaaguuguagaagucuucaagccaggaaa

SEQ ID NO: 129726 - RNA, 47 nt, Homo sapiens
ccacaauguucaauccuuguggguauucgaugaauggaaugaaaucg

SEQ ID NO: 129727 - RNA, 76 nt, Homo sapiens
gaacuauuuuuaauuuuuauuuagguacuuauauacucuggauuucccagagagucggguaaucagucagccagau

SEQ ID NO: 129728 - RNA, 51 nt, Homo sapiens
uuaaauggauguguuauauuuauuuugcguucucuucccucaacagaugga

SEQ ID NO: 129729 - RNA, 45 nt, Homo sapiens; identical to SEQ ID NO: 29552

SEQ ID NO: 129730 - RNA, 62 nt, Homo sapiens
agacaugugguaccacccucuugcugaaagcacugguuccccuguugaagcuugcuagggau

SEQ ID NO: 129731 - RNA, 57 nt, Homo sapiens
auacuuuugaaggaugugcaauguucaaucauaagugugacaaaaacugacaagcag

SEQ ID NO: 129732 - RNA, 65 nt, Homo sapiens
uuucucagguuaucugaauucacugccgcaggaaggcacccucagaaucuaacuucuggucaguc

SEQ ID NO: 129733 - RNA, 44 nt, Homo sapiens
guuuacaaaccauguaucuuuaagaagcacauguugaaaguagc

SEQ ID NO: 129734 - RNA, 50 nt, Homo sapiens
uguacuuuaaucagcccaaauuguuuuacugcuccaguguggcuuuuaaa

SEQ ID NO: 129735 - RNA, 44 nt, Homo sapiens
aggcccgccugccccaggacauaaugccucuaaugccuuaagcu

SEQ ID NO: 129736 - RNA, 42 nt, Homo sapiens
cgccgugguugccgcgccuggcauugcccugggggaggggag

SEQ ID NO: 129737 - RNA, 46 nt, Homo sapiens; identical to SEQ ID NO: 29570

SEQ ID NO: 129738 - RNA, 44 nt, Homo sapiens
acacagcuggaacaauccgcagcggcggcggcagcggcgggaga

SEQ ID NO: 129739 - RNA, 48 nt, Homo sapiens
uggguccgccuauugccccgccccccgucccgcugcucauuggcgggg

SEQ ID NO: 129740 - RNA, 48 nt, Homo sapiens
gccacagcagccaccuccuccaccucuuccuccuccuccuccgcgacg

SEQ ID NO: 129741 - RNA, 40 nt, Homo sapiens
uacugguuguccucuuaagaagagcuggauaauguacuga

SEQ ID NO: 129742 - RNA, 52 nt, Homo sapiens
uuauuauuauugcagaauuuuuuuuuucuuuuguaacugaacaggccuuaag

SEQ ID NO: 129743 - RNA, 28 nt, Homo sapiens
guaguuagauuauuguauuugcauuuuu

SEQ ID NO: 129744 - RNA, 48 nt, Homo sapiens
gaaaccuagagcuuugagagguuaacugucaugcucauagugucacag

SEQ ID NO: 129745 - RNA, 43 nt, Homo sapiens
cucacugucaacacuuuuggccauuauuucugauuuggauagu

SEQ ID NO: 129746 - RNA, 47 nt, Homo sapiens
gugccggaggcuguccuugucacaucucagagguaaccaguguuaac

SEQ ID NO: 129747 - RNA, 45 nt, Homo sapiens
cuuccucuuccucuuccaccuuuuuccgggcaacuuuagcaggac

SEQ ID NO: 129748 - RNA, 32 nt, Homo sapiens
aagcaaacuucauagaauuguuugucuucuaa

SEQ ID NO: 129749 - RNA, 50 nt, Homo sapiens
caaaacuuggaaggcauggauuuaacuucucuuauaagaacagcucacaa

SEQ ID NO: 129750 - RNA, 57 nt, Homo sapiens
cugguaucagcacccuugagaaugcuuacuguacuuacuguauuguacuagcugcuu

SEQ ID NO: 129751 - RNA, 46 nt, Homo sapiens
uggguuucuccuaguguuccugagaaugacauguugguggcuagag

SEQ ID NO: 129752 - RNA, 46 nt, Homo sapiens
agaaaagaugaaaaggaauaugcauugaagcaaauugaaggcacag

SEQ ID NO: 129753 - RNA, 34 nt, Homo sapiens
cuggacccauuugcuagguagcaauagagaugaa

SEQ ID NO: 129754 - RNA, 99 nt, Homo sapiens
uuguaagcucuuauuauagacgauaugagauuagaucaguugcggcuaaccccucugcccuuuuuguuguuuuuuacaugcaauauaagaaucuaaugc

SEQ ID NO: 129755 - RNA, 46 nt, Homo sapiens
agggaaccagcucuccagugcacauccuaugugcugcagcugcagg

SEQ ID NO: 129756 - RNA, 79 nt, Homo sapiens
ucagauccagauaaccaggaucacuaacuguaugccccaugaacaucuugagcucaucacaucugauacuaaaaucuac

SEQ ID NO: 129757 - RNA, 47 nt, Homo sapiens
gaucauuuagcugcuuuccuuauuacuacuguuaaaauuccugugag

SEQ ID NO: 129758 - RNA, 51 nt, Homo sapiens
ucugagccuugacuucacuguguuuaucuucucuagaagcauagugaucua

SEQ ID NO: 129759 - RNA, 47 nt, Homo sapiens
uuucagauaucucucuuagaccaaguacaugcagaauuuaaaaguca

SEQ ID NO: 129760 - RNA, 31 nt, Homo sapiens
aaagauguauacauaaaaauacgaauggauu

SEQ ID NO: 129761 - RNA, 50 nt, Homo sapiens
cuagagaaaguuuagaauucuaacuguagauuauuuuacauuuaggacag

SEQ ID NO: 129762 - RNA, 47 nt, Homo sapiens
gucaccaaaaauaacuuaaaaugaagaauugcuuuaaaaggaaagga

SEQ ID NO: 129763 - RNA, 48 nt, Homo sapiens
gagacagugaaguagaggcauaagucuauaaauauuuggaacuuguaa

SEQ ID NO: 129764 - RNA, 36 nt, Homo sapiens
uucacauuagugggugaauuugcagucuuuugaagu

SEQ ID NO: 129765 - RNA, 70 nt, Homo sapiens
aucagguagaagucuucuauagggagggccauaaucaguuaaguacuguucauuuucccagggugcugug

SEQ ID NO: 129766 - RNA, 55 nt, Homo sapiens
uguaggauguaaguagucagaucugaggauugguuagauuugagggagaaaagag

SEQ ID NO: 129767 - RNA, 40 nt, Homo sapiens
cacauuuuauuuuguacuuaguagcuguugaucagaagaa

SEQ ID NO: 129768 - RNA, 50 nt, Homo sapiens
acuauugaaaacagucauaucccuuagacaaccucagaaggaaccagagg

SEQ ID NO: 129769 - RNA, 45 nt, Homo sapiens
caggaagauauaaaaacaagcaaucccuuucaucaugaucaacug

SEQ ID NO: 129770 - RNA, 68 nt, Homo sapiens
agaaaaugaacuuuauaagggcuuuaaugcugaugauuucugccaauuucacauaaaaguauguagua

SEQ ID NO: 129771 - RNA, 48 nt, Homo sapiens
uguaguuuuucuuguuaaggcaaauacaaauuaaguuauuuuuggcgc

SEQ ID NO: 129772 - RNA, 46 nt, Homo sapiens
ggcugccagauuccauaccccaaacgagaauuccuuaaugaagaug

SEQ ID NO: 129773 - RNA, 53 nt, Homo sapiens
uagaauuucccaagguacauucuaggcauuauaguucuaucaaaugcuucaga

SEQ ID NO: 129774 - RNA, 32 nt, Homo sapiens
cuuuucaucucaaaagucuuuguucugauaaa

SEQ ID NO: 129775 - RNA, 49 nt, Homo sapiens
cccaagaguagacagaaaaucuacagagaucuuccaagcccacauccag

SEQ ID NO: 129776 - RNA, 52 nt, Homo sapiens
cagcagcagcaucauuuuaaaaucucucugaauccucacacaaaaaaacaga

SEQ ID NO: 129777 - RNA, 37 nt, Homo sapiens
uuauacccaucugagggcucuaggacuggccugugca

SEQ ID NO: 129778 - RNA, 47 nt, Homo sapiens
uaccauguauuuuaggauucuuccagcgcaggauaagcugacaugua

SEQ ID NO: 129779 - RNA, 46 nt, Homo sapiens
uagcucagcauuacauugucauggcaacugcccaagaauguuuuug

SEQ ID NO: 129780 - RNA, 46 nt, Homo sapiens
accaaauuguauuauacaaagugauuauuccacuaaaauaauauga

SEQ ID NO: 129781 - RNA, 66 nt, Homo sapiens
guuauaacuauuuagcauauggaacuaugggcucucaaaugaauugaaauagauauguccaaggaa

SEQ ID NO: 129782 - RNA, 48 nt, Homo sapiens
auuuguucagcuggggcagagucaacauaaacaagacaagaauagcca

SEQ ID NO: 129783 - RNA, 46 nt, Homo sapiens
acccauaaggcauucccugaaaucaugugcauaauuucguguguau

SEQ ID NO: 129784 - RNA, 44 nt, Homo sapiens
auauacagaguuaaagugcuaaaugccugagacucugccccuca

SEQ ID NO: 129785 - RNA, 49 nt, Homo sapiens
cucagaagaagauuucuccauuuauucaaggugagauacuuucauguag

SEQ ID NO: 129786 - RNA, 58 nt, Homo sapiens
gagggcucugugucucagcgcuccacucccgugaagaugacugaugcaggagacagug

SEQ ID NO: 129787 - RNA, 34 nt, Homo sapiens
cagccagcgccccgccgccccccagcgaggaggc

SEQ ID NO: 129788 - RNA, 41 nt, Homo sapiens
gaagaccuacugugucaaaagcuuugcaaacauguuuuaaa

SEQ ID NO: 129789 - RNA, 68 nt, Homo sapiens
cuacguagaaugaacuauuaagugcuauuaaggcuauuuaagaagcagaaagaauguaauugccauaa

SEQ ID NO: 129790 - RNA, 26 nt, Homo sapiens
ucauagcagcgugcuucuucacagcu

SEQ ID NO: 129791 - RNA, 26 nt, Homo sapiens
gaaccgucaugacugggauuaguguc

SEQ ID NO: 129792 - RNA, 59 nt, Homo sapiens
ucucacuauugugaaauuaauuguuuuucuuuguuucuaagugaaggcuugaucagggu

SEQ ID NO: 129793 - RNA, 58 nt, Homo sapiens
uauaggucaaauuucugccuuaguuuccaggacaacuuggagaaagaagcaugaaauc

SEQ ID NO: 129794 - RNA, 45 nt, Homo sapiens
ccauguggcuucucugcauggcugaaaaaaaugaguaguauauau

SEQ ID NO: 129795 - RNA, 28 nt, Homo sapiens
uaacaagccaugcuuucccucuuccuag

SEQ ID NO: 129796 - RNA, 21 nt, Homo sapiens
aauaugcagauguucugaaaa

SEQ ID NO: 129797 - RNA, 42 nt, Homo sapiens
aauggcaaugcuauuaaccaagcauguuacuuugaaguuaaa

SEQ ID NO: 129798 - RNA, 53 nt, Homo sapiens
aaggugagauuauucucuuaucgcacagggguaaacugauaagaaauggagug

SEQ ID NO: 129799 - RNA, 90 nt, Homo sapiens
agaaaaacaugucuacuacauggggugaauuaugucuuuauugaugcaaaccugaaggaaguugauuauuuuaacagaaauggagugaag

SEQ ID NO: 129800 - RNA, 51 nt, Homo sapiens
ucagguucuuagaaggcuauuauauuguguuaauaacuaaaaggaggaaga

SEQ ID NO: 129801 - RNA, 87 nt, Homo sapiens
guuagaaggaugaacaggcugauucuugguggaugucuaugccaagcugaagccuuuaauuguugagagacauuuccaauugguagu

SEQ ID NO: 129802 - RNA, 39 nt, Homo sapiens
cucaagugacacagccuuuuuuauuuuggagagagaaau

SEQ ID NO: 129803 - RNA, 49 nt, Homo sapiens
uuuaguauuuuuauggaaaugugccuuauguguccuacuucagucaugu

SEQ ID NO: 129804 - RNA, 59 nt, Homo sapiens
uuauuggccagauuuuauuauucauaauugaaguuuucuugaugauuaaauguaacgaa

SEQ ID NO: 129805 - RNA, 65 nt, Homo sapiens
aaucccuuuaggcucauuuuguguguuagguggcugcaggggaagguaaagaguaguauaacaug

SEQ ID NO: 129806 - RNA, 58 nt, Homo sapiens
gcuguguaguaugaauuaaaugguguuggaggucacagaagagguaaauuacuuggac

SEQ ID NO: 129807 - RNA, 57 nt, Homo sapiens
aguuuauaaggcuauaaggcuuuaaaauuauaauuaccuguagcuuugguuauuuaa

SEQ ID NO: 129808 - RNA, 42 nt, Homo sapiens
cuaauggguguuguuccuggcuggacuugauguccagggccu

SEQ ID NO: 129809 - RNA, 37 nt, Homo sapiens
gcggcgggcugggaacggaggggcagcuggauggugg

SEQ ID NO: 129810 - RNA, 42 nt, Homo sapiens
gucuccggagauuccugggagagcgcgcccgggcgcacaggg

SEQ ID NO: 129811 - RNA, 44 nt, Homo sapiens
uccucccgccguuuguugaggcaguuugguggagggaaguggaa

SEQ ID NO: 129812 - RNA, 49 nt, Homo sapiens
gguaucagaucugucccuguguugcaugcaaaggcagcucuguccucuc

SEQ ID NO: 129813 - RNA, 41 nt, Homo sapiens
uugugaauggacgcaccguggaggagacacaggugccggag

SEQ ID NO: 129814 - RNA, 46 nt, Homo sapiens
gcugcggcugggggugcugcgccaggugaggcccaguccuggccag

SEQ ID NO: 129815 - RNA, 46 nt, Homo sapiens
ucugucacagacauccccagaaaacaugcaucgcaauguggcccag

SEQ ID NO: 129816 - RNA, 44 nt, Homo sapiens
uagguacgagaccuguaugaugugcuagccaaggagccugugca

SEQ ID NO: 129817 - RNA, 50 nt, Homo sapiens
ucuaaugcauucagauaguggagagcuuugugaauggcacaggcccccaa

SEQ ID NO: 129818 - RNA, 46 nt, Homo sapiens
ucagccacuuccacagugccuucaagagcauggcccacagcccagg

SEQ ID NO: 129819 - RNA, 41 nt, Homo sapiens
ccaacauggcgucggacucugcugcgccgugcgaaggagga

SEQ ID NO: 129820 - RNA, 42 nt, Homo sapiens
cgggagagccgcgacaucguguccucagcgcuggcguucggg

SEQ ID NO: 129821 - RNA, 52 nt, Homo sapiens
augccuuaaccagcccuaugcgacugcacauaacaaaagacacgcuccugau

SEQ ID NO: 129822 - RNA, 38 nt, Homo sapiens
aacaagaguaaggggagaaccuuucccaacaaaucuua

SEQ ID NO: 129823 - RNA, 58 nt, Homo sapiens
uaccugauguaguaacugucuuggaaguuguagaaggggagggcugaacuguggguuu

SEQ ID NO: 129824 - RNA, 44 nt, Homo sapiens
aaacuggcugcaucaaagguagacuuucgcacagguugugaggu

SEQ ID NO: 129825 - RNA, 47 nt, Homo sapiens
cacugucauguacaggauauaucaacauuuacuacucaucugucaug

SEQ ID NO: 129826 - RNA, 51 nt, Homo sapiens
auagcucaggaaacccugaguuuacccuuaguuaccacuaaaaacuaacaa

SEQ ID NO: 129827 - RNA, 46 nt, Homo sapiens
cugagguucuacuuguugacaacugcauuaaaacugcagcauuuaa

SEQ ID NO: 129828 - RNA, 46 nt, Homo sapiens
uaguaaugaacuuugucuugggcccgaggaaacugagcacuucuug

SEQ ID NO: 129829 - RNA, 45 nt, Homo sapiens
cuguacuagaauacguccuccuucacgaaauucuuuacuggagag

SEQ ID NO: 129830 - RNA, 91 nt, Homo sapiens
cccugguagagugugaucauccauaugguucaccuggaccucacugagcccugacauaaacaaacacuuccaaaaaugguuuccaggucca

SEQ ID NO: 129831 - RNA, 26 nt, Homo sapiens
cuggaacuucuucuggcauuugcugu

SEQ ID NO: 129832 - RNA, 46 nt, Homo sapiens
ugaaauggaaacguauaaaaagcuugagcuugcugaagggaguagc

SEQ ID NO: 129833 - RNA, 48 nt, Homo sapiens
uugucugauuuuccauuuuuaccacuucccacaaucauggcuaucaac

SEQ ID NO: 129834 - RNA, 58 nt, Homo sapiens
uuuucuagaguuuuauauaaauggagucacauaguauguacucauuuuuuuggucugg

SEQ ID NO: 129835 - RNA, 45 nt, Homo sapiens
uuuuucuauuuccuuuucuucggaguuuccuguuugugacggaaa

SEQ ID NO: 129836 - RNA, 87 nt, Homo sapiens
ucaguguccuguaacauucuuuuucccccccgccccaugugaucugcaggaaacuaacauucuugacuuggaauagaacuaaaauaa

SEQ ID NO: 129837 - RNA, 46 nt, Homo sapiens
gaggagguuaccaacuuuccuaaagucauacagcuaccagguggaa

SEQ ID NO: 129838 - RNA, 80 nt, Homo sapiens
uuuagugauuaauaaagugauuuaauuaaaguacagauuaagggaguuuagguaaggaagaauuaaauauauacugguaa

SEQ ID NO: 129839 - RNA, 344 nt, Homo sapiens
uuuugauuaaaccugauuaauggguucuaaauagaaaacuagucuuuuggccagccgcaguggcucgugccuauaauaucaguacuuugggaggcugagguaggaggauugcuugaggccaagaguuugagaccagccugggcaacauagggaaacccucaucuguacaaaaaacuaacacaauuagcugaacguggugacacaccccugugguuccagccacuugggaagucaaggcugcagcgagcugugauugcaccacugcacuccagccugggcgacagagcaagacugucucaaaaaaaaaaucuuuuguguuuaucaguagaauguuagaacugaaa

SEQ ID NO: 129840 - RNA, 55 nt, Homo sapiens
ucauccagauaaaggaggugaugagguuauguucaugaggauagcaaaagcuuau

SEQ ID NO: 129841 - RNA, 57 nt, Homo sapiens
ggccaggggcuucuuaucucauuuguucccagagcacuaacuacugagagguugugg

SEQ ID NO: 129842 - RNA, 42 nt, Homo sapiens
gucuuaucaugguuuuggcuggagcuucugaauuugauccuc

SEQ ID NO: 129843 - RNA, 81 nt, Homo sapiens
ucagcaauucaugcuaaaaaaguguccugcccuacuucaagaaaugguuaauguaaucugccaacuaauaguaauggcccg

SEQ ID NO: 129844 - RNA, 45 nt, Homo sapiens
uccaacuuuggcaucccuagaaaacugcaugaagcuuucucagau

SEQ ID NO: 129845 - RNA, 50 nt, Homo sapiens
aauuaaaacuauccaggauuuggugaguuuaaaagaaucagaucgucaca

SEQ ID NO: 129846 - RNA, 29 nt, Homo sapiens
uugugaaaacuugguuugcuuuggugagg

SEQ ID NO: 129847 - RNA, 42 nt, Homo sapiens
guaggauccuuaguuacaguguugguuaaguugacaaggcaa

SEQ ID NO: 129848 - RNA, 45 nt, Homo sapiens
uauuugaaaaggagcaguccaucugugcugcagaggaacagccag

SEQ ID NO: 129849 - RNA, 43 nt, Homo sapiens
cagggugaaacuaacaagaacaggacaaaaggaggauggcaac

SEQ ID NO: 129850 - RNA, 65 nt, Homo sapiens
agcugcaguaaaggaagaugaagaagaaguuucagauaagggcagugauucugaagaagaagaaa

SEQ ID NO: 129851 - RNA, 90 nt, Homo sapiens
ccaauagagauucccaaagugagaaagaugaugguagugacagagacucugauagagagcaagaugaaaaacaaaacaaagaugaugaag

SEQ ID NO: 129852 - RNA, 36 nt, Homo sapiens
ggaguggcaagaauuacaacaaagcauacagcgaaa

SEQ ID NO: 129853 - RNA, 46 nt, Homo sapiens
aucaaaaauaacacauccuguguauagccuuuacuuuccugaggug

SEQ ID NO: 129854 - RNA, 28 nt, Homo sapiens
uauauacacacacacauauauguauaug

SEQ ID NO: 129855 - RNA, 47 nt, Homo sapiens
gagcagacauuaauauccaugccauaucauguguguacgcugaaaga

SEQ ID NO: 129856 - RNA, 52 nt, Homo sapiens
gguugcuuuaaguacugcuuucuugaauuguggagagacaaauuaaccucau

SEQ ID NO: 129857 - RNA, 56 nt, Homo sapiens
auuuuaucuucuagguagagcugaaguuuccugcaccaggcaagccuggaaauuau

SEQ ID NO: 129858 - RNA, 62 nt, Homo sapiens
caguauacuguguuucugagaucagacuccuauauggguuuggaucagauuaaaccauugaa

SEQ ID NO: 129859 - RNA, 71 nt, Homo sapiens
ugggauacagcaauagagggggaugaagaccaggaggacagugagggcuuugaagauagcuuugaggaaga

SEQ ID NO: 129860 - RNA, 67 nt, Homo sapiens
guguuugcacauauuugcaauuuuuugcuguuuuggaaguguaucauaaaccagaaacaguacagaa

SEQ ID NO: 129861 - RNA, 47 nt, Homo sapiens
aacugauuguaauaauucuuuccuaucaaaaucuccauaggucaaaa

SEQ ID NO: 129862 - RNA, 106 nt, Homo sapiens
aucaccaguuuagugagagccuuucuuggcaggcaggaggcagugucacugaggauuuuuuucauuuacuucauuguacaaguaggaggguggguuuaauuuucaa

SEQ ID NO: 129863 - RNA, 51 nt, Homo sapiens
cucuggaaugagaauaacaaacuauccuaguuugcauuuaaucuaauggaa

SEQ ID NO: 129864 - RNA, 44 nt, Homo sapiens
ucgccuaauuugcauuuuagcauuguuuuguuucuuaaauguca

SEQ ID NO: 129865 - RNA, 45 nt, Homo sapiens
uaggcaacguggagguacucagcucuccugcguacacgcccaugu

SEQ ID NO: 129866 - RNA, 26 nt, Homo sapiens
caagacugacagcuuuuuauguauca

SEQ ID NO: 129867 - RNA, 57 nt, Homo sapiens
auuaucagaaaaugugaagaagaaaaaaaugccauguuuuaaaaccacugcgaaaau

SEQ ID NO: 129868 - RNA, 47 nt, Homo sapiens
uucucaacuaaauucaagcagagacauuuuuuagacgaugaaggaua

SEQ ID NO: 129869 - RNA, 54 nt, Homo sapiens
agaaaaguaaguagccagaaaucacaaaauggcauuuuucuaaaaacaaaggaa

SEQ ID NO: 129870 - RNA, 55 nt, Homo sapiens
uuuacccagguuuaccaguuauugauaaguauauccauuugcuuuaccagaaggc

SEQ ID NO: 129871 - RNA, 40 nt, Homo sapiens
caucucguuuuugcuggcaggaauaugaacaucuguugug

SEQ ID NO: 129872 - RNA, 45 nt, Homo sapiens
ccuccaaaguuaccuggacaagcaccauagucuuagaguuucagc

SEQ ID NO: 129873 - RNA, 46 nt, Homo sapiens
ucauucuccuuuaaaaucauagcuaagucaaguaaugcucuuagau

SEQ ID NO: 129874 - RNA, 44 nt, Homo sapiens
gcuuccccggggugccugcuugaaggaaacaaugggcuguagau

SEQ ID NO: 129875 - RNA, 68 nt, Homo sapiens
uuaaucucagagguggauugucuguuaugugguaucaguccaagccauauauucagaugccauuccug

SEQ ID NO: 129876 - RNA, 32 nt, Homo sapiens
uagguaaauuucuuuucagaaaaguuauacca

SEQ ID NO: 129877 - RNA, 68 nt, Homo sapiens
ucuuccgucaucaagggggauagaccaggagaucuggggaugauggcaacaagcagagguguagcaga

SEQ ID NO: 129878 - RNA, 46 nt, Homo sapiens
auuuuugguuuggaaugcauacugaauggaguauaaguagauagga

SEQ ID NO: 129879 - RNA, 34 nt, Homo sapiens
uuaaaguuguauuuauauagaaaugugaaaagaa

SEQ ID NO: 129880 - RNA, 57 nt, Homo sapiens
ccauuuugauuuuucugcuaacaccaauaucagaaauaacuaggaaagaaaaaggaa

SEQ ID NO: 129881 - RNA, 68 nt, Homo sapiens
uagaaaggagaccauagaauaagaaugaaugcagaucaacauggucauggaugagaagaagcaagcaa

SEQ ID NO: 129882 - RNA, 29 nt, Homo sapiens
ugaacauauuggccaguuugauucaauuc

SEQ ID NO: 129883 - RNA, 45 nt, Homo sapiens
ucuacugagcggucgccgaagacgccgggaggcgaggggcgaggu

SEQ ID NO: 129884 - RNA, 32 nt, Homo sapiens
auuaauucuucagucuuuuaaaacggaguaga

SEQ ID NO: 129885 - RNA, 51 nt, Homo sapiens
uuuaggaaacagauuuucaaagaaucaaggguaggggacaaaauacauuug

SEQ ID NO: 129886 - RNA, 28 nt, Homo sapiens
auuuuuucccuuugacuuuaaguccuaa

SEQ ID NO: 129887 - RNA, 54 nt, Homo sapiens
cuucucuugcccccagcuuugcggcccuugugccaguugucccgagaggugccc

SEQ ID NO: 129888 - RNA, 45 nt, Homo sapiens
cuuguuaccuccucgcacacggacuguguggaugcggcacggguc

SEQ ID NO: 129889 - RNA, 53 nt, Homo sapiens
ucucuaagcucugaugagucuuugaauucucugagcuuggcucuuuaaaguau

SEQ ID NO: 129890 - RNA, 49 nt, Homo sapiens
guauuacccuaaguaauggagugcagguaguugaguccuccuaggcagg

SEQ ID NO: 129891 - RNA, 41 nt, Homo sapiens
gaugaaguucagguuguacguggacacuauaaaggucagca

SEQ ID NO: 129892 - RNA, 44 nt, Homo sapiens
aguguugccuagguuggacaggggaagggcauaguccuuugacu

SEQ ID NO: 129893 - RNA, 39 nt, Homo sapiens
gcugaaaagaauuuucauguaccguuuuuuagaaacaaa

SEQ ID NO: 129894 - RNA, 73 nt, Homo sapiens
uuuauaauguucauucuguucucaguuuuagcaaauaaaacuucauauuuuauuuuaucuuuugcuguuaagc

SEQ ID NO: 129895 - RNA, 37 nt, Homo sapiens
cuauuuuucuacuugcauuguguaugguacaaguaac

SEQ ID NO: 129896 - RNA, 43 nt, Homo sapiens
uuauaguucuacauagcuauuuaucauucaugauaucucaaua

SEQ ID NO: 129897 - RNA, 51 nt, Homo sapiens
ucuuuccuauuuucuacuuugucuuuuuauucuacuuuguagaauuccuga

SEQ ID NO: 129898 - RNA, 45 nt, Homo sapiens
agaaaacaugguauuguauuugugauaguagcuuguaaaugaaga

SEQ ID NO: 129899 - RNA, 30 nt, Homo sapiens
uauuuauguauacuaacuuuauuuucaguc

SEQ ID NO: 129900 - RNA, 45 nt, Homo sapiens
cuagaacuaacuuuuucuguugagacugauguguuuggagcaaug

SEQ ID NO: 129901 - RNA, 44 nt, Homo sapiens
cacauugaggauauacccuucauugugcaucucaccagaggugg

SEQ ID NO: 129902 - RNA, 66 nt, Homo sapiens
auugcuugguugauuagaggcuaacuuuuuuaaguaauuaggaguguuaauagcagggucuugauu

SEQ ID NO: 129903 - RNA, 40 nt, Homo sapiens
auuaauguuauacauucucagcuuucauuuuuuuuauaua

SEQ ID NO: 129904 - RNA, 57 nt, Homo sapiens
gauugagucccuggaauuuuuuccucaacagcuuagugaauaguggcuugcugauuu

SEQ ID NO: 129905 - RNA, 39 nt, Homo sapiens
gaggcuugaauaacuuaauaaaaaggaugaaaaaauaau

SEQ ID NO: 129906 - RNA, 46 nt, Homo sapiens
aaggccaggauccgcaaaccacacucagcguaucgggcgugcaggu

SEQ ID NO: 129907 - RNA, 42 nt, Homo sapiens
ccgcggcgaacucuuugaucucuucguuacucccuggcuccu

SEQ ID NO: 129908 - RNA, 46 nt, Homo sapiens; identical to SEQ ID NO: 57471

SEQ ID NO: 129909 - RNA, 70 nt, Homo sapiens
gaagcauacguacaagcuuuggagggcaaguauacagaucuuaaacucuaaugauguaacuggccuaaga

SEQ ID NO: 129910 - RNA, 40 nt, Homo sapiens
caaaguggaccucuuaguccaacuacggucauuucccuga

SEQ ID NO: 129911 - RNA, 45 nt, Homo sapiens
gcucuucaggaccaggaaaaggccuggggcuucccagaaaacgcg

SEQ ID NO: 129912 - RNA, 46 nt, Homo sapiens
cgagagcagcggcugcgaguagugaccacgaaaauccgauccgcac

SEQ ID NO: 129913 - RNA, 47 nt, Homo sapiens
gcaauucgagacuacaagggaagauucucccgacgauaaacucagga

SEQ ID NO: 129914 - RNA, 34 nt, Homo sapiens
aagaggacaaauuaaguuacaaaacaaguggcaa

SEQ ID NO: 129915 - RNA, 64 nt, Homo sapiens
aucuaguuagugccaccauguguggccauuuuuguguaacuguagauauuuuuguucccuaaau

SEQ ID NO: 129916 - RNA, 36 nt, Homo sapiens
cucuuuggaggagucuccuguuuagcugaggaagaa

SEQ ID NO: 129917 - RNA, 52 nt, Homo sapiens
uugcccaguuggcauaaggaccucauauuuauuuuaucucaaagccauuuua

SEQ ID NO: 129918 - RNA, 46 nt, Homo sapiens
cuuuccuaucugaccauccucauuuaaauauacucuacuaugugaa

SEQ ID NO: 129919 - RNA, 42 nt, Homo sapiens
ugagggcugaggcaaaagcaaauucuguggacugauggucag

SEQ ID NO: 129920 - RNA, 46 nt, Homo sapiens
aagcuuuuaauagagauuuaaucaagaauaugacaaaacuauagaa

SEQ ID NO: 129921 - RNA, 30 nt, Homo sapiens
aaauaaaaaauagugguuaguagacaucac

SEQ ID NO: 129922 - RNA, 23 nt, Homo sapiens
gagcaagagagaaagaagcagcc

SEQ ID NO: 129923 - RNA, 45 nt, Homo sapiens
cucaguauaaaaaggugacugcaucuaagguuuuucuugcaauua

SEQ ID NO: 129924 - RNA, 51 nt, Homo sapiens
uuagcauuaaacaaaauuuuuuuugcaaauugguuucauucucuugaugaa

SEQ ID NO: 129925 - RNA, 29 nt, Homo sapiens
agaagcaggaauaaaugcuguuuuguccu

SEQ ID NO: 129926 - RNA, 23 nt, Homo sapiens
gcccggggacggggacagcaaag

SEQ ID NO: 129927 - RNA, 45 nt, Homo sapiens
caucgccaccagagaacggcuggcccaggccaucggcauuccgga

SEQ ID NO: 129928 - RNA, 23 nt, Homo sapiens
gcccggggacgaggacggcgacg

SEQ ID NO: 129929 - RNA, 37 nt, Homo sapiens
guauguuuuuauaugaagaaaaucugaucuuacacag

SEQ ID NO: 129930 - RNA, 128 nt, Homo sapiens
aagaauaacggauauguaguguaauaaaggagauaauaguuuccuuuuaagaccuucaaaccucucugguccagugucucuccgcauccuauccccuucccauccugaauuuaccauuaguaauuuac

SEQ ID NO: 129931 - RNA, 51 nt, Homo sapiens
gcuuuacucugaaagccucuauuuucaauaauguuguguuugcucuuugga

SEQ ID NO: 129932 - RNA, 44 nt, Homo sapiens
aguccgagugugaaugggaaucaucccaagaagaguuuagggag

SEQ ID NO: 129933 - RNA, 50 nt, Homo sapiens
gacucaggcaaacagaagcuucaaagaaauuuacuggaaaaauacugggg

SEQ ID NO: 129934 - RNA, 48 nt, Homo sapiens
guguuagucucuacucagauuucuagucuuugagaaauaguaucugau

SEQ ID NO: 129935 - RNA, 27 nt, Homo sapiens
auuguggccagaggauaggaagaagca

SEQ ID NO: 129936 - RNA, 55 nt, Homo sapiens
gcugaaugucaugaaguaugcauccacaggacuuugaugcugguuaaaaacguaa

SEQ ID NO: 129937 - RNA, 58 nt, Homo sapiens
uugcuaagcacuugcugugcacuguguaacacuuugucaggcuuaggguaacagagga

SEQ ID NO: 129938 - RNA, 44 nt, Homo sapiens
augcgaguggcgcauggcuucaagaggaggguugaugggaccca

SEQ ID NO: 129939 - RNA, 58 nt, Homo sapiens
agauaauucgcagugaugugaaacuggccucccaagcccugauaaguaaguuaaauaa

SEQ ID NO: 129940 - RNA, 91 nt, Homo sapiens
acauagagaaaugguagauccuggaaacacaagagugugcugagucuagggaagugguugggaaauuaaaauauagcacaauuaguuguua

SEQ ID NO: 129941 - RNA, 48 nt, Homo sapiens
uuauagccuagagcagucuugagaggccucacuuaggaagacagcuug

SEQ ID NO: 129942 - RNA, 27 nt, Homo sapiens
guuugagaguaaauggguuaccagagg

SEQ ID NO: 129943 - RNA, 45 nt, Homo sapiens
caguggaacuauucaauguagccuaggaaggaaggacaucaaaaa

SEQ ID NO: 129944 - RNA, 37 nt, Homo sapiens
auucagcaugccagcuguucaauuuaaugucuauacc

SEQ ID NO: 129945 - RNA, 49 nt, Homo sapiens
ggcaggaauaugcgugauucuucucugccuuucauacauuuucugcaau

SEQ ID NO: 129946 - RNA, 44 nt, Homo sapiens
cuucuuaagaaacaagccaccacauaggucgucaagacuuaaaa

SEQ ID NO: 129947 - RNA, 48 nt, Homo sapiens
ccucaguacaccucugccuggggcuccugaguggccacucucuuuugc

SEQ ID NO: 129948 - RNA, 38 nt, Homo sapiens
gugccugcuaguuuucuuccagaaauauuucaaccuga

SEQ ID NO: 129949 - RNA, 43 nt, Homo sapiens
cuuuagauuaaguuucauuucagagggaguuucuugaagacaa

SEQ ID NO: 129950 - RNA, 29 nt, Homo sapiens
gcucugccuuacuuugauaauaaucccaa

SEQ ID NO: 129951 - RNA, 44 nt, Homo sapiens
gcaguaaacaagagcaaacuggacauguggagcaacuuggauug

SEQ ID NO: 129952 - RNA, 54 nt, Homo sapiens
agcuggcccauacaauuuuauugacuggacuuugggugggaguuuuccagggug

SEQ ID NO: 129953 - RNA, 41 nt, Homo sapiens
acuugcgagcgcugcaagggcggcuuugcgcccgcugagaa

SEQ ID NO: 129954 - RNA, 46 nt, Homo sapiens
uaaggguuuggguuaaggaaugcuauuuuauucacuagcacacauu

SEQ ID NO: 129955 - RNA, 102 nt, Homo sapiens
ucauaaucgugagaaagccagaggccuugggaaauacaucugccagaaaugccaugcuaucaucgaugagcagccucugauauucaagaacgaccccuacca

SEQ ID NO: 129956 - RNA, 44 nt, Homo sapiens
uuugugccaagugugagaaacccuuucuuggacaucgccauuau

SEQ ID NO: 129957 - RNA, 46 nt, Homo sapiens
cuaaacaacauggugcauggacaguugccacaugugcccaggccaa

SEQ ID NO: 129958 - RNA, 50 nt, Homo sapiens
aaauucuaagcugcccugcuccccauacugauguauuuccaugugaccag

SEQ ID NO: 129959 - RNA, 46 nt, Homo sapiens
ucuaccugcaacacuaaauuaacacucaaguaaguguacgguuuug

SEQ ID NO: 129960 - RNA, 46 nt, Homo sapiens
ccauuggagcugaagaaaagacuuaagaaacuagcugagaccuuag

SEQ ID NO: 129961 - RNA, 46 nt, Homo sapiens
guugaguaguuuaaaacaaucuuugcauuuuacaguaagaaucaaa

SEQ ID NO: 129962 - RNA, 25 nt, Homo sapiens
cauaggccaugacuacacagaauua

SEQ ID NO: 129963 - RNA, 72 nt, Homo sapiens
cauacacauccaauaagaaacuaguggaaucaccuagaaaacuuuauggucacuguugguauccgcaccaga

SEQ ID NO: 129964 - RNA, 45 nt, Homo sapiens
caugggcacuuccuccaucugucucaugauucuuguuugcugucu

SEQ ID NO: 129965 - RNA, 56 nt, Homo sapiens
auucuucuucaucuuccucaccaguuuuuacuucaaucuuaucaggaagagguacu

SEQ ID NO: 129966 - RNA, 45 nt, Homo sapiens
caucgcuguccucagucuuauaggcaucaucaucuuucucaaagu

SEQ ID NO: 129967 - RNA, 46 nt, Homo sapiens
agaaaucacuggcuaaccacauccaugcucuaucugauccagagag

SEQ ID NO: 129968 - RNA, 48 nt, Homo sapiens
uccaaaaaaugaaaaguagcauuugaauguaaaaacucaccagcauaa

SEQ ID NO: 129969 - RNA, 44 nt, Homo sapiens
aagcuguucuacuuuugcuucuccaucuggcagggagggaaagg

SEQ ID NO: 129970 - RNA, 45 nt, Homo sapiens
ugaaauacaccaguguuuaaacuuuuauuucacaccaugcaaggu

SEQ ID NO: 129971 - RNA, 46 nt, Homo sapiens
caugguugugugaggauuuugaguuggauuacauggcuggcccccg

SEQ ID NO: 129972 - RNA, 32 nt, Homo sapiens
ccaaaaaaauuagugcaaaagacuauugaaaa

SEQ ID NO: 129973 - RNA, 173 nt, Homo sapiens
agaaaguuuaguuuagaauaucaagcauucuuggcuggaccaagugcaaugguguuuacaacuaauugaucacaaugaguuacagguuucuuuguuuuuucugcacucccauugcuuuacuugacuagcuuaaaaaaagagaauaucaagcacucuuuagucugccuuauuaa

SEQ ID NO: 129974 - RNA, 49 nt, Homo sapiens
auguucuauaaugauucucuuugcaagcugcuuucugaaugaagguaga

SEQ ID NO: 129975 - RNA, 60 nt, Homo sapiens
auuagagaaccauucucuagaguaauuagacauucaguuguacuuuuacauaagauaaau

SEQ ID NO: 129976 - RNA, 45 nt, Homo sapiens
uccccagucuuuggcucauccaggcuuuuuuacuucaauugguaa

SEQ ID NO: 129977 - RNA, 80 nt, Homo sapiens
ggucagaugacugauuugauccauacugagaaagaucuggugacuucucugaaagauuauauuaaggcagaagaggacaa

SEQ ID NO: 129978 - RNA, 47 nt, Homo sapiens
uugcuuauuaugacucugacucaaccuggauguuuucuuucucaagc

SEQ ID NO: 129979 - RNA, 71 nt, Homo sapiens
aguuagaucggcuaacuaguacagcgacaaaagauccagaaggauuuguugggcauccaguaaaugcauuc

SEQ ID NO: 129980 - RNA, 62 nt, Homo sapiens
aaauuaaugaaacgucugaauacugaguggagugaguuggagaaucugguccuuaaggauau

SEQ ID NO: 129981 - RNA, 32 nt, Homo sapiens
aucucuaaccuaaccauucagagacaguacuu

SEQ ID NO: 129982 - RNA, 48 nt, Homo sapiens
uuuuaaaauugguuucagguuuucauagauauuaaauacuuaauaugu

SEQ ID NO: 129983 - RNA, 44 nt, Homo sapiens
uuaaaaucagauucccaggcagucugccuuuaauauuguuaaua

SEQ ID NO: 129984 - RNA, 47 nt, Homo sapiens
uuaauggcauacugucaucuuauguguuuugcaugucccuaagagaa

SEQ ID NO: 129985 - RNA, 49 nt, Homo sapiens
ugaggacugcuuugaguugggcaaaguggccuauacagaagcagauuau

SEQ ID NO: 129986 - RNA, 61 nt, Homo sapiens
gcuauaacagugguuguguuucuuugcucuauauucuccaggaauuucaaaauugaagcua

SEQ ID NO: 129987 - RNA, 46 nt, Homo sapiens
uguaugauaauaaguuuagguggccuuugguauauaacgaagcuuu

SEQ ID NO: 129988 - RNA, 49 nt, Homo sapiens
acuuaaaauauuuugaguauauaauggcuaaagaaaaagaugucaauaa

SEQ ID NO: 129989 - RNA, 46 nt, Homo sapiens
aacuacaccaaagaaaaaagggguugcuguggauuaccugccagag

SEQ ID NO: 129990 - RNA, 46 nt, Homo sapiens
cgcuaccaugauggaaaccguaauccuaaauuuauucuggcuccag

SEQ ID NO: 129991 - RNA, 46 nt, Homo sapiens
caagccucguauuauucgcuuccaugauauuauuucugaugcagaa

SEQ ID NO: 129992 - RNA, 64 nt, Homo sapiens
gcugaauuuggucuguggccauaguuuguugacccuuauuauaucaaagguuugaauuaucugg

SEQ ID NO: 129993 - RNA, 45 nt, Homo sapiens
cugaggcgagccaccauuucaaacccaauaacaggagacuuggag

SEQ ID NO: 129994 - RNA, 41 nt, Homo sapiens
ugacccugagacuggaaaauugaccacagcacaguacagag

SEQ ID NO: 129995 - RNA, 63 nt, Homo sapiens
aucugugcuggaguuuucaugacggacuaauaaacaugguuauggggcaguuaauagggguuu

SEQ ID NO: 129996 - RNA, 45 nt, Homo sapiens
uauuacaauagaacuccuuuuccaucuacuugugaagguuucucg

SEQ ID NO: 129997 - RNA, 55 nt, Homo sapiens
ggacuggauaaauucccagucuagauuauuagccuuuguuaaccaucaagcaccu

SEQ ID NO: 129998 - RNA, 47 nt, Homo sapiens
ugagaauacaagaucuaacaggacuagauguuuccacagcagaggaa

SEQ ID NO: 129999 - RNA, 41 nt, Homo sapiens
uggaguuggaggacaguaugaaccccauuuugacuuugcac

SEQ ID NO: 130000 - RNA, 30 nt, Homo sapiens
ucugguauaaucuguuugccaguggagaag

SEQ ID NO: 130001 - RNA, 79 nt, Homo sapiens
augaacguggacaagaauuucgaagaccuuguacguugucagaauuggaaugacaaacaggcuucccuuuuucuccuau

SEQ ID NO: 130002 - RNA, 88 nt, Homo sapiens
uguuguacucuuaugugucugauauacacauuuccuagucuuaacuuucaggaguuuacaauugacuaacacuccaugauugauucag

SEQ ID NO: 130003 - RNA, 48 nt, Homo sapiens
caauugcuuacuuuguggguucuuuuaaaaguaacacgaaaucaucau

SEQ ID NO: 130004 - RNA, 54 nt, Homo sapiens
uuuuugguuggauaaaaacauaauuugagcauccaguuuuaguauuucacuaca

SEQ ID NO: 130005 - RNA, 60 nt, Homo sapiens
uaguaauaaacuaggacacuaacuggguuccaugugauugcccuuucauaugaucuucua

SEQ ID NO: 130006 - RNA, 66 nt, Homo sapiens
auacuguauuuuaccaacccccucucuuuucuuuuagcuccucuguggugaauuaaacguacuuga

SEQ ID NO: 130007 - RNA, 84 nt, Homo sapiens
ggugguaauauuggcauucugauuaaauacugugccuuaggagacuggaaguuuaaaaauguacaaguccuuucagugaugagg

SEQ ID NO: 130008 - RNA, 83 nt, Homo sapiens
gaauugauuuuuuuuaaaagucuuuuucuuagaaagccaaaauguuuguuuuuuuaagauucugaaauguguugugacaacaa

SEQ ID NO: 130009 - RNA, 41 nt, Homo sapiens
uauuuaaauccgaauguaugauguggcaguaacagguuaac

SEQ ID NO: 130010 - RNA, 57 nt, Homo sapiens
aggauauucgggcugucuccggagucgcagugucuugggccgccggaagguggguga

SEQ ID NO: 130011 - RNA, 46 nt, Homo sapiens
auaggucaucauuauccccauucuacagugaggcaucugaugccca

SEQ ID NO: 130012 - RNA, 49 nt, Homo sapiens
uuccaucuagaacuguuuacaugaagauaagauacucacuguucaugaa

SEQ ID NO: 130013 - RNA, 42 nt, Homo sapiens
gcagcugcguuuaagccuucccccaucguguacugcagaguu

SEQ ID NO: 130014 - RNA, 33 nt, Homo sapiens
uguuuguuguuuguuuuguaucuuguuuuucug

SEQ ID NO: 130015 - RNA, 33 nt, Homo sapiens
gacagugcccuccaagacagagacgacugaacu

SEQ ID NO: 130016 - RNA, 55 nt, Homo sapiens
ucgucgucguccaccuccucuucgcccucguccuugccccgaacucccaccccag

SEQ ID NO: 130017 - RNA, 46 nt, Homo sapiens
cuggucggucccccucuugucuuacagcggcuucuacgcuccggca

SEQ ID NO: 130018 - RNA, 47 nt, Homo sapiens
cauucuaccugacgggagguggugaccucauucagucgguuaagagc

SEQ ID NO: 130019 - RNA, 52 nt, Homo sapiens
ucauuuauuacguuguaugcaaauuuugccuuagacaacauuugucugguuc

SEQ ID NO: 130020 - RNA, 50 nt, Homo sapiens
aaaccaucucuccuaaacaaaugguagacuggcuuuacuuaagggauauu

SEQ ID NO: 130021 - RNA, 46 nt, Homo sapiens
gucauccauauggugccuggaaauauuuaccagucaaggucaaggu

SEQ ID NO: 130022 - RNA, 47 nt, Homo sapiens
guuucucuguaucuauucacaggcaacaaauacuuauaugugugauc

SEQ ID NO: 130023 - RNA, 47 nt, Homo sapiens
auucaaaaacuugucaggcuguauuuugacccaguguaguccggaag

SEQ ID NO: 130024 - RNA, 49 nt, Homo sapiens
acuagaaaaauggagaagguaggaggagaaacaggagacugcugcagca

SEQ ID NO: 130025 - RNA, 54 nt, Homo sapiens
uaucuuuuauuuuucugaaauuaauuuuaagaaauuguuuuuaggaguuaugaa

SEQ ID NO: 130026 - RNA, 42 nt, Homo sapiens
aagacggcguccgacugcggggcagugaagcacugccugcag

SEQ ID NO: 130027 - RNA, 79 nt, Homo sapiens
cuuagaaaucccuucccugcgacauaugcaaagacguugucaccgcagcuggugauaugcugaaggacaaugccacuga

SEQ ID NO: 130028 - RNA, 54 nt, Homo sapiens
ugcaaggagauaguggacuccuaccucccugucauccuggacaucauuaaagga

SEQ ID NO: 130029 - RNA, 87 nt, Homo sapiens
uuuugucauucuugguaugcugagcaguuugaauuuagacaacagguuuguguuucuuuuaagggauuuaaagagagggacuaauuc

SEQ ID NO: 130030 - RNA, 51 nt, Homo sapiens
caaccucugcgagucucuccagaagcaccuagcagagcugaaucaccagaa

SEQ ID NO: 130031 - RNA, 50 nt, Homo sapiens
aacaucccucuccuccucuacccucaggacggcccccgcagcaagcccca

SEQ ID NO: 130032 - RNA, 42 nt, Homo sapiens
ugguggaacaugucaaggaggagugugaccgccugggcccug

SEQ ID NO: 130033 - RNA, 25 nt, Homo sapiens
cugagauuguguaaauggcuuugaa

SEQ ID NO: 130034 - RNA, 52 nt, Homo sapiens
cccgccaaaguggccuccaagaaugucaucccugcccuggaacugguggagc

SEQ ID NO: 130035 - RNA, 45 nt, Homo sapiens
cacagaagcacgaggucccagcaaagucugauguuuacugugagg

SEQ ID NO: 130036 - RNA, 48 nt, Homo sapiens
gacgcuuuugacaaaaugugcucgaagcugccgaagucccugucggaa

SEQ ID NO: 130037 - RNA, 33 nt, Homo sapiens
cagcuccauccuguccauccugcuggaggaggu

SEQ ID NO: 130038 - RNA, 42 nt, Homo sapiens
gugugcaagaagcugguggguuauuuggaucgcaaccuggag

SEQ ID NO: 130039 - RNA, 47 nt, Homo sapiens
auauggggcccaagcuacuggugccagaacacagagacagcagccca

SEQ ID NO: 130040 - RNA, 85 nt, Homo sapiens
ucgagcauugcaaacgccauguguggaacuaggaggaggaauauuccaucuuggcagaaaccacagcauugguuuuuuucuacuu

SEQ ID NO: 130041 - RNA, 51 nt, Homo sapiens
gugugucugggggaaugaacgcacagaucuguuugacuuuguuauaaaaau

SEQ ID NO: 130042 - RNA, 117 nt, Homo sapiens
cgcuuuccugggccucucaguugaacaaagcagcaaaacaaaggcaguuuuauaugaaagauuagaagccuggaauaaucaggcuuuuuaaaugauguaauucccacuguaauagca

SEQ ID NO: 130043 - RNA, 63 nt, Homo sapiens
cucauaaucuccgggacucccuccugcagcagggcuucugagguggagaauggagagaccgug

SEQ ID NO: 130044 - RNA, 64 nt, Homo sapiens
ucuuacccccacuuuacagaugagagaacugaggucuuaagaggugaccccaagggcacauggu

SEQ ID NO: 130045 - RNA, 47 nt, Homo sapiens
acauguuuuaggugaggcagggcgggcauggcaagggaugcuggggg

SEQ ID NO: 130046 - RNA, 42 nt, Homo sapiens
acaguugacgagugagacccagagauggaaaggaacuugccu

SEQ ID NO: 130047 - RNA, 25 nt, Homo sapiens
agggccuaucggcagacgagccugg

SEQ ID NO: 130048 - RNA, 49 nt, Homo sapiens
uucuuugcaacuucccagcaacaauaaugauuuucuugccaggccgucu

SEQ ID NO: 130049 - RNA, 99 nt, Homo sapiens
cugugauacagggugaaauaaagucuugucuuagaaaccaggacccuaaaccccacacuauguaauagaaacacauguguuuuuaugucucaaauaaaa

SEQ ID NO: 130050 - RNA, 46 nt, Homo sapiens
ucagcaauaaucucaaaaagcaauuaaauaguuaaaugacccuaau

SEQ ID NO: 130051 - RNA, 46 nt, Homo sapiens
uguuucugcauuagacuuaaguagucaugugaauauacugcuaugu

SEQ ID NO: 130052 - RNA, 46 nt, Homo sapiens
cuauggcaguuuugccucaggugcugaacauuucucagcccuggcu

SEQ ID NO: 130053 - RNA, 43 nt, Homo sapiens
caaggaaaauuuucucuauuaguguguucuucugccucuuccc

SEQ ID NO: 130054 - RNA, 49 nt, Homo sapiens
ugccguucccuauucugcaggacaggacuauucuagcauaccugcuucg

SEQ ID NO: 130055 - RNA, 378 nt, Homo sapiens
gaggcuuuuucagccuucucucucuuuuuuuuuuuuuuuuuuuuuuuugagauggaauuuugcucuuuugcccagucuggagugcaguggcaugaucucagcucacugcaaccuccacccacuggguucaagcgauucuucugccucagccucccgaguagcugggauuaccggcacccaccaccacgccuggcuaauuuuucaauuuucuuuuucaguagagacggguucaccguguuggccaggcuggucuugaacuccugaccucaggugauacccgcccccccgccucagccucccaaagugcugggauuacaggcgugagccaccgugccuggcccugucucucuuaagaguagguucauugucugucuuaga

SEQ ID NO: 130056 - RNA, 23 nt, Homo sapiens
uagagcuucuuuguuaucucagg

SEQ ID NO: 130057 - RNA, 46 nt, Homo sapiens
ucaacuuuacuuaaacauugugugguagcucugaccuguccugauu

SEQ ID NO: 130058 - RNA, 48 nt, Homo sapiens
uugcuccauagagcacaacucaagauagaccaugagacagcuugagcc

SEQ ID NO: 130059 - RNA, 48 nt, Homo sapiens
ccggaaacgaguagcuauacaauuccuaaaggacauucgagaaucugu

SEQ ID NO: 130060 - RNA, 46 nt, Homo sapiens
auuuugacaucuaccgacuaucaaaccugaugacugcuaaggggug

SEQ ID NO: 130061 - RNA, 54 nt, Homo sapiens
uugggaguuggguagacagguucgaagucagugauugagucauuagaucuagau

SEQ ID NO: 130062 - RNA, 46 nt, Homo sapiens; identical to SEQ ID NO: 30146

SEQ ID NO: 130063 - RNA, 46 nt, Homo sapiens
guacaggaacuaucaguucuucgucgauacagauuggcaggguggc

SEQ ID NO: 130064 - RNA, 72 nt, Homo sapiens
gaaagcaggauacccacuggagcacccauuugauuuccgggugaaagguguaaccagcauuucagcugacac

SEQ ID NO: 130065 - RNA, 41 nt, Homo sapiens
ucccauugacgaagaugauggagguggaugugcgggugagu

SEQ ID NO: 130066 - RNA, 49 nt, Homo sapiens
cagaaagcauacugauggccugcaaagcauaucgggaucuggccuuuga

SEQ ID NO: 130067 - RNA, 43 nt, Homo sapiens
gcauccagauaucuucccaggacuacgcaagauagaggcagaa

SEQ ID NO: 130068 - RNA, 42 nt, Homo sapiens
cucuugcaucuggauaacuuugucuuucuuaccuuuggagau

SEQ ID NO: 130069 - RNA, 41 nt, Homo sapiens
guugguuccuggcuguaguuugcugaucccaaguugcacag

SEQ ID NO: 130070 - RNA, 77 nt, Homo sapiens
uucuauaaagggcuagauaugaaacauuuugggcucuguaggccauaucauuucuguugcaacuccucaccucugcc

SEQ ID NO: 130071 - RNA, 70 nt, Homo sapiens
uauuugaauaagagaaccauuuguuucuuuuagguuuauggucaagguuuaaaaagaaauguuuuaagcu

SEQ ID NO: 130072 - RNA, 54 nt, Homo sapiens
uuuuuaaaauuuuuuaaacgaaagaaacucuuugcaauuggaaggcaagugagg

SEQ ID NO: 130073 - RNA, 46 nt, Homo sapiens
gcccuacuuagagauuuuggaaguauacuccacaaaagccaagaau

SEQ ID NO: 130074 - RNA, 38 nt, Homo sapiens
gcacucauaugcuuuuuguggcuauuccccugagaagu

SEQ ID NO: 130075 - RNA, 42 nt, Homo sapiens
ugugcuuugaaauauaaccuguauacaugugcacaguaaguc

SEQ ID NO: 130076 - RNA, 41 nt, Homo sapiens
ggaauugaugugaaucagucuguauguguaaauguacagaa

SEQ ID NO: 130077 - RNA, 54 nt, Homo sapiens
gaaaauucauugggauuguugauaggacauuaaaaaauuuguugacauuugagu

SEQ ID NO: 130078 - RNA, 49 nt, Homo sapiens
aaacugaaagauugaccuuaggagcucuguucuauuauuugagccuugu

SEQ ID NO: 130079 - RNA, 37 nt, Homo sapiens
gagucugaaaaaggggagcgcggagaggaggcuggaa

SEQ ID NO: 130080 - RNA, 38 nt, Homo sapiens
ccgacgggaggggugacaacgagagcgaggccgugcug

SEQ ID NO: 130081 - RNA, 38 nt, Homo sapiens
gccgcgguggggcgggucuggagcccacgccugccgcg

SEQ ID NO: 130082 - RNA, 22 nt, Homo sapiens
gugggccgagggcgggcagagg

SEQ ID NO: 130083 - RNA, 45 nt, Homo sapiens
gagcagaugguggggacgggcugucgcagcggcuccuuugcagag

SEQ ID NO: 130084 - RNA, 41 nt, Homo sapiens
cggaggcguguuccgagaugccugagaggguugguagguac

SEQ ID NO: 130085 - RNA, 54 nt, Homo sapiens
acacaggccuuguggguuccaucaacacccacugagggccuaugaccagggagg

SEQ ID NO: 130086 - RNA, 101 nt, Homo sapiens
cucccaaacagccugagagaccaaauucugcaaauggaaauuuuaaagcccacugaauacauuuuucauggauccaaacaaaugcuacaauacuuuuaagu

SEQ ID NO: 130087 - RNA, 45 nt, Homo sapiens
ggcugcccacaggggcccggagucucggaggggcagaccccacgg

SEQ ID NO: 130088 - RNA, 66 nt, Homo sapiens
gacaccuugccccagauucuccccacagggguucuggguauaaaggaugaggggaggguuccaggu

SEQ ID NO: 130089 - RNA, 66 nt, Homo sapiens
aacauacccaucuccuuaccccaggagagcaccauccugggccucugggaccuuaucacuuucaga

SEQ ID NO: 130090 - RNA, 41 nt, Homo sapiens
agcagcccccccuuuaucgcccaaggaagcaaguugggcag

SEQ ID NO: 130091 - RNA, 42 nt, Homo sapiens
gcaagcggcaguucucugggccgcggauaguagcggggggag

SEQ ID NO: 130092 - RNA, 46 nt, Homo sapiens
aacagcuacucagcugcuuaagcuggcccacaaguacaggccagag

SEQ ID NO: 130093 - RNA, 46 nt, Homo sapiens
ccuuguuccuucacccacacgaggaugcaggagguguccaggccgc

SEQ ID NO: 130094 - RNA, 46 nt, Homo sapiens
acucuuccacaaacucccugaugacauccucaaugaacaccuuuuu

SEQ ID NO: 130095 - RNA, 45 nt, Homo sapiens
ccaggugagcucaaaccggaccugauauuccccuuaccgguggcg

SEQ ID NO: 130096 - RNA, 45 nt, Homo sapiens
ugaccgggauaggaaucccgugcugcuuugcguauuccaucaggu

SEQ ID NO: 130097 - RNA, 45 nt, Homo sapiens
agaccuggaggcacuugguucuugggguucuccaggauuccagcc

SEQ ID NO: 130098 - RNA, 45 nt, Homo sapiens
cuuuuuuaacucgaucucgaggaugucagggguguugggggcuuu

SEQ ID NO: 130099 - RNA, 31 nt, Homo sapiens
ugauuuugcacaccucccaguccauggugaa

SEQ ID NO: 130100 - RNA, 43 nt, Homo sapiens
gcaguggcggacaaauucacacucagggcuaugccagaaagcg

SEQ ID NO: 130101 - RNA, 45 nt, Homo sapiens
acagugggcgcacccgaggguugaggcgucauccuacggcggggu

SEQ ID NO: 130102 - RNA, 45 nt, Homo sapiens
gcggacguggggcaggucacuucgucuuccgaggcucuggggaag

SEQ ID NO: 130103 - RNA, 48 nt, Homo sapiens
aggaggugguuaugauggagacucaagccagacugccugggucggaau

SEQ ID NO: 130104 - RNA, 72 nt, Homo sapiens
gaaaguggagcuucugggggucggggguagggagaccaugucuuucuuagugguguugguuaaaaucuauug

SEQ ID NO: 130105 - RNA, 41 nt, Homo sapiens
cugccccagggugacccacauaauaaacugccuccgucucc

SEQ ID NO: 130106 - RNA, 50 nt, Homo sapiens
aagagcccuuucaugaccugccaaccuagagcugccccuccccacuuucc

SEQ ID NO: 130107 - RNA, 57 nt, Homo sapiens
ggugucuggcuaccaggacguguacugcagcccugguugagcccuccagucccagcu

SEQ ID NO: 130108 - RNA, 38 nt, Homo sapiens
gcccuguaggucaacagaacaucaccuccuucuuucaa

SEQ ID NO: 130109 - RNA, 42 nt, Homo sapiens
ccaguuuauauuguaccauggcugcugaguuggggaauggac

SEQ ID NO: 130110 - RNA, 48 nt, Homo sapiens
gugaggucccagcagagggaagcugagcagaaaugagcuuagcaugug

SEQ ID NO: 130111 - RNA, 21 nt, Homo sapiens
aaggcuaacuagcaaggaaau

SEQ ID NO: 130112 - RNA, 44 nt, Homo sapiens
cagcagaugaggaagcccgggaagggcugcgcuguggguggaga

SEQ ID NO: 130113 - RNA, 93 nt, Homo sapiens
acagcuagaaaaagaguggaugacacaacaaacugaacacaacaaagaaaaaacagagucugggacucauccaaaagggacgagaagaaagaa

SEQ ID NO: 130114 - RNA, 45 nt, Homo sapiens
cacuaagucugcgagugagguauguuuucugcacagcuccuauca

SEQ ID NO: 130115 - RNA, 39 nt, Homo sapiens
uaggcaguccaguaauuucugucuuuuuuuccccaagga

SEQ ID NO: 130116 - RNA, 44 nt, Homo sapiens
auuccuuauacuuuccuguggccauguccuaacgguguaaugug

SEQ ID NO: 130117 - RNA, 29 nt, Homo sapiens
cauaagugaaagaaaauuuugugccauga

SEQ ID NO: 130118 - RNA, 46 nt, Homo sapiens
uaaagaaggagagguuacaacaaugaaucaugaagaucucaguuua

SEQ ID NO: 130119 - RNA, 45 nt, Homo sapiens
agcauaaggagaauuauuuuuuacucccuuauaaagcccaguauc

SEQ ID NO: 130120 - RNA, 68 nt, Homo sapiens
guugcuacagaugcaauuggcaugggacuuaauuuguaaguaauuuguuuuuaauaagaugaauauuu

SEQ ID NO: 130121 - RNA, 45 nt, Homo sapiens
aaugauauuuauucugugagucggcagauugaaauucggggauua

SEQ ID NO: 130122 - RNA, 45 nt, Homo sapiens
uaugucagauauuggggccuuugauacacaucuaauugccagaca

SEQ ID NO: 130123 - RNA, 35 nt, Homo sapiens
aaauucuucacuucuugacaaaaccuuguggggcu

SEQ ID NO: 130124 - RNA, 45 nt, Homo sapiens
ucugggccucugacuuuuucugucaaauggagauagugauaauac

SEQ ID NO: 130125 - RNA, 54 nt, Homo sapiens
auguuuccagguuuacccaaguuguguaagagaguggcucuuauuuuacuuuau

SEQ ID NO: 130126 - RNA, 38 nt, Homo sapiens
uaaugaagucaaauaguucagagauguacaaaguuaaa

SEQ ID NO: 130127 - RNA, 58 nt, Homo sapiens
gaacccauuaguccuagacaaaccagaaugguugaucacccugauacagcauuaaugu

SEQ ID NO: 130128 - RNA, 26 nt, Homo sapiens
aguuucuguccuugccaccgccuccu

SEQ ID NO: 130129 - RNA, 43 nt, Homo sapiens
ugaagugaucuuuuucccuagucagacaggcccaauuccauug

SEQ ID NO: 130130 - RNA, 46 nt, Homo sapiens
aauuuauuguugauuacugugaaaagcauccugaggccgcccagga

SEQ ID NO: 130131 - RNA, 29 nt, Homo sapiens
gucucuauggcaaaaucauuacugcagau

SEQ ID NO: 130132 - RNA, 66 nt, Homo sapiens
aagguugccauugcugacaggcuaagggauccugauucacacauuguaaaaaaaauaaauaaucuu

SEQ ID NO: 130133 - RNA, 61 nt, Homo sapiens
cuguuuaaggugcuugcauucuuugaaacugacauggagagacggugcaagaugcauaaac

SEQ ID NO: 130134 - RNA, 58 nt, Homo sapiens
gucagguagacagagucgacaaggaagucgcucaggaagucgacaagaugguagaaga

SEQ ID NO: 130135 - RNA, 24 nt, Homo sapiens
aaggaucauuuuacaagggacaug

SEQ ID NO: 130136 - RNA, 41 nt, Homo sapiens
gugaccaugacucuggaaagccuagaggaaauacaggaugu

SEQ ID NO: 130137 - RNA, 35 nt, Homo sapiens
ucagagauuuuuuacuuauucaaguauaagugagg

SEQ ID NO: 130138 - RNA, 74 nt, Homo sapiens
gcuggacggacagggauuuguauauguuuuuaucaaccaagagaaagaggucaacuaagauauguggaacaaaa

SEQ ID NO: 130139 - RNA, 46 nt, Homo sapiens
cauugcacagucacaaagagaaauuacacuaaaaggcuucagagaa

SEQ ID NO: 130140 - RNA, 26 nt, Homo sapiens
gucugagacugaguagcagaauagaa

SEQ ID NO: 130141 - RNA, 88 nt, Homo sapiens
uugcccacaguggguauacaaaguugcaaaaaaauacaugaaauccagauaugaacagguugaccuuguuggaaaaaugacucaaaag

SEQ ID NO: 130142 - RNA, 45 nt, Homo sapiens
gugggaaauuaagaaaacauuugaauucuuuuuguuuauuuaaga

SEQ ID NO: 130143 - RNA, 45 nt, Homo sapiens
gaucuuucuaaacugcgacauguugugcuugaugaaguggaucag

SEQ ID NO: 130144 - RNA, 40 nt, Homo sapiens
auaucaguaucuuaggugguuuaagugcugaggagaaaug

SEQ ID NO: 130145 - RNA, 378 nt, Homo sapiens
uucugaaagguaugcaguuugguuguuguuguuauuguuguuguuuugagacagagccucgcucuguugcccaggcuggagugcaguggggcagucuuggcucacugcaaccuccgccuccuggguucaagcgauucuccuaccucagccugcugaguaguugggauuauaggcgugugccaccaugcccggcuaaguuucauauuuuuaguagagacgcaguuucacuguguuggucaggcuggucucaaacuccugaccuccugaucuguuccaguuggguuaccaaagugcugggauuacaggcgugagccaccacggcuggcccaaagguuugcaguuuuaauggauaugcaauuaaaaaucuaucacuagauu

SEQ ID NO: 130146 - RNA, 45 nt, Homo sapiens
agaaggaagucaaggcaccauuaugacucggaugagaaaucagaa

SEQ ID NO: 130147 - RNA, 81 nt, Homo sapiens
gaggaaggagaggaaccauugaagaagauaugugguagagguaagaagauagagguaagaagggaauauaaaguguaacug

SEQ ID NO: 130148 - RNA, 45 nt, Homo sapiens
aaaaaaugcccagguaaaauuauuacuggagacauuugaccugga

SEQ ID NO: 130149 - RNA, 54 nt, Homo sapiens
gaguuguagucuuuccuccucccagcccccugcccuccaaaaaaaaaaaaaaaa

SEQ ID NO: 130150 - RNA, 42 nt, Homo sapiens
ccucaauaacuagucuguagaggcuuaaggaaaagugucacu

SEQ ID NO: 130151 - RNA, 44 nt, Homo sapiens
augauuaagaaaaaaugauugcuuugaauauguguugcuucugu

SEQ ID NO: 130152 - RNA, 38 nt, Homo sapiens
ggaagcacccuuggaggaguccgagagccagaagaagg

SEQ ID NO: 130153 - RNA, 46 nt, Homo sapiens
aguacuugaagacuugugaguuggaauugcauguuacuugaaagau

SEQ ID NO: 130154 - RNA, 80 nt, Homo sapiens
ugauucaguucaguaauggugauucaguucaguaacugccuauccucaucaaugcuuguuugugaugaugaaauaguuga

SEQ ID NO: 130155 - RNA, 61 nt, Homo sapiens
ugcuuugauucuugccacguaaaaucugugggucuugacccagagauuugcucagacaguu

SEQ ID NO: 130156 - RNA, 52 nt, Homo sapiens
aauaauuucuagugggagcuaaggccuaaaaucuaaaacauaaucucgcaag

SEQ ID NO: 130157 - RNA, 54 nt, Homo sapiens
agucaaugaauuacccuauuuuacauauucaacaagcagaaaucuacuuguaca

SEQ ID NO: 130158 - RNA, 48 nt, Homo sapiens
uccauuucuguaagguagaagauuaggaagauaauggugauuuuaaau

SEQ ID NO: 130159 - RNA, 49 nt, Homo sapiens
uuuuuuaaauuuucacagugaguuuuaugaguaucacgcacuaaugaug

SEQ ID NO: 130160 - RNA, 46 nt, Homo sapiens
gguuggagugauugauuuuucuauguauuuaaagaaugaagaagau

SEQ ID NO: 130161 - RNA, 43 nt, Homo sapiens
auuggguuuuuuauauagcucuuuacaaaucauuauaagaucc

SEQ ID NO: 130162 - RNA, 57 nt, Homo sapiens
ucauuuaggaauguucaaauugcugccauauuagaccaaaagaauuauguugaagaa

SEQ ID NO: 130163 - RNA, 46 nt, Homo sapiens
ccuccauucaagaguugauucauuagaaaagucaaauacuaagcug

SEQ ID NO: 130164 - RNA, 46 nt, Homo sapiens
acauacuguaaaucauacaguaaacauaauauguuuauuauaagca

SEQ ID NO: 130165 - RNA, 45 nt, Homo sapiens
gaaaaaaaugaaauaauugcccgacuagaagaaaaaaccaauaaa

SEQ ID NO: 130166 - RNA, 55 nt, Homo sapiens
agcugaauuuucaaaauauccggggagcugucuuugagauuguuuugagaagaag

SEQ ID NO: 130167 - RNA, 69 nt, Homo sapiens
gccaauauuuuguccuacaaaauuuccucuuggucucuuuaaaaaucaguuauugucgugcuugcugaa

SEQ ID NO: 130168 - RNA, 43 nt, Homo sapiens
aauaacauuucuggcaaaaacaaguaacaaguucaauaacuga

SEQ ID NO: 130169 - RNA, 31 nt, Homo sapiens
gaaagaguaacaggggagaaaggaaugaugg

SEQ ID NO: 130170 - RNA, 54 nt, Homo sapiens
guaaaguuucccaggggccggggaggggagcagcggagcagcggcacagacgcc

SEQ ID NO: 130171 - RNA, 40 nt, Homo sapiens
cgucugugccgcugcuccgcugcuccccuccccggccccu

SEQ ID NO: 130172 - RNA, 83 nt, Homo sapiens
ggaggugcccuggugaucgucgccacuggcugacagaggagggucccaggagccggagacgugcuucagcgaccgcgcugccu

SEQ ID NO: 130173 - RNA, 69 nt, Homo sapiens
uugggaauuaucgaguucugauaccccaaaagaaugaaaucaaacuucuguuaaugggaugaugggucg

SEQ ID NO: 130174 - RNA, 41 nt, Homo sapiens
ccuccaacuuuccgggguuucagaagagaauuuuuuauuga

SEQ ID NO: 130175 - RNA, 47 nt, Homo sapiens
gcagcuagguuuggguggaauugaugaagaaauuguacuagagccca

SEQ ID NO: 130176 - RNA, 45 nt, Homo sapiens
auguggauguaaugaucuaggacagcuaggucaugaaaaauccag

SEQ ID NO: 130177 - RNA, 33 nt, Homo sapiens
auuauauguguauauuuguaugguucuaaguac

SEQ ID NO: 130178 - RNA, 49 nt, Homo sapiens
uagcuauuaaagauuuugugacuaugaaguguccugauuuuguaguagu

SEQ ID NO: 130179 - RNA, 48 nt, Homo sapiens
agaacauuuuauggauuccuaccagauuuucaugaucucaggcauuga

SEQ ID NO: 130180 - RNA, 54 nt, Homo sapiens
uguguacuaguaguauaaugauuauagugccaggaacagccuccaacuguauag

SEQ ID NO: 130181 - RNA, 54 nt, Homo sapiens
gauugccucauuguugucccgauuacaccacagccuguggaagagaaaagugac

SEQ ID NO: 130182 - RNA, 45 nt, Homo sapiens
aggacuuggccugacaauguagugaauagauuuaaccuguggccu

SEQ ID NO: 130183 - RNA, 23 nt, Homo sapiens
cuacuguugagucauuccaauaa

SEQ ID NO: 130184 - RNA, 53 nt, Homo sapiens
ucaggaguggaggcuugcuuugaacgcuuuacuuugagaaagguuagugccca

SEQ ID NO: 130185 - RNA, 47 nt, Homo sapiens
aauuugcaagaauuauccucaucuuaggggauaaauuuacggagaaa

SEQ ID NO: 130186 - RNA, 37 nt, Homo sapiens
cacucauaguuuguaaugggaauuaccauggauuuau

SEQ ID NO: 130187 - RNA, 38 nt, Homo sapiens
gaauggacaggcuuugguaaccagauggaaauaaauag

SEQ ID NO: 130188 - RNA, 88 nt, Homo sapiens
aagaagagaaauauucucuuuuaagaggcaaguuaaaagauucugguaaggugaauuuugugguaaacuuaauaauauuaagugagca

SEQ ID NO: 130189 - RNA, 54 nt, Homo sapiens
uuucuaauccaaguauugcuuagcuauagauuucauaacuaggcucucuaauag

SEQ ID NO: 130190 - RNA, 47 nt, Homo sapiens
auagaacuauucauauuuucaguuaggaaguugaaugagccucugca

SEQ ID NO: 130191 - RNA, 70 nt, Homo sapiens
aaaacacaguaauacguauuaacuuuuuuuaaagacaguuucuaauauacauuaaguaaaaugagcaagg

SEQ ID NO: 130192 - RNA, 66 nt, Homo sapiens
auagauacacaaaaaacccuggaaggauauauacaaguaauaacauugguaacuguugguguagag

SEQ ID NO: 130193 - RNA, 27 nt, Homo sapiens
acaaugccuagcguauggugaguauuc

SEQ ID NO: 130194 - RNA, 36 nt, Homo sapiens
aauggauuggauuccuuuaccuucagacuuuaaaga

SEQ ID NO: 130195 - RNA, 50 nt, Homo sapiens
uacuuuuaaaaccagcccugcccuucccaaaaugaugagcugaccuuaaa

SEQ ID NO: 130196 - RNA, 47 nt, Homo sapiens
ggguucagaccuuaaauucacuuuaggaucuuuuccuuucccguagc

SEQ ID NO: 130197 - RNA, 31 nt, Homo sapiens
auagcucauauuccuuuaaugccuuuuguau

SEQ ID NO: 130198 - RNA, 48 nt, Homo sapiens
aaaguuaauuuuaaaugguaucuuuuaaaaaacuugugauacuaguaa

SEQ ID NO: 130199 - RNA, 41 nt, Homo sapiens
gugucaguuaugaucuuauuguuaaaaucaagcagcccagg

SEQ ID NO: 130200 - RNA, 45 nt, Homo sapiens
acagcuuggccugguaggaucagaggaaugcaucagaguacccag

SEQ ID NO: 130201 - RNA, 53 nt, Homo sapiens
agauguauugccaaguuucuaacuguaagcugaugauuuaaaaacacguuuuu

SEQ ID NO: 130202 - RNA, 63 nt, Homo sapiens
acuauuauaggaaucaguuaagauggugaggaauggaucuauuugccguauuuuucuuuagga

SEQ ID NO: 130203 - RNA, 118 nt, Homo sapiens
acucccuagguuuauaauuuuugcuacugagucacuuaggauguuacuuaccaaaauggggagcacuggaaagagguccagggaaguaggaugggggucaugaauucagucuggggca

SEQ ID NO: 130204 - RNA, 78 nt, Homo sapiens
guuuuuugcucaggagagguuugggcuaguguuaaaauuuugaaugugaucagcagauaguuauuaaaguuugagcuu

SEQ ID NO: 130205 - RNA, 46 nt, Homo sapiens
cagcugcuuaagucuuugcuuggaaucccuuucaugcaaguugcag

SEQ ID NO: 130206 - RNA, 38 nt, Homo sapiens
uuauuuaaaaauuccauuuggggaaugcagugggaaga

SEQ ID NO: 130207 - RNA, 43 nt, Homo sapiens
aacauuuugaauuugaaaaaauuguaacugaaacaaguuggga

SEQ ID NO: 130208 - RNA, 45 nt, Homo sapiens
aagucacuaagaucucagaaaauaguuuauauuuguuguggagaa

SEQ ID NO: 130209 - RNA, 46 nt, Homo sapiens
gauucugaagaauauuucuguguaaaaagaauuuucucagggggag

SEQ ID NO: 130210 - RNA, 42 nt, Homo sapiens
gggccaccagaugacuucagaugucccaauccgacaaagcag

SEQ ID NO: 130211 - RNA, 46 nt, Homo sapiens
uauagaacagguaccagauuuucagggguugauaugaaugcugcua

SEQ ID NO: 130212 - RNA, 36 nt, Homo sapiens
uugcuuaaguuuguguaugguuauagagguagagag

SEQ ID NO: 130213 - RNA, 45 nt, Homo sapiens
cuuaccugauguugaagcauugagguuuuaucuuacucuaccaga

SEQ ID NO: 130214 - RNA, 53 nt, Homo sapiens
uccuuucccucaucgccuuuaguauaaucuugcuauuaaagaaguaaaggagg

SEQ ID NO: 130215 - RNA, 46 nt, Homo sapiens
acuuuacauuguucagcuucuguauuugaucuucaggaguaccuug

SEQ ID NO: 130216 - RNA, 46 nt, Homo sapiens; identical to SEQ ID NO: 30374

SEQ ID NO: 130217 - RNA, 57 nt, Homo sapiens
cauagccauguauuuccuagggaaacaggucauucuuauguuugccuuuacccagaa

SEQ ID NO: 130218 - RNA, 39 nt, Homo sapiens
gucucuaccuuucuguguacuguuugccgaggauucaag

SEQ ID NO: 130219 - RNA, 42 nt, Homo sapiens
ucauucuaaauacuagaaucuucacaucuugauaguugaagg

SEQ ID NO: 130220 - RNA, 46 nt, Homo sapiens
uaacaauaagcauacauuauaauacaucucacugaaaaugcaacag

SEQ ID NO: 130221 - RNA, 72 nt, Homo sapiens
ggauuugucugauuguuuccucauugugauguuuauuuaacuuguuccucuaucccuuguauuuccuauaaa

SEQ ID NO: 130222 - RNA, 46 nt, Homo sapiens
aaaaugggacagauuauacaguaugauaaauuuuauauacaugaag

SEQ ID NO: 130223 - RNA, 51 nt, Homo sapiens
ucaaccauggauuaacugagguaaguuugguguaauaaagcucauguuuag

SEQ ID NO: 130224 - RNA, 54 nt, Homo sapiens
uuugcuuuagaauaguuucuguccuccucaagucuuccaguauaaaauguaaug

SEQ ID NO: 130225 - RNA, 45 nt, Homo sapiens
gguuuugcuuugauuugcauuuuguugguugcuauguuuuuccca

SEQ ID NO: 130226 - RNA, 42 nt, Homo sapiens
uaaauauuugaaauuuuccuaggaucaguaaugaagguacac

SEQ ID NO: 130227 - RNA, 36 nt, Homo sapiens
uaaaauuauauuuauuuuaaacuauuaauuguagag

SEQ ID NO: 130228 - RNA, 28 nt, Homo sapiens
gcauguuuagguauuaugaagauuccag

SEQ ID NO: 130229 - RNA, 89 nt, Homo sapiens
uuccuugcuaccuuguguacuuacuaugacagaauguuccagacuuaucuuacacauuuacugccuaacaguaccaacauuaccaccaa

SEQ ID NO: 130230 - RNA, 72 nt, Homo sapiens
uguggcuuagcaauuuauaauuguaccauuguggaccuccauuuuccuuuggcuuuauauaagaaacuacug

SEQ ID NO: 130231 - RNA, 38 nt, Homo sapiens
uccugaaaucccuugaagacauuaaaacaaagagaagg

SEQ ID NO: 130232 - RNA, 48 nt, Homo sapiens
uacaagcaauggucauuggaaauacaaauuaugauuggaaggaacugg

SEQ ID NO: 130233 - RNA, 50 nt, Homo sapiens
aaaagauuauguuguuuuuagaauacagaauacaaaggggaauauugggc

SEQ ID NO: 130234 - RNA, 42 nt, Homo sapiens
guugacugaaugauuucuuucuuggcaguauuuuugacaggu

SEQ ID NO: 130235 - RNA, 50 nt, Homo sapiens
uuucauuuuguaaauaauguuaaguuuuguaauaaaauaguuauguucug

SEQ ID NO: 130236 - RNA, 46 nt, Homo sapiens
aagauugagacagaaaucaagaacaagaugcaacagaaaucacaga

SEQ ID NO: 130237 - RNA, 36 nt, Homo sapiens
ggaaaacacaaggugggauuaccugacccagguuga

SEQ ID NO: 130238 - RNA, 48 nt, Homo sapiens
cgaaccauuaauaaagccuggguggaaucaagagagaagcaagccaaa

SEQ ID NO: 130239 - RNA, 47 nt, Homo sapiens
cccuucucuccuuuuuuuuacaauaaccaaguugagaacacucagau

SEQ ID NO: 130240 - RNA, 45 nt, Homo sapiens
ggacaguuggaguuuacaguauaagguggagggugacacggaaag

SEQ ID NO: 130241 - RNA, 39 nt, Homo sapiens
aauucucccuucaccguuggaugaggcucauccacauua

SEQ ID NO: 130242 - RNA, 46 nt, Homo sapiens
gucaucuacacgucaaauaucccaagacagauuaugcuaaauacau

SEQ ID NO: 130243 - RNA, 44 nt, Homo sapiens
uguaacauauaucuaaauauuaccaacuacauuuuuuaugaguu

SEQ ID NO: 130244 - RNA, 41 nt, Homo sapiens
uagccacacacagcuauugaacauuugaaaaguggcuagug

SEQ ID NO: 130245 - RNA, 28 nt, Homo sapiens
auuauuaacccaaaguaacugaaucaag

SEQ ID NO: 130246 - RNA, 40 nt, Homo sapiens
aaacagugguucucaacuagaggcaauuuugugccccuac

SEQ ID NO: 130247 - RNA, 47 nt, Homo sapiens
aucacugaaccagacacuucauacugaagaguaaauugaaacugaaa

SEQ ID NO: 130248 - RNA, 46 nt, Homo sapiens
uuauacguuaacaccuuaaaaucacguguccaccccaaaggcagua

SEQ ID NO: 130249 - RNA, 55 nt, Homo sapiens
gacuaaggauuuaacaacugugguuuugccauauugagaguaugggggaaagaga

SEQ ID NO: 130250 - RNA, 39 nt, Homo sapiens
auaauugauuuugguguguuugguauggaaagaaaauag

SEQ ID NO: 130251 - RNA, 25 nt, Homo sapiens
ugcugcuguuacugcagcaguaaag

SEQ ID NO: 130252 - RNA, 68 nt, Homo sapiens
gaagcagcuguucucaugccagaaggcaaaagcuuaaagcaagaguuugaggguaauggguaauggag

SEQ ID NO: 130253 - RNA, 46 nt, Homo sapiens
ugaaacuccagugcacuugagagacaagaaacucuguguacugagg

SEQ ID NO: 130254 - RNA, 73 nt, Homo sapiens
caaugacugaagaacuauagaaaucuauuucuuuuucacauaaaaguccugguuaggugcucauuucaucaag

SEQ ID NO: 130255 - RNA, 71 nt, Homo sapiens
cacaguugcuuaaaaugugguccccuucuccauuucucaaucauuguagcacugucacgaccaguccgggc

SEQ ID NO: 130256 - RNA, 66 nt, Homo sapiens
uuuucagaaaacauagccucacuacuuugaagaaaauaccaguaauuuccacacaggagaaauaau

SEQ ID NO: 130257 - RNA, 110 nt, Homo sapiens
ggaaaccuaaauaaaguauaaaguuuaauugauaaacaaaaaucagcacugguacauuaauuguaauaaguguaccaugccaauauaagauguuaauaauaggggaaacu

SEQ ID NO: 130258 - RNA, 47 nt, Homo sapiens
caagaggcauauugaggaaaccauguuggaacagaugguuuauauaa

SEQ ID NO: 130259 - RNA, 42 nt, Homo sapiens
uuauggcuuuccuuacucauccuccuuuaauuuguagagacg

SEQ ID NO: 130260 - RNA, 49 nt, Homo sapiens
ucugagaggagggagagcucacaacaugaagagcgagauuguucuagcu

SEQ ID NO: 130261 - RNA, 86 nt, Homo sapiens
ugcuuuggaagauucucugcccuucugugaaaugauuggcaauggagaccuggaagacaaggagacuccuuaggaggcucccuaac

SEQ ID NO: 130262 - RNA, 52 nt, Homo sapiens
gcuggguuggguacuaacaaagaaggccagaaugagcucaaggguauugcau

SEQ ID NO: 130263 - RNA, 42 nt, Homo sapiens
agguguguaguguaaggugugugagcgggugugugaagaggg

SEQ ID NO: 130264 - RNA, 42 nt, Homo sapiens
cuugggcugaggcggggacgcgcggcugucgggaaaggcgga

SEQ ID NO: 130265 - RNA, 55 nt, Homo sapiens
augaucccagacuauccuggauucuuuccaucucagugccagagagaccuacaug

SEQ ID NO: 130266 - RNA, 43 nt, Homo sapiens
uuaugaaaaaaagaaguuuuaaaguuuucaauuacgagcaauu

SEQ ID NO: 130267 - RNA, 39 nt, Homo sapiens
auguguuauaauacaacuuaguacauuaaagcuacgaaa

SEQ ID NO: 130268 - RNA, 42 nt, Homo sapiens
gccucgagagguguggcuccuggagaccccacaggccgauga

SEQ ID NO: 130269 - RNA, 59 nt, Homo sapiens
uguagcugcguggugucugaucuugccacguguguuccaggugacaacagcuccugagg

SEQ ID NO: 130270 - RNA, 51 nt, Homo sapiens
auugagcugcaggcugcaagaauaggaaugguacagaagcgacaagaggau

SEQ ID NO: 130271 - RNA, 36 nt, Homo sapiens
uaagaaaauuaauugcuuagaaauaugcuaauauaa

SEQ ID NO: 130272 - RNA, 41 nt, Homo sapiens
guaaagaacgaacagcauguaaaggaaagauugccauauca

SEQ ID NO: 130273 - RNA, 43 nt, Homo sapiens
guuuacuuuauaaauggaaaaacaucaggaaacaaaaacaaaa

SEQ ID NO: 130274 - RNA, 58 nt, Homo sapiens
ccucaaaucucugauguagauaaccagaagaaggagauucauucugugaaaaauaaaa

SEQ ID NO: 130275 - RNA, 47 nt, Homo sapiens
gagucacacaugaauugcacucaacuuugauuuguguagagacaacu

SEQ ID NO: 130276 - RNA, 24 nt, Homo sapiens
aggaaaugcuauuuugagaaaaaa

SEQ ID NO: 130277 - RNA, 40 nt, Homo sapiens
uuauauuuaucauagaaccuagaaagcaaaauuauuauga

SEQ ID NO: 130278 - RNA, 63 nt, Homo sapiens
agcggggucuuuuccauuuauagagaaugauguaacugccaggacacuuuuguguuugcccag

SEQ ID NO: 130279 - RNA, 37 nt, Homo sapiens
gagaucaucacauguauggaaaccuuaaaaaguaaac

SEQ ID NO: 130280 - RNA, 40 nt, Homo sapiens
auuauuguuugaauuuuuggguuauuuuuuaaaacuucau

SEQ ID NO: 130281 - RNA, 40 nt, Homo sapiens
uggccuauugguguccacuagaaagagagagaaacuagga

SEQ ID NO: 130282 - RNA, 25 nt, Homo sapiens
gacagagagaaaggagggaaggaag

SEQ ID NO: 130283 - RNA, 45 nt, Homo sapiens
agucgcuggaguugaucaauucuaggcucuaacuuguuauaaaaa

SEQ ID NO: 130284 - RNA, 30 nt, Homo sapiens
cucuguuuuagauaggcaucaugaggucaa

SEQ ID NO: 130285 - RNA, 48 nt, Homo sapiens
agaagacgaaguacagcugaaguuugauaacaaagaaauauauauaag

SEQ ID NO: 130286 - RNA, 59 nt, Homo sapiens
cuaggguauuuaacuaaguauaaauaacuaaggaggcaaaaaucauuaacacagguaag

SEQ ID NO: 130287 - RNA, 44 nt, Homo sapiens
ggucaggccgcucugcaaaagauucaaagggcacagucaucgua

SEQ ID NO: 130288 - RNA, 54 nt, Homo sapiens
aaagaggagacagagagaaaagggagagagaagggagguagggaaggacagaca

SEQ ID NO: 130289 - RNA, 40 nt, Homo sapiens
ugauuuuucaacaaauugugcaaaucagagcccuucuaug

SEQ ID NO: 130290 - RNA, 46 nt, Homo sapiens
uauuuaaaauuucagcucuuuucucaaacuccuuauccacuagccc

SEQ ID NO: 130291 - RNA, 54 nt, Homo sapiens
ccuguaggccugcaggaggaggcagaacugccagccaagauccugguugaguuu

SEQ ID NO: 130292 - RNA, 45 nt, Homo sapiens
aggcaauugcagcuaaggaacaauggaaagagcugaaggccaccu

SEQ ID NO: 130293 - RNA, 46 nt, Homo sapiens
uugacaggguguuucagaaacuuggaaaccugaagcagcaggcaga

SEQ ID NO: 130294 - RNA, 53 nt, Homo sapiens
aggucagacccaacucaggccuuggugucccuggacugcaaguguggaaggag

SEQ ID NO: 130295 - RNA, 2886 nt, Homo sapiens
ugugaaauuaaauaauuuuauuucauuaugauucccaguccaguuuuucaaugacccuuuuuauagauagaacauugggcucugaggaacuuccuguuuggguuuguaauucauuaauuaacaaacaugccccacugauaaaauuugcucuugaaacccugacuauccuagauuguuuugaggccaauuuaaaacugucauaaauucguuauguccucaaauuuauaacuuaacaaaauuaugaaaaagcaaaaaaccuuaaucuucauagaccucuguaauauacagagacuggauuuuggaugccauguuuguaugcauuucuaaauuuuaaauugucagacggacuuuaggaaacacacuacccaagguguguauaauucauuucaucaugcauuauguaguaauuauacccaaauguagaaguugauuguuuaaguggguagauuacuauaugccuaaaaucauguuuuaugauugauaaaaccagaggaaauucaggaucaugcuuucagaaagugauaggacuauuagaaagauaagguuaucacuaaaauguuuaaaauaaaccauaaaaaauauaauuuagugcaaacauauuuguucuguuuguauguacuauaaaaaauaacaugaagugaaauaauuuguuuucuggaaaaaugaauuauuguuuaaaauauucuguagauucuccagguuauccaauauaugaaauuuuauuguaaaaccgggucuaaucuuaauaaccaaacaguaaaugucgauuuuauuagucuaguuaaaaagcagugauauuaaauauucauccuuaucauauaacuaaucauugaacaauaauucauuuuuuauauaggcauuugaggaaaauuacuucucuuuggggauagaaguguauccacagucuccauuuguaugaggguuggauaaaaguaauuugaaauaauuuauuuacugaaauauagcauuaucucuggugguuucauucuguuacuucauaaagauaauagacugugagggaagauacauggauuucuagcuugaaaauucuaauguuaauaaucacaaaguguaacuuuguuucaguauguuuucaacagggaaauaagaggaaaaggaaagaaaugauaaauucacuagagaaauucaaucguaaaaauauagagcaugucuguguaugugguaauguuacaggcgggucuuuguucuucaagcucccaagaugguggcaggccgcucccaagaugguggcggggugcuuuuuguucucugaccugggguucuuggccucacggauuccaaggaauggaaccuuggggcauguggugaguguuauaacucuauuagaagccgugggucacggaagagaaccguggaacccagcaacuaguauucagguugauuaggacgaacccgggcauuuagcuguguaggaacaauggcgagccuuuagcccgauagggagccgcaauggaugccucgcuggaucaggagggcagcggacacccugccguauccagaggaguauaaguuagcggcaggucugugacaguggcauucagcagugguggaacagugugcgaaagcucagcuccagccagaacaaacacggaccagaagagggugcaguugcaagauuuaauagagugaaaacagagcuccuauacaaugagaggggaccccaagggggcugcccacucccagcucgaaugccugggguuuauaucccaaucauuguuccucccccugugcucucaggugauagaugauuugauuauuucuuuaucuccuguuuuuagccuaauugguauuucagugagcucucuuuacuaccugauugguugggugugagcugaguuacaagccccguauuuaaagggcggugcggucaccuuccccagcuaggcuuaagaauucuuaguccgccuaggaaauccagcuaguccugucucucaguaugucuuuauacauauauacauacauaacauagccagggagaauggaaauaagauggaaaaagugacuacuugaaggauauuaugguauuuuucagauucagacccugccauuaaccacuugcucuccuaauuccuacacacagggacauaacaucuuugcauccacaaaugaacauacaccaguaccuucaacauuaaauauacuuauuuacgaaaugcucauuguauaguauuagggaauauuuuacaaaaagcugccccuuaagcuuagcuucaaauagaugaaauuauccagaggcagauuucaucaaacauuuauugaaugucagcucugugcugaacauaaguucuaagaaucuuuuaaaaagaaaaaacucgggagggcgcgguggcuuacgccuguaaucccagcacuuugggaggccgaggcgggcagaucacgaggucaggagaucgagaccacagugaaaccccgucucuacuaaaaauacaaaaaauuagccaggggagguggcggaugccuguagucccagcuacucgagaggcugaggcaggagaauggugugaacccgggaggcagagcuugcagugagccgagaucacgccacugcacuccagccugggcgacagaguaagacuccaucucacgaaaacaaacaaacaaaaaaaaacaaagaaaaaacucaauaguccuaccuucuuugaguuuaaauuuggagucaggaaagaaaaaaaauuaugaaaaauaauucuauuaaaacaauguuuauuauauuauuuucaaagacuaagaagcaggauguuuugacagcaccaaggauaaucuguaauacuaagcaggggaaacauaagugaaauaaaggaagugagagacugauagaaucaggaaugcaaguggccaagcaguuuggagcagaggauagaaagg

SEQ ID NO: 130296 - RNA, 46 nt, Homo sapiens
cuugugccugaguaacagcuuccuuaucaacguuucagagaccaag

SEQ ID NO: 130297 - RNA, 42 nt, Homo sapiens
uugaccuugauguucaaggguugcuaagggaggcuagugaga

SEQ ID NO: 130298 - RNA, 49 nt, Homo sapiens
acauaaaugucaaagauaauaaccuucuaucaccacacaguugaauaga

SEQ ID NO: 130299 - RNA, 47 nt, Homo sapiens
uccuucaagagucaaucugaauuuguaaagauuuacuuaagcaagag

SEQ ID NO: 130300 - RNA, 46 nt, Homo sapiens
uugaauucaaaauguaaaguuauguccauuugacucuaaaagucau

SEQ ID NO: 130301 - RNA, 50 nt, Homo sapiens
uaggcccgccauucgcuugacucacgccuucgccguagcaucuuucgcag

SEQ ID NO: 130302 - RNA, 41 nt, Homo sapiens
gugagguauaucgggggaagcucauugaagcagaggacaac

SEQ ID NO: 130303 - RNA, 48 nt, Homo sapiens
ugggaggaauggcccugugucuugaaggacagaaaaguguguguugag

SEQ ID NO: 130304 - RNA, 46 nt, Homo sapiens
agauguauuaaccacucaguuuucucaucuguaaaauggggguggu

SEQ ID NO: 130305 - RNA, 35 nt, Homo sapiens
ggacuuaugcaacagcuucugucaggaaaggagug

SEQ ID NO: 130306 - RNA, 46 nt, Homo sapiens
caacaucacagucacauacagagauggccgaguggcacagcuggag

SEQ ID NO: 130307 - RNA, 46 nt, Homo sapiens
aaauccgcuuucugauuuugccugacaugcugaagaacgcacccau

SEQ ID NO: 130308 - RNA, 43 nt, Homo sapiens
aguugaacagaacuuuguccuuuuuucuuucagguuaucugag

SEQ ID NO: 130309 - RNA, 39 nt, Homo sapiens
ucuggcgggcaguagguggggccuuuggaccuaccagca

SEQ ID NO: 130310 - RNA, 56 nt, Homo sapiens
ggugaccccgggaggcggucauggaacucuccagaaccagggcgcagcaugaacac

SEQ ID NO: 130311 - RNA, 34 nt, Homo sapiens
auuagaaucccaggguaugaaguuucagguuugg

SEQ ID NO: 130312 - RNA, 30 nt, Homo sapiens
gagucgcaggacugggcugccuguucucag

SEQ ID NO: 130313 - RNA, 28 nt, Homo sapiens
cccccaaagaugaugcccaacagcaccg

SEQ ID NO: 130314 - RNA, 18 nt, Homo sapiens
ccucucggcuuuugacca

SEQ ID NO: 130315 - RNA, 34 nt, Homo sapiens
uugauuggcccaaaguucuccggagccaaccuuu

SEQ ID NO: 130316 - RNA, 66 nt, Homo sapiens
ucucauccuggccccaccagggccuugggcaaguccugcccaccauaggccucugcuaccugccag

SEQ ID NO: 130317 - RNA, 43 nt, Homo sapiens
cggggccuccuccaaagacagguugucauuuucaugguaacaa

SEQ ID NO: 130318 - RNA, 47 nt, Homo sapiens
gggguauucuucaugcaggagaccccaggcccuggaggcugcaacau

SEQ ID NO: 130319 - RNA, 45 nt, Homo sapiens
gcuuggaugcccucaggggugcugaccccugccaggccacgaaua

SEQ ID NO: 130320 - RNA, 71 nt, Homo sapiens
ugaggcucuggguaccugucaggcuggguauuagcccagcccagauuccggggcaggcagaagggcucccu

SEQ ID NO: 130321 - RNA, 42 nt, Homo sapiens
ggcuuuguguggcgccuccgugggggccagcugcagcccggc

SEQ ID NO: 130322 - RNA, 29 nt, Homo sapiens
ugggggcauccuggcccaugccuucuucc

SEQ ID NO: 130323 - RNA, 39 nt, Homo sapiens
gcuggaguaggugacaggcagcccagggcccuccacgau

SEQ ID NO: 130324 - RNA, 50 nt, Homo sapiens
gcccugguggggugugaccaaaaccaccucugcuagaagccaggccucag

SEQ ID NO: 130325 - RNA, 46 nt, Homo sapiens
gcacagcucugcccuuuccagggagggucuucauaccccugccagg

SEQ ID NO: 130326 - RNA, 53 nt, Homo sapiens
ugucagaaagaagcggggagagaaaggaaagggagaaaaugugugcucaggag

SEQ ID NO: 130327 - RNA, 42 nt, Homo sapiens
gccgcaguuaguacaccuccaggugugcggugggaugaagga

SEQ ID NO: 130328 - RNA, 29 nt, Homo sapiens
cgcagggacaaagccgagcagaucccagg

SEQ ID NO: 130329 - RNA, 51 nt, Homo sapiens
uccaaucccagcuaucuggguacaaucugguguuguggucuggcugucggc

SEQ ID NO: 130330 - RNA, 63 nt, Homo sapiens
auuugaggccgccaggggcaccuaagcugugggugcagagaaugggaugcagagguagagaca

SEQ ID NO: 130331 - RNA, 44 nt, Homo sapiens
gaagcggcccugaaagcaaaggaagcgacgauugccgagagaaa

SEQ ID NO: 130332 - RNA, 45 nt, Homo sapiens
agcugaaagccacuauugaaaaucugcaagagaaucagaaacgau

SEQ ID NO: 130333 - RNA, 40 nt, Homo sapiens
ucaggaaaaaaguggcccagcuccaggaagaaguggaaaa

SEQ ID NO: 130334 - RNA, 46 nt, Homo sapiens
cucccucagacuccgcgcgggccgcccggcggugacggggcugaca

SEQ ID NO: 130335 - RNA, 47 nt, Homo sapiens
ucaggaagccaauuaauuuuguacacauaauacuuaauuaccuucua

SEQ ID NO: 130336 - RNA, 42 nt, Homo sapiens
auccucugucccggggcgaucauccuccagacaaacgaccug

SEQ ID NO: 130337 - RNA, 34 nt, Homo sapiens
ggauagcacuauuuauuucauaacuuggcauauu

SEQ ID NO: 130338 - RNA, 47 nt, Homo sapiens
acacauggcgguuguggacuguuuuccaggcaucugcagcccuggcu

SEQ ID NO: 130339 - RNA, 26 nt, Homo sapiens
ucuaaaggcccaccaauucgagggag

SEQ ID NO: 130340 - RNA, 46 nt, Homo sapiens
ugcccacuucaugugugaggagcccauguccuccuuugaugccaag

SEQ ID NO: 130341 - RNA, 48 nt, Homo sapiens
ugguugaauuaaagaacaucggaagaggacuaacagcuuagguaccaa

SEQ ID NO: 130342 - RNA, 45 nt, Homo sapiens
ucauguggaugcugcacagcugacuucaccuggucuuguugaugg

SEQ ID NO: 130343 - RNA, 45 nt, Homo sapiens
uugaggcacauugcagcugaagaagugucuaaggaaagagagcga

SEQ ID NO: 130344 - RNA, 67 nt, Homo sapiens
ugaaacaagagagagagcugguguuaagugagcugagccagggccuggccguggagcugauggaacg

SEQ ID NO: 130345 - RNA, 42 nt, Homo sapiens
ggagcauguguuuuggaagcuggugcugguguugccggaugu

SEQ ID NO: 130346 - RNA, 45 nt, Homo sapiens
ccccgugugcuccaugguuguccaguacgccucccagauccccag

SEQ ID NO: 130347 - RNA, 43 nt, Homo sapiens
cucuuggcgcaguguuugucgagcagucugcugcuggagaaag

SEQ ID NO: 130348 - RNA, 46 nt, Homo sapiens
ucuuugcauaagcccauucugcuucacucuucaaucgaggcuuuuc

SEQ ID NO: 130349 - RNA, 80 nt, Homo sapiens
gugggacccgggcccgcuuagcaccauggacggggugggcucacgacccucgacugcggggcccgggcggcggcgcuagc

SEQ ID NO: 130350 - RNA, 46 nt, Homo sapiens
ggacgugcucaccacgcucagccugggugaccgcgccgccguguuc

SEQ ID NO: 130351 - RNA, 41 nt, Homo sapiens
gcgccgacucgugcagacugucguugcccgugacgccgucc

SEQ ID NO: 130352 - RNA, 46 nt, Homo sapiens
ucguguuccucacggacggcgucacgggcaacgacagucugcacga

SEQ ID NO: 130353 - RNA, 46 nt, Homo sapiens
ccacgaggcgcuggagaccacacaauaccugaacuccuucucgcac

SEQ ID NO: 130354 - RNA, 43 nt, Homo sapiens
cucaacgcacgcguggcgcugcugcaguuugguggccccggcg

SEQ ID NO: 130355 - RNA, 55 nt, Homo sapiens
uuccugcuggacggcuccgagcggcugggugagcagaacuuccacaaggcccggc

SEQ ID NO: 130356 - RNA, 41 nt, Homo sapiens
gacaguggcccuuuugugggcagcaaauucuugagccauga

SEQ ID NO: 130357 - RNA, 25 nt, Homo sapiens
cacacgugugggugucacguggggc

SEQ ID NO: 130358 - RNA, 48 nt, Homo sapiens
ccacagacacugaugaauggacagagacccccaaaaccagcugccccu

SEQ ID NO: 130359 - RNA, 53 nt, Homo sapiens
ccacugcacagggcaggccaggcuggucuucccacuguggggaugaaggaucc

SEQ ID NO: 130360 - RNA, 30 nt, Homo sapiens
auccaaagggagcggcccccacggcgagcu

SEQ ID NO: 130361 - RNA, 53 nt, Homo sapiens
cggggugucugcacccuuccagcccaaccucugggucuccaaaagcacagucg

SEQ ID NO: 130362 - RNA, 34 nt, Homo sapiens
aagucuuuggaggcccuuacuuagcggcccagcu

SEQ ID NO: 130363 - RNA, 40 nt, Homo sapiens
cauuugggcuggcgagucgguagaggaaaugcagguggag

SEQ ID NO: 130364 - RNA, 36 nt, Homo sapiens
gccguccccuccaggagugugaggguagggaugcca

SEQ ID NO: 130365 - RNA, 23 nt, Homo sapiens
cacacgaucugagggucuggaag

SEQ ID NO: 130366 - RNA, 35 nt, Homo sapiens
uccuccaugucaucgaugaacuucucagcgaccag

SEQ ID NO: 130367 - RNA, 45 nt, Homo sapiens
cuguucuccgaccuggucgcugagaaguucaucgaugacauggag

SEQ ID NO: 130368 - RNA, 46 nt, Homo sapiens
acgucacagugacggccaucggcaucggggacauguuccacgagaa

SEQ ID NO: 130369 - RNA, 53 nt, Homo sapiens
ggccgucacugugacgucgcggucgcacagcgcccgcaaguugaggucaucgu

SEQ ID NO: 130370 - RNA, 55 nt, Homo sapiens
ucagcccucaaguuugccuacgaccgccucaucaaggagagccggcgccagaaga

SEQ ID NO: 130371 - RNA, 51 nt, Homo sapiens
ccggcucuccuugaugaggcggucguaggcaaacuugagggcugagggugu

SEQ ID NO: 130372 - RNA, 45 nt, Homo sapiens
gucgauacguucgucguccagcuggauggccucaaaggugcccuc

SEQ ID NO: 130373 - RNA, 42 nt, Homo sapiens
cugaccugucucggacuugggguccuuagcgauggcacccag

SEQ ID NO: 130374 - RNA, 48 nt, Homo sapiens
ucaucaacguggucaacaggcugggugccaucgcuaaggaccccaagu

SEQ ID NO: 130375 - RNA, 72 nt, Homo sapiens
cacagggaggccgaggcgacuuuggcuugaaaggagaaccugggaggaaaggagagaaaggagagccuguga

SEQ ID NO: 130376 - RNA, 44 nt, Homo sapiens
ucacgggugcuccucgggguccuggguagcugaauccaggccug

SEQ ID NO: 130377 - RNA, 36 nt, Homo sapiens
ugcucaacagggcgcaaggugcacacugggguggaa

SEQ ID NO: 130378 - RNA, 45 nt, Homo sapiens
guccugagucuccacgggguccugcaucaccggggucuccccgag

SEQ ID NO: 130379 - RNA, 41 nt, Homo sapiens
aggcccccagggagcucuuggggagcccggaaagcagguca

SEQ ID NO: 130380 - RNA, 46 nt, Homo sapiens
ccgggcuccccaagagcucccugggggccucuggguccaggcaagc

SEQ ID NO: 130381 - RNA, 44 nt, Homo sapiens
ccccgcggccuggcuggagagguuggcaacaaaggagccaaggu

SEQ ID NO: 130382 - RNA, 52 nt, Homo sapiens
cuccuuuguugccaaccucuccagccaggccgcggggccccucagggccagg

SEQ ID NO: 130383 - RNA, 44 nt, Homo sapiens
cucccccuuggggccaucgcugccugggcugcccuuggugccgg

SEQ ID NO: 130384 - RNA, 46 nt, Homo sapiens
ggggcgcaggggagaccccggcaccaagggcagcccaggcagcgau

SEQ ID NO: 130385 - RNA, 76 nt, Homo sapiens
guaucaaggcaacaguggagccccaggaaguccuggugugaaaggagccaagggcgggccugggccccgcggaccc

SEQ ID NO: 130386 - RNA, 46 nt, Homo sapiens
ccuggccgcccaggacgcagagggcccccgggagaaaucggggcca

SEQ ID NO: 130387 - RNA, 46 nt, Homo sapiens
gccccgauuucucccgggggcccucugcguccugggcggccagggu

SEQ ID NO: 130388 - RNA, 58 nt, Homo sapiens
gagccccuggggcaccaacguucccauggggagcuccaggagguguggguggggcucc

SEQ ID NO: 130389 - RNA, 41 nt, Homo sapiens
gguuacccgggggaagcagggaguccaggggagcgaggaga

SEQ ID NO: 130390 - RNA, 45 nt, Homo sapiens
cuuaccuugccgccuuggucuccucgcuccccuggacucccugcu

SEQ ID NO: 130391 - RNA, 41 nt, Homo sapiens
uuuccagggucucccuugcagccaggagguccgaugcgccc

SEQ ID NO: 130392 - RNA, 45 nt, Homo sapiens
agggggccccuggccuggcuggcaagaacgggaccgauggacaga

SEQ ID NO: 130393 - RNA, 42 nt, Homo sapiens
uucuguccaucggucccguucuugccagccaggccaggggcc

SEQ ID NO: 130394 - RNA, 50 nt, Homo sapiens
gcaccgagcucacugcgccggcuuuccuccuacacagggugaauuuggag

SEQ ID NO: 130395 - RNA, 29 nt, Homo sapiens
ggcguuccuggcuucaaaggagagaaggu

SEQ ID NO: 130396 - RNA, 46 nt, Homo sapiens
cagggagacccgggcaucgaaggccccauuggauucccaggaccca

SEQ ID NO: 130397 - RNA, 47 nt, Homo sapiens
gugccaagggcaacaugggugagccgggagagccuggccagaaggga

SEQ ID NO: 130398 - RNA, 42 nt, Homo sapiens
ucuggccaggcucucccggcucacccauguugcccuuggcac

SEQ ID NO: 130399 - RNA, 44 nt, Homo sapiens
ggaaaucccugggcccucuggccccaagggcuaccguggacaga

SEQ ID NO: 130400 - RNA, 60 nt, Homo sapiens
acgccaccaugcugcccgacuccaccgagaucgaccaggacaccaucaaccgcaucauca

SEQ ID NO: 130401 - RNA, 49 nt, Homo sapiens
gccguggcccccaaccagaaccugaaggagcagggccugcgggacaucg

SEQ ID NO: 130402 - RNA, 57 nt, Homo sapiens
ccgacugcgcgcuggccaacaugacggagcagauccggcaggaccgcagcaagggca

SEQ ID NO: 130403 - RNA, 47 nt, Homo sapiens
cugcuccgucauguuggccagcgcgcagucggugaaggugccgcggc

SEQ ID NO: 130404 - RNA, 43 nt, Homo sapiens
gcacuucucugaccagguggagguguucagcccaccgggcagc

SEQ ID NO: 130405 - RNA, 50 nt, Homo sapiens
gcagucccccacggacauccugcucuuccacaugaagcaguucgugccgc

SEQ ID NO: 130406 - RNA, 23 nt, Homo sapiens
ggacacuaccgagagaaacaaca

SEQ ID NO: 130407 - RNA, 42 nt, Homo sapiens
cugcucuggggaauccugggggccauccaggcccagcagcag

SEQ ID NO: 130408 - RNA, 40 nt, Homo sapiens
ggaugggagggaagcggggacccucgagggcgggaggcug

SEQ ID NO: 130409 - RNA, 49 nt, Homo sapiens
aucuagcgaaucagguuggucgggaaaauucgcaucacauuuuacucug

SEQ ID NO: 130410 - RNA, 114 nt, Homo sapiens
uccaccagacagucuccaggaagguggcgcugggcuagcccacccugcacgccggcaccaaacccuguccucccaccccuccccacucaucacuaaacagaguaaaaugugaug

SEQ ID NO: 130411 - RNA, 59 nt, Homo sapiens
gggccgccaggugaaugagccccacauccgcguccuggucaccggcaagacggccgagu

SEQ ID NO: 130412 - RNA, 64 nt, Homo sapiens
cugccaucgagaaggccgugcaggaagcccagcgggcaggcaucgagaucuucgugguggucgu

SEQ ID NO: 130413 - RNA, 42 nt, Homo sapiens
uuccugcacggccuucucgauggcagcgggcguggcgcccug

SEQ ID NO: 130414 - RNA, 32 nt, Homo sapiens
agugccgucgaugccauggacuuuaucaacga

SEQ ID NO: 130415 - RNA, 46 nt, Homo sapiens
gguggcgguggugcaguacagcggcacgggccagcagcgcccagag

SEQ ID NO: 130416 - RNA, 42 nt, Homo sapiens
ugggcgcugcuggcccgugccgcuguacugcaccaccgccac

SEQ ID NO: 130417 - RNA, 68 nt, Homo sapiens
acguucuccuccccggcugacaucaccauccugcuggacggcuccgccagcgugggcagccacaacuu

SEQ ID NO: 130418 - RNA, 23 nt, Homo sapiens
ggccgugcccccggaagucacag

SEQ ID NO: 130419 - RNA, 48 nt, Homo sapiens
augcagagcugcuggaggaugccuuccugaagaaugucaccgcccaga

SEQ ID NO: 130420 - RNA, 52 nt, Homo sapiens
cggcccugggauggugccaggccuuggcaagaaaugacauugagcuggucug

SEQ ID NO: 130421 - RNA, 46 nt, Homo sapiens
gcccagcccgaacaaccgcaucgcccuggucaucacugacgggcgc

SEQ ID NO: 130422 - RNA, 42 nt, Homo sapiens
guucgggcugggcggcagcagcuggucccgcguguacugcag

SEQ ID NO: 130423 - RNA, 50 nt, Homo sapiens
ugcuccugcaucuggcuguggcuguacugcaccacacccgcguacgacug

SEQ ID NO: 130424 - RNA, 46 nt, Homo sapiens
gagccagggcagucguacgcggguguggugcaguacagccacagcc

SEQ ID NO: 130425 - RNA, 46 nt, Homo sapiens
cagccggucgaugaccuugacgacgaaguccuuggcaaucucgaag

SEQ ID NO: 130426 - RNA, 56 nt, Homo sapiens
ccuguucgugcuggacagcucagagagcauuggccugcagaacuucgagauugcca

SEQ ID NO: 130427 - RNA, 45 nt, Homo sapiens
ccccggccucaagggggacgagggagaagccggggaccccggaga

SEQ ID NO: 130428 - RNA, 45 nt, Homo sapiens
ccgggguccccggcuucucccucgucccccuugaggccgggguag

SEQ ID NO: 130429 - RNA, 47 nt, Homo sapiens
uuucacccaucagccccgggucuccaggggguccggcagguccuggg

SEQ ID NO: 130430 - RNA, 47 nt, Homo sapiens
cccaggaccugccggacccccuggagacccggggcugaugggugaaa

SEQ ID NO: 130431 - RNA, 41 nt, Homo sapiens
cgaggcuggcccuaucggaccuaaaggcuaccgaggcgaug

SEQ ID NO: 130432 - RNA, 47 nt, Homo sapiens
cgggagagccugggccccccggagagaaaggagaggcgggcgacgag

SEQ ID NO: 130433 - RNA, 41 nt, Homo sapiens
caagggagaccccggugccuuuggacugaaaggagaaaagg

SEQ ID NO: 130434 - RNA, 46 nt, Homo sapiens
gguacccaggccugccaggcugcaagggcucgcccggguuugacgu

SEQ ID NO: 130435 - RNA, 46 nt, Homo sapiens
ggccuggguaccccaucucccccuggaaagaggaagaaaacuagaa

SEQ ID NO: 130436 - RNA, 44 nt, Homo sapiens
ggagagaagggcaagcguggcaucgacgggguggacggcgugaa

SEQ ID NO: 130437 - RNA, 41 nt, Homo sapiens
guguccccggggaugaggacagugucccugacaggagacca

SEQ ID NO: 130438 - RNA, 44 nt, Homo sapiens
cccggggaccucggaccuguuggguaccagggaaugaagguacg

SEQ ID NO: 130439 - RNA, 42 nt, Homo sapiens
cuucauucccugguacccaacagguccgagguccccgggucu

SEQ ID NO: 130440 - RNA, 27 nt, Homo sapiens
cagggagaacgaggcaagccggggcuc

SEQ ID NO: 130441 - RNA, 44 nt, Homo sapiens
cugcaagaggaccuccggggcuccggggcgaccccggcuuugag

SEQ ID NO: 130442 - RNA, 42 nt, Homo sapiens
caaagccggggucgccccggagccccggagguccucuugcag

SEQ ID NO: 130443 - RNA, 30 nt, Homo sapiens
gccccugcccaggagacggggaggcccgcg

SEQ ID NO: 130444 - RNA, 46 nt, Homo sapiens
cacguaccggcgcaacuucacggcggcugacuggggccagagccgc

SEQ ID NO: 130445 - RNA, 121 nt, Homo sapiens
gaccgacgggcacccccuggagggcuacaaggaacccuguggggggcuggaggaugcugugaacgaggccaagcaccugggcgucaaagucuucucgguggccaucacacccgaccaccug

SEQ ID NO: 130446 - RNA, 42 nt, Homo sapiens
ucggucaccacaaucagguacuuauucuccuucaggugggag

SEQ ID NO: 130447 - RNA, 73 nt, Homo sapiens
acucaaaagcagcguggacgcggucaaguacuuugggaagggcaccuacaccgacugcgcuaucaagaagggg

SEQ ID NO: 130448 - RNA, 48 nt, Homo sapiens
cgaaaccugguguggaacgcaggcgcgcugcacuacagugacgaggug

SEQ ID NO: 130449 - RNA, 46 nt, Homo sapiens
acaaagucaaguccuucaccaagcgcuucaucgacaaccugaggga

SEQ ID NO: 130450 - RNA, 23 nt, Homo sapiens
gcuuggugaaggacuugacuuug

SEQ ID NO: 130451 - RNA, 61 nt, Homo sapiens
gacaugagggcggcccgugcucugcugccccugcugcugcaggccugcuggacagccgcgc

SEQ ID NO: 130452 - RNA, 42 nt, Homo sapiens
gucucugggcggcggcggcggcccacucugcccuggccgcgc

SEQ ID NO: 130453 - RNA, 52 nt, Homo sapiens
uccccaucagccgcgugcccuggcaggagggcgugcaggccaagcccacagu

SEQ ID NO: 130454 - RNA, 46 nt, Homo sapiens
uuagaacaguuucaauaagacccuuuguccucauggcugaguaaaa

SEQ ID NO: 130455 - RNA, 36 nt, Homo sapiens
gagcagggcaaggcugugagcccagcaggcuucaga

SEQ ID NO: 130456 - RNA, 49 nt, Homo sapiens
gccugugcugccuucuccuccgcggcacuccucaggcccugggccgggg

SEQ ID NO: 130457 - RNA, 37 nt, Homo sapiens
ggacgcagaagcccaccacccaccucuuccagcaaca

SEQ ID NO: 130458 - RNA, 43 nt, Homo sapiens
ucuguaauugugugugaugugaagccaauucagacaggcaaau

SEQ ID NO: 130459 - RNA, 53 nt, Homo sapiens
aacaagguccucugucagucacagccaccccugagauccggcaacaucaaccc

SEQ ID NO: 130460 - RNA, 107 nt, Homo sapiens
gacaggcuggcuccagaugcagggcagucauuggcugucuccuaggaaacccauauccuuacccuccuugggacugaaggggaaccccggggugcccacaggccgcc

SEQ ID NO: 130461 - RNA, 43 nt, Homo sapiens
agggggagccccuucugcucagcucugggccauucuccacagc

SEQ ID NO: 130462 - RNA, 55 nt, Homo sapiens
cgccccagcaggugcugacuucaucucccaccuagcagcaccguucugugcacaa

SEQ ID NO: 130463 - RNA, 47 nt, Homo sapiens
ccauacuuuccuguauaguucacguuucauguaauccucaagaaaua

SEQ ID NO: 130464 - RNA, 48 nt, Homo sapiens
ugccgcgagcugccaucacgccuacaucgugcucugcauugagaacag

SEQ ID NO: 130465 - RNA, 41 nt, Homo sapiens
ggaccccaacgggcgcaggcugaccgagagcuacugugaga

SEQ ID NO: 130466 - RNA, 36 nt, Homo sapiens
cccugccuuagccaaggccucuuggggucugcagag

SEQ ID NO: 130467 - RNA, 46 nt, Homo sapiens
ggcuggcgggcaccuuccgcgccuuccuguccucgcgccugcagga

SEQ ID NO: 130468 - RNA, 46 nt, Homo sapiens
gcucaacagcccccugucaggcggcaugcggggcauccgcggggcc

SEQ ID NO: 130469 - RNA, 110 nt, Homo sapiens
uggcgggcagaugacauccuggccagccccccucgccugcccgagccccagcccuaccccggagccccgcaccacagcuccuacgugcaccugcggccggcgcgacccac

SEQ ID NO: 130470 - RNA, 49 nt, Homo sapiens
cccguggugcagcugcacgacagcaaccccuacccgcggcgggagcacc

SEQ ID NO: 130471 - RNA, 87 nt, Homo sapiens
caggugaggcucugggcuacacgccaggccaugcugggccaggugcacgagguucccgagggcuggcucaucuucguggccgagcag

SEQ ID NO: 130472 - RNA, 50 nt, Homo sapiens
ggcccccuggaaccaugggcgccuccucagggguaagugucugggcagcc

SEQ ID NO: 130473 - RNA, 46 nt, Homo sapiens
caggccccccagggcccccuucauuuccuggcccucacaggcagag

SEQ ID NO: 130474 - RNA, 63 nt, Homo sapiens
ccaguccagggcacgagguaaccaggaagcgucucuugucgccguccguagggucccaaggga

SEQ ID NO: 130475 - RNA, 47 nt, Homo sapiens
gggggagaagggagaccgaggugaugcaggacagaaaggcgaaaggg

SEQ ID NO: 130476 - RNA, 94 nt, Homo sapiens
agugcccagugcugcugccugaggccuguggcagcaccuccuccguucaggagcacagucccuuucccacgcugcagugagcuucccaaaaugu

SEQ ID NO: 130477 - RNA, 45 nt, Homo sapiens
augaggagaccaggggucuaaacgucuccugucuguccguccagg

SEQ ID NO: 130478 - RNA, 45 nt, Homo sapiens
acccgucgcagcaugguguuugccaggcaccugcgggagguggga

SEQ ID NO: 130479 - RNA, 52 nt, Homo sapiens
cuguuacccgagauggugagguuugaacccacgugggaggagcuggagcucu

SEQ ID NO: 130480 - RNA, 48 nt, Homo sapiens
uggcaccucagucucaacauuuucuuuucggauucaugaggaaagaga

SEQ ID NO: 130481 - RNA, 41 nt, Homo sapiens
aacagguucugcggagaccaagagaaggcgugugagcaacc

SEQ ID NO: 130482 - RNA, 34 nt, Homo sapiens
gggcuccaggccccgccaguaaagaggucacaag

SEQ ID NO: 130483 - RNA, 39 nt, Homo sapiens
cuguuacuuugcucuggaaacagggcuuacguuccaaug

SEQ ID NO: 130484 - RNA, 45 nt, Homo sapiens
gggcgcugggcagagacuucagguacuccaggugccuccgggcau

SEQ ID NO: 130485 - RNA, 49 nt, Homo sapiens
gaaacgcguccacugguggggaggguguugagggcccacugaagggucu

SEQ ID NO: 130486 - RNA, 41 nt, Homo sapiens
uccacgccuggcgcggcggccaccccgcugccccugcgacc

SEQ ID NO: 130487 - RNA, 69 nt, Homo sapiens
gagagagcuguaggaaggccaggcccugaacucaaaggcggacugggguggaccccaccagcaacagcc

SEQ ID NO: 130488 - RNA, 18 nt, Homo sapiens
ccuccagaucaaccuugg

SEQ ID NO: 130489 - RNA, 38 nt, Homo sapiens
cccucuuuccugccaccaucuguccccggccccagggg

SEQ ID NO: 130490 - RNA, 66 nt, Homo sapiens
cagugcuggggaggggcaggggaggaaggggacucggaagcuggaggacgagaaagaagggaggcg

SEQ ID NO: 130491 - RNA, 33 nt, Homo sapiens
uggggcgugguggcuccaugcuggggaccaaga

SEQ ID NO: 130492 - RNA, 29 nt, Homo sapiens
gagaugacgggaagcucacuagcuacaga

SEQ ID NO: 130493 - RNA, 36 nt, Homo sapiens
gguucuaggcuggaaagaugugucggaacguggcug

SEQ ID NO: 130494 - RNA, 41 nt, Homo sapiens
aggugguugguugugagggaguggccccagcaagguccaga

SEQ ID NO: 130495 - RNA, 44 nt, Homo sapiens
ucaguuaaugccaugggugugagagagccgggugggggccggga

SEQ ID NO: 130496 - RNA, 45 nt, Homo sapiens
uccuccuguuccaucuccacagccaccagaggaccuucgugcugg

SEQ ID NO: 130497 - RNA, 42 nt, Homo sapiens
gggccuagugggcuccaucgauaacgacuucugcggcaccga

SEQ ID NO: 130498 - RNA, 47 nt, Homo sapiens
uccuccucggggcccucgcggccgccuuccuugugggucuagcuggg

SEQ ID NO: 130499 - RNA, 39 nt, Homo sapiens
cgccaggcugcgggcuuccgggaccuccucccggcuggg

SEQ ID NO: 130500 - RNA, 53 nt, Homo sapiens
uuucggccgccgccauggccgcgguggaccuggagaagcugcgggcgucgggc

SEQ ID NO: 130501 - RNA, 48 nt, Homo sapiens
cacacaguagggggugcagggccgaggaguccagcccuggcagcgggg

SEQ ID NO: 130502 - RNA, 72 nt, Homo sapiens
cugugcacaguagaccuacuacccucacagcagcagaacaaggaacacaucuuccggggccguuaucaaugc

SEQ ID NO: 130503 - RNA, 154 nt, Homo sapiens
ggggccucccuaaacugacccaccuguuaaggggaauggcacccagcagaauggggaggugaucaagggcagaaagagacggcaaggaggaacggcuucaggagccgagcaaugacccccacugugccccuuauucuagugaugaggcacaagg

SEQ ID NO: 130504 - RNA, 31 nt, Homo sapiens
ccagagcucuuccucccacagacugccacgu

SEQ ID NO: 130505 - RNA, 83 nt, Homo sapiens
ugugcauugguggacaaacucccaccugcccuggggggcacagcucuguggccucugugcuccccagcccugucuggaguggg

SEQ ID NO: 130506 - RNA, 50 nt, Homo sapiens
uugggguggcuucccuucagggucaguggguggaggcggccgugaaccgg

SEQ ID NO: 130507 - RNA, 76 nt, Homo sapiens
cggggauuguccuggaucuacaccaggguguucaacagcgucccccgaaguucacguccacccagaaccucagagu

SEQ ID NO: 130508 - RNA, 53 nt, Homo sapiens
gcacaggcagaacuuucuaaggaugcaaccccauggcccaggagggcccaugc

SEQ ID NO: 130509 - RNA, 48 nt, Homo sapiens
ccagggaugauuuucuggaggaagcuaugucuaggcugguccugaagg

SEQ ID NO: 130510 - RNA, 49 nt, Homo sapiens
uugucaucagggacgccccuggcuccuuguggggagggaguuggggaag

SEQ ID NO: 130511 - RNA, 48 nt, Homo sapiens
gugaggaauggcagugagguuucuucaauuagucucaguucucuuaau

SEQ ID NO: 130512 - RNA, 32 nt, Homo sapiens
ggcaaucccuguagccgcagagaauaaacgcc

SEQ ID NO: 130513 - RNA, 45 nt, Homo sapiens
aggagcacguuugccguggacgggaaagauugcaaggugaauaaa

SEQ ID NO: 130514 - RNA, 46 nt, Homo sapiens
gcugccaucuuuccaggaggcuuuggagcggcuaaaaaccugugcg

SEQ ID NO: 130515 - RNA, 45 nt, Homo sapiens
gagaagaagaaaaaggagagcaucuuggacuuguccaaguacauc

SEQ ID NO: 130516 - RNA, 2344 nt, Homo sapiens
ggugagugggguggcggccgaggcaggcagcgggacgagggggauaguggggugaggggggcagcgggacgaggggggcagugggacgaggggggcagccguggggcucccugcuggcucuucuucucucaaacccacaaaaccucugaguuaccaacgugaagccucguggcggccgauggacgggcuugagcgcucacugguccuagacguccucacaaagcaggaaaccccauuguuguggggccuggagagacgggagcugccagcucacccacuggucucuacacacugacggggcgcccggcacaguuagaggacaaccuuuuuaaauguuuuauuauuuuaauuuuuguuaaauuggugacgugagaggccaggcacaauggcucacaccuauaaucccagcgcuuugggaggccaaggcaggaggaucucuugaggucaggaguuugagaccagccugaccaacauggugaaaccccgucuccgcuaaaaaugcaaaaaaauugcugggugugguggcgcaugccuguaaucccagcugcucgggaggcugacgcaggagaaucgcuugaaccugggaggcggagguugcagugagccgagauggugcaacugcacuccagccugaguaacagagugagacuccgucucaaaaaaaagagauaagcugaggucucacuguguugcccgggcuggucucgaacuccugggcucaagccauccuccugcuucagccucccacagugcugggguuccaggcgugagcuguggcgcccagcggagagcagccuugcugugggguagugagcgugccguggggcuccucucgggcgccuuuccucuucugcccuuguuaauucccgcuaugaacgcagggucccugucuccuccccagaggacccucccucauuucccugcccccgcucgcuccccuccccagugaggccgccaaguccucagacucucccccagaagcuccugcggcaaguccccagcuggcaaguccccaucccggcccgggcacugggggaaugucaggacuuaggagagagagggucuugccccuuggauccauugauacugagacaagauuuauucuuguagcuggccaugguggcucaugccuguaaucccagcacuuugggaggccaagacaggaggaucacucgagcccaggaauuugagaccagccugggcaacauagugagacccugucucuacaaaaaaaaaaaaaauguaauuagccaggcauggcgguacaugugccuguggccccagcuacucaggaggcuaaggcaggaggauuguuugagcccaggagguugaggcugugagcugugauugcacugcugcacuccaaccugagcaacagagcaagaccuggugucugaaaaaaaguuuaaaaaccugggccccaugguucucccaugcccccaccacugcaggaccacaguagugaggaguuuuaaucgccuucagccucuugagagcuugucuugggcuugcuggcacuucccuggggugccagcccacaugguccccaccccacaugaacagccucuuuauuuuuuuauuuuuugagauggaaucucgcucugucacccaggcuggagugcaguggcgcgaucucggcucacugcaagcuccgccuccuggguucacaccauucuccugccucagccucccgaguagcugggacuccaagugccugccaccacgcccggcuaauuuuuuuguauuuuuuaguagagacgggguuucaccaaguuagccaggauggucucgaucuccugaccucgugauccgccugccuuggccucccaaagugcugggauuacaggcgugagccaccgcgcccggcccccagccucuuuguuauagggugaauauuggcccccuagggcuccagggaccuugcagagaccaggaggcccagggugccuguauucuggccggccaucugauaaccugguucccggcccuggugccugggccccagugagcucugagacgcgggguagccggcuaucaccugggccuucuuguucccaugguuuguggagugagggagggcuguggcugcugucuguggagcugccacuggucucuaggggccaugggucucagccgugggagccggggaccugccccacagagcgcaucccgucugaggucccugcgugcucguggcgccugcagggugcagguggggaggucggagcgagggucuuggguggguggggggucucggaggcuuccuggaggucccucaguccucucuaucugcuccuccccagacccugacgaccaguacaagcucacggaggacacccggcag

SEQ ID NO: 130517 - RNA, 48 nt, Homo sapiens
ggugagaaggagcccccgagcccgggcauggagaggaagaggagcagg

SEQ ID NO: 130518 - RNA, 37 nt, Homo sapiens
gaccagcgugaggacagggucaugagacccaggagca

SEQ ID NO: 130519 - RNA, 22 nt, Homo sapiens
ggaaggggugaaucccuaggcc

SEQ ID NO: 130520 - RNA, 79 nt, Homo sapiens
gauagcaggcacccaggaugggggacucggcacucaugcuucagggggagacacugcaggugacccccauccaggggag

SEQ ID NO: 130521 - RNA, 46 nt, Homo sapiens
ccagagaaggccugcaggcgccugcuugaagggaggcggcagaaga

SEQ ID NO: 130522 - RNA, 72 nt, Homo sapiens
cgccugcaggccuucucugggaucucaucuucagggaaaaugccugagaaccagggcagaagucagggggcu

SEQ ID NO: 130523 - RNA, 48 nt, Homo sapiens
gaucacuuuguagagacgcuuucuguucugagaaggggugcucuggcg

SEQ ID NO: 130524 - RNA, 61 nt, Homo sapiens
ugucccugucgucaccugccugcuccucaccagccucagguucagcccugcagauggagcc

SEQ ID NO: 130525 - RNA, 45 nt, Homo sapiens
uccaucugcagggcugaaccugaggcuggugaggagcaggcaggu

SEQ ID NO: 130526 - RNA, 24 nt, Homo sapiens
aggcugggcauuuggggcuuugau

SEQ ID NO: 130527 - RNA, 39 nt, Homo sapiens
agacgggccaggaacgaggaacacgaggagcaagugauu

SEQ ID NO: 130528 - RNA, 69 nt, Homo sapiens
gaggacagagggaaggccugucugaauguuuacacgugcugcauuuuguagcugacaugcacacucagg

SEQ ID NO: 130529 - RNA, 88 nt, Homo sapiens
ccccagcgguacccaguggaggcaguggagaggaacaccaggcagggcgucucgucucagccaagccuuucucucugcuagcaaucuu

SEQ ID NO: 130530 - RNA, 40 nt, Homo sapiens
gauucuccagccuugcuacggagcuuccuaaggaucacac

SEQ ID NO: 130531 - RNA, 41 nt, Homo sapiens
uccugaacgaguccuugaagguucugaagaugcaaggcugg

SEQ ID NO: 130532 - RNA, 28 nt, Homo sapiens
gagucaccgcaccacgagggaaagcggc

SEQ ID NO: 130533 - RNA, 46 nt, Homo sapiens
gcugccccccacaaacagugccucaugcuagucuuugugucgucca

SEQ ID NO: 130534 - RNA, 44 nt, Homo sapiens
cgaggcgcaggugguccaggagaagcgucagcguggccugggag

SEQ ID NO: 130535 - RNA, 24 nt, Homo sapiens
cccaccuccucuucccccuuagcu

SEQ ID NO: 130536 - RNA, 46 nt, Homo sapiens
cucgccggcgggcuccccagugccagguaccccaggcccuaaagag

SEQ ID NO: 130537 - RNA, 45 nt, Homo sapiens
gagcagaggggcccuccagccccgaggcaucaaggagcccugcac

SEQ ID NO: 130538 - RNA, 45 nt, Homo sapiens
cagggcuccuugaugccucggggcuggagggccccucugcuccgg

SEQ ID NO: 130539 - RNA, 36 nt, Homo sapiens
cagagagggaagcgacuugcccaaggccacgcaggu

SEQ ID NO: 130540 - RNA, 33 nt, Homo sapiens
acuuuuccaaaaggcuccuggaagccucccugg

SEQ ID NO: 130541 - RNA, 44 nt, Homo sapiens
agaggagggagggaaggggaagucccaaagcauugagcgugggg

SEQ ID NO: 130542 - RNA, 67 nt, Homo sapiens
ggccgggccgagccgagugcgcgccccgggcuccggccgcgccgccccgcgcccuccccgccccgcc

SEQ ID NO: 130543 - RNA, 28 nt, Homo sapiens
gaggcugcuggugcggggcagggcgucc

SEQ ID NO: 130544 - RNA, 51 nt, Homo sapiens
accccaaggcccgggggguggggaaggggucaggaagacugacagaggcgg

SEQ ID NO: 130545 - RNA, 46 nt, Homo sapiens
aggggcuccgaguguagcccgggggccgggcacguggggugggcgg

SEQ ID NO: 130546 - RNA, 41 nt, Homo sapiens
cgaggacccaccugcuggagggcagagcccugccugccccg

SEQ ID NO: 130547 - RNA, 47 nt, Homo sapiens
cgugcccaugggcucggggaggaagacgcaggaguacucuccccacu

SEQ ID NO: 130548 - RNA, 72 nt, Homo sapiens
agggcucugggaugugccgggugccucaggccaacaacuucucccgacagucgguggugcccgguaccccug

SEQ ID NO: 130549 - RNA, 43 nt, Homo sapiens
cagcaccagcaccucagccacgaugcccaggaagggccagagg

SEQ ID NO: 130550 - RNA, 24 nt, Homo sapiens
ugcuggacgagcgcgagguggugc

SEQ ID NO: 130551 - RNA, 46 nt, Homo sapiens
cgggugccuggaggacugcacgcgccaggcccccgagagccccugg

SEQ ID NO: 130552 - RNA, 42 nt, Homo sapiens
gagggccuuggcgcccagaugaaagcggugggaaggacaggg

SEQ ID NO: 130553 - RNA, 28 nt, Homo sapiens
uugcagaggggccaguugaggccuggga

SEQ ID NO: 130554 - RNA, 46 nt, Homo sapiens
aggaaaaaauauguguaucuugaaagcuauuuaaaauacacuacuu

SEQ ID NO: 130555 - RNA, 33 nt, Homo sapiens
cuaaccucacccucuaaacguucagcgguggaa

SEQ ID NO: 130556 - RNA, 78 nt, Homo sapiens
acacggccacgaaccccccuggccucacuggggugagcuucuccuccucgucgucaucguccuccuccagcucgccca

SEQ ID NO: 130557 - RNA, 46 nt, Homo sapiens
gagcucucuucaucuccgucuuccagauggggaaacugaggcucag

SEQ ID NO: 130558 - RNA, 51 nt, Homo sapiens
cgcggggcuccgcgugcccucgcccucgggugcugucuagacagagggcag

SEQ ID NO: 130559 - RNA, 62 nt, Homo sapiens
gguuggugggucuacaggagccucagccaggcagcccaccccacccuggggcccugccucac

SEQ ID NO: 130560 - RNA, 41 nt, Homo sapiens
cagaacacagccucaguuacugaucaacccgagccccgccc

SEQ ID NO: 130561 - RNA, 46 nt, Homo sapiens
ucacggcucuugucauuguuguacuugacguugaggcuggugagcu

SEQ ID NO: 130562 - RNA, 43 nt, Homo sapiens
ccgugcagucaguuggcaaagaaauuccggaucagggcaagaa

SEQ ID NO: 130563 - RNA, 48 nt, Homo sapiens; identical to SEQ ID NO: 30961

SEQ ID NO: 130564 - RNA, 45 nt, Homo sapiens; identical to SEQ ID NO: 30962

SEQ ID NO: 130565 - RNA, 58 nt, Homo sapiens
aaauucgcaaaccgaaagcaaaccauaaaacgaggcggaugccacggagcaucagagu

SEQ ID NO: 130566 - RNA, 61 nt, Homo sapiens
auggaggauuuuuuuccuaccucuccaacgcuggcuccaaaaggagaugacguuuggggug

SEQ ID NO: 130567 - RNA, 64 nt, Homo sapiens
ccagggccccagaaggcaccccccgaggcccagaggacauaggcaggcuuggggacugguagac

SEQ ID NO: 130568 - RNA, 61 nt, Homo sapiens
gggucacucgucccccagaucucagaccugggugcuccccaagauucgcgggagccucagg

SEQ ID NO: 130569 - RNA, 30 nt, Homo sapiens
aguggcucagccuugcgaaggaucaaggca

SEQ ID NO: 130570 - RNA, 72 nt, Homo sapiens
gggucaggcuuagccccaacaacucagaauuucacuuccuuguacggcccucacuuucuccaccuggccccg

SEQ ID NO: 130571 - RNA, 133 nt, Homo sapiens
ggacccgcucccugggaaccugggucacgcucuucucugggcccaguggcccuggcuuuaagagggggauauuggggguguggucucgagguccccuccaggcccuggaucaagggggaggggcugucgggga

SEQ ID NO: 130572 - RNA, 46 nt, Homo sapiens
ucgacauggcccccaaguacauccuggagcaguuucugcagcagga

SEQ ID NO: 130573 - RNA, 845 nt, Homo sapiens
gcuccaggauguacuugggggccaugucgaccagggacuggaagagagcggcucuaaggcacggcccggaggggcccagacaaccccaaccccauuuccugccucaagcuaccuggggcuuacucgugugccccaacaacacacccacgucgugaaucagaaaaccccaccgccagcccaggagccuucaacagcccgccccuccccagccucucugcucaucgagagccucauccagcagugaaguggccguggaaacucggauguguuuccauccaucacacgcuuccaggggcggcccucagagcuggcagggcgaccucuuccccauacaggggugcugcucuguguggcugcgugaaccccacagcuggugggccagggacuaaacugcucugcugacugcccgucacagcacagcagccuggcuccagaguguccgacagacagacggggaacacggauaggccccuggaggaccccgugccgggccuccucugcaagucccccuggacaucagcucaggauaaagaaccuccggcuccuggaaucugcaccaggccgagggcuggagcccacaggagcuggcgagaggcacagugcccuccgcccugacgccccuccugagagcugggggaggacggcggcugccugggguggggcccauggacgcggugggagggaggcggucggggcuugccggacaucccggccacauccuccagggcacccuggcuggccuggcccaaagcccaaggcacgugggccgccuguggguacugcuugcgggaggaggcuggggagggggagaggcuggcgggguggggcaggggugcccaccugcu

SEQ ID NO: 130574 - RNA, 60 nt, Homo sapiens
agggugggagccucucagagucgaaggucucugcuucucccuggucucugggugacugag

SEQ ID NO: 130575 - RNA, 47 nt, Homo sapiens
gaccucaccgugcugguggcccacaacgaugaccccaccgaccagau

SEQ ID NO: 130576 - RNA, 46 nt, Homo sapiens
cucguccugggucaccagauagccacggucguggcacagcugcaga

SEQ ID NO: 130577 - RNA, 210 nt, Homo sapiens
ggccuggagggccgcggagcgcgucgcaguacggucacccgcguccgugcccggccggggguggggagggggagcccccagacgccccccaccaaggucacuggagccugaggguuccccacgccggcgagcggaggcagggaucgcgcgcccgccccaacggucaccgggccggcaacggccgcggcgcuagcucaccauggucccggc

SEQ ID NO: 130578 - RNA, 41 nt, Homo sapiens
uugcgaaggauccccaacggggaggccaacgugaagaagua

SEQ ID NO: 130579 - RNA, 42 nt, Homo sapiens
accggccaagagguucuccauccggcagauccggcagcacag

SEQ ID NO: 130580 - RNA, 23 nt, Homo sapiens
agugcccaucccaccgagcccag

SEQ ID NO: 130581 - RNA, 42 nt, Homo sapiens
gcccccaacccugcccgcaaggccugcuccgccagcagcaag

SEQ ID NO: 130582 - RNA, 80 nt, Homo sapiens
cgcgcggccgcuuugguuuuuuguuugguugguuccauuuucuuuuuuucuuuuuuuuuuuaagaaaaaauaaaaggugg

SEQ ID NO: 130583 - RNA, 54 nt, Homo sapiens
cggagcaagcaggagugugcggucaauauuuauaucauccagaaaagaaaaaca

SEQ ID NO: 130584 - RNA, 38 nt, Homo sapiens
ccccaggucagcaccgcacgcgcgagaccuuucccgga

SEQ ID NO: 130585 - RNA, 45 nt, Homo sapiens
ccagcuacccgcuuccugccgcccgccgcugccaugcugcccgcc

SEQ ID NO: 130586 - RNA, 58 nt, Homo sapiens
ccgccucuggccccaaccagauguccuucaccuucgccucucccacgcagguucgggc

SEQ ID NO: 130587 - RNA, 29 nt, Homo sapiens
caaauacuuuggugaguccgguggagggc

SEQ ID NO: 130588 - RNA, 70 nt, Homo sapiens
gguggggacagcugacgaggccacgcgggcagagauccagauccgaaucgaggccaacgaggcccuggug

SEQ ID NO: 130589 - RNA, 80 nt, Homo sapiens
ggugcguacccggugucccgaggcccggccaggggcugggcagggaugccaggugggcccagccagcuccuggggucccg

SEQ ID NO: 130590 - RNA, 62 nt, Homo sapiens
cugcagagccagccgccaagguugaccucagcuucggagccaccucuggaugaacugccccc

SEQ ID NO: 130591 - RNA, 42 nt, Homo sapiens
gggaggaaccccgaucgggaacgaaagacuguagucgggaga

SEQ ID NO: 130592 - RNA, 46 nt, Homo sapiens
cgccccacguggcagccgggcccgcccccucgccccgcccccagcg

SEQ ID NO: 130593 - RNA, 28 nt, Homo sapiens
gaggcccgcuuccacgguggguaccaag

SEQ ID NO: 130594 - RNA, 73 nt, Homo sapiens
aggccugugucacccuccugggagguggccagggcccuugucugaggaaggcuuggccgcagccaagaaaaug

SEQ ID NO: 130595 - RNA, 25 nt, Homo sapiens
gggcgccgcugggggcuguggggac

SEQ ID NO: 130596 - RNA, 38 nt, Homo sapiens
cugucuuggcaguugggguguagcgugccugcgggcag

SEQ ID NO: 130597 - RNA, 142 nt, Homo sapiens
cggaggaggaggaggaggaggaagaggagggcaggagugaagggugaaggagguaggaagcaaagcccaugaagaguccaggaaaccacggucagaacuuuuuaaaaaaagaaaaaaauaauaaaaaagaagaaaagaaaaa

SEQ ID NO: 130598 - RNA, 52 nt, Homo sapiens
aucgacauuuuugacuuaaaaccugaauagggucgggggggaaaggaggcgg

SEQ ID NO: 130599 - RNA, 44 nt, Homo sapiens
ggcgagccgguuccugccuggagguuccacccucaaccagugga

SEQ ID NO: 130600 - RNA, 48 nt, Homo sapiens
ccucgcuggacagcgacgaggagacgguguuugagucccggaaucuga

SEQ ID NO: 130601 - RNA, 42 nt, Homo sapiens
cauugugucuggggcuuugauguacgauuaggaguuuuaagg

SEQ ID NO: 130602 - RNA, 54 nt, Homo sapiens
ggaugggcaggauccaggcccccaccccuguguccuaaacccacagaaccagug

SEQ ID NO: 130603 - RNA, 24 nt, Homo sapiens
gggucuggggccgugggagccucg

SEQ ID NO: 130604 - RNA, 45 nt, Homo sapiens
ucucuguggcccaugaccuucggccuggccugcugcgccguggag

SEQ ID NO: 130605 - RNA, 82 nt, Homo sapiens
ccggccacgaucaugacgucggacuggcgcgggcuggcgcggaagaccacgccaaagcgguccaugucguagcggggugcug

SEQ ID NO: 130606 - RNA, 46 nt, Homo sapiens
cccauggagaccacguagcgcggcuccggcaucuggucguagaccu

SEQ ID NO: 130607 - RNA, 45 nt, Homo sapiens
gugaggggcugcgaccgcaucgugcccguggacaucuacauccca

SEQ ID NO: 130608 - RNA, 42 nt, Homo sapiens
accugggauguagauguccacgggcacgaugcggucgcagcc

SEQ ID NO: 130609 - RNA, 46 nt, Homo sapiens
accuacggccgaggcccugcucuacggcauccugcagcugcagagg

SEQ ID NO: 130610 - RNA, 50 nt, Homo sapiens
cugcagcugcaggaugccguagagcagggccucggccguaggugggcagc

SEQ ID NO: 130611 - RNA, 121 nt, Homo sapiens
aacucguacgcacccgucgcggucccgcucccggggaagcccgcccugucccgccccucugagcucgccccaggcccugacccucccuccgcccaaaaacacgguggccaaggcuucaggg

SEQ ID NO: 130612 - RNA, 40 nt, Homo sapiens
uacgccuggcucucccgugccagggccacccccaccaaac

SEQ ID NO: 130613 - RNA, 45 nt, Homo sapiens
uuugguggggguggcccuggcacgggagagccaggcguauagugg

SEQ ID NO: 130614 - RNA, 27 nt, Homo sapiens
aguaggcgugcagucacccgggagaug

SEQ ID NO: 130615 - RNA, 45 nt, Homo sapiens
cucaccguauggccacgaguguggagcgcgugcccauggggcugg

SEQ ID NO: 130616 - RNA, 25 nt, Homo sapiens
aggcgaggucggggcucagagguca

SEQ ID NO: 130617 - RNA, 42 nt, Homo sapiens
ccgcagcacauccacauuuacagcgccagcuggggucccgag

SEQ ID NO: 130618 - RNA, 38 nt, Homo sapiens
ggggcgggacccggggugggagagggacggggaggggg

SEQ ID NO: 130619 - RNA, 50 nt, Homo sapiens
ccggccacccaggccauucauaucuuuuccuagagcgcggaccaccacgu

SEQ ID NO: 130620 - RNA, 52 nt, Homo sapiens
cccagcagccccgcggccgccgccugcgccccccuggacuccggcgccuccg

SEQ ID NO: 130621 - RNA, 51 nt, Homo sapiens
aggcgccggaguccaggggggcgcaggcggcggccgcggggcugcugggca

SEQ ID NO: 130622 - RNA, 45 nt, Homo sapiens
ccgcgcgcgcgaggagaucgaggcgcacaucacgcugcgcacugg

SEQ ID NO: 130623 - RNA, 71 nt, Homo sapiens
accgggacgcacucggucauguugacgcuuuucuugcggcugccgaucacgcucaucuggucggccagcag

SEQ ID NO: 130624 - RNA, 59 nt, Homo sapiens
gcgaagcccgcgaacacgucggggggcgacggccggggcggcggcggcggcgggggacu

SEQ ID NO: 130625 - RNA, 21 nt, Homo sapiens
agccguuugcaggggaggcgg

SEQ ID NO: 130626 - RNA, 67 nt, Homo sapiens
ggcaccgggcuugggccuccagucccugccuugcugacuuuggccguugcgguaucacgugacaauc

SEQ ID NO: 130627 - RNA, 30 nt, Homo sapiens
cuuccaaagaacauuugacucagugggguc

SEQ ID NO: 130628 - RNA, 60 nt, Homo sapiens
accucggcaaggugaaucccugcacuuaaucccgaggguggggacgcugggggcggcagu

SEQ ID NO: 130629 - RNA, 61 nt, Homo sapiens
aauauuaggggggacaccagggacgcggauggcccaguucgcaggcccaaggcggcggggg

SEQ ID NO: 130630 - RNA, 43 nt, Homo sapiens
gcaacagagcuacgcacuccuuuccuuuuggaagcaagaagaa

SEQ ID NO: 130631 - RNA, 30 nt, Homo sapiens
gcaccaggugagggcgacccugggggcagc

SEQ ID NO: 130632 - RNA, 42 nt, Homo sapiens
ccgggcgcuggaagcugcaccugacggagcgugccgacuucc

SEQ ID NO: 130633 - RNA, 55 nt, Homo sapiens
gcugggggagaauguccuggagcaggugaucagcaaggagggaggcuguugcugu

SEQ ID NO: 130634 - RNA, 59 nt, Homo sapiens
agccggaaugcggaccuggcaggcuguggggagggcuuugaucucuauccagggaauaa

SEQ ID NO: 130635 - RNA, 32 nt, Homo sapiens
gggcggggccugcgcugguggggcgggcgggg

SEQ ID NO: 130636 - RNA, 26 nt, Homo sapiens
gggguaaagggagagaggaggggggc

SEQ ID NO: 130637 - RNA, 49 nt, Homo sapiens
cuaucgacauucccguauaaagagagagacauaucacgcugcugucaug

SEQ ID NO: 130638 - RNA, 46 nt, Homo sapiens
aaacccaagaagaaagagaaaaaacacaaagagaaagagagagaca

SEQ ID NO: 130639 - RNA, 45 nt, Homo sapiens
ggucaagcacauccagaagcuucaggccaaggacgugccuguggc

SEQ ID NO: 130640 - RNA, 82 nt, Homo sapiens
agugggaccuggaggucagcaggacgggggauccgucaguaggacuggggcaggucucuggggugcuggguaugugagggug

SEQ ID NO: 130641 - RNA, 44 nt, Homo sapiens
gaucugcggggaguucucagagugagugggcgcugggccucugg

SEQ ID NO: 130642 - RNA, 25 nt, Homo sapiens
ugugaacaccgugauugcaggugag

SEQ ID NO: 130643 - RNA, 56 nt, Homo sapiens
caggggccuggugagcccccaggcugguggcauggccccccugccccgugcugaau

SEQ ID NO: 130644 - RNA, 45 nt, Homo sapiens
ccagcuacgaguucaugcggagaagccucaucuucuacaggaacg

SEQ ID NO: 130645 - RNA, 44 nt, Homo sapiens
uucauugaggacccugagaggaaguaucacuuugagugcagcag

SEQ ID NO: 130646 - RNA, 81 nt, Homo sapiens
uucccuucugcggggaaagauggagucccugcuaguuugcccagaguggcugucaaaauuccacaggccagguggcuuaaa

SEQ ID NO: 130647 - RNA, 42 nt, Homo sapiens
cuccagcccgucggagcccugcugcuggagcgcugcagaguc

SEQ ID NO: 130648 - RNA, 41 nt, Homo sapiens
gcucaggcuggggccggcgccaaaaaugucucagggcgcag

SEQ ID NO: 130649 - RNA, 103 nt, Homo sapiens
ugcuaaagcccuaaggccaucaccauggacuuccagcaucgccccgggggcaagaccgggagcgggggcguggccuccuccuccgagagcaaccgugaccgca

SEQ ID NO: 130650 - RNA, 42 nt, Homo sapiens
cucugccacccggccgugucccugcagauugacuacccugag

SEQ ID NO: 130651 - RNA, 46 nt, Homo sapiens
gaacggucugcccccucggccaccgcugccugagucuuugccaccg

SEQ ID NO: 130652 - RNA, 39 nt, Homo sapiens
ggguccaucccccagcuccuggcguccaccccccagcuc

SEQ ID NO: 130653 - RNA, 45 nt, Homo sapiens
augcccccaaugcugaggcccccacuucccuccgaaggcccaggg

SEQ ID NO: 130654 - RNA, 42 nt, Homo sapiens
caggccauccgcggaacucgaggagucgccacccagcgcaga

SEQ ID NO: 130655 - RNA, 42 nt, Homo sapiens
ugguggguuuuuuuaaggcuuucuacaaaaccaaauucagaa

SEQ ID NO: 130656 - RNA, 45 nt, Homo sapiens
gucaauggccaagaggcagaggaccacgcugucugggucccugag

SEQ ID NO: 130657 - RNA, 41 nt, Homo sapiens
gaccagucagcccgacuuuguugacaaacaccggcccaggu

SEQ ID NO: 130658 - RNA, 40 nt, Homo sapiens
ugugaggguucuguaggagggaaaagaagggguuuagugg

SEQ ID NO: 130659 - RNA, 63 nt, Homo sapiens
gaccucagugguggagaggaggagcccaccccggggagggggcgcggagggaggggcuuggcu

SEQ ID NO: 130660 - RNA, 42 nt, Homo sapiens
cauguccacguucaggcaggaggacguggaggaccauuauga

SEQ ID NO: 130661 - RNA, 41 nt, Homo sapiens
gaggcggggaacgaguucaagaacaucuucggcaccccgga

SEQ ID NO: 130662 - RNA, 41 nt, Homo sapiens
ccagugccugacccacaucucccuguucugcagccccagag

SEQ ID NO: 130663 - RNA, 23 nt, Homo sapiens
ggcaucuucaggcagcugaaaga

SEQ ID NO: 130664 - RNA, 51 nt, Homo sapiens
cggggcucagggcaggccugggcucgugggggacgugggggcgccccuggc

SEQ ID NO: 130665 - RNA, 42 nt, Homo sapiens
gcgagcaggagcuggagaugcugcagcgcgagaaggaggcag

SEQ ID NO: 130666 - RNA, 42 nt, Homo sapiens
gggccaagcccaucgaccugcuggccaaguacaucagcgcug

SEQ ID NO: 130667 - RNA, 45 nt, Homo sapiens
ugagcgccgcgagggggucaacgccuccgucagcucugaugugca

SEQ ID NO: 130668 - RNA, 46 nt, Homo sapiens
caaccgcgugcacacgggcuucgaguggaacaaguacaaccagacg

SEQ ID NO: 130669 - RNA, 73 nt, Homo sapiens
ugcccugggggggcccagcacagccccagcccggagcccagcccccugccccggcccugcuccagaacccagc

SEQ ID NO: 130670 - RNA, 103 nt, Homo sapiens
ugggcggggaugggggcggggccuagcugggaggaagaacccggaaaagauggagguagggcccggucagcagucgggacacgguggguuagagggaucccug

SEQ ID NO: 130671 - RNA, 44 nt, Homo sapiens
ucaccacgaagcccccaugcuggcccggagccuugccgcccgcc

SEQ ID NO: 130672 - RNA, 23 nt, Homo sapiens
aggugggacaagcggggcuccug

SEQ ID NO: 130673 - RNA, 33 nt, Homo sapiens
gagacuccgauccugaggcaggcagacggcggg

SEQ ID NO: 130674 - RNA, 47 nt, Homo sapiens
agacaggggagguucgggccaggggacagacagaggggugaaaacuc

SEQ ID NO: 130675 - RNA, 27 nt, Homo sapiens
ugauccauugguagugacugcccagug

SEQ ID NO: 130676 - RNA, 35 nt, Homo sapiens
cccgugucgauacacugcagugguuguccugucag

SEQ ID NO: 130677 - RNA, 46 nt, Homo sapiens
ccagcaccuugaaggggaucuuggagaucuugcggguggguuuccg

SEQ ID NO: 130678 - RNA, 40 nt, Homo sapiens
cauaguccugguccauggcgaggcagggcucggcccgcgg

SEQ ID NO: 130679 - RNA, 27 nt, Homo sapiens
cugaacugggaagucccggggaugaca

SEQ ID NO: 130680 - RNA, 55 nt, Homo sapiens
cagcccgccccgccgucccgguuuuggggggucgcagucaagcuccgccgccuag

SEQ ID NO: 130681 - RNA, 41 nt, Homo sapiens
uggccgcgcugcaggcucacgcggacgacccagagcgcgug

SEQ ID NO: 130682 - RNA, 39 nt, Homo sapiens
aucaccaucucccaauuuuccauggcgagaaaaaggaga

SEQ ID NO: 130683 - RNA, 59 nt, Homo sapiens
uaaaaggaggcagaggcuuagagggaggggcuuauaaaggaggagcucagaggggaggu

SEQ ID NO: 130684 - RNA, 48 nt, Homo sapiens
agcgauggugauuuaaaaaaaaaaaaaaucaaaacgaaucauccagaa

SEQ ID NO: 130685 - RNA, 41 nt, Homo sapiens
cuugaagcaucaccccaccuggggaggguuuggagcaugaa

SEQ ID NO: 130686 - RNA, 51 nt, Homo sapiens
cggaggcacagcccagagaagcccccguggcuccagcccggggacccuucc

SEQ ID NO: 130687 - RNA, 73 nt, Homo sapiens
aaaaaaucaggaaggcguuucauccaaggcaccucuguaacccgggacacggagggcccuaagaggcucacgg

SEQ ID NO: 130688 - RNA, 61 nt, Homo sapiens
aagacugucuuuuucccacagggugcauuccagccaagaggaguacgggguuucccggaac

SEQ ID NO: 130689 - RNA, 70 nt, Homo sapiens
agucaucgucccggccccggccgacgcggccgccugcccgccgccgccccccggcccccggcccggcccu

SEQ ID NO: 130690 - RNA, 47 nt, Homo sapiens
gggaggagggagaagcggcgcggggcaagggacccuggagucccugg

SEQ ID NO: 130691 - RNA, 42 nt, Homo sapiens
agaucgagaacuugaagggcuggccggacuggagcggggucu

SEQ ID NO: 130692 - RNA, 46 nt, Homo sapiens
gaugcauggaagaggccagaugccuugcccgggcagucaaagagac

SEQ ID NO: 130693 - RNA, 79 nt, Homo sapiens
aggcccugaggcaggacggugccuguuguguugguccugaaggcacuacgaggaagcccgcauggcuggagcagaguga

SEQ ID NO: 130694 - RNA, 42 nt, Homo sapiens
gaacgccgaccuguccaucacgcuggguacaucgcugcagau

SEQ ID NO: 130695 - RNA, 46 nt, Homo sapiens
uggcagagcuccacgggaacauguuuguggaagaaugugccaagug

SEQ ID NO: 130696 - RNA, 44 nt, Homo sapiens
ugagcgaauaaacaaaugagugaaggaaugaacgagugggugaa

SEQ ID NO: 130697 - RNA, 26 nt, Homo sapiens
guuccacagaggagugaaaacgugug

SEQ ID NO: 130698 - RNA, 45 nt, Homo sapiens
ccgccuccugcagaagauccggggccuggaacagcacaaggaacg

SEQ ID NO: 130699 - RNA, 41 nt, Homo sapiens
ugagagucaugcgugggcuugggccacaggugcagcgugag

SEQ ID NO: 130700 - RNA, 43 nt, Homo sapiens
acauugauguggccaaggucaacauccugauucggccugaugg

SEQ ID NO: 130701 - RNA, 45 nt, Homo sapiens
aaagaagaagauccgcacgucacccaccuuccggcggccgaagac

SEQ ID NO: 130702 - RNA, 46 nt, Homo sapiens
cuugaaaaagugguuguugagggcaaugacagccccagcauugaag

SEQ ID NO: 130703 - RNA, 44 nt, Homo sapiens
agguggggcucccuaggccccuccccucuucaaggggucuacau

SEQ ID NO: 130704 - RNA, 45 nt, Homo sapiens
aagcccgugguguccagcacgccuuugguggacuucuugaugcag

SEQ ID NO: 130705 - RNA, 126 nt, Homo sapiens
ugugaguaaacccagggcagguuaguuuugggugcuugugcaguauguuguccaucuccuucucaucuaaguuuuuucucucuagaauucggcucaucuccuuagcugcccagaaauucaucucag

SEQ ID NO: 130706 - RNA, 47 nt, Homo sapiens
caccugagccacccaaccuaaauguacuuaucuguccccaugucccc

SEQ ID NO: 130707 - RNA, 45 nt, Homo sapiens
ugggcagccaggagccccgaagaggccgaaggcggagagguaggg

SEQ ID NO: 130708 - RNA, 44 nt, Homo sapiens
uugcucaacucaacaaauguuaguuuagaggaggcccuuaauaa

SEQ ID NO: 130709 - RNA, 57 nt, Homo sapiens
ucucccaacuuccucaguccuuaggaugcuaacagggcuguagcagagcgaguccuc

SEQ ID NO: 130710 - RNA, 41 nt, Homo sapiens
ugcuucugccuuuucaguuucuuugauuucccacauaugga

SEQ ID NO: 130711 - RNA, 45 nt, Homo sapiens
cacggcuucuugcugcgcccgugauccuaagcauggggugugggu

SEQ ID NO: 130712 - RNA, 54 nt, Homo sapiens
gaacuguuugaagaguggaggucuuucuggacuuagguugggaguugaugagca

SEQ ID NO: 130713 - RNA, 50 nt, Homo sapiens
augcugucaucuucgucuucugauucugaacuguucucugaacugucuug

SEQ ID NO: 130714 - RNA, 41 nt, Homo sapiens
aggaguauaccucucaacugagaagaauugaggacgcucug

SEQ ID NO: 130715 - RNA, 42 nt, Homo sapiens
uuuuucucuuugguguaaaaauucuguuuucaauacuaugca

SEQ ID NO: 130716 - RNA, 46 nt, Homo sapiens
cagaugccagcaugguggaaggugauugccaaauucaaauggggag

SEQ ID NO: 130717 - RNA, 33 nt, Homo sapiens
uaaauuacacaacacguaaaaaguucugaaacc

SEQ ID NO: 130718 - RNA, 92 nt, Homo sapiens
uguacucugaggauaagacacuuaauuagcauuggauuauaguuuaggagaucauaacuccuaaaagauuuccaaguauuuuuagaggaaaa

SEQ ID NO: 130719 - RNA, 48 nt, Homo sapiens
aaauaauuuaaacuuuguacccacuggaaaagauaaauuguaucagga

SEQ ID NO: 130720 - RNA, 45 nt, Homo sapiens
uauuagacuugaaauaggaguaugaaugaaaugcagugggaacaa

SEQ ID NO: 130721 - RNA, 45 nt, Homo sapiens
gguuacugaaaucuguccaucacaauccuucaaaauuuggaauuc

SEQ ID NO: 130722 - RNA, 53 nt, Homo sapiens
cuugaaacuuauuuuucaauuugagcagauuaaaaagauugcagauaaaacua

SEQ ID NO: 130723 - RNA, 48 nt, Homo sapiens
gucuuacuaaguggacaguugaauaaguugacuuucaaagacuuauca

SEQ ID NO: 130724 - RNA, 46 nt, Homo sapiens
uugaacuucucaagguagguuuuagauuauuuuacugcuccaucau

SEQ ID NO: 130725 - RNA, 42 nt, Homo sapiens
cuucaaguagucaugaaaaaacuggaucuuauuagugaacuu

SEQ ID NO: 130726 - RNA, 45 nt, Homo sapiens
cagcguuauggacugguuaugacagaggcacaucuucccagucag

SEQ ID NO: 130727 - RNA, 46 nt, Homo sapiens
auuuuuuaagaaauuauuugccauauaaaaucuuauacuugacaac

SEQ ID NO: 130728 - RNA, 49 nt, Homo sapiens
agucacauuuaaggauuuuaagccugguuauaguauauaaaauuuagua

SEQ ID NO: 130729 - RNA, 47 nt, Homo sapiens
gauguuuuagaaauuaugagaaacauucauauauuugugucccgaua

SEQ ID NO: 130730 - RNA, 45 nt, Homo sapiens
uaauauucggcauauugcuaauucaauucgaacacauggcacggg

SEQ ID NO: 130731 - RNA, 124 nt, Homo sapiens
ugagaauauuuuccacuuuuuucuuuucuuuuuucuuuuuuaguaaaaauauguaagaggagcuuauagaaaguuuugugaacuucagcaauaaaaaauguuauuuaaauauuuucagguccaa

SEQ ID NO: 130732 - RNA, 50 nt, Homo sapiens
uucaccuaccaguuuuugaaaaagaaguucuauauauuuagccaauuuau

SEQ ID NO: 130733 - RNA, 77 nt, Homo sapiens
guaugaugaacacaucaaauccagauugauuaaagauauucgauuuuucagggaaauuaaggaccaaaaugaucaua

SEQ ID NO: 130734 - RNA, 46 nt, Homo sapiens
gcagaaaaauucaaucgaggcaucagaaaacuuggaguaacaccug

SEQ ID NO: 130735 - RNA, 45 nt, Homo sapiens
aagacaaaggcuguacucauggaucuugaacucuaggugggggaa

SEQ ID NO: 130736 - RNA, 62 nt, Homo sapiens
gcaaagucaauauaauuugcccagucauuuugauuauaaaaugugagagaaaggagccaggg

SEQ ID NO: 130737 - RNA, 57 nt, Homo sapiens
uuuauaaaaaacauucugaagagaagaccagaggguaauauguaauuuuuaugccac

SEQ ID NO: 130738 - RNA, 62 nt, Homo sapiens
ccgaaggcacagaauauuucaaaaugcuuguagacguuuuugcuccagaauuucgaaggcca

SEQ ID NO: 130739 - RNA, 45 nt, Homo sapiens
ucacuucacugguuccagucuguuagagagaaauaccugaaggag

SEQ ID NO: 130740 - RNA, 45 nt, Homo sapiens
ucagagcagacaagacugcggcugaagaaaaccaagaaaagaaag

SEQ ID NO: 130741 - RNA, 73 nt, Homo sapiens
guccuuuuggaaaauaacacagaccuagcauuaagucuuuuaaaaaaaguaaagccuguauagaucuugugug

SEQ ID NO: 130742 - RNA, 50 nt, Homo sapiens
agccauaauaacugauagugauuucaaugaacuucagucauuaaggaaag

SEQ ID NO: 130743 - RNA, 73 nt, Homo sapiens
uuuacuuaauacucagaaaauucagauaaagccauagaguccuguuugaagcuucacuucuauuuugguugaa

SEQ ID NO: 130744 - RNA, 30 nt, Homo sapiens
ccgggguaaggugaccagggguagacagga

SEQ ID NO: 130745 - RNA, 46 nt, Homo sapiens
augagggcaguguuucaggccauuacucuggcagcagugaggaggc

SEQ ID NO: 130746 - RNA, 43 nt, Homo sapiens
gcacaacguccacaaacuguauagaagcagaacaguuucagga

SEQ ID NO: 130747 - RNA, 44 nt, Homo sapiens
cugugaucugaauguuugugucccucccaaaauucacauguuga

SEQ ID NO: 130748 - RNA, 46 nt, Homo sapiens
ugcauucauguaauuugccaccuagauaauaauaauuccuaaaucc

SEQ ID NO: 130749 - RNA, 1310 nt, Homo sapiens
auguccuguuauggccaaugugugaugcuguguccggaauugguggguucuuggucucucugacuucaaggaugaagccgccaacccucgcggugaguguuacaguuccuaaaggccgcgugucuggaguuugugccuucccauguucggauguguucggaguuucuuccuucuggugggcucguggucgcgcuggcuucaggaacaaagcuguagaccuuugcagucaguguuacagcucauaaaggcaguguggacccuaagacugagcagcagcaagauuuauugcaaagagucaaaaaacaaacguuccacaguguggaacacgaccgaguggguugucacugcuaucgcgggaagccugcauuuauucccuuaucuggccccacccacauccugcugauugguccauuuuacagagagccgauuggucuguuuuacagagagcugauuggucccuuuugacagggugcugauuggugcauuuacaaaccuugagcuagacacaaaaguucuccaagaccccacuagauuagcuagacacagagcacugauuggugcauuuacaaaccuugagcuagacacaggaugcugauuggugcauuuacaaucccuuagcuagacauaaagguucuccaaguccccacuagacucaggagcccaacuggcuucacccaguggaucccgcaccaggggcugcagguggagcucccugccagucccgcugggugugcccgcacuccucagcccuuggguggucgaugggacugggugccauggagcacauggagcagggggcggugcucgucggggaggcucgggcugcaggagcccacggaggugggggagaugggggcggaggcucagacauggcgggcugcaggucccgagcccugcccggucaggaggcagcuaaggcccagugaguaaucgagugcagcgugggugggccagcacugcugggggacccggcgcacccucugcagcugcuggcgugggugcuaagccccucacugcccaggccgccggcugcuccgagugcgggguccgccaagcccaugcccacccggaacucuagcuggcgcaugcagcccugguucccgcccgugccucucccuccgcaccucccggcaggcuguuugagccagcuccggccucggccaucccaggaaggggcucccacagugcagcagugggcugaagggcuccucaagcgccgccagagugggcgcugaggacgaggaggugccaagagcgagcgagggcugcgagggcugccagcacgcucucaccucucaaugucaggcaag

SEQ ID NO: 130750 - RNA, 77 nt, Homo sapiens
gacacagugcccugcuuucagcagacacuuaagaaauugagugauuugagauggcuuugcaggggcaaccccuugaa

SEQ ID NO: 130751 - RNA, 40 nt, Homo sapiens
ugccuugguguucagguggugacaacugcucuuuaagagg

SEQ ID NO: 130752 - RNA, 34 nt, Homo sapiens
cuugaggcucaccagcucgcggaccucgguguag

SEQ ID NO: 130753 - RNA, 26 nt, Homo sapiens
cucuggacuuggcugaggucuguauc

SEQ ID NO: 130754 - RNA, 50 nt, Homo sapiens
ucagccgcuccuccaccguguucuccagggacgugaagucccgcucccgg

SEQ ID NO: 130755 - RNA, 45 nt, Homo sapiens
agcuucucaagauggacucaaaaguuccaaauguggcuugcaaag

SEQ ID NO: 130756 - RNA, 48 nt, Homo sapiens
ccuguucuaagcauagcacucagaacagaggugugagcaggugagcac

SEQ ID NO: 130757 - RNA, 45 nt, Homo sapiens
ccuucugcucgacgcccugcaagcccuggcccagcuccucccucu

SEQ ID NO: 130758 - RNA, 45 nt, Homo sapiens
agcggccgccgccaccagggcgagguagaagagaaaguugagcgc

SEQ ID NO: 130759 - RNA, 46 nt, Homo sapiens
uuuaauguuccuaguguugccaaaauaauuccgaaggcacguggag

SEQ ID NO: 130760 - RNA, 71 nt, Homo sapiens
gagggucaggaaagaagaacgguucagucugugaaagcccccuuaaaagacuggacaguucuccgagggag

SEQ ID NO: 130761 - RNA, 96 nt, Homo sapiens
ccgugaggcgccgguugcugggggagcggugacgucgcggggugaaaguugaggggcggugacgucgggccggcccgggcggaggcuggcggguug

SEQ ID NO: 130762 - RNA, 45 nt, Homo sapiens
ccacuacccccacuguagcgcccacuccucugauuccuggcccag

SEQ ID NO: 130763 - RNA, 48 nt, Homo sapiens
cucaagcgugcaagucacacccccggaauccguagaugugcaucugug

SEQ ID NO: 130764 - RNA, 43 nt, Homo sapiens
uagaugaggaaaccgaggugcaaagagcugaaaucacgcccaa

SEQ ID NO: 130765 - RNA, 45 nt, Homo sapiens
acagaaccaccugugaugaugauaucuuuaguacucaguguacuu

SEQ ID NO: 130766 - RNA, 35 nt, Homo sapiens
aacuacauugcuaucucuuugaaaaacacuaaccc

SEQ ID NO: 130767 - RNA, 42 nt, Homo sapiens
caaaauaggcaccuauaauaaaugcuuguuaacugaaugaaa

SEQ ID NO: 130768 - RNA, 48 nt, Homo sapiens
aagcaggauacagugcaaaaguaugcauacaguaugaucacagccacg

SEQ ID NO: 130769 - RNA, 49 nt, Homo sapiens
ccagugacguucaucacagaagaguguagacauaaccuugagaggccag

SEQ ID NO: 130770 - RNA, 660 nt, Homo sapiens
ggacagcuaucaguuuccaucacagugucuaacaauuaaacuguuagaugagccuacagucagcccucuguauccauagauucaaccaacagaauucaaaaauauuuaggggaggcugggcacuguagcucaugccuguaaucccagcacuuugggaggccaaggcuggcagaucaccugaggucaggaguucgagaccagccuggccaacaugguuaaaccccaucucuacuaaaauacaaaaauuaguggggugugguggcacgugucuguaaucccagcuacucaggaggcuggggcaggagaaucgcuugaaccugggaggcggagguugcagugagcugagaucgcaccacuguacuccagccugggcaaaagagcgagacucugucucaaaaaaaaaaaaaaaaauuaggggaaaaaaccucccaaaacaaugauauaacaguaaaaaauacaaauaaaaaauacaguauaacaauuuacauagcauuuauguuguauuggguauuauaaguagucuagaggugauuuaaaguauaugggagguugugcaaagguuauaugcaaguacuauaccacuuuauauuagggacuugagcaucuguggauuucaguaucuauggagguccuggaacuagccuucugaggacacugagg

SEQ ID NO: 130771 - RNA, 40 nt, Homo sapiens
ucuguaaccuccugagaaagugcaaggaccggaaauuuau

SEQ ID NO: 130772 - RNA, 32 nt, Homo sapiens
aaucaguaaacaaauauauaauucaaauuccg

SEQ ID NO: 130773 - RNA, 24 nt, Homo sapiens
ucauuacuugcugguaguucuggg

SEQ ID NO: 130774 - RNA, 115 nt, Homo sapiens
uaaucaccaugccaacauuauaagguagauucugcaauuuuucccuuuuacuaguugaggaaacugaugcauagaaagaucaagcaauuucucugagauuauacagcccuaacaa

SEQ ID NO: 130775 - RNA, 45 nt, Homo sapiens
uagcucuuuaagcugacucucuguaaaugacagucaucuagguga

SEQ ID NO: 130776 - RNA, 50 nt, Homo sapiens
ccagucucguguauucauuaauacacagcugaaaggccuaggggcuagag

SEQ ID NO: 130777 - RNA, 45 nt, Homo sapiens
guccguuaacccaugaagaaacagcccaagaggcaacgacucuag

SEQ ID NO: 130778 - RNA, 46 nt, Homo sapiens
auuggaguguuuuaagaggggaagugaugugaccuuauuuaugcuu

SEQ ID NO: 130779 - RNA, 41 nt, Homo sapiens
aauugcugcugaauuccuuuuuguccuuugcaaagagagag

SEQ ID NO: 130780 - RNA, 50 nt, Homo sapiens
gugguauacuugcacccuuucuugcuauacuauugccacacugaccucuu

SEQ ID NO: 130781 - RNA, 47 nt, Homo sapiens
cuuccgaauauccaggggaaaaaugucuuuuuaaaggaaaaaaugaa

SEQ ID NO: 130782 - RNA, 44 nt, Homo sapiens
uuucacaggaaagcuagcauuugugcugauccuagaauuuugau

SEQ ID NO: 130783 - RNA, 43 nt, Homo sapiens
uuuccuucccugacuucggaaaaaauaagccccugcaacucaa

SEQ ID NO: 130784 - RNA, 44 nt, Homo sapiens
guuuugacuucucuaauccccuuuaguuucuacauuggaaccag

SEQ ID NO: 130785 - RNA, 25 nt, Homo sapiens
auuaaagauaauuguucuaccauuu

SEQ ID NO: 130786 - RNA, 50 nt, Homo sapiens
cccucauuaaaaacagagaauuaaucagggggugauugaaggaagcaaug

SEQ ID NO: 130787 - RNA, 46 nt, Homo sapiens
acugagacucggaagcuugcccaagaucacacagcugguaagugga

SEQ ID NO: 130788 - RNA, 82 nt, Homo sapiens
uacuacucucauucuccaaccccuuuuccucccagugagucaugagaucuaccucagaaauguugccuuuucuucccacaac

SEQ ID NO: 130789 - RNA, 67 nt, Homo sapiens
cauaauuaaacugccacaaacaaaagcaaugguguuuuuuagaaaggaggaggaggaggaaagaaag

SEQ ID NO: 130790 - RNA, 47 nt, Homo sapiens
uuugccaagaucccuagcagaagauuuagccauguccuuccccucac

SEQ ID NO: 130791 - RNA, 42 nt, Homo sapiens
aucaauuuuguauaaauauauagaaacacacacacagccuca

SEQ ID NO: 130792 - RNA, 44 nt, Homo sapiens
uuguggaaaguuuggaaaaugcagaaaauaaaauuaauaauuua

SEQ ID NO: 130793 - RNA, 928 nt, Homo sapiens
uggagacacagguaaaauuggcauuaucuccuuuuuaccaggaugcuugaguuccuuguuuagugauuaucuagcugccugggcuauacugcagguaccugugucaauauuagauguggcucuugggaguaauuuuggguagaauucccaguuagaacuuccuggggcuuggaguuuagcuguccaaucauugcaguuuuaaagaggcucuggucaguagugcugacagugucuuccuuuuuuuuuuggcuuugccuauauauaaagcaugcauuguuuccuaauugacuuugugugggagcaucauggcaggagguggacguaguuaaaggauauucuccccucagcugccuuugcugccaggcuuguaaauaacagcccgccuuuggugaguaauaacuuguaccaacugacaaauacuggucagggauacuguuuuuuuuuuuuuuaaacuuuguagcugcugcuugaagauaggcuaguaagaaaaauacaucacaugguaaaauuuuuuguacuuauuugcaaguuugcugucuguacuuauguaagaauaagucauuugaacaucaacagaauaagcuagagucuuugagggaaagaggcacuuuuaguuuuugaaagaguaaacuuggugcuuugaggcauaacccucuuuuucaaggcaguaauucucuuguccgucguugcguagaguccuugugauauguuuauuuccagagcuauuucucuuccucucauguacucccaaguacucaggguuaauguuaauuaagaaaaccacauuugagccuucaguuuucaaucccaguuuaaagggaugugcguagugagauggugggcugcuuuaauguccuuauuagaagguuguaccaugcuuugcucuucuucuagaaccacugguucaccuacaaugagacaaugacag

SEQ ID NO: 130794 - RNA, 42 nt, Homo sapiens
gaagccaucaagucuucacucaucauccucaaacaaguaaug

SEQ ID NO: 130795 - RNA, 7906 nt, Homo sapiens
ugaaugcaacaaacauugagguacuuucuguuuuauuguuggauuuuuuucgguuuuuuuuuuaagagaugaggucuggcuauauugccuagacuggucuugaacucaugaguucaaguaguccucccaccccagccucucgaguagcugggacuacaggugcacacaccaugccugguuaauguuuuuuaauuuuuuuagagauggggucuugcuguguugcccagacuggucuuaaacuccuggccucaggcaauucuccugccucagccuacugaguaccugggacuauaggugagagccacugcaccuggcuguuuuauuguuuuuuauucagauaucauagcuggcauugcugaagacuacauagaucauggaaaugacauuuuuguauguuuaguuccuaagaaauuauuaacagccuuugaauaauaagcagcuucaguaaaguggugcuggcagaagccagaauucagugaguuaaagaaugaggccuggcgagguggcucacgccuguaaucccagcacuuugggaggccaaggcaggcagaucacuugaagccaggaguucgagaccagucuggccagcauggcaaaaccccgacucuaccaaaaauacaaauacuagccagguguggcggcacgcaccuguaguuccagcuacucgggaggcugaggcaucagaauugauugaacccaggauuuggaaguugcagugagcugagauugugauacugcgcuccaaccugggcgauagagcgagacucugucucaaaaauaaaauaaaaagaaugaaagggagaugaugaguggagaaaacaauaguaugcugcuuucucaagaaguuugauuagugucagcagaagauagcauuaaagaaaaggauugugucuuuuuuaggauguggaaaagucuugaaaauauaaacggagaugaaacuaguguauagaaaaauguugaaagaguugggcgcaguggccuguaaucccagcacuuugggaggcugagacagguggaucgcuugagggcaggaguucaagaccagccugcccaacauggugaaaccccaucucuacuaaaaauacaaaaauuagccaggcguggugguggacgccuguaaucccagcuacuugggaagcugaggcaugagaaucacuugaacccgggagguggagguuacagugagccgagauugcaccacugcacuccagccugggcgacagaacgagacuccgucccgaaaaaaaaaaaagcugaaagaaauaaaaggagagguuaggauagugauggaaaaguuauagaagagguaaggcaugguacacaugaaggaguugguuuugaaaaguaaaauucauucagcaucauauugaguacccauuauauagcagguauuaugcuagaugcccaggguuacagacacagaaaauccaauuccuauucaaguaguauacuguguagugcagggaacauauagauaauaagaaccuggggugauacuucuauaauagcaguaaaaacagauuccugugaguauguauaacuuagacuaaagcauuagggaagcuucuuggaagaggugaugucuggaaaagggagcagaaagguauuccaggaagacgggacaacaugugcaaaggguucaagauguaaaaauaauauuguggguaaaggaaacuuugagguuuugucugacugcugaggugugggauguauauaagauggugggggacgguaagggaugagacuggagagguauggaccagcuugggaauguccuuuuuuaguaugcuaagaguagacaggagcaaaggaaguaaugacgaguaaagauagguggguuuggcgguaaaccuggagagaugucccacauuuccccagauuuuuccuagugauuguaaagucaucugccgaggguaggugaaugcaacaguaaaauugagaaugggaaauauuuggaaaaguuguuaugagaagacagggaagaguaaaaggauugcugggccauauuaaaaucguaguugaggccaguaaucccagcacuuugggaggccaaggcaggaagaucacgugaggccagaaguucgagacuagccuggccaacauagugaaaccccgucucuacuaaaaaaauacaaaaaauuagcugggugugguggugcgugccuguaaucucagcuauucgggaggcugaggcaugagaauugcuugaaccugggcaguagagguugcagugagcugagauugcacuccagcugcacuccauccugggcaacagcacgaaacucugucucaaaaaauaaauaaauaaaauuuaaaggccaaccaaggcuguaauuauauaucaguaauuaaaccaaucaguacuuaccaggauauuuguugaccacacucaugagaaaauggaugguuggauuaauccaugguaggggauugacuaguuaagaacagaagauuagagaggacuggagaguauuguuggugaaugucucacccauagaaccagcuuucauaggcugcugugaaaggucagucuaagaaggacugacauuugggagccacugcgcuagagcccaucugcuuuaaguucuuaguccauuaguuguuccuuggagcuccagccucccuacaugaacugcuuccccuaagaaaaggaaaauauccggccaggcgugguggcucaugccuguaaucucagcacuuugggaggccgaggcuggcggaucacgaggucaggagauugagaccauccuggcuaacagggugaaaccccuucucuacuaaaaauacaaaaaaaauuagccggguaugguggcgggcgccuauagucccagcuacuccagaggcugaggcaggagaagugugaacccgugaggcggagcuugcagugagccgagaucaugccgcgccacugcacuccagccugggcgacagagcgagacugucucaaaauauauauauauauccaaguuacaucuuacaucuuucuuuuuaagaaaaucuuuauauguaccuccuucugucgaguguccuuacuuucaaugaacuuuuuugagauauaauuuauauacaguaaaauguaccuauuuuaaguuuacaauucagcggauguugacaaauguacaacccccaguaucugucaccccagucauuauauugauccucccaaaaaguucucucaugucccuuuguagucucuucccccacauugaucuacuuuuugucacuauagauuuguuuuguguucuagaauuucauauaaauguuuuuguuuguuuuuuuaagagaugaggucuggcuguauugccuagacuggucuugaacucaugagcucaaguaguccucccaccccagccucucgaguagcugggacuacaggugcacacaccaugccuggcuaauguuuuuuaauuuuuuuagagauggggucuugcuguguugcccagacuggucuuaaacuccuggccucaggcaguucuccugccucagccuccugaguaauugggacuauaggugauuauagggacuauacuucuuucacuuggcaugauuuugagauucaccuguguugcaucaauucuguuacauuucauugcugagugcuaucucauccauccuauuuuuucaccuuuauugccaagucuccuccaaacagaaccuguauuaucuccacugcuucaccucucauuuacuccucaaucacuacuauuuguuucagcuuuuauuauuuccaugagacugcuccuugcuaagauaacucuuauuugucagauuucauggucacucuuuggaacuaucauuugacuuuuuugaaggauucaccucagauuugacaguucuaaaauuaaaaucauuaucuuuccuaaaaaccauuucaucuucccauauuucuaaucuugguugaugacacccccaggguacuugucauucacacgagaaaccuggaagacuuugacuuuccuucccuuuuacucagucauuucuuugcucccuuauaaauaacucccaaauccaugucccuucuccaucccuacuuccagugccgccuuuuguucagguucccauuuuuccccuaccuuguauauuuucagaggcuuccuaauuaaucuugcccuccuccauuucaguccauuuuuuccucauugugcuacuauaguggauuuucuaagcuauaucuaaucuuaaugguucuccacuuaaaaaauauuuucuggcuggacauguggcucacaccuguaaucccagcacuuugguaagccaagauggguggaucacuugaggccaggaguucaagaccagccaggccaauauggugaaaccccugucucuaauaaaaauacaagaaauuagcuaagcacggugacaugugccuguaaucccagguacuugggaggcugaggcaugagaauugcuugaacccaggaggcggagguugcagugagcuggaaucacgccacugcacuccagagcgagacucugucucaaaaaaaaaaaaaaaaaaaaccuuuucugacuucuauugucugugagauaaauuccaaaauucuuuucauggcauaauucacuacuucuuaagucauuuguuuaaucuauuagagacuuugcuaagcauuuuacaugcaauuacaucucuuaaucuucacaacacuucuaugagauagauauuccuauuccgaaaaucuuauuuuacagaagaggaaacuggcuuugagacgguagggccaacagguaaaugguagagucaggauuugaauccaggucuggucuuaggucuuauacuuuuaaccacuuuaacguacugucucccaugagcucugacccccuacucccucuccuuuucacgucauauuccaugugcaagcuguggucuagccauacagaauuacuuucaguuuugcaaauaugucguguucuuuugugguucugugcauuugcacauuguuugcccuuccugucuuugacugucugacccauucuugccaugcuuuaauacacaacucaaaaguugcuucucccugaagccuuccugggcuccuccagaucacucuuaaacauauucuuaguucuauuacaacacuuaccugacauugaacacauuuggcaucuagcacuuaguaaauaaagacuuucuucaucuuuggauccuuagucacaaguacauguaacuaauacacaggugcuuaguaauuaauuauuggugaaauaaauugaaagaaaauaucuguucuaccugccucauagagauguuuuuugaaagugagauaauaaauagaaaaguaucuuucauauuaugcaaauacauuuauuauuaugcaaauguaagggauuauuuuuacuuaucuagugaugagcaacuuccugaaggcaguccuuggcucagacgcuauuauuaauaguauugauuugcguuccaguucuucuguaggacuguuccacucagaguuuucccaguuucugcuuuuuagccccuguaauguuuugagaaggcuagccugagucaugagugaaauucuuuaggcccucacucuuuagauuauugcucuuauauuucucuguccucaugucauugaucaucaaguaaagauauaucuuaagagaagcaguaguaacauuuuuauuuauuuauuuauuuauuuauuugagacaggaucucacuuuguugccugggcuaagugcaguggugcgaucucagcucacugcaaccuccacaucccauguucgagcaauucuugugccucagcugggccuacaggcgugugccaccaugcccgacuaauuauuguauuuuuaguagagacaggguuuugccauguucaccaggcuggucucgaacuccugaccucaagugaucugccugccccagccucccaaagugccauaauugaaggaauuacaggcuaccacgccuggccaagagaagcaguaauaauauuuguauguuuaaauauccuuggaauggaacucauggucuacaugguaaacuaauuguuuaccuauauuuugcagauauauuugggacuuuucugacauuucauguaauuagagauauaucuuuuaggagaaucuagaggagacuacaagcuuugagaggagaacuuuuuuuuuaagucuguucccagauaucagaugucuuaagacuugcagcagucuuucugaauuuuacuuauagaugaggcagaggauacuaaacaucauauaacuggauuaugcugauucucucuagcaacuuucaaguuacauuaaauauuaguacugaaaauuacuuuaaaaugcccuacuauauuuaauuuuaaaaaauuauuauuaauuaauuuauuguuuuagacagagccucuuucugucacccaggcuggagugcagugggaugaucacaacucacugcagccacaaccucccaggguuaagcaauucucccaccucagccuccugaguacgugggacacaggcguuugcuacacccccugcuaguuuuugggguuuuuuuuuuuugguagacacggggucucccuguguuguccaggcugguuuuugacucucgggcucaagugauccucccgccucagucucccaaagugcugggguuacaagcaugagcuacuguuuccagccauguguuuaauuuuaaaaauugaagaaaaaagacacuaugaggaaaugacauguaaaacacaaaucuuuugaggcaaaugugaaguggcaccuauugcucaguauugcccaaaacugugggacaugaucaacagagagaauggaaaaccuagucaugauaguuaaauuugaaauuaaccaucuucugacccuaguuuuuuauuguuguuguugcuuuuaaauguaaauauaaucuggauuuccaguuauuacugauaucuucagcagucacaacugguuuccuaugccaguguuaaugaaaucuuuucuuggccaguucuuuuaaaaaaacguaacaggccaggugcaguagcucacaucuguaauccuagcacuuugggaagcugaggugggcagaucaccugagguugggaguucgagaccagccugaccaacauggagaaucgccgucucuacuaaaaauacaaaauuagccgggugugguggcgcaugucuguaaucccagcuacucgagaggcugaggcaggagaaucgcuugaacccgggaggcggagguugcggugagccuagaucacgccauugcacuccagccugaacaacaagagcgaaacuccaucucaaaacaaaaccaaaaacaaacaaaaaaaacuuuuuuguuaaguuuugccacauaaacaauuuuagagaaaauaccugacaauaguuaaugauuauuuguuguaggcaauaauggucuaagcacuuuauauauauuaacauuuaauccucacaacuacucuaugaauuagcuauucuuauuguccucauuguacagaugaagaaauagaggcacagaguggccaaguaaccucaagucacacacacaagcucaacuuuuaaguauuuaaauauacuucaaauauauuucuaaaggagucuuuaacagaaaaaaguacugacuccauguacuuugcugcugcuuuugugaucccuguugaagugacuucaagaagugacaaugaugccaggcauuugguuaaguaugauguggugaguuaaccuuaaaauagaaaauuuggucaauaagcauuuuuauuuuggagccagagagcuauuuuagggaccugcugccuggaaaggauauccuugggacagcagaucccuuaguuccuaaugaauagcugcaucaccaacacagcuucuccugaccaugguagggccaucagcaggguaacucagcccagcuuauuaacccuucuguuuucuuuccagcuagccacagugcagccuggccagaauuuccacauguucacaaaggaag

SEQ ID NO: 130796 - RNA, 48 nt, Homo sapiens
ggacaauuucaguucuaauaauguccuuaaauuuuauuuccagcuccu

SEQ ID NO: 130797 - RNA, 42 nt, Homo sapiens
uaugcagccugguuucuagcgugacacgcccuugacuugagg

SEQ ID NO: 130798 - RNA, 46 nt, Homo sapiens
acgugcguggccuggguccgcugcggcguggccaaagagacaccag

SEQ ID NO: 130799 - RNA, 49 nt, Homo sapiens
gagauugaauuuaugaaauccuagaaaggaaaacuuggaccaaaugaga

SEQ ID NO: 130800 - RNA, 49 nt, Homo sapiens
gaagaaggugguggcagugaugaagaggagacaggcaguccuucagaag

SEQ ID NO: 130801 - RNA, 42 nt, Homo sapiens
gucuucacacucggaaguaaacuuucaaaaaagaagaaaaag

SEQ ID NO: 130802 - RNA, 65 nt, Homo sapiens
cauguugaauucuaauuauccauguauuaacuccugcagcuuuuaaaaucguuagguuuuaugag

SEQ ID NO: 130803 - RNA, 53 nt, Homo sapiens
ugaaucagcuugucacuuucuguaaaaagaaagaaaaaagucaucagagauuu

SEQ ID NO: 130804 - RNA, 45 nt, Homo sapiens
auguggcgauucagugggcagauagagagagugacuuggaaucac

SEQ ID NO: 130805 - RNA, 48 nt, Homo sapiens
gaacauguaaaugauuuugcugguugccggccauuccaaagugugcca

SEQ ID NO: 130806 - RNA, 45 nt, Homo sapiens
uuggaugcacguucagauaagccaauuuuuacacuuaaugcacac

SEQ ID NO: 130807 - RNA, 46 nt, Homo sapiens
aaucaagggcugucucgugacugcuucagcugacaaauacgugaag

SEQ ID NO: 130808 - RNA, 47 nt, Homo sapiens
ggauguguuggggaagugaauuuugaguuuagucaaauuugguggga

SEQ ID NO: 130809 - RNA, 42 nt, Homo sapiens
uguugcccugauuugccauuuauuuaugccuuuggaggucaa

SEQ ID NO: 130810 - RNA, 42 nt, Homo sapiens
gagugcaagaaauucaucuauuaguggcccuuuuggcagcag

SEQ ID NO: 130811 - RNA, 51 nt, Homo sapiens
uugaauacaauucccgaaggaaggaaugcaagaaaauguuccucucauuuu

SEQ ID NO: 130812 - RNA, 51 nt, Homo sapiens
gauugaucuucuucacaccaagcucuguuuacauuccgagaggugucauga

SEQ ID NO: 130813 - RNA, 54 nt, Homo sapiens
ggggaggcugcugcuuucaggggcccgugcuuguaaaauaaccuuccaggaaga

SEQ ID NO: 130814 - RNA, 46 nt, Homo sapiens
aagccauuaaacugagaccaauugcugugaucaaaggauagaaccu

SEQ ID NO: 130815 - RNA, 44 nt, Homo sapiens
uggacuuguacaauguuuaaauuccucuccugcaggcuccugag

SEQ ID NO: 130816 - RNA, 46 nt, Homo sapiens
cuagggccgugcauugucccgagcaaaaucucgacguaauuuagau

SEQ ID NO: 130817 - RNA, 44 nt, Homo sapiens
aaguggagcagcaugugguggacggaaaggaacggacacuguua

SEQ ID NO: 130818 - RNA, 45 nt, Homo sapiens
cugggucaaccgcucuuccaugaccuucuuaacccgucagguaca

SEQ ID NO: 130819 - RNA, 50 nt, Homo sapiens
acugguccuuaagagaaggguaugccugggcugaagacaaggagcacugc

SEQ ID NO: 130820 - RNA, 46 nt, Homo sapiens
cugccuuugcugugagaugacuagcaccuuuuauacuuauccagag

SEQ ID NO: 130821 - RNA, 32 nt, Homo sapiens
uuuuaagcaugagguacagcccauuuauugga

SEQ ID NO: 130822 - RNA, 47 nt, Homo sapiens
cggguuugacaucaacugugguguccgcuugcuaagaaccaauuuag

SEQ ID NO: 130823 - RNA, 78 nt, Homo sapiens
aaacagccugaaugcauuauucaaccuuaauaaagaaagaaaucaaucuuuuaaaauugaagggaaaagacagggaau

SEQ ID NO: 130824 - RNA, 45 nt, Homo sapiens
cuggagaaauugauguuugaggaauuaaggaaugccugucgaggu

SEQ ID NO: 130825 - RNA, 95 nt, Homo sapiens
uuuguucacuaaaccagguuuucagcauucaguaucgcauguugguuuuuaauaaagcgaugucauuucuugcaguagcgcagggcagggccugu

SEQ ID NO: 130826 - RNA, 82 nt, Homo sapiens
uuuugcuacaguuuucgccaccaugagucgcagcuauaaugaugagcugcaguucuuggagaagaucaauaaaaacugcugg

SEQ ID NO: 130827 - RNA, 45 nt, Homo sapiens
cccuuuggggccuucgaucuuucaucugugaacuaaugggagaug

SEQ ID NO: 130828 - RNA, 31 nt, Homo sapiens
gcgcaggacucggcgggcggccucccggcga

SEQ ID NO: 130829 - RNA, 43 nt, Homo sapiens
uuuuuucccccuugaauguguguggggagggggagaaugggua

SEQ ID NO: 130830 - RNA, 64 nt, Homo sapiens
ggcugggcugggcgguggggugggacagccuugccgcccucugccugugucgauucagagguga

SEQ ID NO: 130831 - RNA, 49 nt, Homo sapiens
uuuuuugguauguagugggaguagguccccauucuucccccuugcccuu

SEQ ID NO: 130832 - RNA, 41 nt, Homo sapiens
cuugccgccuuugcaugggaggaauggggcuguaggaugaa

SEQ ID NO: 130833 - RNA, 43 nt, Homo sapiens
uguucugacaggggccagugccagcagauucuuucaguaucag

SEQ ID NO: 130834 - RNA, 102 nt, Homo sapiens
agaauuuggguuuuacuagagaugguguuuuucagcaugcuuaaaauaugggcaagguuuaugacuguucgucuguaccaaugccaaggagugaucagggaa

SEQ ID NO: 130835 - RNA, 58 nt, Homo sapiens
ugccuggcacauaguaagggcaccaaacuuacuaugaaaauuacaguauuauguuugu

SEQ ID NO: 130836 - RNA, 52 nt, Homo sapiens
uaacugugucagaggaggaggaggcaggaaauaggaaauuaugcaggagggg

SEQ ID NO: 130837 - RNA, 127 nt, Homo sapiens
gaggcuggcuccugugcccaaagucuuccucgcugucucuggguauguucacaggguaugaucacauuuccccugcaugcccugcgugggaugugcuccaugugcugaugccucuggggauuuccag

SEQ ID NO: 130838 - RNA, 47 nt, Homo sapiens
cuuuuauaagaaaaggagcacacagaaggcagaaagggaccuuguuu

SEQ ID NO: 130839 - RNA, 215 nt, Homo sapiens
agggaggcaaggaaggccucucuacgaaggugacauuugaguugagaccuccaugaugagaaggggccagccagugaguaucugggggaugagguguuccuggaagagaggacagcaaguucaaaagagacagugacaaacuuggagccuggagcauuugaggaauagcuagaaguauguggcaacagcaaggccaagggagacagaggccagau

SEQ ID NO: 130840 - RNA, 40 nt, Homo sapiens
ggcaagacacuucacuugucucagccucaauuuccuagcu

SEQ ID NO: 130841 - RNA, 48 nt, Homo sapiens
agaauguuguccuaagaagcugucugcuccuaaguggccccguaagaa

SEQ ID NO: 130842 - RNA, 49 nt, Homo sapiens
cgcuggacugagcguucccagauucagugcuggagccagcgguggggag

SEQ ID NO: 130843 - RNA, 37 nt, Homo sapiens
aaaccuuccuucuggaggagcugugggugugggaagc

SEQ ID NO: 130844 - RNA, 44 nt, Homo sapiens
gucaaaugcauuggaaaugcggagauagggaaaauucccaagac

SEQ ID NO: 130845 - RNA, 47 nt, Homo sapiens
ggacugcaucugggacuccagcacauggcauagagccuagauugugg

SEQ ID NO: 130846 - RNA, 46 nt, Homo sapiens
cagcacguguucuuuaaugauugguuccuuggacacucacuagcau

SEQ ID NO: 130847 - RNA, 40 nt, Homo sapiens
cugggcagggagguuuucauauccuccagguuuaauagcu

SEQ ID NO: 130848 - RNA, 46 nt, Homo sapiens
ugugcauuaaucuguccguauuugcuccaguuucuccucuguaauu

SEQ ID NO: 130849 - RNA, 72 nt, Homo sapiens
ucaucugcuugaugguguagaccagcgugccgaagggccccuccuuuaccagcuucuuccccaccaccuugg

SEQ ID NO: 130850 - RNA, 46 nt, Homo sapiens
uaaaggaggggcccuucggcacgcuggucuacaccaucaagcagau

SEQ ID NO: 130851 - RNA, 27 nt, Homo sapiens
ugcgauaugugugugugugugagggag

SEQ ID NO: 130852 - RNA, 65 nt, Homo sapiens
uacuuuauaauuguuagauugaaccacgugaaauugcugauauuuggcuauuuguaucuacgaca

SEQ ID NO: 130853 - RNA, 42 nt, Homo sapiens
guggccuuaagcuggaggucaacaaguaccaguaccugcuga

SEQ ID NO: 130854 - RNA, 85 nt, Homo sapiens
acccaggugauaccgauaguucagccccuugcgcugggagagggugagcuggucccaccucuccacgaaguugcacagccccgug

SEQ ID NO: 130855 - RNA, 49 nt, Homo sapiens
cagcucacccucucccagcgcaaggggcugaacuaucgguaucaccugg

SEQ ID NO: 130856 - RNA, 46 nt, Homo sapiens
gaugcaggcguaguguuuggacugguagccaggguaaccgaaauug

SEQ ID NO: 130857 - RNA, 91 nt, Homo sapiens
accgaggaugggcccccccggauaaaagcaucaucaaugccacagaccccugagcgccagacccugccccaccucacuucccucccuuccc

SEQ ID NO: 130858 - RNA, 40 nt, Homo sapiens
ugucaucaucugggaagaguuaguguccaagggaagcuca

SEQ ID NO: 130859 - RNA, 45 nt, Homo sapiens
uaugcugucauaugggguuuauugggaacuauccuccuggcccca

SEQ ID NO: 130860 - RNA, 46 nt, Homo sapiens
aagaggaauacagguuccucauucuuucuggcauggcaccagaaau

SEQ ID NO: 130861 - RNA, 48 nt, Homo sapiens
uugaggauuguaauucccaccccucuugcuucuuccccaccucaccau

SEQ ID NO: 130862 - RNA, 47 nt, Homo sapiens
guauuggaggagaagggcaaagggaagagggucugggagauggugag

SEQ ID NO: 130863 - RNA, 39 nt, Homo sapiens
ugaaaggccaaccauuucaggaucagucaaaggcagcaa

SEQ ID NO: 130864 - RNA, 54 nt, Homo sapiens
cugcaugucccaaccagacugugucugucugugucugcauguaagagugaggga

SEQ ID NO: 130865 - RNA, 50 nt, Homo sapiens
agcacccaggccagaauaacagagcuuucuuaguuggugaagacuuaaac

SEQ ID NO: 130866 - RNA, 49 nt, Homo sapiens
uucuauuuuguugucguugcuuguuugaagaaaaucaugacauuccaag

SEQ ID NO: 130867 - RNA, 43 nt, Homo sapiens
ucaugggucaucugaccccuguccgucuccuugucccugcuuc

SEQ ID NO: 130868 - RNA, 75 nt, Homo sapiens
guguagucaagggccugggcacaggagggagagcugcagaguguccugccugccuuggcuggagggacaccucuc

SEQ ID NO: 130869 - RNA, 47 nt, Homo sapiens
auaaaauuauuuuaaguuuuagugucaaaagugagaugcugagagua

SEQ ID NO: 130870 - RNA, 41 nt, Homo sapiens
aucuucaguucauuccacuuuaggaaacagagcugccaauu

SEQ ID NO: 130871 - RNA, 42 nt, Homo sapiens
uguagagucuugcacacacacaagugcccaggcaaggugcuu

SEQ ID NO: 130872 - RNA, 44 nt, Homo sapiens
ccugaccaaccuacacaaguucccucccacaaguggacaucagu

SEQ ID NO: 130873 - RNA, 43 nt, Homo sapiens
gaggcugaccacaccagggagugcgaauggccagaugccucac

SEQ ID NO: 130874 - RNA, 52 nt, Homo sapiens
uggugaggaggcccugggcaaagaagggucuuucgcaaagcgaugucagagg

SEQ ID NO: 130875 - RNA, 59 nt, Homo sapiens
agcuauagcuuuguuuauuucacccguucacuuacuguauaauuuaaaaucauuuaugu

SEQ ID NO: 130876 - RNA, 49 nt, Homo sapiens
aaacccacaugccgccauuuuccugaaucaaauucugcaguggaaugga

SEQ ID NO: 130877 - RNA, 37 nt, Homo sapiens
uauuggaaucccaauggcuccuggaguaggaaaaaag

SEQ ID NO: 130878 - RNA, 49 nt, Homo sapiens
ugucacucggcccuggguagucuaccauuuacuucaccccaaguccugc

SEQ ID NO: 130879 - RNA, 46 nt, Homo sapiens
aucucuucugccucccaaucaaggaagcuccaugcucaggcucuca

SEQ ID NO: 130880 - RNA, 35 nt, Homo sapiens
ucuagugacauguuaaccuuagguagccagaagcc

SEQ ID NO: 130881 - RNA, 36 nt, Homo sapiens
aucugauggcaaaagcaaaacaaaauggaaaguagg

SEQ ID NO: 130882 - RNA, 51 nt, Homo sapiens
uaaagggaaaggcggaugcugggagaaucuaagaagccucuacccccaaag

SEQ ID NO: 130883 - RNA, 46 nt, Homo sapiens
caucuuucugugugcuuacugguguucagaagaugacugcugaaca

SEQ ID NO: 130884 - RNA, 61 nt, Homo sapiens
ucucuguuuuacuacagccauuguaguggguaugaagugguauuucacugugguuuugauu

SEQ ID NO: 130885 - RNA, 84 nt, Homo sapiens
cauuccucaugaauguaaauuuguacuauuuaacugacuauucuugauguaaaaucuugucauguguauaaaaauaaaaaagau

SEQ ID NO: 130886 - RNA, 84 nt, Homo sapiens
ccuaauccccuucuccccugcacuguaaaaugugggauuaugggucacaggaaaaaguggguuuuuuaguugaauuuuuuuuaa

SEQ ID NO: 130887 - RNA, 50 nt, Homo sapiens
aagaugaauuguaaauuauacucucaccauuuggauccuguguggagagg

SEQ ID NO: 130888 - RNA, 50 nt, Homo sapiens
acacagagcaagacgaagaugaagaaauggaugugggaacagaugaagaa

SEQ ID NO: 130889 - RNA, 46 nt, Homo sapiens
gaaugcuucgccucaguuugaacauugacccugaugcaaagguuug

SEQ ID NO: 130890 - RNA, 74 nt, Homo sapiens
cuaucuccauaugcuuuagugucugguaaaagauacccugaccgaagcguugcuguuucaaacaaaaccacagc

SEQ ID NO: 130891 - RNA, 45 nt, Homo sapiens
cuaccuuaauucgucgaagcaugucucugaucagcgggugucugg

SEQ ID NO: 130892 - RNA, 46 nt, Homo sapiens
gaaauuaaucccagacacccgcugaucagagacaugcuucgacgaa

SEQ ID NO: 130893 - RNA, 49 nt, Homo sapiens
gcaacauggagagaaucaugaaagcacaagcguaccaaacgggcaagga

SEQ ID NO: 130894 - RNA, 46 nt, Homo sapiens
ccguuugguacgcuugugcuuucaugauucucuccauguugccaga

SEQ ID NO: 130895 - RNA, 61 nt, Homo sapiens
gaauguugccaaggaaggagugaaguucgaugaaagugagaaaacuaaggagagucgugaa

SEQ ID NO: 130896 - RNA, 58 nt, Homo sapiens
aaucuucuccauuuguugagcgacuucugaaaaagggcuaugaaguuauuuaccucac

SEQ ID NO: 130897 - RNA, 105 nt, Homo sapiens
gguuccagucuucucaucauccaacugacauuacuagccuagaccaguauguggaaagaaugaaggaaaaacaagacaaaaucuacuucauggcuggguccagca

SEQ ID NO: 130898 - RNA, 53 nt, Homo sapiens
aagauugcugaugauaaauacaaugauacuuuuuggaaagaauuugguaccaa

SEQ ID NO: 130899 - RNA, 45 nt, Homo sapiens
uguuucccgcgagacucuucagcaacauaaacugcuuaagguaag

SEQ ID NO: 130900 - RNA, 44 nt, Homo sapiens
guuuauguugcugaagagucucgcgggaaacauucaaggggaga

SEQ ID NO: 130901 - RNA, 42 nt, Homo sapiens
acuuaccacacccuugacaaaauugagguauuuaggcaucau

SEQ ID NO: 130902 - RNA, 45 nt, Homo sapiens
ccguguauucaucacagacgacuuccaugauaugaugccuaaaua

SEQ ID NO: 130903 - RNA, 50 nt, Homo sapiens
auuuguacccacaucugcuccacguggucuguuugacgaauauggaucua

SEQ ID NO: 130904 - RNA, 47 nt, Homo sapiens
uaugaaugauaucaaaccaauauggcagagaccaucaaaagaaguag

SEQ ID NO: 130905 - RNA, 46 nt, Homo sapiens
agagauuaaccauaaaaaugguucucuggcuugcuuagguagcaga

SEQ ID NO: 130906 - RNA, 50 nt, Homo sapiens
agccaaagaagagaaagaagaaucugaugaugaagcugcaguagaggaag

SEQ ID NO: 130907 - RNA, 56 nt, Homo sapiens
gaagaagcaucugauuaccuugaauuggauacaauuaaaaaucucgucaaaaaaua

SEQ ID NO: 130908 - RNA, 44 nt, Homo sapiens
uguagaggagauucuucucuuuacuguaucuacauguguuacau

SEQ ID NO: 130909 - RNA, 59 nt, Homo sapiens
caucugggagucugacuccaaugaauuuucuguaauugcugacccaagaggaaacacuc

SEQ ID NO: 130910 - RNA, 73 nt, Homo sapiens
gagaagaguugguuaaaaaccuugguaccauagccaaaucugggacaagcgaguuuuuaaacaaaaugacuga

SEQ ID NO: 130911 - RNA, 53 nt, Homo sapiens
ugauaaggagaagaaccugcugcaugucacagacaccgguguaggaaugacca

SEQ ID NO: 130912 - RNA, 50 nt, Homo sapiens
cacugacugaugaaaaugcucuuucuggaaaugaggaacuaacagucaaa

SEQ ID NO: 130913 - RNA, 46 nt, Homo sapiens
uuauacaaugaauugaugauaaguuucaucauucuguuaacuucgg

SEQ ID NO: 130914 - RNA, 79 nt, Homo sapiens
agaagucggaaaaguuugccuuccaagccgaaguuaacagaaugaugaaacuuaucaucaauucauuguauaaaaauaa

SEQ ID NO: 130915 - RNA, 30 nt, Homo sapiens
cuaacacccuguauuuaaauacccggugag

SEQ ID NO: 130916 - RNA, 47 nt, Homo sapiens
gguaaaaguagagaaggaucaaggacggaugaugaaguaguacagag

SEQ ID NO: 130917 - RNA, 52 nt, Homo sapiens
gcaaccccuacccuucccuauuugaucauccuccuuggagaagugugauguu

SEQ ID NO: 130918 - RNA, 47 nt, Homo sapiens
uucagaugcugaagucuccaguagauccugaaauacggaggcaguca

SEQ ID NO: 130919 - RNA, 44 nt, Homo sapiens
cgcccggaggacuuuuucggccaccgcaaccuucggccauccca

SEQ ID NO: 130920 - RNA, 41 nt, Homo sapiens
gggacuugagacucaccggccgcacgccaugagggcccugu

SEQ ID NO: 130921 - RNA, 58 nt, Homo sapiens
gcgugcggccggugagucucaaguccccuucgaucgcaggagccgccuccacccccca

SEQ ID NO: 130922 - RNA, 48 nt, Homo sapiens
ccccuggguucggauccucacaccuccagccgcgcgguccgcccacua

SEQ ID NO: 130923 - RNA, 43 nt, Homo sapiens
gcauuuuguauaaauccaccuuguugaagaauucuucugaggu

SEQ ID NO: 130924 - RNA, 46 nt, Homo sapiens
acagagcauguucaagaacacagagaucagcuuuaagcuggggaug

SEQ ID NO: 130925 - RNA, 43 nt, Homo sapiens
uuuaaggugauaauguccccauucuuuuugaugauugugguag

SEQ ID NO: 130926 - RNA, 40 nt, Homo sapiens
gcagggggguauucuugccuucguccucccucugaguguc

SEQ ID NO: 130927 - RNA, 42 nt, Homo sapiens
gcacuccggcagcccagcacucucucacuucuggccagggaa

SEQ ID NO: 130928 - RNA, 80 nt, Homo sapiens
gcguaacagaacagagcuacuggggggaaugacagcaacuugaauacguauaaauguuagguacuugggaaaauucaaga

SEQ ID NO: 130929 - RNA, 80 nt, Homo sapiens
caacuucuauuacuuguagaacugucaucacuuaagcuacuucagcagucagaucugagucccaaaaagcuaaugaagaa

SEQ ID NO: 130930 - RNA, 46 nt, Homo sapiens
ggacgucuuugggggaaggucagcaaaugaccucuguagguacgcu

SEQ ID NO: 130931 - RNA, 57 nt, Homo sapiens
caaguaucuggaagacaggaucagagaccuggggugaggagcagaaaugguuaaucc

SEQ ID NO: 130932 - RNA, 68 nt, Homo sapiens
cacauccuuagagaucccauucucccacuugaccaguguacugcugagcccauaaccugcgucuucug

SEQ ID NO: 130933 - RNA, 60 nt, Homo sapiens
ccaacaccaagucuaguucucuagcucccauucuaucagugucauaccucccagcuuaaa

SEQ ID NO: 130934 - RNA, 53 nt, Homo sapiens
auuagaguuuaauucuuuuauagaacuccauuugagaggggcucuuaaaaauu

SEQ ID NO: 130935 - RNA, 53 nt, Homo sapiens
aagacugugaaccaacaugagaaagagcucucauuuuuagccuugagguugaa

SEQ ID NO: 130936 - RNA, 37 nt, Homo sapiens
uggaugaagggacuugagaagcugguauguugggaaa

SEQ ID NO: 130937 - RNA, 46 nt, Homo sapiens
uaucuacuugaagaaucugaaaugaggacaaggagguguguuggug

SEQ ID NO: 130938 - RNA, 50 nt, Homo sapiens
aguguguuaaaugcuacugaaaaaguaacauagggaaaggggaugagaag

SEQ ID NO: 130939 - RNA, 58 nt, Homo sapiens
gcuauuaacuaaaucggaaaauuggagaagacugcaggaggagcaggcuuaugggaga

SEQ ID NO: 130940 - RNA, 42 nt, Homo sapiens
gauuugagauuuacucguauucaggauccacagagaggagag

SEQ ID NO: 130941 - RNA, 51 nt, Homo sapiens
aaagcuaugguacaauaugcaaagucucuuagugaagcaauagaaaaauca

SEQ ID NO: 130942 - RNA, 46 nt, Homo sapiens
uuuacacagcuaacuauagauuauuauccuuaucauaaagcaggug

SEQ ID NO: 130943 - RNA, 46 nt, Homo sapiens
caaccaaaacaaaaaauggaugggccaaugaguuauugcaugaauu

SEQ ID NO: 130944 - RNA, 42 nt, Homo sapiens
ugucagcugucuauauagaauucacagaauauuacuauccag

SEQ ID NO: 130945 - RNA, 50 nt, Homo sapiens
gagaaaacucaagauagaugaaggaagacaucugcucugcaucucauagg

SEQ ID NO: 130946 - RNA, 51 nt, Homo sapiens
ugggcuguguacuuuucucaauuuuggauagauuaugaagggaugaaaagu

SEQ ID NO: 130947 - RNA, 60 nt, Homo sapiens
ggaaaaggacggccaauaaguuuuguagacucauucccucuuuccauuuggauuugucaa

SEQ ID NO: 130948 - RNA, 45 nt, Homo sapiens
uauucaucuccuaguucauguucauaaacaugucaguaugcagau

SEQ ID NO: 130949 - RNA, 41 nt, Homo sapiens
auauaaauagaauuagaaguguaacuguuaaucauauguca

SEQ ID NO: 130950 - RNA, 48 nt, Homo sapiens
ucuucacaaaugucauuggauaccauuucacuugacagcaugauauug

SEQ ID NO: 130951 - RNA, 46 nt, Homo sapiens
uguuuauaccucucuaggccaucuauaaauuuuuuggggggacagg

SEQ ID NO: 130952 - RNA, 46 nt, Homo sapiens
uccaaauccucuccugagauuucucugagauuugaaagugggccug

SEQ ID NO: 130953 - RNA, 44 nt, Homo sapiens
auccaagaaagugacucaauacaagagaagacgaccgagcaaug

SEQ ID NO: 130954 - RNA, 51 nt, Homo sapiens
aaagaaacaaucauauuuuuauacaaaauuauguuuucagguaacgaaaua

SEQ ID NO: 130955 - RNA, 45 nt, Homo sapiens
cacacuucaggagagaacuucauagcacaaugucuuucuauaaga

SEQ ID NO: 130956 - RNA, 37 nt, Homo sapiens
uaaaguucuccagauggagcuaauaugcaacaaaguu

SEQ ID NO: 130957 - RNA, 78 nt, Homo sapiens
uuuaaguauuacacagaaguaaaagaacuacagaaaauguacagcaagacaagugcccggaaguucacugauccuuca

SEQ ID NO: 130958 - RNA, 48 nt, Homo sapiens
ucuucuucacccuaaacauagcucuuucuuuauaauauuugugaugau

SEQ ID NO: 130959 - RNA, 49 nt, Homo sapiens
gucggaaaccaaagaccuccacugaucgacacagcuugagccucgauga

SEQ ID NO: 130960 - RNA, 1600 nt, Homo sapiens
uacaggacgaugguaacaguacuguccccucacuggcucucuguuuagucucccaguuuuuucaagcauugguucuauagaacuggugucuggagagcaacuuuaggcaguaguaauaaaguggaagaggugucuuguugucuuccccaaugacuugguugaguugcuuguguuuggcugugaacaaaacaucccucuaguugugauccuuugcggccacaagacuggaugguuguagacucagucuuagcuguuucuaugaaguagauuggaaauuaguccugcugcccuugugucuguauuucugcuucccagauuaaauaaaacagugguuaggacagcacaguggagugcaguaauagugacagaaacaucuugaacuucuggaccccuccccacaaaguaaagauuggaguccaugccauugaguuacuuaguaauguuuuucugaagcgccucccauguaaccagaacuauagggaggauaaaagaaauauagcaccugguugauaggaacuuacugcauguuaaggagauaagaugaauccuauggcuuaucuuagccaaacuuaacauuugugucccucuuuuauauuauuuuucugucucaaauaagugcuguagcauucaggcuugacggaaaagauagacuuuguuaaagaaaagugcagaccaucuuuuugguuucuguagaauuuguguggcucucaagucacucagugcccuucagaauaggcagcuauggacauggggggcuuugugaacugucaucugccugugucagugagccuugcuuugguaucaggcaaagggcccaucaguuucgguuuguccuuugucauugcagcaaggugguauaguuuuucuucuuaaaaaauacagaauaaugggcaaauuauaguauuaaaacacauauagguaaugcagcaauccgauaagaaagaacaaguaggccaggcaugguggcucacacuuguaauccuggcacuuugggaggccaaggcaggcggaucacgaggucaagagaucaaggccauucuggccaacaugaugaaaccucaucucugcuaaaaauacaaaaauuggaugggcguaguggcgcgcgucuucagucccagcuacucgggaggcugaggcaggagaaucgcuugaacccaggaggcggagguugcagugagcggagaucacaccacuccagccuggugacagagugagacuucgucucaaaaagaaagaaauugagaaagaaagagagggagggagggagggaaggaaggaaggaaggaacaaguaguaccuguugaaaauggucccaggaaggaaggaaggaaggaaggaagggagggaggaagggagggaggaaggaagggaggaaggaaggagggaaggagggaaggaguaaacaaguaguaccuguugaaaauggucccuggaguuuccuauuggagucucauuagcaaauuuauuuucaaauaggaauaauuacauagccacccucaaaauaugguugcauauuaugauggucauuucccuuuuugucauuaacuaucuuuuccuucuucugugucagaaauagagauguugguugaugacccccggg

SEQ ID NO: 130961 - RNA, 42 nt, Homo sapiens
caaaaggaauaagcacuauggaaaauacuucgagccagaggc

SEQ ID NO: 130962 - RNA, 2206 nt, Homo sapiens
uacuauguggaaaauggcagauugaucagguaagaggacagggggugauucuaaacgcuuuuuuuucccccauagcacuuuuucuaacauaccaaauaaguuacguguguuuauucuuugucuucaccuuuaggauauaaacucuguaggagcagcaauuuuuuucuuuuuaauauuuuguacgcugguauauccucagucccuaaaacagagauacaauaggcauucaguaaauauuuguuaaaugaaagaauguuagacuguugauaaaaauauuaacaguaucuauuggcccacauuuucuccacuccacguuuucauaaccaaaucagucuccaaaaagauacuuauuucaagaagaaacuagcacuuuuguaaagagugaggagguugauuaaaagauuauguucuuuuccagugguaaggugggagugggucagaggcaggaacucuccuauaaaaguggauggguguuuauauaaucgguuuucuuuucauguuuggggucuuguuuauauucuuggcaguagccuuaaaaccaagauuaagcccagugaagcuauccuaucagaaucuuagaugcaauuugacaagggcagguaauugauucuuuuucuggaggugugugcaugaacaguaguaggcucaggaugcaaauucagaauucaccauuucagaagcucggucuguauaggaggauucagugcuagaaaacuuucagaagugauuucuuggccgauagaaaauacuagaaauaugaacucuguuuugcuuauauauuuuuaaacuuugagaaguuccaugugaaagaaacaaaauacauauggcuagugaguuauauguaaaauuagcucuugauauuuuuaucaaugccagaugcaaauuaaaaaguaaaaaaauuagcccauaaggauuuuuuuuaaaaaaggcuaagacacuuuauuaguuauccuuaguuuacauacaauuuuuacuuauuuuaccugguaaguguggcaugaccuggaaagaaggaauauauauauuuaacaaauaguuaacccccuggggcuaaguuuuaaugcaucccuauacuucugccccuuuuucccaggcaugaaccaguccaaaccaucugugguuggcauuauaaacaaaagugcucugaaaaguacucuguccuaaggggggaaaauuuacauaaaugcuuuauuuuuaagcucuuucuacuuaaccauggucuuaguuuaaauaaacccauauguguuuauuguuaucugcuaaugacaucagcuaugaaucucagguaaacauucaaccugaaauaauguagaggcaaaugagcucauuaaaauauguacacacacauuuuuacuuugaucacaaaagcauccuauuugccaguaaauauuuuuuggagcuuuuaccauguuuuccccagucagcauuucuuaacguauuuaaugaugacuguauuuauuucugaucucaagagauuguaaugagugcucuguuaguauuuccuuuuguggggaguauaauaauugucgugacaugugccuguaaaaacauaacaguaauguaacauucacuucaaaaaaauccccaaaaaaagauuuaaggaaagcauucauugcauuucuucuuggagaaguuuaaaaaacggaaaagaaaccuuuguuaagcaaauuuuuuuccagaagaguauauaugcaaauacuuauaaagggccuuagaguauuuguaguguguucaguuaaaaaauaauaaaaagaacagcaaaacacugaagcaggauugcuccucagauuuuuccuuauuuaugucacguguguagcaucauuguagcaacauuaguacagacaacacaugucuaguuucuauucuaauacuuguucagugaaauauuuaccauuuuagaguggaaugauucagaccuuuuucuucucugaaugaaucaaaugcuguaagccuuaggaaacguuauuuuuauugucuggauagucugauuugggguucugacccccugcaaccucagugaggcagcuaucagauauuagcuacaaccgcuuccuuuucagugaggugggagggaggagcagaaacagaaggguuccugucaccagauggagagaaggauuuggguucuguuuacaugucauuggauuauuccaucaaaaugugaguucuguuuucuuuuauuuuucuagugacagagcagcaagau

SEQ ID NO: 130963 - RNA, 46 nt, Homo sapiens
ugaguuaacccaagcuucuucuucagagacucuggcaucucgggug

SEQ ID NO: 130964 - RNA, 46 nt, Homo sapiens
cagcuaauaauuccuccaaguccacaaaggauaaagaaucugccag

SEQ ID NO: 130965 - RNA, 55 nt, Homo sapiens
auacuucacuaggauuuaaaacacacacaacuaaguuaaagcugggcccaaccac

SEQ ID NO: 130966 - RNA, 62 nt, Homo sapiens
ggcuuagucucaaagcaagacuaacaaucauaagggucauagguaaauacuaaagacaguaa

SEQ ID NO: 130967 - RNA, 49 nt, Homo sapiens
guauaaugugaagcuacacauuuaaauacuuagaauucuuacagaaaag

SEQ ID NO: 130968 - RNA, 55 nt, Homo sapiens
aacuuuuuguaggcuuuauuuuuuuaaugugggcaucuuauuucauuuuugaaaa

SEQ ID NO: 130969 - RNA, 45 nt, Homo sapiens
aaaaacugccacaacaacaaacagcaaaauuuuuauccauacggg

SEQ ID NO: 130970 - RNA, 46 nt, Homo sapiens
gauugaacauccugaauacggagagguuauucagcuucaaggugac

SEQ ID NO: 130971 - RNA, 44 nt, Homo sapiens
ccggcagacgugaggcgcuuccgagcgcaggccuccgccgccac

SEQ ID NO: 130972 - RNA, 22 nt, Homo sapiens
ggggaccuuugugucucggggg

SEQ ID NO: 130973 - RNA, 43 nt, Homo sapiens
uuugcaaaaguggcaaaaagcguuuagcugaaaucuguggcuc

SEQ ID NO: 130974 - RNA, 56 nt, Homo sapiens
caaauuuuguuuugagacuuggccauuccuagggucagcaaaguguauuccuggca

SEQ ID NO: 130975 - RNA, 41 nt, Homo sapiens
ucucccugggcacucuuaaguccuuuccucccugucugcag

SEQ ID NO: 130976 - RNA, 24 nt, Homo sapiens
guggaccuuugggaaguaauuagg

SEQ ID NO: 130977 - RNA, 33 nt, Homo sapiens
uguauauuguuauucauuuggcauuguaacagc

SEQ ID NO: 130978 - RNA, 54 nt, Homo sapiens
aguaucuuguagugcuggaaaggaaggaacuauucaaacaaaaacacgaaugag

SEQ ID NO: 130979 - RNA, 16 nt, Homo sapiens
gcauuuacucucagua

SEQ ID NO: 130980 - RNA, 41 nt, Homo sapiens
uccuaaacaccugauaagauuugugucuuccuuguuacucu

SEQ ID NO: 130981 - RNA, 57 nt, Homo sapiens
uuugcucuuacuuauuucacuguaacucaguauguccuccaagucaagcacggagac

SEQ ID NO: 130982 - RNA, 56 nt, Homo sapiens
uugucuauuuauagaaacuaguauguuugcacauugacagguggguugaacccaag

SEQ ID NO: 130983 - RNA, 44 nt, Homo sapiens
auuccuuccuccaccaguacacaggaucuuucaagaagccccca

SEQ ID NO: 130984 - RNA, 41 nt, Homo sapiens
cuuuuauuaucucguuucuucugucagauaaaaaucaaguu

SEQ ID NO: 130985 - RNA, 42 nt, Homo sapiens
uggaguuggcucacacuaguucauaagagaugauuguuaaag

SEQ ID NO: 130986 - RNA, 51 nt, Homo sapiens
augaguaaaguucugacaagccaucauuguuucacguuugucuugauggaa

SEQ ID NO: 130987 - RNA, 27 nt, Homo sapiens
uauguuuuugcucugaacagauuuuug

SEQ ID NO: 130988 - RNA, 51 nt, Homo sapiens
agugacacauuauuuaauugaaagaauacuaaauaagaggcagaugaccag

SEQ ID NO: 130989 - RNA, 46 nt, Homo sapiens
ccaacgaguaaaaaucacagcauaaaaagucauuuacauucugggu

SEQ ID NO: 130990 - RNA, 47 nt, Homo sapiens
aauuggcuuuggaaaaauggaaaccuacaucaaauuggaaaagcuug

SEQ ID NO: 130991 - RNA, 38 nt, Homo sapiens
ugccaaaacaaggaagaauuuauuuuuuaggcugagau

SEQ ID NO: 130992 - RNA, 45 nt, Homo sapiens
cggccaccugaugugcuucuugguuccucggaguacucaacacag

SEQ ID NO: 130993 - RNA, 44 nt, Homo sapiens
aacauguugguacaaggcgguguguguaagugaaggaaaagaaa

SEQ ID NO: 130994 - RNA, 52 nt, Homo sapiens
acuguuagcuguuguuaguguuauucuucaaggauuaugcaaaggagaguug

SEQ ID NO: 130995 - RNA, 72 nt, Homo sapiens
aaaugaggaguucaagaacuacaacuuuccaaaauauaaaccacagccucuaauuaaccacgcacccaggua

SEQ ID NO: 130996 - RNA, 42 nt, Homo sapiens
uacuuucgaagucugggaccaagaauacaugcuuuaccagaa

SEQ ID NO: 130997 - RNA, 94 nt, Homo sapiens
cuuuauuuuuauuuguccaagguuagggucuggggugauuggggagauggcuauugauuuuuaagccuaagauucuagucuucucuauaguuag

SEQ ID NO: 130998 - RNA, 46 nt, Homo sapiens
cuuugacaauaugcucacugcugucauggggauaguaaagucagug

SEQ ID NO: 130999 - RNA, 59 nt, Homo sapiens
auauucaguuugaaagagauucaguugcaaaaggacccggguuuucgaaauucuucuua

SEQ ID NO: 131000 - RNA, 57 nt, Homo sapiens
gcguggaaccaagcuuuugguuuauaaauugaucaguaaaauuauugauguaaaaac

SEQ ID NO: 131001 - RNA, 46 nt, Homo sapiens
aaaucugacucagucaagucagggauccugaaagcugcagauggca

SEQ ID NO: 131002 - RNA, 45 nt, Homo sapiens
ucacuucgaagcauagaagcuguagacugaccccgucaacagaag

SEQ ID NO: 131003 - RNA, 47 nt, Homo sapiens; identical to SEQ ID NO: 31670

SEQ ID NO: 131004 - RNA, 45 nt, Homo sapiens
uacacuguccucuucacaguggagucuuuuuauuucagaccuaca

SEQ ID NO: 131005 - RNA, 43 nt, Homo sapiens
uuuuuguacagucgguuuuaaggucuucucugccauuagagcc

SEQ ID NO: 131006 - RNA, 46 nt, Homo sapiens
aauaacuacugucuguuuauuuaacacaacaauugaaugccugaag

SEQ ID NO: 131007 - RNA, 46 nt, Homo sapiens
aacugcaguguuuccuggaauguaaauuuagcuuugcuuaauagua

SEQ ID NO: 131008 - RNA, 30 nt, Homo sapiens
aguuauuuucaguuccuaucauuuuaaaau

SEQ ID NO: 131009 - RNA, 49 nt, Homo sapiens
acugcuuuauguauuacuaaaguuaggggagaaugaaggaaaucugaca

SEQ ID NO: 131010 - RNA, 40 nt, Homo sapiens
uuauuauaaaaacauuacuuggacauuuacugaauuucag

SEQ ID NO: 131011 - RNA, 45 nt, Homo sapiens
guuccccacacugcuuaauggccacaugccagugccaauccccag

SEQ ID NO: 131012 - RNA, 49 nt, Homo sapiens
ggccauuaagcaguguggggaacuguaggggacaaaagauuuuuacaau

SEQ ID NO: 131013 - RNA, 71 nt, Homo sapiens
aaaaguucuaagcuacucaggaugcugauaaugcuauaaauauuaaaauaauguuuaauauuaaauauuaa

SEQ ID NO: 131014 - RNA, 32 nt, Homo sapiens
aauguauuuaaagauuuagaauagauuauuuu

SEQ ID NO: 131015 - RNA, 44 nt, Homo sapiens
aagguagagcuaauuaaguuuucaauuaagaaugugugcuguaa

SEQ ID NO: 131016 - RNA, 42 nt, Homo sapiens
uauagcagguuauagcagauaugaaagaauuccaaggaagga

SEQ ID NO: 131017 - RNA, 26 nt, Homo sapiens
aaauggucuccauaucaacagcuguu

SEQ ID NO: 131018 - RNA, 43 nt, Homo sapiens
uucccaacaacccuguaacgugggcauuuuuauucuccccauu

SEQ ID NO: 131019 - RNA, 43 nt, Homo sapiens
ucugcccaucaaaaugccaccuccuccaaggacacuuuccuga

SEQ ID NO: 131020 - RNA, 448 nt, Homo sapiens
gauuugagguuccccauaaucuggguucacacacuugcuaacuucugaggacuaagcucucauuuuuuaucuugcccaaauuccuaccuaggggucuagggagucaugcccuacaaaccguaaauucucaucagauggguuuuauuugacccuauauauggugacuuacuuuucaaucugacucuggaguaacauuauggaacgaggaaaaaauauuuaaccccaaaauauauuuccuugccauaccuugaaguugccuggcaauuucaugacgucucaugccucccuaaaauauauaaaaccaaacuguaccccgaccaccuggggcacauguucucaggaccuccuguggacugugucacaggccauggucacucauauuuggcucagaauaaaucucuucaaauauuuuacagaguuugacucuucguagacacuucccucccca

SEQ ID NO: 131021 - RNA, 42 nt, Homo sapiens
ggccaaaaaacccaaaggcuuggaaaucucagcgcccccgcu

SEQ ID NO: 131022 - RNA, 56 nt, Homo sapiens
aagggcuccagggaaucggagucauggcaggcggccuccaggaagaggcuucugug

SEQ ID NO: 131023 - RNA, 45 nt, Homo sapiens
cugcggcggcguccgccuuccuggccucguccgucucggccaaga

SEQ ID NO: 131024 - RNA, 38 nt, Homo sapiens
ggagaagcuggaggagccgcccgaagacagcccccccg

SEQ ID NO: 131025 - RNA, 113 nt, Homo sapiens
uuuguguacaaguuugucucuuucccggagauccugaagauggauccucacgcgguggagaucagccgggagagccuucugcugcaggacagcgacugcaaggcgucuccgga

SEQ ID NO: 131026 - RNA, 23 nt, Homo sapiens
ucauucuuuacuacagcuggaua

SEQ ID NO: 131027 - RNA, 28 nt, Homo sapiens
ggcaagauuaucugagucagcugaaaau

SEQ ID NO: 131028 - RNA, 26 nt, Homo sapiens
cuaccccaaauuuguaacauaaaaaa

SEQ ID NO: 131029 - RNA, 41 nt, Homo sapiens
gcagcugguaucaggggaccaggcugcugggagcagggggc

SEQ ID NO: 131030 - RNA, 30 nt, Homo sapiens
uuucaagcacagaguaucuugggagugagg

SEQ ID NO: 131031 - RNA, 54 nt, Homo sapiens
gaaaaaacaaaacaaauaugaacuaugauaagcugagcagagcccugcgauacu

SEQ ID NO: 131032 - RNA, 89 nt, Homo sapiens
guggcaguuccuguugcaguugcugcuggaucagaaacaugagcauuugaucugcuggaccucgaacgauggugaauucaagcuccuca

SEQ ID NO: 131033 - RNA, 43 nt, Homo sapiens
ggaaggcuacaugacugcccagucaucgaaacugguggaucca

SEQ ID NO: 131034 - RNA, 43 nt, Homo sapiens
auaacauagggcuggguuguauggugguuauuaggguggggug

SEQ ID NO: 131035 - RNA, 130 nt, Homo sapiens
gaaacagucuuuaauuuucauuguggauuuauuaauagcuuuauuacaucuaaugaaucauuuuucugauccaaaugacuacuguuuaggagaaucugcuuaguauuuuuucccuguugaauucacaaug

SEQ ID NO: 131036 - RNA, 26 nt, Homo sapiens
aauuuaaagcucaaacugaaagacag

SEQ ID NO: 131037 - RNA, 41 nt, Homo sapiens
augcaaauccuuguuggaguugauucacagaugaaagggcu

SEQ ID NO: 131038 - RNA, 45 nt, Homo sapiens
guggcaaaguuguccuaaaaacagcccaaacagcccgaccggggu

SEQ ID NO: 131039 - RNA, 47 nt, Homo sapiens
aagagagagcccccuuagucauugcuaaguaaugucugcacacacac

SEQ ID NO: 131040 - RNA, 75 nt, Homo sapiens
cccugggagcucgcccagggccccgcugcaggcagcgcggggagcgggggacggcgagacuucgggucccuggga

SEQ ID NO: 131041 - RNA, 38 nt, Homo sapiens
aaaaaaaaagaggagcgagagaaagaaaaaaaggggga

SEQ ID NO: 131042 - RNA, 32 nt, Homo sapiens
aaacaaaacccauggcauaaagcccucuauac

SEQ ID NO: 131043 - RNA, 35 nt, Homo sapiens
auaugaaggaguaacccuauuauuuuaaauaagau

SEQ ID NO: 131044 - RNA, 28 nt, Homo sapiens
guaaggauaacaaaugagguacccccaa

SEQ ID NO: 131045 - RNA, 40 nt, Homo sapiens
ucugccaguccagggccugaccuggguuaguaguggaaag

SEQ ID NO: 131046 - RNA, 47 nt, Homo sapiens
uuggacagaaaagacuuuguugaucggggugggggcugcccuuucaa

SEQ ID NO: 131047 - RNA, 32 nt, Homo sapiens
uuaguggguagauccaucaaguagaauuuugu

SEQ ID NO: 131048 - RNA, 25 nt, Homo sapiens
cuugcccuugccccagaggccagcu

SEQ ID NO: 131049 - RNA, 48 nt, Homo sapiens
agugccaguaugcuaaguauuuagguaggcagucuuuuagauagucug

SEQ ID NO: 131050 - RNA, 42 nt, Homo sapiens
ucauagcuggacagggaaucuagugaccaacaaaacuuggga

SEQ ID NO: 131051 - RNA, 47 nt, Homo sapiens
cggacgauuguuuggugaaaaguucagacauuuuaaugcucugggag

SEQ ID NO: 131052 - RNA, 58 nt, Homo sapiens
uuuaauacuuccaauucauucuggauguagcugcugaagaaaucuguauuguuuucug

SEQ ID NO: 131053 - RNA, 46 nt, Homo sapiens
aagcuuauguugagaaguuuuccuauaagagcauaacuacugauga

SEQ ID NO: 131054 - RNA, 22 nt, Homo sapiens
ucucuuguugccuuucuuuugg

SEQ ID NO: 131055 - RNA, 46 nt, Homo sapiens
gcugccuuugacaaaucccaugaucaagcuguccgaaccuaccaag

SEQ ID NO: 131056 - RNA, 43 nt, Homo sapiens
uucgccaugucuacaccuuaagccgcggcucccgaagcaccua

SEQ ID NO: 131057 - RNA, 45 nt, Homo sapiens
augaauggagaucaaaaaucagaugcuuaugcccaagaaaaacag

SEQ ID NO: 131058 - RNA, 45 nt, Homo sapiens
gaugcugauaguuuccagcgggcccugaugguggguuggugugug

SEQ ID NO: 131059 - RNA, 29 nt, Homo sapiens
ugauaccagcagaucuguccccagugggu

SEQ ID NO: 131060 - RNA, 44 nt, Homo sapiens
cccaacaacagagcuucagcaggcaguagauacaugcuuccaga

SEQ ID NO: 131061 - RNA, 42 nt, Homo sapiens
ucuucgcagauucaaggaaaagaauuacaaauugucaaguac

SEQ ID NO: 131062 - RNA, 49 nt, Homo sapiens
uuuaagauucaggaugaucacuuugaccucuuuggggacuccacuguga

SEQ ID NO: 131063 - RNA, 59 nt, Homo sapiens
gugguucagugucugcaaugggccacuccaaaacaguaccagauccugaaggagaauua

SEQ ID NO: 131064 - RNA, 48 nt, Homo sapiens
uguggcuguaacugucauccucauacugcaagaacacggccagcagau

SEQ ID NO: 131065 - RNA, 57 nt, Homo sapiens
cccagccaucuuucuggggcuggcgugcaaaaucuacaagcggaaaaagugaccuag

SEQ ID NO: 131066 - RNA, 52 nt, Homo sapiens
uaauuuaauugguggcaauauuuuaauucuaaaauuaaauugggauuuacug

SEQ ID NO: 131067 - RNA, 49 nt, Homo sapiens
acugaguaacacugcuauugaaaaaaacauucugaagugaggguuugau

SEQ ID NO: 131068 - RNA, 45 nt, Homo sapiens
ucauaucucagccguuggcaucaggagccauuuggaaagugcaga

SEQ ID NO: 131069 - RNA, 48 nt, Homo sapiens
uggguaaggauuugggacugaagggacaugacguuggaggaauaggau

SEQ ID NO: 131070 - RNA, 51 nt, Homo sapiens
uacauuccuagauucccuacaggaguuucccugggucagggagaagcugaa

SEQ ID NO: 131071 - RNA, 46 nt, Homo sapiens
ucaguaccucuaccaggaaggaaucuugacggaaaaccauauucaa

SEQ ID NO: 131072 - RNA, 42 nt, Homo sapiens
cuuuguuagcugggaaaugccccccuccccgacucaucugcu

SEQ ID NO: 131073 - RNA, 47 nt, Homo sapiens
guaagacaaucuuauccauagacagaaaaauccaaacucaccgagag

SEQ ID NO: 131074 - RNA, 50 nt, Homo sapiens
ucagucaaauuugccucuuuuaauuaguauggguuuuaaaaaugggagaa

SEQ ID NO: 131075 - RNA, 41 nt, Homo sapiens
gaagggacuguagaauuuccauuggcuggggaacaacccag

SEQ ID NO: 131076 - RNA, 46 nt, Homo sapiens
uauuaacagaaucuucccaaucuucuaauauuucagugacuguuag

SEQ ID NO: 131077 - RNA, 75 nt, Homo sapiens
ccucucccagucacccacauccaacuccaaaugacucacauuggaucugaaccccagaauacccgaccgcacuuu

SEQ ID NO: 131078 - RNA, 32 nt, Homo sapiens
ccaaccuuucccuacagaaugauucuuaggag

SEQ ID NO: 131079 - RNA, 42 nt, Homo sapiens
accucguccuccugcucgcuccggaagcacaggcacgccgcc

SEQ ID NO: 131080 - RNA, 43 nt, Homo sapiens
ggaagggcggcuagaggcgcgcgccacgcggagacaguugcga

SEQ ID NO: 131081 - RNA, 38 nt, Homo sapiens
cagauaccaggaggauuacucuaauucaacgcagaaau

SEQ ID NO: 131082 - RNA, 43 nt, Homo sapiens
uaagugacaauuucagaaagagaagccaaggaagaaaccagag

SEQ ID NO: 131083 - RNA, 47 nt, Homo sapiens
gacuuugaaugcaggcuguugaaacuguagcccaugcuucuaaucac

SEQ ID NO: 131084 - RNA, 42 nt, Homo sapiens
gggaugcaugggggcggcgugcgggggcggcccggggcggcu

SEQ ID NO: 131085 - RNA, 38 nt, Homo sapiens
aauuuuuuuuuuuuuuaccauucuaucuugugccagau

SEQ ID NO: 131086 - RNA, 29 nt, Homo sapiens
cuuuuaagaaguuauuucuacacccagga

SEQ ID NO: 131087 - RNA, 41 nt, Homo sapiens
uuagaguacaaaugucuguggauauuauuggcacaccauuc

SEQ ID NO: 131088 - RNA, 45 nt, Homo sapiens
guaauuacaucucagcuuugagggcuccuguggcaaauucccgga

SEQ ID NO: 131089 - RNA, 66 nt, Homo sapiens
ugggauaggcccagaaguuccugaugaccgcgacuucgagcccucccuaggcccagugugccccuu

SEQ ID NO: 131090 - RNA, 56 nt, Homo sapiens
guggugcuccggguggugugguucuccgaguggccuggugcuccggguggccuggu

SEQ ID NO: 131091 - RNA, 226 nt, Homo sapiens
cuggugcuccggguggccugguucuccggguggcgugguucuccggguggccuggugcuccggguggccugguucuccagguagugugguucuccggguggccuggugcuccggguggugugguucuccggguggccuggugcuccagguggccuggugcucuggguggccuggugcuccggguggcagggugcuccgggggguguggugcuccgggugguguggu

SEQ ID NO: 131092 - RNA, 47 nt, Homo sapiens
ccugacacaacucugcuagaccugcaaaacaacaaaauaaccgaaau

SEQ ID NO: 131093 - RNA, 48 nt, Homo sapiens
caauaaaauuagcaaaguuaguccuggagcauuuacaccuuuggugaa

SEQ ID NO: 131094 - RNA, 54 nt, Homo sapiens
aaugcccaaaacucuucaggagcugcgugcccaugagaaugagaucaccaaagu

SEQ ID NO: 131095 - RNA, 46 nt, Homo sapiens
uccuacauccgcauugcugauaccaauaucaccagcauuccucaag

SEQ ID NO: 131096 - RNA, 63 nt, Homo sapiens
aggucuuccuccuucccuuacggaauuacaucuugauggcaacaaaaucagcagaguugaugc

SEQ ID NO: 131097 - RNA, 45 nt, Homo sapiens
cuuaccagaguaccuggugggcuggcagagcauaaguacauccag

SEQ ID NO: 131098 - RNA, 41 nt, Homo sapiens
uagguugucuaccuucauaacaacaauaucucuguaguugg

SEQ ID NO: 131099 - RNA, 69 nt, Homo sapiens
aagaaagcccucauuuuuauaaccuggcaaaaucuuguuaaugucauugcuaaaaaauaaauaaaagcu

SEQ ID NO: 131100 - RNA, 60 nt, Homo sapiens
auguuuuacccacaugacuuauuaugcauaaagccaaauuuccaguuuaaguaauugccu

SEQ ID NO: 131101 - RNA, 118 nt, Homo sapiens
cuuucuguugauguuaacugagcuacuagagauauucuuauuucacuaaauguaaaauuuggaguaaauauauaugucaauauuuaguaaagcuuuucuuuuuuaauuuccaggaaaa

SEQ ID NO: 131102 - RNA, 42 nt, Homo sapiens
auugagcaguuagcucauuugagauaaagucaaaugccaaac

SEQ ID NO: 131103 - RNA, 46 nt, Homo sapiens
uccccuaucaauuuaugggcaaucaucaccaaacugugcaccagaa

SEQ ID NO: 131104 - RNA, 64 nt, Homo sapiens
ggcucauucuagaucacaaccuucuagaaaacuccaagauaaaagggagaguuuucucuaaauu

SEQ ID NO: 131105 - RNA, 45 nt, Homo sapiens
gaucacaaagcugggcucuuuugaaggauugguaaaccugaccuu

SEQ ID NO: 131106 - RNA, 76 nt, Homo sapiens
aacucucuacuuagacaacaauaagaucagcaacaucccugaugaguauuucaagcguuuuaaugcauugcaguau

SEQ ID NO: 131107 - RNA, 66 nt, Homo sapiens
ggaucuguccuauaacaagcuuaaaaacauaccaacugucaaugaaaaccuugaaaacuauuaccu

SEQ ID NO: 131108 - RNA, 43 nt, Homo sapiens
uuuuacugguugcauggaaaucagccaaguuuuauaauccuua

SEQ ID NO: 131109 - RNA, 42 nt, Homo sapiens
aauuugucugguuaaaaaauaggugguagauauugaggccaa

SEQ ID NO: 131110 - RNA, 76 nt, Homo sapiens
caaacaaccucaugacuaguaauaaagaaaauaugauuuaagaggcauuaggaaggcaucuuuguccuaaacacua

SEQ ID NO: 131111 - RNA, 48 nt, Homo sapiens
ugagcauuugugaauuaggguguuuaggagugaggcagcaguauuuaa

SEQ ID NO: 131112 - RNA, 52 nt, Homo sapiens
cgggagcagcugcgccgccagcguggagcgggaggcguguggguguggagaa

SEQ ID NO: 131113 - RNA, 57 nt, Homo sapiens
uaugaggcucucaucuggcagaggguguguaacccuuuggaugguggcccacgugag

SEQ ID NO: 131114 - RNA, 27 nt, Homo sapiens
gcauccccauuuugacguguaaggggg

SEQ ID NO: 131115 - RNA, 53 nt, Homo sapiens
gucuuucagaagauccaucugugguuacuuaaguuacuuauuaagcacuguaa

SEQ ID NO: 131116 - RNA, 48 nt, Homo sapiens
ugguuccaaaaaauauuaauagggauuuccugggggaaagaggcacaa

SEQ ID NO: 131117 - RNA, 62 nt, Homo sapiens
cuuuuuuaaaaaagccauaaauccacaagggagaagagaaacccacaccaaaauuuuagaag

SEQ ID NO: 131118 - RNA, 50 nt, Homo sapiens
gguuuauucuuauugauucuaaauauugacugcaaaaaagccagauuuaa

SEQ ID NO: 131119 - RNA, 46 nt, Homo sapiens
acaugacuuuguguguacuauguguaugaggaaggauaggagauga

SEQ ID NO: 131120 - RNA, 30 nt, Homo sapiens
ugguagagacaggaucuauauauuuuuauc

SEQ ID NO: 131121 - RNA, 48 nt, Homo sapiens
cauaaauaugccaugcaccgauguaggcauagugaaacauggaaaugg

SEQ ID NO: 131122 - RNA, 48 nt, Homo sapiens
uuauugucaaaauagugaaguacaucuuuuuaauggauaaugauggua

SEQ ID NO: 131123 - RNA, 110 nt, Homo sapiens
uuauauuuuggagggaaugaugacccagugcuagcugugacacccccuguaccacugguuuuacucaugucauauucauaacauuuccuaauuaccucaucagcccucaa

SEQ ID NO: 131124 - RNA, 62 nt, Homo sapiens
auagucauaaguuugagugccagugagaugaaaauagaagacuccagacucuacuguggugg

SEQ ID NO: 131125 - RNA, 48 nt, Homo sapiens
gaagagauugcuaaugaugauacugagguaucuccucucuugggguaa

SEQ ID NO: 131126 - RNA, 23 nt, Homo sapiens
uagcagguagagaauacagauca

SEQ ID NO: 131127 - RNA, 47 nt, Homo sapiens
aggagaaaacaaaguaguuuauuuucugggagagcaaaagaaaguag

SEQ ID NO: 131128 - RNA, 38 nt, Homo sapiens
aucagagaaaugaaggcagaagaacauuucaauaggga

SEQ ID NO: 131129 - RNA, 71 nt, Homo sapiens
uaguuucaacgcagcauaaaagaggaagcuagauugucauggguugauuuaugagugggagauaguguaga

SEQ ID NO: 131130 - RNA, 46 nt, Homo sapiens
uugggaaacauuuuccuucugauauauuauacuuguaaugggcgac

SEQ ID NO: 131131 - RNA, 38 nt, Homo sapiens
cucucauggagcucagguccacagaugcauuacgaaaa

SEQ ID NO: 131132 - RNA, 47 nt, Homo sapiens
acaucucccaaugaaggugaguuuuauuaugcuuguuuuugguucuu

SEQ ID NO: 131133 - RNA, 21 nt, Homo sapiens
uuguuaauuauuuuaaugaua

SEQ ID NO: 131134 - RNA, 46 nt, Homo sapiens
ucauugggccuuucuuuuuaucagccuccagaaggggauaaugcac

SEQ ID NO: 131135 - RNA, 49 nt, Homo sapiens
guccuuacucuuaacuaguacccuaccuagacugccucccucuacugag

SEQ ID NO: 131136 - RNA, 51 nt, Homo sapiens
cuguuggggaggaagaaggugaaggugaaacugguuggauugaaggagcug

SEQ ID NO: 131137 - RNA, 27 nt, Homo sapiens
auacuuauucaaggcaacgaucuuaaa

SEQ ID NO: 131138 - RNA, 50 nt, Homo sapiens
agauugggucggucucaaggugaggacuuuggacucaauccaguaggcaa

SEQ ID NO: 131139 - RNA, 60 nt, Homo sapiens
acucauguaauggaaggcucuggaagaaugguaguuacagcuguagguguaaauucucaa

SEQ ID NO: 131140 - RNA, 57 nt, Homo sapiens
acuggaauuaucuuuaccuuacuuggagcuggaggugaagaggaagagaagaaagau

SEQ ID NO: 131141 - RNA, 42 nt, Homo sapiens
gcccaggauggugcagccauggaaaugcagccauugaagagu

SEQ ID NO: 131142 - RNA, 45 nt, Homo sapiens
uguugaugucugccaucacaguuaucauucuaguauuauauuuug

SEQ ID NO: 131143 - RNA, 46 nt, Homo sapiens
auaaaugaaaaacauuauaaaaagguuccugaaccagaagcuauuc

SEQ ID NO: 131144 - RNA, 41 nt, Homo sapiens
augugccuuguugggacuucuuuuggauuuaaaacgggauu

SEQ ID NO: 131145 - RNA, 46 nt, Homo sapiens
cagguaagggguugacuacgcuuggcuuuuuaccuuaaaagaagaa

SEQ ID NO: 131146 - RNA, 55 nt, Homo sapiens
caaaagacaagguuuagagaaguucuagaguaauugauaaauggagaacugucaa

SEQ ID NO: 131147 - RNA, 152 nt, Homo sapiens
aguucccaaccuagccuaauagcaucuuuuuauugaguucucacugugugccauauacuuaagccauguguuuuacaaguaauuuuuuuaaaugucuaccuuuaugagguaugcauauuauuacucuuauuuggcagauuuuuaagaaucaa

SEQ ID NO: 131148 - RNA, 53 nt, Homo sapiens
ucugauucuuaaagaaggaggaaguauuaucuaaaccaagaaagagagcgagc

SEQ ID NO: 131149 - RNA, 60 nt, Homo sapiens
ugcuuuaaaaagccuucuguaaauaaauacugcaaacaaauuaguagaugacaacugaaa

SEQ ID NO: 131150 - RNA, 76 nt, Homo sapiens
auggucacuggugauaauauuaauacugcucgggccauugcuaccaaaugugguauuuuacauccuggggaagauu

SEQ ID NO: 131151 - RNA, 55 nt, Homo sapiens
uucugugccuagaagguaaagauuuuaacagaagaauacgaaaugaaaaaggaga

SEQ ID NO: 131152 - RNA, 46 nt, Homo sapiens
cgccagguuguagcuguaacuggugaugguacaaaugauggcccag

SEQ ID NO: 131153 - RNA, 37 nt, Homo sapiens
aucccccgcccuaccccaucccaaauuuaaaugguug

SEQ ID NO: 131154 - RNA, 42 nt, Homo sapiens
ccucucaucucacguacaaugaugaagaauauuuugggucau

SEQ ID NO: 131155 - RNA, 46 nt, Homo sapiens
uggguaauuggaaaagauaguuucaaauuugccuguuaaaugggag

SEQ ID NO: 131156 - RNA, 54 nt, Homo sapiens
ugcaguuugguggaaaaccuuucaguuguucagaacuuucaauagaacaguggc

SEQ ID NO: 131157 - RNA, 51 nt, Homo sapiens
gaagcuggucauggaacacaaaaggaagaaauaccugaggaggaauuagca

SEQ ID NO: 131158 - RNA, 88 nt, Homo sapiens
guugcggcguggccaaaucuugugguuuagaggucugaacagaauccaaacacagguaugggccugguagagagguaggagagaugau

SEQ ID NO: 131159 - RNA, 47 nt, Homo sapiens
ugaaugcauuucguaguucuuuauaugaaggguuagaaaaaccggaa

SEQ ID NO: 131160 - RNA, 47 nt, Homo sapiens
aagauucagagccucauaucccccuuauugaugacacugaugccgaa

SEQ ID NO: 131161 - RNA, 44 nt, Homo sapiens
aaaaaaaagcaaagcuuucugccagacugagggugcuuuuuggg

SEQ ID NO: 131162 - RNA, 42 nt, Homo sapiens
agauaacacuaaugcuuuguuuaaaaaaacgaaaaaaacaaa

SEQ ID NO: 131163 - RNA, 43 nt, Homo sapiens
aauaaccuuuuguucagaauuuaguagauuguuuaaugcagga

SEQ ID NO: 131164 - RNA, 42 nt, Homo sapiens
ugggagucucagcugucuauguugagaaacacugcauuaguc

SEQ ID NO: 131165 - RNA, 41 nt, Homo sapiens
ggguaguaaccaggacuggaauaagagcgaugaauggaagg

SEQ ID NO: 131166 - RNA, 44 nt, Homo sapiens
ucuggcauucagggauacuaaagccucagaaacggaugcccuca

SEQ ID NO: 131167 - RNA, 41 nt, Homo sapiens
gucagggcccgcggccggguccagcuuggugguugcgguag

SEQ ID NO: 131168 - RNA, 65 nt, Homo sapiens
aguugacccagaugaccugccccgucaagaagaacuggcagauaauuuauugauuuccuuaucca

SEQ ID NO: 131169 - RNA, 45 nt, Homo sapiens
gcuaaaaagugaaaagcaagaaaaugugauacaccuuuucagaau

SEQ ID NO: 131170 - RNA, 67 nt, Homo sapiens
uuauauuugaggaaacaaggugcagcaaguuuguagcagacuguagagaaaacaaaucuuggguaag

SEQ ID NO: 131171 - RNA, 31 nt, Homo sapiens
cuggcuuuggaagaaguagaaaaagcuggag

SEQ ID NO: 131172 - RNA, 46 nt, Homo sapiens
gagcuuauagucuugggaaauauacagaaagauuacuaguaacuga

SEQ ID NO: 131173 - RNA, 143 nt, Homo sapiens
ggggauuugaggaauagugacgaaaggguguuauagaaguaauuuuugacaaagcugaaggcuaaaauaugaauguauuguugaagaacaaaauacauugagauuccugagaagguaggaaugugauacaaauggaucagccu

SEQ ID NO: 131174 - RNA, 52 nt, Homo sapiens
aaauuugccaacuugaaaaacaauuagaacaaaaagauagagaauuggagga

SEQ ID NO: 131175 - RNA, 46 nt, Homo sapiens
cagaagcuaaugagaaaauugaaguucagaaucaagaaaugagaaa

SEQ ID NO: 131176 - RNA, 44 nt, Homo sapiens
agaaugaaagcuauugugcaucagacagauaauguaauagauca

SEQ ID NO: 131177 - RNA, 46 nt, Homo sapiens
aaaugaagaagaugauccaauuaugguagcugucaaugcaaaagua

SEQ ID NO: 131178 - RNA, 45 nt, Homo sapiens
gcugucguugaaauaaagaauuguaaaaaccaaauuaaaauaaga

SEQ ID NO: 131179 - RNA, 36 nt, Homo sapiens
gcaguacagagcugaaaaccagauucuuuugaaaga

SEQ ID NO: 131180 - RNA, 48 nt, Homo sapiens
gcuguuucccuggcagacacacaggcgcucacgagucucuccuugcca

SEQ ID NO: 131181 - RNA, 67 nt, Homo sapiens
acgaauugauggauggaugccgggaaggacucgcugcguccuggggugggaggagggagggcagcuc

SEQ ID NO: 131182 - RNA, 43 nt, Homo sapiens
ugcccucccuccucccaccccaggacgcagcgaguccuucccg

SEQ ID NO: 131183 - RNA, 60 nt, Homo sapiens
uugcugggaggcuggagucuggcucacacauucagaacauuugcagguuacugagacaac

SEQ ID NO: 131184 - RNA, 44 nt, Homo sapiens
uuauauacauucaggggucuuaguacuggguagcuuauauaagu

SEQ ID NO: 131185 - RNA, 46 nt, Homo sapiens
caggggaagcccuuguuccagaggaagaggaggugguggcugccaa

SEQ ID NO: 131186 - RNA, 16 nt, Homo sapiens
auguguguaugcaugu

SEQ ID NO: 131187 - RNA, 45 nt, Homo sapiens
agaagaaagccacacuaauucagggaaagaacacuuucccagggc

SEQ ID NO: 131188 - RNA, 81 nt, Homo sapiens
gacaaauauggaauuaaaaauguggcacccaguaaaaauauagcagggugucuagcgcuuucucaauuucauuaauuuaga

SEQ ID NO: 131189 - RNA, 57 nt, Homo sapiens
aauagaaauuuaaaguuacuauuguuguggaggaacccaguuguauuggcuuagagg

SEQ ID NO: 131190 - RNA, 68 nt, Homo sapiens
uggauauaguacauuuuaucauuuagcuuaugguugauacaucuccauuguguuguauccuuuauaga

SEQ ID NO: 131191 - RNA, 55 nt, Homo sapiens
aaguuuuagaguuauuuuuauguugugagauauauuuuugaaaccuucgcaucag

SEQ ID NO: 131192 - RNA, 44 nt, Homo sapiens
uucuuuuuagaaaagcuguaacacuuuaugcucaugccuuucaa

SEQ ID NO: 131193 - RNA, 25 nt, Homo sapiens
auguaugguaugagcccuuuggggg

SEQ ID NO: 131194 - RNA, 49 nt, Homo sapiens
ugaaccuuuuauuucaugaggaaugacugcuugacgaugugaugaacac

SEQ ID NO: 131195 - RNA, 68 nt, Homo sapiens
aguggacuacagaaaguucagagaaaagcuaaguauaauuaccaaaaaggcaagucauuuuugaagga

SEQ ID NO: 131196 - RNA, 53 nt, Homo sapiens
caaagggguuuuaaaggauaaaauuuggguuuuagaauuuuaaacaauccaau

SEQ ID NO: 131197 - RNA, 27 nt, Homo sapiens
uguuguuuauagguacauuuguuguuu

SEQ ID NO: 131198 - RNA, 43 nt, Homo sapiens
uauaucaaaagacauuuuaauuuucuuauaaucuuuuucacag

SEQ ID NO: 131199 - RNA, 31 nt, Homo sapiens
uguauguuucuauaugcauguguguagauau

SEQ ID NO: 131200 - RNA, 33 nt, Homo sapiens
uguacauauaguaacaacuaagauggguucuug

SEQ ID NO: 131201 - RNA, 51 nt, Homo sapiens
uuccauggcacguauaaaagugcuauguaaguaaggguuaguguuuauuua

SEQ ID NO: 131202 - RNA, 28 nt, Homo sapiens
aguauucuuuuguaacuuguuuuuuaag

SEQ ID NO: 131203 - RNA, 46 nt, Homo sapiens
uaggcuugcauugaugacaauguugauauggugaaguuucugguag

SEQ ID NO: 131204 - RNA, 61 nt, Homo sapiens
aguuuuagggaagugaugaccuuucagacuguuuuuuuggaagauucuugacaaauuagag

SEQ ID NO: 131205 - RNA, 41 nt, Homo sapiens
ucuuuuuaguuuuauauacauuuucaaaacuaugaaaacag

SEQ ID NO: 131206 - RNA, 49 nt, Homo sapiens
ggggcugucaacagugaaggagauacaccuuuagauauugcggaggagg

SEQ ID NO: 131207 - RNA, 52 nt, Homo sapiens
uuaaguauuuuuaaaguuaaaagaaauguuagaagcagcaggaucaggcaua

SEQ ID NO: 131208 - RNA, 47 nt, Homo sapiens
caaugagggaaugagucaugaugaucuggggaaagagcauuccagac

SEQ ID NO: 131209 - RNA, 42 nt, Homo sapiens
uugauguagagggccaacuccugcugaaaugugcuucaucag

SEQ ID NO: 131210 - RNA, 39 nt, Homo sapiens
uaauucuuuaaaguaaacauuuaaggcuccuauuuuuua

SEQ ID NO: 131211 - RNA, 36 nt, Homo sapiens
ggacuucaugaguauauauuggguuuguaguacuaa

SEQ ID NO: 131212 - RNA, 49 nt, Homo sapiens
guccuuacuacucuguagagacccuguccuucuaaacagaacauuccua

SEQ ID NO: 131213 - RNA, 45 nt, Homo sapiens
agacuaugauggcuggacaccucuucaugcugcagcucauugggg

SEQ ID NO: 131214 - RNA, 44 nt, Homo sapiens
uugguuagaauaagugaguaaagaaaaaugaagaaacuaugaag

SEQ ID NO: 131215 - RNA, 53 nt, Homo sapiens
cugguugcuuugagugacacugcuuauauacuauaaauguguuuauacucuau

SEQ ID NO: 131216 - RNA, 38 nt, Homo sapiens
uuguuuaaagagcauguuuaaguugaugaguuaaguug

SEQ ID NO: 131217 - RNA, 54 nt, Homo sapiens
gauuucagaacuauuuauucuucaggaauuuaaauuuuggcuucuauuucccaa

SEQ ID NO: 131218 - RNA, 49 nt, Homo sapiens
ccauccccccuuguuuccuacguagggccaaacagccuuugauguagca

SEQ ID NO: 131219 - RNA, 48 nt, Homo sapiens
aaugcaucccguauugaaucucuggaacaagaaaagguugaugaagaa

SEQ ID NO: 131220 - RNA, 44 nt, Homo sapiens
uaaaagauaaaugcauuuucguugaauuuuguggcaguguaaaa

SEQ ID NO: 131221 - RNA, 75 nt, Homo sapiens
cuacuaaauuaucuuucagugaaugcuagaaacuuacauauaguugugaauuuauuauuauuuaauuaucuggag

SEQ ID NO: 131222 - RNA, 26 nt, Homo sapiens
gccggucccaacagcaucccaaauuu

SEQ ID NO: 131223 - RNA, 61 nt, Homo sapiens
uguagcuguuacaacaccuacugugucaucaggucaagcaacaccuacaucaccuauuaaa

SEQ ID NO: 131224 - RNA, 65 nt, Homo sapiens
auucugaauuuuuauagucuguuccaaaaauauguaagauuucagaauauaaauauguauuuaug

SEQ ID NO: 131225 - RNA, 58 nt, Homo sapiens
ugauauuacaguugguaguuaacaaauauuacauacaguugauaguuaauaaauggca

SEQ ID NO: 131226 - RNA, 42 nt, Homo sapiens
ugcauguugauaauuucacacacggguaaauuacaaauacua

SEQ ID NO: 131227 - RNA, 118 nt, Homo sapiens
aaagaagaagagagaaaagaugagucuccugcaacuuggagguuaggacuuagaaagacgggcagcuauggugcacuugcugaaaucacagcaucuaaagagggucagaaagaaaaag

SEQ ID NO: 131228 - RNA, 46 nt, Homo sapiens
uucaagucccagacuuuccuccucuuuggauaauaaagaaaaggua

SEQ ID NO: 131229 - RNA, 67 nt, Homo sapiens
gaacuaggcuugcauauguugcaccuacaauaccaagacgacuagccaguacaucugacauugaaga

SEQ ID NO: 131230 - RNA, 48 nt, Homo sapiens
auucuucaaguuugcgaacaaguaguucauauacaaggagaaaauggg

SEQ ID NO: 131231 - RNA, 49 nt, Homo sapiens
aagcacuacuacaaagauuacaacggguucuuccucagcaggcacacaa

SEQ ID NO: 131232 - RNA, 42 nt, Homo sapiens
augcugcagcuucuaccacaacccugacuacaacuacugcug

SEQ ID NO: 131233 - RNA, 62 nt, Homo sapiens
aacuagcaauuauuuauauuuaggcuuugcgacucaccucugacagaauuaauguuuuuuug

SEQ ID NO: 131234 - RNA, 50 nt, Homo sapiens
ggaaaucgggggcagagaauaggcucguauauuagguauaaacaacuaau

SEQ ID NO: 131235 - RNA, 96 nt, Homo sapiens
agaagcugagaaaacaauaggaagaagucguucuacccgaaccagagaacaagaaaaugaagaaaaagaaaaagaggaaaaagagaaacaagauaa

SEQ ID NO: 131236 - RNA, 50 nt, Homo sapiens
agucuuguaggcauaacuucugcuuacuccagaggaauaacaaaagaaaa

SEQ ID NO: 131237 - RNA, 54 nt, Homo sapiens
ugguucauugcaauccuuaacagagggagaaaaaagagaagaggagaaagaagg

SEQ ID NO: 131238 - RNA, 87 nt, Homo sapiens
agaagauaaaucacaaccuaaaucaaucagagaacgacgacgaccaagagagaaaagaagaucuacaggaguuucauuuuggacaca

SEQ ID NO: 131239 - RNA, 46 nt, Homo sapiens
aacaacaaucagacacagaagagggauccaauaagaaagaaacuca

SEQ ID NO: 131240 - RNA, 23 nt, Homo sapiens
acaagaacugugugauuccacuu

SEQ ID NO: 131241 - RNA, 24 nt, Homo sapiens
cugaauaaauuauagaaucaguga

SEQ ID NO: 131242 - RNA, 42 nt, Homo sapiens
cauaaaaauuuaguaugccuauguuuuucucuuucuuuccag

SEQ ID NO: 131243 - RNA, 61 nt, Homo sapiens
gaucacuagucagagcaaguaagauuuuuccccaaaucucuacaacaaagguauuccaaag

SEQ ID NO: 131244 - RNA, 45 nt, Homo sapiens
cauacaguuacuuagaagaaagaaaaccuuacagcagcaggcuag

SEQ ID NO: 131245 - RNA, 55 nt, Homo sapiens
uacaugauacaaauauggaacuaacagaucuuaaauuacaguuggaaaaggccac

SEQ ID NO: 131246 - RNA, 46 nt, Homo sapiens
caagaaagauuugcugauagaucacuguuggaaauggaaaaaaggg

SEQ ID NO: 131247 - RNA, 47 nt, Homo sapiens
cugcaaguuuuuauugauuguaauacauucacuuguauuucucuuca

SEQ ID NO: 131248 - RNA, 46 nt, Homo sapiens
auauacuuucauguuuuuuggcgaguaaguaguggaggggguuacu

SEQ ID NO: 131249 - RNA, 46 nt, Homo sapiens
ccuaaaagcagacaaccagaggcuaaaggaugaaaauggggccuug

SEQ ID NO: 131250 - RNA, 46 nt, Homo sapiens
cuuguuuacagcuccagcauauaaggaaaguguucaaggccagaua

SEQ ID NO: 131251 - RNA, 47 nt, Homo sapiens
cuucauuuuaaaaggucauuguguucuacugccuauuuuagauuacu

SEQ ID NO: 131252 - RNA, 49 nt, Homo sapiens
acuaccaagcucaggauucuugauuuuaaagguacaaggauaguugugg

SEQ ID NO: 131253 - RNA, 45 nt, Homo sapiens
auugagaauuuccauggucuuauguggagguaaaauauacagaua

SEQ ID NO: 131254 - RNA, 45 nt, Homo sapiens
guuaggcaugcuaugguuuauauuugugaaguuuggaugccugug

SEQ ID NO: 131255 - RNA, 60 nt, Homo sapiens
aacaugguuuuaagaugugggaagccagccuucugaaaaugaguugcuuuauuucuuuuu

SEQ ID NO: 131256 - RNA, 46 nt, Homo sapiens
uuucccaggcucuccuaacguuucagacacaaauauuagacgguau

SEQ ID NO: 131257 - RNA, 50 nt, Homo sapiens
cucuccuguaucuuuuucacuccagcccuccuucaucguuacauguuuag

SEQ ID NO: 131258 - RNA, 25 nt, Homo sapiens
uaugaaaagaaggcugcgaagcuga

SEQ ID NO: 131259 - RNA, 65 nt, Homo sapiens
uggcauggaaauuuaaagcagguucuuguuggugcacagcacaaauuaguuauauauggggaugg

SEQ ID NO: 131260 - RNA, 45 nt, Homo sapiens
gcccuggucuugcgggcaccgaaagucgaucuccuugcccucugc

SEQ ID NO: 131261 - RNA, 39 nt, Homo sapiens
auugcagacauauauggcuguuugguagaaacauuacag

SEQ ID NO: 131262 - RNA, 54 nt, Homo sapiens
uccuguguccuaaucagucucuugcuauguguucuaauuuauuaaaguuucgua

SEQ ID NO: 131263 - RNA, 42 nt, Homo sapiens
guaaaacgagcgcccucuccgcacucguuuacaaauuaaaau

SEQ ID NO: 131264 - RNA, 46 nt, Homo sapiens
caagcagguguucacaggguuugaaggggccuagaaguccaaggaa

SEQ ID NO: 131265 - RNA, 69 nt, Homo sapiens
caggugcuaaaguugaacgagcugauggauaugaaccaccaguccaagaaucuguuuaaaguucagacu

SEQ ID NO: 131266 - RNA, 82 nt, Homo sapiens
aagaagcccaaguuugaauugggaaagcucauggagcuucauggugaaggcaguaguucuggaaaagccacuggggacgaga

SEQ ID NO: 131267 - RNA, 67 nt, Homo sapiens
uuuuacuaaaaaacgcaacaaucagauacggaagaccucuuaugcucagcaccaacagguccgccaa

SEQ ID NO: 131268 - RNA, 73 nt, Homo sapiens
ggcagacaaugauugaagcucacguugaugucaagacuaccgaugguuacuugcuucgucuguucuguguugg

SEQ ID NO: 131269 - RNA, 60 nt, Homo sapiens
uaagaaauauuggaaagacgcucgucaccaggacccaaggaaccaaaauugcaucugaug

SEQ ID NO: 131270 - RNA, 60 nt, Homo sapiens
ugguugauccauuuucuaagaaagauugguaugaugugaaagcaccugcuauguucagua

SEQ ID NO: 131271 - RNA, 36 nt, Homo sapiens
uuacgaaaggcggcaaaaagggagccaagaagaaag

SEQ ID NO: 131272 - RNA, 44 nt, Homo sapiens; identical to SEQ ID NO: 32026

SEQ ID NO: 131273 - RNA, 42 nt, Homo sapiens
aguuggauuaugcaguaauuugugcuaauucagaugguagaa

SEQ ID NO: 131274 - RNA, 84 nt, Homo sapiens
caguuugaaaccagacagauaagguaaaauauguuaacccaugguagcuaaugucacuuguugccuuaaucuuuaauacauaau

SEQ ID NO: 131275 - RNA, 65 nt, Homo sapiens
aaauuagcuguaucucuaauuuuagcacauacuaggcuuucaauaaauucugcuguuaggucugu

SEQ ID NO: 131276 - RNA, 81 nt, Homo sapiens
auauaacaaacauguaaaugguguuaccaguaaucaaaguaacuuauguauuuuaagaagaauaaaaguacguggaaaaca

SEQ ID NO: 131277 - RNA, 42 nt, Homo sapiens
cagauguccccuaacagacaacaccaaauaagauccacauaa

SEQ ID NO: 131278 - RNA, 46 nt, Homo sapiens
gggcaccaggcauggagccaacaaugaaaaccaauaccuaugagag

SEQ ID NO: 131279 - RNA, 38 nt, Homo sapiens
caacuucaaguacagauggacccaaauucccuggagau

SEQ ID NO: 131280 - RNA, 60 nt, Homo sapiens
cuauacuauuuuuaucacauaguuuuuuucuuuugggaaaaccugauagagaccaguaac

SEQ ID NO: 131281 - RNA, 37 nt, Homo sapiens
caccuacauacaccuaguacagugccgugcauuauuu

SEQ ID NO: 131282 - RNA, 38 nt, Homo sapiens
gcauuauuggagaggauuaaauguaaaggaaguggaag

SEQ ID NO: 131283 - RNA, 56 nt, Homo sapiens
auacuguaagagagaagaucuauuaugaaaaguaauauuugcaagcuuuaccagua

SEQ ID NO: 131284 - RNA, 49 nt, Homo sapiens
uuuuuuuuucuucacaugcuuagucuuguacaaaaaagggagggaggca

SEQ ID NO: 131285 - RNA, 44 nt, Homo sapiens
ucacagucacaccaguaguucucucaucuuagauaccaccuuuu

SEQ ID NO: 131286 - RNA, 79 nt, Homo sapiens; identical to SEQ ID NO: 32040

SEQ ID NO: 131287 - RNA, 54 nt, Homo sapiens
aguaaauuggcuuuuucuaaaauauaauuuuaaaggaucacauaaaauuaaagc

SEQ ID NO: 131288 - RNA, 51 nt, Homo sapiens
aaaauuugcagcuauaguugacuucaggacagcauguuuagggaguagaau

SEQ ID NO: 131289 - RNA, 37 nt, Homo sapiens
uuguagggcuuaacgauuguuaaaagggggccaaaag

SEQ ID NO: 131290 - RNA, 47 nt, Homo sapiens
cuaaaauauuccugaaaugauaaauuuuuaugauacagcauagaaua

SEQ ID NO: 131291 - RNA, 44 nt, Homo sapiens
guaaaaaggugauaaccuuuuuuauaagaugauuauaagaagga

SEQ ID NO: 131292 - RNA, 37 nt, Homo sapiens
aaaaaugaucaauaaggaauuugacuaacacccugcc

SEQ ID NO: 131293 - RNA, 48 nt, Homo sapiens
acaagagaagggaaaguauucuugcugaggaguuagauaugaguagua

SEQ ID NO: 131294 - RNA, 46 nt, Homo sapiens
agccacuuagcuccauccauguuucuugucuuauacauucuuagca

SEQ ID NO: 131295 - RNA, 40 nt, Homo sapiens
uuugugaaugagugccacuaaucuagagcagaaauuuagg

SEQ ID NO: 131296 - RNA, 14 nt, Homo sapiens
gacuuggacuagug

SEQ ID NO: 131297 - RNA, 29 nt, Homo sapiens
ugaaggguuaggggaauaaccagaaucac

SEQ ID NO: 131298 - RNA, 51 nt, Homo sapiens
caaaaccuuuuuuaaaaaaacauuaauuaagaacauaguauggcauaggaa

SEQ ID NO: 131299 - RNA, 52 nt, Homo sapiens
uaaugaaaguuaaguuugcuuggaaaauguuaaugaaauauuuauuacugau

SEQ ID NO: 131300 - RNA, 63 nt, Homo sapiens
gacagugacuaccaugacgaaaacauguacuacagccagucuucuauguuuccacaucgguca

SEQ ID NO: 131301 - RNA, 42 nt, Homo sapiens
gguuugaucagcuugaauuuuaauuguugaagaucacaaagg

SEQ ID NO: 131302 - RNA, 41 nt, Homo sapiens
guugucccauagcuuacugaugcuuuguucauuuuuuucuu

SEQ ID NO: 131303 - RNA, 48 nt, Homo sapiens
agcuugauuaaggucuaugucgguauaauuuuuuuuaugagucuuaca

SEQ ID NO: 131304 - RNA, 70 nt, Homo sapiens
gucugcugucauucuuauguuuagucuuguguguauaauauaccuuuuucucucuggcuaauauuaagau

SEQ ID NO: 131305 - RNA, 39 nt, Homo sapiens
cacuucuaguggugaugaauuauuuuagguuuuguuuga

SEQ ID NO: 131306 - RNA, 71 nt, Homo sapiens
agguuuguugacucuuuuucucuuuuucuucccaucuuuuccuguuuuuacuucuuaucccuuucuucucu

SEQ ID NO: 131307 - RNA, 49 nt, Homo sapiens
gaucucagcugaaaucucacuuccuaagggaaacauuuucugcuuagac

SEQ ID NO: 131308 - RNA, 56 nt, Homo sapiens
uauugaaauauaguugacuuuuaaaauugauuuuuguaucucaauguugcuaaacu

SEQ ID NO: 131309 - RNA, 63 nt, Homo sapiens
uuaugacuacuuuuguugcuuuucuugguuguaaauuaaaaaaaaauuuuuaguuauaggugu

SEQ ID NO: 131310 - RNA, 44 nt, Homo sapiens
ucuuaugucucuguuaccuugauguguuugucugugccuauacc

SEQ ID NO: 131311 - RNA, 46 nt, Homo sapiens; identical to SEQ ID NO: 32082

SEQ ID NO: 131312 - RNA, 44 nt, Homo sapiens
ugaacucucauuuucaauauucauuuuaaagacagcauuucuug

SEQ ID NO: 131313 - RNA, 121 nt, Homo sapiens
uagaguauauaauggcuauggauugaaacuccaggccaugaaauauuuccaguuauccccagaagaggaaacaaagcaaauaauaaauagauuuucccuuuauacaaaaauccauaauucu

SEQ ID NO: 131314 - RNA, 50 nt, Homo sapiens
ccuagggugcaugcugucucucauacuuguuccuuuucacagauuguguc

SEQ ID NO: 131315 - RNA, 56 nt, Homo sapiens
ucaucaugaaauacauccuugccuuauagaaaauuucauuguaguuuugcaaauau

SEQ ID NO: 131316 - RNA, 59 nt, Homo sapiens
ugucuggaaaccauuguuucauauauuuugucuaguuuucuguuuauuuaagguagaag

SEQ ID NO: 131317 - RNA, 47 nt, Homo sapiens
aaaguuugaauauuuggacaacuaugguggucacagauagaagggcu

SEQ ID NO: 131318 - RNA, 45 nt, Homo sapiens
gacaacaacaaagaacaaaaaaccugagagagacggauucuugau

SEQ ID NO: 131319 - RNA, 60 nt, Homo sapiens
uaaagggaagauucuuuuguaauagaaaguuucucuauaacuuaccuauuuuguaauuuu

SEQ ID NO: 131320 - RNA, 122 nt, Homo sapiens
cuaauuguauauuccagccuuggaccaaaaauguacaugcuaaaauaucaagacaaggcaaagauauauuuuugcuuuucugucacuuaauacuauuucaaaauaguuucagauuuaucaau

SEQ ID NO: 131321 - RNA, 81 nt, Homo sapiens
gaauuaacuaaaaguaauuagggaauucauuccucagaauaauuuauauccuaagcuuuaugaugaagaaggcuuuuauuu

SEQ ID NO: 131322 - RNA, 79 nt, Homo sapiens
guuaaugaguuggcuucaaggaggugauaagugagcucuggguucugaagggugauuuguaguuaacuaggugggggag

SEQ ID NO: 131323 - RNA, 45 nt, Homo sapiens
ucaaguuaaauuuuugucauacuguagaaacauccuagaguagag

SEQ ID NO: 131324 - RNA, 73 nt, Homo sapiens
uuucuacaucagaugaauugcagggguugagggguggucugucuggaguacuggaaaaugacauaggaaagca

SEQ ID NO: 131325 - RNA, 146 nt, Homo sapiens
cuaaaggggagaagaggugauuaaagcauaaugaucugugucuuucacuucagaaaauauugugguggacccaguaaucuguaauagguuuuacaaagagcaauaggaaggagggauuauuuuuuauuaaggugccuugaaauugu

SEQ ID NO: 131326 - RNA, 96 nt, Homo sapiens
uagaaggcccugagauagggucaaguuuuguauguuugaagauaagaaauuucauaaacaauuacuuagugcuuucugcauaaauggggguaagcu

SEQ ID NO: 131327 - RNA, 48 nt, Homo sapiens
uacaauguguuugagagaggagcauuugguuuugugucauaucuggca

SEQ ID NO: 131328 - RNA, 32 nt, Homo sapiens
ccuuauacgugaguagaugaaaaugcacauuu

SEQ ID NO: 131329 - RNA, 46 nt, Homo sapiens
uagcuucuuagggaaguguguguaaaguuaguauggaauuagggaa

SEQ ID NO: 131330 - RNA, 67 nt, Homo sapiens
cuccccaaauccuuugcuguauugcuuuuuacucuucaaacuucuauuauagaaugucacacuguau

SEQ ID NO: 131331 - RNA, 26 nt, Homo sapiens
uucuuugucuauacuauuaggaaugu

SEQ ID NO: 131332 - RNA, 78 nt, Homo sapiens
aggcaaacuaacaaugccaugugcuugcuugaauaggcauuugaggacagguuauuuuccugagauuucaggaaaaua

SEQ ID NO: 131333 - RNA, 36 nt, Homo sapiens
gagucggugggagacaagacggagcggcgguaaggg

SEQ ID NO: 131334 - RNA, 45 nt, Homo sapiens
ugaaauccaaggccagaaucugcagguucuguagcugccccagcu

SEQ ID NO: 131335 - RNA, 42 nt, Homo sapiens
ucauagaugaccagcuucagacuugacaggugcgccaggcug

SEQ ID NO: 131336 - RNA, 24 nt, Homo sapiens
cauuuacaguaaagaaaauauguc

SEQ ID NO: 131337 - RNA, 44 nt, Homo sapiens
gcuaguauuaagugaaagguugacagggaagucaguucucuucg

SEQ ID NO: 131338 - RNA, 37 nt, Homo sapiens
uaagaaucguagguucagaacacagaauucuaaaaua

SEQ ID NO: 131339 - RNA, 99 nt, Homo sapiens
auuuagacaaccugaaauuuauucacauauaucaaagugagaaaaugccucaauucacauagauuucuucucuuuaguauaauugaccuacuuugguag

SEQ ID NO: 131340 - RNA, 74 nt, Homo sapiens
ucaaggucgaccuaaaaaugguugcauuguccauggcaaaacaggacaucuuauggccugcuuuacaugugcaa

SEQ ID NO: 131341 - RNA, 46 nt, Homo sapiens
ucucagccaucaacuucuaguagcauuauuuauagcagccaagaag

SEQ ID NO: 131342 - RNA, 56 nt, Homo sapiens
ucgugagaauuggcuuccugaagauaaagggaaagauaaaggggaaaucucugaga

SEQ ID NO: 131343 - RNA, 57 nt, Homo sapiens
uucaugcaaugaaaugaaucccccccuuccaucacauugcaacagauguugggcccu

SEQ ID NO: 131344 - RNA, 75 nt, Homo sapiens
aguuacuguguaucaggcaggggagagugauacagauucauuugaagaagauccugaaauuuccuuagcuguaag

SEQ ID NO: 131345 - RNA, 45 nt, Homo sapiens
guaucacucuccccugccugauacacaguaacuugauauaccuaa

SEQ ID NO: 131346 - RNA, 54 nt, Homo sapiens
ucagauuucacuugaaaucuuuaccucuugauuuguuuaaacuaacacauuggu

SEQ ID NO: 131347 - RNA, 60 nt, Homo sapiens
gguuggaucaggauucaguuucagaucaguuuaguguagaauuugaaguugaaucucucg

SEQ ID NO: 131348 - RNA, 53 nt, Homo sapiens
uuuccuuugaugaaagccuggcucuguguguaauaagggagauauguugugaa

SEQ ID NO: 131349 - RNA, 50 nt, Homo sapiens
cacauuugguuucuagaccaucuaccucaucuagaaggagagcaauuagu

SEQ ID NO: 131350 - RNA, 37 nt, Homo sapiens
uacauuagaaugagaaauuuacuuagauuaccuuuug

SEQ ID NO: 131351 - RNA, 52 nt, Homo sapiens
cacucccugucccuaccaaaauaaugacucuccugucucucugcuaauuuau

SEQ ID NO: 131352 - RNA, 35 nt, Homo sapiens
uguuaauguccaggcaugaguucacuguuaagaug

SEQ ID NO: 131353 - RNA, 83 nt, Homo sapiens
aggaguucugaaguuaauucuacugauaucuaaaccaaacucagacugcaaauaaguaauuuguaaguuuccaucucaauaau

SEQ ID NO: 131354 - RNA, 42 nt, Homo sapiens
gcuuuugagugcugcuuagagcugucucuaauacacuacacu

SEQ ID NO: 131355 - RNA, 44 nt, Homo sapiens
auauuaugacuaaacgauuauaugaugagaagcaacaacauauu

SEQ ID NO: 131356 - RNA, 50 nt, Homo sapiens
aguaaauagucauaaauacuauaaaccucaauagccucugaggucaccag

SEQ ID NO: 131357 - RNA, 45 nt, Homo sapiens
guuagaccaaagccauugcuuuugaaguuauuaaagucuguuggu

SEQ ID NO: 131358 - RNA, 26 nt, Homo sapiens
ggauuggauacugucugugaucacaa

SEQ ID NO: 131359 - RNA, 47 nt, Homo sapiens
cauuucucuuugauucucuaaguuagcuugcaauaagcucguuggau

SEQ ID NO: 131360 - RNA, 26 nt, Homo sapiens
ggguguuauauaauauaugugucagu

SEQ ID NO: 131361 - RNA, 41 nt, Homo sapiens
auuucuuaauccuaccucccugcuucuauugccuagcccgu

SEQ ID NO: 131362 - RNA, 52 nt, Homo sapiens
aucccuuuucuuuuuuggaggucaguaggaaugguugaggcagucuuguguc

SEQ ID NO: 131363 - RNA, 42 nt, Homo sapiens
uugaaucucacacuaacuauugcauggccuaaauugaguaga

SEQ ID NO: 131364 - RNA, 43 nt, Homo sapiens
caagugaacucaaugcagcugcuguacuaccaggcuccgaugu

SEQ ID NO: 131365 - RNA, 62 nt, Homo sapiens
uagaaaaaaggcaccaguugauuuuaaacaaguuccugcagauuauauaaguagagauggcc

SEQ ID NO: 131366 - RNA, 46 nt, Homo sapiens
cccugucuuuagaaaaguaacugauggcaaugaaggguggguaaga

SEQ ID NO: 131367 - RNA, 24 nt, Homo sapiens
uaaagaggggcggugagguaagac

SEQ ID NO: 131368 - RNA, 30 nt, Homo sapiens
ucuuauacugcuggagacauuaaaaggagu

SEQ ID NO: 131369 - RNA, 44 nt, Homo sapiens
uauaacuuuagguguaauccuaaauucuuauuacgaugugaagu

SEQ ID NO: 131370 - RNA, 14 nt, Homo sapiens
gucuuaagucucuu

SEQ ID NO: 131371 - RNA, 32 nt, Homo sapiens
aggguaccaagccuggaaaguuaguaagacga

SEQ ID NO: 131372 - RNA, 26 nt, Homo sapiens
uuuuuaaugccacuggcucuucagaa

SEQ ID NO: 131373 - RNA, 30 nt, Homo sapiens
agaggcagaacaguauguguggcugguaaa

SEQ ID NO: 131374 - RNA, 50 nt, Homo sapiens
aaacugaagucauaguaagaugagauuccuuauccugccuugauggaaga

SEQ ID NO: 131375 - RNA, 46 nt, Homo sapiens
aaucagauuuuaucugauagcaacugcuguugggaugucuccucaa

SEQ ID NO: 131376 - RNA, 77 nt, Homo sapiens
guuacgcagagauccuacaagccauaagacuuugcagaaauguccuucuacagaaccagaagaaaaaggaaauaucg

SEQ ID NO: 131377 - RNA, 48 nt, Homo sapiens
gagaacacaagugaagacguacagaaacagcccggggagaaagaggag

SEQ ID NO: 131378 - RNA, 82 nt, Homo sapiens
cuagaaggucacuguugcuggaagagagagagagagaaugagagggagaguaguguugauaauggguucagagacauaaugg

SEQ ID NO: 131379 - RNA, 68 nt, Homo sapiens
ggugcuaaauuguguagggcuuuguaaaucauagcaaagauuuugaauuuuuuucuguaugcaguggc

SEQ ID NO: 131380 - RNA, 3034 nt, Homo sapiens
uccaaagaagagcugaaaaagguaugauugagcuggaauauuucuucuugagauuuagguaguuguuaggugcuguguaucauggacaaauaaugaacuuauuuuucccuguugguauucauaaacaacugaaauguaugauuaggagaugcauguuuagauuaaguguuaugaaaaggacaugcuuuaaauaccuccaucccccguguucagugugauagaccuuuagcaaauaaacaccgccaggguguuuuugguucauggguauuaauggcuucguugacaguuguuacaguugccguuuucuguauucagcucugcuaucucugaauaaaaauuagaugccuuuaguacuuaaacaucacuuauuuagaauaauaugaagaggugagagagacuaauauaaaaauguuuauagauuaaaccuuuuagcuauugaaaggaaggaaguauuuuuuuuacugaauauauuccccucacaugauuucccccuacucuuuuggauaaggacaugaagaaaugauuucuuauaugaagucuguaucuggucuuuucuucuacaugcauuuuauuccuucuguuuugacagagcaaacaacugugauuguaaauagaaaucuccauaauuguauaagaagauacagugggucucaucguuggaagcagaguggucauuagcuuaaaagucuuuuuuucuuuagccuucagcccugaggagcagugauagaccuauggauuuggaaugagcugcuguauacuuaggauaaaacaaacaagauucuuacaaacucuccugucuucucuccugcauucuuccucuuucuucgcuuuucacaauuucuuacuuuguguuuucuuuauugcauaaguaauacauuauuuauuauaggauuuuuagaaaauagagaaaggaaggaggguuucgauuuauauuucaauaacuugucccugauuucagaauaacugagucacucauuuuuuaguaagugcaguagggaaacuaacaucuguugaguugccuacucugucgagcacauuuaaucauugaacugggauugagaaucaggcuacgaaauugauacuugcacaguuuccucuuuugaaagugaaaauaugaggggaagaggaauuuaggaaauaaauuuuccuaaauuguauguauggaaaccuaaaacaaggaucacauuguugcuuuuggagauucuguagaggguaaacccuaacacaauuuuugaaaaauaauaauucuaaguauugguuuguaauuguuugaaacaaaguagcuuaaauauucucucauauuuuaucuguguauaucucucuuuguuccaaaaagaauuugaagcagcuauuuaguuagcagauuauuuauggauaguuuaaagauaacuuagccauauucucucguaaugauuauaagaucugaacuuguaaauuuuuacucugugcaguuucagagugaaauagcauuucucuuuuaauaaacugucagauuuucuuuuucuuuaauauacuuuaagauauguuaacauugauuuguuuccauuauuucccuuaagguauuaaguguccauuuuuucuucuauagagaugauuuuccguuucuuuuguuaaaauuuuuuguuuaucaaucauuucucuugauuuuguagauuuugauguguuuauuuucauuauuacuggaaagauugaaagccuucuguaaggcacagaaggugguucccaguuuuucauaagccaugaagcaaagggcugggaaaaaauucauaugcuuauggaauucugugugucuggcauugggcuaggcucuauaguauauuguucacuuaauccuaauaacaaacacaucugaucuaaggucagcaucaucauugcuuggaaagcuguuuuucagcuuuccaggcugaaaaagcccugagaaaugggcucagauaaauuaagcaagcucaaagagcugcuucaaugguaaagcugugaucugaacccaggccuguccagcuuucccucucauucugucauuuuacacuauuuucuuuaguagugaacuaaacugguuuaugaucuaucaucuaauucgugccccagucucauuaucuggcaaugucagggcauuccuucaggaugagaaaaaugccaugugacaaaaagaugccuagcuccccuuuaccaucacgugagguccugcacacaugguggagugggagaguggaaggggcacacccaguggugccauuuguauucugccucaucugccuacuaacgauguggucuuaacaagugguugaaucucuaugagccuuaguuucauuagcuuuuuuuuuuuuuuuuuuuuuuuugagacugagucucacucuguugcacaggcuggggugcaguggcacgaucccagcucacugcagccuccaccuccuggguucaagggauucuugugccucagccuccugaguagcuaggauuacaggcaugugccacuacguccuacuaauuuuuacauuuuuaguagacacgagguuuugcuguguuaaccaggcuagucuugaacuccuggccucguuauccgcccaccucagccucccgaagugcugggaucauaggagggagccaccgugccuggccaaauuucauuagcuuuuaaaugagguuaauauuggcuaauuuguaaggugauuaugaucuuuggauauaauguagguaaaacuuuuaaaccuaguuucucacacacacaauagguaccugagaaaugauagcugcuguuauagugagugaaagcaaaggauguuuauacuuuugaggaaacauggaugcuugauuuuuaaaaagcagucugcauugacucaaaggcuucuuaagcuauuuuuccuagguauuguuauccacccuuccaaaaaacaaccaaccacaucuuggauuugacucaaggcaugagggaaaaaauuagucuucuaaagcucucuggauauggcaaguguuuguaguacuuaaacuuauugaaauuauuauuguaaacaggcccaggauguuuuggugcaggaga

SEQ ID NO: 131381 - RNA, 46 nt, Homo sapiens
uaaaugaaacuauucuaagacccuuaaauguagaaccgccuuuaac

SEQ ID NO: 131382 - RNA, 1564 nt, Homo sapiens
ugaagaugcugcugauguggaugcucgaaagcagguggguaacuguacugaaagaagcgugaguuuggcugaaugugucaguaggcuggaagaaugaagaauagccauuaaaugucccaagaucucuaccuaguccuuuuuaauauugaaaaaacuucuaaaguaaauaacuuaugucauuaauaauguauccucacauaauuaacauacucacaauauuuugaugagcauucuuaaaaauauauauauggaaauuuaaauacauucugucaaauucauuaugcuucucuaaaauacacauagguagucuuuuagacauugcuucaaucuagcaaagaaaagauguuauugguuagucuuaaaaacaaauacaucuugguuccuggguggugcgauguacgagccuguagucucagcugcucgagaggcugaggugggaggauucuuugggcccaggaguuugaauccaguccggggaacauaguaagaccucuaucuaaacuggaguuggaaauuuagauagagugugucaaaauaauauuaguaacacuuuguacuaauauaucuuauacguaauuacuuucucauuugcacguaacagcacagugauauaaauaggaucgguauuacagguugaacauugcuaauccaaaaauccaacaccugaaaugcuccaaaauucaaaacuuuuugagugccgacaugaagcucaaaagaaaugcucauugaagcuuuuuggauuagaguuaguauaaugcagauguuccagaaucugaaaaaaucagaaauccaagauacucugggcccagauauuucuaguaaggaauacucaacaagcucagaugaauugaggucucauggucucaacuuucucaggucucaugguggguaaguggugaauccuaaacuagaacugauauuuuaugaccccuuucaguagcugcaguccauugcuggaugauuuuagggaccuugaaucucaggggauuggagugagaaugacaucaguggaaacaauauuuuagaggggacccauguaaaugugcuuuucaguggggaacagaggaugauacuuuuuguguuuaguucucagcuacuuugaguuacauuuacuccuucagaaauggcaugaaauuuuaauguguuaucccacauuauucauaagaaucaggaaacaauacauuuuuuggcuggcuuuuugaguuaaaagucaguaauuuuggagugaaagggaagaaagaguuuugucgugggagucucuuuggaguuuagguuuuccauuuagaugagaaaaguuuguuacgugauauggauccaugcaaguuuggagaaugcucuaguagacauuggaagcucuuaguuucuauuauaaugagagugaauagacugauucauuucuguugccuuagcauugccuuucuacaaacuuaaaccgauuucuaaacuuuagcuauugaacacacaugaucuuacauaccaaaguguuuuuagcuuuacugagagauaucaaauacgcuauagcugcaauaaaggauauaaaaaucauuuuuuaggccauacgaga

SEQ ID NO: 131383 - RNA, 46 nt, Homo sapiens
gacuccuucuaauggagcugaagggcugacuccccggaguggaaca

SEQ ID NO: 131384 - RNA, 2340 nt, Homo sapiens
caggaucuugauggggagcuaagaucguaaguugccuuucugauuuuggaaauggaaaggaauaguaggaggagucuuacgaagggccaaguauuauccuugucagagccagauuuuuauuauuuauuuauuuuacauuuuuuaaaaucaauuuuuuuuuugagacagggucuugcuguguugcccaggcuggaguacaguggcacaaacacggcuuacugaagccuugaccuccugggcucaagcaauccucccaccucagccuccugaguagcuaggccuucaggugcacaccaccacaccuagcuaauuuuuuuuuauuguuuuguagggugggaucuccuuuuguugugcagacuggucucaaacuccugggcucaagcgauccuucuuaaaguguugggauuauaggcaucaguuacugugccuggccuagauuuuuauuaguacaauguggccuacauaugguuuuauuuauuuaauggauucaucuuucugagaaaaucagggacuguggcuaucacguuuuuagcacagaaugcuguuuauggcucuugaguugaaaugcauggcucucaauugacuguuuacucuuugaaucacaucuuaacuuuuauguacauuuaugaguagauuaguuuuacuaguggcugaggaaucugucaaaauugagucugguauuuuuagccuuaaaaaacaauuuuuuuuuuuaagacaaggucucacucuuaucacccaggcuggagugcaguggcaugaucacagcucacuguauccaccucccaggcucaagcaguccuuccaccucaaccucucaaguagcugggaguacagaugugugccaccaugacuggcuaauuuuuuauuuuuuguagagaggugggucuugccauguuauccaugcuggccuugaacuccuaggcucaagcuacccucccuuugcgucccucacaaaguguugggauuacaggcaugagucaccacuccuggcccuuuuagucuuuucuagugaaaaauuuuaccuuguuuuuauuaagaugaaauuaaaagaaaaaacuuacugauccuuucacuugaugggauaaauauacauuuauaaaaucuuuauguuuuagggcauagcagauuuucccuauuucuugagauuuuuaguuucuuuaaaucucauaucugaauauuguagggagaguauuuuaugguugucaaggguuuuuuaaaguuuucuacuccguugaccuuucauuucuguugacaugaauuguuacaaaacaacagcuaucagccauuguaaaauaggauuuucuuagauguacuccauuguauuuauuccucagauuaggacuuugcuuuagguaggcucuacaaauaaagagauugaacaggaaaacuauucauuuggaaggaguacuaagugggggaggcaagaaagacacacagaaggggaggagguauuccuggagcuuugaaagacugcuuugagccugucuuuaggcuuccuaaccauguuuagaugucacuugucaguauuaagacagccuuuuuaaaaaaguugugaauuuuaagaaucaugagaauuuaauaacaaguuuuaaagggaaauuuaauuauguuuuaauuuuauuucuuucauacacauuuuccuuuuuacauacuugucauacuuuuuccuaugugcacacguuuuuauugaauguauucauaauauaggaauaguuuuugacauuauguggaauguuuuguuuaucacaaucuucauacuuacauguuuuaauauuuaguacuucaauuaggguaccuuauugauaauuuuguugcuauucugaguuugcuuuuaucuugaauaugguaaguaaugguguaggggacuacuuaauguauauuguuuuuaccuuuuuuuagcuauuuucuuuuuuuuuuugagauggagucuuucucuauugcccaggcuggaguauaguggugcgaucucagcucacugcaaccucugucucccgggcucuaaugauucuccugccucagccucccgaguagcugggauuacaggcacgcaccacuaugccuggcuaauuuuuguauuuuuaguagagaugggguuucgccacguuggccaggcuggucuugaacuccugaccucagguaauccacccaccuuggccucccaaagugcugggauuacaggcgugagccauugcaccuggccuuuucaguuauuuucuuagaaaugagguuguuuguucaaaggguuugaguauuuguauggauuuuaauguuuuuggcuauauguaacuuaaaaaucucuuuucuacuuugauccaugacagugaaaaagaaggaagagau

SEQ ID NO: 131385 - RNA, 46 nt, Homo sapiens
aagaggaaacaacagaugauccacgaaaacuuaaaccuggagaaau

SEQ ID NO: 131386 - RNA, 2486 nt, Homo sapiens
aauuaugaucaaggggggcguauggaggaauaccgagguaagucuccuuuucccgccguccgcugcccgccgcucccucuagcagcuugugcgcacgcgcgcggaggucgggggggcgacgaggagacccuguggggucugcguggagggcagcccgggggcugacccuuggggcccuuuccgugugucuggccccguguugugcgagcgccaguaggacagggaccgugaugucaccaccuggcuacucggcuccaagcucacuuguuaggcccugagugaacauuuguugacuugaauacgcccccucccaccccgcccccccgccccccccggccccgggaagaacucagaguuccaacucagccagaguuggucccccggggcaccauccacucuuaguccaggcaccacgacucugucucauacucagaaauaaagaaguugccguggccacaacuuugugucuccauugacuuccuugcagaggggaagcaguuugagugccagguucagagagcccguuuaugcccgcaucucucugguuaucuguuaucagggcauaaccugucugccaucucgacagaucccaaggucugucucuuucugucacugccuuugccuagauagaagccagaaaggaaaaacuggccuaggauagucucuguuuccagaaacguaguggauagugccauuggugagccaaagggcaguagagugggagugaaauagaaauuagauuuuagugcguuuuguguucagaguguaccgaauuuaucaguuucuggagcacaucaugucuuuucaugcucugugucuuuuuuucguuacauuuuauggcuucuuuuuuuuuuuuuuuuuacaucuuuugccuuccuagcgcuugacaucuuucugaucauccuucaaaccuaguucggaaacacuucuuggaaucucuguaagaauuaauugcacccccgauauucucaugauaccuuuuucuuccguuuguuaaaacuugcuuugucuuuuuguaagcaucacauccucugugugguacucgguaaguuucuuaacuucugaaagccucaguuuucuacuuuuucuaaauugggauaauaauacuuaaccucucuugaggauuacacgaguuaauacguuuggaauauuuagaucagaguagggcacauaguagccucugaguaagagcuaguugcucuuucaccucaccagacagcauggcgagaggaccaggucuugguaucccuaggaccuaggacaguaaccaacaugaaguagguugcucgacagguauuugcagaaugaaucaaguagaguagguaucugcuguaucuauuuaauugaaaauguguuuaaguguaguuguacugcaaccaaguuacaaaaaagacaaugaaaacugccucagcuuccaccgagggaaccagacuguuuaaauuggagaagagaugacuucugagggagagacagauauaaaaucaaguaacaguaggauuccuaugcaguggucaaagcucugcagucuuuuuaaaaaguaucuuugaucaugggagauguagaggauggagugggguaucucaagaggcacguaccucaaauccaaugugggaaaaaaagccuagaaguaaaaucgccuaagugcaugcaucuauggcuccauuaacuuucuugucuuuggcuuggcuugccaggcuuccuugagguuggugcauuccacauggcaaugggugcccuggugaaaugguaucuagagauggggggaaauuggaaggagagcugacuagugggguugggguagaaauauguaauucuuagguuagaccugagauguggauucuugggucauaguugggguuaaggggcuggaggggaaaugccauguauaaacuugagacaggaggcuuggauuggagaauauauucaccagagucccaacuugcuucuugaggccuggauauguccuguuugauaagaccuuuccccaagggaaagguagauguuucaagguagauguucaggaaguguuuuuugagugaguguauaaaugaaugaguuauacauuuuuguuguuguuguguuuuuuaguuauccuuuuugaagagaaggacagccacacguugaagaauacuuuuucuuaauuuuugucauaaaguaggguuucucagauugggcuguucccacucccaauuuauuggagagugugguguaaggguggguagcugucuuucuaagggauuucuucuuaauuucucaauucuugguugcuguuauuauaguuaaugagguuuucauccuuagucuuuuaaccuaggugguguguaugugcauguuauaugucucuuucuccaauagcccuaucagaguuaauuuaaauuuugucuuuucccacuuggaguuuugugacugaauguacucuuuggcaauuuuuuuuaggaugaaauucugaaagcagcgguaaugaaauaugggaaaaaucagugguc

SEQ ID NO: 131387 - RNA, 2454 nt, Homo sapiens
auggaggaauaccgagguaagucuccuuuucccgccguccgcugcccgccgcucccucuagcagcuugugcgcacgcgcgcggaggucgggggggcgacgaggagacccuguggggucugcguggagggcagcccgggggcugacccuuggggcccuuuccgugugucuggccccguguugugcgagcgccaguaggacagggaccgugaugucaccaccuggcuacucggcuccaagcucacuuguuaggcccugagugaacauuuguugacuugaauacgcccccucccaccccgcccccccgccccccccggccccgggaagaacucagaguuccaacucagccagaguuggucccccggggcaccauccacucuuaguccaggcaccacgacucugucucauacucagaaauaaagaaguugccguggccacaacuuugugucuccauugacuuccuugcagaggggaagcaguuugagugccagguucagagagcccguuuaugcccgcaucucucugguuaucuguuaucagggcauaaccugucugccaucucgacagaucccaaggucugucucuuucugucacugccuuugccuagauagaagccagaaaggaaaaacuggccuaggauagucucuguuuccagaaacguaguggauagugccauuggugagccaaagggcaguagagugggagugaaauagaaauuagauuuuagugcguuuuguguucagaguguaccgaauuuaucaguuucuggagcacaucaugucuuuucaugcucugugucuuuuuuucguuacauuuuauggcuucuuuuuuuuuuuuuuuuuacaucuuuugccuuccuagcgcuugacaucuuucugaucauccuucaaaccuaguucggaaacacuucuuggaaucucuguaagaauuaauugcacccccgauauucucaugauaccuuuuucuuccguuuguuaaaacuugcuuugucuuuuuguaagcaucacauccucugugugguacucgguaaguuucuuaacuucugaaagccucaguuuucuacuuuuucuaaauugggauaauaauacuuaaccucucuugaggauuacacgaguuaauacguuuggaauauuuagaucagaguagggcacauaguagccucugaguaagagcuaguugcucuuucaccucaccagacagcauggcgagaggaccaggucuugguaucccuaggaccuaggacaguaaccaacaugaaguagguugcucgacagguauuugcagaaugaaucaaguagaguagguaucugcuguaucuauuuaauugaaaauguguuuaaguguaguuguacugcaaccaaguuacaaaaaagacaaugaaaacugccucagcuuccaccgagggaaccagacuguuuaaauuggagaagagaugacuucugagggagagacagauauaaaaucaaguaacaguaggauuccuaugcaguggucaaagcucugcagucuuuuuaaaaaguaucuuugaucaugggagauguagaggauggagugggguaucucaagaggcacguaccucaaauccaaugugggaaaaaaagccuagaaguaaaaucgccuaagugcaugcaucuauggcuccauuaacuuucuugucuuuggcuuggcuugccaggcuuccuugagguuggugcauuccacauggcaaugggugcccuggugaaaugguaucuagagauggggggaaauuggaaggagagcugacuagugggguugggguagaaauauguaauucuuagguuagaccugagauguggauucuugggucauaguugggguuaaggggcuggaggggaaaugccauguauaaacuugagacaggaggcuuggauuggagaauauauucaccagagucccaacuugcuucuugaggccuggauauguccuguuugauaagaccuuuccccaagggaaagguagauguuucaagguagauguucaggaaguguuuuuugagugaguguauaaaugaaugaguuauacauuuuuguuguuguuguguuuuuuaguuauccuuuuugaagagaaggacagccacacguugaagaauacuuuuucuuaauuuuugucauaaaguaggguuucucagauugggcuguucccacucccaauuuauuggagagugugguguaaggguggguagcugucuuucuaagggauuucuucuuaauuucucaauucuugguugcuguuauuauaguuaaugagguuuucauccuuagucuuuuaaccuaggugguguguaugugcauguuauaugucucuuucuccaauagcccuaucagaguuaauuuaaauuuugucuuuucccacuuggaguuuugugacugaauguacucuuuggcaauuuuuuuuaggaugaaauucugaaagcagcgguaaugaaauaugggaaa

SEQ ID NO: 131388 - RNA, 2343 nt, Homo sapiens
cauagaaaaucagcaaagcagugcaaagccagaugguauguaucaguuuaauaaguggaaaacagaaaaggagcuuaauuaugaugauggaaaaugucaacucugugaaccuuaucaaagaaagcagacauuguaauauaacaaggcauggagugggagauggaaguuggguguuugacuuagcugucacuugcuuccuguguggucuuaggcaagccauuuuucuaucccucuccccugcccuuguuuucucccaauuagggauaauaauacuugguccugacugauagagaugugaguugucaucuaaauggguuaauguauuugagagugcuuugugaagcauacaaagucuacuuucagggacagaugagccccagcuuguaaauuaauuguguucuaaaagugcauaaguuagcuguuuuagaaauuacuugcucaaagaaauaaaugauaaauaauggcuaauuuucuaaguaagccuacaguaguugaguuuccucauaauacaguugaaauauuauauauuuuauaguuaauauguuauauauuauauauuaaacauacuuaauguuauauauuauauauuaaacauauuuaauauguuauauauuauauauuaaacauauuuaauauguuauauauuauauauuaaacauauuuaauauguuauauauuauauauuaaacauauuuaauauguuauauauuauauauuaaacauauuuaauauguuauauauuauauauuaaacauuuaauauguuauauauuauauauuaaacauauuuaauauguuauauauuauauauuaaacauauuuaauauguuauauauuguauauauuaaacauauuuaauauguuauauauauuaaaagauauaagccaacucugaaccuguggugucaccucuuuuuuauuuuuauuuuuugggacggagucuugcucugucgcccaggcuggagugcaguggcgugaucucagcucacugcaagcuuugccucccggguucacgccauucuucugccauagccuccugaguagcugggacuacaggcuccugccaccauucccggcuaauuuuuuguauuuuuaguagagacggaguuucgccguguuagccaggauggucuugaucuccugaccucgugauccauccaccucggccucccagagugcugggauuacaggcgugagccaccgcgcccggcuggugucaccucuuaaaucauaggguaguggacacgugaagcuauuuaggguguucuuggcaugaguuauuuagcaccauccccaagucauguggcauuaggaaaauacuuuggauuguauaagaaugaccuaauuuccuaggcaccugguuaggggaaaguaucagaauguagaaauuggccaggcgugguggcucacaucuguaagccuagcacuucgggaggccaaggcugggaucaccugaggucaggaguuugagaccagccuggccaacauggugaaaaccccgucucuucuaaaaguacaaaaauuagccaggcgugguggcuacuugggaggcugaggugggaggaucgguugaacccaggagguggagguuguagugagcugagaugcugccacugcacuccagccugggcgacagagugaggcuuuuugaauguagaaauuggcuguuaagaggaagaugauuuuuaggcugaagaagucguucugauuucuguuugucuuagugguaccaguuccugcugucauauuugguaggacuuaaguccuguuugccugccugucauccagcuaaguagacuggauggaaaaggugggcuggguggggaauuaggaaagacagagggaaugucauaguaguuuuacuuaaauuuuaaaacauaucaaaugaaagguuacggugaauuuagugaguguaagucaaaugcuuaaagaaauaagccauggugugagaaucaaagcaugagaaaauaguaugaaaacuggaaacacuguaagaaacgugauuuuguauugucuuccaaauauuucaaaauuucuagaaaagcguaaauaaauaaaaacaugauagaugagaaagaaggcuuaugaucaugauucagugaaguaaccuuuuuuaaccauuacuaaucuugcauaauuaaaauaaaauagaaugugaugagauggggaauauugacugggguaaguguaaccacacagcaaauauucuguugucaaaaagaacaguuuuuguaauugaaggaugagagcacaagucaguguauccauugugcaaauuggauauuuaugccagguaacugauuaauauauaaaaugaucuauguuuaauagguaugaauggcug

SEQ ID NO: 131389 - RNA, 46 nt, Homo sapiens
ugaagaggaaacaacagaugauccacgaaaacuuaaaccuggagaa

SEQ ID NO: 131390 - RNA, 2340 nt, Homo sapiens
aacaggaucuugauggggagcuaagaucguaaguugccuuucugauuuuggaaauggaaaggaauaguaggaggagucuuacgaagggccaaguauuauccuugucagagccagauuuuuauuauuuauuuauuuuacauuuuuuaaaaucaauuuuuuuuuugagacagggucuugcuguguugcccaggcuggaguacaguggcacaaacacggcuuacugaagccuugaccuccugggcucaagcaauccucccaccucagccuccugaguagcuaggccuucaggugcacaccaccacaccuagcuaauuuuuuuuuauuguuuuguagggugggaucuccuuuuguugugcagacuggucucaaacuccugggcucaagcgauccuucuuaaaguguugggauuauaggcaucaguuacugugccuggccuagauuuuuauuaguacaauguggccuacauaugguuuuauuuauuuaauggauucaucuuucugagaaaaucagggacuguggcuaucacguuuuuagcacagaaugcuguuuauggcucuugaguugaaaugcauggcucucaauugacuguuuacucuuugaaucacaucuuaacuuuuauguacauuuaugaguagauuaguuuuacuaguggcugaggaaucugucaaaauugagucugguauuuuuagccuuaaaaaacaauuuuuuuuuuuaagacaaggucucacucuuaucacccaggcuggagugcaguggcaugaucacagcucacuguauccaccucccaggcucaagcaguccuuccaccucaaccucucaaguagcugggaguacagaugugugccaccaugacuggcuaauuuuuuauuuuuuguagagaggugggucuugccauguuauccaugcuggccuugaacuccuaggcucaagcuacccucccuuugcgucccucacaaaguguugggauuacaggcaugagucaccacuccuggcccuuuuagucuuuucuagugaaaaauuuuaccuuguuuuuauuaagaugaaauuaaaagaaaaaacuuacugauccuuucacuugaugggauaaauauacauuuauaaaaucuuuauguuuuagggcauagcagauuuucccuauuucuugagauuuuuaguuucuuuaaaucucauaucugaauauuguagggagaguauuuuaugguugucaaggguuuuuuaaaguuuucuacuccguugaccuuucauuucuguugacaugaauuguuacaaaacaacagcuaucagccauuguaaaauaggauuuucuuagauguacuccauuguauuuauuccucagauuaggacuuugcuuuagguaggcucuacaaauaaagagauugaacaggaaaacuauucauuuggaaggaguacuaagugggggaggcaagaaagacacacagaaggggaggagguauuccuggagcuuugaaagacugcuuugagccugucuuuaggcuuccuaaccauguuuagaugucacuugucaguauuaagacagccuuuuuaaaaaaguugugaauuuuaagaaucaugagaauuuaauaacaaguuuuaaagggaaauuuaauuauguuuuaauuuuauuucuuucauacacauuuuccuuuuuacauacuugucauacuuuuuccuaugugcacacguuuuuauugaauguauucauaauauaggaauaguuuuugacauuauguggaauguuuuguuuaucacaaucuucauacuuacauguuuuaauauuuaguacuucaauuaggguaccuuauugauaauuuuguugcuauucugaguuugcuuuuaucuugaauaugguaaguaaugguguaggggacuacuuaauguauauuguuuuuaccuuuuuuuagcuauuuucuuuuuuuuuuugagauggagucuuucucuauugcccaggcuggaguauaguggugcgaucucagcucacugcaaccucugucucccgggcucuaaugauucuccugccucagccucccgaguagcugggauuacaggcacgcaccacuaugccuggcuaauuuuuguauuuuuaguagagaugggguuucgccacguuggccaggcuggucuugaacuccugaccucagguaauccacccaccuuggccucccaaagugcugggauuacaggcgugagccauugcaccuggccuuuucaguuauuuucuuagaaaugagguuguuuguucaaaggguuugaguauuuguauggauuuuaauguuuuuggcuauauguaacuuaaaaaucucuuuucuacuuugauccaugacagugaaaaagaaggaagag

SEQ ID NO: 131391 - RNA, 46 nt, Homo sapiens
aggacuccuucuaauggagcugaagggcugacuccccggaguggaa

SEQ ID NO: 131392 - RNA, 1564 nt, Homo sapiens
auugaagaugcugcugauguggaugcucgaaagcagguggguaacuguacugaaagaagcgugaguuuggcugaaugugucaguaggcuggaagaaugaagaauagccauuaaaugucccaagaucucuaccuaguccuuuuuaauauugaaaaaacuucuaaaguaaauaacuuaugucauuaauaauguauccucacauaauuaacauacucacaauauuuugaugagcauucuuaaaaauauauauauggaaauuuaaauacauucugucaaauucauuaugcuucucuaaaauacacauagguagucuuuuagacauugcuucaaucuagcaaagaaaagauguuauugguuagucuuaaaaacaaauacaucuugguuccuggguggugcgauguacgagccuguagucucagcugcucgagaggcugaggugggaggauucuuugggcccaggaguuugaauccaguccggggaacauaguaagaccucuaucuaaacuggaguuggaaauuuagauagagugugucaaaauaauauuaguaacacuuuguacuaauauaucuuauacguaauuacuuucucauuugcacguaacagcacagugauauaaauaggaucgguauuacagguugaacauugcuaauccaaaaauccaacaccugaaaugcuccaaaauucaaaacuuuuugagugccgacaugaagcucaaaagaaaugcucauugaagcuuuuuggauuagaguuaguauaaugcagauguuccagaaucugaaaaaaucagaaauccaagauacucugggcccagauauuucuaguaaggaauacucaacaagcucagaugaauugaggucucauggucucaacuuucucaggucucaugguggguaaguggugaauccuaaacuagaacugauauuuuaugaccccuuucaguagcugcaguccauugcuggaugauuuuagggaccuugaaucucaggggauuggagugagaaugacaucaguggaaacaauauuuuagaggggacccauguaaaugugcuuuucaguggggaacagaggaugauacuuuuuguguuuaguucucagcuacuuugaguuacauuuacuccuucagaaauggcaugaaauuuuaauguguuaucccacauuauucauaagaaucaggaaacaauacauuuuuuggcuggcuuuuugaguuaaaagucaguaauuuuggagugaaagggaagaaagaguuuugucgugggagucucuuuggaguuuagguuuuccauuuagaugagaaaaguuuguuacgugauauggauccaugcaaguuuggagaaugcucuaguagacauuggaagcucuuaguuucuauuauaaugagagugaauagacugauucauuucuguugccuuagcauugccuuucuacaaacuuaaaccgauuucuaaacuuuagcuauugaacacacaugaucuuacauaccaaaguguuuuuagcuuuacugagagauaucaaauacgcuauagcugcaauaaaggauauaaaaaucauuuuuuaggccauacga

SEQ ID NO: 131393 - RNA, 344 nt, Homo sapiens
aguaaguguuagaauuucugguuuaggaaguuuuaaguuucuuuuuauaugauugcugcguuuuacaucauucauaaagacuauaaaacaaaauuucaucuacuuucuggaauauagcaaaguaguucucaaauccaaucuuuaaaauguuucaguaguaccagaaagaauuuagaaggaaaaaaauggaaauugcuuuugaaaauguaaaaccgcuguuuaauucaugcuguaacagguaauaacauuaauauauuauagugauauguuugguaauuguauuuguuuuaaaauuuuagguaaaugaaacuauucuaagacccuuaaauguagaaccgccuuua

SEQ ID NO: 131394 - RNA, 3034 nt, Homo sapiens
ucuccaaagaagagcugaaaaagguaugauugagcuggaauauuucuucuugagauuuagguaguuguuaggugcuguguaucauggacaaauaaugaacuuauuuuucccuguugguauucauaaacaacugaaauguaugauuaggagaugcauguuuagauuaaguguuaugaaaaggacaugcuuuaaauaccuccaucccccguguucagugugauagaccuuuagcaaauaaacaccgccaggguguuuuugguucauggguauuaauggcuucguugacaguuguuacaguugccguuuucuguauucagcucugcuaucucugaauaaaaauuagaugccuuuaguacuuaaacaucacuuauuuagaauaauaugaagaggugagagagacuaauauaaaaauguuuauagauuaaaccuuuuagcuauugaaaggaaggaaguauuuuuuuuacugaauauauuccccucacaugauuucccccuacucuuuuggauaaggacaugaagaaaugauuucuuauaugaagucuguaucuggucuuuucuucuacaugcauuuuauuccuucuguuuugacagagcaaacaacugugauuguaaauagaaaucuccauaauuguauaagaagauacagugggucucaucguuggaagcagaguggucauuagcuuaaaagucuuuuuuucuuuagccuucagcccugaggagcagugauagaccuauggauuuggaaugagcugcuguauacuuaggauaaaacaaacaagauucuuacaaacucuccugucuucucuccugcauucuuccucuuucuucgcuuuucacaauuucuuacuuuguguuuucuuuauugcauaaguaauacauuauuuauuauaggauuuuuagaaaauagagaaaggaaggaggguuucgauuuauauuucaauaacuugucccugauuucagaauaacugagucacucauuuuuuaguaagugcaguagggaaacuaacaucuguugaguugccuacucugucgagcacauuuaaucauugaacugggauugagaaucaggcuacgaaauugauacuugcacaguuuccucuuuugaaagugaaaauaugaggggaagaggaauuuaggaaauaaauuuuccuaaauuguauguauggaaaccuaaaacaaggaucacauuguugcuuuuggagauucuguagaggguaaacccuaacacaauuuuugaaaaauaauaauucuaaguauugguuuguaauuguuugaaacaaaguagcuuaaauauucucucauauuuuaucuguguauaucucucuuuguuccaaaaagaauuugaagcagcuauuuaguuagcagauuauuuauggauaguuuaaagauaacuuagccauauucucucguaaugauuauaagaucugaacuuguaaauuuuuacucugugcaguuucagagugaaauagcauuucucuuuuaauaaacugucagauuuucuuuuucuuuaauauacuuuaagauauguuaacauugauuuguuuccauuauuucccuuaagguauuaaguguccauuuuuucuucuauagagaugauuuuccguuucuuuuguuaaaauuuuuuguuuaucaaucauuucucuugauuuuguagauuuugauguguuuauuuucauuauuacuggaaagauugaaagccuucuguaaggcacagaaggugguucccaguuuuucauaagccaugaagcaaagggcugggaaaaaauucauaugcuuauggaauucugugugucuggcauugggcuaggcucuauaguauauuguucacuuaauccuaauaacaaacacaucugaucuaaggucagcaucaucauugcuuggaaagcuguuuuucagcuuuccaggcugaaaaagcccugagaaaugggcucagauaaauuaagcaagcucaaagagcugcuucaaugguaaagcugugaucugaacccaggccuguccagcuuucccucucauucugucauuuuacacuauuuucuuuaguagugaacuaaacugguuuaugaucuaucaucuaauucgugccccagucucauuaucuggcaaugucagggcauuccuucaggaugagaaaaaugccaugugacaaaaagaugccuagcuccccuuuaccaucacgugagguccugcacacaugguggagugggagaguggaaggggcacacccaguggugccauuuguauucugccucaucugccuacuaacgauguggucuuaacaagugguugaaucucuaugagccuuaguuucauuagcuuuuuuuuuuuuuuuuuuuuuuuugagacugagucucacucuguugcacaggcuggggugcaguggcacgaucccagcucacugcagccuccaccuccuggguucaagggauucuugugccucagccuccugaguagcuaggauuacaggcaugugccacuacguccuacuaauuuuuacauuuuuaguagacacgagguuuugcuguguuaaccaggcuagucuugaacuccuggccucguuauccgcccaccucagccucccgaagugcugggaucauaggagggagccaccgugccuggccaaauuucauuagcuuuuaaaugagguuaauauuggcuaauuuguaaggugauuaugaucuuuggauauaauguagguaaaacuuuuaaaccuaguuucucacacacacaauagguaccugagaaaugauagcugcuguuauagugagugaaagcaaaggauguuuauacuuuugaggaaacauggaugcuugauuuuuaaaaagcagucugcauugacucaaaggcuucuuaagcuauuuuuccuagguauuguuauccacccuuccaaaaaacaaccaaccacaucuuggauuugacucaaggcaugagggaaaaaauuagucuucuaaagcucucuggauauggcaaguguuuguaguacuuaaacuuauugaaauuauuauuguaaacaggcccaggauguuuuggugcagga

SEQ ID NO: 131395 - RNA, 46 nt, Homo sapiens; identical to SEQ ID NO: 32234

SEQ ID NO: 131396 - RNA, 45 nt, Homo sapiens
ugaacauuuauaaauggacuaauacugcuugucuuucccccaccg

SEQ ID NO: 131397 - RNA, 47 nt, Homo sapiens
cucucuguuccucuuuuaauaccacacgucuguugcuugcauuuagu

SEQ ID NO: 131398 - RNA, 45 nt, Homo sapiens
acggaggccguucccggagggggaaacugaggggcccaccggaga

SEQ ID NO: 131399 - RNA, 49 nt, Homo sapiens
accggcaagcagcggaggagauccgaauccuggaacaccugcggaagca

SEQ ID NO: 131400 - RNA, 42 nt, Homo sapiens
uaugaugaugaccagggaucauaugugcaggugccccacgau

SEQ ID NO: 131401 - RNA, 45 nt, Homo sapiens
ccugaaauauauuucuugggucuaaaugcuaagaagcgccagggc

SEQ ID NO: 131402 - RNA, 46 nt, Homo sapiens
uggggaaggugaaagccacccccaugacaccugaacaagcaaugaa

SEQ ID NO: 131403 - RNA, 29 nt, Homo sapiens
aacaagacagacauggucccugucuucau

SEQ ID NO: 131404 - RNA, 53 nt, Homo sapiens
gcccuggcuguguucaggaucaguugcaggggguuaugggaguaagaagccaa

SEQ ID NO: 131405 - RNA, 48 nt, Homo sapiens
caggcacacagugcugaggauucauucgcagguggauagccugaguga

SEQ ID NO: 131406 - RNA, 37 nt, Homo sapiens
aaagcaccuaacaggugcuguggucucugggagggga

SEQ ID NO: 131407 - RNA, 48 nt, Homo sapiens
gaggccgccgaguuuuccggggagcggaggggcggcugcgcgcaaacc

SEQ ID NO: 131408 - RNA, 51 nt, Homo sapiens
uuguucucacacacacugucucuaccuccauuacagcagcuuucauauaau

SEQ ID NO: 131409 - RNA, 38 nt, Homo sapiens
uuugaaauuacuggaauaugacaagugcugcugucccc

SEQ ID NO: 131410 - RNA, 53 nt, Homo sapiens
caauaaacaccaaaguaauuuacccuugcuugcucccauuuugguuauuugca

SEQ ID NO: 131411 - RNA, 51 nt, Homo sapiens
caucucuaucuaggcacuaggcacucacaccucacaaacacaaacauccac

SEQ ID NO: 131412 - RNA, 87 nt, Homo sapiens
ggcaacuugccacauucauguuccuucaacuuauaguaauggguaacuggauggggcaauuugaacuagaauuuaaaguaaaaagga

SEQ ID NO: 131413 - RNA, 43 nt, Homo sapiens
acacucugccauaaaguacuauaaugaauaauuaaaacaacua

SEQ ID NO: 131414 - RNA, 52 nt, Homo sapiens
ugcacuuugccaagaagcacaacaagaagggccuaaagaagaugcaggccaa

SEQ ID NO: 131415 - RNA, 44 nt, Homo sapiens
uuucaacacgucaucaugagaacugguagcacuggacauaagug

SEQ ID NO: 131416 - RNA, 46 nt, Homo sapiens
ucuuccagacuucagaauuugagacugaauaauuuaauucccaggc

SEQ ID NO: 131417 - RNA, 51 nt, Homo sapiens
augauggugauauugacugagguuuaguggaugaugaugguuagggagaga

SEQ ID NO: 131418 - RNA, 49 nt, Homo sapiens
gcacaccgucagcaucuccacucccuguagucacagaccacgccaugac

SEQ ID NO: 131419 - RNA, 28 nt, Homo sapiens
accgccgugaccaggggccgcugccgag

SEQ ID NO: 131420 - RNA, 88 nt, Homo sapiens
cuggaaguaacuguggauuuuaagaaacuaaugaaauauugucgcauaaaacaugcaugggcaagaacuauucacacuuuucagguaa

SEQ ID NO: 131421 - RNA, 49 nt, Homo sapiens
ucuuaaugguaauuguaauucuuauauuuuauguuugacccaaagauag

SEQ ID NO: 131422 - RNA, 40 nt, Homo sapiens
cuuguauuuguucucacaguguagauacccucacugaaag

SEQ ID NO: 131423 - RNA, 53 nt, Homo sapiens
ucucccacgucuauaaaagcggguauggacacagaauuucccuuaccaaguug

SEQ ID NO: 131424 - RNA, 50 nt, Homo sapiens
uguuuucuagcgguaaucuucccuucaucugaaaaaugaagggcucagca

SEQ ID NO: 131425 - RNA, 46 nt, Homo sapiens
gauaagacauuuauuuuugucaggcucccagaagaggaugccaguu

SEQ ID NO: 131426 - RNA, 45 nt, Homo sapiens
cauuagacaguuacccaguauugaaccugguaacuugcugaaaga

SEQ ID NO: 131427 - RNA, 43 nt, Homo sapiens
ggaauggaaaagaauagggagcuuucuguguuuaagaacgaug

SEQ ID NO: 131428 - RNA, 31 nt, Homo sapiens
uuuuuaagcauauagagcaguuggaagaaag

SEQ ID NO: 131429 - RNA, 61 nt, Homo sapiens
ugcuugccucuauucacaccacaaaaccugagaauucaagcgaugaugcauugaaugagag

SEQ ID NO: 131430 - RNA, 36 nt, Homo sapiens
gaaugcauuaauaauguauuccagacugaagcagau

SEQ ID NO: 131431 - RNA, 74 nt, Homo sapiens
gaucaaggagcuaucaauaucaaguucaaggauuuccgucuuacuuuuugcagucugauaugucaccaccaaau

SEQ ID NO: 131432 - RNA, 33 nt, Homo sapiens
gcacccuaccagacaucuuuagagagugcugua

SEQ ID NO: 131433 - RNA, 51 nt, Homo sapiens
uguucaucgacgccgaggagcucugcagugggggcguaaaggcuggcagcc

SEQ ID NO: 131434 - RNA, 26 nt, Homo sapiens
guccucagagccuccaucugccaaga

SEQ ID NO: 131435 - RNA, 46 nt, Homo sapiens
gggaugaauaugaacaguacaaaaaagaauaaauucuaccagaaga

SEQ ID NO: 131436 - RNA, 85 nt, Homo sapiens
gccagaauaacaauuuacuaccuucugaugaaggccugaggauagacagaaugacucagaaaacuccuuuugaaugcagccaguc

SEQ ID NO: 131437 - RNA, 45 nt, Homo sapiens
ucuccucuauuccuggagaauguaccaaguauuccaguggaagau

SEQ ID NO: 131438 - RNA, 43 nt, Homo sapiens
agaugucuacagcuuuggaauugugaguaccaacugccaguua

SEQ ID NO: 131439 - RNA, 42 nt, Homo sapiens
cuagaacaucagaguuguaccauaaauaugaccagcagcagc

SEQ ID NO: 131440 - RNA, 28 nt, Homo sapiens
agagaucugaucagaaacaagaauauua

SEQ ID NO: 131441 - RNA, 41 nt, Homo sapiens
ugaguucaucaaauccuuuccugaaugcagaguuugaagaa

SEQ ID NO: 131442 - RNA, 51 nt, Homo sapiens
uuuugacuugggcagaaaaggagcugauugcuuacuuguuuuucugaugaa

SEQ ID NO: 131443 - RNA, 51 nt, Homo sapiens
acccccugucggugaauuuuuuucuauuugcccuuuaucuucaaccugucc

SEQ ID NO: 131444 - RNA, 409 nt, Homo sapiens
aaugaacaauguaggauagacaauucuguguacagauggucccaauuuaugaugauucaacaaaaugauuuuuuuuacuuuacaauggcacaaaagugauauguauuauguagaaaucauacuuugaguauccccauacaaucauucuguuuuucacuuucaguacaguauucaaugaauugcaugagguagucaacacuuuauuauaaaauagccuuagcacuagaugauuuuacccaacuguaggcuaauauaauuguccugagcacauuuaacauaggcugggcuaagcugggauguucgguagguuagguguauuaaaugcauuuucgacuuaccauggguuugucaggauguaaccucauaaguugagaagcaucuguauuuuaguaauuauuaauggcacuuu

SEQ ID NO: 131445 - RNA, 53 nt, Homo sapiens
aaacuuuuucagauuuuuuuuuaaccaagaugugaagucgggaagcagggagg

SEQ ID NO: 131446 - RNA, 43 nt, Homo sapiens
uauccaaauaacccaagucauaaacaccaaauuagugaaauuu

SEQ ID NO: 131447 - RNA, 436 nt, Homo sapiens
agauuuguguuguuaaaauaugacuuagauucuagguuagauaguggauuggaaguuggcagaagaauugggggaaagauggcaagagcuagcuggaggcaggcugggcaugguggcucaugccuguaaucccagcacuuugggaggcugaggugggcggaucacuugaggucaggaguucgagaccagacuggccaacauggugaaacccugucucuaccaagaaauacaaaaaaaaaauuaaaaaaaaaauagcugggugugguggugccugccuguaguuccagcuacucgagaggcugaggugagaggauugcuugaacccaggaggcagagguugcagugagccaagaucacgccacugcauuucagugugggcaacagaguaagacccuaucaaaaacaaaacaaaacaaaacaaaacaaaaccaccaga

SEQ ID NO: 131448 - RNA, 82 nt, Homo sapiens
uggcaggcaguaaaggaggggaauuacauuccugguggaacaaauagcaguugcagagaccuggagguguguguaugaaaac

SEQ ID NO: 131449 - RNA, 46 nt, Homo sapiens
uaaaauuacuucacuucccucucuuucuguuucuuacuuuuuggaa

SEQ ID NO: 131450 - RNA, 40 nt, Homo sapiens
cacaccucacgcucacgccgaccggaagucuuugcacuuc

SEQ ID NO: 131451 - RNA, 143 nt, Homo sapiens
gaaaccauuguuuucugucacgccccccgacccucuccccagacuguagacuccacgaagguagagggaaaggucuuguucacugcugaaucgcacacuuuuugcauacuuguugaacgaaccacuaacauuuuuugaacgcc

SEQ ID NO: 131452 - RNA, 51 nt, Homo sapiens
augguacauacacagucacuaaauaacaagauaucaaaucaaacuuguggu

SEQ ID NO: 131453 - RNA, 42 nt, Homo sapiens
auccauauuggguacuguccaugcuggucuagaagagucuuu

SEQ ID NO: 131454 - RNA, 27 nt, Homo sapiens
uuuaagagucuaccaggccaaacccuu

SEQ ID NO: 131455 - RNA, 42 nt, Homo sapiens
gaaugguguacuguagugaccugggaaaggaagagagguaua

SEQ ID NO: 131456 - RNA, 55 nt, Homo sapiens
ucaauauauaaucuuucuucuuacucuccaaacuugcugacccaaauuaaugugg

SEQ ID NO: 131457 - RNA, 46 nt, Homo sapiens
agcuggaggaaauuuucuaguaauugcuccauccuacuguuagggc

SEQ ID NO: 131458 - RNA, 74 nt, Homo sapiens
uuuguugagcaaaugaccacagaaugucaauguguaugggacacacgggggauacagaugaaugaguggaaugc

SEQ ID NO: 131459 - RNA, 23 nt, Homo sapiens
gaaaacccuaggccagugaaaga

SEQ ID NO: 131460 - RNA, 45 nt, Homo sapiens
cagccugcaagaauguauguggauuugaaacgguuugggaguaaa

SEQ ID NO: 131461 - RNA, 46 nt, Homo sapiens
agacagcaguuuguuuccuuucccuuuuuaugaauggugguaguau

SEQ ID NO: 131462 - RNA, 29 nt, Homo sapiens
aaggucaucaauccagagaagaccgugaa

SEQ ID NO: 131463 - RNA, 46 nt, Homo sapiens
caguagaaagccauguggaugggaaggggagagaugugauuaugua

SEQ ID NO: 131464 - RNA, 83 nt, Homo sapiens
guucaugguggugaugcuggucccauuccccuugcaaagcaggucuggccuguuaaaaagggccaugaaaucugcagggacug

SEQ ID NO: 131465 - RNA, 45 nt, Homo sapiens
ccaucuccauaauaacuguaaaacugaaacauacacguucuacaa

SEQ ID NO: 131466 - RNA, 45 nt, Homo sapiens
uuaucugaagagaauaaauuuuaaauucucaguuuaugucucaga

SEQ ID NO: 131467 - RNA, 47 nt, Homo sapiens
gaacguuccagaagucuuaagguuccaaagggauuuagcagugaggc

SEQ ID NO: 131468 - RNA, 46 nt, Homo sapiens
auccugugacaaaauauuaguuauaccuucuaaaguauggcaaggu

SEQ ID NO: 131469 - RNA, 46 nt, Homo sapiens
gauauggugguaaagauuauagguaugauauuuguaagaaucucaa

SEQ ID NO: 131470 - RNA, 46 nt, Homo sapiens
uuugugucguucugcguuacaugaaauaucgauggacaaaagaaga

SEQ ID NO: 131471 - RNA, 73 nt, Homo sapiens
uaaauaguaguuagaauuuaaauguucacuuaucaguguaauggaagaaaugcuuuuuucuagaaagugaauc

SEQ ID NO: 131472 - RNA, 48 nt, Homo sapiens
gguagaaauaaaacuuuguuauaagacugucacagaaaaacaagugug

SEQ ID NO: 131473 - RNA, 46 nt, Homo sapiens
uauauuuaacacuucauugcaguggaucuuagaaaauggaaaagau

SEQ ID NO: 131474 - RNA, 88 nt, Homo sapiens
gaugccuaacaagauuaguucugcuuuauaaaacuuuuuauuacauuugcaaauuugauacauuagaauaacuuaccaguuuuauauu

SEQ ID NO: 131475 - RNA, 42 nt, Homo sapiens
uuucaaaaccuucuuaaccuuuaacacaaugaauauguuuaa

SEQ ID NO: 131476 - RNA, 46 nt, Homo sapiens
aauucccaauuuaaaaugacugcuuuagcacaaucuagccaaaauu

SEQ ID NO: 131477 - RNA, 47 nt, Homo sapiens
guggcaguucuagucaaagaacgcuuucuguucaagaggcagcugcg

SEQ ID NO: 131478 - RNA, 32 nt, Homo sapiens
augugguugaguuagauuaaaacaagacauga

SEQ ID NO: 131479 - RNA, 48 nt, Homo sapiens
gauagaagauauugguguguuuuuagaaauacugaaaugauuugggga

SEQ ID NO: 131480 - RNA, 42 nt, Homo sapiens
auauuugaggcuugaaauaaucugaacuaaaguauugaagaa

SEQ ID NO: 131481 - RNA, 53 nt, Homo sapiens
aucacaagauaauuuguuccuugcaacaaggugugauuaggaaccauuggaaa

SEQ ID NO: 131482 - RNA, 45 nt, Homo sapiens
agaaaagaucaguaaaacuaguaacauuuuuggaauugguggggg

SEQ ID NO: 131483 - RNA, 36 nt, Homo sapiens
augauaaaagguaguacauuacugagauucugagaa

SEQ ID NO: 131484 - RNA, 42 nt, Homo sapiens
uccuuaucaguauuuaaaccuuucaagcugucugagcagaua

SEQ ID NO: 131485 - RNA, 55 nt, Homo sapiens
ucuggccaugagccuggaugacugagagaaugauaauaucauuggaggaauuaga

SEQ ID NO: 131486 - RNA, 32 nt, Homo sapiens
ucgguaauugguuaucuacuuaguaucuggua

SEQ ID NO: 131487 - RNA, 60 nt, Homo sapiens
uuaagugagauaaugcaucuaaacuaguguugucuggcacauggaaaucucuuaguagau

SEQ ID NO: 131488 - RNA, 56 nt, Homo sapiens
aaauaguaugcuuagggaaauacguuuacuuugaguaauaguuuucaccagaagau

SEQ ID NO: 131489 - RNA, 37 nt, Homo sapiens
uauagugcauuucuuaaccuaacauuugauuuuuauc

SEQ ID NO: 131490 - RNA, 46 nt, Homo sapiens
auuuuuccuaauacugggacugacuuaccuaggaaugagagggaca

SEQ ID NO: 131491 - RNA, 42 nt, Homo sapiens
accgaagcuuuccgaacccgaagaggaacuucuccagcaauu

SEQ ID NO: 131492 - RNA, 43 nt, Homo sapiens
ucccucccagugcggcgguggccgccucuaguucacucaggau

SEQ ID NO: 131493 - RNA, 27 nt, Homo sapiens
cgcggagcagggaggagggugugauca

SEQ ID NO: 131494 - RNA, 119 nt, Homo sapiens
gccucuccccccgcugacugcuaaaucggccggcggcaggcuggagacuucaguucagggagggggaggacucgcgaugaaugacagggcggcggcugccgggagucuagacaggagcc

SEQ ID NO: 131495 - RNA, 42 nt, Homo sapiens
uccagcagacagguauuaaaggacgacucccuuucccggcau

SEQ ID NO: 131496 - RNA, 37 nt, Homo sapiens
gauucuuuuuuuuaauaaguguuucuacuggagagag

SEQ ID NO: 131497 - RNA, 46 nt, Homo sapiens
uacuuguaaggaucuuagauuuugaacaaaagaugaaaagcaggac

SEQ ID NO: 131498 - RNA, 64 nt, Homo sapiens
cagaagauccaagaaccaaauacuuucccagcaauucucagaucaaugugugguuaucagaccu

SEQ ID NO: 131499 - RNA, 52 nt, Homo sapiens
cuaaguauuauaauuacacccugucuaucaaugggaaggcacggaagcaugg

SEQ ID NO: 131500 - RNA, 44 nt, Homo sapiens
gcaccucaguaccagaaggcuuuccagaaugucuuugcaccaag

SEQ ID NO: 131501 - RNA, 26 nt, Homo sapiens
ugugauuuuuuuggggggcugguggg

SEQ ID NO: 131502 - RNA, 46 nt, Homo sapiens
augaguuugauaucaaaguuccacuguugguucgaggaccugggau

SEQ ID NO: 131503 - RNA, 63 nt, Homo sapiens
uacuauuuuggacauugcuggcuacgaccuaaauaagacacagauggaugggauguccuuauu

SEQ ID NO: 131504 - RNA, 33 nt, Homo sapiens
gaugcuuauaacaauaccuaugccugugugagg

SEQ ID NO: 131505 - RNA, 51 nt, Homo sapiens
cuagguguuuguagaagucuauaaucugacugcagacccagaccagaucac

SEQ ID NO: 131506 - RNA, 42 nt, Homo sapiens
gaacuaucgguuaaugauguuacaguccuguucugggccaac

SEQ ID NO: 131507 - RNA, 62 nt, Homo sapiens
aaagcaacccagucagcugacuuccucgugcaauguguuaaacugugaacucugcccaugug

SEQ ID NO: 131508 - RNA, 118 nt, Homo sapiens
acuuuaggacacacacaaacacacagacacaccuuuugauauguaagcuugaccuaaagucaaaggaccuguguagcauuucagauugagcacuucacuaucaaaaauacuaacauca

SEQ ID NO: 131509 - RNA, 52 nt, Homo sapiens
guaucaacuacuuuacccuaccuucuccccuuuuagauggguucuuccugag

SEQ ID NO: 131510 - RNA, 43 nt, Homo sapiens
aagugaaauggacaccucugcugugaauguuuuagagaaggaa

SEQ ID NO: 131511 - RNA, 116 nt, Homo sapiens
ugucauauuauucaguuuuaugcuuguuccugagcagaacucauaagagugacauagucagcugcugacggcaccucagccacgccacucuuacucaguucagugggugugcuugc

SEQ ID NO: 131512 - RNA, 209 nt, Homo sapiens
gugguaggauguggugcagcccucucuacgcucuucuauuuuugguauauuuccuaucuaaccuucaaauagcuuccaauucuuuuuuucuuggacuggcuucauucugaauuugugcuaaaauaaucuuucauaaagagaccucaguuuauagcguaacagacuacacaaugcacugauguuuucauaauguuuaagggacccacugc

SEQ ID NO: 131513 - RNA, 56 nt, Homo sapiens
augaauagagaguuugccuuauacaauuuccuguuacaaagcucucccucucaugc

SEQ ID NO: 131514 - RNA, 344 nt, Homo sapiens
gacaaauggugcuguugcaaacacuuuuuuuuugagaugaagucucgcgguugucacccgggcuggagugcaguggcgugaucucggcucacugcaacuuccaccuccuggguuccagcaguucuccugccucagccucccaaguagcugagauuacaggcgccugccaccccaccuggcugauuuuuguaauuuuaguagagacgggguuucaccauguuggccaggcugauuaacuccugaccucaggugauccaccuuucucggccucccaaagugcugggauuacgggugugagccaccgugcccggccugcaaacacauuuuaauugacaacacuaggg

SEQ ID NO: 131515 - RNA, 54 nt, Homo sapiens
aguguucuuaaacuuauuaagugucuaaacuaagguuuagugcuuuuuuaaagg

SEQ ID NO: 131516 - RNA, 47 nt, Homo sapiens
acugcuucagaaaugaaaacguugacagcaaaagcuaacccagacuu

SEQ ID NO: 131517 - RNA, 57 nt, Homo sapiens
guucugagaguuuucagggucaugguuaucaccacccccauuccuacagagaggccc

SEQ ID NO: 131518 - RNA, 46 nt, Homo sapiens
ccucaacaaccacuuuuucaagcucauuuccugguaugacaaugaa

SEQ ID NO: 131519 - RNA, 39 nt, Homo sapiens
accccuggaccaccagccccaguaagagcacaagaggaa

SEQ ID NO: 131520 - RNA, 53 nt, Homo sapiens
uagguguggauaacaguaucucacauuuguugagaacuauguaugagccagag

SEQ ID NO: 131521 - RNA, 42 nt, Homo sapiens
aaucuugcguaucugacuuauagccaaaucugcuugcucgaa

SEQ ID NO: 131522 - RNA, 39 nt, Homo sapiens
uugaaggagaaccuguguccucuacuuuucugaucuccc

SEQ ID NO: 131523 - RNA, 72 nt, Homo sapiens
aaaauugaguuauuuuauaagcuacauagaauacaucaaaauuuuauaagcugcauagaauaggcuuuaaaa

SEQ ID NO: 131524 - RNA, 45 nt, Homo sapiens
gauaaccgaauguaaauccuuuaucagauuuuaacuugugcagua

SEQ ID NO: 131525 - RNA, 77 nt, Homo sapiens
caaugauaaugacaaugauauagaaaaugaaaacuguaugcacacuaacuaaugaaaguccuagaagccauaaaaga

SEQ ID NO: 131526 - RNA, 93 nt, Homo sapiens
cacuuucaguggaacuggcuuuuuuccucuugaccgagaaacuaaaggugcuucagcugccacuggcaucccauuagaaagugaugaagauag

SEQ ID NO: 131527 - RNA, 49 nt, Homo sapiens
aaugguacuauuuugaugacaguagugucuccacugcaucugaagacca

SEQ ID NO: 131528 - RNA, 36 nt, Homo sapiens
gcaacagcuuagcagagguccuguguagcuggaagg

SEQ ID NO: 131529 - RNA, 50 nt, Homo sapiens
guugucccauuuagagugcauuucccuccacguucuccuuccccuuugcu

SEQ ID NO: 131530 - RNA, 36 nt, Homo sapiens
auuaaugaaugagucagcuuuugaaccuuuuuuuuu

SEQ ID NO: 131531 - RNA, 49 nt, Homo sapiens
ccuugccgcuauaaucugauugcuguuuccaaccacuauggagggaugg

SEQ ID NO: 131532 - RNA, 103 nt, Homo sapiens
ggguuaauuggucucauuuauaaaucuaagauacuuuaugguacuuagugauuuuguuuauccuaggaauuacuucaucauuacucaucacuuacuccuaaau

SEQ ID NO: 131533 - RNA, 44 nt, Homo sapiens
ucaaaauuuuuauuuuuucuuagagauuuuccaaagaucaaaga

SEQ ID NO: 131534 - RNA, 89 nt, Homo sapiens
uuucuuacagucgauacaugagagacaaguuggauaccuuaguugauuuuccuaucaaguaagcuuuaauuguacuuuauaagcauugg

SEQ ID NO: 131535 - RNA, 90 nt, Homo sapiens
auuguccgaauuguaaagaacaucagcaagccacaaagaaauuggauuuauggucccugccuccaguacuuguaguacaucucaagcgau

SEQ ID NO: 131536 - RNA, 45 nt, Homo sapiens
cuuuuuuuuuuaaagguucagaguucauuuugaacguguuuuggu

SEQ ID NO: 131537 - RNA, 46 nt, Homo sapiens
gauccugauuugaaaaaaagauauuuugaugaaaaugcugcugagg

SEQ ID NO: 131538 - RNA, 45 nt, Homo sapiens
aaaaacgauuguuuacauuccaguucaacaacuuaggcaauacug

SEQ ID NO: 131539 - RNA, 36 nt, Homo sapiens
cuucccucagagaaugaaaacagucagucugaagau

SEQ ID NO: 131540 - RNA, 41 nt, Homo sapiens
gcuauggaugaaaaccuuaguaguauuauggaacgggauga

SEQ ID NO: 131541 - RNA, 44 nt, Homo sapiens
gauaaaacuaggacaaauuauccaugugggcauugucacacagg

SEQ ID NO: 131542 - RNA, 42 nt, Homo sapiens
uugagauaaaugagagaauaaccacaugugugauaugcagaa

SEQ ID NO: 131543 - RNA, 48 nt, Homo sapiens
gcaacacaccuccacuuacugaguauuuccucaaugauaaguaucaag

SEQ ID NO: 131544 - RNA, 23 nt, Homo sapiens
uaauagaaaacaugaucagcaaa

SEQ ID NO: 131545 - RNA, 49 nt, Homo sapiens
auguagaucagaggccuaagcuggaaauaaaaaucugcgugucguaggu

SEQ ID NO: 131546 - RNA, 54 nt, Homo sapiens
uuauauaucauaaugauagauguaaccauuuaaugaaauuccagaguaguagga

SEQ ID NO: 131547 - RNA, 46 nt, Homo sapiens
uucuuccucuaaauauauauauucuugcacucucacuuccauuagg

SEQ ID NO: 131548 - RNA, 36 nt, Homo sapiens
augaaagagaaaguagagugcuaacaggaacuugga

SEQ ID NO: 131549 - RNA, 83 nt, Homo sapiens
aagaugcucucauuaaguagcauuaauguugugccauuuaaaacaguuucccuaggaggugauauacacacuuacucauucaa

SEQ ID NO: 131550 - RNA, 56 nt, Homo sapiens
ucuguugcacuuuuuuuuucuuuuuuuuuuuuuuuugucuuaaugggaaauuaaaa

SEQ ID NO: 131551 - RNA, 54 nt, Homo sapiens
uuaaaaauguaugugcacaggccaaaaaaaaagagugaaaauaaccccucguaa

SEQ ID NO: 131552 - RNA, 72 nt, Homo sapiens
uucuucucuggaauuuuaaauccaagauaauuguuaagcauauuuaaaaaggaaaaauaaauggaaaaaaga

SEQ ID NO: 131553 - RNA, 107 nt, Homo sapiens
uuuuuuugacauguauagugccuuuuauggauuagauugaaaguauuuagauauuugcacuaacauauuaguauuagauauuuaucuaauacuuauacuaauuaugu

SEQ ID NO: 131554 - RNA, 47 nt, Homo sapiens
uagaauuuucuuuuucuuucagaacuugucuuagaauguugauuaga

SEQ ID NO: 131555 - RNA, 41 nt, Homo sapiens
cauagcaaaaacuagaaagacuuauuagacuggacgauaua

SEQ ID NO: 131556 - RNA, 77 nt, Homo sapiens
uaaaaucaacauuuuauuguuacauauacucugaaacaugcuuacauuuuacauagcuaggcucuaaaugccaauuu

SEQ ID NO: 131557 - RNA, 49 nt, Homo sapiens
cagcaaaaaguccuuuuaaccauccauauaauaaaauuaaccaucccau

SEQ ID NO: 131558 - RNA, 48 nt, Homo sapiens
ugaaaaggaaauaagaaaaaucuucaguauuccagaugaaaaggagac

SEQ ID NO: 131559 - RNA, 46 nt, Homo sapiens
cuaugugaaaauggaaacaugaauaauguuguaacucgaagauuua

SEQ ID NO: 131560 - RNA, 46 nt, Homo sapiens
ucagcugguacacauugauggaaggucaagagccaauagcacgaaa

SEQ ID NO: 131561 - RNA, 45 nt, Homo sapiens
guggaaaaaauauguuggcuuugacaguugggacaaauaccagau

SEQ ID NO: 131562 - RNA, 52 nt, Homo sapiens
uguguggagaagaaaauagguuagaagugcauggaaucuaaaaauuaagcua

SEQ ID NO: 131563 - RNA, 48 nt, Homo sapiens
aggaaccucauacccauuaauagucaccucccauuucucucccaaacu

SEQ ID NO: 131564 - RNA, 56 nt, Homo sapiens
auuucuguuauuuacccauauguuuuuacagcuuaacaaaguuuaacagguuaguc

SEQ ID NO: 131565 - RNA, 28 nt, Homo sapiens
uagauccuuuagauuuuaucacccaguu

SEQ ID NO: 131566 - RNA, 342 nt, Homo sapiens
uaauaauaguuauuguuggccuggcagggugguucacgccuguaacccagcacuuugggaggccgaggagggaggaucacuugaacucaggaguuccagaccagccugggcaccauggugaaaccccgucucuacaaaaauacaaaaaaauuagcugggcaugguggcacgccuguggucccagcuacucaggaggcugaggugggaggauugccugagccuaggaagcggagguugcagugagccgagauccggccacugcacucuagccugggcaacgugagacuccaucucaaaaaaagaaaaaaaaaaguuauuguuuuuauuauaauguuagauguu

SEQ ID NO: 131567 - RNA, 64 nt, Homo sapiens
guggcaucuacaauaacuuaaauaugugaauauguaacauaauuuaaaauuccuuauuuuuugg

SEQ ID NO: 131568 - RNA, 42 nt, Homo sapiens
agagaaagggguugagaugcccgcgguugcccgaggauagug

SEQ ID NO: 131569 - RNA, 44 nt, Homo sapiens
guuguucaaagguacaguuugagacuaaacguaaggcuggguau

SEQ ID NO: 131570 - RNA, 30 nt, Homo sapiens
acaugaugaugccaugaaaggcagagagag

SEQ ID NO: 131571 - RNA, 40 nt, Homo sapiens
cauucuucauguccuagguaagauaagaauguaggcacag

SEQ ID NO: 131572 - RNA, 66 nt, Homo sapiens
ggagugcauauaugauuucaaugauuuacaggcuaaauagauuuuagaaauaaucaucuuaaaauu

SEQ ID NO: 131573 - RNA, 41 nt, Homo sapiens
ggggugucgguaguagacuuugugcgguuugaauguggaga

SEQ ID NO: 131574 - RNA, 46 nt, Homo sapiens
uggggaaguauggggcccuggucaucugugagacgucugaacagaa

SEQ ID NO: 131575 - RNA, 42 nt, Homo sapiens
gaaagguagguggugucaucucuauuuuaaaggugaggaaac

SEQ ID NO: 131576 - RNA, 21 nt, Homo sapiens
uuaucuuuucuguuuuugaug

SEQ ID NO: 131577 - RNA, 507 nt, Homo sapiens
uggccaggugcaguggcucacgccuguaaaccuagcacuuugggaggcugaagcagguggaucacuugaggucaggaguucaagaccagcguggccaacauggugaaacccugucuccacuaaaaaagauauaaaaauuugccaggcaugguggcgcaugccuguagucccaucuacucgggaggcugaggcaggaggaucgcuugaacccgggagguggagguugcaguaagcugaaaucaugccaccgcacuccagccugggcggcagagcgagacuccaucucaaaaaaaagaaaaaacuguucuuggccaggugcaguggcuuacgccuguaaucccaacacuuugggagacugaagcaggaggaucucuuaagcuaagaguucaagaccagccugagcaacauagggaaaccccaucucuauauuuaaaagaaaaagaaaauaauuguucuugauuucuaggaaauuacauucuaggaaguuaggcuggaggaugagagugg

SEQ ID NO: 131578 - RNA, 45 nt, Homo sapiens
ugaugcauugucagacccuaaaggaucaacccucugcauacagua

SEQ ID NO: 131579 - RNA, 51 nt, Homo sapiens
acaaggaggcccagaaggagggcuggagcaaagcugccaagcuccaaggga

SEQ ID NO: 131580 - RNA, 32 nt, Homo sapiens
gacuguuacgguguuucuuguugccuggagcu

SEQ ID NO: 131581 - RNA, 59 nt, Homo sapiens
uuagcagagggcgcugcgaaagcgccuucucgcuguccugagguguggagauccugcag

SEQ ID NO: 131582 - RNA, 48 nt, Homo sapiens
aaaauguguuuuucaucuggaguugcacagaaucauggaauuuugugu

SEQ ID NO: 131583 - RNA, 46 nt, Homo sapiens
ucucugcacagguugcaaaucccaaaugcagcaguggguucugagu

SEQ ID NO: 131584 - RNA, 45 nt, Homo sapiens
ucugcucuuucagaucugcuacggcauguauggcuucauggaugu

SEQ ID NO: 131585 - RNA, 42 nt, Homo sapiens
cuucuuuucuguugcagccuuacuuagccucuugcccugucu

SEQ ID NO: 131586 - RNA, 25 nt, Homo sapiens
ggccgggcgcggaggguggaggcgc

SEQ ID NO: 131587 - RNA, 23 nt, Homo sapiens
aucccggagccggagggggacug

SEQ ID NO: 131588 - RNA, 44 nt, Homo sapiens
gggaaguggggccuuuguggucaugggaaaguauaauuuuaggg

SEQ ID NO: 131589 - RNA, 87 nt, Homo sapiens
caguggcugaaauuggugucggugccuaugggacaguguacaaggcccgugauccccacaguggccacuuuguggcccucaagagug

SEQ ID NO: 131590 - RNA, 44 nt, Homo sapiens
cuggaggcuuuugagcaucccaauguuguccggugagaaggugg

SEQ ID NO: 131591 - RNA, 48 nt, Homo sapiens
ccgagaucugaagccagagaacauucuggugacaagugguggaacagu

SEQ ID NO: 131592 - RNA, 46 nt, Homo sapiens
ggccuggccagaaucuacagcuaccagauggcacuuacacccgugg

SEQ ID NO: 131593 - RNA, 67 nt, Homo sapiens
cccccagagggccccgcccagugcagucggugguaccugagauggaggagucgggagcacagcugcu

SEQ ID NO: 131594 - RNA, 45 nt, Homo sapiens
cacuccggauuaccuucauccuuauguagauaagagugcugcaga

SEQ ID NO: 131595 - RNA, 44 nt, Homo sapiens
uuuauauuugggguccuuuuuuauacaggaaaaacaaaacaaag

SEQ ID NO: 131596 - RNA, 51 nt, Homo sapiens
gcaaagccaaacagaggaagaaacauuaaaaaaaaaaaaaagaccauuauu

SEQ ID NO: 131597 - RNA, 46 nt, Homo sapiens
guuuugguuugagaaaaaggaaaggccccuugucacauccucuaaa

SEQ ID NO: 131598 - RNA, 45 nt, Homo sapiens
ugauuccgaaaucucauugcuagccaaacaccaaggaucuguagg

SEQ ID NO: 131599 - RNA, 45 nt, Homo sapiens
uguguggagaaaaguuucuuaagcauucagacgaagcccugaaaa

SEQ ID NO: 131600 - RNA, 35 nt, Homo sapiens
ucuggcucuugcagaucugaggauaaaacgugaag

SEQ ID NO: 131601 - RNA, 45 nt, Homo sapiens
aaucucuugcucaugucuggcuauuaaccgaagcaaacagguaag

SEQ ID NO: 131602 - RNA, 45 nt, Homo sapiens
acuugguggugguugacagcacccaccaguccagccacugcaaua

SEQ ID NO: 131603 - RNA, 49 nt, Homo sapiens
ugggucugguguccagcauccacaucaucggcggagucauugcuguggg

SEQ ID NO: 131604 - RNA, 42 nt, Homo sapiens
augauguggaugcuggacaccagacccaggcccuugccccaa

SEQ ID NO: 131605 - RNA, 45 nt, Homo sapiens
uucccucgucgccggaaguuccugggaaucuucccggaaccccca

SEQ ID NO: 131606 - RNA, 83 nt, Homo sapiens
ccugcuccaagaaugcgcuuugcgcucucaacguggucuacauggugagguuuuggaggugggggaagcuucaaggcggaaag

SEQ ID NO: 131607 - RNA, 61 nt, Homo sapiens
gaccccgacagcuucugucucuuuaaaucgaggccagccaaacccaauacucugcgccugc

SEQ ID NO: 131608 - RNA, 48 nt, Homo sapiens
gcugagcuuucuguggucggaguuaggagagggcuaauucccagggag

SEQ ID NO: 131609 - RNA, 47 nt, Homo sapiens
ugcgcuggccugaggccgcuauuuccacacugaauuucugguauauu

SEQ ID NO: 131610 - RNA, 45 nt, Homo sapiens
uauaccagaaauucaguguggaaauagcggccucaggccagcgca

SEQ ID NO: 131611 - RNA, 38 nt, Homo sapiens
acaaucccagugaaaaaggugugaagcacccaccaugu

SEQ ID NO: 131612 - RNA, 29 nt, Homo sapiens
gugccgggagcugaagaggcccagaagga

SEQ ID NO: 131613 - RNA, 50 nt, Homo sapiens
agggaaaauugagaucaaaauuguccgcccaugggcugaagggacugaag

SEQ ID NO: 131614 - RNA, 42 nt, Homo sapiens
ugaaacaaaucgaggggcuggugaaggagcugcuggagaggg

SEQ ID NO: 131615 - RNA, 48 nt, Homo sapiens
ugguguugggaagcaggcgcaagugaggacaguguuccagaaaguggg

SEQ ID NO: 131616 - RNA, 75 nt, Homo sapiens
acauccacucucaacaaacucaucaaaagacuggaggaaaaacagaguccagagcuggugaagaagcacaagaaa

SEQ ID NO: 131617 - RNA, 45 nt, Homo sapiens
ugaaggcuggcauggagcgggaacuggaaaacaucauccaggagg

SEQ ID NO: 131618 - RNA, 45 nt, Homo sapiens
ggaagcaggaucccuuccaguuccuucucaaauucucccaguaac

SEQ ID NO: 131619 - RNA, 61 nt, Homo sapiens
auccagaacggcagagagagauggaagaagaggaggaugaggaugaggaugaggaugaaga

SEQ ID NO: 131620 - RNA, 53 nt, Homo sapiens
uguggaugaugcugcagaagucccucagagggaaccagagaaggaaaggggug

SEQ ID NO: 131621 - RNA, 45 nt, Homo sapiens
uuccuucucugguucccucugagggacuucugcagcaucauccac

SEQ ID NO: 131622 - RNA, 76 nt, Homo sapiens
aacgugcaggucaaagucauucgaagcccugcggauuugauucgauucauagaggagcugaaagguggaacaaaaa

SEQ ID NO: 131623 - RNA, 68 nt, Homo sapiens
uccucuaugaaucgaaucaaauccgcagggcuucgaaugacuuugaccugcacguuguucugaaaauc

SEQ ID NO: 131624 - RNA, 39 nt, Homo sapiens
gggagcaccagaagcugaaucugcugccucagggcuugg

SEQ ID NO: 131625 - RNA, 46 nt, Homo sapiens
uucuggaagaugcuuaaugagccagaggaccaggccccaggagggg

SEQ ID NO: 131626 - RNA, 53 nt, Homo sapiens
ccggcaccuccuccccuccuggggccugguccucuggcucauuaagcaucuuc

SEQ ID NO: 131627 - RNA, 46 nt, Homo sapiens
ccuaggguacagagaacagggagagacugaucugacaggaggggug

SEQ ID NO: 131628 - RNA, 74 nt, Homo sapiens
ugcccccacccucuccuccggcccccacccagugcugcaccgcaggccauccucugucacccuucccuacagcc

SEQ ID NO: 131629 - RNA, 45 nt, Homo sapiens
ugacagaggauggccugcggugcagcacugggugggggccggagg

SEQ ID NO: 131630 - RNA, 49 nt, Homo sapiens
agcaggacaagggcucguccacgcgaucgauguaguccccagagauacc

SEQ ID NO: 131631 - RNA, 46 nt, Homo sapiens
cugugacgagggugcagguaucucuggggacuacaucgaucgcgug

SEQ ID NO: 131632 - RNA, 46 nt, Homo sapiens
cuauggcaauggguccaagugcgaccuuaaugggaggccccgggag

SEQ ID NO: 131633 - RNA, 65 nt, Homo sapiens
uaccaagggccugggaucccugaguuguugagcccaaugagagaugcucccugcuugcugaaggu

SEQ ID NO: 131634 - RNA, 62 nt, Homo sapiens
agugucgccugccagcuggagcuauucacuuccagcgugaaagggaggaggaaacaccugcu

SEQ ID NO: 131635 - RNA, 44 nt, Homo sapiens
ggcgagggucugggcagaagaggaagcggguaagagauagagga

SEQ ID NO: 131636 - RNA, 45 nt, Homo sapiens
aagucugaccggcggugucgggagccugaaccuggaggagcugag

SEQ ID NO: 131637 - RNA, 41 nt, Homo sapiens
gaaagauggcggcggaaacgcugcuguccaguuuguuagga

SEQ ID NO: 131638 - RNA, 62 nt, Homo sapiens
ucaauaggaaaaaaagauauaacaagaaauauagaacauaacgaaaauaugugugugugugu

SEQ ID NO: 131639 - RNA, 54 nt, Homo sapiens
auaaggauggggaugggcgugggagguugugcagucaagggagggcccugaaag

SEQ ID NO: 131640 - RNA, 107 nt, Homo sapiens
gguuggguggggaagaaugggagaugauuggaaugggaggugggaaccucugaugaaugggggacuuaagcucaaacggcggcuuaggaggugggaagugaggacag

SEQ ID NO: 131641 - RNA, 46 nt, Homo sapiens
cucagcccaguacaacaucagcgcucuagucacgauugccaccaag

SEQ ID NO: 131642 - RNA, 47 nt, Homo sapiens
ccuucuggcacugcuccagaauuccuccuucuuggugugucuggagg

SEQ ID NO: 131643 - RNA, 48 nt, Homo sapiens
ugagcuguaacuggugaaaaccauggggguggugcugacucagccgcc

SEQ ID NO: 131644 - RNA, 43 nt, Homo sapiens
ucucugcgguaacccuccuucuguuccucucuuugcuccagca

SEQ ID NO: 131645 - RNA, 56 nt, Homo sapiens
uagcucaaaauuugauagaauccccuaaagcccuaagcaauugacauuggcugaca

SEQ ID NO: 131646 - RNA, 45 nt, Homo sapiens
cugugcagcggaucaugaaauaccagcugcugcucaaggucagga

SEQ ID NO: 131647 - RNA, 46 nt, Homo sapiens
caacggugucugaaagauccugauuggcuggcucagcuauucauca

SEQ ID NO: 131648 - RNA, 46 nt, Homo sapiens
gucuucgaggccgugacaggauuguguuugggaauauccagcaaau

SEQ ID NO: 131649 - RNA, 45 nt, Homo sapiens
aacugguagaaacagagaaaauguacguggacgacuuggggcaga

SEQ ID NO: 131650 - RNA, 43 nt, Homo sapiens
cagccaccugaagaggagacuuugucccaagccccugagagug

SEQ ID NO: 131651 - RNA, 42 nt, Homo sapiens
guuccccaggccccccagggcccgucaguggccugaggagau

SEQ ID NO: 131652 - RNA, 45 nt, Homo sapiens
ccucucuuuuuccucccauuagaauccuauuccauugcgggcagu

SEQ ID NO: 131653 - RNA, 54 nt, Homo sapiens
cucauccuccccucuucccagagaauggucuguacccauugaaagagggagggu

SEQ ID NO: 131654 - RNA, 42 nt, Homo sapiens
cuuaauuggcgauuagucuuagcuggagucccggggccugga

SEQ ID NO: 131655 - RNA, 46 nt, Homo sapiens
auguacacggggaggggagaacagagccuuggaggucggccucugc

SEQ ID NO: 131656 - RNA, 44 nt, Homo sapiens
acagguccccuacaggugugguguggggggcagggggcagagag

SEQ ID NO: 131657 - RNA, 43 nt, Homo sapiens
cgggucagguagguggggucuggguacccaaaccugggagcaa

SEQ ID NO: 131658 - RNA, 25 nt, Homo sapiens
gccaagggaaaggaaaugaagaggg

SEQ ID NO: 131659 - RNA, 42 nt, Homo sapiens
uccgggcuagguagagcccauuuggaggggccgggggaggac

SEQ ID NO: 131660 - RNA, 45 nt, Homo sapiens
cugucauuucucccagaucauagaaacaacuugccccucccaccu

SEQ ID NO: 131661 - RNA, 42 nt, Homo sapiens
aaauaauucagccccuauugccagggagccuuccuugagagc

SEQ ID NO: 131662 - RNA, 46 nt, Homo sapiens
ggaaaguuuggaagccgccaguguggggugggagcaauggugaggc

SEQ ID NO: 131663 - RNA, 45 nt, Homo sapiens
acaugauacgcucagugccuuagacuuaagucucugaccucggga

SEQ ID NO: 131664 - RNA, 69 nt, Homo sapiens
guaucauguuaaagaugagcggguggcagcgacagagccaaaaucagagcuggaaccugaggagagagg

SEQ ID NO: 131665 - RNA, 33 nt, Homo sapiens
uacugauucccaucuaccuuuuacccucccguc

SEQ ID NO: 131666 - RNA, 24 nt, Homo sapiens
agcggacgccccaacuuugaggag

SEQ ID NO: 131667 - RNA, 42 nt, Homo sapiens
ccuucccucgggauuagucccugccucuuuaacccgguccug

SEQ ID NO: 131668 - RNA, 43 nt, Homo sapiens
cuccagaccuguucaagacaccccuagcccuucuccagaccug

SEQ ID NO: 131669 - RNA, 73 nt, Homo sapiens
ccaacugcagagauggcagcugagucauugccuuucuccuucgggacacuguccagcugggagcuggaagccu

SEQ ID NO: 131670 - RNA, 74 nt, Homo sapiens
gguaugaggaccugcaagagguccugucuucagaugaaaauggggguaccuauguuucaccuccuggaaaugaa

SEQ ID NO: 131671 - RNA, 45 nt, Homo sapiens
cuuaccucuucauuuccaggaggugaaacauagguacccccauuu

SEQ ID NO: 131672 - RNA, 44 nt, Homo sapiens
ggucuuccuccucuuccuccugagccagggagcucugacuggaa

SEQ ID NO: 131673 - RNA, 47 nt, Homo sapiens
ccucacucuccagauuccagucagagcucccuggcucaggaggaaga

SEQ ID NO: 131674 - RNA, 51 nt, Homo sapiens
guggucauuccccagcccgggcuggaaagcagcgcaugaaggagaaagaac

SEQ ID NO: 131675 - RNA, 46 nt, Homo sapiens
uccuguucuuucuccuucaugcgcugcuuuccagcccgggcugggg

SEQ ID NO: 131676 - RNA, 47 nt, Homo sapiens
aguuggcuguagcugaggggaaacccccugaagccccuaaaggcaag

SEQ ID NO: 131677 - RNA, 46 nt, Homo sapiens
agcugccuugcucucugucaugcuucagccuuacaugcccacgguu

SEQ ID NO: 131678 - RNA, 105 nt, Homo sapiens
aacagguaggacuugguaaggggucagaguuagcagugagcugggguggggcucauuuucccucaggagaugggaauguggagagaacuagaaaaugggcaggag

SEQ ID NO: 131679 - RNA, 44 nt, Homo sapiens
ggaaaaagaucuuggagagcugcuaucuugaguuaggaguugag

SEQ ID NO: 131680 - RNA, 56 nt, Homo sapiens
cuguccaucacagccaacuacacagaccagugggagagaugguggaagaacccaga

SEQ ID NO: 131681 - RNA, 46 nt, Homo sapiens
ggcugaccgcuucguggagggcgugugucccuucuguggcuaugag

SEQ ID NO: 131682 - RNA, 45 nt, Homo sapiens
ggacauuuuccagcaguugcugaaacgagguuuugugcugcaaga

SEQ ID NO: 131683 - RNA, 35 nt, Homo sapiens
aaaauacaaaacagauaaaucuguguucaacaaaa

SEQ ID NO: 131684 - RNA, 46 nt, Homo sapiens
ccuguggcuggagaaaggaaugugcucaucaccagugcccucccuu

SEQ ID NO: 131685 - RNA, 52 nt, Homo sapiens
uaguggcuagagauuauaguaacauagcaccuggaaagaaggggagaagcca

SEQ ID NO: 131686 - RNA, 46 nt, Homo sapiens
gcuacccuaucugaggaggagauugcuauggcuguuacugcuuggg

SEQ ID NO: 131687 - RNA, 53 nt, Homo sapiens
caaaagcagccccagcccagccccgcugagggaagggcugucaccaaugagcc

SEQ ID NO: 131688 - RNA, 90 nt, Homo sapiens
uuccagacacugaguacccaggaaccaugucagcgagcugcagagacuguacugaaacagcaagguguccuggcucuccggccuuaccuc

SEQ ID NO: 131689 - RNA, 49 nt, Homo sapiens
acuauuuagugguccaaggcaagaagggggaagauguucuugguucagu

SEQ ID NO: 131690 - RNA, 42 nt, Homo sapiens
uggcugggagcaagaugaccucacuaaccaguggcuggaaug

SEQ ID NO: 131691 - RNA, 24 nt, Homo sapiens
aaguaguaagggaaggaaaggcuc

SEQ ID NO: 131692 - RNA, 42 nt, Homo sapiens
gaaagggauuagauuucauagugggguccaaccucuugcagg

SEQ ID NO: 131693 - RNA, 42 nt, Homo sapiens
gaggcagugggagcugggggugggcccaucuacuacaucuau

SEQ ID NO: 131694 - RNA, 48 nt, Homo sapiens
accuuuuccuuugauuccucuccuacuucugauccuuuaaucuucuag

SEQ ID NO: 131695 - RNA, 44 nt, Homo sapiens
ccggcagaucaaaagacauccgggggugaguccucagaaccuca

SEQ ID NO: 131696 - RNA, 35 nt, Homo sapiens
gggggucccauuucccagauacugacaaaggaacg

SEQ ID NO: 131697 - RNA, 31 nt, Homo sapiens
agcugggacagaaagaacaacccggagcccu

SEQ ID NO: 131698 - RNA, 43 nt, Homo sapiens
caguuuccacugacuauaagaagcugaagaaggaccggccaga

SEQ ID NO: 131699 - RNA, 41 nt, Homo sapiens
gacaggguggccggagugaugccuuggggccugcggggagg

SEQ ID NO: 131700 - RNA, 106 nt, Homo sapiens
cucuuucuuggggaaguugaggagugcccuucagagccaguagcaggcagggguggguaggcacccuccuuccuguuuuuaucuaauaaaaugcuaaccugcccug

SEQ ID NO: 131701 - RNA, 46 nt, Homo sapiens
ggcagguuagcauuuuauuagauaaaaacaggaaggagggugccua

SEQ ID NO: 131702 - RNA, 48 nt, Homo sapiens
uagggcaagagccagguauagucucccuucccagaauuuguaacugag

SEQ ID NO: 131703 - RNA, 27 nt, Homo sapiens
ggcaccugggaaaugaggcccacagac

SEQ ID NO: 131704 - RNA, 48 nt, Homo sapiens
caggauuucaaauccuuccugcuuaaggacucagaaacaagucagcgu

SEQ ID NO: 131705 - RNA, 44 nt, Homo sapiens
uccuuaagcaggaaggauuugaaauccuggagcuuggcuagaga

SEQ ID NO: 131706 - RNA, 50 nt, Homo sapiens
gccaaggugauucccucgccuuucaagcacgcggacaucgucaccaccac

SEQ ID NO: 131707 - RNA, 42 nt, Homo sapiens
gccuuggaagccuuugaccuggauccugcacaguggggaguc

SEQ ID NO: 131708 - RNA, 45 nt, Homo sapiens
ggguccugucugaacaacaaguacucggaggguuauccuggcaag

SEQ ID NO: 131709 - RNA, 42 nt, Homo sapiens
aguacuuguuguucagacaggaccccagggccuccagcgcag

SEQ ID NO: 131710 - RNA, 36 nt, Homo sapiens
uccccuggacucccacagucccucccugccagagcc

SEQ ID NO: 131711 - RNA, 46 nt, Homo sapiens
gaagcaaacaggggcuggacaggccaggagagccugucggacagug

SEQ ID NO: 131712 - RNA, 41 nt, Homo sapiens
uggccuuagaagcaugagugaggguggccgggagacgauuu

SEQ ID NO: 131713 - RNA, 41 nt, Homo sapiens
uuggcuccagaacuggcuuuugaagguggagguggggguag

SEQ ID NO: 131714 - RNA, 64 nt, Homo sapiens
ccucucuggaguuggggagacauaggcuuuuggaggacaagcuuugcagagugguucauggagu

SEQ ID NO: 131715 - RNA, 44 nt, Homo sapiens
ccucagcgagcucuucucgcgcaugcguucuccgaacggucuuc

SEQ ID NO: 131716 - RNA, 40 nt, Homo sapiens
gggacgagguaauuggagagagacaacacaaacgucuaaa

SEQ ID NO: 131717 - RNA, 40 nt, Homo sapiens
gagacaaggacagagauagggaauggggacaaggaucuag

SEQ ID NO: 131718 - RNA, 74 nt, Homo sapiens
auaacacagauauuguuauaaauaaaauuguaaaaaaaaaaaaaaaaaaaaaggccaaaaaaaaaaaaaagaaa

SEQ ID NO: 131719 - RNA, 44 nt, Homo sapiens
cuccagccuccccuccccuggggacgccaaggaggugggccaca

SEQ ID NO: 131720 - RNA, 42 nt, Homo sapiens
agaggaagucuccagcccugggaaccucggugggggcccugg

SEQ ID NO: 131721 - RNA, 84 nt, Homo sapiens
ccugucuggaagacguggcucugggugagguaggcgggaaaggauggaguguuuuaguucuugggggaggccaccccaaacccc

SEQ ID NO: 131722 - RNA, 47 nt, Homo sapiens
agacaggggcagcaaagaacucucccuucccagaauuagcccucagg

SEQ ID NO: 131723 - RNA, 44 nt, Homo sapiens
gccuuggcaaagugucuuauacagggaggggaaggcugcaccac

SEQ ID NO: 131724 - RNA, 44 nt, Homo sapiens
ccacugggagagcugguggugcagccuuccccucccuguauaag

SEQ ID NO: 131725 - RNA, 51 nt, Homo sapiens
gaaggaauuacauuuuauaugugagcgagcaagccggcaagcgagcacagu

SEQ ID NO: 131726 - RNA, 51 nt, Homo sapiens
ccugcccccugccagugaaguccuucagugagccccuccccagccagcccu

SEQ ID NO: 131727 - RNA, 57 nt, Homo sapiens
gucgccacucccuggccagcacggacgagaagcgagaacuccugggccggggcccug

SEQ ID NO: 131728 - RNA, 54 nt, Homo sapiens
accaacggaugaccaacggggccaugaacguggagauuggaaaccccaccuaca

SEQ ID NO: 131729 - RNA, 46 nt, Homo sapiens
uccacguucauggccccguuggucauccguuggugcuggaagcccu

SEQ ID NO: 131730 - RNA, 46 nt, Homo sapiens
gcugguucugguggccggagugguauucugguauaagcggcgaguc

SEQ ID NO: 131731 - RNA, 46 nt, Homo sapiens
agugcagccgcugucucgaaggggccuguguggucaacaagcagag

SEQ ID NO: 131732 - RNA, 81 nt, Homo sapiens
cugcagugcuucaacgguggcagcuguuuccucaaugcacggaggcagcccaagugccgcugccaaccccgcuacacgggu

SEQ ID NO: 131733 - RNA, 104 nt, Homo sapiens
ggcucugccugcugagccccagugggccugucugcaccugucccaaugggaagcggcuggacaacggcacaugcgugccugugcccucuccaacgcccccccca

SEQ ID NO: 131734 - RNA, 48 nt, Homo sapiens
aucaauaaucgugucuucaagauccauaaguuuggccacagccccuug

SEQ ID NO: 131735 - RNA, 46 nt, Homo sapiens
gcggcuguacugggcagacgccaagcuuucagucaucggcagcauc

SEQ ID NO: 131736 - RNA, 53 nt, Homo sapiens
ccaagauugagacggcagcgauggaugggacgcuucgggagacacuggugcag

SEQ ID NO: 131737 - RNA, 47 nt, Homo sapiens
gaaggggugagugugggcaggccggagggccagaggaggcaggccca

SEQ ID NO: 131738 - RNA, 44 nt, Homo sapiens
gagaugugauugagguggcgcagaugaagggcgagaaccgcaag

SEQ ID NO: 131739 - RNA, 42 nt, Homo sapiens
uacacguuuccggccacccagucgauggcgaugccucugggc

SEQ ID NO: 131740 - RNA, 88 nt, Homo sapiens
ggaccaacuggcacacgggcaccaucuccuaccgcagccugccaccugcugcgccuccuaccacuuccaaccgccaccggcgacagau

SEQ ID NO: 131741 - RNA, 42 nt, Homo sapiens
augacaaugagauccgcagccuguuccccggccacccccauu

SEQ ID NO: 131742 - RNA, 55 nt, Homo sapiens
cccugagcagggaggguaagcagcagcuucuggccggagcagaugguccuaccag

SEQ ID NO: 131743 - RNA, 46 nt, Homo sapiens
cugcaacauguucgaugacugcggggacggcucugacgaggaggac

SEQ ID NO: 131744 - RNA, 42 nt, Homo sapiens
ccuaaagccucugcccuccucagagccccccacagcccacac

SEQ ID NO: 131745 - RNA, 79 nt, Homo sapiens
cagacucaccccacugugcacuacccguccccugcaggccucucgucggcccccugcucaccacaguccucuucaucag

SEQ ID NO: 131746 - RNA, 94 nt, Homo sapiens
ugcccucccaaccggcccuuccguugcaagaaugaccgcgucugucuguggaucgggcgccaaugcgauggcacggacaacuguggggauggga

SEQ ID NO: 131747 - RNA, 93 nt, Homo sapiens
acgaguuccagugcaacaacaccuugugcaagccgcuggccuggaagugcgauggcgaggaugacuguggggacaacucagaugagaaccccg

SEQ ID NO: 131748 - RNA, 47 nt, Homo sapiens
gugcccugccacauaccagagaaggagugcccucugaacuccuccag

SEQ ID NO: 131749 - RNA, 47 nt, Homo sapiens
cccugcgcuggcgcugugacgcagacgccgacugcauggacggcagc

SEQ ID NO: 131750 - RNA, 46 nt, Homo sapiens
ggccgcuggcagugcgacuacgacaacgauugcggugacaacuccg

SEQ ID NO: 131751 - RNA, 54 nt, Homo sapiens
uuggaagugugacggagaggaugacuguggggauggcucggaugagcccaagga

SEQ ID NO: 131752 - RNA, 44 nt, Homo sapiens
uccucuccgucacacuuccaacgcgcugggaugcagcggcccga

SEQ ID NO: 131753 - RNA, 63 nt, Homo sapiens
ccagaugaccugugguguggacgaguuccgcugcaaggauucgggccgcugcaucccagcgcg

SEQ ID NO: 131754 - RNA, 50 nt, Homo sapiens
ggucgcagacccagacccgggggaugcaccguuugguaauggagcacugg

SEQ ID NO: 131755 - RNA, 47 nt, Homo sapiens
gucccucucauccuccccaucuccgcaguuguccugcccauugcagc

SEQ ID NO: 131756 - RNA, 42 nt, Homo sapiens
ccgcugcaaugggcaggacaacugcggagauggggaggauga

SEQ ID NO: 131757 - RNA, 49 nt, Homo sapiens
cugcacaaacccugccuucaucugcgauggcgacaaugacugccaggac

SEQ ID NO: 131758 - RNA, 47 nt, Homo sapiens
guguccaccccagccgcucugacucugagccucccucucuggcagcu

SEQ ID NO: 131759 - RNA, 42 nt, Homo sapiens
uguaugcaagaacgacaagugcauccccuucugguggaagug

SEQ ID NO: 131760 - RNA, 94 nt, Homo sapiens
aaccugugccugcugucccccgggggagggcacaaaugugccugccccaccaacuucuaccugggcagcgaugggcgcaccuguguguccaacu

SEQ ID NO: 131761 - RNA, 46 nt, Homo sapiens
gccgcaucggcauggauggguccagccgcagcgucaucguggacac

SEQ ID NO: 131762 - RNA, 46 nt, Homo sapiens
caugccgaugcggccgaucagugaauggucaccccagucuguccag

SEQ ID NO: 131763 - RNA, 80 nt, Homo sapiens
guggacuggguggguggcaaccuguacuggugcgacaaaggccgggacaccaucgagguguccaagcucaauggggccua

SEQ ID NO: 131764 - RNA, 44 nt, Homo sapiens
cccagggcagcaugauccgaaggaugcaccuuaacgggagcaau

SEQ ID NO: 131765 - RNA, 29 nt, Homo sapiens
cacauuugcaucugggggagggaugguug

SEQ ID NO: 131766 - RNA, 45 nt, Homo sapiens
accaccuuccccugcagccagcgcugcaucaacacucauggcagc

SEQ ID NO: 131767 - RNA, 72 nt, Homo sapiens
gcagggaagugaggggaccagcagaagagccugagaaggagcagcugcugaggcaggagaacagccacgaga

SEQ ID NO: 131768 - RNA, 45 nt, Homo sapiens
gccgcaagcucaguggcugcagccaggacugugaggaccucaaga

SEQ ID NO: 131769 - RNA, 57 nt, Homo sapiens
gcgcuguguggcugaggcacugcucugcaacggccaggaugacuguggcgacagcuc

SEQ ID NO: 131770 - RNA, 46 nt, Homo sapiens
gaccagagugacgaggcucccaagaacccacacugcaccagccaag

SEQ ID NO: 131771 - RNA, 42 nt, Homo sapiens
gcucagacagcgcccauuggcacagcggaacucacuggggcc

SEQ ID NO: 131772 - RNA, 75 nt, Homo sapiens
aaccgccagugcauccccaagcacuucgugugugaccacgaccgugacugugcagauggcucugaugaguccccc

SEQ ID NO: 131773 - RNA, 46 nt, Homo sapiens
gcgcuggcucugugacggugacaaagacugugcugauggugcagac

SEQ ID NO: 131774 - RNA, 41 nt, Homo sapiens
aagcaguggcugugugacggcagcgaugacuguggggaugg

SEQ ID NO: 131775 - RNA, 118 nt, Homo sapiens
gauggggaagggugggggucacccaccuggggaggcugaugccaugggaaggacaggagagaugcccacagcaccccucugugggggggcucagcagcagcuagaggcagagucucug

SEQ ID NO: 131776 - RNA, 62 nt, Homo sapiens
agugggcgcugcauccccaugagcuggacgugugacaaagaggaugacugugaacauggcga

SEQ ID NO: 131777 - RNA, 72 nt, Homo sapiens
gcuacgcacccagcugggugugugauggcgccaaugacuguggggacuacagugaugagcgcgacugcccag

SEQ ID NO: 131778 - RNA, 41 nt, Homo sapiens
ggugccaccgacugcagcagcuacuuccgccugggcgugaa

SEQ ID NO: 131779 - RNA, 79 nt, Homo sapiens
ggacgggaccugcaucgggaacuccagccgcugcaaccaguuuguggauugugaggacgccucagaugagaugaacugc

SEQ ID NO: 131780 - RNA, 28 nt, Homo sapiens
ggacaaagcuuggccagggagggguggg

SEQ ID NO: 131781 - RNA, 46 nt, Homo sapiens
gggcgcuguguguccaacaugcuguggugcaacggggccgacgacu

SEQ ID NO: 131782 - RNA, 60 nt, Homo sapiens
ugccaggaccugugucugcucacucaccagggccaugucaacugcucaugccgagggggc

SEQ ID NO: 131783 - RNA, 48 nt, Homo sapiens
uggacugacugggugcggcgggcagugcagcgggccaacaagcacgug

SEQ ID NO: 131784 - RNA, 45 nt, Homo sapiens
accgugccgagaagcucuacuucucugacgccacccuggacaaga

SEQ ID NO: 131785 - RNA, 27 nt, Homo sapiens
agcaucccagcaucaugcgggcggcgc

SEQ ID NO: 131786 - RNA, 77 nt, Homo sapiens
ugguggucucagacuccacugugccuaaggaucgccuaggagcaagagaauguggaguccccugccccgcccugggc

SEQ ID NO: 131787 - RNA, 96 nt, Homo sapiens
agacaaguucacaggccagaggacagaucuguggccagaauggugaggggcagagguaggaggaggccagaggcacuggggugggggcgggggcag

SEQ ID NO: 131788 - RNA, 55 nt, Homo sapiens
uggaccagacccgcccaggggccuucgagcgugagaccgucaucacuaugucugg

SEQ ID NO: 131789 - RNA, 50 nt, Homo sapiens
cguggaaggccuggccuaucaccguggcugggacacucucuauuggacaa

SEQ ID NO: 131790 - RNA, 45 nt, Homo sapiens
ucgcaucuucuucagcgacauccacuuugggaacauccaacagau

SEQ ID NO: 131791 - RNA, 46 nt, Homo sapiens
gccaucgucguugaucuguuggauguucccaaaguggaugucgcug

SEQ ID NO: 131792 - RNA, 46 nt, Homo sapiens
accugcucuacucagagcgcaccauucucaagaguauccaccuguc

SEQ ID NO: 131793 - RNA, 46 nt, Homo sapiens
ccgugggcagcgggccugcgccugugcccacgggaugcuggcugaa

SEQ ID NO: 131794 - RNA, 47 nt, Homo sapiens
cggcguccagcuuaaagacaucaaagucuucaaccgggaccggcaga

SEQ ID NO: 131795 - RNA, 43 nt, Homo sapiens
uugcucccgcgcuugauagagccguuggcaugaguccugaggg

SEQ ID NO: 131796 - RNA, 47 nt, Homo sapiens
uguuuucagugucuguguuugaggauuucaucuacuggagugacagg

SEQ ID NO: 131797 - RNA, 54 nt, Homo sapiens
agcuguacuggugcgaugcacggacagacaagauugaacggaucgaccuggaga

SEQ ID NO: 131798 - RNA, 48 nt, Homo sapiens
ggacugaguggggucaguauccgcguauugagcggucucggcuagaug

SEQ ID NO: 131799 - RNA, 100 nt, Homo sapiens
ccugagcacgaucagccgggccaagcgggaccagacguggcgugaagacguggugaccaauggcauuggccguguggagggcauugcaguggacuggauc

SEQ ID NO: 131800 - RNA, 45 nt, Homo sapiens
auuggucaccacgucuucacgccacgucuggucccgcuuggcccg

SEQ ID NO: 131801 - RNA, 51 nt, Homo sapiens
cugugcaugagggaaucaggggaauuccccuggaucccaaugacaagucag

SEQ ID NO: 131802 - RNA, 693 nt, Homo sapiens
gacaugggaaaacugggccaggcgcaguggcucaagccuguaaucccagcacuuugggaggcugaggccggccgaucacuugaggucagaaguuugagacuagcuuggccaacauggcaaaacuccgucucuacuaaaaccacaaaaauuagcugggcgugguggugggcaccuguaaucccagcuacucagaagaccuaggcaggagaaucacuugaaccgggaagguucaaggguugcagugggccaauauugugccacugaacuccagccugggcgacagaucaggacuccaucucaauuaaaaaaaaaaaaaaaaaagagccaggugcguggcucaugccugugaucccagcacuuugggaggcuaaagagggcggauuaccuugaggccgggguucaagaccagccugaccaacacggagaaacccugucucuacuaaaaauacaaaauuagccgggcaugguggugcaugccuguaaucccagcuacucggaaggcugaggcaggagaaucacuugaaccugggacgcggagguuguggugagccgagaucgcgucauuguacugcagccuggggaacaagagugaaauuccgucucaaaaaaaacaaacaaagaaaaacaaaagaaaagaaaagaaaaagaaaugggauaacugggaaugagacuggcuucggagugaccuuaggg

SEQ ID NO: 131803 - RNA, 56 nt, Homo sapiens
cuccugcaugugcacagccggcuauagccuccggaguggccagcaggccugcgagg

SEQ ID NO: 131804 - RNA, 54 nt, Homo sapiens
ugucaacaacggugacugcucccagcucugccugcccacgucagagacgacccg

SEQ ID NO: 131805 - RNA, 46 nt, Homo sapiens
gcuccgugguccuucggaacagcaccacccuggugaugcacaugaa

SEQ ID NO: 131806 - RNA, 45 nt, Homo sapiens
ggagccagcugggcaaggccaccgcccuggccaucaugggugagg

SEQ ID NO: 131807 - RNA, 49 nt, Homo sapiens
cuacuggaucagcuccgggaaccauaccaucaaccgcugcaaccuggau

SEQ ID NO: 131808 - RNA, 67 nt, Homo sapiens
ugggucucccgaaaccuguucuggacaagcuaugacaccaauaagaagcagaucaauguggcccggc

SEQ ID NO: 131809 - RNA, 59 nt, Homo sapiens
ucccaguccuguucccccucagugcuccagccugguuuccugaucccuuuucuccagaa

SEQ ID NO: 131810 - RNA, 47 nt, Homo sapiens
gucacagugcuagacuacgaugcccgcgagcagcguguguacugguc

SEQ ID NO: 131811 - RNA, 57 nt, Homo sapiens
uacaaccggaccguguccugcgccugcccccaccucaugaagcuccacaaggacaac

SEQ ID NO: 131812 - RNA, 46 nt, Homo sapiens
cgaacaaacacacuggcuaaggccaacaaguggaccggccacaaug

SEQ ID NO: 131813 - RNA, 46 nt, Homo sapiens
ccacauggaggugcuucggggacacgaguuccugucgcacccguuu

SEQ ID NO: 131814 - RNA, 44 nt, Homo sapiens
gccuccaugaguggggcugggcgccgcaccgugcaccgggagac

SEQ ID NO: 131815 - RNA, 59 nt, Homo sapiens
gggccuggcuguagacuggauugcaggcaacaucuacuggguggagaguaaccuggauc

SEQ ID NO: 131816 - RNA, 42 nt, Homo sapiens
uugccugcaauccagucuacagccaggcccucggguguggcc

SEQ ID NO: 131817 - RNA, 86 nt, Homo sapiens
ccugcgcaacaccaucgcccuggacuuccaccucagccagagcgcccucuacuggaccgacgugguggaggacaagaucuaccgcg

SEQ ID NO: 131818 - RNA, 82 nt, Homo sapiens
agccguucaucauuuucuccaaccgccaugaaauccggcgcaucgaucuucacaaaggagacuacagcguccuggugcccgg

SEQ ID NO: 131819 - RNA, 75 nt, Homo sapiens
augcagccaaaagugcgaccagaacaaguucagcgugaagugcuccugcuacgagggcuggguccuggaaccuga

SEQ ID NO: 131820 - RNA, 86 nt, Homo sapiens
auuguguguuccugcccucugggcauggagcuggggcccgacaaccacaccugccagauccagagcuacugugccaagcaucucaa

SEQ ID NO: 131821 - RNA, 46 nt, Homo sapiens
acaaggcaucccugggggccaggugcucuguuuucuccguuugaca

SEQ ID NO: 131822 - RNA, 45 nt, Homo sapiens
gcaggcagacugagguguuguuggcacaagggugcgaggguggcc

SEQ ID NO: 131823 - RNA, 45 nt, Homo sapiens
gcgugggugugugauggcgacaaugacugugaggauaacucggac

SEQ ID NO: 131824 - RNA, 45 nt, Homo sapiens
ccagagccugcacagaggaccugagaagccaaaacccuaccagag

SEQ ID NO: 131825 - RNA, 47 nt, Homo sapiens
cugcgguggcgcugcgauggggacacugacugcauggacuccagcga

SEQ ID NO: 131826 - RNA, 45 nt, Homo sapiens
accgcagggggaugcauaguccauccagccggcacuggaacucau

SEQ ID NO: 131827 - RNA, 57 nt, Homo sapiens
aagccggcugcagccacuccuguucuagcacccaguucaagugcaacagcgggcguu

SEQ ID NO: 131828 - RNA, 46 nt, Homo sapiens
ccgcuguugcacuugaacugggugcuagaacaggaguggcugcagc

SEQ ID NO: 131829 - RNA, 46 nt, Homo sapiens
agggagccucugaggaaaggagaugacagagagguggugacaaaaa

SEQ ID NO: 131830 - RNA, 46 nt, Homo sapiens
aguuuaccugcaacaauggcagauguaucaacaucaacuggagaug

SEQ ID NO: 131831 - RNA, 42 nt, Homo sapiens
gagcgguccccacagucgucauccagaucacacguccaggag

SEQ ID NO: 131832 - RNA, 48 nt, Homo sapiens
uucuccugugccaguggccgcugcauccccaucuccuggacgugugau

SEQ ID NO: 131833 - RNA, 46 nt, Homo sapiens
accgcuggcucugcgacggggacaaugacugugggaacagugaaga

SEQ ID NO: 131834 - RNA, 83 nt, Homo sapiens
uugcaguuuccauccagauaauuuguuucaugaggaauuuuguacuagaaaaaauuacuuuguauuauuaaaaaauaguaaaa

SEQ ID NO: 131835 - RNA, 42 nt, Homo sapiens
cugcagcagccugugcuuggccaccccugggagccgccagug

SEQ ID NO: 131836 - RNA, 71 nt, Homo sapiens
ucaccauggcaacuaccucuucuggacugaguaucggaguggcagugucuaccgcuuggaacgggguguag

SEQ ID NO: 131837 - RNA, 45 nt, Homo sapiens
ugccuucuacgaccgcaucgagacgauacugcucaauggcacaga

SEQ ID NO: 131838 - RNA, 45 nt, Homo sapiens
ggacagucggcgugggcggcuggagagggcguggauggauggcuc

SEQ ID NO: 131839 - RNA, 58 nt, Homo sapiens
agcugcucagacccgcaagacuuuaaucgagggcaaaaugacacaccccagggcuauu

SEQ ID NO: 131840 - RNA, 84 nt, Homo sapiens
uguggccguggacuggaugggagacaaucuguacuggacggacgaugggcccaaaaagacaaucagcguggccaggcuggagaa

SEQ ID NO: 131841 - RNA, 50 nt, Homo sapiens
cuggccacgcugauugucuuuuugggcccaucguccguccaguacagauu

SEQ ID NO: 131842 - RNA, 54 nt, Homo sapiens
uugccgacaccaccagcuaccucauuggccgccagaagauugauggcacugagc

SEQ ID NO: 131843 - RNA, 49 nt, Homo sapiens
guagcugguggugucggcaaaguagaugaagccggucucagcguggaag

SEQ ID NO: 131844 - RNA, 58 nt, Homo sapiens
caggcaucauccggggcauggauaugggggccaaggucccggaugagcacaugauccc

SEQ ID NO: 131845 - RNA, 46 nt, Homo sapiens
ccccauauccaugccccggaugaugccuggccggcccuugccauac

SEQ ID NO: 131846 - RNA, 44 nt, Homo sapiens
ggaccugccgcugccguuccggcuucagccugggcagugacggg

SEQ ID NO: 131847 - RNA, 47 nt, Homo sapiens
acccggcuucccauacuggucguuuucacaggcauggcuccucacug

SEQ ID NO: 131848 - RNA, 45 nt, Homo sapiens
ccucggggcugacgccucuggugguagauguggagggcaccaccc

SEQ ID NO: 131849 - RNA, 51 nt, Homo sapiens
gguggacaaggguggugcccuccacaucuaccaccagaggcgucagccccg

SEQ ID NO: 131850 - RNA, 45 nt, Homo sapiens
uuaucucuaugccaccaacucggacaaugccaaugcccagcagaa

SEQ ID NO: 131851 - RNA, 31 nt, Homo sapiens
ugcugggcauuggcauuguccgaguuggugg

SEQ ID NO: 131852 - RNA, 44 nt, Homo sapiens
cuaugagggcaagggccgccagaccaucauccagggcauccugg

SEQ ID NO: 131853 - RNA, 46 nt, Homo sapiens
cccuugcccucauaguccaccacuucaauauaguccagauaggcau

SEQ ID NO: 131854 - RNA, 66 nt, Homo sapiens
gguggaacgcugugacauggaugggcagaaccgcaccaagcucgucgacagcaagauuguguuucc

SEQ ID NO: 131855 - RNA, 42 nt, Homo sapiens
ccauccaugucacagcguuccaccuuugggaucugcccauag

SEQ ID NO: 131856 - RNA, 45 nt, Homo sapiens
aacagaaauggggacacaugugucacauugcuagaccuggaacuc

SEQ ID NO: 131857 - RNA, 46 nt, Homo sapiens
gucuagcaaugugacacauguguccccauuucuguugcagacaaag

SEQ ID NO: 131858 - RNA, 44 nt, Homo sapiens
caauguccuuauugcucaauguccucauguccuggggaggguca

SEQ ID NO: 131859 - RNA, 34 nt, Homo sapiens
gcauucauuugaaucuguuuucucugugguuaca

SEQ ID NO: 131860 - RNA, 20 nt, Homo sapiens
ccagcaugaagagggaggcu

SEQ ID NO: 131861 - RNA, 49 nt, Homo sapiens
gucuagggcccaguuggacccagggcagagcagaaugauaugaggagag

SEQ ID NO: 131862 - RNA, 33 nt, Homo sapiens
aauggaucaauacaugugugucagacgccugag

SEQ ID NO: 131863 - RNA, 43 nt, Homo sapiens
cagaguuuucucuggggcaggcucccccuucugccugcaccag

SEQ ID NO: 131864 - RNA, 44 nt, Homo sapiens
gguuguuuugcucucucccacaaacuaauuaugggucccaaacu

SEQ ID NO: 131865 - RNA, 27 nt, Homo sapiens
caaccauccucagggugacagccagac

SEQ ID NO: 131866 - RNA, 47 nt, Homo sapiens
gcugcacaagagggucuagcaccaaucccaccccaucagccaugggg

SEQ ID NO: 131867 - RNA, 54 nt, Homo sapiens
gacagugcugcucagacgcagcucaagugugcccgcaugccuggccuaaagggc

SEQ ID NO: 131868 - RNA, 48 nt, Homo sapiens
gggcccaggugucuaccaucacaccuacgagcacgcggcagaccacag

SEQ ID NO: 131869 - RNA, 46 nt, Homo sapiens
aaggauaccuccugcagccggauaaccgcuccugcaaggccaagaa

SEQ ID NO: 131870 - RNA, 26 nt, Homo sapiens
augaaauauaguuacuauaauaacau

SEQ ID NO: 131871 - RNA, 45 nt, Homo sapiens
aacagcagcuuucagcuucaggcagauggcaagaccugcaaaggu

SEQ ID NO: 131872 - RNA, 52 nt, Homo sapiens
ucuucggggucugggcccggagcaagaggccagcuuugagaggccaugagcg

SEQ ID NO: 131873 - RNA, 46 nt, Homo sapiens
ccaggacugcauggacggcucagaugaggggccccacugccgaggu

SEQ ID NO: 131874 - RNA, 55 nt, Homo sapiens
ggaacucuuuuacaauauuccccacaguagccacacaccuguaggcaaacaggug

SEQ ID NO: 131875 - RNA, 57 nt, Homo sapiens
uggaggguggacucuacugaaggccuaguuucuaccuccaccuguuugccuacaggu

SEQ ID NO: 131876 - RNA, 359 nt, Homo sapiens
caguaaaagguuuugaugaugccgggagugauggcucacaccuauaauccuagcacuuugggaggcugaggcgggcagaucacuugaggucaggaguucaagaugagccuggccaacauggugaaaccccgucucuacuaaaaaugcaaaaaauuagccaggcaugguggcaugcaccuguagucccagcuacucgggaggcugaggcaggagaaucgcuugaacccaggaggcagaaguugcagugagcugagauugcaccacugcacuccagcgugggcgacagagcgagaucugucucaaaacaaacaaacaaaaaaaaagguuuugaugagcugagggaagcaggguccauggca

SEQ ID NO: 131877 - RNA, 50 nt, Homo sapiens
gugcgacggugagagggacugcccagacggaucugacgaggccccugaga

SEQ ID NO: 131878 - RNA, 42 nt, Homo sapiens
ucagauccgucugggcagucccucucaccgucgcaccgccag

SEQ ID NO: 131879 - RNA, 64 nt, Homo sapiens
agacuugcagccccaagcaguuugccugcagagaucaaauaaccuguaucucaaagggcuggcg

SEQ ID NO: 131880 - RNA, 47 nt, Homo sapiens
gugaugggucaggggaccaggagugucccagaaggcagggaagcaga

SEQ ID NO: 131881 - RNA, 46 nt, Homo sapiens
auaguagcuaacuaguuggacuggacugaaaccaguuccuagaguu

SEQ ID NO: 131882 - RNA, 36 nt, Homo sapiens
ugggaggagcagggcauggaccaagucccagguggg

SEQ ID NO: 131883 - RNA, 46 nt, Homo sapiens
ucccuuagcuauaucaugugguucccuuuagagaaccccccucuca

SEQ ID NO: 131884 - RNA, 44 nt, Homo sapiens
accucuggaggccuucugggggucuggcuuuuauuuguggggaa

SEQ ID NO: 131885 - RNA, 78 nt, Homo sapiens
agggggaagaagaaagaggaagucggaggaaaguggagaggaaacuuuuggugcugaacuggacacugggucuggcca

SEQ ID NO: 131886 - RNA, 30 nt, Homo sapiens
agaugcccccauucuucaaaaccccuuccu

SEQ ID NO: 131887 - RNA, 39 nt, Homo sapiens
uucucuuguucucagcccugugaggugagaagggaaauc

SEQ ID NO: 131888 - RNA, 43 nt, Homo sapiens
caguugugccaucuuggggacucucuaccccccacccccaccc

SEQ ID NO: 131889 - RNA, 40 nt, Homo sapiens
ugcugcugccccugcucucagcucuggucgcggcggcuau

SEQ ID NO: 131890 - RNA, 43 nt, Homo sapiens
gccccuuccccucugguccugcuacuucucuccuucacccccc

SEQ ID NO: 131891 - RNA, 82 nt, Homo sapiens
ccccaaggggcucggaacucuaccucuucacccacgccccuggugcgcuuugccgaaggaaagaauaagaacagagaaggag

SEQ ID NO: 131892 - RNA, 61 nt, Homo sapiens
ggagggccugcugacgggggugcgcccccugccccgaaauccaaacccuucaccccacccc

SEQ ID NO: 131893 - RNA, 99 nt, Homo sapiens
cgcccggggagggggaaagagcagcgaggagugaagcggggggguggggugaaggguuuggauuucggggcagggggcgcacccccgucagcaggcccu

SEQ ID NO: 131894 - RNA, 45 nt, Homo sapiens
ggccuuccagcaccguucuguguccuggucgcaguucaacaaggu

SEQ ID NO: 131895 - RNA, 26 nt, Homo sapiens
uaaauauauggaaaggcuugaaauag

SEQ ID NO: 131896 - RNA, 46 nt, Homo sapiens
caaugagcccgacggaaccuuucuccuccgcuucagcgacucagag

SEQ ID NO: 131897 - RNA, 46 nt, Homo sapiens
gcagaugccccccagccugggccagaugagccugcccuuugaccag

SEQ ID NO: 131898 - RNA, 46 nt, Homo sapiens
ccucaggagcaugcuguguccagcccugacccccugcucugcucag

SEQ ID NO: 131899 - RNA, 47 nt, Homo sapiens
uccuauccccaccuacuccugggucaggaggaaaagacuaacaggag

SEQ ID NO: 131900 - RNA, 45 nt, Homo sapiens
auaggaggggucuggacaugugguuacuaguacagguuuugcccu

SEQ ID NO: 131901 - RNA, 46 nt, Homo sapiens
gauauguuaaauguauagcuggcaccuuaguugcaugaccacauag

SEQ ID NO: 131902 - RNA, 52 nt, Homo sapiens
ggccauguggcccuccaguguaugagagggcccugccugcugcaucuuuucu

SEQ ID NO: 131903 - RNA, 44 nt, Homo sapiens
cccgcagcuccugacagaaccagaaauuccagcgcaaccgagga

SEQ ID NO: 131904 - RNA, 47 nt, Homo sapiens
ggaccccaggcccugauccccuccccaacaggccccuaccccagcgg

SEQ ID NO: 131905 - RNA, 42 nt, Homo sapiens
agagucggacguuggggcaggaggagaagaggaggcuggcuc

SEQ ID NO: 131906 - RNA, 45 nt, Homo sapiens
agauggguggagcuggacuugggaaugggguccagagggcggagg

SEQ ID NO: 131907 - RNA, 54 nt, Homo sapiens
cucucaggcccgccuuaagugcacacuauacgggagucagaugcacgcacagga

SEQ ID NO: 131908 - RNA, 57 nt, Homo sapiens
ucgucccucucuggccgagcacccccucucccaggacccgggagcggagagcucaaa

SEQ ID NO: 131909 - RNA, 43 nt, Homo sapiens
ggacuuguuaaggaggcucaugauggucacuacgcucucgguu

SEQ ID NO: 131910 - RNA, 47 nt, Homo sapiens
gaaugcaccgcgcggaaagagcggcuccuccggucggggagaagagg

SEQ ID NO: 131911 - RNA, 45 nt, Homo sapiens
uuucucuccggucgcggccucuucucgcuucccucaggcgacggc

SEQ ID NO: 131912 - RNA, 41 nt, Homo sapiens
aaccggaacaaggauccuggaccucccgcccccaggcagga

SEQ ID NO: 131913 - RNA, 41 nt, Homo sapiens
cuuugcccuuucuuuuguuaaccuuggccaugacuggccag

SEQ ID NO: 131914 - RNA, 46 nt, Homo sapiens
aacaaacagguugaaaaauggguuaaaguaggcaaauacagcauau

SEQ ID NO: 131915 - RNA, 47 nt, Homo sapiens
gagggggugcuggggggaggagaggguguucagcagugguguuuggg

SEQ ID NO: 131916 - RNA, 68 nt, Homo sapiens
cauuuucugaagccuucugggcaagcuuggaucuugccaaccauguggcccgagagaccuuucguugg

SEQ ID NO: 131917 - RNA, 50 nt, Homo sapiens
guaagugaugcaaauucccucagcauagagagcugucagggagacuagag

SEQ ID NO: 131918 - RNA, 45 nt, Homo sapiens
agagcaccugagcaagugagcuugugaagaaggguagauucuaag

SEQ ID NO: 131919 - RNA, 70 nt, Homo sapiens
auaguuuguccgagucagaguucaagggaagcuuguuacuagggcacucagaauggguuaucgugauugg

SEQ ID NO: 131920 - RNA, 32 nt, Homo sapiens
agagcagugaaguggcuacugcugcugauaac

SEQ ID NO: 131921 - RNA, 42 nt, Homo sapiens
uccugaccagaauuuugaggugaugcccaauggacccccuag

SEQ ID NO: 131922 - RNA, 46 nt, Homo sapiens
uccccagaaaucucuccagaaguuugucccgcagcuucuacaguug

SEQ ID NO: 131923 - RNA, 42 nt, Homo sapiens
gaccugguauuauggccccugugggaagaggaugaagcaauu

SEQ ID NO: 131924 - RNA, 54 nt, Homo sapiens
caggcaauuacuggcaaacggggucgaccucgaaacacugagaaggcuaagacu

SEQ ID NO: 131925 - RNA, 46 nt, Homo sapiens
augaggaggauaaagcaaagauugcuaaaagcaagaagaagaugag

SEQ ID NO: 131926 - RNA, 54 nt, Homo sapiens
ccuuggguaggcugagaaagaaaaaggaaagacaaagcaggaaaaacugaagga

SEQ ID NO: 131927 - RNA, 83 nt, Homo sapiens
aaaagucaagagggaaaagaaggagaagguaaaaaugaaggaaaaggaggaggugaccaaagccaagccagccuguaaagcag

SEQ ID NO: 131928 - RNA, 45 nt, Homo sapiens
cgacagaggauaugugucugacugaccaccagguagugaggagag

SEQ ID NO: 131929 - RNA, 45 nt, Homo sapiens
cuuccuugugcaugagcucaauggcuccacccucaucaucaagug

SEQ ID NO: 131930 - RNA, 44 nt, Homo sapiens
cagugagauugacaagacucuggagaguauguccagcuacagga

SEQ ID NO: 131931 - RNA, 49 nt, Homo sapiens
acggaggcgcaguucucggaucauggaggagaccaguggcauggaagaa

SEQ ID NO: 131932 - RNA, 52 nt, Homo sapiens
uugaugccacagcaucuagcaucccagagcuagagcgccagauagaaaaacu

SEQ ID NO: 131933 - RNA, 118 nt, Homo sapiens
agcugcuucacucaucccagaugcuucgggcggucucccugggucaggaccgcuacagacgucgcuacuggguauugccguauuuggcugguaucuuuguagaaggaacagaggggaa

SEQ ID NO: 131934 - RNA, 55 nt, Homo sapiens
uacaguuccugaggaggugauaaagaaggaaacugacuccuuaaaaguggcagcc

SEQ ID NO: 131935 - RNA, 77 nt, Homo sapiens
ucaggggucaggauucagaacagccccaggcccagcuucagccugaggcucagcuucaugcuccugcccagccccag

SEQ ID NO: 131936 - RNA, 57 nt, Homo sapiens
ccugaugaggcagaauccagcccugauccucaagcacucugguuuaacaucucagcc

SEQ ID NO: 131937 - RNA, 42 nt, Homo sapiens
uggcgaggucggggcagggagggacuggcaccucagcguaaa

SEQ ID NO: 131938 - RNA, 42 nt, Homo sapiens
agaucauaugagaucaccccucgcauucgugucuggcgccag

SEQ ID NO: 131939 - RNA, 42 nt, Homo sapiens
auggggagggggaaagucgucccuacuuccuccucccugcuu

SEQ ID NO: 131940 - RNA, 52 nt, Homo sapiens
uuccccaaguaccuguuuucauucccauuuuucccauuguuuaaaaccauca

SEQ ID NO: 131941 - RNA, 41 nt, Homo sapiens
cccuuccccagcagcagagacccuggagcacaggagaguag

SEQ ID NO: 131942 - RNA, 46 nt, Homo sapiens
cuuuuccugcucagcagagccccucccuucagagauuacggguacu

SEQ ID NO: 131943 - RNA, 114 nt, Homo sapiens
aguugaaacuguuagaguugggggcucugcuuuuucccccuggcaauuuuccccugguauaagaugugcuagauuaauuucauugugagguggaugggggagugaaauugugag

SEQ ID NO: 131944 - RNA, 45 nt, Homo sapiens
uuccucaucuucacugcccccuugagcuagguggauuuucucuuc

SEQ ID NO: 131945 - RNA, 55 nt, Homo sapiens
gacaacccacccccugcccuuuugcuucccucccaucagucugguugacaggaag

SEQ ID NO: 131946 - RNA, 43 nt, Homo sapiens
aaucucauuuuuaauaagguuaaaaagaaaaaaaaagucuagc

SEQ ID NO: 131947 - RNA, 45 nt, Homo sapiens
aaagaaaucagugaauccagguauuuaccuguuguugaauuguga

SEQ ID NO: 131948 - RNA, 52 nt, Homo sapiens
aggucagggguaacgggugaugagggcaccuggcuuuuguaaucaugugggg

SEQ ID NO: 131949 - RNA, 42 nt, Homo sapiens
gaaaugggaugguccaucccuggugucagaacugaacccuag

SEQ ID NO: 131950 - RNA, 46 nt, Homo sapiens
aagggcuucagcauccccuccaguuccugcucauccauugacagug

SEQ ID NO: 131951 - RNA, 48 nt, Homo sapiens
uacuguugcuugggcuagguggugccaucugcugagccaaugacacau

SEQ ID NO: 131952 - RNA, 97 nt, Homo sapiens
acggauagcagcauuuucucuuuaauguuagggaacgagcgagagagagagagagagagaaagggaggggguaagaaagacggggagggagggagga

SEQ ID NO: 131953 - RNA, 44 nt, Homo sapiens
aaaaagggagggggaggagaaaggaggagaaaaggagcaggagg

SEQ ID NO: 131954 - RNA, 42 nt, Homo sapiens
ucauuuccaauaggacaggaagugccugcucagcucagggga

SEQ ID NO: 131955 - RNA, 43 nt, Homo sapiens
aaaugcuggacuauucugagugccugcagacaauguccccuga

SEQ ID NO: 131956 - RNA, 44 nt, Homo sapiens
uguccugaaccccugguaauagaauuguucaccuuuauaccaag

SEQ ID NO: 131957 - RNA, 45 nt, Homo sapiens
ucgugacagggucaagcgugcuuuccuuaucaaggagcagaaaau

SEQ ID NO: 131958 - RNA, 46 nt, Homo sapiens
uacagagaagggccucagaggacaccugcaguacagcuauccagag

SEQ ID NO: 131959 - RNA, 45 nt, Homo sapiens
gagucccuccaccagaguaucucucucaugaugguuucuucaggg

SEQ ID NO: 131960 - RNA, 48 nt, Homo sapiens
ggagggacucuagcuaccaugcacauguacauauccacagaauauggg

SEQ ID NO: 131961 - RNA, 43 nt, Homo sapiens
ggcuagaacccuagggcuggugauauauucagauaugaggcag

SEQ ID NO: 131962 - RNA, 44 nt, Homo sapiens
aaagaggugaggauuuccuuuggagucccugggguggaauaugg

SEQ ID NO: 131963 - RNA, 41 nt, Homo sapiens
ggcuuggucaaagaaugaguuggagagcuucaaggcagggc

SEQ ID NO: 131964 - RNA, 46 nt, Homo sapiens
uugcagaacuggagguguugcgccagcgagagauggcagaaaagaa

SEQ ID NO: 131965 - RNA, 45 nt, Homo sapiens
augagaccuauuauaugugggccuuggcuuucuucauggccuuca

SEQ ID NO: 131966 - RNA, 80 nt, Homo sapiens
agacccucaguguccguaccuuccacuucauugagcagaaccucaccaacuacuaugagaugaugcugacugaccgcaag

SEQ ID NO: 131967 - RNA, 46 nt, Homo sapiens
agaccacccaccucuuccucaaaauguuggagcgauucugucggag

SEQ ID NO: 131968 - RNA, 93 nt, Homo sapiens
gcccagaggaacguggggcagaggaagaagaagaggaggaggaggaggaagaggaggaguugcaagugguccaggugucggagaaagaauuua

SEQ ID NO: 131969 - RNA, 44 nt, Homo sapiens
uuagccaaauggagcggagucccugaaagauuuuugccaggaag

SEQ ID NO: 131970 - RNA, 46 nt, Homo sapiens
augaaaaccuuggucaaagccugcaucaggaaggugaggacuuugg

SEQ ID NO: 131971 - RNA, 45 nt, Homo sapiens
cugaaggcagcacccaagaaacgacaauugcuggacagcgacgag

SEQ ID NO: 131972 - RNA, 42 nt, Homo sapiens
gcgggccuuacaaugcagggaccuuaaaagacucagagacaa

SEQ ID NO: 131973 - RNA, 45 nt, Homo sapiens
guuugguuuucaaaccuagacguaauuuuguucaagaagacuaaa

SEQ ID NO: 131974 - RNA, 45 nt, Homo sapiens
gcugacagcgcuugcgcucccccuacucguucuaauuccacgcgc

SEQ ID NO: 131975 - RNA, 41 nt, Homo sapiens
cggauauuuuggagcgcguggaauuagaacgaguaggggga

SEQ ID NO: 131976 - RNA, 46 nt, Homo sapiens
uccuggacaguguuaagaucaaucucuauuaugugauucugcagcc

SEQ ID NO: 131977 - RNA, 71 nt, Homo sapiens
cauguacuugaaguggugugauggcacgcaucaugcgcaaaucauacaccuugaggaaacggucgcaggcc

SEQ ID NO: 131978 - RNA, 45 nt, Homo sapiens
uucugggggcccugcugggaaccgccugggcucggaggagccagg

SEQ ID NO: 131979 - RNA, 31 nt, Homo sapiens
uagaaaugaagaaaacagacucagaaaaaag

SEQ ID NO: 131980 - RNA, 43 nt, Homo sapiens
uugaucagguuaaucaaaaaauucuguuuauaacuuggagcua

SEQ ID NO: 131981 - RNA, 50 nt, Homo sapiens
gaugaaggaguauggggaacagauugauccuuccacccaucgcaagaacu

SEQ ID NO: 131982 - RNA, 46 nt, Homo sapiens
cgagaggcugacaauguuaaagacaaacuuugcaguaagcgaacag

SEQ ID NO: 131983 - RNA, 37 nt, Homo sapiens
ucugucagcuuucagaauuuguguccccuugacccug

SEQ ID NO: 131984 - RNA, 54 nt, Homo sapiens
cuggaauugcccuuacauuaagcuugaagauaaggaguuauauagacaggaaag

SEQ ID NO: 131985 - RNA, 49 nt, Homo sapiens
aaaugagaugugcuuaggaaagggucaggcccaucguaggagcaccaua

SEQ ID NO: 131986 - RNA, 60 nt, Homo sapiens
uuuugggccuggcucaugguccucaaagccccugucaggaaggucauagauaucauagag

SEQ ID NO: 131987 - RNA, 43 nt, Homo sapiens
ucauagaugagaaucucuucauaaaugaaggcuccagcuccua

SEQ ID NO: 131988 - RNA, 27 nt, Homo sapiens
guuuuucgacuugcagaacucuggagg

SEQ ID NO: 131989 - RNA, 25 nt, Homo sapiens
gguugcagcaguucauguuuggcgc

SEQ ID NO: 131990 - RNA, 47 nt, Homo sapiens
ggggagagagagggagggagugagcacaugcacgcuacaagucuagg

SEQ ID NO: 131991 - RNA, 45 nt, Homo sapiens
uuucuccaucgaugacaugcugcuucaacuggugugacagcauac

SEQ ID NO: 131992 - RNA, 46 nt, Homo sapiens
acacaggcucaguaccgacacaccugagcuagaugcuuccaccaag

SEQ ID NO: 131993 - RNA, 41 nt, Homo sapiens
guuuccauaauacucccuggugccauugcccugaggcugaa

SEQ ID NO: 131994 - RNA, 44 nt, Homo sapiens
uguacccaucaugcccacugcaggcacaacuccagaugaagacu

SEQ ID NO: 131995 - RNA, 50 nt, Homo sapiens
ucaguucuguccuggguacugaagaagaagaugaagaugaggaguaugaa

SEQ ID NO: 131996 - RNA, 47 nt, Homo sapiens
cuaaugccuacugccaucaaggccuuguuuugcuuuucuuuuuggau

SEQ ID NO: 131997 - RNA, 41 nt, Homo sapiens
guuuguaaggcuguggaugaugguuacaaugugcagccaga

SEQ ID NO: 131998 - RNA, 45 nt, Homo sapiens
ugguggcagggcugugauccggguggaugugucucuggauggggg

SEQ ID NO: 131999 - RNA, 46 nt, Homo sapiens
gagugugcagccagaggaaaguuacagccacuggcaacggcgggau

SEQ ID NO: 132000 - RNA, 45 nt, Homo sapiens
ucacaaccagucccaugugcgugaguuacuggcucaguacaagau

SEQ ID NO: 132001 - RNA, 44 nt, Homo sapiens
gcacccagggauggagagucauggggacccuauuaggucucggu

SEQ ID NO: 132002 - RNA, 30 nt, Homo sapiens
aaccuuuuuuggagacagacccagggggcc

SEQ ID NO: 132003 - RNA, 76 nt, Homo sapiens
agccacuggccccccauagcacccagugcauccuuuuuacaaguggaagaacuaggauggcuuuccaaagucuucu

SEQ ID NO: 132004 - RNA, 77 nt, Homo sapiens
aagagaacuuuaaguuccuuguuccagcccggaguuuugggaaagaaagaaaggaaaggucacagugaccuaggauu

SEQ ID NO: 132005 - RNA, 43 nt, Homo sapiens
cuucauauccuucaucagguguuuuaagaugucucugagaagc

SEQ ID NO: 132006 - RNA, 39 nt, Homo sapiens
auuuauacauaugcauuuuuuccccucuggccuuuagau

SEQ ID NO: 132007 - RNA, 45 nt, Homo sapiens
uuauuugguuggaguuucucauauuugaaaacauugcgguaucca

SEQ ID NO: 132008 - RNA, 47 nt, Homo sapiens
acugaggggguggcuagcagcaaacaaguauggagcuagcacaagag

SEQ ID NO: 132009 - RNA, 46 nt, Homo sapiens
cagcaggccgaagccgggguguggaucuccaugaacagucccagca

SEQ ID NO: 132010 - RNA, 41 nt, Homo sapiens
ggcagggaacaaagcugaccuggccaacaaacguauggugg

SEQ ID NO: 132011 - RNA, 45 nt, Homo sapiens
cuuugcccgagcaaagacaugggugaaggaacuacagcgacaggc

SEQ ID NO: 132012 - RNA, 45 nt, Homo sapiens
uuugucuagaugacacaacagugaaguuugagaucugggacacag

SEQ ID NO: 132013 - RNA, 32 nt, Homo sapiens
agcacagcuaggcccaaugggcaaccccaggc

SEQ ID NO: 132014 - RNA, 24 nt, Homo sapiens
guauaugcauguguggguauugug

SEQ ID NO: 132015 - RNA, 42 nt, Homo sapiens
auaggguuugggaguauuguuguauccaaacuggagauuucg

SEQ ID NO: 132016 - RNA, 33 nt, Homo sapiens
gagccccggagccgcggcgggagaggaacgcgc

SEQ ID NO: 132017 - RNA, 46 nt, Homo sapiens
caggcccggcagccauggcgguggaaggaggaaugaaaugugugaa

SEQ ID NO: 132018 - RNA, 51 nt, Homo sapiens
uucugggagagaauugagcugggagcccuggaggccuguagaaagcauuau

SEQ ID NO: 132019 - RNA, 51 nt, Homo sapiens
acugauugccgugggugucggggcacagcuuguccugagucagaccauaau

SEQ ID NO: 132020 - RNA, 43 nt, Homo sapiens
uccucuuccugguggcuuuugugggcugcugcggggccugcaa

SEQ ID NO: 132021 - RNA, 50 nt, Homo sapiens
cauguugguggagguggccgcagccauugcuggcuauguguuuagagaua

SEQ ID NO: 132022 - RNA, 47 nt, Homo sapiens
ucaggugaugucagaguuuaauaacaacuuccggcagcagauggaga

SEQ ID NO: 132023 - RNA, 90 nt, Homo sapiens
cuaacuacacagauugggagaaaaucccuuccaugucgaagaaccgaguccccgacuccugcugcauuaauguuacugugggcuguggga

SEQ ID NO: 132024 - RNA, 56 nt, Homo sapiens
uugccugcugccucgugaagaguaucagaaguggcuacgaggugauguaggggucu

SEQ ID NO: 132025 - RNA, 68 nt, Homo sapiens
ggucuccucagccuccucaucugggggaguggaauaguauccuccagguuuuucaauuaaacggauua

SEQ ID NO: 132026 - RNA, 36 nt, Homo sapiens
caaaauuuauacauauauauacauauauguauuucu

SEQ ID NO: 132027 - RNA, 46 nt, Homo sapiens
ugacauacgguagcuguaucuuuauguauauuaaaccaucugcaaa

SEQ ID NO: 132028 - RNA, 44 nt, Homo sapiens
ccagagcugcugcuaggagacuggagccaggguacccaagggag

SEQ ID NO: 132029 - RNA, 46 nt, Homo sapiens
uaccaguuuuaucggaucccagggacgugucugccccaaggugaca

SEQ ID NO: 132030 - RNA, 42 nt, Homo sapiens
aagaugcacaagggcuucauccaggucagugaccacacagau

SEQ ID NO: 132031 - RNA, 42 nt, Homo sapiens
cuuuaagcccagcaacaaugcuagcuucacagugccuacaga

SEQ ID NO: 132032 - RNA, 46 nt, Homo sapiens
caucaaaccaggacugcacaggcacugcauucucuggguggaagau

SEQ ID NO: 132033 - RNA, 66 nt, Homo sapiens
agaaugcagugccugugcaguccugguuugaugacauggcagauacugaguugcugaaccuguucc

SEQ ID NO: 132034 - RNA, 53 nt, Homo sapiens
gcuuuaggacagcuuagaugccaaguaggcaaaugccagaccaacaauaccca

SEQ ID NO: 132035 - RNA, 41 nt, Homo sapiens
augccuuugggugcuccagguacacaccuuuccaaaaucuu

SEQ ID NO: 132036 - RNA, 49 nt, Homo sapiens
aagugcaggugauguugucuaccugcgggucuguggugcgggaauggag

SEQ ID NO: 132037 - RNA, 39 nt, Homo sapiens
agggcugcgggcgcuggggaugcuccgggcuuggagagg

SEQ ID NO: 132038 - RNA, 41 nt, Homo sapiens
aggggaggggcagugggagcugguuugcuggcucggcgcuu

SEQ ID NO: 132039 - RNA, 46 nt, Homo sapiens
ggaggcgggcgggcggagaggagagaguggcgcgcaguccagcgag

SEQ ID NO: 132040 - RNA, 70 nt, Homo sapiens
ucugcugcgccccgcuucucgcugcugaggggaagggagggggcgggcaggugcagcggccgggcuagug

SEQ ID NO: 132041 - RNA, 47 nt, Homo sapiens
augugcggucccaugauggguccgugggcaagccuuacaucugccag

SEQ ID NO: 132042 - RNA, 45 nt, Homo sapiens; identical to SEQ ID NO: 33082

SEQ ID NO: 132043 - RNA, 45 nt, Homo sapiens
cuccacuggcccagcuguaaacugggagagaucagaaucccccag

SEQ ID NO: 132044 - RNA, 77 nt, Homo sapiens
uaacucaucuguaaauucauguaaauguaauucugugcauuauagcuaaugcaccuaaagucaauucuuaaugucua

SEQ ID NO: 132045 - RNA, 51 nt, Homo sapiens
guagcacaaguagucagaagagagcccaaacucagguagauuguggccuug

SEQ ID NO: 132046 - RNA, 41 nt, Homo sapiens
agucaagccuguccccaagguucugccgggucuaguuggcu

SEQ ID NO: 132047 - RNA, 51 nt, Homo sapiens
acaggacaacuugcucuaccaggcagggcaggacaccagcaccuggucuag

SEQ ID NO: 132048 - RNA, 42 nt, Homo sapiens
uggaaacaccugaugaugagucaaccagaucugaaguggauu

SEQ ID NO: 132049 - RNA, 42 nt, Homo sapiens
ugccacccuccauccugagucacauggcucaugugguugcag

SEQ ID NO: 132050 - RNA, 46 nt, Homo sapiens; identical to SEQ ID NO: 33092

SEQ ID NO: 132051 - RNA, 37 nt, Homo sapiens
gcucugacuccuauggugaccucucagaugccagcga

SEQ ID NO: 132052 - RNA, 48 nt, Homo sapiens
agugauuuugguccccucccacuucucuaguucgucauccucccuucc

SEQ ID NO: 132053 - RNA, 42 nt, Homo sapiens
agagacagcauuuaaccuccaagcaagaagaaaacaaaacaa

SEQ ID NO: 132054 - RNA, 45 nt, Homo sapiens
uguuucagccaguucugcagguccugacucugcagagggaagagg

SEQ ID NO: 132055 - RNA, 73 nt, Homo sapiens
uaacacaucaaggagucuuguuucuucaucagagcuuuggaacucgagaccaguuggcgaugaccccugaaua

SEQ ID NO: 132056 - RNA, 59 nt, Homo sapiens
ccaguucugccucuaccuugaaaaacaagucauuuugccugucuggauccuaguucucu

SEQ ID NO: 132057 - RNA, 50 nt, Homo sapiens
ugugggacuauggaaaauauccucaagcccugugagugcugacuuauguc

SEQ ID NO: 132058 - RNA, 51 nt, Homo sapiens
augugaaagaugaugcaguguagaacaugcacauggaaagaaaacugaggg

SEQ ID NO: 132059 - RNA, 48 nt, Homo sapiens
uguugaccaaagugcauaccucuagcauuuauaagcaccugcagcuac

SEQ ID NO: 132060 - RNA, 50 nt, Homo sapiens
cauauugacuaugaguuuaugaagaacacauaacacauuaaguuuuggag

SEQ ID NO: 132061 - RNA, 47 nt, Homo sapiens
ugugaauaaucacagccugcugaaagucucccuggucgucagcagua

SEQ ID NO: 132062 - RNA, 106 nt, Homo sapiens
cuggcucugagaaccuaggugcuaggugaaggucggauuuugguuuuuuguguguguguguguguuuuuuuuugucuugagauuuugagcugaaccuugaaagguc

SEQ ID NO: 132063 - RNA, 72 nt, Homo sapiens
ggggaagcugcugauuucugccaugccaccuugguguacugagauuccugugcauagguguaggagaaggug

SEQ ID NO: 132064 - RNA, 51 nt, Homo sapiens
cauuuuagacauuuugggaaauacagaaaaaucucccucuccccacccuag

SEQ ID NO: 132065 - RNA, 43 nt, Homo sapiens
uccagaaaugagguugucauccaagauaugauaagacuaguca

SEQ ID NO: 132066 - RNA, 57 nt, Homo sapiens
ccccgugcgagaccgccucuaucaucugggagugcauuucacgaguuugcccugagu

SEQ ID NO: 132067 - RNA, 63 nt, Homo sapiens
aggacgagcuggcguugugguucugcgucccaugaauacagauuggggaaacugaggccuugc

SEQ ID NO: 132068 - RNA, 45 nt, Homo sapiens
cagaucaaaaauuccagauaaaguguuucacgccucaccugaaga

SEQ ID NO: 132069 - RNA, 46 nt, Homo sapiens
ccguaaguguagugauugcucucuuuagaggcagcacucgcuaaac

SEQ ID NO: 132070 - RNA, 42 nt, Homo sapiens
cuggaccccgacccugccaacgcucccugucggugcucagcc

SEQ ID NO: 132071 - RNA, 71 nt, Homo sapiens
cgggaagcugagcagcgggcugcccuggcacggcuggcagggcagcuggaguccaugaacgauguggagga

SEQ ID NO: 132072 - RNA, 41 nt, Homo sapiens
ccacacacgcuucuggaaaaacagagauguuugugggcaug

SEQ ID NO: 132073 - RNA, 51 nt, Homo sapiens
aggaggcccuggcauccaagcguuuccgugccgagcggcaggacaacaagg

SEQ ID NO: 132074 - RNA, 51 nt, Homo sapiens
accaguggaaugagguugucagucuccagccuugcccacccacuuuggggg

SEQ ID NO: 132075 - RNA, 47 nt, Homo sapiens
aggcuggacgaggccauaagagagagacagguuuugugggcccuuau

SEQ ID NO: 132076 - RNA, 45 nt, Homo sapiens
gcaguaaucacuggggcuguguagcagccacucccaagacgagac

SEQ ID NO: 132077 - RNA, 44 nt, Homo sapiens
aagauccucauccggggaucaauauagagcacagcggcauaggc

SEQ ID NO: 132078 - RNA, 46 nt, Homo sapiens
gagcaaacccaggugucaggguaaucuuuuuccacagaacucagcu

SEQ ID NO: 132079 - RNA, 45 nt, Homo sapiens
cugguggucacuuccaagggcaauuucuucaggucugcuugggag

SEQ ID NO: 132080 - RNA, 93 nt, Homo sapiens
aggacgcugaggucuacgcacagguuccuaaaaaaaggcccacagagagugagaacacugauccuagcaugagacaccugaggaaaagcccuu

SEQ ID NO: 132081 - RNA, 46 nt, Homo sapiens
gcugaugacaggagccuuucggggcuggcuggcuggucuaggaguu

SEQ ID NO: 132082 - RNA, 45 nt, Homo sapiens
uagucaaacuucaccuuccaccgcaccacaugcuugcccaccucc

SEQ ID NO: 132083 - RNA, 23 nt, Homo sapiens
cagggagaauucagggauugggu

SEQ ID NO: 132084 - RNA, 30 nt, Homo sapiens
aaguuguagaguaggguucgaaggaugaau

SEQ ID NO: 132085 - RNA, 44 nt, Homo sapiens
gucguugggcgcacggaggccgguuggaagccauggucguuggg

SEQ ID NO: 132086 - RNA, 53 nt, Homo sapiens
gcagggcugcucagugccugccucugacaaaauuaaagcauugauggccugug

SEQ ID NO: 132087 - RNA, 45 nt, Homo sapiens
ggccagccuggcccugcaggucucccaugaaggccaccccauggu

SEQ ID NO: 132088 - RNA, 44 nt, Homo sapiens
ggcucucugcuccaaggugggccaugguauagggcccucgaagg

SEQ ID NO: 132089 - RNA, 51 nt, Homo sapiens
cgccugacccugcugccaccuccugugcacuuugagcaaugcccccuggga

SEQ ID NO: 132090 - RNA, 47 nt, Homo sapiens
ugacuacagacccaaggauggagaaaccauugagcugaggcugguua

SEQ ID NO: 132091 - RNA, 57 nt, Homo sapiens
gcaacagugggguguuggggucucggagaagcugccagaacucccuuucuccggccg

SEQ ID NO: 132092 - RNA, 44 nt, Homo sapiens
cggccggagaaagggaguucuggcagcuucuccgagaccccaac

SEQ ID NO: 132093 - RNA, 65 nt, Homo sapiens
ugaagacuauguuugaggccccugaaugcacagcagagaaagcucaacugcagacacagauagac

SEQ ID NO: 132094 - RNA, 46 nt, Homo sapiens
ggcauccaugcacacuaacaagagaaccauuucucagacuggaguc

SEQ ID NO: 132095 - RNA, 46 nt, Homo sapiens
gguccaccguggaagauguccugaagaaggcccaugaguuaggagg

SEQ ID NO: 132096 - RNA, 46 nt, Homo sapiens
ucuugggucugaggaauggucucagcagcugguuccaacaugacug

SEQ ID NO: 132097 - RNA, 46 nt, Homo sapiens
cucucuguccucacaccagcugcccgccccuuucuuccuggcacag

SEQ ID NO: 132098 - RNA, 54 nt, Homo sapiens
gaacaaaugcauguucuaggaagagcccucuggagugcuaggugccagagaggu

SEQ ID NO: 132099 - RNA, 42 nt, Homo sapiens
gcuugugugauacccaguacagaaauguuuggauggauggau

SEQ ID NO: 132100 - RNA, 49 nt, Homo sapiens
guucugaaccacaagaccuacauugaucugaucuucccagacugucugg

SEQ ID NO: 132101 - RNA, 45 nt, Homo sapiens
ucgccuugagacaugcuguucccaguucugccccacgcauggggg

SEQ ID NO: 132102 - RNA, 41 nt, Homo sapiens
cucucgcacuguucugauggccauggugauccguugucucc

SEQ ID NO: 132103 - RNA, 46 nt, Homo sapiens
cgcucaaacuucaacccuggucggagacaacggaucaccauggcca

SEQ ID NO: 132104 - RNA, 95 nt, Homo sapiens
accaauggcucucuucucauccuccaggaaccauuugagcugugagaccagccugucccccuuguggccccugacaaacucacaguuggcucuga

SEQ ID NO: 132105 - RNA, 45 nt, Homo sapiens
ugcaggcugggaccaaggaagaccucuaccugcacagccucaagc

SEQ ID NO: 132106 - RNA, 41 nt, Homo sapiens
cagguagaggucuuccuuggucccagccugcagacuggaga

SEQ ID NO: 132107 - RNA, 46 nt, Homo sapiens
gcccggggugaggucagggaacucccuugcgcguuucaagaaaagg

SEQ ID NO: 132108 - RNA, 31 nt, Homo sapiens
caggugcuugacagagucaccccaugguggu

SEQ ID NO: 132109 - RNA, 66 nt, Homo sapiens
caggaaaauuacauccucccauggaggaugagagacugaggcucagggagggcaaggaauaggccc

SEQ ID NO: 132110 - RNA, 45 nt, Homo sapiens
cacugccacccgcuggccccuggcuguccgcaaguggaccaccac

SEQ ID NO: 132111 - RNA, 52 nt, Homo sapiens
cugccuuggaggcagucgugcccaggagcaggugggugcuagcagauuacau

SEQ ID NO: 132112 - RNA, 35 nt, Homo sapiens
gcccacacaggccucuggacagggcaggcauuggu

SEQ ID NO: 132113 - RNA, 44 nt, Homo sapiens
ugagcagccuuggccaggcugcaggcuggggucaaggugguccc

SEQ ID NO: 132114 - RNA, 80 nt, Homo sapiens
acccccacccaggagaacgaagcaacaggccuugggggcuggcucccucccguacaggggggugcgaacauucaggcugg

SEQ ID NO: 132115 - RNA, 40 nt, Homo sapiens
ccgcuacuccgaugauuagcugcccagcuggacucugcac

SEQ ID NO: 132116 - RNA, 113 nt, Homo sapiens
ggggccaguguagcugucgccaggguucugggagcucccuguggccugucugggaauuccugggggcugagacuacaguggccagguuuugugcuuauuuauugggggguggg

SEQ ID NO: 132117 - RNA, 51 nt, Homo sapiens
ggugccucauccaggggcauccuuuuuuuuuuuuuuuuuuuuuuuuaaaga

SEQ ID NO: 132118 - RNA, 40 nt, Homo sapiens
caccaagcugaagaugcuccccacccccaaccaggugcaa

SEQ ID NO: 132119 - RNA, 42 nt, Homo sapiens
cgggagcaggaccuguccguggugauccacacgcuggcccag

SEQ ID NO: 132120 - RNA, 24 nt, Homo sapiens
gaggcccagaaaugugggcggcag

SEQ ID NO: 132121 - RNA, 61 nt, Homo sapiens
cugggccagcugccccgcugaccuccguucugccucuggugggguugccuucccuggccag

SEQ ID NO: 132122 - RNA, 56 nt, Homo sapiens
gaaagugucauguggacaugugaggguuuaaagagcaucaaaggguuaaagggcag

SEQ ID NO: 132123 - RNA, 41 nt, Homo sapiens
cucaguuucccuuucuagauaaguccaugagucccaaagug

SEQ ID NO: 132124 - RNA, 25 nt, Homo sapiens
cagauauagagagagcaguguuuuc

SEQ ID NO: 132125 - RNA, 38 nt, Homo sapiens
ccaaugaucaggggcugcugcuucccuugcaauuucua

SEQ ID NO: 132126 - RNA, 47 nt, Homo sapiens
ccacuccucaccagcccugagccugggacccacccucuggccccccg

SEQ ID NO: 132127 - RNA, 48 nt, Homo sapiens
acuggggacugguccagagcucacgugcucugaguggucagguccuug

SEQ ID NO: 132128 - RNA, 50 nt, Homo sapiens
cuccugguacuggggguccccuggcagcuuuagggacggcauggccccag

SEQ ID NO: 132129 - RNA, 52 nt, Homo sapiens
cauggggguaggggugacugacucaguucugucgggacacucugggaaggug

SEQ ID NO: 132130 - RNA, 45 nt, Homo sapiens
auaucucaccuagcgcagaccacacgcuuccagacaccagcagau

SEQ ID NO: 132131 - RNA, 46 nt, Homo sapiens
acagccaggcagaaauggggugagcuugagugagauaggggacacu

SEQ ID NO: 132132 - RNA, 45 nt, Homo sapiens
accugugccauacgccacccaugucacaacaaccucaugaaccag

SEQ ID NO: 132133 - RNA, 48 nt, Homo sapiens
gaggcagugggcugugggugcugggcauggaggggcgucccggaacau

SEQ ID NO: 132134 - RNA, 46 nt, Homo sapiens
cagcuccaccagcuuggccuucuccgugccguuggcguggaagggc

SEQ ID NO: 132135 - RNA, 46 nt, Homo sapiens
cacccgggaccagaagauccucaaccccagugcccucagccuccac

SEQ ID NO: 132136 - RNA, 40 nt, Homo sapiens
aacagugcgccucacaacacaaugcuggggcgcccaagaa

SEQ ID NO: 132137 - RNA, 41 nt, Homo sapiens
gacuggggggaucagcugcccauugcucccaagaggaggag

SEQ ID NO: 132138 - RNA, 28 nt, Homo sapiens
cgccuggccccagcacaaaggaagagau

SEQ ID NO: 132139 - RNA, 44 nt, Homo sapiens
gagagcaggggagggaaggaggcagcagaguuggggcagcugcu

SEQ ID NO: 132140 - RNA, 46 nt, Homo sapiens
uuugcaccuuucccugucgcucucuaagcacuuuaccuggauggcg

SEQ ID NO: 132141 - RNA, 59 nt, Homo sapiens
gggcuggcugcauucccccaggaugggcuucgagaaagacaaacuugucuggaaaccag

SEQ ID NO: 132142 - RNA, 105 nt, Homo sapiens
ggcucugagucgcucucccacccagccuggacuuggccccaugggacccauccucagugcucccuccagaucccguccggcagcuuggcguccacccugcacagc

SEQ ID NO: 132143 - RNA, 55 nt, Homo sapiens
ggacgggaucuggagggagcacugaggaugggucccauggggccaaguccaggcu

SEQ ID NO: 132144 - RNA, 40 nt, Homo sapiens
cuucccuuuuuaucugcugguguggaccacaccugggccu

SEQ ID NO: 132145 - RNA, 44 nt, Homo sapiens
gggcccuuauuuauuauuuaaacauuuuuuuaaaaagcacugcu

SEQ ID NO: 132146 - RNA, 30 nt, Homo sapiens
gugcagguaaggcuccuguuugagacaggg

SEQ ID NO: 132147 - RNA, 47 nt, Homo sapiens
uucucaaaggaaagaaggauuuuuuugcauaauuaaacucuucagcu

SEQ ID NO: 132148 - RNA, 54 nt, Homo sapiens
ggacgcgaguccacuuugccauaaggaaagcgggucaauagggcugccucugga

SEQ ID NO: 132149 - RNA, 42 nt, Homo sapiens
aucucuccuaaaccuuaauugcuucuuguuggccccacaacu

SEQ ID NO: 132150 - RNA, 48 nt, Homo sapiens
aauauaucuaauuguucacccaguuaagcaaaaauaaguucuaaaauc

SEQ ID NO: 132151 - RNA, 451 nt, Homo sapiens
caaagggaauuugugguuccugagaucagaaauucaacugcuuucuaaaacugaaggaugaauuaguacuuaaguuagccauuuugauacacaaucuuuguuccuaaaugacacuuaaauguuuuauuugcacuuccacuauuuuguuauaguaacauaucaauaauaauaacaugccucuccuacgaaggacaaaaaggauaauuuuagaaacucuacuauauauucucacaagucuugcuuuaaauauauauauuauauauuauauuauagaauauauuauauauaauauaauauagaauauauauaauaauauauauaauauaauauagaauauauauaauaauauauauaauauaauauauauauauauauaucuuauuccauuuuccuuccaaagaaaaaacauaggacauggaaaaaccuuuccucccaucuaguggcuggaaaa

SEQ ID NO: 132152 - RNA, 35 nt, Homo sapiens
uuagaagaagggaucccuucuaaagcuucccaaau

SEQ ID NO: 132153 - RNA, 47 nt, Homo sapiens
aaaugugggggucuuugcuuaugaaugguaauugauuccuagaagug

SEQ ID NO: 132154 - RNA, 46 nt, Homo sapiens
ccaaauucagcagguucaaaacucccauuguucucgaccugagaga

SEQ ID NO: 132155 - RNA, 47 nt, Homo sapiens
uggggcugcccucucccgugguuccccaugcaggucuaccuccucau

SEQ ID NO: 132156 - RNA, 50 nt, Homo sapiens
uaucccuuuugaagccuugccaggccuccccagaaagaacugauaagauc

SEQ ID NO: 132157 - RNA, 46 nt, Homo sapiens
auuauuucuaguaucuauauuccuauuaucaccauaaucccuaaga

SEQ ID NO: 132158 - RNA, 43 nt, Homo sapiens
aaucuagccauauucuguaauagauuugcugcaguuuauacuc

SEQ ID NO: 132159 - RNA, 57 nt, Homo sapiens
uccacaaaguaaaaaaaaaacaaaaacaaaacuuaaaaguuugguuccuacauaauc

SEQ ID NO: 132160 - RNA, 36 nt, Homo sapiens
cccucuaauuaagcacuuccuuacauccuguuacaa

SEQ ID NO: 132161 - RNA, 76 nt, Homo sapiens
uggccuucuuucuguuucuacaaaaagcuaagcuuuuugacaccucacuuacacauggacacauuucagaauaguc

SEQ ID NO: 132162 - RNA, 45 nt, Homo sapiens
cuuccuguguccaauucccugcuuucuguucucuuuaacccacuu

SEQ ID NO: 132163 - RNA, 50 nt, Homo sapiens
cauauuuauaaaaacauaaauaugucaagaguuaguuuauaggacaagca

SEQ ID NO: 132164 - RNA, 53 nt, Homo sapiens
aagauugagccuacauguaaggaaugaguugggguaaagaaaaaacaugcagg

SEQ ID NO: 132165 - RNA, 42 nt, Homo sapiens
ugaacagauuuuccuauuaguaauauuauuucagcggugaua

SEQ ID NO: 132166 - RNA, 46 nt, Homo sapiens
uauagucauggucccuccuggaaacuacucaaaugugagacuaauu

SEQ ID NO: 132167 - RNA, 45 nt, Homo sapiens
uucaaauacacgaaagaaggagccacuauggauuuugacagguag

SEQ ID NO: 132168 - RNA, 22 nt, Homo sapiens
auauaagaccauauagaauuau

SEQ ID NO: 132169 - RNA, 12 nt, Homo sapiens
cagauugugaau

SEQ ID NO: 132170 - RNA, 67 nt, Homo sapiens
uauuuuaagauguuuuucugaguugaggcuauagauuuuguuacuagacuaccauaugagcagagga

SEQ ID NO: 132171 - RNA, 85 nt, Homo sapiens
uucccuuauacagcuuuacacagaucccaugggaucugagguaagaacacacacaaacguauagguggguaguauauguauauua

SEQ ID NO: 132172 - RNA, 46 nt, Homo sapiens
aacuaauagaacacaaauugaacucuauauaaaaaagguauuugau

SEQ ID NO: 132173 - RNA, 61 nt, Homo sapiens
uuuuaaggguagggauaguuaucuuuuuugugucccucucgucucuagcagagcccugugu

SEQ ID NO: 132174 - RNA, 47 nt, Homo sapiens
uucaacacugaccagagggaccuagggauacaaagauaaaacagaag

SEQ ID NO: 132175 - RNA, 83 nt, Homo sapiens
gguuuuuauucugucuuaguuauuuugguaacuauauuuuguucauaaguauaaucuauucccuuacaauagcuaguauugua

SEQ ID NO: 132176 - RNA, 46 nt, Homo sapiens
uagugcauugaacaaauuuagaauaguggugauucaauuugcagau

SEQ ID NO: 132177 - RNA, 42 nt, Homo sapiens
uuaaaaauccuccgagaagauaaaaaaugucccgggucacug

SEQ ID NO: 132178 - RNA, 51 nt, Homo sapiens
aauggagauagucucaauacuaccucauaauuacuuagaauucuacagcgg

SEQ ID NO: 132179 - RNA, 44 nt, Homo sapiens
cuuaauaugauauuccuauucuucuuaaguauaaaaagguagau

SEQ ID NO: 132180 - RNA, 41 nt, Homo sapiens
auauauuuguaauuuucccucuugucuagaacauagaauug

SEQ ID NO: 132181 - RNA, 57 nt, Homo sapiens
aggcuguagcugaagcuaugaaacuagaugagauuauucaagaagacagcuauaaaa

SEQ ID NO: 132182 - RNA, 46 nt, Homo sapiens
uacauuccuacaauggccacugcucagcuuucucacugcaucacaa

SEQ ID NO: 132183 - RNA, 60 nt, Homo sapiens
ugauguauuagauaugaagguuauagucucaaaucaaguaaagauagcuuggaaucuuua

SEQ ID NO: 132184 - RNA, 44 nt, Homo sapiens
aaaauaauucacauucaaauguguugagaacaucaagguggaac

SEQ ID NO: 132185 - RNA, 39 nt, Homo sapiens
agccaugguaagaguuuuagauuuuauccugagaguagu

SEQ ID NO: 132186 - RNA, 20 nt, Homo sapiens
auaguuuuauguuuagguuu

SEQ ID NO: 132187 - RNA, 43 nt, Homo sapiens
aggcggguccaaggucagggauggcacaggcccucacccccuc

SEQ ID NO: 132188 - RNA, 54 nt, Homo sapiens
ggccccuagccuggauggaguucaggacaccuggggugggcagaacauguggcc

SEQ ID NO: 132189 - RNA, 54 nt, Homo sapiens
cccauuucacagaugagacacccgaggcuuagagagggacgugacuugcccagg

SEQ ID NO: 132190 - RNA, 40 nt, Homo sapiens
uggcccugccagcccauugccagcauccucaugccaagau

SEQ ID NO: 132191 - RNA, 33 nt, Homo sapiens
cagggcuggccauuccuggcacggaucccccuc

SEQ ID NO: 132192 - RNA, 42 nt, Homo sapiens
accagcacagucagggaggauggugggagcccaggggaagcc

SEQ ID NO: 132193 - RNA, 44 nt, Homo sapiens
ggaaagaggaguggcauaagcgccccaccuagacugcccaauaa

SEQ ID NO: 132194 - RNA, 43 nt, Homo sapiens
ggugaugcauaaauuagcaucucuggauguccuugccaccuca

SEQ ID NO: 132195 - RNA, 41 nt, Homo sapiens
gggccaucaaguaccggcaggagaaccaggaggcagugggc

SEQ ID NO: 132196 - RNA, 74 nt, Homo sapiens
ugccuuucucacagccuauaaagaccugcagucucgggaggagacucgaaacgcugccuggaggaagagaggcu

SEQ ID NO: 132197 - RNA, 129 nt, Homo sapiens
guaacaggaacucggaagguagaacuuagaauucagaacuuggguuucaauuguagaauuuggaaucuggaauacagaauugggaagaagaacagagaugacaaaagaccacuugaagagagguuccua

SEQ ID NO: 132198 - RNA, 45 nt, Homo sapiens
ucagcccaacccucauucugcagggccaccugguguguggaggug

SEQ ID NO: 132199 - RNA, 57 nt, Homo sapiens
gugugcauuucaugacucuaaagaagcuuaaccgauuagcccacaucagguugaaga

SEQ ID NO: 132200 - RNA, 25 nt, Homo sapiens
uauguuucuaagauucaucugugcu

SEQ ID NO: 132201 - RNA, 29 nt, Homo sapiens
uaugggcaggccuguggugaguauggggc

SEQ ID NO: 132202 - RNA, 42 nt, Homo sapiens
uguuuccaucaucagcucauaugaaauccucccagcccccua

SEQ ID NO: 132203 - RNA, 49 nt, Homo sapiens
gaggugugaaagaaggugcugcugggaggggagucugacaacccagcua

SEQ ID NO: 132204 - RNA, 45 nt, Homo sapiens
aacgcaaggagaugcugaagaggcacccacugucugucaugcucg

SEQ ID NO: 132205 - RNA, 58 nt, Homo sapiens
uguucuuucuugcuuacaaggcaaagggagaucacaaaaaggguggaaggaucaaaac

SEQ ID NO: 132206 - RNA, 45 nt, Homo sapiens
gaaaaauccuccagcacagaccaaaaagacagcaagccuccagag

SEQ ID NO: 132207 - RNA, 33 nt, Homo sapiens
gccaaggccaaggaacccagcaaaccagcagag

SEQ ID NO: 132208 - RNA, 42 nt, Homo sapiens
aaggaaccugcugucgaaaagcccaaagaauccaaaguugaa

SEQ ID NO: 132209 - RNA, 64 nt, Homo sapiens
cagagaaggcgaaaucuccccugaaggaggaugccaaggccccugagaaggagaucccaaaaaa

SEQ ID NO: 132210 - RNA, 27 nt, Homo sapiens
agugaaggaagaagcaaagacccccga

SEQ ID NO: 132211 - RNA, 34 nt, Homo sapiens
guccccugagaaggccaaguccccagugaaggca

SEQ ID NO: 132212 - RNA, 74 nt, Homo sapiens
caccggcugaggccaaguccccagagaaggaggaagcaaaauccccagccgaagucaaguccccugagaaggcc

SEQ ID NO: 132213 - RNA, 42 nt, Homo sapiens
aagaggcugcauccccagagaaggaagccaagucaccaguaa

SEQ ID NO: 132214 - RNA, 58 nt, Homo sapiens
acugaagaagugacugaagaagaggagaaagaggccaaagaggaggagggcaaggagg

SEQ ID NO: 132215 - RNA, 40 nt, Homo sapiens
agggaauuuuggggaguccuucuggaagcgagaaaggaau

SEQ ID NO: 132216 - RNA, 29 nt, Homo sapiens
uuucagaaugaaaguaagucacucucaag

SEQ ID NO: 132217 - RNA, 45 nt, Homo sapiens
ccauucagcagcuggacgcugagcugaggaacaccaagugggaga

SEQ ID NO: 132218 - RNA, 64 nt, Homo sapiens
caugcacuuugcagagggaaggugagcagcgcgccacuccacgcgcaguccggcagcgcccccu

SEQ ID NO: 132219 - RNA, 42 nt, Homo sapiens
gcagcgcguccgcgccgccgaagcucaucauggccugagcag

SEQ ID NO: 132220 - RNA, 51 nt, Homo sapiens
ucuuccauugcuccaucccgagggcauccugccccuauucccaucagguuu

SEQ ID NO: 132221 - RNA, 53 nt, Homo sapiens
aguuaauuguccccuccuggugguucccaugguucccagugcuaaucucuaau

SEQ ID NO: 132222 - RNA, 45 nt, Homo sapiens
gaaugaauaaguuccgucuguuuuccagccaaacuuguggucugg

SEQ ID NO: 132223 - RNA, 64 nt, Homo sapiens
gcaccgcuucaggguuauucaguccucugccucauggcugaaauugcucaucucgucugcagau

SEQ ID NO: 132224 - RNA, 42 nt, Homo sapiens
aauggagccccucugggaacaggaaccugcuucagcccuuua

SEQ ID NO: 132225 - RNA, 62 nt, Homo sapiens
agccuugguccucagauagaaucugugguccagcagcaacggcagcaccuggaagccugaua

SEQ ID NO: 132226 - RNA, 38 nt, Homo sapiens
uguccauguuuggacauaauucccaaaggagguauacu

SEQ ID NO: 132227 - RNA, 256 nt, Homo sapiens
gugaaauuguccucuuuaaaaaaaaguuuucuaauugacagauaauaauuguacauauucgugggguacauagcaauauuucaauacauacaagguauagugaucagaucaggguaauucgcauauccauuaucucaaacauuuaucacuucuuuguguugggaauguccuucuccuagcuauuugaaacuauauguuauuguuaacucuagucaucaguccccuucuuuauagaugggaaaauugaggauuagga

SEQ ID NO: 132228 - RNA, 23 nt, Homo sapiens
aggaguuugaguguuguguucag

SEQ ID NO: 132229 - RNA, 44 nt, Homo sapiens
ccucaaagccuaggguguucaccugccuguguacaacccccuca

SEQ ID NO: 132230 - RNA, 36 nt, Homo sapiens
ccauuagucaaucuccaggaaggagucuaccccucu

SEQ ID NO: 132231 - RNA, 39 nt, Homo sapiens
gcauucacauggugaaagguugucugugucaaaauaguu

SEQ ID NO: 132232 - RNA, 140 nt, Homo sapiens
uuguggccauuuucuuuacucuaagaggugugaaugucuuguaacacuuggcaggagauauuugauucuuugugucaaucauguaucuuccuucuaguugagcuaguaaagauugaagauuacaacagaacaacuuaaau

SEQ ID NO: 132233 - RNA, 49 nt, Homo sapiens
ugagcuuguccagaaaagaguauagacuaggaagagagaagggguacag

SEQ ID NO: 132234 - RNA, 41 nt, Homo sapiens
uuauggagauuggauguggagagaggaaggggaagggguag

SEQ ID NO: 132235 - RNA, 1130 nt, Homo sapiens
uauacuugucuauuuccauuuccaaaggugagauguuuuccaggcagagcucugucaguuuuaugaaagccaaaaaugcauuagccacacaggguacacuugugcaguauuuuaaguguaacuugguugccaacacuugaauuggaagguuuaauauaaaaauccacauuucuaccuucucuugaaaaaucagaaggucuggcagugcuggugucccauuucuccugguaaaggaagccccagcugccuagaaguugcccccaucaggcagguguacacuguccagucugccacggcgccugccacucucugcuguccucacacugcagcagcacauccauugccguaaaucuuaaguguggccccuguggacaauugaguuugcaaucuguguugugugauuuuuaaauugcagggaggaagaucauccaggcugucuguggaaaguugagcaaaucaagugugaacgcagaccaauaauuucugacagucaaaccauaaauaugaagagggaccacagagaagcuggauuagcagacuuguauacucugauuuugucaagcacuggaagaccaauuuagggugaccauaucauuugucauccaagcugagacgcuuuugagaauggaagggguuauggugggaggagaaauguaaacuggggcuguccugggcaugcuaggacagaaacuguggacacccuaggccugugaaugggacauggaaacagaaagcuuauauccgucaaccaggaugagugcagaaaagacucauaagaggagcucacauagaggcuacgcugguauagaaauuguucuagaaaaauugggcaagauuuugcagagaaaggaggcuuuuagauguguccuuaagcauugaagcgcuuugagagguaaucaaggguccaggacagcaguugagguaacaugaauaaccuaugcaacagcuggaagaugugcguaugccuuaacuuuucagaaaugggggaacuguguggguggagcaucuggugcuuggagggcagauagugugggaggggagggcggacgggcagaccggauccaaacuggauccaaaggagagucuugaacauuauaaggaauugagacuugaaucugagaaggaugaga

SEQ ID NO: 132236 - RNA, 111 nt, Homo sapiens
ucauucaccuggagaaacuuccuuccugugucaagcaccuguagcaugcuagggguugugccugcccaguggugcacuaaagccaccucugcaauguuuucauccaagaaa

SEQ ID NO: 132237 - RNA, 46 nt, Homo sapiens
ucaauaaagguuaauuuaaggacccaaugggacuugagauagagcu

SEQ ID NO: 132238 - RNA, 24 nt, Homo sapiens
cagcauccuuuacacugguaggug

SEQ ID NO: 132239 - RNA, 28 nt, Homo sapiens
gacauuucuggaguucccccucccuuuc

SEQ ID NO: 132240 - RNA, 32 nt, Homo sapiens
uuugaaggauagaggaaguaccaguaucgggu

SEQ ID NO: 132241 - RNA, 42 nt, Homo sapiens
gcaaagccugguuggcccugauucuguaacucaaggcagaau

SEQ ID NO: 132242 - RNA, 46 nt, Homo sapiens
ucuuagucuuucccugucagauggucagcucucagaggaagggaag

SEQ ID NO: 132243 - RNA, 43 nt, Homo sapiens
uauacauuuuauaauuguuuucaaacucccgauuaaacaacau

SEQ ID NO: 132244 - RNA, 42 nt, Homo sapiens
cgguccugcucccuucucuuuugacaggcccugggaaccagc

SEQ ID NO: 132245 - RNA, 46 nt, Homo sapiens
uugcaggaggagccagcauguugcauaacugcaggggccccauuca

SEQ ID NO: 132246 - RNA, 42 nt, Homo sapiens
uuuggaaaaguguucccauucacaguuugaaagccaaguaua

SEQ ID NO: 132247 - RNA, 48 nt, Homo sapiens
uguaaaacuuuuaugaagauguuguuguacuugcauuggagguugaaa

SEQ ID NO: 132248 - RNA, 43 nt, Homo sapiens
uuguuccucuuuacacuuuccaaguguuuguguguuggcacua

SEQ ID NO: 132249 - RNA, 43 nt, Homo sapiens
ucccucagccuguguuuucucucucuaaaauaugagguuugga

SEQ ID NO: 132250 - RNA, 45 nt, Homo sapiens
aaauuggaauaauacuguaaagaaguuuugguugaagacaaggcu

SEQ ID NO: 132251 - RNA, 45 nt, Homo sapiens
ccuuggggcuuuuauugugaaucuccacuuacggugcuccuaaca

SEQ ID NO: 132252 - RNA, 40 nt, Homo sapiens
gcauauugaaccccucuggcaggcucuucuggugcccucu

SEQ ID NO: 132253 - RNA, 57 nt, Homo sapiens
uuagggucuucaaaauggcuccccuacccgaauucccgaccaucccacuaacucaga

SEQ ID NO: 132254 - RNA, 85 nt, Homo sapiens
gguagggugcccacaccaacaucccugacacagaucuggccagccaccuuggaucagccugcugccuucucccaucuccucuuag

SEQ ID NO: 132255 - RNA, 66 nt, Homo sapiens
auuguggucuuugaaaguucuugcugagagauuuggaguuuuauuaagaauaccaggaagccagcg

SEQ ID NO: 132256 - RNA, 46 nt, Homo sapiens
cccagccuagaaccagacuuggcacuuacuucaaggggcuugagau

SEQ ID NO: 132257 - RNA, 50 nt, Homo sapiens
augagggggugaaauuuaauucugugccccaaaccugaucagaagcuguu

SEQ ID NO: 132258 - RNA, 44 nt, Homo sapiens
cuacuuccuaucucccuuagacaaggagugucccuuagacagau

SEQ ID NO: 132259 - RNA, 46 nt, Homo sapiens
ccuugaguauuugcagccaaggagggguuggggcaagaugggagga

SEQ ID NO: 132260 - RNA, 49 nt, Homo sapiens
gcaagacacuucucuacuguaaagccugcaguugagcagaaauggcauu

SEQ ID NO: 132261 - RNA, 46 nt, Homo sapiens
gcugacuucucuuaaccuuggguuucccaucaauaaaguugggcug

SEQ ID NO: 132262 - RNA, 46 nt, Homo sapiens
uagaacacugcagagggcgugcuguccccuggccaccaagccaagu

SEQ ID NO: 132263 - RNA, 40 nt, Homo sapiens
uuuucacguggccuuccaucuguaacugucuguguccaaa

SEQ ID NO: 132264 - RNA, 39 nt, Homo sapiens
gcggggcugagauaucccccauugagaugcuaagaggaa

SEQ ID NO: 132265 - RNA, 68 nt, Homo sapiens
ggucuuucacuuuauuuaaucugguacuucccaaauguacuugaucacagaacuuuuucucaaaggac

SEQ ID NO: 132266 - RNA, 81 nt, Homo sapiens
uggccagaaccaaagcacgugucagcuuuuuuauuuagggcaagaggugcagaauggacugggccaguccaggcagaauuu

SEQ ID NO: 132267 - RNA, 46 nt, Homo sapiens
auaaacuuuguuuguuuacaaauuauguaagagaagggcccggcca

SEQ ID NO: 132268 - RNA, 32 nt, Homo sapiens
ggaauauauuuuucuaaauccagccagugagc

SEQ ID NO: 132269 - RNA, 51 nt, Homo sapiens
gugugcucucuugaacaugguccuuuaggauuaggcaauagagugguaggc

SEQ ID NO: 132270 - RNA, 60 nt, Homo sapiens
agagaaagugccuagaaaucagagaaaggucuuggggguggaccuccagcuggacucuua

SEQ ID NO: 132271 - RNA, 60 nt, Homo sapiens
caugguauuuuuuuuuuucucagaaaauaaucaaaccaaaacuuucccuugcugauacag

SEQ ID NO: 132272 - RNA, 43 nt, Homo sapiens
gcuuugaagcucuuccugauuuuaacuauugcuaccuauggaa

SEQ ID NO: 132273 - RNA, 47 nt, Homo sapiens
ggauaugcgagagucacuaacuagcaaccuuuagggaaaaagaaguc

SEQ ID NO: 132274 - RNA, 52 nt, Homo sapiens
uugcuccgaggaaaggagggugcugauugcuccucuggauccagccggacgc

SEQ ID NO: 132275 - RNA, 61 nt, Homo sapiens
uugguauugugcaguaaaaugucuggaagggaauugaucaagucugguaagccagaucaga

SEQ ID NO: 132276 - RNA, 62 nt, Homo sapiens
agagaauuuuagauuucaauuuagcaaacguuugauuuucuagucuuuauggggcugacugu

SEQ ID NO: 132277 - RNA, 47 nt, Homo sapiens
aauuauuuaccgaaccggaauucuccuagaucacacuacuuugggau

SEQ ID NO: 132278 - RNA, 50 nt, Homo sapiens
uuuuccuguccuagcuccucccaucugcagccaaacuuucaguccuuccc

SEQ ID NO: 132279 - RNA, 42 nt, Homo sapiens
gcaccuuuaugggauuucuggaauaucgcuggguaccuggag

SEQ ID NO: 132280 - RNA, 49 nt, Homo sapiens
ugaagaguagcuucucacaccuucccuuguggaccuggaccccaugggg

SEQ ID NO: 132281 - RNA, 32 nt, Homo sapiens
ucugcauuuacauggcaaaguguaagaacuug

SEQ ID NO: 132282 - RNA, 48 nt, Homo sapiens
gcugaggacauuuaagaacuaagucaguuccuuuagcuauuaggggug

SEQ ID NO: 132283 - RNA, 79 nt, Homo sapiens
gccuaguuaagaauugugucaguuugucagugucagagagagagagagagugcaagagggagggagguaguaauucaaa

SEQ ID NO: 132284 - RNA, 53 nt, Homo sapiens
ucugcagggccuaagcuuugugggccuucugugcuuuacucuugggugaguua

SEQ ID NO: 132285 - RNA, 39 nt, Homo sapiens
cagguagauggcgacucccgggaagcgcgucgagggcgg

SEQ ID NO: 132286 - RNA, 58 nt, Homo sapiens
cgcagagggaaacuccgagcgagacggaaggaagccccagugaggcugacggaagcgg

SEQ ID NO: 132287 - RNA, 48 nt, Homo sapiens
cgggagagaggauggggugagcgagggaauccgggaaagggagggaga

SEQ ID NO: 132288 - RNA, 49 nt, Homo sapiens
ccucccuuucccggauucccucgcucaccccauccucucucccgccccu

SEQ ID NO: 132289 - RNA, 54 nt, Homo sapiens
agggagggacgacgugaagcugugccaccaacagggagaguggucccauuagua

SEQ ID NO: 132290 - RNA, 41 nt, Homo sapiens
ccuuucuucccuuugucuuuggucuuuuccggaggcacugu

SEQ ID NO: 132291 - RNA, 101 nt, Homo sapiens
gacaaagggaagaaaggcaagaaagacaaaggccccaaggugcccaaggaguccuuggaggggucccccaggccgcccaagaaggggaaggagaagccacc

SEQ ID NO: 132292 - RNA, 59 nt, Homo sapiens
caaggccaccaagaagcccaaggagaagccaccuaaggccaccaagaagcccaaggaga

SEQ ID NO: 132293 - RNA, 25 nt, Homo sapiens
gggguagcuccucggggccagggcu

SEQ ID NO: 132294 - RNA, 32 nt, Homo sapiens
gugccgggcuccucuggggugauggggcucug

SEQ ID NO: 132295 - RNA, 42 nt, Homo sapiens
uugcaggggcgccccucucaaauaacuggcagaauccaggag

SEQ ID NO: 132296 - RNA, 48 nt, Homo sapiens
ggaggaggagaccgagcaacccacacuggacuacaaugaccagaucga

SEQ ID NO: 132297 - RNA, 84 nt, Homo sapiens
gccggggccuucuccucagggggcucuggccagacccgcucgggccuccuccuucugcuuggggguggccuggguugcuucugg

SEQ ID NO: 132298 - RNA, 58 nt, Homo sapiens
acccccaagcagaaggaggaggcccgagcgggucuggccagagcccccugaggagaag

SEQ ID NO: 132299 - RNA, 45 nt, Homo sapiens
acaggacugggagggcuggaacccacaugggugacagggcagagu

SEQ ID NO: 132300 - RNA, 30 nt, Homo sapiens
ggggcggaggaggcccaaaguaauagucca

SEQ ID NO: 132301 - RNA, 45 nt, Homo sapiens
ccccagaagcccgaugcugagcgccagacagacgaagagaaggag

SEQ ID NO: 132302 - RNA, 44 nt, Homo sapiens
aaacccaaaaaggaggacagcagccccaaggaggagaccgacaa

SEQ ID NO: 132303 - RNA, 46 nt, Homo sapiens
gccccgaaagggcgaggaguuggaggaggaguggacgccuacggag

SEQ ID NO: 132304 - RNA, 46 nt, Homo sapiens
guguccccccauugggauggagucacaccguauugaggacaaccag

SEQ ID NO: 132305 - RNA, 68 nt, Homo sapiens
uuugugaccaccuucuucgugggcuucagcaaugacagccagacaugggugauguacaccaacggcua

SEQ ID NO: 132306 - RNA, 52 nt, Homo sapiens
cccagagccggugguggcucguuucauccgcaucuacccacucaccuggaau

SEQ ID NO: 132307 - RNA, 41 nt, Homo sapiens
gcaccuccaggcgcaugcacaggcugccauuccaggugagu

SEQ ID NO: 132308 - RNA, 57 nt, Homo sapiens
ugaggugguggccaccgaugaccuggauuuccggcaccacagcuacaaggacaugcg

SEQ ID NO: 132309 - RNA, 47 nt, Homo sapiens
ccaccaucacccgcacuuacagccugggcaagagcucacgaggccuc

SEQ ID NO: 132310 - RNA, 63 nt, Homo sapiens
ucaugcuccccaggguugucugagaucuccauggcauagaucuugaggccucgugagcucuug

SEQ ID NO: 132311 - RNA, 42 nt, Homo sapiens
gguacucucggcacagguacugcaugagcagcagcaacagcu

SEQ ID NO: 132312 - RNA, 44 nt, Homo sapiens
caguaccugugccgagaguaccgcgaugggaacccacgugugcg

SEQ ID NO: 132313 - RNA, 45 nt, Homo sapiens
ccaccuggugcccucacugaacccugauggcuacgagguggcagc

SEQ ID NO: 132314 - RNA, 46 nt, Homo sapiens
gggacccauuuccucuccucagcuccccagagcacagaguugagau

SEQ ID NO: 132315 - RNA, 46 nt, Homo sapiens
guccccaacaauaacuugcccaucccugaacgcuaccuuucgccag

SEQ ID NO: 132316 - RNA, 46 nt, Homo sapiens
gguucuucuccauccaggcaaugauggcccggaccuccguggauac

SEQ ID NO: 132317 - RNA, 46 nt, Homo sapiens
ccaucauugccuggauggagaagaaccccuucgugcugggagcaaa

SEQ ID NO: 132318 - RNA, 46 nt, Homo sapiens
gccauaucguagggguaggauacuagccgcucgccgccguucagau

SEQ ID NO: 132319 - RNA, 59 nt, Homo sapiens
ccggggggaggaugaggacgaggucuccgaggcccaggagacuccagaccacgccaucu

SEQ ID NO: 132320 - RNA, 42 nt, Homo sapiens
uaccgcggaggcugccaagcccaggacuacaccggcggcaug

SEQ ID NO: 132321 - RNA, 51 nt, Homo sapiens
uggaacccccggaccgggagugagucagccugggaggggcugugggcgggg

SEQ ID NO: 132322 - RNA, 44 nt, Homo sapiens
gcggggcagcucacucucaugagggaacuugucacagcccaggu

SEQ ID NO: 132323 - RNA, 47 nt, Homo sapiens
ccugggcugugacaaguucccucaugagagugagcugccccgcgagu

SEQ ID NO: 132324 - RNA, 102 nt, Homo sapiens
aggugcaccgcggcauuaaggggguggugacggacgagcaaggcauccccauugccaacgccaccaucucugugaguggcauuaaucacggcgugaagacag

SEQ ID NO: 132325 - RNA, 73 nt, Homo sapiens
gccagugguggugauuacuggcgaaucuugaacccgggugaguaccgcgugacagcccacgcggagggcuaca

SEQ ID NO: 132326 - RNA, 62 nt, Homo sapiens
ucucccggaugcgcuuccaguuggagcgagccaggaugaaguugcacugaguggccccgaug

SEQ ID NO: 132327 - RNA, 91 nt, Homo sapiens
ccccgagcgccaagaccugcaauguugacuaugacaucggggccacucagugcaacuucauccuggcucgcuccaacuggaagcgcauccg

SEQ ID NO: 132328 - RNA, 63 nt, Homo sapiens
uggccaugaacgggaaccggccuaucccacacauagacccaucgcgcccuaugaccccccaac

SEQ ID NO: 132329 - RNA, 31 nt, Homo sapiens
ucgcugcugcaggcgucgcuguugggggguc

SEQ ID NO: 132330 - RNA, 44 nt, Homo sapiens
ucagucuccgacuccucccagccagcggugguuggcgguaugag

SEQ ID NO: 132331 - RNA, 163 nt, Homo sapiens
uaccgccaaccaccgcuggcugggaggagucggagacugagaccuacacagagguggugacagaguuugggaccgagguggagcccgaguuugggaccaagguggagcccgaguuugagacccaguuggagccugaguuugagacccagcuggaacccgaguu

SEQ ID NO: 132332 - RNA, 70 nt, Homo sapiens
aucagcguccuaccaagaccccagcccaacucaagcuacagcagcagcacuucccaagccugcugaccac

SEQ ID NO: 132333 - RNA, 79 nt, Homo sapiens
ucguaagagaugggguugcugcaguguuggaguaggggcagagggagggagccaaggucacuccaauaaaacaagcuca

SEQ ID NO: 132334 - RNA, 45 nt, Homo sapiens
uagguugccacuggcacccgggcaaagguggcauuguuggcugau

SEQ ID NO: 132335 - RNA, 44 nt, Homo sapiens
gagguccgaggaaagcggggugacucauuucccuuguccagggc

SEQ ID NO: 132336 - RNA, 45 nt, Homo sapiens
guuggcccccauugcagcccccacccuguggguagucuuccagaa

SEQ ID NO: 132337 - RNA, 49 nt, Homo sapiens
aaagagaucucgacccuggggagcagaauucuugucaucuaugaggggu

SEQ ID NO: 132338 - RNA, 43 nt, Homo sapiens
gcccucaggaggagaccacagcauguccaucagcucagcagag

SEQ ID NO: 132339 - RNA, 56 nt, Homo sapiens
ccucagccucauggucagagcaguggagacuggagcccuguuugcacguucuaguu

SEQ ID NO: 132340 - RNA, 46 nt, Homo sapiens
cuuguuuaccccuagccauccuuucuuucaagggugaaccaggccu

SEQ ID NO: 132341 - RNA, 47 nt, Homo sapiens
uucucuggccagccggucuugccaggcaagugccugagcccugagga

SEQ ID NO: 132342 - RNA, 50 nt, Homo sapiens
aauuuggacagagauccugguggaaaagggacaagaugaaccauaaagag

SEQ ID NO: 132343 - RNA, 54 nt, Homo sapiens
ucaugaguugaccuucgggagaaagagucuguuuugacuggagaacaugaaccc

SEQ ID NO: 132344 - RNA, 54 nt, Homo sapiens
agaucaacaaggagcgcuccauggccaccguggaugaggaggaacaggcggugu

SEQ ID NO: 132345 - RNA, 66 nt, Homo sapiens
ugagcaaggugggcgaguauugguggaacgccauccuggagggagaagagcccaucgacauugaca

SEQ ID NO: 132346 - RNA, 63 nt, Homo sapiens
guauuauuccauuugugugaaauguccagaaccggcaaaucuguagaggcagaaucauuagua

SEQ ID NO: 132347 - RNA, 40 nt, Homo sapiens
uuuauagacaacaccucagguccuguuugcugccccagca

SEQ ID NO: 132348 - RNA, 48 nt, Homo sapiens
auuccacacaugugacauucuggacacggacaugcuggauggcaaaac

SEQ ID NO: 132349 - RNA, 49 nt, Homo sapiens
gccaugaagcacaguguggcugagcgucaagaguccccacacucaaagg

SEQ ID NO: 132350 - RNA, 87 nt, Homo sapiens
uaaucaggagaugucaggggaggaaaaaggcuguggaaauguccuagauuaaagaggacaggacccccaagaugcaggaaggacucu

SEQ ID NO: 132351 - RNA, 88 nt, Homo sapiens
gagaaggugcuugcuucaauaagaugcauaagccaucagucaguguggagggacuagggcaagaaagucagcauuucccagccuucgu

SEQ ID NO: 132352 - RNA, 88 nt, Homo sapiens
aaauggacugauuagaggucugggacuggguagauaaaagaggaaccuggagcauuuuguuaugcuggaaaaugagaacgugccaggg

SEQ ID NO: 132353 - RNA, 50 nt, Homo sapiens
uuacuaaggaaggaaagggauauaaaugcuggugagucaucagcgcagau

SEQ ID NO: 132354 - RNA, 55 nt, Homo sapiens
gaacgucccacaacauucccauaagucucauuggcccagucucgaucacgcgggc

SEQ ID NO: 132355 - RNA, 42 nt, Homo sapiens
acagauuaaauuaccuuagcauuuuggcaagagcccagagcc

SEQ ID NO: 132356 - RNA, 45 nt, Homo sapiens
guggcccuuagcagcagcuccauucguguggccaugcuggaggaa

SEQ ID NO: 132357 - RNA, 27 nt, Homo sapiens
gggcuccugcgucucccagguagccac

SEQ ID NO: 132358 - RNA, 46 nt, Homo sapiens
acagcugccaguccaguucuggagacggacaagugguggggcaggg

SEQ ID NO: 132359 - RNA, 94 nt, Homo sapiens
cagggagccauguccuauaaguaccgcaugcuaaccgauugcgccacuggagccacaccaugucaugauguaccuguaacauucgcaacuugag

SEQ ID NO: 132360 - RNA, 45 nt, Homo sapiens
cacucccugugccucuguuacugcuuagcggcgugauggguaggu

SEQ ID NO: 132361 - RNA, 55 nt, Homo sapiens
agguucauccauguuguagcauguguagaauguccuuccuuuuuaagucugaaua

SEQ ID NO: 132362 - RNA, 58 nt, Homo sapiens
auucuuuuucuagggauguaaugcagcauauauuuacaaacaaaaugccucacagaca

SEQ ID NO: 132363 - RNA, 45 nt, Homo sapiens
aagaucuggaaaaauggcagaaaaucuguuuccaucccuucaguu

SEQ ID NO: 132364 - RNA, 71 nt, Homo sapiens
augaugaagcaugguuacauuggcgaauuugaaaucauugaugaucacagagcugggaaaauuguugugaa

SEQ ID NO: 132365 - RNA, 85 nt, Homo sapiens
gaggccgccgcgcccuuggugcugcgggcgccgcggugacaggggaguggagcuggauggaguggggcucacggagggugguagg

SEQ ID NO: 132366 - RNA, 45 nt, Homo sapiens
uggagccgcggggccugcccggcgggcggagauuggcggguacgg

SEQ ID NO: 132367 - RNA, 51 nt, Homo sapiens
gggggcgggcgcggcggcggaugugagggagagggcggugcguccgcaggg

SEQ ID NO: 132368 - RNA, 42 nt, Homo sapiens
uuuucacaaaacagaccagcagcagcuaggacauuucaacag

SEQ ID NO: 132369 - RNA, 51 nt, Homo sapiens
gcuucaggaugaagccgcugaagaaagaagaaagaaagaaaguguguggaa

SEQ ID NO: 132370 - RNA, 54 nt, Homo sapiens
cuucucccaacagugccuucagcagcugccuugagggugccaucauuggcccug

SEQ ID NO: 132371 - RNA, 34 nt, Homo sapiens
ggagcccaacaggggcucacggucacucagcagg

SEQ ID NO: 132372 - RNA, 19 nt, Homo sapiens
auccguuuggggagaggaa

SEQ ID NO: 132373 - RNA, 41 nt, Homo sapiens
cucaguauaaacagcuuguaguggcaggucaccaggccugg

SEQ ID NO: 132374 - RNA, 52 nt, Homo sapiens
ccuuucugaguguauguugucacuuuacuuauaccuccucaaauacuaggug

SEQ ID NO: 132375 - RNA, 92 nt, Homo sapiens
ugagcaaaucucccagcaccacuaaugccugccuuauaaaagggauccuuauuuccuuuccuuccuuggcaagaaauauuugugggcaggga

SEQ ID NO: 132376 - RNA, 49 nt, Homo sapiens
gagugaugaggggcaggggaacucuccaaaaguauugcaguuaguggcc

SEQ ID NO: 132377 - RNA, 46 nt, Homo sapiens; identical to SEQ ID NO: 33608

SEQ ID NO: 132378 - RNA, 25 nt, Homo sapiens
aauagaguugacguuuaauuagcuu

SEQ ID NO: 132379 - RNA, 42 nt, Homo sapiens
uguuggaaaaucugugugcuuucuguaaauugugacaaccag

SEQ ID NO: 132380 - RNA, 35 nt, Homo sapiens
agcuguucuaugaaucauuuccauguuuaauaaaa

SEQ ID NO: 132381 - RNA, 43 nt, Homo sapiens
guugucuuaugauuguuuugcauauaaugucuaggauuuuuag

SEQ ID NO: 132382 - RNA, 50 nt, Homo sapiens
agaaagagcucuuccagcauuauucuuucucagacugagaugcacuuuca

SEQ ID NO: 132383 - RNA, 42 nt, Homo sapiens
acuuucaucgggggacaggaaucagcacuuccucugcgggag

SEQ ID NO: 132384 - RNA, 42 nt, Homo sapiens
ugacuugcaguuugcucucagacucucauucugguccuccag

SEQ ID NO: 132385 - RNA, 48 nt, Homo sapiens
uuugagaccccugggaucaugcaguucacaaaugaggagaaacggacc

SEQ ID NO: 132386 - RNA, 46 nt, Homo sapiens
agggcggcugaacgugcuugcaaaugucaucaggaaggagcuggaa

SEQ ID NO: 132387 - RNA, 25 nt, Homo sapiens
auauauauggauuuuguuaucagaa

SEQ ID NO: 132388 - RNA, 47 nt, Homo sapiens
cggcuucaccaccgacccucggauggcccgcuccucccccuacccca

SEQ ID NO: 132389 - RNA, 45 nt, Homo sapiens
agauggaugagcccauguucacgcagccgcucauguacaagcaga

SEQ ID NO: 132390 - RNA, 435 nt, Homo sapiens
ggagucaguguguuaggccauucuuguguugcuauaaagaaaaaccugagacuggguaauuuauaaagaaaaguuuaauuggcucacaguucuguaggcuguacaggaagcaugaugcuggcaucugcucagcuucuggggaggccucaggaagcuuacaaucaugacagaagaugaagugggagagcaggcaugucacauggccagagcaggaguaagagagugggggagaggggccacacacuuucaacaaccagaucucgugugaacucagagugagagcucacucaucaccaaggggauggcccaagcucuaauccuaacaccucccaccaggccccaccuccagcagugggagauuacaauucaacaugagauuugggcagggacaaauauccaaacuagaucaccugagggcccccacaugccccagaa

SEQ ID NO: 132391 - RNA, 46 nt, Homo sapiens
cccuguuggugcagggaagggcuccucagagagccucuugcuuggg

SEQ ID NO: 132392 - RNA, 40 nt, Homo sapiens
agcccugggcccaggagagcucucagccacauaccugaga

SEQ ID NO: 132393 - RNA, 61 nt, Homo sapiens
uauuaugaccucacccgggagcgcaaagcacgcgacaugguggggcagguggccaucacaa

SEQ ID NO: 132394 - RNA, 51 nt, Homo sapiens
uugaccuccugcugaaggaggugcagaaguaccccaaugcugagcuggccu

SEQ ID NO: 132395 - RNA, 49 nt, Homo sapiens
gcgccaagcccgucugguaaggcuucagucccugccaggaaggcugugg

SEQ ID NO: 132396 - RNA, 42 nt, Homo sapiens
aaagguagcccccgagggauguccuuggggaggggucagcuc

SEQ ID NO: 132397 - RNA, 49 nt, Homo sapiens
ccgcugucacccagcaaggcacaggcuccuguauuugagacuaggauag

SEQ ID NO: 132398 - RNA, 49 nt, Homo sapiens
gagguuucuagggugggccccagccguggcgugaacugaggaugacccg

SEQ ID NO: 132399 - RNA, 52 nt, Homo sapiens
ugcuguuccuucgaggguuccaggcuguguguggggcccaagcaugccccac

SEQ ID NO: 132400 - RNA, 45 nt, Homo sapiens
ugcauugcauuggcuugacccauaaacuaaguuauauccgugggc

SEQ ID NO: 132401 - RNA, 46 nt, Homo sapiens
gcggguuuuagggacguuaaccaugcuugcgugagcgcuaucggcg

SEQ ID NO: 132402 - RNA, 46 nt, Homo sapiens
uacuguucaaaaaggaaugccccacaaguguuaccauggcaaaacu

SEQ ID NO: 132403 - RNA, 45 nt, Homo sapiens
cuccccuuccccagacucgccucgggcccugggcucgggccagca

SEQ ID NO: 132404 - RNA, 46 nt, Homo sapiens
ccaggacccccaggaagacucuguggaagacgaggagcccccaggc

SEQ ID NO: 132405 - RNA, 44 nt, Homo sapiens
aucuuucagguggaggcaguggaggugacaccgcuauccccaga

SEQ ID NO: 132406 - RNA, 42 nt, Homo sapiens
gaccaggagggugggcacgcaagcccagacccaccccccgag

SEQ ID NO: 132407 - RNA, 45 nt, Homo sapiens
ucauuggaugcuucaaacagaggugccuuuggccuagguccaagu

SEQ ID NO: 132408 - RNA, 27 nt, Homo sapiens
ucuaaguuucccaugaccuaucgcucc

SEQ ID NO: 132409 - RNA, 43 nt, Homo sapiens
aagcggagcgauaggucaugggaaacuuagaaaagauaaagaa

SEQ ID NO: 132410 - RNA, 54 nt, Homo sapiens
guugaggccugugggggcugggaggacgagugaguggagacuggggaacuccag

SEQ ID NO: 132411 - RNA, 350 nt, Homo sapiens
ucuaagcagguuauuuuaucagagagaaaauucaugcugggcucaguggcucacgccuguaaacuuaccacuuugaguggccaaggcgauuggauugcaugagcucagggauuugagaccagccuggggaacauggcaaaaccccaucucugcaaaauauacaaaaauuagcugggaaugguggcacgugccuguagucccagcuacucaggaggcugaggugggaggauggcuugaacccgggagguggagguugucaugagcuaagacagugccacuacacuccagccuaugugacagagccagacccugucucaaaaaauaaaaaauaaagaaaauuuaauuccuag

SEQ ID NO: 132412 - RNA, 82 nt, Homo sapiens
ucuccuugaaaacagaggggucucaagacauucugccuaccuauuagcuuuucuuuauuuuuuuaacuuuuuggggggaaaa

SEQ ID NO: 132413 - RNA, 46 nt, Homo sapiens
acgcccagagacugggcugcucucccggaggccaaacccaagaagg

SEQ ID NO: 132414 - RNA, 86 nt, Homo sapiens
gauauguucuuguuaacauuguauacaacauagccccaaauauaguaagaucuauacuagauaauccuagaugaaauguuagagau

SEQ ID NO: 132415 - RNA, 49 nt, Homo sapiens
agagucauucucaugcuuuucuuuauaauucacacauauaugcagagaa

SEQ ID NO: 132416 - RNA, 83 nt, Homo sapiens
cccagucgaaggcccaggauggcuuuugcugcggccccgugggguaggagggacagagagacagggagagucagccuccacau

SEQ ID NO: 132417 - RNA, 45 nt, Homo sapiens
ggaugcagcaaugcgugcucgaccauucaagguugaugggcgugu

SEQ ID NO: 132418 - RNA, 45 nt, Homo sapiens
uacuuugaaaaguacggcaagauugaaaccauagaaguuauggaa

SEQ ID NO: 132419 - RNA, 43 nt, Homo sapiens
ugguggcaacuauggcagugguccugguuauaguaguagaggc

SEQ ID NO: 132420 - RNA, 66 nt, Homo sapiens
guguacugauauggcaaaauguaugacuuauaguuaaaaaagcagguuagauguugauagauacag

SEQ ID NO: 132421 - RNA, 87 nt, Homo sapiens
ugaaauuaugugguagggagagaagccaguaagcuucacuucuccguuuggcugaugucacucucgaauucuguacuuucauacgga

SEQ ID NO: 132422 - RNA, 46 nt, Homo sapiens
ugcacauagauauuaggaagcuccuacaguuucuugcuggacaaca

SEQ ID NO: 132423 - RNA, 44 nt, Homo sapiens
acuguuucacuugaucacauuucuuaucucauacaagguaauaa

SEQ ID NO: 132424 - RNA, 55 nt, Homo sapiens
caguuagccaccagggggagaagcugugccaccaaguagcugacagaucugugca

SEQ ID NO: 132425 - RNA, 26 nt, Homo sapiens
gaaagcuuuuauauuugccuuuaauc

SEQ ID NO: 132426 - RNA, 41 nt, Homo sapiens
cacgggaagugagauggauuucuuggguaacaacucauuau

SEQ ID NO: 132427 - RNA, 46 nt, Homo sapiens
ucucugcagaaaacaaugagauuuauuuagagcuaacaucggaaaa

SEQ ID NO: 132428 - RNA, 45 nt, Homo sapiens
gagagggcugacaggacaaugguuucaggacgcagagagccacag

SEQ ID NO: 132429 - RNA, 46 nt, Homo sapiens; identical to SEQ ID NO: 33687

SEQ ID NO: 132430 - RNA, 25 nt, Homo sapiens
uccaccgagcacucggggcagaacu

SEQ ID NO: 132431 - RNA, 2914 nt, Homo sapiens
agucaauggcuaaaaaaugaaagaagcagacauggaguuuagccaucaaauuuaccuacagacuuaaugcagugguucucaagauuuaggaaucaccugacacuaaacugcagauugcugggcugauuccacagcauuagaguggggcccagguacuugcauuuuaauaagacccacacacaccacaccucaccucccugcccaggugaauuuaaugcagggggcucccugcuucacagaaaacacugacuuauagaauaucauagaaguggaaacauguuuauuugagcugaguauuugcaugagaagcacuuaaaucugcuaccugugccaccacuaaauccaagaacaugaacuauuugagcacuucaaagucagggaaacccucacagaagcaacacagacuuauggggccauaccucauuuuaggauauaaugacuggacugcccaacuuagcacuuuuuaaacacucaaucaacaaauguuuacugaauucuuuuaaugcgcaaaguauacuaaauauagaacccaaucccuagcagcaaugagcucguaggaggguaaagacuguauuaucgaucacacaugcuugacuuaaacacacauuuauucauucauaaacauuugcauggaaccaacuaaauccaggaaucaaauggcacuggagcccaacugccaaacgagggacacagacacuaggaacagcggucggaagaggaccucccccugccaggccuccaccugcucuguccugcuaugcuucccauugcuuccccaguccaagccaacugagagaacccugacccaagcuuuucugccucuuuaaucccccagcccuucccuccagcacacccuuccccuccuugcuguacagguuaagauccucugugccuccugaaaacuaagccuugccugcucucuaugcuacagaugugacauucccucccuuucaacuccucucucacaaaacucuguucagacuucccucaagacacuugucauagugugccuugugucauauuuguguauguuaugucuauaccucaagcuucagaaauuccuucacgcagguccugggaugucuuuguauuccuagcaugggugcucaauauuauuuguagaacugaauuuguugggaaagaggcauuuagacucagaauggcagggcugcaucaugaaguacaacucccucaccugacuccugaugaaacugagguccagaggcaugaagugcuuaggcagggggagguccagcacuccaagcugaauuuaagaagugacuggggggcggggggguggggugguggugguaguggauaaacuacaauguucucuugccuaaucauuuggccugcuuauuuccuuaaaagucugaauauuugaugccacagcuaugacuuauauuuauuuugccuaauccaaacucucugagcugacucucagaaaugcuugaaguauuucauacaaguauaaucaaugcauuaagcaccuggagcagaguggcuggaaccagaccagaaauugaucuucccuccucuaagagccaagugcaccacagcuaugcuucuccugaacuacugaucaaaaucuaccuugcuuuaguguugucuguggauucaucucuccccuacaaccucacuguggacuccaugagggcaaaaacccuguucucuacagcuuugcauucccagagcuuaccaccaugccugccacuuucaugcuccauaaaugcuguugaaggaauagauuaauaaaaaagccaucuaccagcacugagcacucacuaaacacaaagcacuuauauggauuaccucacuuaauccuuaacauuacccugauaaggaucauuaguggccgaauguuacagaugaggaaacugcagcacacagaaguuuaauaacuugcccaaguuucacaaaagcaguaagugaugcagccauaagaacgaacgaaaucauguccucugcagcaacauggacguggcuggaagccacuaucuucuuuuuuauuuucuuuuguuugagaaggagucucacucuauugcccaggccagagugcaguggcaugaucucggcucacugcaaccuccaccuucuggguucaaucaauucugccucagccuccccaguagcugggauuacaggugggagccaccacaccuggcuaauuuuugcauuuuuaguagaggcgggcuuuccccauguuggccaggcuggucucaaacuccuggccucagguguuccucagucuuggccucccaaagugcuggaauuacaggcgcgagcgcggccuggaagccauuauccuaagagaauuaacacaggaacagaaaaccaaacaccgcaugggagcuaaaacuggguacgcacggacauaaagaugacaauaaacacacuggugacuacuagagcuggaagggaggcaguggggcuaggggugaaaaacuaccuauugcguacuaugcucacuaccugggugaaaggaucauuuauaccccaaaucucagcaucacgcacuauacccaggcaacaaaccugcaccaauguaccccuugacuccaaaauaaaaguugaaaacauuuuaaaaacuuuuguaacaauaguagugaaaacaguauuugaacccaagucugcacacugcuaaacccaugcuucucagcaaugcauacccaggacaaggguggaccuaaguggcccgugggcgccagggaggcggccacugagccaagggcacaggguauggucaagucuccagcaaugcacuuuucucagcacuaccacccucagcccgaaccaaggacuggaaggagccccaaagaguguguggguggagagcggggcaggaacccgugggcgcgggaacgaggaaggggagucgcuuaccuauuaugggaaccucagcgaugaagacccu

SEQ ID NO: 132432 - RNA, 48 nt, Homo sapiens
gccaagguuucaaaugcuuuucugaucagaacagggaaaagauaccua

SEQ ID NO: 132433 - RNA, 42 nt, Homo sapiens
acauucucagcaccuguaggugagucagcuacugcaaaauuc

SEQ ID NO: 132434 - RNA, 30 nt, Homo sapiens
uagaucugugcaccugagugaauggcagaa

SEQ ID NO: 132435 - RNA, 27 nt, Homo sapiens
uaguuuaaauuugugauccaugcuguu

SEQ ID NO: 132436 - RNA, 42 nt, Homo sapiens
uucuuucaguuucucauuucuaguauuguauaaaugaguuua

SEQ ID NO: 132437 - RNA, 47 nt, Homo sapiens
aggaagaaguaagacuuggaagaugaauauugaaggaaaggugaaga

SEQ ID NO: 132438 - RNA, 47 nt, Homo sapiens
uaagaaaaaaaaauugggaggcuuuucaaagguggcuuuguuaggua

SEQ ID NO: 132439 - RNA, 69 nt, Homo sapiens
agccuucccacccuccaggagggucuggcacagaaagccacauucuccuagaaagagaggaaaagccca

SEQ ID NO: 132440 - RNA, 53 nt, Homo sapiens
ggccugcagcagggagcuggucaauggcucugugcgcgccccaggccacggcg

SEQ ID NO: 132441 - RNA, 45 nt, Homo sapiens
gaccugcugcuauccacagaagcuccuguuucucacugguucagu

SEQ ID NO: 132442 - RNA, 46 nt, Homo sapiens
ggccaaaacccagggaaaagcuacagacuuaagcacggccucacaa

SEQ ID NO: 132443 - RNA, 45 nt, Homo sapiens
gacaaaguguauggcugugcugacggggagaggacucaagccaca

SEQ ID NO: 132444 - RNA, 47 nt, Homo sapiens
ggcaagggaggaaguaccugcccugcaccccgcuucccaugacgucg

SEQ ID NO: 132445 - RNA, 51 nt, Homo sapiens
cucggaggguguugccagcaggagagacucccuggcgccacuucaagcuga

SEQ ID NO: 132446 - RNA, 69 nt, Homo sapiens
acagcuaugaaacagacaccagcucccucaccagcuccauccauggugcauccaaccacugcccacagg

SEQ ID NO: 132447 - RNA, 50 nt, Homo sapiens
uugcuggagaguuccguaaaacccuugcagaacuugaugaagaccuggaa

SEQ ID NO: 132448 - RNA, 42 nt, Homo sapiens
agugccaagugaggccaguggugggagggagcuggacaggaa

SEQ ID NO: 132449 - RNA, 24 nt, Homo sapiens
gugacaugagcccucuccaucccc

SEQ ID NO: 132450 - RNA, 55 nt, Homo sapiens
cgucucucuggacucgcagcaggacagcaugaaauacaaagacaagugggccaca

SEQ ID NO: 132451 - RNA, 46 nt, Homo sapiens
ggcagauagucucacccagauaugauaaauugguuaccugcaagag

SEQ ID NO: 132452 - RNA, 95 nt, Homo sapiens
ggaaauaaaaauauguuaauuaaugcuauuuuugaaaucuacauuuuccuuaagugguuagaaguaaacacuaggagagcucagaaauauaugug

SEQ ID NO: 132453 - RNA, 53 nt, Homo sapiens
ugucaggcaagaggauggucugacuccuuuccucucuuaucauccguagagau

SEQ ID NO: 132454 - RNA, 46 nt, Homo sapiens
uuaauuugcuggcuguguagucuguugacuuuggauaaggcuagaa

SEQ ID NO: 132455 - RNA, 42 nt, Homo sapiens
ccucuguuacagugugacuagugguucuaaaaagggaugugu

SEQ ID NO: 132456 - RNA, 68 nt, Homo sapiens
uauugagauuauuuagacuggacacacuguuuccugguugauaaaucugcuacagggcuucagggcag

SEQ ID NO: 132457 - RNA, 45 nt, Homo sapiens
aauaaaggacuuuugucugauaaguagcagucauuugaccucaaa

SEQ ID NO: 132458 - RNA, 47 nt, Homo sapiens
agcagagggcguggaacuggagaagguaggacgggaauuuggcugau

SEQ ID NO: 132459 - RNA, 45 nt, Homo sapiens
auggucaggacaacuugcagagucugaguugauaaauaucacaca

SEQ ID NO: 132460 - RNA, 44 nt, Homo sapiens
ggaacuaaagcaucugcuuucuugauagucuuuguaguaagagg

SEQ ID NO: 132461 - RNA, 46 nt, Homo sapiens
uuggcaagaauggaaugaccuuagaugagccaggcccaucuggcag

SEQ ID NO: 132462 - RNA, 36 nt, Homo sapiens
gaucugguguuagguguggcuggaucugguguugag

SEQ ID NO: 132463 - RNA, 52 nt, Homo sapiens
uggaauuauacuaucugugagcagaaagagaccuauuagaucaucauagccc

SEQ ID NO: 132464 - RNA, 57 nt, Homo sapiens
acagccaccaccaccgaguccccugauccccaaccgcacugaggauaaggaggagaa

SEQ ID NO: 132465 - RNA, 52 nt, Homo sapiens
gaaccaaauccucaucuucuggaguagaugccaauaccuaacauggaaaaau

SEQ ID NO: 132466 - RNA, 44 nt, Homo sapiens
caugaauuugaggaagacucaaaauaugauaagcagaggccaag

SEQ ID NO: 132467 - RNA, 82 nt, Homo sapiens
guuguauaccugaggaguuuuaguaaauggauuuauugaaaacucgaaaaauaaagagagaaaaagaaaugugaggaaaaga

SEQ ID NO: 132468 - RNA, 65 nt, Homo sapiens
uguaugucuauuuccuuccuccaauuuggagaauugucagacauuacuucuccagaucaacucuc

SEQ ID NO: 132469 - RNA, 44 nt, Homo sapiens
cauucaguccauaacgagaaggcacuagauuuccugguugcggg

SEQ ID NO: 132470 - RNA, 54 nt, Homo sapiens
cacaaugagauuaugagaccaaagaaaccaaaguggagcaaaugcuuccaaaaa

SEQ ID NO: 132471 - RNA, 69 nt, Homo sapiens
augaggcacuuacaguagucagauucauggagacaaaaaguaggaugaugguugccagggccugggggg

SEQ ID NO: 132472 - RNA, 68 nt, Homo sapiens
ccauguucaucgcagcaugauucauaauagcugaaacauggagguaacacagguguccaucgauggau

SEQ ID NO: 132473 - RNA, 49 nt, Homo sapiens
ugugaaaacagccaggcugcaaggauccuccuugguggaaauagccggg

SEQ ID NO: 132474 - RNA, 35 nt, Homo sapiens
gguggaagaucugccagggcuaggagagaagaggc

SEQ ID NO: 132475 - RNA, 58 nt, Homo sapiens
uuagccacaccagucacuuguuaauaucuuauggggagacucuggaagggcaggugcg

SEQ ID NO: 132476 - RNA, 42 nt, Homo sapiens
gcccuccuccaagcuccuggccagcucuucgugugucuugau

SEQ ID NO: 132477 - RNA, 29 nt, Homo sapiens
ccaauauugcuaucagugaacuguagcuu

SEQ ID NO: 132478 - RNA, 42 nt, Homo sapiens
cgugugagcccugagguuccucuccagaauauucucccaguc

SEQ ID NO: 132479 - RNA, 46 nt, Homo sapiens
auccuuuguccucaggagaugagaggcagguugggaucugaugagc

SEQ ID NO: 132480 - RNA, 47 nt, Homo sapiens
acucuauccacccugugaggugggcacugucauucugcucucaccag

SEQ ID NO: 132481 - RNA, 47 nt, Homo sapiens
uuccauugaaccugagauuuaaccugaauguagauagaugaugagag

SEQ ID NO: 132482 - RNA, 51 nt, Homo sapiens
uggcacaggcucuccguuucuugucuagggcucugcuaagauuucaaaaag

SEQ ID NO: 132483 - RNA, 40 nt, Homo sapiens
agugccuuguguccaaacugguguucaaggccaagggcua

SEQ ID NO: 132484 - RNA, 63 nt, Homo sapiens
gagauggaguguuaaaauaauguuaucuuucuuaaguagugaauuauuaucccuucucauggu

SEQ ID NO: 132485 - RNA, 42 nt, Homo sapiens
ugccacucugcaugugcacagugaccagaagcccccccacga

SEQ ID NO: 132486 - RNA, 46 nt, Homo sapiens
gccacugacucugugccuuuguguuguuguuuuuaaggaggaagau

SEQ ID NO: 132487 - RNA, 47 nt, Homo sapiens
uucauagacacauauuucagcccuuacuuaucuggaucuucuguuga

SEQ ID NO: 132488 - RNA, 31 nt, Homo sapiens
uuuuuaugccacaauucugugggcugcagug

SEQ ID NO: 132489 - RNA, 29 nt, Homo sapiens
cccacuucccaaauaacaccaccaucaag

SEQ ID NO: 132490 - RNA, 43 nt, Homo sapiens
ugaggcacuuagggauuggaacuggagcaugcugugggugaga

SEQ ID NO: 132491 - RNA, 74 nt, Homo sapiens
agacagaggcguggugaagguggagcccaggacaagaacauguugggcgaggucuuccgggacuuggaauggcu

SEQ ID NO: 132492 - RNA, 139 nt, Homo sapiens
ugggaagaggcaacugaucagguccguuagaguguggaggaagccuggcuguaaaggcgcggguuucggaagcuaugaggaaauugggacauuggguguagggcuccucuuuggaggcguuuccucuuuugaauggaag

SEQ ID NO: 132493 - RNA, 45 nt, Homo sapiens
uaggguuugcagaaaauacuucuaauuucagcaggaguggguagg

SEQ ID NO: 132494 - RNA, 44 nt, Homo sapiens
ugggucuuaaccugguuuaucucaguaucuuuuccaaaucuuaa

SEQ ID NO: 132495 - RNA, 46 nt, Homo sapiens
uauuuaauagguauauaugcagacuuggauaaauaaauuauacuau

SEQ ID NO: 132496 - RNA, 48 nt, Homo sapiens
uugccuucccuuucaaggauucuguuuugggguugcacguccucaugu

SEQ ID NO: 132497 - RNA, 41 nt, Homo sapiens
aggaagcaaaauaccuggcaugucauauacauucucuuggu

SEQ ID NO: 132498 - RNA, 46 nt, Homo sapiens
ugcacaucuccugcgguggggcugagcuuggcgugugugagcagca

SEQ ID NO: 132499 - RNA, 49 nt, Homo sapiens
uuuaugcccugggaacacagccaugaauaugacaggugaggucucccug

SEQ ID NO: 132500 - RNA, 30 nt, Homo sapiens
gcacaggccagccauccucccugucaggca

SEQ ID NO: 132501 - RNA, 91 nt, Homo sapiens
ggaacagccccugcucuggguuucucuggaacccaguucuucugguucuccccucuccacagcuauuuaacucccaacccccaccugcuuu

SEQ ID NO: 132502 - RNA, 43 nt, Homo sapiens
acguggacaguugauccacauggacuuugagccugucauagaa

SEQ ID NO: 132503 - RNA, 63 nt, Homo sapiens
cgccaauucacuggaucacaucgauccacuggaucacaucuggcuguaacuuucauuauaaau

SEQ ID NO: 132504 - RNA, 41 nt, Homo sapiens
uguguaaugaauauuauuaaauauuauguuaaucccagggg

SEQ ID NO: 132505 - RNA, 48 nt, Homo sapiens
aaaagugcucaugcaacaacacaggugcuuuagaaccugaguccauuu

SEQ ID NO: 132506 - RNA, 46 nt, Homo sapiens
gaugauugaggacuaauuuucagucuaacggcagaagcagguguca

SEQ ID NO: 132507 - RNA, 42 nt, Homo sapiens
cugcagguccugugcuggggaaggggagcgagggccucacuu

SEQ ID NO: 132508 - RNA, 58 nt, Homo sapiens
gcagugagggucaugugcaguguguuugggagggaagguguguuugggagggaaggcg

SEQ ID NO: 132509 - RNA, 45 nt, Homo sapiens
uggcaacagauguuccagucugguggggcguggguugucggggag

SEQ ID NO: 132510 - RNA, 35 nt, Homo sapiens
aagauaagaucaguguuugcuguugccagggguca

SEQ ID NO: 132511 - RNA, 28 nt, Homo sapiens
aguggagagcacgggcugugaggcuccu

SEQ ID NO: 132512 - RNA, 48 nt, Homo sapiens
gaggggacacugaggacagcagauggcuuagaugccuggaucugcgcu

SEQ ID NO: 132513 - RNA, 33 nt, Homo sapiens
cugcauccgaauguaaaagcauaaaucugaaag

SEQ ID NO: 132514 - RNA, 41 nt, Homo sapiens
gugagauugccaugugacucugacgucucucgucagugucc

SEQ ID NO: 132515 - RNA, 100 nt, Homo sapiens
cugaaacuaccacuccuccuuguguuguauagaaacaagcuagacugggugcagugaauuaacgagauuucacccuguggccuacaaacgcucuucuaga

SEQ ID NO: 132516 - RNA, 45 nt, Homo sapiens
agugugcuugagggaaauuuguuuuccaucugauucugcaaccgu

SEQ ID NO: 132517 - RNA, 120 nt, Homo sapiens
cuuugucauuuguuaauacuuucagugaagaagcaucaagaaaauguuaauauccuuauauuuuuucagacaagaauuacguguuuaauaagcaauuuuguguucaaaucugaggagaua

SEQ ID NO: 132518 - RNA, 74 nt, Homo sapiens
cauucaguucuuucccucacucauauccagugucuaauuuacuuguccgaacaucuuuguccaagaaauguaga

SEQ ID NO: 132519 - RNA, 75 nt, Homo sapiens
gauuggcuuucauauuugaauugcaaaguaaaacuaaggauuuuugcuauggaaaacaugaaauuauuccugaug

SEQ ID NO: 132520 - RNA, 45 nt, Homo sapiens
guuacaguugugucccacugacucacccugcccaugugcccauag

SEQ ID NO: 132521 - RNA, 47 nt, Homo sapiens
cgugcagggauuacacgucacauucaggauuugacucucagaaagag

SEQ ID NO: 132522 - RNA, 47 nt, Homo sapiens
guuugccguagggguggagcggggagcgaggggacgcccggccuuug

SEQ ID NO: 132523 - RNA, 42 nt, Homo sapiens
ggugccaucauucuugaggaggaaguagcguggccgccaggu

SEQ ID NO: 132524 - RNA, 3361 nt, Homo sapiens
ucaucagcuggcacucugcgggcaggcagagccucugucugcgugcaucccccugccccucccagggcccucaccacagcccccgcugcaccagccagcuccccuugcauaccacccaccagguccugggaagccccaucucuuccucucuccaagccucaguuucucgccucacagaguggggcuaggaccccuguuccagcucagacacucuacuccaggcugaggcagccacacagggcaucuggcccggcgucaggucaaacccccaccaucguccacuccuacaguccuuccuucagucucugagccccgccgugcgccaggccucagaggaugagggguauggagaucccacagaggggcuggcaugaggggggcaccccagaaaccugcuugucccaccuaguguagaaauguccugcuuuuuucccaaccucacccugaguaccugggaaauacagccaccuggagcacacccacaccuggggcacacccacaccuggggcacaggcacaccuggggcacagccacaccuggggcacaggcacaccuggggcacagccacaccuggggcacacauacaucuggggcacacacacacuggaggcaaagccacaccuggggcacacgcacaccugaggcacacaccuggggcacacgcacaccugggacacagccacacuggaauacacagacaucuagaacacaucuagacaccuagccacaucuggggcacacgaacaccuggggcacacgcacaccuggggcacagccacaccuggggcacaagcacaccuggggaacacauaccuggggcacagccacaccuacagcacguacacccugagggcugugggaacgugcggggcccugagaggugugagugaguggaguguguagccgcuggggcuccguggcaggcucuggcccagccugugcaaagcaggaggaggcugaggggccaguggggggccucugacauuccagcaucgaggcccuggcaaccacaagggggccuggccaggcagcaaggaagcugucuuccaggccugggggccaggagggggcucgggaccagccugguggggaggguggccugugucaacacaggccagagaaguggaaaccggugugaagccccggcacacccaccucccacucgcuccuggaugguccgaucugccccaguaugcaauccccagggccagagucucgagcccacugccccggaaccguuccccggagaaaagccccggacagaggcccagcacagccccuggccccugcccagcucugcuccuuggccaggcgcuccaggccacucaccuauggccuaaucugaaggccccagccuugccagcugcucaggcaacaccuccagcugguacccacccgugugccucuccagagagcuccccaccucguuccuucccaaugccucggccuggcgagcacacccacagcacccacccccagcaaggcccugucccaggugccaccaggcacgcugcuggcacccagccucucccugaucccugaagcccccagccccaaccgaggagacacuggggagggugugggacaagucacagugagucuccugcaugguuacgaggcugucaggagacaggggugucugccuuccuggucuccccucaccccuggggugcccuacucuaucaggcugcccugcuacugcuggcuugaggcuggaagagccagggaaggagaccucggcuuacaggaaccagguccugguaaaccccaccccaaccccagccccucagccuggggcuuugcagggcaaggccucugccccucccaacuagaagcuucagggcacgguuugcuggccacagaccaccuagcagccagggugccagacugaccccaccuccccuuauacgugcaggcaccaagggugggaguccuucccugcccagccuggggacggauucccugcauuuaaccuccucccagacccuggaccagaaccuggggguccagcaaguucaagggagucggaggaccgcaggccucaaagaaaggagggcagagcuacuuggaggggaggggccgaugcagcacauggggauggaaccuaaggccagccccuggugggcaccucgcucugcaccacagaccugccugagacagaucccagaggccugcaguuacccagcccugccacauacagauggcccacaacugggcccuaauuagccacucagucacaccugcaugcccaacccgugucucuggcugccacaggcagagcugggcuccaggacagggacacagaaaauggggaccaugcugggaggcccacguguccccagccucccaccuagcagggcgccugggucuccaugccaggguucccgucugacauggguagggucgcaccugcccccgcuacagguaaggaauaaagccacagcagggcggagcagggagcgucacaugucucucaucucugugggaugcuccggccaaggucccccgcuggccuuucugcaccugccccuccaugggcaaggaggcagccucacagaggggaagcaaaggcucugccauggggucuggaggcugagagccugugcagggagaggcacgagcucuuccucgagugauggaggcuucagagcuggagaccccaauggacucuugcccccucacccaagggguuucccaaggagaggcccugaugggcucuaucuaacccccuuggaggaggggcccccggggcagcuguccacccugagacugggcucugcugccacuuguccggacccuccagcuuccagagcaugggcaccagggaacugcuccagggucagccagccuugggacucggcccagagacccccgcccagccagccucggccucaggacucugcccagaaaccccugcccagccggccucggccucgggacucagcccagagaccccggcccagccagccucggccucgggacucggaccagagacccccgcccagccagccucaggacucagcucggagaccccugcccagccagccucggccucgggacuuggaccagagaccccugcccagccagccucggccuuaggacucagccuggagacucccacccagccagccucagcuuugggacucagcccggagaccccugcccagccagccucgggacucggcccagagacccccacccagccagugcuuguugcuugccagcccaggacuuggaggcuccaggggacccccaucguggggccuggugggcaaagagggcuccagccaaccccccaaaucugaaucccgagaggccaaggggauacuuacgcgccacagagaaguuguugaggggagcc

SEQ ID NO: 132525 - RNA, 45 nt, Homo sapiens
ggcaggcggccgcacaucaucucguacaugaccacacccagcccc

SEQ ID NO: 132526 - RNA, 585 nt, Homo sapiens
gccccccaccaagccugugcagagacggccgucagcaccugccucccggagcagcuggguucgggcagacgggcuuucggagcaggcaggcccuguauggcccuuaaugauucugucuugaccacaaaccacuucacagaggaggaaaccgaggcucagggagggagcucacgugcccagggucagagccagggagucagcaacccggacccacguguccucacugccuggccuuacccugaguccagaaagggaguuaguagggcaggcuccguuccuauccuggcucugccacauaugguuugguggccccagccaggcccaggggaugcccuguuccucaguguccccauaaaauaaggcagugucaaggaugggccugcccugggggaagcacucccuaagugccacuguggacguuuucaggggcuguguggggacgacacacugcgacccuacaagcgagcacccuuguggacgcugcccccuccaggccgcagggacaguggcagcagcuggcgcugggcuggguggggccgacgccagcccucaccucugcuugggguccuucuuaagcagcccagc

SEQ ID NO: 132527 - RNA, 166 nt, Homo sapiens
gaccugagguuugaaggguggcaggagcuacggaggagaggagcucaggcucagggacccugaggccaggaggccucaaccaaggucaccacgagugggccaggucccugaggguccugcuggggcaagcaguggggcucaccuucuucuggaccacguccugcca

SEQ ID NO: 132528 - RNA, 33 nt, Homo sapiens
uuuugucucauuguguuauugucugacuaaauc

SEQ ID NO: 132529 - RNA, 36 nt, Homo sapiens
aaaacacaaaacauaacuuguuuccaaagucacaaa

SEQ ID NO: 132530 - RNA, 46 nt, Homo sapiens
auaaagacaaagaacuuuuaaaauuaacucaguaccucaaggagau

SEQ ID NO: 132531 - RNA, 46 nt, Homo sapiens
ggcguucuggaagaacuccuguaagggucuugagaaacuguuugag

SEQ ID NO: 132532 - RNA, 49 nt, Homo sapiens
agguauuuuuuuuucugaaggaaagcugcuuccucauauguuucaagaa

SEQ ID NO: 132533 - RNA, 33 nt, Homo sapiens
ggaaacagaggucgaaggaaaguaaggagcuga

SEQ ID NO: 132534 - RNA, 43 nt, Homo sapiens
ugcccucccuaaagcaaccaaguagccuuuauuucccacagug

SEQ ID NO: 132535 - RNA, 55 nt, Homo sapiens
uccuaucugaauucccagcagaagcacuaagaagcuccacccuaucaccuagcag

SEQ ID NO: 132536 - RNA, 52 nt, Homo sapiens
cacacauauuuaugcugucugaaggucacgaucauguuaccauaucaagcug

SEQ ID NO: 132537 - RNA, 42 nt, Homo sapiens
cuucucacaagacuuucaggauuaagcgauuccuggccaaga

SEQ ID NO: 132538 - RNA, 48 nt, Homo sapiens; identical to SEQ ID NO: 33873

SEQ ID NO: 132539 - RNA, 42 nt, Homo sapiens
gguuuuauucguagcaaauguugccaauuucuccggccagau

SEQ ID NO: 132540 - RNA, 46 nt, Homo sapiens
aggcucuacugcaggaacauuugaaggaacuuucuuuggggggcgg

SEQ ID NO: 132541 - RNA, 40 nt, Homo sapiens
gggcagcaaugagccccggggugcgcucaucuccuccgag

SEQ ID NO: 132542 - RNA, 42 nt, Homo sapiens
caguucugaguacuguuaauaucuggaaaguaucuugagaua

SEQ ID NO: 132543 - RNA, 43 nt, Homo sapiens
uuuacuauuccagggugacauaaugcauuuaaauuugggauuu

SEQ ID NO: 132544 - RNA, 47 nt, Homo sapiens
uaauuuuaaaauaugggaguagaaaacaacaaagaauggaauggacu

SEQ ID NO: 132545 - RNA, 54 nt, Homo sapiens
ugacuugagggucucuguuugguaagaauacaucauuagcuuaaauaagcagca

SEQ ID NO: 132546 - RNA, 44 nt, Homo sapiens
aagaaauugcaucacacuaauuacaaaauacaaguucuggaaaa

SEQ ID NO: 132547 - RNA, 57 nt, Homo sapiens
auuuguacugaaaaacuaaucauaacuguuaauucucagccaucuuugaagcuugaa

SEQ ID NO: 132548 - RNA, 151 nt, Homo sapiens
guacuuacaaauaauuacuggcaguagguuauaauuggugguuuaaaaauaacauuggaauacaggacuuguugccaauuggguaauuuucauuaguuguuuuguuuguuuugauuugaaaccuggaaauacaguaaaauuugacuguuua

SEQ ID NO: 132549 - RNA, 97 nt, Homo sapiens
uccuuuggguaauucgaauuacagauuuaaaagagcuuaagaucugguguuuuguuaaugcuucuguuuauuccagaagcauuaagguaacccauug

SEQ ID NO: 132550 - RNA, 50 nt, Homo sapiens
ugugcucugccuggagcuguuuccauaugauauaaaaagcaaguguagua

SEQ ID NO: 132551 - RNA, 36 nt, Homo sapiens
gaccuaaguugagcgugagaggagugagccuuguga

SEQ ID NO: 132552 - RNA, 45 nt, Homo sapiens
cgagaacuuaaacagcuuuacuuagaacgaguuuugaagggugau

SEQ ID NO: 132553 - RNA, 47 nt, Homo sapiens
ugaauugcuuuuuaacacaauucaggcagcugacauugauaccaggu

SEQ ID NO: 132554 - RNA, 46 nt, Homo sapiens
ugcccaguauaugaaggcuuuucucucccucaucuuaccaggagac

SEQ ID NO: 132555 - RNA, 48 nt, Homo sapiens
uuucagucauuuaagcaaaagauaaugaugguuaggauugaaguagua

SEQ ID NO: 132556 - RNA, 770 nt, Homo sapiens
ugguuuguuagaaggugagugauccaguugacccaugagcaaugcagggguuaggggcaccaacccucccuacucacgugcaaacuuaacuaccacccaaaauacuuaacuucuaauagccuacuguugaccagaagccuuacugauaacauaauauguauuauauacuauauucuuaacaauaaaguaagcuagaggaaauacuguuaagaaaaucauggccgggcgcgguggcucacgccuguaaucucagcacuuugggaggcggaggcgggcagaucacaaggucaggagaucgagaccauccuggcuaacacagugaaacuccgucucuacuaaaaauacaaaaaauuagccgggcgugguggcgggugccuguagucccagcuacucaggaggcugaggcaggagaaugacgugaacccuugaggcagagcuugcagugaguggagaucgugccacugcacuccagccugggcgacagagcgagacuccgucucaaaaaaaaauaaaaaaucauaagagaaaauacauuuacuauaccuuaaguggauguagaucaucauaaagaucuucaucgucauugucuucacaccgacgaagaagaggagggguuggucuugcugucucggguggcagagacagaagaggugcaaggggaggcaggaaagauuuauugacaaaaaucguguauaaguggaccugugugguucaaacuuguuguuauucauggaucagcuguagaugcuaaaggcaaaauaaaucagguu

SEQ ID NO: 132557 - RNA, 46 nt, Homo sapiens
ggaugacaugaaacaccugugggacuacacauuuggaccagagaaa

SEQ ID NO: 132558 - RNA, 46 nt, Homo sapiens
ugaggcaagugaauuacgaucaauguuagaaguuaacuacccuaug

SEQ ID NO: 132559 - RNA, 65 nt, Homo sapiens
gacaugugagguguucuuauaaaaguaguuuaacaguucuuuuaaguaguuuuaaaauauguugc

SEQ ID NO: 132560 - RNA, 342 nt, Homo sapiens
cauauuugaaaaaacucuguuuuuaaaagacuaaguggggccgggugcgguggcuuaugccuguaagccccaggcugguggauuacaugaggucaggaguuagagaccagccuggccaacauggugaaaccccgucucuacuaaaaauacaaaaauuagcugggcgugguggcaggcgccuguagucccagcuacuugggaggcugaggcagaauugcuggaaccuaggaggcagagguugcagugagcugcgaugacgucacugcacuccagccugggugacagagcgagacuccaucucaaaaaaaaaaaaaaagacaagugaaauucuggauggcagaa

SEQ ID NO: 132561 - RNA, 51 nt, Homo sapiens
aguucuuguuauuauaacuguuaauguuuucacuuuugaaguaaugugaaa

SEQ ID NO: 132562 - RNA, 47 nt, Homo sapiens
aaugaaagaacgaagucaccaagucuuaaaaugauugacauggggga

SEQ ID NO: 132563 - RNA, 34 nt, Homo sapiens
aaaaaaaauguacuuuuagagcagauguagauag

SEQ ID NO: 132564 - RNA, 29 nt, Homo sapiens
acaugccuuagguuuuaaaauuguaggcu

SEQ ID NO: 132565 - RNA, 64 nt, Homo sapiens
guuuuggagggauacauaagaaauguucauaaugguuaccuaugagacagaggauaagggagug

SEQ ID NO: 132566 - RNA, 55 nt, Homo sapiens
uuacaagcaauaauuaugguagcuucaucugaacuguguuaaaaauggacuagag

SEQ ID NO: 132567 - RNA, 104 nt, Homo sapiens
uuuguuuuacauacuaguauuuggcccaggaguaggcccacggagaccagcauguuccauugagugguuuugggugaccuaggaucccgcaagacucaaguguu

SEQ ID NO: 132568 - RNA, 71 nt, Homo sapiens
gcggcgguggcuguagguugugcggcugcagcggcucuucccugggcggacgauggacagccagggcagga

SEQ ID NO: 132569 - RNA, 59 nt, Homo sapiens
gaaugcaacgaauguagaacagucuuucaugacgauggcagcugagauuaaaaagcgaa

SEQ ID NO: 132570 - RNA, 53 nt, Homo sapiens
ugggucccggagcaacagcugguggugcugagaaguccaauguuaaaauucag

SEQ ID NO: 132571 - RNA, 46 nt, Homo sapiens
augaauuugcaaucugaacccaagugaaaaaacaaaauugccugaa

SEQ ID NO: 132572 - RNA, 46 nt, Homo sapiens; identical to SEQ ID NO: 33928

SEQ ID NO: 132573 - RNA, 54 nt, Homo sapiens
guuuagugagauguuauauguaagaucugauuugcuaguucuuccuuguagagu

SEQ ID NO: 132574 - RNA, 46 nt, Homo sapiens; identical to SEQ ID NO: 33930

SEQ ID NO: 132575 - RNA, 33 nt, Homo sapiens
uauaucccuaaaaauuaaaacaugaauacuggg

SEQ ID NO: 132576 - RNA, 56 nt, Homo sapiens
gugacugaggucaaacguuguuuccuuagguugaaauagcagccaaaacauucuuc

SEQ ID NO: 132577 - RNA, 83 nt, Homo sapiens
acgcaggggcuugggauauggcugcuggcaacacauuuuguugugggcuccuuaauuuaaugauaaaauuuaagcuaaacaca

SEQ ID NO: 132578 - RNA, 45 nt, Homo sapiens
cuuaaggcuuggcucucugggcccagaaaauggcagggcaguggc

SEQ ID NO: 132579 - RNA, 82 nt, Homo sapiens
uugggagcugaggcccgggccucaguggguaaguauagucaagcagaucuucauacucuuuauuuggguuccagagagggga

SEQ ID NO: 132580 - RNA, 49 nt, Homo sapiens
uggaaggcugagcugcggaaccugggcucagcacggacuuccacuguga

SEQ ID NO: 132581 - RNA, 51 nt, Homo sapiens
aaagccauucccaggaaaggccuuggcaagcagaacagaaaagaauguaag

SEQ ID NO: 132582 - RNA, 54 nt, Homo sapiens
gccuaagucaccuuuuugcccuuuuagcccaaccccacuggguaagaggccugg

SEQ ID NO: 132583 - RNA, 72 nt, Homo sapiens
uguggaaagcugguggguaacagugguaggguaaguguaacacagcaugugugcacaugagagcaagagcca

SEQ ID NO: 132584 - RNA, 54 nt, Homo sapiens
uacuauucagaaccuugguuuucuuuucucuacaaaaaauaucuaggggcucau

SEQ ID NO: 132585 - RNA, 69 nt, Homo sapiens
gguggggaccagaggcucccggcggcggcucccggcggcggcucccgggcugugauuggccagcgccac

SEQ ID NO: 132586 - RNA, 70 nt, Homo sapiens
uaagagcacaagaggaagagagagacccucacugcuggggagucccugccacacucagucccccaccaca

SEQ ID NO: 132587 - RNA, 34 nt, Homo sapiens
aagugacaagccaugagaaguuaaucacaggcuu

SEQ ID NO: 132588 - RNA, 52 nt, Homo sapiens
auaccuggaaccacagaacagcccccacggaacaggcugaauaugguuaaau

SEQ ID NO: 132589 - RNA, 47 nt, Homo sapiens
gcuguacaaacaaaaccuaaauuauauauaaauacacccccacccca

SEQ ID NO: 132590 - RNA, 43 nt, Homo sapiens
agugaaacuugccauuuguuuuuguuuucuuuuuaagucucca

SEQ ID NO: 132591 - RNA, 46 nt, Homo sapiens
gucucaugccaccuuuaaugugcccacaaaauggaacuaucugaaa

SEQ ID NO: 132592 - RNA, 46 nt, Homo sapiens
uucccacgcgccgggcgccggccgggccugcggcugcucagcaccc

SEQ ID NO: 132593 - RNA, 41 nt, Homo sapiens
cgaaggugcacuaaaaacucacuagacaaaacaaggguguu

SEQ ID NO: 132594 - RNA, 40 nt, Homo sapiens
caggguggguuugcacauccccccaagcaaguggcacaaa

SEQ ID NO: 132595 - RNA, 44 nt, Homo sapiens
ugagccguuucacugagcagcuccuggaggccagaacugggcag

SEQ ID NO: 132596 - RNA, 50 nt, Homo sapiens
guagggaguccauaggaguaaggagaaguuaaaagcagggccaggcuggg

SEQ ID NO: 132597 - RNA, 45 nt, Homo sapiens
guucguacgggcgaagcccauuucccacccgaaaaaacuucccaa

SEQ ID NO: 132598 - RNA, 86 nt, Homo sapiens
cuuuggcucuuggccucuuacccaucuucaaagccagcagcauagcauuuccaaaucucucucucugucugcuuccuuugucauau

SEQ ID NO: 132599 - RNA, 35 nt, Homo sapiens
guucccacugcuccccagaauguaaaagguggcac

SEQ ID NO: 132600 - RNA, 116 nt, Homo sapiens
guccccgggcuccagggcgaggugggcacggaauggguugggagguuccaaagccccgcagcgggcggugucccucuccucucccucugggcugagguuggguggcugggacggcg

SEQ ID NO: 132601 - RNA, 31 nt, Homo sapiens
gaaccgggcggggguagcaggguguccggaa

SEQ ID NO: 132602 - RNA, 32 nt, Homo sapiens
gucugcaaaaacccaauucugugagaaagaca

SEQ ID NO: 132603 - RNA, 42 nt, Homo sapiens
cauacucucaaaauauuuacuuauaucaauuccuggacacag

SEQ ID NO: 132604 - RNA, 50 nt, Homo sapiens
gaaaauaagagaagcucagauggugggaggauauguaugauauuggugua

SEQ ID NO: 132605 - RNA, 48 nt, Homo sapiens; identical to SEQ ID NO: 34001

SEQ ID NO: 132606 - RNA, 46 nt, Homo sapiens
aucuucaaagaguucugauccuuuuaguuuauggaguacagaugag

SEQ ID NO: 132607 - RNA, 40 nt, Homo sapiens
acugagucugcugcuucuaaaauaaacuugcucaucagug

SEQ ID NO: 132608 - RNA, 260 nt, Homo sapiens
uuugcuaauuuucauuuuuuaacuuauuuuuuuuuuuuuuuuuuuuuuuuugagagagagggucucacuccguuguuuaggcuguagcuucuaccuccugggcucaggugauccucccaccucacccuccugaguagcugggacuagaggugugcaccacugugccuggcugaauuuuuguacuuuuuuuagagacagaguuuuaccauguugcccaggccauuuuaaacuugaucuuccugggauucuguccugggaaa

SEQ ID NO: 132609 - RNA, 67 nt, Homo sapiens
cuaggaggagaccaauugaaagguuuauauauuaguccuggaaggaaagugaugauuacuuacagua

SEQ ID NO: 132610 - RNA, 41 nt, Homo sapiens
cagugccaagugauuuugaauuuuuuggcagcagaagggcg

SEQ ID NO: 132611 - RNA, 46 nt, Homo sapiens
aaaguggagguagugacauugaaauggaugagcaacuuauuaauag

SEQ ID NO: 132612 - RNA, 41 nt, Homo sapiens
gacauugcagauauugaagcccucaaagaggaagaugaaga

SEQ ID NO: 132613 - RNA, 43 nt, Homo sapiens
augcucuggaaauuauugaagcacugggaaaaccuaauagaag

SEQ ID NO: 132614 - RNA, 43 nt, Homo sapiens
ugguauguuuguguaggaauauauuuggcaguggaaucaggag

SEQ ID NO: 132615 - RNA, 46 nt, Homo sapiens
gcuugcuugcugaaguuaauaugccaguuugcaguagauccauccg

SEQ ID NO: 132616 - RNA, 41 nt, Homo sapiens
caaaguaaugaauuguuacugauagauugugacggacauaa

SEQ ID NO: 132617 - RNA, 52 nt, Homo sapiens
cuccagacuccugaaaggaaaacaggucuuuagcauaaacccguuaggcaca

SEQ ID NO: 132618 - RNA, 47 nt, Homo sapiens
uacuauuugggaugugugagggugauaacuugguaaaauagcaaagg

SEQ ID NO: 132619 - RNA, 50 nt, Homo sapiens
augacagaguuuuuuacugaucuaauuaccaaaaucgaagaaaugucucc

SEQ ID NO: 132620 - RNA, 46 nt, Homo sapiens
ugcugaagaguuuuauacugugaggugccaaguggcugauaugaag

SEQ ID NO: 132621 - RNA, 53 nt, Homo sapiens
ugaguuucaauacuaugagauacacauuuaauauggucacgaugaugaaagag

SEQ ID NO: 132622 - RNA, 63 nt, Homo sapiens
aaagugaauacacacuuuuccuucccauuacguuuggacaugacgcccuauacagaagauuuu

SEQ ID NO: 132623 - RNA, 93 nt, Homo sapiens
uuucagguuuuaaagaagucagugaucauucaaaagacucagagagcuaugaauaugacuugauaggagugacuguucacacaggaacggcag

SEQ ID NO: 132624 - RNA, 54 nt, Homo sapiens
acacagugcauauaugcuguuuuacaaacgcauggaaccagaggaagaaaaugg

SEQ ID NO: 132625 - RNA, 45 nt, Homo sapiens
ucuagauuuauguggcaauuguguaguuguauucccaguacauua

SEQ ID NO: 132626 - RNA, 45 nt, Homo sapiens
gugguuuuuagaucguauggcugaugacgacugguggccaaugca

SEQ ID NO: 132627 - RNA, 41 nt, Homo sapiens
agaggcugagaccugugcaugcucaucucuauuugcagcca

SEQ ID NO: 132628 - RNA, 41 nt, Homo sapiens
aacuguuuaaccugaugcagcuguuuauagcucagaggcca

SEQ ID NO: 132629 - RNA, 45 nt, Homo sapiens
gugcuacuaguaaagagagagaagguuuuaaaaucaugugcccca

SEQ ID NO: 132630 - RNA, 45 nt, Homo sapiens
guuugaucucagauggcauauuuauaugugcuuuuauauuugcag

SEQ ID NO: 132631 - RNA, 334 nt, Homo sapiens
acauuaaauaaucugggcuggcucaugccuguaauccaugcaguucgggaggucuaggcaggaggggauugcucgagaccaggaauucaaaagcagccugggcaacauagcaagaccucaucucuacaaaaacaaacaaaaaaaauagcugggugugguggugcaugccgguaguuucagcuacuugggagccugaggcaggaggaucacuugcacccaggagcucaaggcuguagugagcugauugcaccacugcacuccagccugggagaccaaaaaaaaaucccucacuguauguugccagaaaauaucucauacuuaaaacaaaauacca

SEQ ID NO: 132632 - RNA, 42 nt, Homo sapiens
uugagaaguucuuauaagauaaaauauuuaaaauaauuaaca

SEQ ID NO: 132633 - RNA, 66 nt, Homo sapiens
ggauccucuccaauguucuauaguuuucagagugggacgugaaauacuugcggaacuacuacccag

SEQ ID NO: 132634 - RNA, 43 nt, Homo sapiens
aauaaauuuaaauagccaaaugugacugguggcacagcauuaa

SEQ ID NO: 132635 - RNA, 24 nt, Homo sapiens
auuugaaauguuccuaucuggguu

SEQ ID NO: 132636 - RNA, 45 nt, Homo sapiens
cuugucugcaacagagaaacucacuccaagagcaagaagccaaag

SEQ ID NO: 132637 - RNA, 49 nt, Homo sapiens
ggaggagggaguaauacacuugguguaacugguuuaagaguuguguguu

SEQ ID NO: 132638 - RNA, 44 nt, Homo sapiens
uaaugacuuucagagaaguuucccuuuuggcauguguuuucaca

SEQ ID NO: 132639 - RNA, 63 nt, Homo sapiens
aaccagggagguccugaccccaacgagcacuucugacaaugagaccagagacuccucaauuau

SEQ ID NO: 132640 - RNA, 44 nt, Homo sapiens
cugcuugaauggcaagauagauuuauaggcuuaauucuugguca

SEQ ID NO: 132641 - RNA, 42 nt, Homo sapiens
aaaaaacuugcaucuucaguauacuuccuaaagggcaaucag

SEQ ID NO: 132642 - RNA, 40 nt, Homo sapiens
augguguccucugugccaguuuuguaccuuauagaggcag

SEQ ID NO: 132643 - RNA, 26 nt, Homo sapiens
guugaaagacugaggguacaaaauca

SEQ ID NO: 132644 - RNA, 28 nt, Homo sapiens
gguaugugugcgugugugugugguaaaa

SEQ ID NO: 132645 - RNA, 48 nt, Homo sapiens
auuucacccuuccuuuucuaauaauagcuacuauuuauucagcaccaa

SEQ ID NO: 132646 - RNA, 35 nt, Homo sapiens
cuuaaauaagaggauguccguaauacaggcaugua

SEQ ID NO: 132647 - RNA, 47 nt, Homo sapiens
gagcuaaagacagagauggcugggcuaaggaauaacugggaagggag

SEQ ID NO: 132648 - RNA, 66 nt, Homo sapiens
uuauacaaagaaaggaaucacuaaguggugauguaaggauaaaguaaacacagccuggcagagaaa

SEQ ID NO: 132649 - RNA, 38 nt, Homo sapiens
guuguccucucucccuuaacauacagaauaauguauua

SEQ ID NO: 132650 - RNA, 95 nt, Homo sapiens
gccguagccccugcuaggacagcccgugcgagccugcuggaggaggaagagaaaggcagagagagucggguuacaagauggcggaucuguaguag

SEQ ID NO: 132651 - RNA, 25 nt, Homo sapiens
gcccuggggggcaaagagacgggag

SEQ ID NO: 132652 - RNA, 25 nt, Homo sapiens
cacuacugccuuuaccgucuccuaa

SEQ ID NO: 132653 - RNA, 81 nt, Homo sapiens
ggcggcuagagcgguggagacagcagccaccaugucggauacgcggcggcgagugaaggucuauacccugaacgaagaccg

SEQ ID NO: 132654 - RNA, 33 nt, Homo sapiens
gcagggagauguuuuugauaguuaagguuuaug

SEQ ID NO: 132655 - RNA, 43 nt, Homo sapiens
cugcagccacagugcagcuccacauuaacucuacagaccaaac

SEQ ID NO: 132656 - RNA, 47 nt, Homo sapiens
ucuccaaguuacaaaaguuugaggugcagagggaaggccagauuuuu

SEQ ID NO: 132657 - RNA, 48 nt, Homo sapiens
ccuccugcccuucucuuaccuuuucagugaaauuccagcaugcaagcu

SEQ ID NO: 132658 - RNA, 54 nt, Homo sapiens
ugccagcacccagagcacgccagcauccagccgcgcgcagacccuccccaccag

SEQ ID NO: 132659 - RNA, 42 nt, Homo sapiens
agacuaaaugauggcaaugaguaccucuuccaagccaaagac

SEQ ID NO: 132660 - RNA, 41 nt, Homo sapiens
cauuuucuguuugccuauucugaaacucuggaacaugugaa

SEQ ID NO: 132661 - RNA, 98 nt, Homo sapiens
acugcugcuucuggaauucccuaccacagcgaggucccugugaguuugaaagaagcugucugcgaaguggcccuugauuacaaaaagaagaaacacgu

SEQ ID NO: 132662 - RNA, 48 nt, Homo sapiens
aacacgagugggaggcccacaauaagaaagccucaagcagguaacagc

SEQ ID NO: 132663 - RNA, 46 nt, Homo sapiens
cacaguugaugguacacaggcugaaaaugauaaugaaucaagaccc

SEQ ID NO: 132664 - RNA, 49 nt, Homo sapiens
uguuuucauauauauauguguguguguuuaaauuuuguaucaucaggac

SEQ ID NO: 132665 - RNA, 48 nt, Homo sapiens
agauggguauauagauagaugccaagcuucuuauguucuggggguagu

SEQ ID NO: 132666 - RNA, 46 nt, Homo sapiens
uaccgcucucaaaccuaccaaaacuacaaaaacuuuaauagcagac

SEQ ID NO: 132667 - RNA, 48 nt, Homo sapiens
guuggaguuacuggaagugcgcagacagcaagaggaagaggagaggaa

SEQ ID NO: 132668 - RNA, 49 nt, Homo sapiens
cccucaggcucagguacuuuucuccucagcagaguugagaguugcauag

SEQ ID NO: 132669 - RNA, 45 nt, Homo sapiens
cugggaugagagguucucugcccuggaaaggcugacuacaguaag

SEQ ID NO: 132670 - RNA, 41 nt, Homo sapiens
ggacaggagccguaccuauccagccgagagauaggccagag

SEQ ID NO: 132671 - RNA, 49 nt, Homo sapiens
ggaaaaauuacugcaguugacggaaaagaggaaagaaaugaucgacaag

SEQ ID NO: 132672 - RNA, 61 nt, Homo sapiens
acaaccugcauugaacuugggaaaucccuguuggcgagaaaacacuaugcaucugaggagg

SEQ ID NO: 132673 - RNA, 50 nt, Homo sapiens
auggugcgcgaccucaugcucuggauggaggaugucauccggcagaucga

SEQ ID NO: 132674 - RNA, 44 nt, Homo sapiens
gccuaugcgggugacaaggccgacgauauccagaagcgcgagaa

SEQ ID NO: 132675 - RNA, 48 nt, Homo sapiens
ugugaacauuagaugagugcccccaugauuaaaauaaauaaaccagau

SEQ ID NO: 132676 - RNA, 73 nt, Homo sapiens
aucuuugggcguauacaggacaaacacaagaaacucccugaggagcuugggagagaucagaacacaguggaga

SEQ ID NO: 132677 - RNA, 48 nt, Homo sapiens
cucaucaacucuggacauucagaugccgccaccaucgcugaauggaag

SEQ ID NO: 132678 - RNA, 45 nt, Homo sapiens
gcucucugauuuccuuacccauccccguuucagauguuacaagaa

SEQ ID NO: 132679 - RNA, 46 nt, Homo sapiens
agcucaaccgggagguggacgaccuggagcaguggaucgcugagag

SEQ ID NO: 132680 - RNA, 45 nt, Homo sapiens
aaguggauaaacuguacgcuggucugaaagaccuugcugaagaga

SEQ ID NO: 132681 - RNA, 50 nt, Homo sapiens
gaugagcagagugcugucuccauguugaagaagcaccagaucuuagaaca

SEQ ID NO: 132682 - RNA, 45 nt, Homo sapiens
ucucacguuaucuagggauacuguaggauuuuaauggcccuaaaa

SEQ ID NO: 132683 - RNA, 46 nt, Homo sapiens
aggagaucgaagagcuccaaagccaagcccaggcccugagucagga

SEQ ID NO: 132684 - RNA, 46 nt, Homo sapiens
gcacggccuggagagucagauucagucugaugacuauggcaaagac

SEQ ID NO: 132685 - RNA, 46 nt, Homo sapiens
uggcagaacuugcauccaacaaagaauggcuugacaaaaucgagaa

SEQ ID NO: 132686 - RNA, 56 nt, Homo sapiens
ugugcggcucucuagaguucagauccaagcagacauguugggucucaaaaucaagu

SEQ ID NO: 132687 - RNA, 50 nt, Homo sapiens
uccuuuuuuaaaaauuauuuuuguuaccauucuaauagacauaggaagaa

SEQ ID NO: 132688 - RNA, 46 nt, Homo sapiens
aagcaagaggacuucaugaccaccauggacgccaaugaggagaaga

SEQ ID NO: 132689 - RNA, 46 nt, Homo sapiens
agaacagacaaaaucuccuaucccagucacaugccuaccagcaguu

SEQ ID NO: 132690 - RNA, 47 nt, Homo sapiens
cugagaagcugcucacgcagcacgagaacaucaagaacgagaucgac

SEQ ID NO: 132691 - RNA, 45 nt, Homo sapiens
uuccaguccuggcucucuaggacccagacagcgaucgccucggag

SEQ ID NO: 132692 - RNA, 41 nt, Homo sapiens
ccccgaccaggcccaggccauccugucucggcuggccgaga

SEQ ID NO: 132693 - RNA, 46 nt, Homo sapiens
agcgggacuugguggccauugaggcaaagcugagugaccugcagaa

SEQ ID NO: 132694 - RNA, 85 nt, Homo sapiens
ggaagagaucgccaauuacaggcccacccuugacacgcugcacgaacaagccagcgcccucccccaggagcaugccgagucucca

SEQ ID NO: 132695 - RNA, 46 nt, Homo sapiens
cagaugcugaugacauugaugccuggaugcuggacauccucaagau

SEQ ID NO: 132696 - RNA, 117 nt, Homo sapiens
agaccugaccagcgucaugcgccugcucagcaagcaccgggcguucgaggacgagaugagcggccgcaguggccacuuugagcaggccaucaaggaaggcgaagacaugaucgcgga

SEQ ID NO: 132697 - RNA, 46 nt, Homo sapiens
ggaagagucccgccgccucuggaaguucuucugggagauggcagaa

SEQ ID NO: 132698 - RNA, 50 nt, Homo sapiens
ugugacccccaggugauccgagaccgcguggcccacauggaguucuguua

SEQ ID NO: 132699 - RNA, 69 nt, Homo sapiens
gcagacauuggcauccaggcagagcgggugagaggugucaaugccuccgcccagaaguucgcaacagac

SEQ ID NO: 132700 - RNA, 67 nt, Homo sapiens
gucucaagacuauggcaaacacuuacuugguguggaagaccuguuacagaagcacacccugguugaa

SEQ ID NO: 132701 - RNA, 67 nt, Homo sapiens
aggugugggguccauggcagacuagagggaaggcauagcuucauugcuggcucucugcuugucgaaa

SEQ ID NO: 132702 - RNA, 47 nt, Homo sapiens
aagagugaaguagaaaucucaucuggcgaggauguagaaugaggccc

SEQ ID NO: 132703 - RNA, 56 nt, Homo sapiens
cucagcacgcuguguucccaagcuugaccuuaugcaagagauucccuucccaggau

SEQ ID NO: 132704 - RNA, 45 nt, Homo sapiens
gugaagugugaaaaaguuguagagaccaguucaguagccagagcu

SEQ ID NO: 132705 - RNA, 48 nt, Homo sapiens
gggcugcagaagauauuccaggaaaugcucuacauuauggacuggaug

SEQ ID NO: 132706 - RNA, 47 nt, Homo sapiens
gugcaggcugugguagccguggccagggagcucgaggccgagaauua

SEQ ID NO: 132707 - RNA, 88 nt, Homo sapiens
cgaaagagaacuggcuuugcggaaugagcucauaagacaggagaaacuggaacagcucgcccgcagauuugaucgcaaggcagcuaug

SEQ ID NO: 132708 - RNA, 89 nt, Homo sapiens
ggaccaagcaagcaaugguaccggguuaggcugcuggaggcuucagggggcaauguuagauuuuaucaaaccagcuuuggcguaggcua

SEQ ID NO: 132709 - RNA, 48 nt, Homo sapiens
gagaaggggaacuuggaagugcugcucuucaccauucagagcaagaug

SEQ ID NO: 132710 - RNA, 46 nt, Homo sapiens
uggaauggauugaacaaaccaucaucauucugaacaaucgcaaauu

SEQ ID NO: 132711 - RNA, 54 nt, Homo sapiens
uauuaccacuacuucucuaagaugaaggccuuagcuguugaaggaaaacgaauu

SEQ ID NO: 132712 - RNA, 48 nt, Homo sapiens
ucuaacgcacacuacaaccugcagaaugcauuuaaucuggcagaacag

SEQ ID NO: 132713 - RNA, 58 nt, Homo sapiens
ucaacauucacaauuucaccacuagcuggagggacggcauggccuucaaugcacugau

SEQ ID NO: 132714 - RNA, 47 nt, Homo sapiens
ggcagcugacccaucuauuugucuaauauuucuuuguaaaucuuaga

SEQ ID NO: 132715 - RNA, 58 nt, Homo sapiens
uugaugaugcuuuauggguuuuguuauacuugaggaggaaggcucuaaguauagaagu

SEQ ID NO: 132716 - RNA, 36 nt, Homo sapiens
auucaguggccacugauguuuucuucccugcacgcu

SEQ ID NO: 132717 - RNA, 56 nt, Homo sapiens
aauaaagccacuuuguucugguaauuugcaagguugccaccuuuggucagaaagaa

SEQ ID NO: 132718 - RNA, 39 nt, Homo sapiens
uugugcuuguuuauuuagaaauauuuuaauccaagcagg

SEQ ID NO: 132719 - RNA, 49 nt, Homo sapiens
gggaguccccaaggacccgaagccugauccucuacugagccaccaaaua

SEQ ID NO: 132720 - RNA, 28 nt, Homo sapiens
gcauauggugaauauaguuguguuuagc

SEQ ID NO: 132721 - RNA, 51 nt, Homo sapiens
gagaaaacugccuucuagguuagaagaaugauagaagcaaagaugggaaaa

SEQ ID NO: 132722 - RNA, 31 nt, Homo sapiens
uuaagcauuuuuggcuucucaugcuuugagc

SEQ ID NO: 132723 - RNA, 30 nt, Homo sapiens
uggaccuuaaaguacagagugaggaugggg

SEQ ID NO: 132724 - RNA, 47 nt, Homo sapiens
cggcagucaaauuugcuuuuuugaaaacuuaagcugggggcgcuugc

SEQ ID NO: 132725 - RNA, 46 nt, Homo sapiens
gcguacacggggcaggugccuuacaacuacaaccagcuggaaggca

SEQ ID NO: 132726 - RNA, 68 nt, Homo sapiens
gaagaaaucaguucucaccaugucaugggucccuccaauagccuaugcccauggauggggcugagaac

SEQ ID NO: 132727 - RNA, 45 nt, Homo sapiens
ggcacugaucaguuuggguguagcagaggggacaguuaggaggaa

SEQ ID NO: 132728 - RNA, 42 nt, Homo sapiens
ggacacagauguccacaccagcaaaccgcuccuugccgagaa

SEQ ID NO: 132729 - RNA, 59 nt, Homo sapiens
gugggguguguuggcuguguucuuggauagcaugugagaaaacagccaugacaaaagag

SEQ ID NO: 132730 - RNA, 35 nt, Homo sapiens
gugggggcagggcaggggccaggcugggcuucugc

SEQ ID NO: 132731 - RNA, 28 nt, Homo sapiens
aacauagaacaggagaggcccugggcug

SEQ ID NO: 132732 - RNA, 43 nt, Homo sapiens
cgcugagauacagaaugguugggagguugaguggguggggagu

SEQ ID NO: 132733 - RNA, 69 nt, Homo sapiens
cgugccugcuuguauuuuuaaauauuucuaaugaauccaaguuaguugcuuuugauuucauguggcucu

SEQ ID NO: 132734 - RNA, 51 nt, Homo sapiens
caaaccucuguccauuauuuuuccaaucgaaagccaggccagauaguaagu

SEQ ID NO: 132735 - RNA, 46 nt, Homo sapiens
aucgccaucgccaccgccuccgcgcaucccgggagccgcggcaaga

SEQ ID NO: 132736 - RNA, 41 nt, Homo sapiens
cagagcggcaggcggagcugggguccggacugcgagaugga

SEQ ID NO: 132737 - RNA, 53 nt, Homo sapiens
cccuucacauaauucccauaaaucauuaacaaacccuguuucguucccuauga

SEQ ID NO: 132738 - RNA, 45 nt, Homo sapiens
cuuuagcaagcacaggccagcuggaugaaaggucggggguaugga

SEQ ID NO: 132739 - RNA, 25 nt, Homo sapiens
cagggugaggaguacggugcaggga

SEQ ID NO: 132740 - RNA, 46 nt, Homo sapiens
uucucugggccaccaguuucacccuugccaccuuggcuaccuugaa

SEQ ID NO: 132741 - RNA, 46 nt, Homo sapiens
acugcagcacguucagacccguggauauaccaagagucccaaccaa

SEQ ID NO: 132742 - RNA, 41 nt, Homo sapiens
gcgucagauagcuuuaaaguugugaccuucuuguacaugaa

SEQ ID NO: 132743 - RNA, 47 nt, Homo sapiens
ugaucucaagauuucaaccuugaccaugggcagugaccagauugaaa

SEQ ID NO: 132744 - RNA, 44 nt, Homo sapiens
ucaggugguggauccaaaacuuaaccacaucuucaggccacaaa

SEQ ID NO: 132745 - RNA, 47 nt, Homo sapiens
ggaauggaauccuacgaugaacaaaaaccaguugcgaaauggucuga

SEQ ID NO: 132746 - RNA, 42 nt, Homo sapiens
guucucccuugugggcccggggcgcagccauggcggacggcg

SEQ ID NO: 132747 - RNA, 41 nt, Homo sapiens
uaaagguggugcuccaagcaucacgugcucuggcccgagcu

SEQ ID NO: 132748 - RNA, 40 nt, Homo sapiens
ugggcccgaggcgcaagaggaagaugaggacgaagaagag

SEQ ID NO: 132749 - RNA, 26 nt, Homo sapiens
gcaagguuuguuuggccaagccgccc

SEQ ID NO: 132750 - RNA, 48 nt, Homo sapiens
guguggaggacguaccaucugaccucugcaggagagaaacucacggaa

SEQ ID NO: 132751 - RNA, 46 nt, Homo sapiens
gacgagguuuccuucaucaaaaagcugaggcaaaagugagccucca

SEQ ID NO: 132752 - RNA, 54 nt, Homo sapiens
cauaaaccugggggcccucaggacuaggacagggugagccagugcucccuccuu

SEQ ID NO: 132753 - RNA, 45 nt, Homo sapiens
caucagcuuuggcaaguucgaccuguaccggaaacgcugccagau

SEQ ID NO: 132754 - RNA, 46 nt, Homo sapiens
ugaccaguucuaccgccuguggcuaucccucuuccugcacgccggg

SEQ ID NO: 132755 - RNA, 38 nt, Homo sapiens
ucugagcaaguagaucaagagaacuagauggagacuug

SEQ ID NO: 132756 - RNA, 46 nt, Homo sapiens
caugcgccaggacccgcaggugcacagcuucauucgcucggcgcgc

SEQ ID NO: 132757 - RNA, 44 nt, Homo sapiens
gcaccuaccgcaagcgcaucgacagcuucgucaagcgccagauc

SEQ ID NO: 132758 - RNA, 35 nt, Homo sapiens
aggauagagacagggugcccuggugccccccgggg

SEQ ID NO: 132759 - RNA, 59 nt, Homo sapiens
ccugcaaaggucucaggccugcccugcuccacccugaaccucauuucuuccacagaaaa

SEQ ID NO: 132760 - RNA, 42 nt, Homo sapiens
guuaaaucuacaagcaucagaaaagaucacaaaggaagagau

SEQ ID NO: 132761 - RNA, 52 nt, Homo sapiens
acacggaaaaaugauuggcggaaaauaaacaucaguuucuuaaaaaaaaaaa

SEQ ID NO: 132762 - RNA, 46 nt, Homo sapiens
aauggacugcuccagcuccugaguucacugcuacuaagccugaggu

SEQ ID NO: 132763 - RNA, 44 nt, Homo sapiens
caugccugaucucuacuucuacagagauccugaagagauugaaa

SEQ ID NO: 132764 - RNA, 67 nt, Homo sapiens
gguuacugaccccagggcugaccaccagccucucacggaggcaucuuauguuaaccuaccuaccauu

SEQ ID NO: 132765 - RNA, 39 nt, Homo sapiens
uugcuggucacuucacuccuggaaccuucacuaaccaga

SEQ ID NO: 132766 - RNA, 73 nt, Homo sapiens
uguagcaggaacccacuuagguggcaccaaucuugacuuccagauggaacaguacaucuauaaaaggaaaagu

SEQ ID NO: 132767 - RNA, 44 nt, Homo sapiens
gaaccuuggaacuauccuccucccagggcugcagauucugcaga

SEQ ID NO: 132768 - RNA, 81 nt, Homo sapiens
uucagagguagaagcucuuccacagggagcuagcugggggucuuugccaacaguuucuacaggcagccuuauaagcuucca

SEQ ID NO: 132769 - RNA, 37 nt, Homo sapiens
guucaacaucccaagcuuaaguccucuccccagagag

SEQ ID NO: 132770 - RNA, 46 nt, Homo sapiens
acuuuuggugggaggaaagucauuauuuuuaucaaaauguucagug

SEQ ID NO: 132771 - RNA, 33 nt, Homo sapiens
aauccuacucuacuguaagcaaucauguuuuuu

SEQ ID NO: 132772 - RNA, 49 nt, Homo sapiens
aauguuauuuuuauauauagauaauuuuaaaauuuaauguaacuuagau

SEQ ID NO: 132773 - RNA, 52 nt, Homo sapiens
uugcccuucuuccuaccugacugucaaacuucucuuauucucaacaacagau

SEQ ID NO: 132774 - RNA, 45 nt, Homo sapiens
agcaguucacuaccacaucacugccagaaagauuuauucagcuuu

SEQ ID NO: 132775 - RNA, 42 nt, Homo sapiens
uugggaaaaaucagauggcccagaccuccuaaaggcucagac

SEQ ID NO: 132776 - RNA, 28 nt, Homo sapiens
uuuuacaaggagcuaaaagaaaaaaaga

SEQ ID NO: 132777 - RNA, 46 nt, Homo sapiens
cacacaaaauaacauggaugaaaugcacguauggaaacaaacaagg

SEQ ID NO: 132778 - RNA, 54 nt, Homo sapiens
acagaacuaauagccugaagggauggacuugaaaaagagggagugggccaguug

SEQ ID NO: 132779 - RNA, 17 nt, Homo sapiens
caguuauuugaucauuu

SEQ ID NO: 132780 - RNA, 40 nt, Homo sapiens
auauuuuguguaacuaggcaaagggcuguagacuuauaau

SEQ ID NO: 132781 - RNA, 357 nt, Homo sapiens
caaauaaguugccugcaaucaucagaaaauguuggccgggcgcagugacucacgccuguaaucucagcaccuuugggaggccaaggcagguggaucaugaggucaggaguucgagaccagccuggccaauauggcgaaacccugucucuacuaaaaauacaaaaauuagcugggcaugguggugugugccuguauucccagcuaugugggaggcugaggcaggagaauugcuugaaccugggaagcagagguugcagugagcgagaucacaccacugcacuccagcuuggcgacagagcuccaucucaaaaaauaaagaaaaagaaaaagaaaaugucacucuauaucaguaaauga

SEQ ID NO: 132782 - RNA, 95 nt, Homo sapiens
cuaauuccacuaaauuuggaaaguaucuucauccuguuuucaguuguuuucuuuugccaaauuacauccauaauaguuuguaauuugcaaaugua

SEQ ID NO: 132783 - RNA, 515 nt, Homo sapiens
aaauaauaguaacggcaugcauaagaaaugaauauugcaaggugcaguaccuguaguaccagcugcuccagaggcagaggcaggaggauugcuugagcccagaaguucaagaccagccugggcaacauagcaagaccccaucucuaaaaaagaagauuuaggccaggcacgguggucaugccuguaaucccagcacuuugggaggccaaggcaggcagaucaccaggucaggaguucaagaccagccugaccaauauggucaaaccccaucucuacuaaaaauacaaaaauuagccaggcgugguggugcucaccuguagucccagcuagucgggaugcugaggcagaagaaucgugugaaccuggggaggcagagguugcagugagcugagaucacaccacugcacuacagccuggaugacagagcaagacuccaucucaaaaaaaaagaaaaaagaaaauuuaaaaauuuuuaaaaaaacauacaugccaaaaauauuucaaaaagaacaaua

SEQ ID NO: 132784 - RNA, 44 nt, Homo sapiens
uguaugccaggcagcuugcuaggaauuucucauucaucauauca

SEQ ID NO: 132785 - RNA, 42 nt, Homo sapiens
auuacauuuuaugcagcaaaacccagauguccugcagcaggu

SEQ ID NO: 132786 - RNA, 47 nt, Homo sapiens
ucaaugcuggguuuuacuacuaaacacaacuuaagacuucuaagaaa

SEQ ID NO: 132787 - RNA, 53 nt, Homo sapiens
gauuuuacacauuagcuucaccccccaccccccccaaaaaaaaaaaccaaaag

SEQ ID NO: 132788 - RNA, 44 nt, Homo sapiens
auauuggucagcagggcugguaguucuagacacaaacaggacaa

SEQ ID NO: 132789 - RNA, 27 nt, Homo sapiens
aggaaugucagcaaguugcaguucucu

SEQ ID NO: 132790 - RNA, 54 nt, Homo sapiens
cugaugagaaugagccaauagcaaacaaacaaacaaacaagauugcauauagag

SEQ ID NO: 132791 - RNA, 59 nt, Homo sapiens
aguguaaauauagaggaagacuuagguuugagcucuggugcacuccaauguuggaaggu

SEQ ID NO: 132792 - RNA, 29 nt, Homo sapiens
aagcuagaaaccaguaaaaaaaaaaaaaa

SEQ ID NO: 132793 - RNA, 44 nt, Homo sapiens
gccaacaucccagauauuccuuggagcuacagugagaccaaaaa

SEQ ID NO: 132794 - RNA, 45 nt, Homo sapiens
agggaugccaggccccucgcuuucguuuaauaguauggcacagua

SEQ ID NO: 132795 - RNA, 58 nt, Homo sapiens
gaauaguuugaagaaggcuucuuagaagauguauuuuguucuggaggcuuccaggagu

SEQ ID NO: 132796 - RNA, 57 nt, Homo sapiens
aaggaccuguguugccaaauugaaauacaguuguuagaggaggaaaugcagcaaaag

SEQ ID NO: 132797 - RNA, 46 nt, Homo sapiens
uugaaacaguauuacaaauauucaacaacaacuuuaaacaagaaga

SEQ ID NO: 132798 - RNA, 23 nt, Homo sapiens
cccuuuagggccuuggcacccaa

SEQ ID NO: 132799 - RNA, 112 nt, Homo sapiens
ccugggccuugaaaaauaacaucuguauaggucuauguuaucaccaguuaacagagaagaguguaucuaagaggagucacuuggucacacagccaguugacagagaagagau

SEQ ID NO: 132800 - RNA, 386 nt, Homo sapiens
gguauuauuguugcuauuauuagauguaugcuuaaauaucugcaauucaaggcagaccgguacaauaguuaagagccaggcggccgggcgcuguggcucacaucuguaaucccagcaauuugggaggccgaggcgggcggaucacgaggucaggagaucaagaccauccuggcuaacacggugaaaccccaucucuacuaaaaauacaaaaaaauuagccgggcguuguggcaggcgccuguaguccuagcaacucaggaggcugaggcaggagaauggcgugaaccugagaggcagagcuugcagugagccaagaucgugccacugcacuccagccuggaugacagagcaagacuccgucucaaaacaagccaggcaaaaugcua

SEQ ID NO: 132801 - RNA, 45 nt, Homo sapiens
aaugaauaaauaugucaaugaauggccaguauaguaagucccaua

SEQ ID NO: 132802 - RNA, 49 nt, Homo sapiens
aauauucauaaaauugugcagccaucaccauuaucuaauucuauaacau

SEQ ID NO: 132803 - RNA, 49 nt, Homo sapiens
ugacuauauugguuuucuguuauuauugcuguaacaaauuaccacaagg

SEQ ID NO: 132804 - RNA, 46 nt, Homo sapiens
cuccuuguuuaucucuccucuuaauuuuccuuaguuuggaccagag

SEQ ID NO: 132805 - RNA, 48 nt, Homo sapiens
uaaaaugauguuuauggauguaaagagauaguucuaucuuuaggggug

SEQ ID NO: 132806 - RNA, 41 nt, Homo sapiens
gggaaaaggagagauuguucaaaugauugaaucaaggaagc

SEQ ID NO: 132807 - RNA, 89 nt, Homo sapiens
auaaaaacugcauuccugugaguaaauauaucucuaauauucuucaguugaaaagaacaucauuuucauuaguugaaaggcacaaugga

SEQ ID NO: 132808 - RNA, 46 nt, Homo sapiens
cuuugcucucccacccacucccuacuucaguguggauaccacagug

SEQ ID NO: 132809 - RNA, 57 nt, Homo sapiens
ugucaacaugaaaaguaagacguaccuguauauuuggggaagcuuaauuagguaaua

SEQ ID NO: 132810 - RNA, 47 nt, Homo sapiens
uggcagggauaaccuggaaucacaccagagcaucagggaguauggag

SEQ ID NO: 132811 - RNA, 43 nt, Homo sapiens
uugcaaauucuacaggcaauauuugucauuugaugaguugaga

SEQ ID NO: 132812 - RNA, 47 nt, Homo sapiens
caucuguuuuucuuaccuaguucccuuuuuaaaaccauauguaacau

SEQ ID NO: 132813 - RNA, 42 nt, Homo sapiens
ucauuaagauuuuaaaagcaauucuuauggauaugugaagau

SEQ ID NO: 132814 - RNA, 46 nt, Homo sapiens
uccuguaaauuggaguauaguuauuucagaauucauuuguacauag

SEQ ID NO: 132815 - RNA, 69 nt, Homo sapiens
acccagguaauaguagcaaguuaaaccagaaaauauauacauauauccuucauaauccuuuagggcuaa

SEQ ID NO: 132816 - RNA, 42 nt, Homo sapiens
auccuguaaacauuuauuaagauauauaauuugugaggaauu

SEQ ID NO: 132817 - RNA, 50 nt, Homo sapiens
uaagaaagcaagcaguguaagugccucuaagaaggaaaagaugcugauac

SEQ ID NO: 132818 - RNA, 73 nt, Homo sapiens
auauugaagaucuuagucccuacgacucuguucuagagcaucccuaguuccuguucuuccucagacuggcagu

SEQ ID NO: 132819 - RNA, 48 nt, Homo sapiens
gguauaagacuaugccuccaguuaccugggugaccuuacccuguuaaa

SEQ ID NO: 132820 - RNA, 41 nt, Homo sapiens
caguacacaaaauuucuaaaacauggccuuaaaggcuaagc

SEQ ID NO: 132821 - RNA, 47 nt, Homo sapiens
caguaugcaauguaaaucauucuucuuuuaaaaauuaauauacagua

SEQ ID NO: 132822 - RNA, 46 nt, Homo sapiens; identical to SEQ ID NO: 34328

SEQ ID NO: 132823 - RNA, 40 nt, Homo sapiens
uuugauuaaaaauaaauaagauuguacuuagugggcacaa

SEQ ID NO: 132824 - RNA, 62 nt, Homo sapiens
aagaagcuugaacuaagcaguaacagagccucagugggccuagaaguauuggcagaaaagug

SEQ ID NO: 132825 - RNA, 57 nt, Homo sapiens
ccuggacaacagucagucaaaugaaggcaaauuggaaggccucacagaugaauuuga

SEQ ID NO: 132826 - RNA, 43 nt, Homo sapiens
guuuauugguugaauuccgcuggcucaggagccucugcagaga

SEQ ID NO: 132827 - RNA, 227 nt, Homo sapiens
gagagaagaugaauaaauuaaagguuuuuuucuuucuuuguuuuuuugagacaaggucucacucuguuucccaggcuggagugcaguguugccaucauggcucacggcuccuggcagcuucaaccuccaggcucaagugacccuccugccucagccuccugagaacugggaccauaggcaugagccaccacagguuugguuuuuuuuucuuaauagguuggacauau

SEQ ID NO: 132828 - RNA, 73 nt, Homo sapiens
ucuuaaauuccagaacucuuaaaaggaguauauguguggggugagagggagaaaaauacugaaacagauaggu

SEQ ID NO: 132829 - RNA, 50 nt, Homo sapiens
uauauucuuauaaaucacugcuagcauagcuguaauaugugaagauaauu

SEQ ID NO: 132830 - RNA, 49 nt, Homo sapiens
acagagaccaguagaccuaguuuuuccugguuauuuuguagaacgggaa

SEQ ID NO: 132831 - RNA, 44 nt, Homo sapiens
uuguagaaaugugaguguuucuuagauuaccaaacaucugugaa

SEQ ID NO: 132832 - RNA, 40 nt, Homo sapiens
gaaagcaggugaaaaauugagagugaucccagaaaggaag

SEQ ID NO: 132833 - RNA, 30 nt, Homo sapiens
uucagugugacugagguuagggaaauuauu

SEQ ID NO: 132834 - RNA, 43 nt, Homo sapiens
cucauuuugucccugccacuaaggcugcaccuuguaguggaaa

SEQ ID NO: 132835 - RNA, 48 nt, Homo sapiens
gcuuagaaaaauaugggaauucucaaagauaauugaaauaugugucuu

SEQ ID NO: 132836 - RNA, 48 nt, Homo sapiens
uagcaauauuaauacaucguuaagcccuucucauuaaacaguguaaua

SEQ ID NO: 132837 - RNA, 504 nt, Homo sapiens
guggauugcuagcaaaagggggggaacccaauuacaguuaaguccccaaaacugcauuuugacuccaaaucuucagugugaugugucuagaaaggugauuaaacacauaagaauccugaaugauacgguuaagcuuuguguccccacccaaaucucauuuugaaucauaaucgucaugugucaaaagagagaccagauggagguaauuggaucaugggggcaguuuccccccaugcuguucucgugauagugagugaguucucacgagaucugaugguuuuauguguuugguaguuccugcugcauucauucucccuccugccgccuugugaagaacuugcauuguuuccccuucgccuucugccgugauuguaaguuucuugaggcuuccccagccaugcagaacugggagucaauuaaaccucucuccuuucuaaauuacccagucuugggcuguucuuuauagcaguguaagaauggacuaauacacggaguggagggcgg

SEQ ID NO: 132838 - RNA, 47 nt, Homo sapiens
aagcaaaaauagucuucaugagauugguugucuugaucauuugaaau

SEQ ID NO: 132839 - RNA, 60 nt, Homo sapiens
uuauuaaguguuaguuaaagcuguuuuuuucccuaaaaagcaaggcaaugaaugaaaaga

SEQ ID NO: 132840 - RNA, 48 nt, Homo sapiens
cuuuuacaaggugucaauuagcauguauuuucuauguauuagguuaaa

SEQ ID NO: 132841 - RNA, 34 nt, Homo sapiens
cugcuggcccugggggcacucugugaaguggggg

SEQ ID NO: 132842 - RNA, 45 nt, Homo sapiens
cagccuccccuacccacaguaccuggcggucaucaaagcccagau

SEQ ID NO: 132843 - RNA, 886 nt, Homo sapiens
gaaggagagucuacaggugauuggccuuaagcagcgagaagcaaacuggauuugguagucuagaggggcaggccgagggccagguuagucggagagagcgcuaagcagaaagaggaauagaaccugcuguuuuggccuggcuggugcacgccuguguucccagcacuuugggaggccgaggcgggcggaucacuugaggucaggaguucaagaccagccuggugaaaccucgucucuacuaaaaauacaaaaauuagccgggcaugguggcgcgcgccuguaauuacagcuacucgggaagcugaggcaggagaaucgcuugaacccaggaggcggagguugcagugagccgacaucgugccauugcacuccagccugggcaacagagcgagacuccgucaaaaaaauaaauaaauaaauaaauaaaacuguuguuuucugcgagaccuaagcgaagcucggcagagaugggaucagcgcugaugcugaggcugggacuggccggagcuugagugagggguuguuuaaaggagaaacugggcucuggucguuaaagccugaggagaguacuggcuuauacggagauucugcccuugauugauaggugagggaggacccuuagguuauuggcgagaagcucaggugagagcgggccucugggaggauggaguggugacagcuauaggaauggaaacgaauauuacuuuggaaagucaggagggaaggugccaguugaaaagaaaaccugagacugagugaucucaagaaagaguguagaucugccagagguauucccuuuuguuuuuccauuucccacguguuuuguuuuuguuuugacuagaccuugaugaagguugcggcccaaaacuugauucagaacacuaac

SEQ ID NO: 132844 - RNA, 41 nt, Homo sapiens
cauccauauauuaugauggcuugaguaucauuuggaaacau

SEQ ID NO: 132845 - RNA, 107 nt, Homo sapiens
aaaauaauuucucuauaccgcuucccacuuuuuuauccuacaugguaauauauauuaacuguuuuuaaaaacacacauuuuauaccugcuuaacagaaaguugagca

SEQ ID NO: 132846 - RNA, 44 nt, Homo sapiens
aucgagcuaaaggaaagccugaugcagcaaaaaagggaguuguc

SEQ ID NO: 132847 - RNA, 46 nt, Homo sapiens
uccccauauauaacuaauuugugcugugcaccaacaagaaccugcu

SEQ ID NO: 132848 - RNA, 47 nt, Homo sapiens
acuuuuggaguaucucucagguguacuccuuucuucugccccuuucu

SEQ ID NO: 132849 - RNA, 43 nt, Homo sapiens
gcaugguugaaugcaggaggaguuucaccaauugccccaauuc

SEQ ID NO: 132850 - RNA, 46 nt, Homo sapiens
cagaugagcaugaugcuauggauggagaauuauccugucgguaagu

SEQ ID NO: 132851 - RNA, 50 nt, Homo sapiens
aaauaccuguuuucaugcaguuuacauucuguuggaauacacagguaaca

SEQ ID NO: 132852 - RNA, 53 nt, Homo sapiens
auauaauuacuauuaccauucauuauuaauaaugggucuacauuuuaauacau

SEQ ID NO: 132853 - RNA, 46 nt, Homo sapiens
uaaagacaaauuaucagcugggagaauuaguuauggugaaggaaua

SEQ ID NO: 132854 - RNA, 24 nt, Homo sapiens
cauuuauuuuaucuuuucaauguu

SEQ ID NO: 132855 - RNA, 47 nt, Homo sapiens
cuuuuaggcaaauaugacuagagauuaucuaucuuacuaugcuucug

SEQ ID NO: 132856 - RNA, 64 nt, Homo sapiens
aggaaaaaaaaaccaagaaaacuagaagaugaaauuaaggaggugugacgguuaggaguucuag

SEQ ID NO: 132857 - RNA, 176 nt, Homo sapiens
gcccagagagauguugagauaaugcaucccugaaacaaggacaggauauuguucagagaauguuccaaauuuacaggacaguugucaaaauaaaacauccaguggaaaaguuguaagacaaaguuaacccaaucuccuagaauguagaacaaaaaagcaaggagauguuugauagg

SEQ ID NO: 132858 - RNA, 63 nt, Homo sapiens
gaagcuaauuuguucucccauguuccagaaaaaugguggcaccuaagguaccucugaacucag

SEQ ID NO: 132859 - RNA, 46 nt, Homo sapiens
cuuuaaaucuucaggaucaaugucagcaaaaucugguaaugcaggu

SEQ ID NO: 132860 - RNA, 22 nt, Homo sapiens
cagguggaaugugaggaacagg

SEQ ID NO: 132861 - RNA, 81 nt, Homo sapiens
ucagauuaugaaaauaaaauuuaaaaguuuugucagugacauauuuagaaaaagauacaaaucaaaucaaagguuaguaga

SEQ ID NO: 132862 - RNA, 43 nt, Homo sapiens
gaaccaaauuuucaagggugagcaugcguuuagacaguuugag

SEQ ID NO: 132863 - RNA, 47 nt, Homo sapiens
gccagccucuggucuagagaaaaaaagagggaguaucuuugcaagaa

SEQ ID NO: 132864 - RNA, 41 nt, Homo sapiens
uaaacagauaguaaguauugguaacauuaaugguaugagca

SEQ ID NO: 132865 - RNA, 54 nt, Homo sapiens
agcaugucauuauaugcagauugaccacuuccaauugaagauuaagugggagcu

SEQ ID NO: 132866 - RNA, 45 nt, Homo sapiens
guaucuuuucacauagauagguacugcuaaauacuaauaucaguc

SEQ ID NO: 132867 - RNA, 39 nt, Homo sapiens
aucaucauugauugcagauguucauauguuaaugcugau

SEQ ID NO: 132868 - RNA, 96 nt, Homo sapiens
aucugugcagguuucaaaacuaagcuucuguuggccucaggacauguugugcucccugcaucaauauauggcaauaugcacuaauuauugcaaacu

SEQ ID NO: 132869 - RNA, 39 nt, Homo sapiens
uuaccuuuugacuucaugccauuucuaaggguccucagg

SEQ ID NO: 132870 - RNA, 43 nt, Homo sapiens
uuauugauucuucuaaagggucuuuuuuuuaaaaccaguuacu

SEQ ID NO: 132871 - RNA, 51 nt, Homo sapiens
gugugagccaaggcaaagaauuguggaagaacaugguguacugcagaaagu

SEQ ID NO: 132872 - RNA, 47 nt, Homo sapiens
cagucuacugguccuugaaagagucguaguuguuugccaggugaaga

SEQ ID NO: 132873 - RNA, 45 nt, Homo sapiens
gauaauaaauguuugcugaauaacugaacggggaugucagagcag

SEQ ID NO: 132874 - RNA, 72 nt, Homo sapiens
cgacgcggcgggaaggcgggaaggcugcuccaccgcucggcagccgcgcgaggcgcgccaaagccggcccag

SEQ ID NO: 132875 - RNA, 44 nt, Homo sapiens
gcagacaucuuacagaggucagaaaucaggaugcguguuuggga

SEQ ID NO: 132876 - RNA, 46 nt, Homo sapiens
uggaaaaaauaacuuaauaaauucuauucaauuccuaaaugaguag

SEQ ID NO: 132877 - RNA, 46 nt, Homo sapiens
uuauugcauucuaaaguuuguggcuuuaaaugccauggcaucugag

SEQ ID NO: 132878 - RNA, 64 nt, Homo sapiens
ugauuuacauaaacucaaauuaacuuuaacuaagguuaagguuuagugucucaaaaacugggag

SEQ ID NO: 132879 - RNA, 33 nt, Homo sapiens
uaaucuugggcuccaugggaauguccuugauua

SEQ ID NO: 132880 - RNA, 39 nt, Homo sapiens
aauggugauugguauugccaucuugagacugaugggaag

SEQ ID NO: 132881 - RNA, 57 nt, Homo sapiens
acaccaguguucauagcagcacuacucauaauagccaaaagguggaaaccaaauguu

SEQ ID NO: 132882 - RNA, 195 nt, Homo sapiens
gaacagagaaagcucccuccgcucacuggggaugguauaugugaaacagaggcugaacagagaaagcucccuccgcucacuggggaugguauaugugaaacagaggcugaacagagaaaacucccuccgcucacuggggaugguauuugugaaacagaggcugagguuuccaggagaaucugucuccugggauuu

SEQ ID NO: 132883 - RNA, 72 nt, Homo sapiens
accccccccccauuacuuuucauuguuguaacucauucuguuauaauuauuuaaaguccugcacccucuauu

SEQ ID NO: 132884 - RNA, 68 nt, Homo sapiens
ucgucauuuaaugguugaauggaugaauugaauguauuuaaaugaggauagacagauggaacccaacc

SEQ ID NO: 132885 - RNA, 73 nt, Homo sapiens
guauuagaaugagaaaaaagacuuuccuuagcagacacaggaaaggacaaacacuggucuugguccuagguaa

SEQ ID NO: 132886 - RNA, 44 nt, Homo sapiens
ggcuacuucacuuucccuugggaaaauugccaaauccuaaugaa

SEQ ID NO: 132887 - RNA, 59 nt, Homo sapiens
gaugaaucaacauuaagaaaagaaaggucacuguguaugagauacuuuucaugaauaca

SEQ ID NO: 132888 - RNA, 45 nt, Homo sapiens
cagcugcaacuugcaugucuguguguccaugggguauuuagacag

SEQ ID NO: 132889 - RNA, 71 nt, Homo sapiens
gaacugaggcugcagccuaggucuccuggcugugcucuucucaugaggcccugccuccucaugggaaccag

SEQ ID NO: 132890 - RNA, 54 nt, Homo sapiens
uuuauucagcauccuuauuuauuaagcacugugcuagguacuugggggaaaugg

SEQ ID NO: 132891 - RNA, 50 nt, Homo sapiens
cucacacauccacauucacacauugcugugggaacauggggaaggggaac

SEQ ID NO: 132892 - RNA, 86 nt, Homo sapiens
uccagcuucugccauuccaaauggaggagggccaugagccauucuuuuuuuuuuuuuuuuuuuuugagcggcuagaaagcauaucc

SEQ ID NO: 132893 - RNA, 64 nt, Homo sapiens
gcaauguccagagucagcgcuaucuguacggguucuccuaagauaaaaaaaaacaagaaagaau

SEQ ID NO: 132894 - RNA, 29 nt, Homo sapiens
acuauauuagugcauucuaaaaaagauua

SEQ ID NO: 132895 - RNA, 47 nt, Homo sapiens
uguaugaaaaauaugcacacauacauagguaucuuaauauguaagag

SEQ ID NO: 132896 - RNA, 44 nt, Homo sapiens
uagaggcaggagaggccagggaugucagggagcauucugaguac

SEQ ID NO: 132897 - RNA, 47 nt, Homo sapiens
uaggaagcagccucuuuccauaccuuucgguuacagcuccuucuccc

SEQ ID NO: 132898 - RNA, 46 nt, Homo sapiens
acaaaaaaguccccccccauuucuucucuuuugucucauacuucag

SEQ ID NO: 132899 - RNA, 38 nt, Homo sapiens
cucguauguggacacgcagccacccucagauggagugg

SEQ ID NO: 132900 - RNA, 46 nt, Homo sapiens
gaaggagggugcagauaggauugaggagaguauagaaaggauggug

SEQ ID NO: 132901 - RNA, 46 nt, Homo sapiens
ucagucucucuccucacaaaaaucugcccguggauaugcagcugaa

SEQ ID NO: 132902 - RNA, 40 nt, Homo sapiens
uuugaaaaugaaacacaucgauaaugggcauagggaaaag

SEQ ID NO: 132903 - RNA, 86 nt, Homo sapiens
cugaaauuauaucaaauuauuuucuuacuguaguuuuaugcaacucuauuacaaacucauuuguaguuauauaccuauaguuaaua

SEQ ID NO: 132904 - RNA, 46 nt, Homo sapiens
cucaaacugaauuugagcagcaggaacgguugcuugccauguugga

SEQ ID NO: 132905 - RNA, 45 nt, Homo sapiens
agccuuggaucccaauaguaaaggcaacucuuuguuugcagaggu

SEQ ID NO: 132906 - RNA, 46 nt, Homo sapiens
agaacagcuagaacuucuuauuacuaaccuaaugcgccagguagac

SEQ ID NO: 132907 - RNA, 48 nt, Homo sapiens
uuggaugugaaccacaacugagauaaacugagcagcugccaaaugaaa

SEQ ID NO: 132908 - RNA, 28 nt, Homo sapiens
gaaaaauuuaacaguaauaguaauuucu

SEQ ID NO: 132909 - RNA, 46 nt, Homo sapiens
ggagaaauuggaagaacaacuaagcagaagccauggacaggaagug

SEQ ID NO: 132910 - RNA, 67 nt, Homo sapiens
cucuaaacaucuaagugccccaugacacuacaccaagcccuuaguucccccaugaaaucuagguuug

SEQ ID NO: 132911 - RNA, 57 nt, Homo sapiens
ugugcgguacgguagccucuagcccgaacuaagaaauggugcagaugggagauacau

SEQ ID NO: 132912 - RNA, 50 nt, Homo sapiens
ccauuaggagccgcuggcugcggcagcaggggacuagcgugagagguagg

SEQ ID NO: 132913 - RNA, 47 nt, Homo sapiens
aacaguugaguuuuggcugcuuggaacuguaaucccuucagcaagac

SEQ ID NO: 132914 - RNA, 47 nt, Homo sapiens
aaccuguagaguggccagcaagggcaugucuagcuugauguuggauc

SEQ ID NO: 132915 - RNA, 42 nt, Homo sapiens
cccuccugagggaucccaggaucaaggcgauugcagccaagc

SEQ ID NO: 132916 - RNA, 45 nt, Homo sapiens
cuuaaacaaaccuggcuuaaaguauaagccugugguuaaccagau

SEQ ID NO: 132917 - RNA, 42 nt, Homo sapiens
cuggacacaugggcagccauggaagagcugguggaugaaugg

SEQ ID NO: 132918 - RNA, 42 nt, Homo sapiens
gacugaggccgugaauguggccaucaaugucggguacugcca

SEQ ID NO: 132919 - RNA, 48 nt, Homo sapiens
uuaaaauaaucaacaugaaaaggucaacagcuucaaaaauccugaaaa

SEQ ID NO: 132920 - RNA, 45 nt, Homo sapiens
auggggaaguugaaaagcucgaagaaagugcugugacuguuaugu

SEQ ID NO: 132921 - RNA, 46 nt, Homo sapiens
uuucaacuuccccauacagaauaggaauccucaaaacagcagcucc

SEQ ID NO: 132922 - RNA, 46 nt, Homo sapiens
uguauggcaaaacaaaauuagauggagaaaaggcuguccuggagaa

SEQ ID NO: 132923 - RNA, 43 nt, Homo sapiens
auuaagaguugucuggaugauacagaaacuauccuugcucuca

SEQ ID NO: 132924 - RNA, 45 nt, Homo sapiens
gggccuccagcauuaaucuguccacagaacauauccaacccuggg

SEQ ID NO: 132925 - RNA, 54 nt, Homo sapiens
gaucuuccaaucaucaccauaaucuuccuucagggaaacuccguagugguucaa

SEQ ID NO: 132926 - RNA, 66 nt, Homo sapiens
augaugguagggucuaugcgaaucaaacgccauucuuaacauagacaauauacaacuucguguggu

SEQ ID NO: 132927 - RNA, 47 nt, Homo sapiens
aauuauuucaggagagcagauacgggaugggucuuagccucugccuu

SEQ ID NO: 132928 - RNA, 46 nt, Homo sapiens
uuguguaauaugaaauaaaauuacacaguaagucauuuaaccaauu

SEQ ID NO: 132929 - RNA, 42 nt, Homo sapiens
uugcuaaaaaaaaacaaagugagacaaaacuucaagaggaau

SEQ ID NO: 132930 - RNA, 78 nt, Homo sapiens
gaguugaacuuuuaucagaaaaauagcuuuguagcugaggaggggcaaggagauuuaaaagacuguaucuccuuuguc

SEQ ID NO: 132931 - RNA, 46 nt, Homo sapiens
aaaucaagcauguugugaaguugaaagaugaaaauagccaacucaa

SEQ ID NO: 132932 - RNA, 51 nt, Homo sapiens
ugcagaaccaacucaagcaacaggaggaagacuuuagaaaacagcuggaag

SEQ ID NO: 132933 - RNA, 46 nt, Homo sapiens
ccacaacucagcaccugcccugaagaggcgggggcucugaccagac

SEQ ID NO: 132934 - RNA, 46 nt, Homo sapiens
uuugcugcaucucucuuugucuuuguaagaacaauacgaaccauuu

SEQ ID NO: 132935 - RNA, 54 nt, Homo sapiens
ccgcauuuuucuuccauuacauaaucuguuuaucugauuaaguuggcaauaucu

SEQ ID NO: 132936 - RNA, 49 nt, Homo sapiens
auuuugaguuacuaauacaauagaaacuaguuuucuugaugggauucag

SEQ ID NO: 132937 - RNA, 48 nt, Homo sapiens
augaauucaaaucuaaacauaauuccacuacagcauaauauuaggcag

SEQ ID NO: 132938 - RNA, 51 nt, Homo sapiens
auacuacuaagaaaauugaaauguucauaucuaauauucauaaucacaugu

SEQ ID NO: 132939 - RNA, 42 nt, Homo sapiens
guggguaaccgaagcauuucuguggggcggcugcagggcaug

SEQ ID NO: 132940 - RNA, 46 nt, Homo sapiens
uuuuguuacguugggacuuccccagcucugcucaauaaucacuguu

SEQ ID NO: 132941 - RNA, 47 nt, Homo sapiens
uuagcaccuuugcuaaucuucuggaagccuuccuuggcuauagagcc

SEQ ID NO: 132942 - RNA, 46 nt, Homo sapiens
gucgacccuggauguugaauugccaccuguuugcugugacauagau

SEQ ID NO: 132943 - RNA, 57 nt, Homo sapiens
aaaaacaugaauuuuugauugacagcuaaugucuauguugauauggacaaugacuca

SEQ ID NO: 132944 - RNA, 46 nt, Homo sapiens
auugcgcaccuccccuugaguggagugccucucaugauccuugacg

SEQ ID NO: 132945 - RNA, 46 nt, Homo sapiens
agggaccccucaaacaaaaacagccaagcuuuucugccaaaaaggu

SEQ ID NO: 132946 - RNA, 46 nt, Homo sapiens
ccaccgaucccucuucccaucauagucaaacaucaguugaggcugg

SEQ ID NO: 132947 - RNA, 55 nt, Homo sapiens
auuccucuuggaguuucugggcuuucaauguucguuuugccuuuaaaaaaaaaaa

SEQ ID NO: 132948 - RNA, 46 nt, Homo sapiens
agaauuugguuccucuucuccccacugguguuuuggagaauucugc

SEQ ID NO: 132949 - RNA, 40 nt, Homo sapiens
cccuuuugccacagggcuuugcuuuucuucccaucaagag

SEQ ID NO: 132950 - RNA, 105 nt, Homo sapiens
agaagagagacaccauccucacuggauuaaacugaugacuguuccaggaaggagucuugagacauugcuggacugauaugugaacacugcuuguucucuccaaau

SEQ ID NO: 132951 - RNA, 31 nt, Homo sapiens
aagaaaacaccccucuucccuuuuucacagc

SEQ ID NO: 132952 - RNA, 41 nt, Homo sapiens
gcagugggcagguauggcugagggcgugugagcgccgagcg

SEQ ID NO: 132953 - RNA, 45 nt, Homo sapiens
ccugcagccccuccggccgcgggcggcgcgggagccuggauggac

SEQ ID NO: 132954 - RNA, 98 nt, Homo sapiens
gagaggcggagcggacacgagggaccgugagaaaacggaggaggauaagccccgagaacggcggaaagagaagccaaaagcagaaaaacagaggaagg

SEQ ID NO: 132955 - RNA, 44 nt, Homo sapiens
agguagcaaacaggagaguaaagcugauucagggagcauuagaa

SEQ ID NO: 132956 - RNA, 41 nt, Homo sapiens
uaccauugacuuuuuauuuaccauugauuaaaagcuacacu

SEQ ID NO: 132957 - RNA, 47 nt, Homo sapiens
caucaguggagaggaaugaagcggugggauucugggcauauucugga

SEQ ID NO: 132958 - RNA, 39 nt, Homo sapiens
uuaaguuuaaaaaagaucacucugccugcgugguggaga

SEQ ID NO: 132959 - RNA, 40 nt, Homo sapiens
caccacgcaggcagagugaucuuuuuuaaacuuaacacag

SEQ ID NO: 132960 - RNA, 42 nt, Homo sapiens
aucucuuuggguuaaaaugauuugugauuuauugggcaacau

SEQ ID NO: 132961 - RNA, 43 nt, Homo sapiens
gcaauacccaagaucuuaauuguuaaaaguaaucugcucuagg

SEQ ID NO: 132962 - RNA, 44 nt, Homo sapiens
uggaugccgggcauccucaggaagggccugagaacaaagcagag

SEQ ID NO: 132963 - RNA, 25 nt, Homo sapiens
cauacacagaccucugugugcccgc

SEQ ID NO: 132964 - RNA, 35 nt, Homo sapiens
aacacagccuaaacuggcuuuacucucaagaggag

SEQ ID NO: 132965 - RNA, 44 nt, Homo sapiens
gacaagugaaguagaugacccauauaaauaccacaguacgaugc

SEQ ID NO: 132966 - RNA, 42 nt, Homo sapiens
auucuuuuuaauggugacauaggauuccacugaauggaugaa

SEQ ID NO: 132967 - RNA, 43 nt, Homo sapiens
uuugaguugcauucucuugccucaggcagacccauguggucag

SEQ ID NO: 132968 - RNA, 52 nt, Homo sapiens
gcuggugggcgggaugcagacggauuuauggauauacauuuggauuugggag

SEQ ID NO: 132969 - RNA, 44 nt, Homo sapiens
cuugaauaaacuaagugaauagucuucuggguacuauggggcaa

SEQ ID NO: 132970 - RNA, 51 nt, Homo sapiens
guagaggggacagauaauuaaacaguuacagaacaaugugggaccugcuag

SEQ ID NO: 132971 - RNA, 73 nt, Homo sapiens
auugcgguagacucuguaacuuacacacuaacccucgcuucuccuaaacaaucuuuuuggaaaggauaugggg

SEQ ID NO: 132972 - RNA, 48 nt, Homo sapiens
uuggauugcauuaggauuuucaggaaacgacuugugagugaugugcau

SEQ ID NO: 132973 - RNA, 41 nt, Homo sapiens
uccaguugugacuucauauucuucaaugccccuuggucaaa

SEQ ID NO: 132974 - RNA, 45 nt, Homo sapiens
agacccauucuugagcuguggguacagaaguggcaggauccaaac

SEQ ID NO: 132975 - RNA, 44 nt, Homo sapiens
ucuuguugacugaagcacauccuagcugaaccuugggauggaca

SEQ ID NO: 132976 - RNA, 47 nt, Homo sapiens
cuagcuccuuuauguacgauauucucaccaccacucugggguacaga

SEQ ID NO: 132977 - RNA, 47 nt, Homo sapiens
ggcacagguaccaaaucaaguacaauccagauguggagggauuugug

SEQ ID NO: 132978 - RNA, 44 nt, Homo sapiens
augggggcagagacuggagugaugaaguugcaagccaaggaaca

SEQ ID NO: 132979 - RNA, 54 nt, Homo sapiens
ucugugugugugucuguguguccuucccucuuguuagaaggacacaaaucauug

SEQ ID NO: 132980 - RNA, 45 nt, Homo sapiens
uucugcgggaaggaaugggcgaggcagagaaagcagguuuaggau

SEQ ID NO: 132981 - RNA, 40 nt, Homo sapiens
ucuucuguuucuuugacaucugggucuuacugaccauaga

SEQ ID NO: 132982 - RNA, 52 nt, Homo sapiens
caaauggaaccaucuggcaugagucuccagcucuuaaaucaguccacccaca

SEQ ID NO: 132983 - RNA, 51 nt, Homo sapiens
aagauaauacaugacuucuucaauuaaaguaaccuaaagaacugcuuugaa

SEQ ID NO: 132984 - RNA, 44 nt, Homo sapiens
acaagaaacuaguaacaacggcugucucuaggaagggggaaaau

SEQ ID NO: 132985 - RNA, 42 nt, Homo sapiens
acaguuuuguauuuuuuuuccaacuuaagcauuauguuuuag

SEQ ID NO: 132986 - RNA, 52 nt, Homo sapiens
gaucaaccaaggcuccuagaaggauaaacaacugguggugcuuggaagaggg

SEQ ID NO: 132987 - RNA, 43 nt, Homo sapiens
gucgugacaugggcaaauaaccaggaacagcaguuggaggaag

SEQ ID NO: 132988 - RNA, 31 nt, Homo sapiens
accucaguuuccuaagagaaaagaugaagga

SEQ ID NO: 132989 - RNA, 30 nt, Homo sapiens
aacuaccgugcugacguggggcagguggga

SEQ ID NO: 132990 - RNA, 58 nt, Homo sapiens
caucgagccccucccugacagcaagggccaacaccuuauuuacagaucugaacaucuc

SEQ ID NO: 132991 - RNA, 46 nt, Homo sapiens
acugggcucuucaguuuacacaacagaccaagaagcgaccucgcag

SEQ ID NO: 132992 - RNA, 35 nt, Homo sapiens
uaugugacugauguaacaagccaggagaggcuuag

SEQ ID NO: 132993 - RNA, 38 nt, Homo sapiens
uucagacccaguacaagaaauguuaaucagacaacugu

SEQ ID NO: 132994 - RNA, 45 nt, Homo sapiens
cauggauuucuggaccccacccugacagucugggauucaggaggu

SEQ ID NO: 132995 - RNA, 26 nt, Homo sapiens
cuccagucugucuguaucccauccac

SEQ ID NO: 132996 - RNA, 59 nt, Homo sapiens
gggagagcacuaggcugcaggccagaaggucuuugaguguuagucacuggauguuagca

SEQ ID NO: 132997 - RNA, 48 nt, Homo sapiens
aggcaucuucuaucuccugaccuccagagucacagcacaccuccagag

SEQ ID NO: 132998 - RNA, 41 nt, Homo sapiens
ucugagaggaugggaaggcaggaaaggggagggcugcuuua

SEQ ID NO: 132999 - RNA, 39 nt, Homo sapiens
cugugucuccacuuucugcucugcauucagagccccaag

SEQ ID NO: 133000 - RNA, 21 nt, Homo sapiens
gcagcuccucgcucccugggc

SEQ ID NO: 133001 - RNA, 44 nt, Homo sapiens
acacaggccuguaaaggacuuccaugaugcuggcacagugcaga

SEQ ID NO: 133002 - RNA, 44 nt, Homo sapiens
cuagaaaauguaaguuugagacaguccuuucuuuacaucagggg

SEQ ID NO: 133003 - RNA, 41 nt, Homo sapiens
cucuggccaaacaaauaccccagguuguuuuacuuggcugu

SEQ ID NO: 133004 - RNA, 68 nt, Homo sapiens
gaggaaggcaauucuacuccgugcauaauuauugcaugccuacugugugugcugcgcugagcuaguag

SEQ ID NO: 133005 - RNA, 44 nt, Homo sapiens
cggccccacagcugcugccccgaugcccccaccccuacccugug

SEQ ID NO: 133006 - RNA, 54 nt, Homo sapiens
uauggguauauugugggagauaaacgaccuuucucucucucuuuguguuccucu

SEQ ID NO: 133007 - RNA, 41 nt, Homo sapiens
aauagaugaagacaagucuuccuugauaugcacuucacagg

SEQ ID NO: 133008 - RNA, 34 nt, Homo sapiens
aagauggggaagagugugacuguggagaagaaga

SEQ ID NO: 133009 - RNA, 42 nt, Homo sapiens
gggauguaggaagugcugucaagucccaaaagggcugcuagg

SEQ ID NO: 133010 - RNA, 35 nt, Homo sapiens
ccggucauuuuuaacaaaugcaugugguuucugca

SEQ ID NO: 133011 - RNA, 62 nt, Homo sapiens
cauccaccccagcagagcaguccuguggucccacugucaggccagggcccaaggcguggaga

SEQ ID NO: 133012 - RNA, 44 nt, Homo sapiens
uuugugaaaacagcuugaaauucugucaguauucacaugagaag

SEQ ID NO: 133013 - RNA, 42 nt, Homo sapiens
uuuaaaauauuaugcauguaugaccuauuuuuuaaaaucuug

SEQ ID NO: 133014 - RNA, 49 nt, Homo sapiens
aagguggugcuggugcauaggagaguaauccaggaagagagaugaauag

SEQ ID NO: 133015 - RNA, 46 nt, Homo sapiens
guccaacgcggugcccauugacaccacuaucaucaugaaugggagg

SEQ ID NO: 133016 - RNA, 33 nt, Homo sapiens
gagguccugaggaggagggugacaugcuggacc

SEQ ID NO: 133017 - RNA, 46 nt, Homo sapiens
guguguugcagaagggcggggcccagcccggcaggcaguggcaguu

SEQ ID NO: 133018 - RNA, 46 nt, Homo sapiens
cacugccugccgggcugggccccgcccuucugcaacacaccgggcc

SEQ ID NO: 133019 - RNA, 52 nt, Homo sapiens
gaggccuccuggacgacuccguccucucuauuugagacccgggcccugggga

SEQ ID NO: 133020 - RNA, 46 nt, Homo sapiens
gaggacggagucguccaggaggccuccuccaagccggccaauuccc

SEQ ID NO: 133021 - RNA, 62 nt, Homo sapiens
gagggccagcaccagggggccgcaguggggaugcaccuccuggccuggggaggcuccugcgg

SEQ ID NO: 133022 - RNA, 47 nt, Homo sapiens
ccccuuggacaggucuagauuuucgagcuaaucaucccuccagcccu

SEQ ID NO: 133023 - RNA, 60 nt, Homo sapiens
agaauacagaucacagagggcuggagggaugauuagcucgaaaaucuagaccuguccaag

SEQ ID NO: 133024 - RNA, 44 nt, Homo sapiens
agagggacuaugaucugauggccucuagguguuguuuugugcaa

SEQ ID NO: 133025 - RNA, 43 nt, Homo sapiens
uuuggggagaggugggaggggacguggcuugucacaugcagcc

SEQ ID NO: 133026 - RNA, 24 nt, Homo sapiens
aaccuuuggcaucacggcucagag

SEQ ID NO: 133027 - RNA, 40 nt, Homo sapiens
ugacaaaaagcuggguugaggaagaggcucccugcucuga

SEQ ID NO: 133028 - RNA, 44 nt, Homo sapiens
uuuuugucauucacuuccuuuuguucucucucuggucacugccc

SEQ ID NO: 133029 - RNA, 67 nt, Homo sapiens
uccuaucuagcaaagcaccacacggcccuccuucccugcugcagggaagacaggagccaccgcagac

SEQ ID NO: 133030 - RNA, 45 nt, Homo sapiens
caaagcaccuggagauguuugcugggagauagacucccacuccac

SEQ ID NO: 133031 - RNA, 64 nt, Homo sapiens
uuggaaauaaguggaaaauacgggauguaccccugggggaaaagccuggguuggguuuagaaag

SEQ ID NO: 133032 - RNA, 50 nt, Homo sapiens
ccuucccuaagcccagauuuauuuguauuugacaccucaaaacagcauac

SEQ ID NO: 133033 - RNA, 73 nt, Homo sapiens
ugggcuuagggaaggagagaccuuauuccaaagcacgauugcagaaggggaaagggaauauugcaaaagggag

SEQ ID NO: 133034 - RNA, 40 nt, Homo sapiens
gaaagaaccacguucagggaaugacguugugcccagccuu

SEQ ID NO: 133035 - RNA, 45 nt, Homo sapiens
uccuuucagccuugcugacuucucccuauaaaaguaaagccuuuu

SEQ ID NO: 133036 - RNA, 42 nt, Homo sapiens
ucuguagaauccaagcccacauuuccaaagucacccccaacg

SEQ ID NO: 133037 - RNA, 41 nt, Homo sapiens
agggaaggcagccuucuuacagcugaugcacaggaaguaga

SEQ ID NO: 133038 - RNA, 31 nt, Homo sapiens
aaaauaaguuuacgcuuaaaaaaugagucaa

SEQ ID NO: 133039 - RNA, 44 nt, Homo sapiens
ugauauuucaacuuacaacuuguuuuaaaagaaaaauugcacac

SEQ ID NO: 133040 - RNA, 47 nt, Homo sapiens
aaggcagcuugagccagaccauggccggauccagcccuaacacgccu

SEQ ID NO: 133041 - RNA, 48 nt, Homo sapiens
uguuagggcuggauccggccauggucuggcucaagcugccuuccggcc

SEQ ID NO: 133042 - RNA, 30 nt, Homo sapiens
cugugucuugagaauccugaaagauagggu

SEQ ID NO: 133043 - RNA, 26 nt, Homo sapiens
ggaaaauaagaagaaauggcaguaaa

SEQ ID NO: 133044 - RNA, 37 nt, Homo sapiens
cuaaggucauagugcaaugggaguugauuucagaugu

SEQ ID NO: 133045 - RNA, 51 nt, Homo sapiens
agcuguucucauuaucagggacccaugcagaccuguuggacagacauagua

SEQ ID NO: 133046 - RNA, 42 nt, Homo sapiens
cccgccgcccgcccaccucuaccucccaguagugccggccgg

SEQ ID NO: 133047 - RNA, 46 nt, Homo sapiens
ggggugggaccacgauauucccagagggaaaagcaaaagcugaggg

SEQ ID NO: 133048 - RNA, 64 nt, Homo sapiens
uccucccagggagaaaagaggcagcucuggacaggcguuugguaagcacugccugacagccaac

SEQ ID NO: 133049 - RNA, 46 nt, Homo sapiens
uugugcuggcugccuugcaaacaaaucuccuuuaccuauguccaaa

SEQ ID NO: 133050 - RNA, 54 nt, Homo sapiens
gaaaagucaaacaacagacauccaaauggugguggcguuguuaguauacaccag

SEQ ID NO: 133051 - RNA, 51 nt, Homo sapiens
ucguccuccucauccuccccccucagguccuccuccuccaugucccccaag

SEQ ID NO: 133052 - RNA, 46 nt, Homo sapiens
cuccaugucacccucguagucuucaucccgcaugggggugucccac

SEQ ID NO: 133053 - RNA, 79 nt, Homo sapiens
acgaaacuguaaccauuuugaaaacaaggguuucaucugaacaggggagaugaacuguaacuucucaucuuguaaaaag

SEQ ID NO: 133054 - RNA, 48 nt, Homo sapiens
uagggacgguggcccguagucacugagcagcuggcgguacugugaaga

SEQ ID NO: 133055 - RNA, 47 nt, Homo sapiens
caauuuguuguuacuucaaacaaugguauacucaauacaguguauua

SEQ ID NO: 133056 - RNA, 25 nt, Homo sapiens
gauuuaagguguagaauccacgcgu

SEQ ID NO: 133057 - RNA, 65 nt, Homo sapiens
uagaaucagcgguccuaggggcuguuuuggauguggccaagggaaguagcccauuucugauuuag

SEQ ID NO: 133058 - RNA, 31 nt, Homo sapiens
gcugggagccaugagggcucccaggggaaua

SEQ ID NO: 133059 - RNA, 47 nt, Homo sapiens
ugugggggugaauuaacacuucuguaagaaggaaggaacugaaucag

SEQ ID NO: 133060 - RNA, 46 nt, Homo sapiens
gaguacagcaaauauaaagacagaacaggaaggugaggcaucugag

SEQ ID NO: 133061 - RNA, 58 nt, Homo sapiens
uacuccagccuuauaaaccacaaaagcacccauucuggggagaagaacuguaaaugug

SEQ ID NO: 133062 - RNA, 55 nt, Homo sapiens
aaggccuucaggaacagcucugggcucagaguccacaaaaggauccacacggggg

SEQ ID NO: 133063 - RNA, 46 nt, Homo sapiens
uucauaccggagagagaccuuauguaugugaugugugugggaaaac

SEQ ID NO: 133064 - RNA, 45 nt, Homo sapiens
uacaaaccacaaaaaaguucaucuuggggagaagcccuacaaaug

SEQ ID NO: 133065 - RNA, 46 nt, Homo sapiens
gaacagcucaggccucacagugcauaaaaggauccacacaggugag

SEQ ID NO: 133066 - RNA, 39 nt, Homo sapiens
auuggucagugggaaaacuaagggccuccaacaggcaaa

SEQ ID NO: 133067 - RNA, 48 nt, Homo sapiens
cuaauggaugaauuaagacugcaggugcucagaggacagcgacuagga

SEQ ID NO: 133068 - RNA, 41 nt, Homo sapiens
ccacuuccggaggacgggcggaaguggcugcgguggauggu

SEQ ID NO: 133069 - RNA, 41 nt, Homo sapiens
guuccggggagaagggugggaggaguuaaauucuuggaggg

SEQ ID NO: 133070 - RNA, 51 nt, Homo sapiens
cacuuugguggaucugauuugggauucucaguuuugaaaauggagugcuga

SEQ ID NO: 133071 - RNA, 22 nt, Homo sapiens
cgugccuuaaaagcacagaaac

SEQ ID NO: 133072 - RNA, 102 nt, Homo sapiens
auucugauucccuaaccaggcccuuucuuuuugggauggucucuugcaguccgggaauuucuccuuuuggaucuuccugugagccuugggauuucagccaag

SEQ ID NO: 133073 - RNA, 23 nt, Homo sapiens
gagggccaggccggagggagcug

SEQ ID NO: 133074 - RNA, 41 nt, Homo sapiens
gauguugugaaacucggccccgggcguccgugcgugcgggg

SEQ ID NO: 133075 - RNA, 50 nt, Homo sapiens
ggccagagugcaggguccaugggguuagugguuggagguaagguugaaaa

SEQ ID NO: 133076 - RNA, 46 nt, Homo sapiens
aaggcugaauugucugaaaaauauuuauguguguguguccuggaaa

SEQ ID NO: 133077 - RNA, 46 nt, Homo sapiens
agagaaagaaguacauaggugugugcagccgaaggucuagccagga

SEQ ID NO: 133078 - RNA, 46 nt, Homo sapiens
guucagacaggcaaaaggccaugggaaguuucaacaccaguuuuga

SEQ ID NO: 133079 - RNA, 42 nt, Homo sapiens
aggccaucaccaccaggagcacacacucuguggagcccaggg

SEQ ID NO: 133080 - RNA, 46 nt, Homo sapiens
cuuuccacagagcccccuucacguccuuguuucuuaguguauaaau

SEQ ID NO: 133081 - RNA, 33 nt, Homo sapiens
ccaggggcggccuccaucccggcacgaggcugg

SEQ ID NO: 133082 - RNA, 85 nt, Homo sapiens
cgggcuucucccagggacagggcuuggaggggcaggacgggaaacagcccugacguagggccgggacaccucuggugcaguuuug

SEQ ID NO: 133083 - RNA, 44 nt, Homo sapiens
gcccugugggucccuccugggagggguccagagagcuuggcccu

SEQ ID NO: 133084 - RNA, 44 nt, Homo sapiens
cagauggguccagucaucaucuccuccugaacaguuauccgacu

SEQ ID NO: 133085 - RNA, 37 nt, Homo sapiens
cugugcuggaacucucuggagagacgggggucaggcg

SEQ ID NO: 133086 - RNA, 45 nt, Homo sapiens
ccguggggccagggcgggccuccccugcacgaggaggacgugggc

SEQ ID NO: 133087 - RNA, 45 nt, Homo sapiens
caagucguagucugggcagacgcugcacuuguagcggguuccuac

SEQ ID NO: 133088 - RNA, 143 nt, Homo sapiens
gggagggagcgcacagccagcacuggucuguguguggucuggccuggccucaccugaccaagagaagggcuccugcccacagagaaacuuuagggccagcccacccucugcaacuaccccagcccugggguccugggguuagg

SEQ ID NO: 133089 - RNA, 46 nt, Homo sapiens
uccugggaguccugcugcaaggugggcugguuccuaucuaggaaga

SEQ ID NO: 133090 - RNA, 41 nt, Homo sapiens
acccgccgccgcgcgcgagcccgcuccgcugcccucggggg

SEQ ID NO: 133091 - RNA, 45 nt, Homo sapiens
cggccgcggcgguagcgcggaaaacaauggggccggggcgguggg

SEQ ID NO: 133092 - RNA, 47 nt, Homo sapiens
augugucagacauuuaaucaggaugcuggaccuucaaaauaacugaa

SEQ ID NO: 133093 - RNA, 49 nt, Homo sapiens
uuuccuuuucaucuguuguucuguggucacagugaccuuagcuacauag

SEQ ID NO: 133094 - RNA, 48 nt, Homo sapiens
auauugggaagauauugggaaggaaauauauuuguaaaagaugaaggc

SEQ ID NO: 133095 - RNA, 44 nt, Homo sapiens
cuguguaaagacuugagaagucuaauucacaggcaaaccaauac

SEQ ID NO: 133096 - RNA, 53 nt, Homo sapiens
gcuuuauugugauuacguguauguuucuucuuucuuuuaagcagacccauacc

SEQ ID NO: 133097 - RNA, 60 nt, Homo sapiens
ucuauuccggagcucacgugccaugcccugcuagcauuccuuaacaagccaccugcucca

SEQ ID NO: 133098 - RNA, 60 nt, Homo sapiens
ggagcagguggcuuguuaaggaaugcuagcagggcauggcacgugagcuccggaauagau

SEQ ID NO: 133099 - RNA, 45 nt, Homo sapiens
aauagauauauaagaaaaaauucuuucacuugauguuuguuagac

SEQ ID NO: 133100 - RNA, 44 nt, Homo sapiens
agaaucuuguuuuguuugcuuccauuauugaguuccuccuaagg

SEQ ID NO: 133101 - RNA, 58 nt, Homo sapiens
aauuuaauguauuaaucuguuugugcaaacauaauaccaccauuuaaaaauguuaggg

SEQ ID NO: 133102 - RNA, 93 nt, Homo sapiens
agcaggcuccaguugaacacuagucuguguaacuuuaaacaucuagcaguaaauacuugcaguugugauauaaaggacccuguuucuguagaa

SEQ ID NO: 133103 - RNA, 56 nt, Homo sapiens
auuucuucucccuccuccccugcaagagugguccuaggagaggaccuggcacaccu

SEQ ID NO: 133104 - RNA, 45 nt, Homo sapiens
gaugaaauuuugaacagaucaccaagaaacagaaagccacgaaga

SEQ ID NO: 133105 - RNA, 47 nt, Homo sapiens
aguuuagaacacagugauuuguauaagaaauacuuuucagggcacag

SEQ ID NO: 133106 - RNA, 56 nt, Homo sapiens
ugcugaagaagaugguggcacugucagucaagaggaggaagacagaaaaccuaaag

SEQ ID NO: 133107 - RNA, 71 nt, Homo sapiens
ccucaaccggaugugaaggaagaggaagaagagaaggaagaggaaaaggacaagggagaugaggaggagga

SEQ ID NO: 133108 - RNA, 45 nt, Homo sapiens
ccucuuccuucucuucuuccucuuccuucacauccgguugaggug

SEQ ID NO: 133109 - RNA, 34 nt, Homo sapiens
guaccccaacauacuguuuugagaguggggaagg

SEQ ID NO: 133110 - RNA, 47 nt, Homo sapiens
accucagcagccccaucagcagcuuucuucaggccccauccaucauu

SEQ ID NO: 133111 - RNA, 76 nt, Homo sapiens
cauuuuuuuugacaacuuuaucauuugugcugaucgaagaauaguugaugauugggccaaugauggauggggccug

SEQ ID NO: 133112 - RNA, 45 nt, Homo sapiens
caaaugauaaaguugucaaaaaaaaugucagaggucauggaccac

SEQ ID NO: 133113 - RNA, 61 nt, Homo sapiens
ccaggaaaauaccaaauccagauuucuuugaagaucuggaaccuuucagaaugacuccuuu

SEQ ID NO: 133114 - RNA, 42 nt, Homo sapiens
aaaucuggauuugguauuuuccuggguuuccagauucccuag

SEQ ID NO: 133115 - RNA, 28 nt, Homo sapiens
gaaaugauuuucugaaacauuuuuuuuu

SEQ ID NO: 133116 - RNA, 109 nt, Homo sapiens
uggagaaugggaggcuccucagauugccaacccuagaugugagucagcuccuggauguggugucuggcagcgaccugugauugacaaccccaauuauaaaggcaaaugg

SEQ ID NO: 133117 - RNA, 47 nt, Homo sapiens
gaugaugagccugaguacguaccugauccagacgcagagaaaccuga

SEQ ID NO: 133118 - RNA, 46 nt, Homo sapiens
cucaucaucuaaccagccuucggguuuuguggccucuucaucugga

SEQ ID NO: 133119 - RNA, 32 nt, Homo sapiens
auauaaagacaacccaauuuaaaaaugggcaa

SEQ ID NO: 133120 - RNA, 54 nt, Homo sapiens
aggauugggaugaaagaccaaaaaucccagauccagaagcugucaagccagaug

SEQ ID NO: 133121 - RNA, 48 nt, Homo sapiens
uccucaauuucacgugaaggauuuacaggaggagucaugucauugagc

SEQ ID NO: 133122 - RNA, 58 nt, Homo sapiens
augacuccuccuguaaauccuucacgugaaauugaggacccagaagaccggaagcccg

SEQ ID NO: 133123 - RNA, 43 nt, Homo sapiens
uuuccaagcucccuuuaccauaauacaaaagaucaugacuucu

SEQ ID NO: 133124 - RNA, 61 nt, Homo sapiens
uucauaagaacaaaauggauggagaggagaaaaccuaugguggcugugaaggcccugaugc

SEQ ID NO: 133125 - RNA, 46 nt, Homo sapiens
uuaguguguaaagauguguuuucuuaucaguaaaauaggucuucag

SEQ ID NO: 133126 - RNA, 65 nt, Homo sapiens
cgacacaaaaaccccaaaacggguaucuaugaagaaaaacaugcuaagaggccagaugcagaucu

SEQ ID NO: 133127 - RNA, 77 nt, Homo sapiens
uccaugacaagaccccuuauacgauuauguuugguccagauaaauguggagaggacuauaaacugcacuucaucuuc

SEQ ID NO: 133128 - RNA, 116 nt, Homo sapiens
uuuuucuucauagauacccguuuugggguuuuugugucggaagaugaagugcaguuuauaguccucuccacauuuaucuggaccaaacauaaucguauaaggggucuugucaugga

SEQ ID NO: 133129 - RNA, 28 nt, Homo sapiens
uuuuagaaagcaguuucacauaggcacc

SEQ ID NO: 133130 - RNA, 47 nt, Homo sapiens
aaaauggaauagaaugugguggugccuaugugaaacugcuuucuaaa

SEQ ID NO: 133131 - RNA, 191 nt, Homo sapiens
aauuuaccggaaaucugcauuaauaguuuuuguaauuaauuaauuacaaaacuaguaauuaauaguuuuuccugccuaaugcauuauuuugaaagaaacugguuacucauuuuccugacucuaaauaacuuguagauuuugcagaacaaauuuacuggaaaucugcauuaauguucaauuuaauuuuauuu

SEQ ID NO: 133132 - RNA, 46 nt, Homo sapiens
caggaagggcuuguucaguuuagcagagauggcaugaugcuuggcc

SEQ ID NO: 133133 - RNA, 71 nt, Homo sapiens
ggagguagaggaaaugaaggagucaaagcuuccaggugauaaaggacuuguguugaugucucgggccaagc

SEQ ID NO: 133134 - RNA, 47 nt, Homo sapiens
aaagccaagaaagacgauaccgaugaugaaauugccaaauaugaugg

SEQ ID NO: 133135 - RNA, 49 nt, Homo sapiens
auuuggcaauuucaucaucgguaucgucuuucuuggcuuuggauaaaau

SEQ ID NO: 133136 - RNA, 64 nt, Homo sapiens
gaguuccucugucaaaagaaucagcaaaauauacuuccccuguuggaacuggagcuuuguaagu

SEQ ID NO: 133137 - RNA, 42 nt, Homo sapiens
aacacagguuacuuacaaagcuccaguuccaacaggggaagu

SEQ ID NO: 133138 - RNA, 64 nt, Homo sapiens
gacgaugucauugaagagguagaagacucaaaaccagauaccacugcuccuccuucaucuccca

SEQ ID NO: 133139 - RNA, 62 nt, Homo sapiens
cugcuauuguugaggcucaugauggacaugaugaugaugugauugauauugaggaugaccuu

SEQ ID NO: 133140 - RNA, 43 nt, Homo sapiens
cugcgauuuaaaagcuuuaauuuuaaaugagagagugguuagu

SEQ ID NO: 133141 - RNA, 24 nt, Homo sapiens
aaaaguuuguuggaaauuguauuu

SEQ ID NO: 133142 - RNA, 92 nt, Homo sapiens
ggauauaauaauacccgauggauuugugaggauuaaauuaagauauguauacaauaagacagggaaguccgacauuuaguaacugcucgaug

SEQ ID NO: 133143 - RNA, 49 nt, Homo sapiens
guuaacgcuaaggcccuggcucgagucuuugauuggucauugguugcuc

SEQ ID NO: 133144 - RNA, 75 nt, Homo sapiens
ggacagggcguuaaaagcaggaaagcccccgaaagcucaucuaagugcaucucuuuccacaccggaggccuggag

SEQ ID NO: 133145 - RNA, 39 nt, Homo sapiens
gugcuguaacugcuaaguuucucaaccacugcguguucu

SEQ ID NO: 133146 - RNA, 64 nt, Homo sapiens
guaguagggaagggugguauuagaccgagagggaauguuuacaacuagcguuacaguuuaauau

SEQ ID NO: 133147 - RNA, 45 nt, Homo sapiens
ggcccgauuccacccuauacuuuuacccaguuacuccagcccacc

SEQ ID NO: 133148 - RNA, 49 nt, Homo sapiens
gcccggauucgggccuccucgcucacggcgggcgcgucggccagggccu

SEQ ID NO: 133149 - RNA, 44 nt, Homo sapiens
gcucuugagggcccaggcccuggccgacgcgcccgccgugagcg

SEQ ID NO: 133150 - RNA, 44 nt, Homo sapiens
ggacgcgcucaggucuccccucucaccucuagccucccggggac

SEQ ID NO: 133151 - RNA, 42 nt, Homo sapiens
ggcacgggcacccccgcgguccccgggaggcuagaggugaga

SEQ ID NO: 133152 - RNA, 85 nt, Homo sapiens
cuucccgcccgcacaccuugccccgcgccgcaguaaagagagaggcggaggcggcccgaccgucacgugccgcagaaccaagagg

SEQ ID NO: 133153 - RNA, 46 nt, Homo sapiens
cgccaagucccgcccucccgcgcaagccccgacauccgguuggccg

SEQ ID NO: 133154 - RNA, 50 nt, Homo sapiens
agugugaagauuggccgggagugaggcaggaaguggcuguugguugggcg

SEQ ID NO: 133155 - RNA, 52 nt, Homo sapiens
ucgcgcgcccuucgcugacggggcaaacggcagccggcaaaagggguaggag

SEQ ID NO: 133156 - RNA, 43 nt, Homo sapiens
uagaccuauccuuaugucccgugauaggauucucauuacuuuc

SEQ ID NO: 133157 - RNA, 103 nt, Homo sapiens
ccaagaucucagcagagcagggcuuccuggcuugaggcuggaagccuuugggaagaggcccagcugggacauucccugggcaccugucuuccgcugaagggag

SEQ ID NO: 133158 - RNA, 27 nt, Homo sapiens
gaugucuucuagcugaguuucuaaccg

SEQ ID NO: 133159 - RNA, 49 nt, Homo sapiens
auuguuauuuuguccccuaacuacaggcugguuuccauaaauuaaugga

SEQ ID NO: 133160 - RNA, 42 nt, Homo sapiens
cgauccucccuuacuguacaucaaagaauucauacuggagag

SEQ ID NO: 133161 - RNA, 46 nt, Homo sapiens
aaacucaaagaauguuuguaggaaagaagaucuaugaauguaauca

SEQ ID NO: 133162 - RNA, 47 nt, Homo sapiens
uuaagaguuuaaguuucauguauguucugguacuuuauguuccagag

SEQ ID NO: 133163 - RNA, 32 nt, Homo sapiens
aguuuagcagauccccuggccugucccuacca

SEQ ID NO: 133164 - RNA, 73 nt, Homo sapiens
gaagaggaagcaagcaagugaagacuuuuaaguacagacugucguuucaacaaggccagcuucuaaggaaaag

SEQ ID NO: 133165 - RNA, 53 nt, Homo sapiens
cagugauaggugcgguguggaaaaauaaagcagcauaagagaaugacauuagu

SEQ ID NO: 133166 - RNA, 41 nt, Homo sapiens
uaauggggagacaauaaaggaagaagggagggggggacaga

SEQ ID NO: 133167 - RNA, 42 nt, Homo sapiens
cagccucagugacuaagugcauacacaggaagagccagaaga

SEQ ID NO: 133168 - RNA, 47 nt, Homo sapiens
acuuucuccuaauaaguauggaauugcucuaugucuuggcggguggg

SEQ ID NO: 133169 - RNA, 57 nt, Homo sapiens
ugcacaauuucacauuagaaauucucucauaguucaggcagcauuuuccugcuuugg

SEQ ID NO: 133170 - RNA, 46 nt, Homo sapiens
gggccaucguggcagugggggacugagagugguugaacuggggggg

SEQ ID NO: 133171 - RNA, 67 nt, Homo sapiens
gacucuucauuucagggacugauacugaaaagauccaacaggaauguaccuugggauuugaaauuag

SEQ ID NO: 133172 - RNA, 96 nt, Homo sapiens
aagggaaguuuucagauaguuucagccacccacaaaaaaauccccacuauagaaagaagccauaaaaauacugaauugagccaaaacuucagccca

SEQ ID NO: 133173 - RNA, 64 nt, Homo sapiens
gaaauacaaggaaacagccucaaacagaauucacaauuacuuaaucaaccaaaaauuacagcag

SEQ ID NO: 133174 - RNA, 46 nt, Homo sapiens
ccuagggagcuccuagaacauauccauaccugggcuuauaccaguu

SEQ ID NO: 133175 - RNA, 61 nt, Homo sapiens
ucugcauagcccagcaagauuacugccguauucucaaucaaguagaaaagaacaugcaaaa

SEQ ID NO: 133176 - RNA, 44 nt, Homo sapiens
aagccagaagccagacuggaggagacugaagaguaggugaagaa

SEQ ID NO: 133177 - RNA, 50 nt, Homo sapiens
gcuucguggaaaaaaauaccagccuagucgccaaaaugaaaguagauuac

SEQ ID NO: 133178 - RNA, 52 nt, Homo sapiens
gauguugcuaaugugcuggccugcagacugcgcucugagaacagcagcucca

SEQ ID NO: 133179 - RNA, 67 nt, Homo sapiens
aauuucuuugguuuuaaugccaaagacacugauuugguggauggaggugggguggauggaggugggg

SEQ ID NO: 133180 - RNA, 83 nt, Homo sapiens
gauauauauaaacuauauauguguuuauaaaaacacugaacaacaguauauauuuugaauuuauaaaaccauugguaaaaggc

SEQ ID NO: 133181 - RNA, 45 nt, Homo sapiens
acggcgcugccgccauuuugugggguguuugucgcagcggccgag

SEQ ID NO: 133182 - RNA, 104 nt, Homo sapiens
gggcaucuucagcagagaaaggugacugagucggcauugcuuuguggucuuuuucagacauggaagagaaggugagaaguugugaaacgcugaggcuccagccc

SEQ ID NO: 133183 - RNA, 62 nt, Homo sapiens
uugguacauaauuguguucacuccauauccaaacaaagcaugugugcgaucaguuggucgcu

SEQ ID NO: 133184 - RNA, 49 nt, Homo sapiens
accccgaagucuaaggcucaaaaucaaguagcucccauggcugagccag

SEQ ID NO: 133185 - RNA, 55 nt, Homo sapiens
ccgcugccucgguucccucgguugcgguuuccacggcccccagagccauacugcu

SEQ ID NO: 133186 - RNA, 60 nt, Homo sapiens
ucggcgccguucugauucccgcucgggggcgccgcggucgcgccuccagcccccgccgcg

SEQ ID NO: 133187 - RNA, 43 nt, Homo sapiens
ggggaaggcgccgcaggcucggccgcacucaagcucgcgcugc

SEQ ID NO: 133188 - RNA, 58 nt, Homo sapiens
caguggacugugguugguuucagagcgccuggcugaggaguuccacugaggggagcac

SEQ ID NO: 133189 - RNA, 44 nt, Homo sapiens
ggcugaagugucccuacugucccauggagcagaacccggcagau

SEQ ID NO: 133190 - RNA, 51 nt, Homo sapiens
gacagccaugacaggaaguggaacucacccgcuucgcugcccuucccagau

SEQ ID NO: 133191 - RNA, 50 nt, Homo sapiens
gcaucaccaggcccugucucuccuccuucgucagaacuucgacucugaga

SEQ ID NO: 133192 - RNA, 46 nt, Homo sapiens
aggggaccccucucucagccacccucucucuggugaugucacagug

SEQ ID NO: 133193 - RNA, 39 nt, Homo sapiens
guauagucaaggaacagaaagcaagcuaguguggcuaaa

SEQ ID NO: 133194 - RNA, 39 nt, Homo sapiens
gcccagagaaggaggcugggggaucaccagccccaaggu

SEQ ID NO: 133195 - RNA, 40 nt, Homo sapiens
ccugccuaggugcuccucugccaggagggccuuguccugg

SEQ ID NO: 133196 - RNA, 39 nt, Homo sapiens
ugcugcugucagcucgcucugcuggccucagaucuugga

SEQ ID NO: 133197 - RNA, 42 nt, Homo sapiens
gcgcugcgcuuugagcaggagcggcggacuuggcaggaggag

SEQ ID NO: 133198 - RNA, 49 nt, Homo sapiens
cugccaaguccgccgcuccugcucaaagcgcagcgccugcuccuggccc

SEQ ID NO: 133199 - RNA, 42 nt, Homo sapiens
ccccugcucuugcagucaucagucucacagcugccuggggcu

SEQ ID NO: 133200 - RNA, 42 nt, Homo sapiens
ccucccaucgggcuuccuccucuggucgugcacuggggucag

SEQ ID NO: 133201 - RNA, 65 nt, Homo sapiens
gccaccagcugugcugagcugccugcccgagccaccaccccccuacgaguucuccugcuccucug

SEQ ID NO: 133202 - RNA, 52 nt, Homo sapiens
cacuggaggagucggacaggcugggcucgggcucagggccgcccucaucuag

SEQ ID NO: 133203 - RNA, 46 nt, Homo sapiens
uugggccagcgugaguuccucagcuaccugcaccuccccaagaagg

SEQ ID NO: 133204 - RNA, 42 nt, Homo sapiens
auugccaugggcagcgugggcagccuguuggaacggcaggac

SEQ ID NO: 133205 - RNA, 36 nt, Homo sapiens
cuacagugggagggauacaaacaggaagggcccaaa

SEQ ID NO: 133206 - RNA, 41 nt, Homo sapiens
cccggcuuuccucaaaggauuacugacagucagagauggag

SEQ ID NO: 133207 - RNA, 52 nt, Homo sapiens
guccuguuugcccccacgaggcuauuguggagaugaaaugagauaaugaaau

SEQ ID NO: 133208 - RNA, 52 nt, Homo sapiens
aucaauaugagcugacuuuaacugaguuguuugggauagggaagaagcaguc

SEQ ID NO: 133209 - RNA, 57 nt, Homo sapiens
gacuagcaaugauaauagggagauaagaaacuuuaauuaucuugauccuuuaagugg

SEQ ID NO: 133210 - RNA, 73 nt, Homo sapiens
ugagaacuaucauuaggugguuuucugauuuccugaugaagaguuggacauacugucuuaaucuauagugaaa

SEQ ID NO: 133211 - RNA, 56 nt, Homo sapiens
cagugauagaaccauaccucagccccccauucuucagcuuucaguggagaagcuga

SEQ ID NO: 133212 - RNA, 61 nt, Homo sapiens
acaacuggcauuuuaaaaguucuggauguauuuuuaaaauauauucuuuuguggggaaugg

SEQ ID NO: 133213 - RNA, 46 nt, Homo sapiens
guguuuagaucuauuuuaucaacuaggaaacagacaccauggagau

SEQ ID NO: 133214 - RNA, 45 nt, Homo sapiens
uacagaaauuacagaaggaacuacagagauaccuuacucggaaga

SEQ ID NO: 133215 - RNA, 47 nt, Homo sapiens
guacuauacuggguaugguaucauuccuggagucagacugccuaguc

SEQ ID NO: 133216 - RNA, 40 nt, Homo sapiens
uucuauaauauugaauuagauauuuucauguaacucuuag

SEQ ID NO: 133217 - RNA, 45 nt, Homo sapiens
uauguagcuuuacauagcuauacuugguuuuggauuguuguauua

SEQ ID NO: 133218 - RNA, 37 nt, Homo sapiens
aagcaugcuuuauaacuuaaaaucaucugcaaaauuu

SEQ ID NO: 133219 - RNA, 48 nt, Homo sapiens
auagguccuucuguaccucccuuagugaauccaccucugccuacaacu

SEQ ID NO: 133220 - RNA, 38 nt, Homo sapiens
uggccagauguauuuuacauucuuguucaugcugaguu

SEQ ID NO: 133221 - RNA, 49 nt, Homo sapiens
ugcaucaucccaaccaacuguaucuggaaauacaaguuuaaccacaaau

SEQ ID NO: 133222 - RNA, 45 nt, Homo sapiens
augccuucuaguagcuuucuuccugaagccaaccugccaccaccu

SEQ ID NO: 133223 - RNA, 45 nt, Homo sapiens
cuuaccugguaaggugaagguggcgggucucacugacagcugaag

SEQ ID NO: 133224 - RNA, 45 nt, Homo sapiens
uaguucuagugcaugaaaucucauucuagucacgcaaggccagag

SEQ ID NO: 133225 - RNA, 61 nt, Homo sapiens
uugaacauguuacugcucuguaaaacaaaaacaaaacaaaacaaaacaaaaaaaccuucag

SEQ ID NO: 133226 - RNA, 42 nt, Homo sapiens
uuccuaauucucucuagagcuucagucaggcuaacuugccca

SEQ ID NO: 133227 - RNA, 51 nt, Homo sapiens
cuccuuuaaaggaugagcagaguaaacauuuacaggaagagccuuaggaag

SEQ ID NO: 133228 - RNA, 62 nt, Homo sapiens
gaugaaaccauugcuaaugugccuauacugauucuugggaauaagaucgacagaccugaagc

SEQ ID NO: 133229 - RNA, 61 nt, Homo sapiens
acucacauugguuccaggucucaacguucaggcuuacucagagauuugauugcucaacaug

SEQ ID NO: 133230 - RNA, 63 nt, Homo sapiens
gaguaucacaauguuagcuuucuaauuccauaaaaguacuugguuuuuacaguuuauaaucug

SEQ ID NO: 133231 - RNA, 45 nt, Homo sapiens
ccucaauuucaaauuaugucuaauuaaagagaaaauaggcccaga

SEQ ID NO: 133232 - RNA, 42 nt, Homo sapiens
ugcuuuguuccuucuacuuugcuguuccuuccacucuuugag

SEQ ID NO: 133233 - RNA, 50 nt, Homo sapiens
cucucuagaaacaguaggcaaauuuuacuuuaaauaaaauuuugcuucaa

SEQ ID NO: 133234 - RNA, 39 nt, Homo sapiens
agcuguguuaauuggaacaugaucuacaguuugggagug

SEQ ID NO: 133235 - RNA, 42 nt, Homo sapiens
caaaggaucaguauuugaaagggaaaaaccugucaguuucag

SEQ ID NO: 133236 - RNA, 25 nt, Homo sapiens
uauuuugccuuuuuugagaagguaa

SEQ ID NO: 133237 - RNA, 48 nt, Homo sapiens
auucauuuccucugauaaguuggaacaauucuauuugauuucugggag

SEQ ID NO: 133238 - RNA, 49 nt, Homo sapiens
uguucuguuguccacuagucgccauuuccacacauucaucuaucacaag

SEQ ID NO: 133239 - RNA, 29 nt, Homo sapiens
aucuuuguuuucacguuuuucacuacauu

SEQ ID NO: 133240 - RNA, 46 nt, Homo sapiens
ucccagauggcuguggggucaaguauauccccaaucguggcccucu

SEQ ID NO: 133241 - RNA, 38 nt, Homo sapiens
ccccccucuuaauacucaccaauaaauucuacuuccug

SEQ ID NO: 133242 - RNA, 42 nt, Homo sapiens
aagguagaugcaaaguagagaaaagaacuggacccugggggg

SEQ ID NO: 133243 - RNA, 66 nt, Homo sapiens
agaguaugcuuggaaacuacgaugaaaugaaggauuucauaggagacagaucuauaccaaagcuug

SEQ ID NO: 133244 - RNA, 54 nt, Homo sapiens
uugcaauucccaagccuacaguaccaccaucagcagaugaaaaaucuaacccaa

SEQ ID NO: 133245 - RNA, 46 nt, Homo sapiens
aauuaauccaaagauucuaaccaguguacugauuuagaguaguggg

SEQ ID NO: 133246 - RNA, 70 nt, Homo sapiens
ucaggaagugaaauucuauuaaaaaucaaagcauuuuaagggaauaaagagcaauuaugugcagguggcu

SEQ ID NO: 133247 - RNA, 33 nt, Homo sapiens
ucuuaccagaccucacccagacauauuuggcau

SEQ ID NO: 133248 - RNA, 45 nt, Homo sapiens
uacaccaugcaaaacagaaccuuccaaauuuccuuuuccaacuaa

SEQ ID NO: 133249 - RNA, 49 nt, Homo sapiens
gacuaaaaucauauggauuaaaaauugucuugccauuccuauucuagug

SEQ ID NO: 133250 - RNA, 45 nt, Homo sapiens
aacugagagcaucuuggaucaagagguauuaagaaagcuuugaag

SEQ ID NO: 133251 - RNA, 34 nt, Homo sapiens
guugcuaauguauauaaaauauugggagcaggga

SEQ ID NO: 133252 - RNA, 33 nt, Homo sapiens
cuaauuuuuaugaucuaauggguaguagugggu

SEQ ID NO: 133253 - RNA, 41 nt, Homo sapiens
acugucuuuaaguuuucuuauuuuuauuuuguugguagaag

SEQ ID NO: 133254 - RNA, 450 nt, Homo sapiens
uaguauuuguguguauguguuuuaauugauuugaaguuugaucaacggagauuuuggaacuugggaguuuuuuuuguuuuguuuuguuuuuuugagacagagucucgcucugucgccuaggcuggagugcagugaugggaugucggcucacugcaaccuccagcucccggguucaagcaauucuccuccuaccucauccuccuggguagcuaggauuacaggugcccaccaccacgccaggcuaauuuuuguauuuuuaguagagacaggguuucacccuguuggccuggcuggucucgaacucaugacuucaggugauccgccaaccucagccucccaaaguagugggauuacaggcaugagccaccgcacccagccagaacuucaaaguuuuaaaaauauauacauagccauuucugcuauauagccaggacuuuuacccaaaauauu

SEQ ID NO: 133255 - RNA, 34 nt, Homo sapiens
acugaauuaugagaguuuauagaaaguagcuuuu

SEQ ID NO: 133256 - RNA, 47 nt, Homo sapiens
gaagaacuguaggcaaaaaacaacccaaaaaggcugagaaggcagcu

SEQ ID NO: 133257 - RNA, 52 nt, Homo sapiens
gucuuccccucgaccuacagcagagaaaaagaaauauaagucaacaaguaaa

SEQ ID NO: 133258 - RNA, 84 nt, Homo sapiens
cugaaucuuuugacuagaauaccaggaaagccuuacaaagaaacagagccgcccaagggggaaaagaaaaaugugccagaaaag

SEQ ID NO: 133259 - RNA, 84 nt, Homo sapiens
agagagcagcagcuugcaaauuggcauuugcaacauucucaacauuuugguuuuagguguuuuuaguuuggauauguacucccc

SEQ ID NO: 133260 - RNA, 96 nt, Homo sapiens
uagaaugaagaugauaaccgagccagugagagcaagaaacccaaaacggaggacaagaauucagcaggccauaagccauccagcaacagagaguac

SEQ ID NO: 133261 - RNA, 46 nt, Homo sapiens
ccuuaaagucaagcaguaacagcaacaaggagacgaguggcagcag

SEQ ID NO: 133262 - RNA, 46 nt, Homo sapiens
agcuaaagaauuacuuggcaccagaugcuacagcugcagauaaacg

SEQ ID NO: 133263 - RNA, 60 nt, Homo sapiens
ucugaccauacauucuguuuaaaauguugcaugacuuagggaacaaauguaacuugagag

SEQ ID NO: 133264 - RNA, 49 nt, Homo sapiens
gauaaaguaaugggcccucucaucuuuaaugcaagcaucaugacagauc

SEQ ID NO: 133265 - RNA, 49 nt, Homo sapiens
uccacaacacugugucacaucacgaaggaaaacugccauaacauaccac

SEQ ID NO: 133266 - RNA, 33 nt, Homo sapiens
gcauucuacauguauguacuaugaaaugugucu

SEQ ID NO: 133267 - RNA, 50 nt, Homo sapiens
agcuugcauuuaaugcauuacaaaagagggaggacaaacuuucuagaaga

SEQ ID NO: 133268 - RNA, 47 nt, Homo sapiens
cacuuaaucgaaacagaauaaguuacuguggaaaaaaggaugaucca

SEQ ID NO: 133269 - RNA, 125 nt, Homo sapiens
guuauuuuucagauuuuucccccucauacuggauugugaugcucugauaugagcaugcaaugacugauacagaaauaggcuggagcuucggugugugcuuuugcuauacagcuuacaguucuaau

SEQ ID NO: 133270 - RNA, 46 nt, Homo sapiens
cuuuacaggugaccuuccccccucccuccucaauagguguccucag

SEQ ID NO: 133271 - RNA, 47 nt, Homo sapiens
ccugggccagacugggcugggcugugggaagcauuccccuucagggg

SEQ ID NO: 133272 - RNA, 46 nt, Homo sapiens
aaaaaauuguuguucguuucuuuucauuaaagguuuaaucagacag

SEQ ID NO: 133273 - RNA, 39 nt, Homo sapiens
uuucuucaugaaugagcuugcauucugaagcaagagccu

SEQ ID NO: 133274 - RNA, 45 nt, Homo sapiens
uuugagcccuucuguagugucguagggcucuuacagggugggaaa

SEQ ID NO: 133275 - RNA, 47 nt, Homo sapiens
uggaacauaaauuucauuucagcuuuaugcauuaauguauugaagag

SEQ ID NO: 133276 - RNA, 45 nt, Homo sapiens
agaaauucacuuuagaccucuagaccccaaaaccaaguuagcaag

SEQ ID NO: 133277 - RNA, 88 nt, Homo sapiens
aaauuuuguauauggaggauggaaaugcuuauauauuuauugaaaauccuuuuauuugaaauuaaaauuauuugguauauaauuguuu

SEQ ID NO: 133278 - RNA, 48 nt, Homo sapiens
gauuuuuauuuguugcaauacauuacaauuucagagguacuuuggggc

SEQ ID NO: 133279 - RNA, 46 nt, Homo sapiens; identical to SEQ ID NO: 35017

SEQ ID NO: 133280 - RNA, 45 nt, Homo sapiens
cugugucauuaagaugcuuuguacaaugccaaaccauaguuggag

SEQ ID NO: 133281 - RNA, 33 nt, Homo sapiens
ucuuugcccuuacagauagauggcuccccaaua

SEQ ID NO: 133282 - RNA, 45 nt, Homo sapiens
uucuuccucuuggaucucucgaacucuucagucccccauguguag

SEQ ID NO: 133283 - RNA, 34 nt, Homo sapiens
agaaauucccgccgccccccgcccgccccagaau

SEQ ID NO: 133284 - RNA, 23 nt, Homo sapiens
uugccuaugcggccguggcggug

SEQ ID NO: 133285 - RNA, 56 nt, Homo sapiens
aacgggacccuucugugugccagaaaccgcaagcaguugcuaacccagugggacag

SEQ ID NO: 133286 - RNA, 26 nt, Homo sapiens
agaguuggaggcagcggggagccgug

SEQ ID NO: 133287 - RNA, 18 nt, Homo sapiens
gaaacucugggugucugc

SEQ ID NO: 133288 - RNA, 35 nt, Homo sapiens
agcugggccaacaaaauggaagccuugacuagcaa

SEQ ID NO: 133289 - RNA, 38 nt, Homo sapiens
acacccuacacucccaccaucaucugguuccuuuggaa

SEQ ID NO: 133290 - RNA, 59 nt, Homo sapiens
aucuuuaguucauucucaggguuauucauugucuguucuuucuggguaggugcucccug

SEQ ID NO: 133291 - RNA, 45 nt, Homo sapiens
uggaugacugcuuugggaugggccgcucggccuacaaugaagggg

SEQ ID NO: 133292 - RNA, 76 nt, Homo sapiens
gagcuggagggaaucugcgguacuuugagcaguuauuggaggaagagagagaaaaaacguuaacaaaucagacaga

SEQ ID NO: 133293 - RNA, 87 nt, Homo sapiens
agcugagcuagcaaccccagaaggcaucuaugagaggccuguggacuaccugccugagagggauguuuacgagagccucugucgugg

SEQ ID NO: 133294 - RNA, 46 nt, Homo sapiens
agguuucuccccugucccagcccuucagaccuacucaagucuucac

SEQ ID NO: 133295 - RNA, 49 nt, Homo sapiens
cgucagguacuacgaugucaugucugaugaggaaaucgagaggaucaag

SEQ ID NO: 133296 - RNA, 46 nt, Homo sapiens
ccuucugccaccaccuggcccgggccaccaucaucucuugcccuga

SEQ ID NO: 133297 - RNA, 46 nt, Homo sapiens
aaucgucggaugcagcauaucacaggguuaacaguaaagacugcag

SEQ ID NO: 133298 - RNA, 46 nt, Homo sapiens
ugcugccugcccugugcuugugggcugcaaguggggugagugucuu

SEQ ID NO: 133299 - RNA, 55 nt, Homo sapiens
uugacugacauccuuuucuguccuuccccuuccugguccuucagcccaugucaac

SEQ ID NO: 133300 - RNA, 44 nt, Homo sapiens
ucuaucuauuguggcuuuaccaaaaaauaaaaugucccuaccag

SEQ ID NO: 133301 - RNA, 38 nt, Homo sapiens
gcaauaaauaaauaaauacauacauacauaaauaaaua

SEQ ID NO: 133302 - RNA, 27 nt, Homo sapiens
aguguuacaggcuuuguuaauuuuuca

SEQ ID NO: 133303 - RNA, 43 nt, Homo sapiens
cauaucgauuucuaugugcuuaucuaagauucuugagcuggag

SEQ ID NO: 133304 - RNA, 41 nt, Homo sapiens
auuugcuuuaaaauaucugaaaauuuuaaaugccaagauuu

SEQ ID NO: 133305 - RNA, 32 nt, Homo sapiens
uggaauauuauauacugucuuucucagcucuu

SEQ ID NO: 133306 - RNA, 51 nt, Homo sapiens
uguaacuuugguaguugugagcagugaaagauguagagaagcuguugggga

SEQ ID NO: 133307 - RNA, 45 nt, Homo sapiens
guucuguuccauuggucuauaugucugucuuaaugucaguaccuu

SEQ ID NO: 133308 - RNA, 27 nt, Homo sapiens
auuauguuaguuaauuuguaaugcuaa

SEQ ID NO: 133309 - RNA, 57 nt, Homo sapiens
aggauuggcuauucaauuaggagaaaaaacaagaguguauucuuuuggggaaagcca

SEQ ID NO: 133310 - RNA, 46 nt, Homo sapiens
aaagcaaugagauccacaggaaugguuguggaaaaaaaaccuccag

SEQ ID NO: 133311 - RNA, 41 nt, Homo sapiens
aagagcccugugaacuucccuguuggaaucauucagaccca

SEQ ID NO: 133312 - RNA, 46 nt, Homo sapiens
aucgaaaccaggacuauugaugauguuccauuuaaaacaaguacag

SEQ ID NO: 133313 - RNA, 46 nt, Homo sapiens
ucagacagugcccuuggggauagugaaagugaagauacaggucaug

SEQ ID NO: 133314 - RNA, 45 nt, Homo sapiens
auaaauggacuguucaaguggccaguagccagagacgagugacag

SEQ ID NO: 133315 - RNA, 59 nt, Homo sapiens
guguuuuacaauaauaaaguagauuuuuauuaggagcuuuuaauaacugauuuucauug

SEQ ID NO: 133316 - RNA, 334 nt, Homo sapiens
guguuucagguuuuuuuuuuuuuguaacuuuugucacccaggcugaauugcaguaguaaucauggcucaaugcacccucaaaaccccugggcucaaguagcuaagacuacaggcacgugccaccaugcucggcuaauucuuuuuuuuuuuuuuuuuuuuuaauuuuuguagagacagagucucacuguguugcccaggcugaucucgaacuccuggccucagaugauccuccugccuccaccucccagaauguugcgauuacaaguaugagccaccaugcccagauguguuuuaauuuucagucuuucagcuuagaaauuggggaaccacauag

SEQ ID NO: 133317 - RNA, 46 nt, Homo sapiens
gaaauaguuauucauuaguuuuuaauuuuuaauuucuaagguacag

SEQ ID NO: 133318 - RNA, 54 nt, Homo sapiens
aaacaauacuauauucuuuaaaagugcucagguagccaaggcccuugcuuuugg

SEQ ID NO: 133319 - RNA, 71 nt, Homo sapiens
uuguaauuccuaauccuucuauaauuucuauuaccuucaccauagucauucuuuccuuacgcaaagcccaa

SEQ ID NO: 133320 - RNA, 54 nt, Homo sapiens
ggcauacucuggggaugaucacuuaaaaaaacagauuuuacauaaugccuacuu

SEQ ID NO: 133321 - RNA, 41 nt, Homo sapiens
gugguuguuugcuuaaaaucagaauuguggggugccuuaua

SEQ ID NO: 133322 - RNA, 38 nt, Homo sapiens
uaguggcauaacuauuuaacauaaauaucaggauaugg

SEQ ID NO: 133323 - RNA, 349 nt, Homo sapiens
auuggaacaagugaaguuugauuuuuuuauuauuaugauuuuuuaaauuugagacagagucgcuguugcccaggcuggagggcaguggcaugaucuuggcucacugcaaccugcgccuucuggguucaagcaauucugccuuagccuuccgaauagcugggauuacaggugugugccaccacacccagcuaauuuuuguauuuuuaguaaagacaggguuucaccauguuggcuagacuggucucaggcuccugaccucaagugaucugcccgccuugggcauuacagugcugugauuacagacaugagccacuguaccuggccugagcagguaaaguuuaauuuuaaa

SEQ ID NO: 133324 - RNA, 650 nt, Homo sapiens
uguggaaagagagaggagcuaaaugaugagaacacauggacacauagaggggaacaacacacacuggggcauuuugguggagggugggaggagggagaggaucaggaaaauuaacuaauaggcacuaggcuuaauaccugagugcuaaaauaaucuguauaacaaaucccaugacacaaguuuaccugcguaauaaaccugugcuuguacugcugaacuuaaaauaaaaguuaaaaaaaagagagagaccauauucacauaacuuuuuuuuuuuuaagagacagggucuugccguguugcccaggcuggacguuaacuccugggcucaagugauacucucgccccagcaucccugguagcagggacuacaggcacucgccacugcgcccccucacccccacauaacuuuuauugcaguauauuauuauauuuuauuauuaaucucuucugugccuaauuuauaaauugaacuuuaucauagguauguaaauacagaaaaauacaugacauauauagaauuugguacugucugcaguuucaggcaucuaguggggaucauggaauguaucccccucagauaagggggcaccacuguguuugggugggugccuaggaaauuuuugguaauaucaagaacucugacauuagca

SEQ ID NO: 133325 - RNA, 25 nt, Homo sapiens
gccuguauuuuaguuauuuuuuaac

SEQ ID NO: 133326 - RNA, 47 nt, Homo sapiens
uagguagugguaucucauuuugauuuuauguaucccugaugacuuac

SEQ ID NO: 133327 - RNA, 49 nt, Homo sapiens
uuaccuguuuucuauguauuuccuauuuuuuggccauacugaacaaauu

SEQ ID NO: 133328 - RNA, 45 nt, Homo sapiens
cccuggaaggcucuuauuggcuucuucacuuaauauaguucuacc

SEQ ID NO: 133329 - RNA, 49 nt, Homo sapiens
cucccuuaauggugugacacuaauucagacagauuugcccagggaacca

SEQ ID NO: 133330 - RNA, 76 nt, Homo sapiens
ugauaauuguuuaaagcaacucagauacuaauguauaccaguggucuaagacugauuaugacaguguuccaguugg

SEQ ID NO: 133331 - RNA, 73 nt, Homo sapiens
uagaaaauguaguauuuaaaaguagagaagggacguaauggucaucuuuaugaacaagggauauaaaggaacc

SEQ ID NO: 133332 - RNA, 57 nt, Homo sapiens
aguuaacugugucugauaacugcaaagaugcauuucagauguucauguuaaacaugg

SEQ ID NO: 133333 - RNA, 39 nt, Homo sapiens
ggaaaaggaugaugucaucuucacuuacaagccaaacua

SEQ ID NO: 133334 - RNA, 64 nt, Homo sapiens
uguacagaauuaaaaaucaaaauggauuuuuaaaacugugaaguagaaagggugcucaagccaa

SEQ ID NO: 133335 - RNA, 41 nt, Homo sapiens
auuugcuuugacugauaccguauuaacuguugugcuaccac

SEQ ID NO: 133336 - RNA, 48 nt, Homo sapiens
caguuuuaaaagggguuuggagaggcugccuuuauauaaacacugcag

SEQ ID NO: 133337 - RNA, 46 nt, Homo sapiens
auggcuuuucuuguucgcuguuaugccaauugucuucagccauggg

SEQ ID NO: 133338 - RNA, 37 nt, Homo sapiens
uuucucauugccauuuuuuuuuaauuuaaauaucuaa

SEQ ID NO: 133339 - RNA, 63 nt, Homo sapiens
caaauaaaacuaacaguaggccuuguggacaugugaucuccagcagagcacagaaguucagau

SEQ ID NO: 133340 - RNA, 54 nt, Homo sapiens
uuugcauauuaagucaucaaaaaacagaguuuaauuuaaaguuacagcacaucu

SEQ ID NO: 133341 - RNA, 46 nt, Homo sapiens
augauuuuugaagugguagagcaggcuggagcuauuauucuugaag

SEQ ID NO: 133342 - RNA, 51 nt, Homo sapiens
guugaggaagagggagaaauuguuaugguacaugagcaucgggaacuagac

SEQ ID NO: 133343 - RNA, 46 nt, Homo sapiens
uagaaccugguagcaaagcugcugauucaggacugaaacgugguga

SEQ ID NO: 133344 - RNA, 51 nt, Homo sapiens
uaaaaguauuaugccugcugcuuuuguucucaucuuccagaaagcaugauc

SEQ ID NO: 133345 - RNA, 45 nt, Homo sapiens
cugggccugaccccagacuacucauuaggaaugucuaauagcuag

SEQ ID NO: 133346 - RNA, 49 nt, Homo sapiens
uugaaauuuugaggaauaauacucaucuugcacuuacugugaagaccaa

SEQ ID NO: 133347 - RNA, 57 nt, Homo sapiens
acugaguaaagcauugacuuaaguacuuagugaauuacagauuucuaauaagagcau

SEQ ID NO: 133348 - RNA, 75 nt, Homo sapiens
uauccagcaugugccaggagauauugaacagacaucacaggagaaaggaaguaagaaaguuaaagcaaauacugu

SEQ ID NO: 133349 - RNA, 48 nt, Homo sapiens
gccuccaaagcuauuuagguagguaaugccgaucuuagcuaugcagga

SEQ ID NO: 133350 - RNA, 53 nt, Homo sapiens
cuuauuuucucuuaccuaaccuuagaacauuuaacucuaaccuuuaggaauac

SEQ ID NO: 133351 - RNA, 47 nt, Homo sapiens
cuggcuauaaugcccaucccuggaacacucucauccagcagcccuga

SEQ ID NO: 133352 - RNA, 46 nt, Homo sapiens
ucaguaccacuggcuaaggcucagcccccaaagaucuaguaaaaug

SEQ ID NO: 133353 - RNA, 17 nt, Homo sapiens
ugaacauugguccagag

SEQ ID NO: 133354 - RNA, 26 nt, Homo sapiens
guguuacaaauaaauaaaauauggaa

SEQ ID NO: 133355 - RNA, 27 nt, Homo sapiens
cauuuauaauaauagaaagugguaagc

SEQ ID NO: 133356 - RNA, 46 nt, Homo sapiens
uacuuaaaaaauaacauggaaacagaaaccuuauguucagaugaag

SEQ ID NO: 133357 - RNA, 46 nt, Homo sapiens
ugccucagaaauuuuaacugaagcaaaucagcucaaacgaaugaag

SEQ ID NO: 133358 - RNA, 44 nt, Homo sapiens
uacaaggacuuaaguugcuuuuccuuuuaccucaaaagacaggg

SEQ ID NO: 133359 - RNA, 34 nt, Homo sapiens
aagaaggguuuguuugguuuuuuguuguaugucc

SEQ ID NO: 133360 - RNA, 23 nt, Homo sapiens
uuuuccuuaagcuucuuauuuau

SEQ ID NO: 133361 - RNA, 50 nt, Homo sapiens
ugagaacacaaccagaaaaagaaugacauccccguuuagaagacuuaggg

SEQ ID NO: 133362 - RNA, 48 nt, Homo sapiens
cacaggguuucuugucaguccuuugggaaaugggagggaguaguuugg

SEQ ID NO: 133363 - RNA, 64 nt, Homo sapiens
agggugauaaaucacaucauugcgaucuauaucaccuccuugagaaucucucccaggcugaaaa

SEQ ID NO: 133364 - RNA, 36 nt, Homo sapiens
uugucauaacaacaauaauaaaauaauuuuucugaa

SEQ ID NO: 133365 - RNA, 361 nt, Homo sapiens
ucccacagcgacuucauaagaagucuuuccuggacaggcacgguggcucacaccuguaaucccagcacuuugggaggccgaggaggguugaucacgaggucaggagaucgagacuguccuggcuaacacggugaaacccugucucuacuaaaaauacaaaaaaauagcugggcgugguggcggacgccuguggucccagcuacucaggaggcugaggcaggagaauggcgugaaccugggaggcggagcuugcaaugagccgagauugcgccacugcacuccagccugggcaauagagugagacuccaucucaaaaaaaaaaaaaaaaaaaaagaagucuuuccccuccccacugguaugc

SEQ ID NO: 133366 - RNA, 26 nt, Homo sapiens
cuaaaaauugcaacaaccacaugguu

SEQ ID NO: 133367 - RNA, 44 nt, Homo sapiens
ugugucuucucugcagcacucuggggaaggauaaauggacucag

SEQ ID NO: 133368 - RNA, 47 nt, Homo sapiens
gggcuuucccugcaaccaauuuggaaaacaggaaccaggagagaacu

SEQ ID NO: 133369 - RNA, 58 nt, Homo sapiens
agggacaagagagggagaaggacagggacaacugguugugaugugcauccgcagggag

SEQ ID NO: 133370 - RNA, 29 nt, Homo sapiens
ucuuugagaaaggggaugucaauggagag

SEQ ID NO: 133371 - RNA, 39 nt, Homo sapiens
caggcagcccugggggucaagaggaaguaacugaaggcc

SEQ ID NO: 133372 - RNA, 47 nt, Homo sapiens
uucaggaagaaauccgugucuccaaccacacuaucuacccaucacag

SEQ ID NO: 133373 - RNA, 69 nt, Homo sapiens
gugacaacccuuucucuccaguucuccacuccaaugauaauaguucacuuacaccuaaacccaaaggaa

SEQ ID NO: 133374 - RNA, 91 nt, Homo sapiens
acugauaccucaaccuuggggccagcaucucccacugccuccaaauauuaguaacuaugacugacguccccagaaguuucugggucuacca

SEQ ID NO: 133375 - RNA, 44 nt, Homo sapiens
ugcccucaccccucacugguccacuggcuugagacucaccccgu

SEQ ID NO: 133376 - RNA, 48 nt, Homo sapiens
uggauuucgaaccccuccacaggguagacgccagguguauuccggcug

SEQ ID NO: 133377 - RNA, 32 nt, Homo sapiens
gaaaaugggacaagugacagcagaucuuugga

SEQ ID NO: 133378 - RNA, 46 nt, Homo sapiens
ggggagaggagcggaggggaggggaggggagaggaaaggaaaggaa

SEQ ID NO: 133379 - RNA, 46 nt, Homo sapiens
cuuaggagggccccugcuccuucugggcucccaaaugcuguuggug

SEQ ID NO: 133380 - RNA, 35 nt, Homo sapiens
aggugaggcacaaggggaagagugcaccuccagag

SEQ ID NO: 133381 - RNA, 45 nt, Homo sapiens
ccacucugaagaauuuaaccaauagaaacacuuacacaagugugc

SEQ ID NO: 133382 - RNA, 19 nt, Homo sapiens
ccugccugaacccacacac

SEQ ID NO: 133383 - RNA, 38 nt, Homo sapiens
uuuaaaugcuuucaugagcuccauuauuucucagggug

SEQ ID NO: 133384 - RNA, 56 nt, Homo sapiens
uuucccuuagcccacgccucccucuuggaccugaguccugucauccugguuuccgg

SEQ ID NO: 133385 - RNA, 60 nt, Homo sapiens
uuucucuuagcagccucaaugcacuguuggcuuguuuggaacaggaguccaaauaaacag

SEQ ID NO: 133386 - RNA, 57 nt, Homo sapiens
gguuugggggcucggcaccuuccucccaaggucaccacccccaagacaaaaacuguu

SEQ ID NO: 133387 - RNA, 66 nt, Homo sapiens
uccuugucaggcacugcauuaaauguuucagauauacaaucuuggaggagcugcacaguaacucua

SEQ ID NO: 133388 - RNA, 53 nt, Homo sapiens
cugcugugacucugacccccaccauacucacacagccaggacacagagccaga

SEQ ID NO: 133389 - RNA, 70 nt, Homo sapiens
agaaaaagacuggccaagaaggcaaggccagaagaagaggggcaggaagaaggaacgagaugggggagag

SEQ ID NO: 133390 - RNA, 68 nt, Homo sapiens
uuacuccugacccccacuccuuaugucccccaugauaaggccugcugccucaucucuuccccugcucg

SEQ ID NO: 133391 - RNA, 45 nt, Homo sapiens
gcuggccgcuaugagguggagucuggcuagaggcugcuagcucac

SEQ ID NO: 133392 - RNA, 52 nt, Homo sapiens
agugaugggaguguugaaggugggcaucagcuugggggugugggacuggcag

SEQ ID NO: 133393 - RNA, 45 nt, Homo sapiens
gccuuuuccuagcagagucauuguguuuccauuacuguuccucaa

SEQ ID NO: 133394 - RNA, 47 nt, Homo sapiens
gugcuugacauguuaauuccuacuggggagcccugcccagagccccu

SEQ ID NO: 133395 - RNA, 82 nt, Homo sapiens
gcccagggcaucugcugggcugaccacguuacucauccccguuaacauucucucuaaagagccucguucauuuccaaagcag

SEQ ID NO: 133396 - RNA, 44 nt, Homo sapiens
gaaucuuuaugacucucucucuuucacucuuuuuuuuuuuuguc

SEQ ID NO: 133397 - RNA, 57 nt, Homo sapiens
ccuggucuccaguuggaaauauaauuaaggguggcaaggacuggagucaguuggaga

SEQ ID NO: 133398 - RNA, 157 nt, Homo sapiens
uggcuaaacucuucagaaguuacuuuagcucgucuauccuuucaaaaugugauucccaggacugagagagcucccaagcguggucugaucuaggaguagaaaugaaguucucuccucccaugagccuaacacaauacuuuugcuaauguagccucag

SEQ ID NO: 133399 - RNA, 45 nt, Homo sapiens
ucacaaauccuucaaaauaaaaaguaaugacuuagaaacugccuu

SEQ ID NO: 133400 - RNA, 45 nt, Homo sapiens
ucuucuauuaaucaagagaaacuucaaaguuaaugggauggucgg

SEQ ID NO: 133401 - RNA, 68 nt, Homo sapiens
uagggacugccaggcuguuucagccaggaaggccaaaaucaagagugagauguagaaaguuguaaaau

SEQ ID NO: 133402 - RNA, 118 nt, Homo sapiens
aguggugggagagaucccugcagaacccaccaaccagaacgugguuugccugaggcuguaacugagagaaagauucuggggcuguguuaugaaaauauagacauucucacauaagccc

SEQ ID NO: 133403 - RNA, 136 nt, Homo sapiens
uuaccgagucagacuuuguguucauuucauuucagggucuuggcugccugugggcuuccccagguggccuggaggugggcaaagggaaguaacagacacacgauguugucaaggaugguuuugggacuagaggcuc

SEQ ID NO: 133404 - RNA, 84 nt, Homo sapiens
guggacacggaucugcugggcucugccuuaaacacacauugcagcuucaacuuuucucuuuaguguucuguuugaaacuaauac

SEQ ID NO: 133405 - RNA, 74 nt, Homo sapiens
aggugcuaacauagauuuaagugaauacauuaacggugcuaaaaaugaaaauucuaacccaagacaugacauuc

SEQ ID NO: 133406 - RNA, 46 nt, Homo sapiens
uaccggauucucucuuuaacccuccccuucguguuucccccaaugu

SEQ ID NO: 133407 - RNA, 47 nt, Homo sapiens
cauggagcauugcaccacccgcuuuuucgagaccugugaccuggaca

SEQ ID NO: 133408 - RNA, 61 nt, Homo sapiens
gauuucuuuggugagcuggguggggcugcgaggucuagagguuaagaagacaacuggaguc

SEQ ID NO: 133409 - RNA, 48 nt, Homo sapiens
ucgcucuuuguccagccugugugccuggagucugccaacccugccagu

SEQ ID NO: 133410 - RNA, 52 nt, Homo sapiens
aaugagaagcgccuggaggcaggagaccaccccguggagcugcuggcccggg

SEQ ID NO: 133411 - RNA, 46 nt, Homo sapiens
cccuguaugagagggaugaggacaacaaccuucugacugagaagca

SEQ ID NO: 133412 - RNA, 52 nt, Homo sapiens; identical to SEQ ID NO: 35259

SEQ ID NO: 133413 - RNA, 68 nt, Homo sapiens
ggaugagaacaacacccccaugugcgugugccaggaccccaccagcugcccagcccccauuggcgagu

SEQ ID NO: 133414 - RNA, 84 nt, Homo sapiens
gguaucugugggagcuaauccuguccagguggaaguaggagaauuugaugauggugcagaggaaaccgaagaggaggugguggc

SEQ ID NO: 133415 - RNA, 31 nt, Homo sapiens
gaggaggcgacagaggaggaagaggagagau

SEQ ID NO: 133416 - RNA, 57 nt, Homo sapiens
guuuuccaaaagggacuuugcacgaacaaucaguugaucucugaaaggcaaaggggg

SEQ ID NO: 133417 - RNA, 42 nt, Homo sapiens
cuaaaccccuccacauucccgcgguccuucagacugcccgga

SEQ ID NO: 133418 - RNA, 76 nt, Homo sapiens
caugccgggugaugguguuccugcggagacccucaguuguccuauuccuuccuagcuucccugcaauaaaaucaag

SEQ ID NO: 133419 - RNA, 49 nt, Homo sapiens
acccugaagaaaacaggaaagacuguuuccuaccuuggccuugaguagc

SEQ ID NO: 133420 - RNA, 28 nt, Homo sapiens
auuaaauaacuuaucugggaucacaugg

SEQ ID NO: 133421 - RNA, 40 nt, Homo sapiens
gcuuugacaggaaccaccagagugugaugauaaagaacac

SEQ ID NO: 133422 - RNA, 49 nt, Homo sapiens
ggggacccccaaaaugucccagaggcuauuggugcccaguguccugagg

SEQ ID NO: 133423 - RNA, 41 nt, Homo sapiens
auuucaggcuuucuuacgggauuucucuggucccaugagaa

SEQ ID NO: 133424 - RNA, 46 nt, Homo sapiens
cgcagcgcucgccguccucgaugaggcagcagcucuggccguagcc

SEQ ID NO: 133425 - RNA, 39 nt, Homo sapiens
ucugggccuguuucaacccuaaaaucagaggggaaacgu

SEQ ID NO: 133426 - RNA, 43 nt, Homo sapiens
ggaggagcagggucugauaaagcacugagaaacgguagggaau

SEQ ID NO: 133427 - RNA, 43 nt, Homo sapiens
auugguuuuuaaaacaucuuaaaacaacaugaauggcaggaua

SEQ ID NO: 133428 - RNA, 65 nt, Homo sapiens
gaagaacuggauccuagaauacaggugagagcacugagagcagggagagaaggagagcccagauu

SEQ ID NO: 133429 - RNA, 44 nt, Homo sapiens
uaggacaggcagaucuuuguguaggagaccuggggguagucagu

SEQ ID NO: 133430 - RNA, 83 nt, Homo sapiens
gugaguugggaagaaaucaaagccaguccuggcauucuuccuucacucucuguguggguuccugggauaugugugugugugug

SEQ ID NO: 133431 - RNA, 131 nt, Homo sapiens
gaccugcugcugacuugcuggguuuccuuacaggcugccaccucuauguccugaauucucaggucucacgguccugagaggugauaagugugcaguaaacaugugcugacugaguggcccugcccuggccc

SEQ ID NO: 133432 - RNA, 76 nt, Homo sapiens
ccagggugaggccuccggcuagcgguggggaagggugguggcacacauguuccaaaugaccuugcaggagugagag

SEQ ID NO: 133433 - RNA, 41 nt, Homo sapiens
ccguggcccuucguaaccuggagcagaucagcgagcagauu

SEQ ID NO: 133434 - RNA, 41 nt, Homo sapiens
cgaggacauggaggacggagacagcgggauugagggggccg

SEQ ID NO: 133435 - RNA, 53 nt, Homo sapiens
agugcuucccugggagaggccagcuguguucgaguccucugugccugcccugg

SEQ ID NO: 133436 - RNA, 101 nt, Homo sapiens
cagaucugggugccuugggagaaccaguccuuccuuuugacccaccccaggaagauggagugcucuuuucuaggcccauguucugccagcaaccgggaugc

SEQ ID NO: 133437 - RNA, 87 nt, Homo sapiens
augagaaccucgggguuugagguggccaugggcagacagccgaaagggagggagggugugggugugcgugugugcaugugcuggugu

SEQ ID NO: 133438 - RNA, 47 nt, Homo sapiens
aaaaguacauggggcuguggaggugggcgucacaguguaucagaagg

SEQ ID NO: 133439 - RNA, 44 nt, Homo sapiens
uuccugucagagcaacuguaaagaggguggcaaugacgacaaag

SEQ ID NO: 133440 - RNA, 42 nt, Homo sapiens
uggagagcugacugagcagaaaguacauuggaguguggaguc

SEQ ID NO: 133441 - RNA, 45 nt, Homo sapiens
gacagaaacucagcacuggggacaggauugcaaagucggggacau

SEQ ID NO: 133442 - RNA, 42 nt, Homo sapiens
gcccccaccccacuccugugccucccaggagcccucccugug

SEQ ID NO: 133443 - RNA, 57 nt, Homo sapiens
uaacgccaucaccugagggaugaggauuucagcauggggauuuggggaggacacaga

SEQ ID NO: 133444 - RNA, 42 nt, Homo sapiens
ggcacacuacaacaagcgcuccaccaucacgucccgcgaagu

SEQ ID NO: 133445 - RNA, 44 nt, Homo sapiens
ugcgcccaagaaggguucuaaaaaggcugucaccaaggcacaga

SEQ ID NO: 133446 - RNA, 43 nt, Homo sapiens
agcagcuuguugagcuccucgucguugcggauggccagcugca

SEQ ID NO: 133447 - RNA, 41 nt, Homo sapiens
acccacuagaaagcacccgugaccguccccugcgcccguua

SEQ ID NO: 133448 - RNA, 53 nt, Homo sapiens
ggaggagacgggggcagccgagggcgccggcgaggaagcggaggaggcaggcg

SEQ ID NO: 133449 - RNA, 46 nt, Homo sapiens
uaugugcaugugugugcauaugcacaaguguguaugugccacuguu

SEQ ID NO: 133450 - RNA, 38 nt, Homo sapiens
gaggugccucuggggugggguguagacagauggguggg

SEQ ID NO: 133451 - RNA, 19 nt, Homo sapiens
agggggcggcccuucccua

SEQ ID NO: 133452 - RNA, 48 nt, Homo sapiens
caaauucugcgggugggagagccaggagggcauggggugcauggugag

SEQ ID NO: 133453 - RNA, 46 nt, Homo sapiens
cgggcaggaccaguucaacugggaggacgugaagacugacaagcag

SEQ ID NO: 133454 - RNA, 40 nt, Homo sapiens
gugaagaagcagcccacgggccugagcaaggagguaacuc

SEQ ID NO: 133455 - RNA, 27 nt, Homo sapiens
gaagccgcgggcggaggaucagacgga

SEQ ID NO: 133456 - RNA, 48 nt, Homo sapiens
gcagggggaguuggagucggagucauggugguggugccugggccuggg

SEQ ID NO: 133457 - RNA, 55 nt, Homo sapiens
ccaccaccaugacuccgacuccaacucccccugcuguaagaggaggaagcgggga

SEQ ID NO: 133458 - RNA, 64 nt, Homo sapiens
uacacgauuaguaaucaacuguuuuguauacuuguuuucaguuuucauuucgacaaacaagcac

SEQ ID NO: 133459 - RNA, 42 nt, Homo sapiens
aaccucuacuuuuuucuuuuguauuuugauaaacacugaagc

SEQ ID NO: 133460 - RNA, 100 nt, Homo sapiens
cagugcauuuuuuaaaauaguuaagaauccaagucgagaacacuugaacacacagaagggagaccccgccuagcauagauuugcaguuacggccuggaug

SEQ ID NO: 133461 - RNA, 48 nt, Homo sapiens
acucagcuuuuuuuauuguaaaaagaaaaaucaacucacuguucagug

SEQ ID NO: 133462 - RNA, 58 nt, Homo sapiens
gcagcuucuggcacucacaccacgagccgcacguuugccacaugagaguaaagcagag

SEQ ID NO: 133463 - RNA, 45 nt, Homo sapiens
augaaggacuggacuggcuguccaaucagcuccggaaccagaagu

SEQ ID NO: 133464 - RNA, 45 nt, Homo sapiens
gagcugauuggacagccaguccaguccuucauagagcccgucgcc

SEQ ID NO: 133465 - RNA, 33 nt, Homo sapiens
aggaccuccccaacgccaugaaugcggccgaga

SEQ ID NO: 133466 - RNA, 36 nt, Homo sapiens
cuuguuggcgaacaccaggaggacagcaucccggag

SEQ ID NO: 133467 - RNA, 36 nt, Homo sapiens
cugaucuucgugguggacagcaaugacagagagcgu

SEQ ID NO: 133468 - RNA, 75 nt, Homo sapiens
uucucuggcccugugcugcccagguagagaaggcacuaaccagcaucaggcuuagguaggucacagacacauggu

SEQ ID NO: 133469 - RNA, 30 nt, Homo sapiens
gauacaaaccauauggagagaagcaauaua

SEQ ID NO: 133470 - RNA, 30 nt, Homo sapiens
gacugauauuauuaacucacuuaugcacau

SEQ ID NO: 133471 - RNA, 42 nt, Homo sapiens
gggccucuuaguggaggagcuggguguccuggggucggagga

SEQ ID NO: 133472 - RNA, 46 nt, Homo sapiens
agggcagccaggagaccuugcagccuuaucuuccucacccccgcac

SEQ ID NO: 133473 - RNA, 45 nt, Homo sapiens
cagggcacagcuggagcuaguaaugacucuucacauagucccuga

SEQ ID NO: 133474 - RNA, 42 nt, Homo sapiens
cugcuccaagcagcuacggcaaaacuggugcugacagaccag

SEQ ID NO: 133475 - RNA, 31 nt, Homo sapiens
cagccaaguugcagaaaagcaguugcuuuuu

SEQ ID NO: 133476 - RNA, 46 nt, Homo sapiens
uguggcuucauggccgcugagcccggguuagccagaccaagucagg

SEQ ID NO: 133477 - RNA, 46 nt, Homo sapiens
caggagcaguaaaugcaauaaaaucauuugguuauacuuugaacac

SEQ ID NO: 133478 - RNA, 50 nt, Homo sapiens
acguccaagaucaggguguccucagaguuggugccuuccgagagcuguga

SEQ ID NO: 133479 - RNA, 67 nt, Homo sapiens
aaaaacaaagcuuacauuuuaauuuguguugcacaccuaccccauaaugucuuuauaccccaaagau

SEQ ID NO: 133480 - RNA, 45 nt, Homo sapiens
gccaaaaaacgggggggaugugccaucaccagguuggacaugcca

SEQ ID NO: 133481 - RNA, 46 nt, Homo sapiens
agugccgguacugcgucaagagcuucacgcagaacuaugaccuccu

SEQ ID NO: 133482 - RNA, 21 nt, Homo sapiens
caggaagcucagaagguauca

SEQ ID NO: 133483 - RNA, 41 nt, Homo sapiens
gcgggcggggcccaccccgggcuccagaugccggagccgcc

SEQ ID NO: 133484 - RNA, 13 nt, Homo sapiens
gagggaccgagcu

SEQ ID NO: 133485 - RNA, 46 nt, Homo sapiens
cgggggagcgaaccacugagaugcggagaccuccccaguccuagag

SEQ ID NO: 133486 - RNA, 46 nt, Homo sapiens
gcccggaacggccgaccgggagucgcggcuggggauggaagcugga

SEQ ID NO: 133487 - RNA, 56 nt, Homo sapiens
cgaaauuggauucuccuacgcagaggagaagguggagaagauucuccgucuuccgg

SEQ ID NO: 133488 - RNA, 59 nt, Homo sapiens
aucuccugcuaaagucagaaugugaacacugacaaacagcggcucccaguaacucugcu

SEQ ID NO: 133489 - RNA, 31 nt, Homo sapiens
ugaacagugggaggcacagcugggcagggac

SEQ ID NO: 133490 - RNA, 47 nt, Homo sapiens
uuaaauccugcccuaugaauuccuagccaggugaccucaggccuaca

SEQ ID NO: 133491 - RNA, 30 nt, Homo sapiens
aguauuauuauucuaaaagauaaugaguuc

SEQ ID NO: 133492 - RNA, 39 nt, Homo sapiens
uucuaagugggauugcacagaaaaaaauaaaucuaagac

SEQ ID NO: 133493 - RNA, 49 nt, Homo sapiens
aauuagacaguguuuaauuuucaaaaacuucccucucuagucgguagau

SEQ ID NO: 133494 - RNA, 42 nt, Homo sapiens
aucccucugcccuccccagguuaagaagaggaaggagggaga

SEQ ID NO: 133495 - RNA, 45 nt, Homo sapiens
ccuucagggcacaacuggaaugguaguuucugaaauaaugagugg

SEQ ID NO: 133496 - RNA, 65 nt, Homo sapiens
uuacaaucaaggcauucucuccagaucagugcuggugaggauggaaggaaucagacucuagggac

SEQ ID NO: 133497 - RNA, 45 nt, Homo sapiens
caugggagugagugugagcacucaggaggcugcauagagugaaag

SEQ ID NO: 133498 - RNA, 43 nt, Homo sapiens
agaguagugugcugauggaauggggaguuccugagccccccau

SEQ ID NO: 133499 - RNA, 86 nt, Homo sapiens
gggucaucucuggggccauuuggggcagguucgaaaacucugcccuagauuuugugcuuuuuccaguuuuagcaauugaggcaguc

SEQ ID NO: 133500 - RNA, 51 nt, Homo sapiens
gaugggccugccggauccuuugaaccucuaccuacuauauugugucauagc

SEQ ID NO: 133501 - RNA, 45 nt, Homo sapiens
gugcuaggugcugggagcugcuggcagagggcccacagagcccca

SEQ ID NO: 133502 - RNA, 27 nt, Homo sapiens
ggaggugagccaauugcagucugcagg

SEQ ID NO: 133503 - RNA, 43 nt, Homo sapiens
gcacccagccuugaugucuuugcacagguaggaaagaguccuu

SEQ ID NO: 133504 - RNA, 41 nt, Homo sapiens
ccaguguucgucggcccuggcaggcuuguucugaaagagaa

SEQ ID NO: 133505 - RNA, 47 nt, Homo sapiens
acaaccuugaagucucccaugauuuacaagcuuagaaagagggccag

SEQ ID NO: 133506 - RNA, 64 nt, Homo sapiens
ugcccucuuuggugccggauugcgcaauaugucugacuaccuuucuccccacccacugcagucu

SEQ ID NO: 133507 - RNA, 53 nt, Homo sapiens
uuuauuaagauaaaauucacacgucauacguuuaacccauuuaaaugauacaa

SEQ ID NO: 133508 - RNA, 48 nt, Homo sapiens
cuggggacaguggcuucgggaagcccuuucugcucggggacuucugcu

SEQ ID NO: 133509 - RNA, 46 nt, Homo sapiens
accacacagauguuuaagacuaaguuuguggucuuugagaaccgag

SEQ ID NO: 133510 - RNA, 38 nt, Homo sapiens
aguggugacuuccuuccagagagcacagggguggggag

SEQ ID NO: 133511 - RNA, 42 nt, Homo sapiens
guuuuugccuuuuauuaaugcuucugaaauccuuuuuggaag

SEQ ID NO: 133512 - RNA, 72 nt, Homo sapiens
gugguccauggaguuuccucagcaaacaagagaguccaccucagagagacaagaugccuugucuagggaggu

SEQ ID NO: 133513 - RNA, 28 nt, Homo sapiens
cugagaaaguccccaccaccaaguccac

SEQ ID NO: 133514 - RNA, 46 nt, Homo sapiens
agaacucgggcccggagcccuggcagggaggagguggcccgucugu

SEQ ID NO: 133515 - RNA, 55 nt, Homo sapiens
auuucuauucucugaaguggcauggaggcagggagucccuagagcuacauguggu

SEQ ID NO: 133516 - RNA, 139 nt, Homo sapiens
ucacccuggcagucccagggugggcaaagggcacugagagguucagaggcagacaggcaugcccaggaaggugggggcagcacagguuccucucucaaggacaugcucccuggggagccacagccccaggaaaccugag

SEQ ID NO: 133517 - RNA, 54 nt, Homo sapiens
cugcugccgaagaagaugagggcccaugcccugcccugcccuuguucuccagag

SEQ ID NO: 133518 - RNA, 43 nt, Homo sapiens
guuccucagccagguuuauggauagacuuacagacuucuggag

SEQ ID NO: 133519 - RNA, 47 nt, Homo sapiens
ggggcuuucuaggccccaguguugggcagaggagcccucauccugga

SEQ ID NO: 133520 - RNA, 63 nt, Homo sapiens
ggguguccuggaacuccagcagcuuccuuagcuuccugcucucacaaugccgcggccucugcu

SEQ ID NO: 133521 - RNA, 45 nt, Homo sapiens
gugauugaaaaguuugaggccuuggacauugagaaggcagagcac

SEQ ID NO: 133522 - RNA, 52 nt, Homo sapiens
agaacagccacaacuaccugaaaaagcuauuaaaaauacuuccuuuguuguc

SEQ ID NO: 133523 - RNA, 45 nt, Homo sapiens
gauccagaccaucaugaagcacgugcacccgaccacugccccgga

SEQ ID NO: 133524 - RNA, 52 nt, Homo sapiens
agaccugcccgaggccuacugagaagcaagaggcagagcugggggagccgga

SEQ ID NO: 133525 - RNA, 45 nt, Homo sapiens
agccagcaacugggcgccagugagcaggcgcagcggcugauggag

SEQ ID NO: 133526 - RNA, 46 nt, Homo sapiens
agacccugcagaaggagaagcugagcgccacuuucgagggcaguga

SEQ ID NO: 133527 - RNA, 24 nt, Homo sapiens
cagagggucuccagccagcugcag

SEQ ID NO: 133528 - RNA, 46 nt, Homo sapiens
gguugccuuggggagcagcuuagaggaaacagaaauuaagcuccag

SEQ ID NO: 133529 - RNA, 42 nt, Homo sapiens
ccugggagccuaccaaaccccagacuuugaaagagugaugca

SEQ ID NO: 133530 - RNA, 50 nt, Homo sapiens
agucccaacccccagcucccagaaguggacucuauguacccccaacccac

SEQ ID NO: 133531 - RNA, 47 nt, Homo sapiens
agccaucgaagccaugaagaacgcccaccgggaggaaauggagcggg

SEQ ID NO: 133532 - RNA, 40 nt, Homo sapiens
gguaacauuuccugauucucgcgggcuugguccccagaga

SEQ ID NO: 133533 - RNA, 90 nt, Homo sapiens
ccgggccuggagauuauccugccauguccugauggcugugcccguguccuuaggccccgugguuuuuccucucuguccacugucugccuc

SEQ ID NO: 133534 - RNA, 45 nt, Homo sapiens
agacagauccugugucacccggcaacucagaaacaucagguccaa

SEQ ID NO: 133535 - RNA, 40 nt, Homo sapiens
acaggaagucaacacagcagagagugguguggacaaccca

SEQ ID NO: 133536 - RNA, 27 nt, Homo sapiens
ugggggcugggagggcaucuguguuag

SEQ ID NO: 133537 - RNA, 40 nt, Homo sapiens
gccccguuuccacaccagcacauggugagacaggguagcu

SEQ ID NO: 133538 - RNA, 45 nt, Homo sapiens
gccagacuagcgggugaggagucagugcugugacccaggccaagc

SEQ ID NO: 133539 - RNA, 65 nt, Homo sapiens
agcauuuuguauuuguuccacugaugcagcuuagaaccacaccccugagagucguggcaaaccuu

SEQ ID NO: 133540 - RNA, 69 nt, Homo sapiens
ucacaaccuggaaaauguugaaagcaaccauuccuauuuuuguuuguuuuuuauuaaaucuugcacaaa

SEQ ID NO: 133541 - RNA, 59 nt, Homo sapiens
aaacuaacauccauccugagcuaaacaagagaaacuaccaucuuggccagugacaagug

SEQ ID NO: 133542 - RNA, 59 nt, Homo sapiens
gaggucuuuaaaguuauugcuuuauuugguuuuuuaauauacaauaaaauaauuuaaaa

SEQ ID NO: 133543 - RNA, 59 nt, Homo sapiens
aagaccuaagagugagcgcggggugggggagggaugugaaguuauccagccucugcuag

SEQ ID NO: 133544 - RNA, 46 nt, Homo sapiens
cucggccaagaagaacagcagccuggaccagauguuccgcgcgcuc

SEQ ID NO: 133545 - RNA, 47 nt, Homo sapiens
cguuccccgccaugcggcgccucuccauccucacaggugagccgggg

SEQ ID NO: 133546 - RNA, 56 nt, Homo sapiens
ucuguccacuggacaggaagguuugcaaagggcuguuugcuuacugggucccaauu

SEQ ID NO: 133547 - RNA, 17 nt, Homo sapiens
uguccuguggcggugag

SEQ ID NO: 133548 - RNA, 66 nt, Homo sapiens
ccucugcucaaugucaagguuucaggaaauguuuuuccaaggacaucugaggaaggaccauaggau

SEQ ID NO: 133549 - RNA, 39 nt, Homo sapiens
auuuggcacucaaagcuuuucuucaagacucuucuggcc

SEQ ID NO: 133550 - RNA, 42 nt, Homo sapiens
ucggaccccgagcgcagcgacuaugaggagcagcagcugcag

SEQ ID NO: 133551 - RNA, 46 nt, Homo sapiens
accagcccggcggcugcaucgugucucacguggaccccauccacau

SEQ ID NO: 133552 - RNA, 45 nt, Homo sapiens
ugugaagugaaaauuuauuuggaagcggccuccuuccaguccuga

SEQ ID NO: 133553 - RNA, 46 nt, Homo sapiens
aucuucauggcgcuccuagauggaugucuuggcaaaaugcuuuaag

SEQ ID NO: 133554 - RNA, 68 nt, Homo sapiens
agaagcacacugaagggggacaucuuuuccacuuuggaguguuggaaguuuaggggaggaaaugaacu

SEQ ID NO: 133555 - RNA, 53 nt, Homo sapiens
cauagguaagaggggguggauguugaugggaggcagauggaguucauuaguag

SEQ ID NO: 133556 - RNA, 50 nt, Homo sapiens
uuggcugcccuugcugcugccagagccugacaaggcagagggcaguaaaa

SEQ ID NO: 133557 - RNA, 671 nt, Homo sapiens
aagcagagaauaaauaggccauaaaaauuucagagcuggccaggcuuaguggcucaugccuguaaugccagaacuuuggguggccaagguggacggaucaugaggucaggaguuugagaccaaccuggccaacaugguaaaaccccaucucuacuaaaaauacaaaaacuagccgggcaugguagugugcaccucuaaucccagcuacucaggaggcugaggcaggagaaucacuugaacccgggaggcggagguugcaaugagccgagaucgagcccuugcgcuccagccugugcuguagagugagacuccgucucaaaaaaaauaauaaaaaaaaaaauuucaaggccgggcgcgguggcucacgccuguaaucccagcacuuugggaggccgagguggguggaucacgaggucaggacaucgagaccauccuggcuagcauggugaaacccugucucuacuaaaaauacaaaaaacaaaauuagcugggugugguggcgggcgccuguagucccagcuacuugggaugcugaggcggcagaauggcacgaacccgggaggcggagcuugcagugaaccgagaucaugccacugaacuccagccuggcagccugggcgacagagcaagacuccgucucaaaaaaaagaaaaagaaaauucagagcuggc

SEQ ID NO: 133558 - RNA, 75 nt, Homo sapiens
ggcuaguggguguacgugugcccuuuggugaggccagcaaggcccccuggacaggcuugcuaccaggaaacacag

SEQ ID NO: 133559 - RNA, 35 nt, Homo sapiens
aaauccagaaaguuugacagcagacuugguuggag

SEQ ID NO: 133560 - RNA, 44 nt, Homo sapiens
uccucaucugcaaaaccagucuaaugaugcuauagaguuguuau

SEQ ID NO: 133561 - RNA, 52 nt, Homo sapiens
gacacaauuuccacaaggccagauggaauagcaaagaggcaugagagggugu

SEQ ID NO: 133562 - RNA, 42 nt, Homo sapiens
guaucuuguggcugccaugcuuccagugauagcaugugaggg

SEQ ID NO: 133563 - RNA, 42 nt, Homo sapiens
caggacaucaaggagcgccgagcagucaucauccucaggaag

SEQ ID NO: 133564 - RNA, 41 nt, Homo sapiens
agcagccugcuuuaaaaaugccuggguuuucacugcuggaa

SEQ ID NO: 133565 - RNA, 51 nt, Homo sapiens
aguuuccagacagaaguguucccauuccuuacuccuaaagguggacuugag

SEQ ID NO: 133566 - RNA, 54 nt, Homo sapiens
ucccugagcagcuccguguuaccacccagcuaugcuucagaucgccugucagga

SEQ ID NO: 133567 - RNA, 45 nt, Homo sapiens
cacaccggcggagggguagcuucagcucugagaacuacuggcgca

SEQ ID NO: 133568 - RNA, 42 nt, Homo sapiens
gacugcucugaggcagcaggcagcccugcccgaaaggugaag

SEQ ID NO: 133569 - RNA, 42 nt, Homo sapiens
uuaaaagcaacaaaauguuuugguuaagaaaauuauuuugcu

SEQ ID NO: 133570 - RNA, 53 nt, Homo sapiens
caugcaaacacccuuucuuccuccugcggcagaguuguucagguugccugggc

SEQ ID NO: 133571 - RNA, 46 nt, Homo sapiens
gguugcuccuuuugagcauaugcgugugauuauuuggaacaguuag

SEQ ID NO: 133572 - RNA, 72 nt, Homo sapiens
gcucauuggccgccagcgucccagaggaguugguuggucuuggacacugggccuccugugugccuagccuug

SEQ ID NO: 133573 - RNA, 71 nt, Homo sapiens
ucuggucccuccuuucaagaugcucaugauaguguggagugcagguacuggcaugaagcagauguuuuuca

SEQ ID NO: 133574 - RNA, 55 nt, Homo sapiens
ccuggcucccuaugccugguaaagggcuucuaucuagagucucuuacucuguucu

SEQ ID NO: 133575 - RNA, 101 nt, Homo sapiens
caaguguggucuggggcuaguugggccuggagggguagacacugggcuaggcagaguggaccuuggauccccuggagaaggaaacaccggaucugagagaa

SEQ ID NO: 133576 - RNA, 1276 nt, Homo sapiens
acuccaugccugagcuucugacucuuggggcaugggauaggggcucagagaagggcugggggagugcgaggaaccgucuuuguggaggacccuauuuuccauugccauuaaaaagucagacuucuggccaggcgcaguggcucaugccuauaaucccagcacuuugggaggccgaggugggcagaucacgaggucaggaguuugagaccagccuggccaacauaguggaaccccgucucuacuaaaaauacaaaaaauuagcugggcaugguggcgggccccuguaaucccagcuacuugggaggcugaggcaggagaaucacuugaagccaggaggcgaagguugcagcgagccgagaucgugccacugcacuccagcccagcggacagugcgaaacuccaucucaaaaaaaaaaaaaaaaaaaaaaaacucccagccugaccaacauggugaaacuccaucucuacugaaaauacaaaaauuagcugggcguagugcugggcgccuguaaucucagcuacucaggaggcugaggcaggagaaucgcuugaacccgggaggcggagguugcggugagccgagaucgugccacuggacuccagccugggcgacagcaagacucagucucaaaaaaacaaaaaaaaaaaaaagucagacucagccaggaacaguggcucauaccuguagucccagcauuuugggaggccaagauggaugagcccaggaguuugagaccagccugggcaacacagcaaaacccugucucuacaaaaauacaaaaauuagccaggugugguuguaugcaccuguagucccagcuacuucagaagcugaggugggagaucacuugagcccaggaggucaaggcuguaguaagccgagaucgcgucacugcacuccagccugggugacccugucucaaaaaaaaaaaaaaagauucgggccgggcgugguggcucaugccuguaaucccagcacuuugggaggcugaggcaggcggaucaugaggucaggaguucgagaccagccuggccaacauggugaaacucuuucucuacuaaaaauacaaaaaucagcugggcacgguggugcgugccuguaaucccagcuacucaggaggcugagacaggagaauugcuugaaccugggaggcggagguugcagugagcugagaucacgccacugcacuccaaccuggaugacacagcgagacucugucucaaaaaaaaaaaaaaggauucagccucuucccaaucccugggugaaaaaggcccu

SEQ ID NO: 133577 - RNA, 73 nt, Homo sapiens
aguagaugcucuaacagcuggugccaucccucaccccgcuaggaccccaucccauuccuccaacccuuuugug

SEQ ID NO: 133578 - RNA, 42 nt, Homo sapiens
gaccuaguauaugaugucauauacgcauaaaguuauaaauuu

SEQ ID NO: 133579 - RNA, 42 nt, Homo sapiens
uauauauucuuauaaauuccauauaaccaaucuuuucucaca

SEQ ID NO: 133580 - RNA, 52 nt, Homo sapiens
gcuuguaauaguuucccguggcugccauaacaagucaccacaacccuggugg

SEQ ID NO: 133581 - RNA, 46 nt, Homo sapiens
uuuucuccauacugugggcccuggcucccucugccacaugggccag

SEQ ID NO: 133582 - RNA, 44 nt, Homo sapiens
accugagacaacugugcagagaugaugggguccuuuugcugaga

SEQ ID NO: 133583 - RNA, 44 nt, Homo sapiens
ucuggggaggccaggcagaaggcugggcuaugauacccauggag

SEQ ID NO: 133584 - RNA, 48 nt, Homo sapiens
ggcugugcccaccuggaagaagcacucaguuuccagcugcccagccgg

SEQ ID NO: 133585 - RNA, 30 nt, Homo sapiens
gguggcugccagcgacauagcagcccuggg

SEQ ID NO: 133586 - RNA, 46 nt, Homo sapiens
caggccccuuucccugcaaggccauuaacaagauucuguggcggaa

SEQ ID NO: 133587 - RNA, 100 nt, Homo sapiens
cuguucugugacugccuuacucuugaucaccucugauggcugcuccagugcaggcagaacccccaaaguccucuguucucuacaugucccccuuugccac

SEQ ID NO: 133588 - RNA, 41 nt, Homo sapiens
uggagggucugguggaaagggagauggacuggcacaggcaa

SEQ ID NO: 133589 - RNA, 45 nt, Homo sapiens
gcccaaggugagcgcgaagaccaaguucaagcugacggcccauga

SEQ ID NO: 133590 - RNA, 46 nt, Homo sapiens
ccaucagaauuugaacgcuucucccuaagugcccggaacaucacag

SEQ ID NO: 133591 - RNA, 46 nt, Homo sapiens
ggggcaggggggggggucaagaugaguuucccuguagauuguaccu

SEQ ID NO: 133592 - RNA, 100 nt, Homo sapiens
cacaaccuuccaacccggcagguacugggugccuguggaguacgaggaggaggaaaagaaggaagacaaggaggagaaggccgagggcaaagaaggcgag

SEQ ID NO: 133593 - RNA, 45 nt, Homo sapiens
gaggguuucgugcuggagggcaagaaguuugcgcggcugccggaa

SEQ ID NO: 133594 - RNA, 43 nt, Homo sapiens
gcucuuugcagagaaaauuaacaagaaugagcggaaagggaag

SEQ ID NO: 133595 - RNA, 63 nt, Homo sapiens
uuuuccugcuggaccgagggcuagacaucuacguauggcggggggcccaggccacacugagca

SEQ ID NO: 133596 - RNA, 52 nt, Homo sapiens
ggguggaacagccaguggcuucuacacuguggaagacacacacuaugucacc

SEQ ID NO: 133597 - RNA, 47 nt, Homo sapiens
gcugagugccgcacuguccgggaggagaugggcgaugagagcgagga

SEQ ID NO: 133598 - RNA, 46 nt, Homo sapiens
ggaugacagcggcucccucaacugggagaucuacuacuggauuggc

SEQ ID NO: 133599 - RNA, 42 nt, Homo sapiens
gugcucaaggugagggcugggcaugcuguuaggggccaugug

SEQ ID NO: 133600 - RNA, 53 nt, Homo sapiens
gcagguuuggcggaggagggaaggccaaacggccuccagggccccgcugcgca

SEQ ID NO: 133601 - RNA, 86 nt, Homo sapiens
gggcagggaugggauaugagcuuggguuuuggggucccaagcccccaucucucaugaggagaugagggagcugccaagccccuucu

SEQ ID NO: 133602 - RNA, 41 nt, Homo sapiens
cuggccuucagcuucugcccaggauggcagaaaccacauuc

SEQ ID NO: 133603 - RNA, 40 nt, Homo sapiens
ucccgcucagcaagaaaacuaaacgcacagaagacagcag

SEQ ID NO: 133604 - RNA, 57 nt, Homo sapiens
agugagaugccccagcugugggcugggggugcagcacagagccucagcucccccagg

SEQ ID NO: 133605 - RNA, 104 nt, Homo sapiens
cagaggaccugaucccccacuagagagguccggugugcacagccggccucccagugugccaaaaugaacugcucucagcugauggcuguauucugacuuugaag

SEQ ID NO: 133606 - RNA, 46 nt, Homo sapiens
cuuuugaaacgaagcucagcuucgaagaugugaacaagaauaaaag

SEQ ID NO: 133607 - RNA, 39 nt, Homo sapiens
cagguccuccuccaccacgaaguccagggcggccuggga

SEQ ID NO: 133608 - RNA, 42 nt, Homo sapiens
gaaugccucaucaaaauaaaaguuccaguugcagaguuguga

SEQ ID NO: 133609 - RNA, 41 nt, Homo sapiens
ugaagccacuugccugagggcacacagcuaggaaggggcag

SEQ ID NO: 133610 - RNA, 34 nt, Homo sapiens
agcccagagcugguaggaagguuucugagcugag

SEQ ID NO: 133611 - RNA, 110 nt, Homo sapiens
aggcaauacuuuuguuuuguugucacuguguccccagugccuaaaacacauuguggaugcuugguaaacaguuucugaaugagugacucauucuagccagcugagugggg

SEQ ID NO: 133612 - RNA, 46 nt, Homo sapiens
gccaccgugaacucacaggagcagaagcggcugcucauggaccugg

SEQ ID NO: 133613 - RNA, 56 nt, Homo sapiens
cuggggcccugagcuuuugggggacucaucaaauaguuuagguucuggaaagaagu

SEQ ID NO: 133614 - RNA, 54 nt, Homo sapiens
ugggugcuuugugauaugguggccacagggcuuucucuggaguucuuggugcuu

SEQ ID NO: 133615 - RNA, 43 nt, Homo sapiens
gugaaaacagcccaaauuaaugacagcagaugcugaagucuga

SEQ ID NO: 133616 - RNA, 31 nt, Homo sapiens
caagaacacaucaaacacaagaccuaaugca

SEQ ID NO: 133617 - RNA, 78 nt, Homo sapiens
aauaaugcccaccaaaaauccaugugacuccaucucucuucccaguucuaauguucucagaacagcagccaccccuga

SEQ ID NO: 133618 - RNA, 49 nt, Homo sapiens
cugcacuccgcaagacaccccaguaaacuggggcgucccaagguggcaa

SEQ ID NO: 133619 - RNA, 56 nt, Homo sapiens
gccuuucauacuuucuacaaccccaaggcaagaagaaugaacaccgagcuuuccag

SEQ ID NO: 133620 - RNA, 28 nt, Homo sapiens
cagggggaaggacacauacguggugauc

SEQ ID NO: 133621 - RNA, 46 nt, Homo sapiens
cacagaaaacaguagaugccuccguacaucagaucaauggcugagg

SEQ ID NO: 133622 - RNA, 38 nt, Homo sapiens
agaugucaacuucagccaaguggggaugcuguggcgau

SEQ ID NO: 133623 - RNA, 56 nt, Homo sapiens
cgggcccuucccaggagcaugcaugcgacccaugauggcggcagucaggcagugaa

SEQ ID NO: 133624 - RNA, 34 nt, Homo sapiens
ggauggcggggcagguauaacccgcuguuagcuu

SEQ ID NO: 133625 - RNA, 60 nt, Homo sapiens
augagugcucccucugcugccccugaugcaugcuucugcugauucccgagcaccaacucc

SEQ ID NO: 133626 - RNA, 54 nt, Homo sapiens
agcacuccucugggcugcucucaaaccaugucccaucuucagcaucccucccac

SEQ ID NO: 133627 - RNA, 48 nt, Homo sapiens
ggagcagaggacaaucucugcagggcugggaguggguagggacugaag

SEQ ID NO: 133628 - RNA, 45 nt, Homo sapiens
ggaagacugaggggcucccccggcgucugggggcggcaggccagg

SEQ ID NO: 133629 - RNA, 45 nt, Homo sapiens
caauggggaguccauguccuaccuuuucagaaacauaggcuuaga

SEQ ID NO: 133630 - RNA, 45 nt, Homo sapiens
caauacaauuccacaugaaguccagaagcuccagugccccaagau

SEQ ID NO: 133631 - RNA, 46 nt, Homo sapiens
ugauggcaacucauggcuuguugucuucugacgccccccggcggau

SEQ ID NO: 133632 - RNA, 45 nt, Homo sapiens
augacaucauugaugauguugacagcuuucuugcugcagcagaga

SEQ ID NO: 133633 - RNA, 34 nt, Homo sapiens
agugugcugcugccucuuucccacuuuccucuga

SEQ ID NO: 133634 - RNA, 55 nt, Homo sapiens
augaguuccaggcauucuaauuugaacuucagugguucccagcgauaucucuuau

SEQ ID NO: 133635 - RNA, 52 nt, Homo sapiens
gaucccagauuacaggaaugcaguaaucguggccaagucuccagccucggcg

SEQ ID NO: 133636 - RNA, 50 nt, Homo sapiens
auacaugaaaaaguuuagaaagacugccagcaaaaauaaugaaagugccc

SEQ ID NO: 133637 - RNA, 91 nt, Homo sapiens
uuuacaccagaaggaaauucagggcuucuucaauauuccuguugacaauuuaagagcaucucccuucuuauuacaguauauucaagaagag

SEQ ID NO: 133638 - RNA, 678 nt, Homo sapiens
uugugugugugcgcgcuuguauaaguguauaugauuuuauuuauuuauuuauuuauuuugagauggaguuucgcuccuguugcccaggcuggagugcaauggcaugaucuucgcucaccacaaccuccaccuccccgguucaagcgauucuccugccucagccucccaaguagcugggauuacaggcaugcgccaccacgcccggcuaauuuuguauuuuuaguagagacaggguuucuccauguuggucaggcuggucucaaacucccgaccccgccucagacucccaaagugcugggauuacaggcguaagccacugcacccggccuaugauuuuuuuauuuuaauuuuuauucuguuuauuuauuuuuugagacggagucuugcuccguugcccaggcuggagugcagugguggcaccucggcucacugcaaccacugucuccuggguucaagcgauuuuuguaccuuagcuucucuaguagcugggacuacaggugccugccaccacacucagcuaauuuuuguauuuuuaguagagaugggguuuugccauguuggccaggcuggucucgaacuccugaccucaagugauccaccugcuuugggcuccuaaaauucugggauuacagacacaagccaccauagccagccugaauguauaugauuuuagaaggu

SEQ ID NO: 133639 - RNA, 35 nt, Homo sapiens
cuggaagccaagugaccguggacauggccgcaugg

SEQ ID NO: 133640 - RNA, 60 nt, Homo sapiens
ugugaauuucuuacuguuaccagauacugaaaaacugaguucaggaguucagggauugau

SEQ ID NO: 133641 - RNA, 41 nt, Homo sapiens
guuguacauuuccauuagcaagaagucaggcaggcaaggua

SEQ ID NO: 133642 - RNA, 46 nt, Homo sapiens
agguuuugauguuuugugugacgccaccugaauuagaaaccaagau

SEQ ID NO: 133643 - RNA, 42 nt, Homo sapiens
ucuguuuguccauauauaucuaauauuuaaaaaauacuauua

SEQ ID NO: 133644 - RNA, 46 nt, Homo sapiens
cagagaauaaaaggagguuguccauaauugacuuuaagcagcaauc

SEQ ID NO: 133645 - RNA, 44 nt, Homo sapiens
ucuuauguugucccuaccaaacugauaagaacccucacuucugg

SEQ ID NO: 133646 - RNA, 52 nt, Homo sapiens
cucuaagaucucuuccuaccucuaaaauacuuucauucuaaguguuccaacu

SEQ ID NO: 133647 - RNA, 65 nt, Homo sapiens
uuaggcaugaguuaacauuguguuggagagauaagcagagccugggaucauacaggaguggaaga

SEQ ID NO: 133648 - RNA, 52 nt, Homo sapiens
gugccagucucuuaguugguguugcuaaauguuagcuuaaaaauacaguaaa

SEQ ID NO: 133649 - RNA, 66 nt, Homo sapiens
ucuuuuccauuuaguuuuuguuuuuaucacuucuuuuuuuccagugacuucugcugaugggaucaa

SEQ ID NO: 133650 - RNA, 49 nt, Homo sapiens
caaugucauuuuuagaacugcaucaauuuccugaauuuuuauguaaaag

SEQ ID NO: 133651 - RNA, 51 nt, Homo sapiens
uuauuuacuuuuaacugacagaaacugucuauauucaugguauauaacaug

SEQ ID NO: 133652 - RNA, 73 nt, Homo sapiens
ccuuggaccuaguugaucgacaguccaucaccuuaaucucaucacccaguggaaggcguguuuaccagguaga

SEQ ID NO: 133653 - RNA, 43 nt, Homo sapiens
caagaagaucugaaauaaguacacaagauauuaacauuaauuc

SEQ ID NO: 133654 - RNA, 160 nt, Homo sapiens
uucugaagaauauauaccaagcucuaccaguguuuuuucuuuggggcaaggaaggagguagaauugagggaacggccuuaaccuuuacuguauuucuuaaauuuuuaauaagaauuaaauauuacuggaaaaaaauguacuacuuuaaaaacaaaagggc

SEQ ID NO: 133655 - RNA, 40 nt, Homo sapiens
cuguuguauuugauuuuuuuuuaaccauuaauguuaaaau

SEQ ID NO: 133656 - RNA, 350 nt, Homo sapiens
cuuuuaaaaacaaaucuggccgggcacgguggcucaugucuauaaucccagcacuuugggaggccaaggccaguggaucacuugaggugaggaguucaagaccagcauggccagcauggugaaaccccaucucuacuaaacauaccaaaaaaaauuagcugggcaugguagugcaugccuguagucccagcuaccugggaggcugaggcaagagaaugguuuaaacccgggaggcggagguugcagugagcugagauugcaccauugcacuccagccugggugacaggacaagacuccgucucaaaaaaagaaaaaggaaauccuuuuauuaugguuuuagugggguuug

SEQ ID NO: 133657 - RNA, 41 nt, Homo sapiens
gucuuauaaaucauuuuccacucuucuaucagcuuccaaug

SEQ ID NO: 133658 - RNA, 52 nt, Homo sapiens
aaaccuagucucuugccagaaugagggaaaggcagucaccuaaagcugugga

SEQ ID NO: 133659 - RNA, 41 nt, Homo sapiens
ugauugcuuguguuaugggagccauguuagggaagagagca

SEQ ID NO: 133660 - RNA, 49 nt, Homo sapiens
cccggggguggaagggacgggagccuacagugagugauagaaacgugga

SEQ ID NO: 133661 - RNA, 55 nt, Homo sapiens
gcggguaaaauugccgagaaugaggugggucauccgagaggggauuggaauccau

SEQ ID NO: 133662 - RNA, 46 nt, Homo sapiens
uucuguagugugcuacugacaugccauuugcacuuuaggaccauac

SEQ ID NO: 133663 - RNA, 45 nt, Homo sapiens
ugcauuucaacucuagaggaaaaaauugaaagagaaaaggaauua

SEQ ID NO: 133664 - RNA, 43 nt, Homo sapiens
aaaggcuuuacuuuacacuuuugagaaauggaaagagaucuaa

SEQ ID NO: 133665 - RNA, 55 nt, Homo sapiens
agaaggauagagacuucauccauuauacucagugcuaaauccucggugccuagaa

SEQ ID NO: 133666 - RNA, 59 nt, Homo sapiens
cugaaugaaagaacaaaagacccaagaaagaccagcaaauaaauccaguuucagugcag

SEQ ID NO: 133667 - RNA, 43 nt, Homo sapiens
uuuaauaaauacugaguagcuguucugugccagguauucuagg

SEQ ID NO: 133668 - RNA, 43 nt, Homo sapiens
uuccauuuucuuaauuucaauauaggacagugcuaaaaacaua

SEQ ID NO: 133669 - RNA, 80 nt, Homo sapiens
agcugugcagggaaaggauguguguuauaguuuaucuaagguuuccagguguuugaagcagauggguuucaucuauagug

SEQ ID NO: 133670 - RNA, 47 nt, Homo sapiens
ccuccacuaaaaccauuaacacucaucagaaagugcuaaucaguuga

SEQ ID NO: 133671 - RNA, 33 nt, Homo sapiens
uccuauauugcuauugauggugaggggguaggg

SEQ ID NO: 133672 - RNA, 45 nt, Homo sapiens
ccauacaaggucgauccagauuaaaccacagugucucagucccac

SEQ ID NO: 133673 - RNA, 46 nt, Homo sapiens
ccauucuuuuauuccuggaauaaaugcuguuuggucaucuuaauac

SEQ ID NO: 133674 - RNA, 136 nt, Homo sapiens
uauaagacauaacaauuuuaacugaaugugucccaaggcugggguacauggguagggugaguaauauguuuuggaagaaaagggagguugagcuaugaauuaucuccaugaaagggauuuauaacuuauuaugaag

SEQ ID NO: 133675 - RNA, 42 nt, Homo sapiens
ugaacacucuacuuccuuugcagccuuagucacacaacugag

SEQ ID NO: 133676 - RNA, 49 nt, Homo sapiens
aaaaagacaguuuuucuagguaccaugaaggaagauugacccuguuggu

SEQ ID NO: 133677 - RNA, 60 nt, Homo sapiens
aaaaaaaaaacuuucugaagaaaauaaaaacaccagaaaccuugagguccaaauccucag

SEQ ID NO: 133678 - RNA, 42 nt, Homo sapiens
uuaacaaacucuaaaauauuaccaguaccugaaaaaaaaaaa

SEQ ID NO: 133679 - RNA, 51 nt, Homo sapiens
cauauauucaaacuaagggaaaaauauguaagcuuuuccuuuggaaccuga

SEQ ID NO: 133680 - RNA, 45 nt, Homo sapiens
uucaucaucugugggcuggcucuccugaaaagucucagggaauaa

SEQ ID NO: 133681 - RNA, 44 nt, Homo sapiens
aaaaucauacuucacuaaugaccaaccccccuuucccaacugga

SEQ ID NO: 133682 - RNA, 46 nt, Homo sapiens
ucuuauaaccuuaaaacacacacacuuaaagccaauaaaaauugga

SEQ ID NO: 133683 - RNA, 29 nt, Homo sapiens
aaucuuaccugacguaguaacugcuggca

SEQ ID NO: 133684 - RNA, 44 nt, Homo sapiens
ccuagaaacaaacuugguugauuagggaggcuuuaaacugacag

SEQ ID NO: 133685 - RNA, 127 nt, Homo sapiens
caaucaagggccaggcaaagcaagacugagcuucuaaggagacagaaguggccagagaaguagagaagaaacaggagaacauggcaucagaaagccaagagaggaaagcauuucaggaaaggaaagu

SEQ ID NO: 133686 - RNA, 39 nt, Homo sapiens
gcuacugaaaacauuaggcaagagagaaaaaacuauaaa

SEQ ID NO: 133687 - RNA, 50 nt, Homo sapiens
gcccccacuuuccuuucuuuugacaggaucaggagacuaguagaugguag

SEQ ID NO: 133688 - RNA, 50 nt, Homo sapiens
ugaggacaugugacccacagcugaugaaacuggggacacugauugagagg

SEQ ID NO: 133689 - RNA, 51 nt, Homo sapiens
auagcaagaacucauaucuaagcaaucaacagcuggacuggaacacaacag

SEQ ID NO: 133690 - RNA, 51 nt, Homo sapiens
aacgguuugauguuuuaguccucacagguguagauaccaaagcagaaggug

SEQ ID NO: 133691 - RNA, 67 nt, Homo sapiens
ucagcaagugugaucagccgauggguccugggcacuugccccauucccucugccugugaagaagggg

SEQ ID NO: 133692 - RNA, 41 nt, Homo sapiens
aacaaccucuggcugauaggucugcaguuucuccuggggug

SEQ ID NO: 133693 - RNA, 47 nt, Homo sapiens
ccagggaaacauuuauggaagagguuaauaaacaaaugagggaguag

SEQ ID NO: 133694 - RNA, 45 nt, Homo sapiens
gauucucuuacacagaugccaauaagaacaaaggcaucaccuggg

SEQ ID NO: 133695 - RNA, 66 nt, Homo sapiens
uucgcucuggcuccagcaauaccugcaaauccaguucuucccagcuguuucuccaaacugguagga

SEQ ID NO: 133696 - RNA, 47 nt, Homo sapiens
cgccgcacaggcgcgccguccugaaagaggguauuuccggcgggaga

SEQ ID NO: 133697 - RNA, 42 nt, Homo sapiens
cuguuagcggauaccaggauccugccaaucaccaaccacguc

SEQ ID NO: 133698 - RNA, 79 nt, Homo sapiens
uggccuucacauuuucgauggugucacugggcuccaccucaagggugauggucuugccgguaaggguuuucacgaagau

SEQ ID NO: 133699 - RNA, 46 nt, Homo sapiens
gcuugccugcaaagaugagccucugcuggucggggggaaugccuuc

SEQ ID NO: 133700 - RNA, 64 nt, Homo sapiens
ggucagggucuucacgaagaucugcauaccaccucucagacgcaggaccaggugcagggucgac

SEQ ID NO: 133701 - RNA, 46 nt, Homo sapiens
gcuugccugcaaagaugagccucugcuggucgggggggaugccuuc

SEQ ID NO: 133702 - RNA, 38 nt, Homo sapiens
ggucagggucuucacgaagaucugcauaccaccucuca

SEQ ID NO: 133703 - RNA, 46 nt, Homo sapiens
gcuugccugcaaagaugagccucugcuggucgggagggaugccuuc

SEQ ID NO: 133704 - RNA, 62 nt, Homo sapiens
ucagggucuucacgaagaucugcauaccaccucucagacgcaggaccaggugcagggucgac

SEQ ID NO: 133705 - RNA, 46 nt, Homo sapiens; identical to SEQ ID NO: 133701

SEQ ID NO: 133706 - RNA, 47 nt, Homo sapiens
ggcacugcgaaugccaugacugaagaauuaacagccaccccucaggc

SEQ ID NO: 133707 - RNA, 147 nt, Homo sapiens
gguuugcacacccccacugugggccggggaaccgggucccggccuucgcagacuccaggcucuggcagauguggcccuaccacaaaagagugauccaugagccucagccacggcagccggauucggccccgcgcugcccugccaggc

SEQ ID NO: 133708 - RNA, 52 nt, Homo sapiens
ucucaccucguggcuaccccgucuucagcacucugcaguggguacgcaaucu

SEQ ID NO: 133709 - RNA, 64 nt, Homo sapiens
gccugggcccucacccagcuccaggaugguggguagguggcccugcuuuggggagcgcuugcgc

SEQ ID NO: 133710 - RNA, 36 nt, Homo sapiens
uugaacugccugggcucugucccaagaacaagcaga

SEQ ID NO: 133711 - RNA, 66 nt, Homo sapiens
caaaggucauggcuuguacuuccuggcaacacaggguacauuuguccuugagaucuaagcugggag

SEQ ID NO: 133712 - RNA, 71 nt, Homo sapiens
caaccgauucagauaauuucccaagcagagagauuaggagggcgcugggaugggugacaaagugcugagaa

SEQ ID NO: 133713 - RNA, 33 nt, Homo sapiens
gggcgaggcgaauagaaauggcuuuggugucgc

SEQ ID NO: 133714 - RNA, 38 nt, Homo sapiens
cucgaggaggagcggggcggccgggaguggagggcugu

SEQ ID NO: 133715 - RNA, 26 nt, Homo sapiens
aagaggagacgacuaauagaccaaga

SEQ ID NO: 133716 - RNA, 52 nt, Homo sapiens
uuaguccugccauuaccauuuuacuuaaucguuuagccaggccugauacaua

SEQ ID NO: 133717 - RNA, 47 nt, Homo sapiens
cagguagacuaaugguuggccuacguugguggaaucacauugaugaa

SEQ ID NO: 133718 - RNA, 47 nt, Homo sapiens
auaccaaaucacuuggcaugucagcacuaaaggagauggccuucuag

SEQ ID NO: 133719 - RNA, 45 nt, Homo sapiens
cuguguugccuuuguuagugucuccauaaaucccucuaugcucag

SEQ ID NO: 133720 - RNA, 47 nt, Homo sapiens
agcccuggggauccuggucuguuuuggguuagccugcuacacuauag

SEQ ID NO: 133721 - RNA, 47 nt, Homo sapiens
uacauauuauuucuguagauuguuuucaggagaaaguuuugcuucua

SEQ ID NO: 133722 - RNA, 60 nt, Homo sapiens
uggaaucaucauaguuuaaggaauacccagagauugcugcuauucuauuuauuuuacaga

SEQ ID NO: 133723 - RNA, 47 nt, Homo sapiens
aucuauguaacuguaaauuaaaccaaucuacaaacuauuguaggcau

SEQ ID NO: 133724 - RNA, 55 nt, Homo sapiens
cacacgcgugcaugcacacacacaugcacacacacacacacggagagagauuuau

SEQ ID NO: 133725 - RNA, 1196 nt, Homo sapiens
uuaggucagguccucaggagcagacgcuuacaugaggauuccuacacaaaugauuuauuucugguuccaugagaguaaaguugaguugggggagcaucagguaggaggguguaauuuuagguuaaguuccaggggguuccaggcugaguucuggauugcacagggagacucuggaguguacguuauaccuuugcacguuuuuccuuugucccugggacucagggagcagggcuuucuugcucucacaucugucagucaucgacucagggccaugcccacuguggguaugggcacccuagccaccuccggcuuguguauucuggcagcuguguuuccgguaccccaaagacaauccugaaaaaaggaguugcacuucugggcuguuggaaaccuaaagcacacugaagcucgggaaagaugccccuaaccuguaaaagggauccgcggggaucuggguggcacacucaugguguuugccacagccaugugcacuucccuguugucucauccuccagagaaggggcucagguuggaucccauugcucaguuucacaccuguguuguccucuguggcuuuuuguuucauguguauuuccuguaaguagcccuuguaacaggagaggucucaagugcugaguagagugaacccuuuuugacauggcaagauuuuguauuauuuuauguguuuaaucuuugaccccaaucguuuacauuguagaacucucuccguuuuaccaguuuugccauaaauugccuacauuauacucugccacacugaugucagcuugccuauuucccugaccuuuggaauuuugugcuccuuauuuccauuuuuuuccuuucuuucaugcuguuuguuuucugucacauacaguuuagccuuuuugucauucuuaaaaguaauaaauaaaugccagagcaugcacacgcuucuuuaaccaaguaaauaaaucagaaagcuauauaggucuuacaaacauuuuaacaugcaguacuaaguugaaaagagguaauguguuuaauguuacaacagaaauccuaagauucauuuuuaaagauugagugucuguuuagaaacauuuccuguucuuuugaagugucccuacuuacuugucguuugauuuguuuaagccacacaggcuaugguauuuuguuaugucccagcugaggcaggacaguugaaaaggcugcuccaa

SEQ ID NO: 133726 - RNA, 46 nt, Homo sapiens
caaaucugaagcuccucgcaggagagagagagagagagagagagga

SEQ ID NO: 133727 - RNA, 44 nt, Homo sapiens
agcccccagcacgccugcuuuguggggcagggccaugcggcccc

SEQ ID NO: 133728 - RNA, 26 nt, Homo sapiens
acaagcaggacugucuugugaagcau

SEQ ID NO: 133729 - RNA, 50 nt, Homo sapiens
gaauaaucacucuaauguccguguuugaggacugcauugcuggugaccgc

SEQ ID NO: 133730 - RNA, 43 nt, Homo sapiens
gggucuuacuccuuggaggccaugugggccaugagguccacca

SEQ ID NO: 133731 - RNA, 48 nt, Homo sapiens
augaaaagcauccgccuuugucagauaguguuucagagcacagaauaa

SEQ ID NO: 133732 - RNA, 46 nt, Homo sapiens
cugcaaacaaaacuuccaaggggacgaggaguagguuccaggcgau

SEQ ID NO: 133733 - RNA, 58 nt, Homo sapiens
cggccuuagcugucacucaggcaaccccggagccgccgcagacaccggauccacugga

SEQ ID NO: 133734 - RNA, 44 nt, Homo sapiens
gagaagacguagagcgcggcgcccgagucccggcuacccgcugc

SEQ ID NO: 133735 - RNA, 63 nt, Homo sapiens
aaguccacguuggacuaccgagccacauuuaugcugguggguuuugagcccuccuuagcagag

SEQ ID NO: 133736 - RNA, 45 nt, Homo sapiens
auuaccauguggaagguguggcucauuuucauucgacucggaguc

SEQ ID NO: 133737 - RNA, 53 nt, Homo sapiens
ugaugcuuuucccguccuugacagcagcaaugaugggagcgauggcagcuguc

SEQ ID NO: 133738 - RNA, 33 nt, Homo sapiens
uuugaaucuuguggcugcgaagguugugaacug

SEQ ID NO: 133739 - RNA, 85 nt, Homo sapiens
acagaccucugccacucccuccugggacggagcugguacuugaggaggcauucacccugaaccaugggcacacugaggguggggc

SEQ ID NO: 133740 - RNA, 42 nt, Homo sapiens
cgccucaacuaugaauuccucaggauugcaaguaauaauggc

SEQ ID NO: 133741 - RNA, 41 nt, Homo sapiens
ccuccuccuccuggucugggcuccucgcguccaucgucagc

SEQ ID NO: 133742 - RNA, 58 nt, Homo sapiens
aaugauuaaaaaaggauaaaguaguaaacaaaauucacccacagcccagagggaagaa

SEQ ID NO: 133743 - RNA, 67 nt, Homo sapiens
aaauaggauauggccuuggccccagaagaggcacaggccugugaccuugggagagugggaaggauga

SEQ ID NO: 133744 - RNA, 69 nt, Homo sapiens
agggcugcuagguggccucugaccaggaggagacuagaaaaggguccuggccugggcaucuggaggcag

SEQ ID NO: 133745 - RNA, 62 nt, Homo sapiens
uuuugguugaucucugucccugauuuuacccuggagaauauacauuucauuaaggauuuugu

SEQ ID NO: 133746 - RNA, 48 nt, Homo sapiens
gaauccaaauuagcagcuugcaggaauuuugcaaaggaccaagcauca

SEQ ID NO: 133747 - RNA, 31 nt, Homo sapiens
cuaggauaucagcacuaaacaucguggggga

SEQ ID NO: 133748 - RNA, 46 nt, Homo sapiens
aagcaucacuuucuuugccagcuaccccuguuggcaaaggaacgga

SEQ ID NO: 133749 - RNA, 43 nt, Homo sapiens
cugcacuguuucuuuuugcauauaagcauaaguaacuucucuc

SEQ ID NO: 133750 - RNA, 45 nt, Homo sapiens
aucuuuguuggucucuguacagagguuaaaggaugaagcaagagg

SEQ ID NO: 133751 - RNA, 42 nt, Homo sapiens
aauucauguacucuaauuuuucuuuuuagggcaacaauaguu

SEQ ID NO: 133752 - RNA, 68 nt, Homo sapiens
aguguuagaagaugauuuaagucagacucgggccauuaaggagcaguugcauaaguaugugagagagc

SEQ ID NO: 133753 - RNA, 50 nt, Homo sapiens
acaaagaaauagagacuugcaggcugauaaccaaagacugaaauaugaag

SEQ ID NO: 133754 - RNA, 46 nt, Homo sapiens
augagcuaguugaauuccaggaaggaagcagagaauuagaagcaga

SEQ ID NO: 133755 - RNA, 47 nt, Homo sapiens
aagcaaagguaauguuggaaagcacacuaaaaguaggggagggcauu

SEQ ID NO: 133756 - RNA, 46 nt, Homo sapiens
gaagauauaccagauuuuucaaguuuaaaggaggaaacugcuuauu

SEQ ID NO: 133757 - RNA, 49 nt, Homo sapiens
ugucaugaucucauucacaauauugguggucccugagaguggagcagug

SEQ ID NO: 133758 - RNA, 48 nt, Homo sapiens
gcaauagagcuggauaauaccaguuaggaagcaauaaagaugaggugu

SEQ ID NO: 133759 - RNA, 359 nt, Homo sapiens
agugguagcaaauuuuauuauuuguaaauaaucugauuuuuauuuuuauuuuuuuggaggcagggucucauuuugucacccaggcuggagugcaguggagugauuacagcuuacugcagccucaacuuccuggacucaagcgauccucccaccacagucucacgaguagcugggaccacaggugcaugccaccacacccagcucauuuuuguauuuuuguuagagaugggguuucagcauguuguccaggcuggccuugaaguuccaggcucaacugacauucccaccucagccuuccaagugcugggauuaauaugcgcgagccacugugccuggccagaaucugauuuuuaaaaaga

SEQ ID NO: 133760 - RNA, 26 nt, Homo sapiens
cgagagcgcgagcagcccacguuggg

SEQ ID NO: 133761 - RNA, 63 nt, Homo sapiens
cgcucuaacuguccccucccuucccugguccgauguguggccccccaggggcgccugcaaggg

SEQ ID NO: 133762 - RNA, 36 nt, Homo sapiens
ccuuuccacuuuauuuuuucuggauuugguauauug

SEQ ID NO: 133763 - RNA, 36 nt, Homo sapiens
ggagagagggacagacaaauaagaaacuuuggauua

SEQ ID NO: 133764 - RNA, 47 nt, Homo sapiens
gcagaaacagcaaauaaugugcaggugguacaacuggaagaucagaa

SEQ ID NO: 133765 - RNA, 42 nt, Homo sapiens
gacguacuuugaaguugucauugaugagcauggagacaggaa

SEQ ID NO: 133766 - RNA, 44 nt, Homo sapiens
auuuuuccuauuauucgcuccaagaaagaugcuaagucugagcu

SEQ ID NO: 133767 - RNA, 42 nt, Homo sapiens
cacaggggaacacgaaaggaggaggcaccuucgccagaacca

SEQ ID NO: 133768 - RNA, 44 nt, Homo sapiens
gugcauaaacagaguuccaguagaucuguagaauuaaacuuuca

SEQ ID NO: 133769 - RNA, 347 nt, Homo sapiens
uaucaauucugugaucuuauagaaggccgggcacgguggcuuacaucuguaaucccagcacucugggaggccgcggcagaaggaucaccugaagucaggaguucaagaucagccuggcuaacguggugaaacccugucucuacuaaaaauacaaaaauuagccgggcauggugacgggugccuguaaucccagcuacucgggaggcugaggcaggagaauggcuuggacccagggagauggagguugcagggagccaagagcgugccacugcacuccagccuggucgacaagagagaaacuccaucucaaaaaaaaaaaaaaucuguagccuuccugggucucagug

SEQ ID NO: 133770 - RNA, 66 nt, Homo sapiens
aucuauagaugccuggaccuugauauugcaguugcugggcagguuaaagauggagauggucugggc

SEQ ID NO: 133771 - RNA, 45 nt, Homo sapiens
acuuccccagacucaccuuccagcacccccacaccuaguccagug

SEQ ID NO: 133772 - RNA, 46 nt, Homo sapiens
uccacaagaacuaccccgaaacuccaaugaugcaccaaccccaaug

SEQ ID NO: 133773 - RNA, 42 nt, Homo sapiens
ugaggugcucugcuggagucauccccugaggaggagggaggg

SEQ ID NO: 133774 - RNA, 41 nt, Homo sapiens
cuuggggcccgaguaccuggguuccuaagggugggguaggg

SEQ ID NO: 133775 - RNA, 50 nt, Homo sapiens
cacuugugccuccaccacuauguccuggugacuacugauuaggugaccuu

SEQ ID NO: 133776 - RNA, 65 nt, Homo sapiens
aguuuuaaacuccucccuccaaaaccaaagggaaucgagagacccaauucccaggcgucugggac

SEQ ID NO: 133777 - RNA, 44 nt, Homo sapiens
gagagcagcuguuacuuuuagggacacuaacagaccuaucggca

SEQ ID NO: 133778 - RNA, 30 nt, Homo sapiens
caucccgucaagccuacggggccucccugu

SEQ ID NO: 133779 - RNA, 56 nt, Homo sapiens
uccgccaggcagcccuguucggaaugcacacaaugagauccuugaagagccacauc

SEQ ID NO: 133780 - RNA, 28 nt, Homo sapiens
acaguacacucggcugcagacucccucc

SEQ ID NO: 133781 - RNA, 46 nt, Homo sapiens
cucuaggcugccuggugcgggcagagagguuucaguugaucguaga

SEQ ID NO: 133782 - RNA, 50 nt, Homo sapiens
cagaucccaccggcccagagggaccccaccuaggacagagccggcucuuc

SEQ ID NO: 133783 - RNA, 48 nt, Homo sapiens
aauuuuuguguccccccaggagcaaguccagaggugcccaagcccgcc

SEQ ID NO: 133784 - RNA, 46 nt, Homo sapiens
ucuugcacccgggacagguguaccgacucauagcuccuggccccgc

SEQ ID NO: 133785 - RNA, 46 nt, Homo sapiens
cgcugagauuuugucacggacacuaugugaaccccuuguggcgucu

SEQ ID NO: 133786 - RNA, 49 nt, Homo sapiens
cccugagcaccuggguucugacuuugucgcaggagcugagggaacaaaa

SEQ ID NO: 133787 - RNA, 60 nt, Homo sapiens
gcggagaagggaaacagccgugagaagcagagaaaaagagagagagagggagggguugga

SEQ ID NO: 133788 - RNA, 44 nt, Homo sapiens
aaugaccagagcggguucugucgucaaacuugggacccguacuu

SEQ ID NO: 133789 - RNA, 67 nt, Homo sapiens
uguucauuguccccucacccccguccacccccaggcuuggggcacuuacguuaagaugucggguguc

SEQ ID NO: 133790 - RNA, 45 nt, Homo sapiens
gaggacgcccaaucucaaagucaucaauugugaagugccgccugc

SEQ ID NO: 133791 - RNA, 51 nt, Homo sapiens
agggacccuggggguuggcguauagguguaggggcccauguugguuuggga

SEQ ID NO: 133792 - RNA, 41 nt, Homo sapiens
gacaucaugagggugaacguggacaagguccuggagcgaga

SEQ ID NO: 133793 - RNA, 78 nt, Homo sapiens
agucugcccugccuagagaagggccucucccccaacccucagccguuccuccaccucucagccauaucuuucagcccc

SEQ ID NO: 133794 - RNA, 44 nt, Homo sapiens
guuuuauuacuagaugauuuuuccgguuguccuuaacaccccuu

SEQ ID NO: 133795 - RNA, 69 nt, Homo sapiens
ucucucuugccuuccuucccuuucccuuucuuccugacuagccccaagucccuucauuugcaucugcua

SEQ ID NO: 133796 - RNA, 37 nt, Homo sapiens
gcuugccccucuccaggacuauugagcccagagagag

SEQ ID NO: 133797 - RNA, 44 nt, Homo sapiens
cuguguggagggggagcagggauaucuaagcuguggugugaaag

SEQ ID NO: 133798 - RNA, 43 nt, Homo sapiens
cccucuucccccaccccaugcccccaauucuguggcgcaucca

SEQ ID NO: 133799 - RNA, 22 nt, Homo sapiens
uuagagggcagagccaagggag

SEQ ID NO: 133800 - RNA, 38 nt, Homo sapiens
acugcaccagacggagacguagagagaaaagaggagga

SEQ ID NO: 133801 - RNA, 48 nt, Homo sapiens
uuguacucucucugccccucagcccagucccagucccuucccgagucc

SEQ ID NO: 133802 - RNA, 37 nt, Homo sapiens
acugcggagggagggaucagaugcugagauggagaaa

SEQ ID NO: 133803 - RNA, 33 nt, Homo sapiens
aggauggcauuaaugcccacacuggguuagaga

SEQ ID NO: 133804 - RNA, 42 nt, Homo sapiens
agagggaagacuguggggcagggagagggaaugaguccagag

SEQ ID NO: 133805 - RNA, 355 nt, Homo sapiens
caaaggaaagggaauggaggccagaugcgguggcucacgccuauaaucccagcacuuugggaggccaagaugggccgaucaccugaggucaggaguucgagaccagccuggccaacauggugaaaccccgucucuacuaaaaaugcaaaaauuagccaggcgugguggugcaucucuguaaucccagcuacucgggaggcugaggugggagaauugcuugaacccaggaaguggagacugcagugagccaagaucgagccacugcacuccagccugagcaacagagugagacuccgucucaaaacaacaacaacaacaacaaaaggaauggaacauggaacaaguaggcgugugg

SEQ ID NO: 133806 - RNA, 44 nt, Homo sapiens
uaguccuucccacucucaacucagauggaauccccuucugacau

SEQ ID NO: 133807 - RNA, 40 nt, Homo sapiens
gucugggcacgagauggggcuggggacucggcccaaggag

SEQ ID NO: 133808 - RNA, 45 nt, Homo sapiens
auuagcagggugguggcccugcaggcuuggcgggcaagcagcgag

SEQ ID NO: 133809 - RNA, 45 nt, Homo sapiens
ggauggccaccaccaagauuuguggucucugaagugggucaggau

SEQ ID NO: 133810 - RNA, 59 nt, Homo sapiens
cggcuaagauucaguggacaaagcuaaaaccugcagagcaaugaacucugggugguagu

SEQ ID NO: 133811 - RNA, 52 nt, Homo sapiens
cucauuguuguuauuuuaauaaaugcucauuagucuguaucagagucucugg

SEQ ID NO: 133812 - RNA, 46 nt, Homo sapiens
gccuugcuacagcccccaagacugaaaaaccucccgcacggaagaa

SEQ ID NO: 133813 - RNA, 46 nt, Homo sapiens
guucucacccuucauaacuucaguuuacacauggguuugaccagcu

SEQ ID NO: 133814 - RNA, 30 nt, Homo sapiens
ccuccuguucuuugcaguuccuccucagau

SEQ ID NO: 133815 - RNA, 43 nt, Homo sapiens
gaguguagguaaccaggagauaagaaaugagguauguauauac

SEQ ID NO: 133816 - RNA, 42 nt, Homo sapiens
aaugaauacgugaaaggccaaagacugaaauucaacagggau

SEQ ID NO: 133817 - RNA, 30 nt, Homo sapiens
gaaugggauggaauguuagaauauggggga

SEQ ID NO: 133818 - RNA, 45 nt, Homo sapiens
cccgcuacaccagccuucggccagggccuccacucaaucccccag

SEQ ID NO: 133819 - RNA, 48 nt, Homo sapiens
guucggggucagcuccagaccaugcuccaaaccucacgugauacagcc

SEQ ID NO: 133820 - RNA, 46 nt, Homo sapiens
auugggcuccuaguggauuuggguccguuuccguugggacguuuug

SEQ ID NO: 133821 - RNA, 46 nt, Homo sapiens
uacaacgugcaacgggucagguggccaauguccuugaucuccgcac

SEQ ID NO: 133822 - RNA, 37 nt, Homo sapiens
cgggguggcggcggcggcggcggcggcggcggcggcg

SEQ ID NO: 133823 - RNA, 42 nt, Homo sapiens
ggcgggaagagguggcagccgggggggcuguggcggucgcgg

SEQ ID NO: 133824 - RNA, 46 nt, Homo sapiens; identical to SEQ ID NO: 35872

SEQ ID NO: 133825 - RNA, 51 nt, Homo sapiens; identical to SEQ ID NO: 35873

SEQ ID NO: 133826 - RNA, 42 nt, Homo sapiens
cgaggaggaggaggaggaggaggaggaggaggaggaggaggu

SEQ ID NO: 133827 - RNA, 30 nt, Homo sapiens
aguguguguguguguguguguguguugggg

SEQ ID NO: 133828 - RNA, 43 nt, Homo sapiens
agaccagagacgugaguuaugcuggaaccugggauugugggua

SEQ ID NO: 133829 - RNA, 58 nt, Homo sapiens
gcggauaaacgcucuccccucggcucccggacgcgacggaggucguaguaguagugag

SEQ ID NO: 133830 - RNA, 42 nt, Homo sapiens
uagaggcgcugcucaacaagacuaugcgcauucgcaugacag

SEQ ID NO: 133831 - RNA, 46 nt, Homo sapiens
uucucugccggggagccccgugugcugggccuggccaugguacccg

SEQ ID NO: 133832 - RNA, 46 nt, Homo sapiens
cacgauggcgcuuaccuuucagacuucauuaaacuuaugaccgaau

SEQ ID NO: 133833 - RNA, 42 nt, Homo sapiens
cucaguguugaucuucgguuucacagacugggcaggggaaag

SEQ ID NO: 133834 - RNA, 47 nt, Homo sapiens
caucaagguagagaguggugacaaggagaccuuuaucgccucugagg

SEQ ID NO: 133835 - RNA, 47 nt, Homo sapiens
cuuccaccucagaggcgauaaaggucuccuugucaccacucucuacc

SEQ ID NO: 133836 - RNA, 46 nt, Homo sapiens
cgcagcuucagcaugucggcccggcugacacccgguggcccugggg

SEQ ID NO: 133837 - RNA, 43 nt, Homo sapiens
ucgggaggaagccccagggccaccgggugucagccgggccgac

SEQ ID NO: 133838 - RNA, 30 nt, Homo sapiens
cccgccugugccgccgaugcuccuucugau

SEQ ID NO: 133839 - RNA, 46 nt, Homo sapiens
gccucuagccaaguucccuccacccucucagccacagccaccacca

SEQ ID NO: 133840 - RNA, 41 nt, Homo sapiens
aagggcuccuucagcggggguuggggggccacgccugcuuc

SEQ ID NO: 133841 - RNA, 45 nt, Homo sapiens
agacccccuuccccggccucccagcccagcacagaacccccagga

SEQ ID NO: 133842 - RNA, 46 nt, Homo sapiens
ugugcugggcugggaggccggggaagggggucuauacuucuggcca

SEQ ID NO: 133843 - RNA, 43 nt, Homo sapiens
ugagagaccuccagcgcgggaguuugguaauggucagcgccgg

SEQ ID NO: 133844 - RNA, 42 nt, Homo sapiens
gggggccugggccugggggagcagccgggaccagccgguggc

SEQ ID NO: 133845 - RNA, 47 nt, Homo sapiens
uugggccccgcggacccucuccgcgguucacgugguauuacugucag

SEQ ID NO: 133846 - RNA, 32 nt, Homo sapiens
gacagaggggggcacccauggccaaacgggag

SEQ ID NO: 133847 - RNA, 46 nt, Homo sapiens
ccucaaaccaggaauuaaacuggaggagcaccccaagaagggcugg

SEQ ID NO: 133848 - RNA, 45 nt, Homo sapiens
uucuacaagcuguaccugguagggggugcucagggccggcgcugu

SEQ ID NO: 133849 - RNA, 43 nt, Homo sapiens
gacaaaggcgggcaagcgugagcugagaauugcuguccuggaa

SEQ ID NO: 133850 - RNA, 45 nt, Homo sapiens
uccaaagcaauagagcacuugccccagaagucuaagacccagugu

SEQ ID NO: 133851 - RNA, 49 nt, Homo sapiens
aaggcagggcagggugccucccucccccagagggacugcgcauccgaga

SEQ ID NO: 133852 - RNA, 62 nt, Homo sapiens
ucccuucacuuccucauccucucuaaccuccuuuuucuuuuuuuaaugcugcagccuccaca

SEQ ID NO: 133853 - RNA, 49 nt, Homo sapiens
uuaaaaaaaaaacaaaaacaaaaacaaaaaaacccauaaugcccacaga

SEQ ID NO: 133854 - RNA, 110 nt, Homo sapiens
aaaggaaggaguuagugauuaguugauaacuugcuaaaagaagccagagaaaggauggugggggcagaucugggcucaggggaaggagguggaauagucccaaagccagc

SEQ ID NO: 133855 - RNA, 49 nt, Homo sapiens
aaguuaucaacuaaucacuaacuccuuccuuuuccucugcaugccagcc

SEQ ID NO: 133856 - RNA, 54 nt, Homo sapiens
gcuuugggacuauuccaccuccuuccccugagcccagaucugcccccaccaucc

SEQ ID NO: 133857 - RNA, 47 nt, Homo sapiens
agccauccauaaaaacaaaguggauauucagccuaggucaaccccgc

SEQ ID NO: 133858 - RNA, 87 nt, Homo sapiens
agaacgugccagcaaagagggaaaaggccacagaaccaccuuguccucaauuacaaaggggugcauuucagaggagggaauagggau

SEQ ID NO: 133859 - RNA, 86 nt, Homo sapiens
agauaaauucaaagucaccaagauggcgacuguguagacagggagaaaguaugagagaucaagggacgguggccagagcuuaggaa

SEQ ID NO: 133860 - RNA, 33 nt, Homo sapiens
ucuuagcccagcucccugucugacugaucugag

SEQ ID NO: 133861 - RNA, 65 nt, Homo sapiens
aaguccauugcgguuccgucacucgccuuucccaccaacuucucccaaccucagaucagucagac

SEQ ID NO: 133862 - RNA, 45 nt, Homo sapiens
ggaagaaguguccucugagauggaaggauugggaguccagggugg

SEQ ID NO: 133863 - RNA, 45 nt, Homo sapiens
uagcuccgcagccccgucuauuuuuagcucgugcccacccccugg

SEQ ID NO: 133864 - RNA, 46 nt, Homo sapiens
uggucgugcaccccggaaucugcagcagcugcauaucugagggggg

SEQ ID NO: 133865 - RNA, 45 nt, Homo sapiens
aagcugcauucauaccccuuccucuuguuauucuccccugcucug

SEQ ID NO: 133866 - RNA, 45 nt, Homo sapiens
cccuccuuggccucucggauccgcacggaagccauccggaucccc

SEQ ID NO: 133867 - RNA, 57 nt, Homo sapiens
uuccaggcaucaaauccaagagguucagaauaccaacagucacacaaagaaaaacuc

SEQ ID NO: 133868 - RNA, 42 nt, Homo sapiens
uacuuuucgggccugcuggauguuggcaccgugagucccaau

SEQ ID NO: 133869 - RNA, 50 nt, Homo sapiens
gcuccucucucuucucugacucagucucugaagcuguagacacaucugag

SEQ ID NO: 133870 - RNA, 42 nt, Homo sapiens
cuugcugggggggguuccccagguucugaaucaaccgggggc

SEQ ID NO: 133871 - RNA, 42 nt, Homo sapiens
uguugggcccaucugauuccaggccuccauccaugacggucc

SEQ ID NO: 133872 - RNA, 47 nt, Homo sapiens
aaagagagucuucugaggguuuagugcguuccagggguggccucugg

SEQ ID NO: 133873 - RNA, 45 nt, Homo sapiens
cuccccccuagauaagagcagcuccagcgcaggucaguugggccu

SEQ ID NO: 133874 - RNA, 46 nt, Homo sapiens
agucugauggggaaggagagaggcuccccuuacccuggggguaggg

SEQ ID NO: 133875 - RNA, 23 nt, Homo sapiens
cuccaggggcagcgucccggggg

SEQ ID NO: 133876 - RNA, 45 nt, Homo sapiens
gccgcuggccagguugccucuucccuguccgcagcgggaaggucc

SEQ ID NO: 133877 - RNA, 34 nt, Homo sapiens
guccuccggcauccgcccccaccaaggcuccaga

SEQ ID NO: 133878 - RNA, 33 nt, Homo sapiens
guuggaggugagucuggccaguucugggcagac

SEQ ID NO: 133879 - RNA, 41 nt, Homo sapiens
ugagggagggagcacggugagggggcuuccaguuugcagug

SEQ ID NO: 133880 - RNA, 56 nt, Homo sapiens
uacuaccaaaaauauaauuguauguugugcggcucucccuggcuaucaugggagga

SEQ ID NO: 133881 - RNA, 77 nt, Homo sapiens
caggguggggugaggagguuccugcucuggcaggucuaggcggaagggaguggagauggggcugguuccugcugcag

SEQ ID NO: 133882 - RNA, 61 nt, Homo sapiens
ccucccucagcccggcugggacugucucccggaccccagugcuggggugggggaaggggga

SEQ ID NO: 133883 - RNA, 45 nt, Homo sapiens
cuccccaucugagccagccugcuggugugacuuacucauccucca

SEQ ID NO: 133884 - RNA, 42 nt, Homo sapiens
uguggucuccucucucugcaacggccucaucgccgcccagcu

SEQ ID NO: 133885 - RNA, 42 nt, Homo sapiens
cucugacgcccuugacuguagucacccugcuccaggccucca

SEQ ID NO: 133886 - RNA, 42 nt, Homo sapiens
gaagucacuucugagaagggcggaagugucucgggcuccuua

SEQ ID NO: 133887 - RNA, 23 nt, Homo sapiens
caccaaucuccuacuccccagca

SEQ ID NO: 133888 - RNA, 43 nt, Homo sapiens
augagaggggagggaggcaggacuggauauaggcucagaggga

SEQ ID NO: 133889 - RNA, 46 nt, Homo sapiens
gccacgguucauccaacaagcaacagcacugccaccagcccaggau

SEQ ID NO: 133890 - RNA, 45 nt, Homo sapiens
guacgaggcucacacagugaguuugcagugacacagcuccuugua

SEQ ID NO: 133891 - RNA, 55 nt, Homo sapiens
cuccagaggguaccauucccaaagugacgggaugggaucucucccaguaguggag

SEQ ID NO: 133892 - RNA, 57 nt, Homo sapiens
aggcucugcagcucuguuuguugggucagcagagccauggcacaagccacggccccc

SEQ ID NO: 133893 - RNA, 42 nt, Homo sapiens
gaagaagguuguuacgcaaggagaaauaaaaaggaacuugaa

SEQ ID NO: 133894 - RNA, 48 nt, Homo sapiens
gccuugagacccuccacccucccucagccucaggagaauuagguucca

SEQ ID NO: 133895 - RNA, 27 nt, Homo sapiens
gagaccagggccccucagugaaccugg

SEQ ID NO: 133896 - RNA, 29 nt, Homo sapiens
uacccagaagacacauagaucaccccggg

SEQ ID NO: 133897 - RNA, 59 nt, Homo sapiens
guucugaggucacggugcugagguagagggugggguagaaauggaaaagaugagcagac

SEQ ID NO: 133898 - RNA, 42 nt, Homo sapiens
cagcgaugcccggcuccccaaacugaccacggccagcaggag

SEQ ID NO: 133899 - RNA, 42 nt, Homo sapiens
gggaccagcagggcggugcccggcuccccccggcgcccccuc

SEQ ID NO: 133900 - RNA, 42 nt, Homo sapiens
cccagcccagcuccguuguacauaaaugccuuguggcagagc

SEQ ID NO: 133901 - RNA, 46 nt, Homo sapiens
agaguauaccccaaccucucccaaguacucaccuaccagucccaaa

SEQ ID NO: 133902 - RNA, 46 nt, Homo sapiens
accaaguuacuccccuuccagcccacgauacacaccacagucucca

SEQ ID NO: 133903 - RNA, 45 nt, Homo sapiens
caucacccagcuauucaccuacuagucccaacuacacaccuacca

SEQ ID NO: 133904 - RNA, 46 nt, Homo sapiens
accagcccgaacuauucuccaaccagucccaauuacaccccaacau

SEQ ID NO: 133905 - RNA, 47 nt, Homo sapiens
ccuacuccccuaccucuccauccuauucuccaaccagucccaacuau

SEQ ID NO: 133906 - RNA, 45 nt, Homo sapiens
uauggcgccuggucccccaguguuggugaguaaccugauccagga

SEQ ID NO: 133907 - RNA, 46 nt, Homo sapiens
aaccgccaggacacaggaccacucaugaaguguuccuuugaggaaa

SEQ ID NO: 133908 - RNA, 56 nt, Homo sapiens
caggaguggauccuggagacggacggcgugagcuugaugcgggugcugagugagaa

SEQ ID NO: 133909 - RNA, 46 nt, Homo sapiens
gcuccguauucgcaucaugaacagcgaugagaacaagaugcaagag

SEQ ID NO: 133910 - RNA, 46 nt, Homo sapiens
acacauccagaacgaguuggagcgggaauuugagcggaugcgggag

SEQ ID NO: 133911 - RNA, 46 nt, Homo sapiens
ccucacacccacugaguucuuuuuccacgccauggggggucgugag

SEQ ID NO: 133912 - RNA, 59 nt, Homo sapiens
guuugggaggaggaaggaagguguuuguauguauuagggucaggagaaucacgggaguu

SEQ ID NO: 133913 - RNA, 104 nt, Homo sapiens
caucgagaaggcacacaacaaugagcuggagcccaccccagggaacacucugcggcagacguuugagaaucaggugaaccgcauucuuaacgaugcccgagaca

SEQ ID NO: 133914 - RNA, 68 nt, Homo sapiens
uggggacuccauugcugauucuaagacuuaccaggacauucagaacacuauuaagaaggccaagcagg

SEQ ID NO: 133915 - RNA, 61 nt, Homo sapiens
uagagaugggucaugacaucacucgccucuucuacuccaacauucagacugucauuaacaa

SEQ ID NO: 133916 - RNA, 71 nt, Homo sapiens
gcugaucaugggcauccuguguaagaagucucugggcacgucagcuggcucccugguccacaucuccuacc

SEQ ID NO: 133917 - RNA, 47 nt, Homo sapiens
auaccuggucacaucaauuguauccguacccacaguacccaucccga

SEQ ID NO: 133918 - RNA, 111 nt, Homo sapiens
ggaggaacagugcagaaggcuuuauguucagaaucucucuugcuuuucuucuagacugaguuccuugagauuggugaaugcuguguauuauucaucccugauaaccuggug

SEQ ID NO: 133919 - RNA, 42 nt, Homo sapiens
gccugcuguugugaugcagggcucugcccguaaccaggucag

SEQ ID NO: 133920 - RNA, 46 nt, Homo sapiens
acgaccuuugcaagggcaaaaacauaugcgaggguggggaggagau

SEQ ID NO: 133921 - RNA, 41 nt, Homo sapiens
ccccaagcuuggggggcugauggacccgaggcaggggguga

SEQ ID NO: 133922 - RNA, 45 nt, Homo sapiens
uaauaaggaccuuguuagcuuugcuaaagcagaggaaagaggacg

SEQ ID NO: 133923 - RNA, 46 nt, Homo sapiens
uauacauuguugguagaaagauagauugguauaaccuuuuuggagg

SEQ ID NO: 133924 - RNA, 45 nt, Homo sapiens
uauucguuacccuuuuucuucuuccucccccaaaaaccuuuuccu

SEQ ID NO: 133925 - RNA, 83 nt, Homo sapiens
gcccagcagccccaccaagccagauaggaaggccacuguugggaggcaggagggaaagugcagagaacgauagaccagaagcc

SEQ ID NO: 133926 - RNA, 43 nt, Homo sapiens
gcgaggguguccaguguuccagaauguguccagaccaagguag

SEQ ID NO: 133927 - RNA, 44 nt, Homo sapiens
uuaugggaggggugcccagcuccguucuugaagcgcaggucaca

SEQ ID NO: 133928 - RNA, 55 nt, Homo sapiens
ccucaaucucccaggcagagaaaccucuggccgggagaccccgccccagccgcac

SEQ ID NO: 133929 - RNA, 54 nt, Homo sapiens
cccgcucacuagggcaugcucuugacgcucaggccccgacucgcugccccaccc

SEQ ID NO: 133930 - RNA, 49 nt, Homo sapiens
gauuucagugaaaaaagugggggauccccuccauuuagaguguagcaaa

SEQ ID NO: 133931 - RNA, 44 nt, Homo sapiens
ccuccagucaacuaccugguguauccacuaggaaggguggauuu

SEQ ID NO: 133932 - RNA, 72 nt, Homo sapiens
agaaaauuuaaggggcagccaggggagaaaaaaacaaaaacaaaaacaaacacggaugcuccucauuuugag

SEQ ID NO: 133933 - RNA, 47 nt, Homo sapiens
ggaggacgaggaagcccuguagcaggaagcugugauccgcucugacu

SEQ ID NO: 133934 - RNA, 46 nt, Homo sapiens
aagccgucggaggcucgggaagcguggcccacauuauguuccgccc

SEQ ID NO: 133935 - RNA, 47 nt, Homo sapiens
cuguagaccagccgcacagcuacgucacugagcacgaggcgccggug

SEQ ID NO: 133936 - RNA, 41 nt, Homo sapiens
ucgggggaggggcaggguccgcagccuggacuuugggccag

SEQ ID NO: 133937 - RNA, 39 nt, Homo sapiens
gaagaagacugcuacugugaugguuggagaaaugguggc

SEQ ID NO: 133938 - RNA, 45 nt, Homo sapiens
uuuucucccccccauugggacaccagucuucgguguguggaaugu

SEQ ID NO: 133939 - RNA, 45 nt, Homo sapiens
uucaaagugggcagcuucccagccucggcagugacgcuggcagau

SEQ ID NO: 133940 - RNA, 40 nt, Homo sapiens
ggcucagcgugggaggggaaaauagaaauaaugaagccgc

SEQ ID NO: 133941 - RNA, 27 nt, Homo sapiens
agccgagggagaucggagggggccggg

SEQ ID NO: 133942 - RNA, 63 nt, Homo sapiens
ccgggacauccaguuggcccaguuuuacuggcccauccuugaggagcuuaaugucacucggcc

SEQ ID NO: 133943 - RNA, 41 nt, Homo sapiens
cugagcucaccaucugaaggagagugccaucauccuuagga

SEQ ID NO: 133944 - RNA, 98 nt, Homo sapiens
cugccgugaguaggaaaggaaagggguagcaaggaccuggggccugcagggugucagaggagggccuggcagcugcaggaggaagcuggguaccaggc

SEQ ID NO: 133945 - RNA, 47 nt, Homo sapiens
ccaagcucccugaguacaccagggaagguaccgaugcgggaugggcc

SEQ ID NO: 133946 - RNA, 57 nt, Homo sapiens
cugaucagggaggggcugcgugaagagagggggaacuggccccgucgaggcccaggg

SEQ ID NO: 133947 - RNA, 36 nt, Homo sapiens
ggaaggcccaaggccgcccagggcagagagaggaga

SEQ ID NO: 133948 - RNA, 44 nt, Homo sapiens
ucugugguauaccugugaggugguugacaauuaguaguuuaauc

SEQ ID NO: 133949 - RNA, 54 nt, Homo sapiens
ugugcacugggacguggaguagaaggcaggcgggagggcgggcagggugcaagg

SEQ ID NO: 133950 - RNA, 42 nt, Homo sapiens
ccucgccccccaccucagugugguggaagggaggugacaugg

SEQ ID NO: 133951 - RNA, 28 nt, Homo sapiens
agauacagggagagcuggaugagccugg

SEQ ID NO: 133952 - RNA, 45 nt, Homo sapiens
gacccgucuggaaaaggugacccugacauggagaggugacccagg

SEQ ID NO: 133953 - RNA, 41 nt, Homo sapiens
ggagcugaguggggagguucuaggggauccagagucacaug

SEQ ID NO: 133954 - RNA, 41 nt, Homo sapiens
uuccgccaggacugugcugacaggagcucagggccugcaga

SEQ ID NO: 133955 - RNA, 45 nt, Homo sapiens
aggacuauggauuuaugaugguggaugagcccaacacucccuacc

SEQ ID NO: 133956 - RNA, 45 nt, Homo sapiens
uccuacgaaagaacagcuccaacuugaugcagaaaucccccaaug

SEQ ID NO: 133957 - RNA, 42 nt, Homo sapiens
uugcgcucccgcuccaucauaaugugccggugcagcgcccug

SEQ ID NO: 133958 - RNA, 40 nt, Homo sapiens
gauauguuugugacuugaauacugguggcaaggaugcaug

SEQ ID NO: 133959 - RNA, 48 nt, Homo sapiens
gccaaccuggcccucggcuccccuucauccaacacagccagaacccgc

SEQ ID NO: 133960 - RNA, 43 nt, Homo sapiens
ggguggugcucaggguaaagggcuauaggcaacaggggaccag

SEQ ID NO: 133961 - RNA, 49 nt, Homo sapiens
cacaagcagcacccacccccuucucccccaccagggcuguagugugagg

SEQ ID NO: 133962 - RNA, 42 nt, Homo sapiens
cuuuugauguuggggacauccauauuaugaguugacgggcag

SEQ ID NO: 133963 - RNA, 78 nt, Homo sapiens
acaccaggagaaggagcugagaaacuggggaauaaggaagguagaagggaaaggauaagaaacuaagaaaugugaaag

SEQ ID NO: 133964 - RNA, 31 nt, Homo sapiens
gcucaaggaacccaaggagagugggaugggg

SEQ ID NO: 133965 - RNA, 44 nt, Homo sapiens
auacuucuauaaagucacugcugaagacaagcauccuauugugg

SEQ ID NO: 133966 - RNA, 48 nt, Homo sapiens
cacugggcugggaggagccuuuggauauuuuuauauacguuugaaaag

SEQ ID NO: 133967 - RNA, 47 nt, Homo sapiens
auuuuuugagauuggcccuggccccauuccuugguucaucguggccg

SEQ ID NO: 133968 - RNA, 44 nt, Homo sapiens
ucgcccaggugaccggagcaagccucaugggugccugggcagug

SEQ ID NO: 133969 - RNA, 48 nt, Homo sapiens
agucagagacuccaggaucgguucuuucaucuucgccgccccugcgcg

SEQ ID NO: 133970 - RNA, 42 nt, Homo sapiens
uaccucuuugcuagggggaauguaaccagcauaugccaaaac

SEQ ID NO: 133971 - RNA, 26 nt, Homo sapiens
guuggccgaggccuccgaagcacccc

SEQ ID NO: 133972 - RNA, 58 nt, Homo sapiens
uccucuucagagucuguaucacuggggggugccuggggaggcccaggaggugggaguc

SEQ ID NO: 133973 - RNA, 52 nt, Homo sapiens
aauuaaaaauacaaccgguguagaagaaaauaaauggggagugaaauagaag

SEQ ID NO: 133974 - RNA, 45 nt, Homo sapiens
cguccugcagcggcccgcgggcgccaaguacuuuuucaagucuau

SEQ ID NO: 133975 - RNA, 26 nt, Homo sapiens
auggacaagguuaugcuuggauagau

SEQ ID NO: 133976 - RNA, 46 nt, Homo sapiens
cagaaaccgagucaguagugucacugaggcgggagcggccucgcag

SEQ ID NO: 133977 - RNA, 85 nt, Homo sapiens
augcccccaccuccaccuccagucccuccagcagugcagccuccgggggccccuccagucagagaccugggcucugugcccccag

SEQ ID NO: 133978 - RNA, 60 nt, Homo sapiens
aauaggcauuuccucuuuuauaugaagaauucccauccauugggccccuucuaaccccag

SEQ ID NO: 133979 - RNA, 44 nt, Homo sapiens
cagcccugcccuuugcaggguuggggguggucagcgguaccccg

SEQ ID NO: 133980 - RNA, 45 nt, Homo sapiens
uuuagucacuuguauaaaacaccaaauaaagcaauagaggcaaac

SEQ ID NO: 133981 - RNA, 45 nt, Homo sapiens
accacaccaccccgcuccaccaaggccuuggagaugcuuuugaag

SEQ ID NO: 133982 - RNA, 42 nt, Homo sapiens
agagccacaaacagccgaagaaugucauuuguccccucaaag

SEQ ID NO: 133983 - RNA, 47 nt, Homo sapiens
ggaaccagggugaggcccauggcucaggccuaggggacugcauguaa

SEQ ID NO: 133984 - RNA, 46 nt, Homo sapiens
aagagacgguuagcaaguucagggaagggacuuccgcugugucaag

SEQ ID NO: 133985 - RNA, 72 nt, Homo sapiens
ugcauaugcacaugugagaguggguacagcagagcguggucaugagugugugcaaauguguguuuuugagug

SEQ ID NO: 133986 - RNA, 38 nt, Homo sapiens
ugaggggagcaaauuuaguguggaacgagguuucuagg

SEQ ID NO: 133987 - RNA, 49 nt, Homo sapiens
gggcaagggguagggaaagagacaugggcaguggcgggcagcgaucggg

SEQ ID NO: 133988 - RNA, 47 nt, Homo sapiens
guguggcaggcccaucggaggggcaggcagguaagggguggccagag

SEQ ID NO: 133989 - RNA, 48 nt, Homo sapiens
uggacgccugcaucgcccaggacgaggcgcuggcccccggucccccag

SEQ ID NO: 133990 - RNA, 42 nt, Homo sapiens
gagaacgcacaccugguggucaucaacuccugggaggagcag

SEQ ID NO: 133991 - RNA, 36 nt, Homo sapiens
cugccugcagguguaccgcugggugugugagaaaag

SEQ ID NO: 133992 - RNA, 41 nt, Homo sapiens
uuugaccuucgcuccgacccuggccugccuguccuguuauu

SEQ ID NO: 133993 - RNA, 42 nt, Homo sapiens
gacugcgacccucggaagggagagggaaugcggcgacuggga

SEQ ID NO: 133994 - RNA, 49 nt, Homo sapiens
guuuggggugcuccgcuccuuuggggucuucuucguggaguuuguggcg

SEQ ID NO: 133995 - RNA, 42 nt, Homo sapiens
acagagccccccgacgggggcuggggaugggugguggugcuc

SEQ ID NO: 133996 - RNA, 46 nt, Homo sapiens
ggcagcgggggugggugugcagaggugcggcguccagaacccggcu

SEQ ID NO: 133997 - RNA, 41 nt, Homo sapiens
gggcuccagccaguacccccuaccuccucacaucccaggcu

SEQ ID NO: 133998 - RNA, 42 nt, Homo sapiens
cacugcaccagcaguccuagcggccgccaccuauuugcagau

SEQ ID NO: 133999 - RNA, 42 nt, Homo sapiens
ucucuaguggcuucuucuauucaauuuuccggggccgugcgg

SEQ ID NO: 134000 - RNA, 58 nt, Homo sapiens
uuccguaguucggggaagggagccucggcugggauuuggagguguguggacggcaggc

SEQ ID NO: 134001 - RNA, 42 nt, Homo sapiens
aggagccgaggccaagaggggagagagaccccgccccccuua

SEQ ID NO: 134002 - RNA, 45 nt, Homo sapiens
guauaugaagauucuggcaucccccuuccagcugagucacccaag

SEQ ID NO: 134003 - RNA, 46 nt, Homo sapiens
augacuccuuuccuaaccucuucucucuuuucuucagggcccagau

SEQ ID NO: 134004 - RNA, 54 nt, Homo sapiens
agggaagcagcugagcuggaaaggaguucugaggacgauggaaccuuggguaag

SEQ ID NO: 134005 - RNA, 24 nt, Homo sapiens
gccccgggcggggggcgggcggga

SEQ ID NO: 134006 - RNA, 28 nt, Homo sapiens
cauggccccgcgcgccuccucacggaga

SEQ ID NO: 134007 - RNA, 55 nt, Homo sapiens
gggacgcgaccugggugacacggugcagggagucuuuaaauagaggaggggcugg

SEQ ID NO: 134008 - RNA, 78 nt, Homo sapiens
gcgcuagggccccggcgcguuuccccgcuccagccccuccucuauuuaaagacucccugcaccgugucacccaggucg

SEQ ID NO: 134009 - RNA, 67 nt, Homo sapiens
gcaagucagcuacaacuguuucaucgcugcaggccuuuaccuccuccucggaggcuucucuuucugc

SEQ ID NO: 134010 - RNA, 39 nt, Homo sapiens
agaucugucauagccauuuugcagagguggacugagaag

SEQ ID NO: 134011 - RNA, 42 nt, Homo sapiens
auuccgcuguguugauugaggacguucccuucacggagaaag

SEQ ID NO: 134012 - RNA, 41 nt, Homo sapiens
ucguuuugguuaaucucaggcucggguguuguagcaacauu

SEQ ID NO: 134013 - RNA, 67 nt, Homo sapiens
gggcccuggagugggaggagccagggcugguaaagguggagaccccucaagguaggagaaacaagag

SEQ ID NO: 134014 - RNA, 46 nt, Homo sapiens
gagcaaguaucgagaacaaaugguuagauugcuaauggcuagcaaa

SEQ ID NO: 134015 - RNA, 42 nt, Homo sapiens
aagccauugaaauugacaagcaacaggauugcaaggaacaag

SEQ ID NO: 134016 - RNA, 42 nt, Homo sapiens
cuuuuuccaaaacauaauuggaaaauagaaacugagccauug

SEQ ID NO: 134017 - RNA, 56 nt, Homo sapiens
uguccauaguauuccccagaugucuccauagcuguccucuuuuugacgauccagag

SEQ ID NO: 134018 - RNA, 80 nt, Homo sapiens
gaauauuuugaagaggaagaagaggaggaagaagaguuugaggaagaauuugaggaagaagaaggugaguuagaggaaga

SEQ ID NO: 134019 - RNA, 71 nt, Homo sapiens
aagaggaagaagaagaagaggaagaagaggaagaggaggaagacuuugaggaagaggaagaggaugaagag

SEQ ID NO: 134020 - RNA, 45 nt, Homo sapiens
cuauagcccccacugggccaccaacagccuccccuccugugccag

SEQ ID NO: 134021 - RNA, 42 nt, Homo sapiens
cucccaccacagccaaccaccuaggccuuucugucccaggcc

SEQ ID NO: 134022 - RNA, 48 nt, Homo sapiens
ccccgucuccucgcugcccaccuccucuugccugugcccugcaagccu

SEQ ID NO: 134023 - RNA, 58 nt, Homo sapiens
cgucagucuguugggagccuacccuuuacacaccauucuucuuccccaggccucagcc

SEQ ID NO: 134024 - RNA, 35 nt, Homo sapiens
augcggggaaggcuccucccugugaagcugacauu

SEQ ID NO: 134025 - RNA, 42 nt, Homo sapiens
ugugggggaagcuauggccccgccaagccaccggaaagggga

SEQ ID NO: 134026 - RNA, 46 nt, Homo sapiens
cucucuccaggccaggagaggccuuacaggugaccauccaggaagg

SEQ ID NO: 134027 - RNA, 46 nt, Homo sapiens
ccguguccgucccugugcaggaaauccuggauuucaucugccggac

SEQ ID NO: 134028 - RNA, 14 nt, Homo sapiens
gaggggauggaaga

SEQ ID NO: 134029 - RNA, 42 nt, Homo sapiens
gcacaccgagagcugggagcaggagcuacacagucugcuggc

SEQ ID NO: 134030 - RNA, 57 nt, Homo sapiens
gaaguagcgauuuggaaauuggaggagaaaacuuuaguagcagcguuaaccagagaa

SEQ ID NO: 134031 - RNA, 108 nt, Homo sapiens
ugggaagagucaugugguggggacugguuagaaauucaagggagauaaagcgagugacaguguaagguucugagaggaagggaggaagauaguauugaaagcacagcg

SEQ ID NO: 134032 - RNA, 107 nt, Homo sapiens
cagacuggcacgggauaagaagcgaaugggagaagggaaauggaaggagagaagaugggaaaucuuuucgagaugcugggcucuaacgaugagggagagaaauuggg

SEQ ID NO: 134033 - RNA, 30 nt, Homo sapiens
ugugugccuccugaggugggacaagacgca

SEQ ID NO: 134034 - RNA, 48 nt, Homo sapiens
cuagggggaagagucuucaguguuuagauggcaguugaagcugaggau

SEQ ID NO: 134035 - RNA, 60 nt, Homo sapiens
cugccuguggauaauggauuagaaaggaacagauuggaagcagaaacucuauguagaugg

SEQ ID NO: 134036 - RNA, 46 nt, Homo sapiens
gaaaguguucuaaugugccaaagccaugagagaagaggagcauggc

SEQ ID NO: 134037 - RNA, 55 nt, Homo sapiens
uuauauaaaugaaugugaagugauaaacugagguaggugcuguggagguaaagac

SEQ ID NO: 134038 - RNA, 43 nt, Homo sapiens
acuuggguggggcauggagggaaggaucaggcaaaauauaacu

SEQ ID NO: 134039 - RNA, 54 nt, Homo sapiens
uaggugcugcccagacauauagaggugaagcagacccaucuuugaagucuggua

SEQ ID NO: 134040 - RNA, 68 nt, Homo sapiens
uggggcauggagagguuaccuggggggcugaugaggaaacaucuuucgugggcuuccagaaugugaga

SEQ ID NO: 134041 - RNA, 42 nt, Homo sapiens
guuggguagggaaaaaauaugggaggggcuguucagucagag

SEQ ID NO: 134042 - RNA, 42 nt, Homo sapiens
ccuuaucugaagacuggcagagauuuuuccaaagaaaccggc

SEQ ID NO: 134043 - RNA, 41 nt, Homo sapiens
ugcgccgggauuacggugcagugcaagugcgauagggaggu

SEQ ID NO: 134044 - RNA, 40 nt, Homo sapiens
gggguccaaucgguuucaagggguugcagcggggcgggga

SEQ ID NO: 134045 - RNA, 43 nt, Homo sapiens
gggaagagccugggugguuccuagggcaaccaguggccauuac

SEQ ID NO: 134046 - RNA, 32 nt, Homo sapiens
uaaaggagguugccuuggcuggguguggacag

SEQ ID NO: 134047 - RNA, 46 nt, Homo sapiens
ggagccccucaauguaaauguccacgucaccaacaacuccaccaag

SEQ ID NO: 134048 - RNA, 46 nt, Homo sapiens
cagggaugucucuguggagcugccuuuuguucuuaugcaccccaag

SEQ ID NO: 134049 - RNA, 45 nt, Homo sapiens
ccaaccucauugaauuugauaccaaguaagaaacucauuccccua

SEQ ID NO: 134050 - RNA, 104 nt, Homo sapiens
ucauaccuaaauuuucuggaaggggacagugaaaagaggagugacaggagggaaagggggagacaaaacuccuacucucaaccucacaccaacaccucccauua

SEQ ID NO: 134051 - RNA, 46 nt, Homo sapiens
gguccaucucccuggccuaguucuccagcaucugcucacagguucg

SEQ ID NO: 134052 - RNA, 32 nt, Homo sapiens
cgcgcgggaacguccuaggcaauacgcacgug

SEQ ID NO: 134053 - RNA, 44 nt, Homo sapiens
uucugcugugcgcucagcuuccgacgggagaggguagaccgggg

SEQ ID NO: 134054 - RNA, 44 nt, Homo sapiens
guggaaacuucucggcuuucccagucuggagugaacgccuccgg

SEQ ID NO: 134055 - RNA, 45 nt, Homo sapiens
ucagucacucgauuggcgauguaggaccugcaggauggcagaaua

SEQ ID NO: 134056 - RNA, 32 nt, Homo sapiens
uggguaucagcagcugagccugagcgacagca

SEQ ID NO: 134057 - RNA, 46 nt, Homo sapiens
uggguggagagggcacucggcucgaccagcugcaguacgacgugag

SEQ ID NO: 134058 - RNA, 50 nt, Homo sapiens
aggggcucagcuccuuggcgcugucaccaucuucugccugggaggagggc

SEQ ID NO: 134059 - RNA, 42 nt, Homo sapiens
aacaaacugcggguguauuaccuguccuggcuccggaacaag

SEQ ID NO: 134060 - RNA, 47 nt, Homo sapiens
gggcuggggcugucccacacuggacccagcucucccccugcagccag

SEQ ID NO: 134061 - RNA, 46 nt, Homo sapiens
ccccuugcuugcaucuguauauagugugagcagcaaguaacccuuc

SEQ ID NO: 134062 - RNA, 44 nt, Homo sapiens
guggccuuggauauccuguuuguuaauaaagacaauucaaccag

SEQ ID NO: 134063 - RNA, 41 nt, Homo sapiens
gcgcguaggggagaucaggcacucgguugaaguaggccccg

SEQ ID NO: 134064 - RNA, 30 nt, Homo sapiens
cacuuccacagcuccaccgaggugaggcua

SEQ ID NO: 134065 - RNA, 37 nt, Homo sapiens
ggagcagagcaguagaguagcagggcaggggucacag

SEQ ID NO: 134066 - RNA, 45 nt, Homo sapiens
gaccccugcagaccccguccacacaggcauagccaugcucccugg

SEQ ID NO: 134067 - RNA, 42 nt, Homo sapiens
gccaagaccacgcagggcaccaagaggcagcgaggucagccg

SEQ ID NO: 134068 - RNA, 23 nt, Homo sapiens
cuuggagugggcuccaggguggu

SEQ ID NO: 134069 - RNA, 33 nt, Homo sapiens
gggggcgggcucugaggugggcucugggguggu

SEQ ID NO: 134070 - RNA, 25 nt, Homo sapiens
uuuuggagugaucaggcuuguggca

SEQ ID NO: 134071 - RNA, 41 nt, Homo sapiens
agagcagccagaagagacccaagacauagaagcccaggggg

SEQ ID NO: 134072 - RNA, 26 nt, Homo sapiens
caggaagaggcuggagcggaaagugg

SEQ ID NO: 134073 - RNA, 105 nt, Homo sapiens
uuccgggcugccugguccugcuucuuggugagaaaggagccucuggugaaagaaacaaaagauggaccucacagaaggcaucgcaugccuucggcccccccagga

SEQ ID NO: 134074 - RNA, 42 nt, Homo sapiens
uucuuauagagugcaaacugcagggguggggaggagggacag

SEQ ID NO: 134075 - RNA, 46 nt, Homo sapiens
guguugagucuuccaaaacccaccauuauucucagugccuaccagc

SEQ ID NO: 134076 - RNA, 46 nt, Homo sapiens
aguguugggcuaacuuggauucauaaacuucacaaauuucuuggau

SEQ ID NO: 134077 - RNA, 46 nt, Homo sapiens
aucuggagaggaugacccuuuugauucugacuuuucuuguccaguc

SEQ ID NO: 134078 - RNA, 46 nt, Homo sapiens
uggaaagcuguuggguccauugcccaugcauccugcggcugaagau

SEQ ID NO: 134079 - RNA, 52 nt, Homo sapiens
uucauguagggagcauuaagugauaaagcuggaguaucugucccgagaaaau

SEQ ID NO: 134080 - RNA, 49 nt, Homo sapiens
augaaguaguggcauacccacuguacaucuuauaugaaaauggagagac

SEQ ID NO: 134081 - RNA, 69 nt, Homo sapiens
gagccgcagacacccacuaacgugauaauacuuucagaagccgaagaggaaagucuaguacucaauaaa

SEQ ID NO: 134082 - RNA, 48 nt, Homo sapiens
gcuuguaggaaccuaggaagacuguaauaaauguguauucaaauggau

SEQ ID NO: 134083 - RNA, 51 nt, Homo sapiens
aaucuuugacauccucucuucuuagucuuccuuuuauaugcuaugauggaa

SEQ ID NO: 134084 - RNA, 46 nt, Homo sapiens
uaucaagucuuguuaagcccaacacaacaucauguagcacuuauag

SEQ ID NO: 134085 - RNA, 37 nt, Homo sapiens
gcucuccccaggugcuagauuuccagcagcaccacca

SEQ ID NO: 134086 - RNA, 28 nt, Homo sapiens
cauuacuuacuaauaaccacacuguguu

SEQ ID NO: 134087 - RNA, 42 nt, Homo sapiens
gcucaugagaagacuggacuuuucuucuguuccuccagugac

SEQ ID NO: 134088 - RNA, 49 nt, Homo sapiens
uacaaaucuauuauuucuagauuuuuguauaacaugauagacauaaaau

SEQ ID NO: 134089 - RNA, 45 nt, Homo sapiens
ggauuuccuugccgaccgagggguggacaacacuuuugcagauga

SEQ ID NO: 134090 - RNA, 73 nt, Homo sapiens
gugguugaaguuauaaagaaugaugauggcaagaaggcccuuguguuggacugucauuauccagaggaugagg

SEQ ID NO: 134091 - RNA, 43 nt, Homo sapiens
ucuaauguuuaguaugggugaaaaugaaaaauauguaacuucu

SEQ ID NO: 134092 - RNA, 43 nt, Homo sapiens
cgaacacaaauuugcugugggcugguuacuaaggagacaaaaa

SEQ ID NO: 134093 - RNA, 44 nt, Homo sapiens
agaugucuggagguugggagcuggaacugaaugggacagaagcg

SEQ ID NO: 134094 - RNA, 70 nt, Homo sapiens
cucucuuuccauugguaaaaucucugauggugugauaacucuuugccaaccuacgaaacccauaucugga

SEQ ID NO: 134095 - RNA, 41 nt, Homo sapiens
ggccaagcugcccaagaggcucuucagagaucauggaugcu

SEQ ID NO: 134096 - RNA, 88 nt, Homo sapiens
gcuuucaggagacauguaagcuuccugggugaagguugauuuguaccuucugaauccugucacguguagacaugggaaacugaccuau

SEQ ID NO: 134097 - RNA, 49 nt, Homo sapiens
gucucucugaaugcaguuuuaaaauagaaaacaaaacugacuucuguag

SEQ ID NO: 134098 - RNA, 38 nt, Homo sapiens
caaaugggaguaauaauaauaauccuuauaaaauuggg

SEQ ID NO: 134099 - RNA, 42 nt, Homo sapiens
gauguggaccuguucucucaguauuucaauggcgcccccguc

SEQ ID NO: 134100 - RNA, 42 nt, Homo sapiens
ccacacagaugugcucuuuggaguggugaaagcugcacagaa

SEQ ID NO: 134101 - RNA, 45 nt, Homo sapiens
ucuauuggucccaugugcuuugcuuucaaaaucugucgucagguu

SEQ ID NO: 134102 - RNA, 39 nt, Homo sapiens
guuuugccaaacuuugucagacaacaugaaaaaaaagga

SEQ ID NO: 134103 - RNA, 46 nt, Homo sapiens
ccagugguuccucacuacacugguacugaaaguguaauuucuuaga

SEQ ID NO: 134104 - RNA, 74 nt, Homo sapiens
cuuuguugcaaaaguguggacacuuuugacagcuuggcagauuuuaacuccagaagcacuuuaugaaaugguac

SEQ ID NO: 134105 - RNA, 58 nt, Homo sapiens
uuucugaugguggacuuuguggccugccaagcaggugguugagauaagcagugaagca

SEQ ID NO: 134106 - RNA, 81 nt, Homo sapiens
gguaggagccugcugguuuuaugaaagcugcuguccacguuuagugaaguaagguagcaaaaugggcaaaacugaugaaag

SEQ ID NO: 134107 - RNA, 41 nt, Homo sapiens
guaaccaacagguucgaagccguaaaacaaccugaaugcaa

SEQ ID NO: 134108 - RNA, 46 nt, Homo sapiens
gccucggcgagcgaaagcaaacgcgggauacucucgcguuccugau

SEQ ID NO: 134109 - RNA, 27 nt, Homo sapiens
gcaugcugggaucuucaggucggaggc

SEQ ID NO: 134110 - RNA, 23 nt, Homo sapiens
cauucacaugcuuaucugagaag

SEQ ID NO: 134111 - RNA, 32 nt, Homo sapiens
ugauuccagaguucacccagggaagcaaaggu

SEQ ID NO: 134112 - RNA, 50 nt, Homo sapiens
caguugagugucacggucagaacugcccuuuagaaggaucacuauggacc

SEQ ID NO: 134113 - RNA, 58 nt, Homo sapiens
uggcaccaaguggcugguggagacccaggugaaggccaggaggcggaagagaggagca

SEQ ID NO: 134114 - RNA, 25 nt, Homo sapiens
cgggggcugcuguccaauggaaaug

SEQ ID NO: 134115 - RNA, 43 nt, Homo sapiens
auaaucuaccucgcagacgugcacaaauugcauacuuaggcgg

SEQ ID NO: 134116 - RNA, 45 nt, Homo sapiens
uccaaauaaugacuucagaaaaaacuugaaaguaacagcagugcc

SEQ ID NO: 134117 - RNA, 73 nt, Homo sapiens
cagcaucuaauaagaauaaggaugaucuacagagcucuuacauugcuggggcagggcaugggaaggagcagga

SEQ ID NO: 134118 - RNA, 42 nt, Homo sapiens
gacuacaugucuuuuacuacagggucaagguguggggauaga

SEQ ID NO: 134119 - RNA, 25 nt, Homo sapiens
ggucagaaaauacaguagacuagau

SEQ ID NO: 134120 - RNA, 45 nt, Homo sapiens
auuuaggaucggcaggggaagcaggaugccacacugagaacaucu

SEQ ID NO: 134121 - RNA, 407 nt, Homo sapiens
acuguuuuguuuguagggauuuccuuggguauugcugaauuuacauuaggauguaaagaaauguugcugggcgugguggcucaugcccuauaauuccagcacuuugggagucugaagcggguggaucaccugaggucaggauuucaagaccagcauggacaacauggugaaaccccaucuguacuaaaaugcaaaaauuagcugggugugguggcgggugccuguacucccagcuacucaggaggcugaggcaggagaaucgcuugaacccgggaggcagagaucgcagugagccgagaucccaccacugcauuccagccugggugacagagcgagacucugucucaaaaaaaaaaaaaaaaaaaaaaagauggcagcuuuacugguucaaaaaaaaaaaagugaaa

SEQ ID NO: 134122 - RNA, 23 nt, Homo sapiens
ugcuagcuccuagaauaucucug

SEQ ID NO: 134123 - RNA, 92 nt, Homo sapiens
gggccugggaugucaguggggucuggggugucaguggggucuggggugucagugggaucuggggugucaguggggucugaggugucaguggg

SEQ ID NO: 134124 - RNA, 46 nt, Homo sapiens
ccccagugcuuggggacaggugugcagagccaaaggagcaguugag

SEQ ID NO: 134125 - RNA, 49 nt, Homo sapiens
uuuguacccagucugguugaggcagauagguaagggguguccugaaggg

SEQ ID NO: 134126 - RNA, 52 nt, Homo sapiens
cugagacaccacacccgcccuccucauaccccaccauuuugaccuggauggc

SEQ ID NO: 134127 - RNA, 54 nt, Homo sapiens
aaggggaggucuucaaaagacuguaacagcugccaggaguuguguggcaggagg

SEQ ID NO: 134128 - RNA, 46 nt, Homo sapiens
agggcgagcacuccaaacagguuugcaaagagagcaggucucagca

SEQ ID NO: 134129 - RNA, 66 nt, Homo sapiens
uccugcaauguggccuucgagaccuaaggauggagggagaagaaaucgugacuuccucugcggggu

SEQ ID NO: 134130 - RNA, 55 nt, Homo sapiens
acggaucccaccagcuucuugagcuuggagggcaccuucugcugggccaggagga

SEQ ID NO: 134131 - RNA, 45 nt, Homo sapiens
ccuccuuccagaaccgugggaacuugucuuccuugagugccaggc

SEQ ID NO: 134132 - RNA, 57 nt, Homo sapiens
gcaucaccaggugcagcugcuccuuggucagcaggggcagggccgcgcccagcaggc

SEQ ID NO: 134133 - RNA, 46 nt, Homo sapiens
uagcacggccagcugccgcucagggucauccuggcaccccucuagg

SEQ ID NO: 134134 - RNA, 386 nt, Homo sapiens
ugugagccacuuauaacuggcagaaacaggcugggcccaguggcucacaccuguaaucccagcacuuugggaggccaaggcuggccaaucacucgaggucaggaguucgagaccagccugaccaacacggugaaaccccaucuccauuaaaaauacaaaaauuagcugggugugguggcgggugccuguagucccagcuacuggagaggcugaggcagagaaucacuugauugcuugaacccgggaggcagaaguugcaaugagcugagaucacacgccacugcacuccagcuuaggccacagagagugagacucugucaaaaaaaaaaaaaaaaaaaaaaaagaaccagcaaaaacaggacauuccuuugccugaucucagagac

SEQ ID NO: 134135 - RNA, 78 nt, Homo sapiens
ugcucagucaaggccuccuccaucuccaggugcaggcuguccacaaugcucaccaaucgaaagaugauccauuuccuc

SEQ ID NO: 134136 - RNA, 51 nt, Homo sapiens
uccucaccuuccucgcucuuguccugugugguagaggcaggcgcgucacac

SEQ ID NO: 134137 - RNA, 93 nt, Homo sapiens
gcugaggguugggcccuggggaagucccggccuccacucccuggcugugaaaugccuggggcugcuccugggccaggcccugcucaccugcgg

SEQ ID NO: 134138 - RNA, 27 nt, Homo sapiens
ccucauguuugcagguccugaagagaa

SEQ ID NO: 134139 - RNA, 43 nt, Homo sapiens
cccugcagcacacccaggagcaccgucagguccaaggucagcu

SEQ ID NO: 134140 - RNA, 70 nt, Homo sapiens
ccuauuuaaaucacccccugguggcucccucacagcaaaaaagccugggggcaaagagguggcaggcacg

SEQ ID NO: 134141 - RNA, 43 nt, Homo sapiens
accgguggggccgacgggcggguugaaggagggaagcgggcga

SEQ ID NO: 134142 - RNA, 47 nt, Homo sapiens
aggaugacggagcugcagucggcacugcuacugcgaagacagcuggc

SEQ ID NO: 134143 - RNA, 51 nt, Homo sapiens
ggacaaguauuaaaguucuagaugcucagggggaguuagcuugcaguaaau

SEQ ID NO: 134144 - RNA, 46 nt, Homo sapiens
ggaaguggugaagacgcaccugcgugacgugaucauccugcccgag

SEQ ID NO: 134145 - RNA, 69 nt, Homo sapiens
gaacaggacaugaaaguuuugcugguacaaaguuuugcaguuauugugggaagacagaugguaaacuag

SEQ ID NO: 134146 - RNA, 66 nt, Homo sapiens
aaugcuguggccuuuaagccaagugaagaaagcuucaagggaagagagaucagcugugucaaaaaa

SEQ ID NO: 134147 - RNA, 37 nt, Homo sapiens
gugaaugguacuuugagaaaggcaguugcacuggacg

SEQ ID NO: 134148 - RNA, 51 nt, Homo sapiens
uuggagaauugcuaguggcaugcuugaugcugaugggauugaauuuaguag

SEQ ID NO: 134149 - RNA, 51 nt, Homo sapiens
gauccagaguaacaugagagaagguagagaaguaaauacaucggcagagau

SEQ ID NO: 134150 - RNA, 50 nt, Homo sapiens
uuauuuuuuguuucuguuaggaaaaaugagugcugguuauguuccacuag

SEQ ID NO: 134151 - RNA, 44 nt, Homo sapiens
guucugcccagaagauuagccuuccuccuucgcugcagcuccuc

SEQ ID NO: 134152 - RNA, 49 nt, Homo sapiens
aaggaaaaugagacucaaaaaauagaaaugaucuguuuaaguugcccag

SEQ ID NO: 134153 - RNA, 45 nt, Homo sapiens
gaggaggagaaccucacgaugcugcagccauucuguaugcuccag

SEQ ID NO: 134154 - RNA, 50 nt, Homo sapiens
uccuuuguacugaauuugaucauggaagaguuuuuguguuuugcuugaag

SEQ ID NO: 134155 - RNA, 55 nt, Homo sapiens
aagauuauccccuccgaccuccuaaaaugaaauucauuacagaaaucuggcaccc

SEQ ID NO: 134156 - RNA, 48 nt, Homo sapiens
guaacaagcaaaaauuauauggggaaaacuaagaaacaccguggcaag

SEQ ID NO: 134157 - RNA, 45 nt, Homo sapiens
cugauucuauuuuaguaaauagauuuuacuagcagauagggaugg

SEQ ID NO: 134158 - RNA, 46 nt, Homo sapiens
gauaaaaauggugaugugugcauuucuauucuucaugagccugggg

SEQ ID NO: 134159 - RNA, 75 nt, Homo sapiens
cacuguggaaaccaucaugauuagugucauuucuaugcuggcagacccuaauggagacucaccugcuaauguuga

SEQ ID NO: 134160 - RNA, 48 nt, Homo sapiens
gcaugaaaucacuugauacugcuuuuuuaaucuacagaaagaauggag

SEQ ID NO: 134161 - RNA, 79 nt, Homo sapiens
cucucauacccuucuccuuaguccuucauauuucucugccucuauucuucuauacugcagauuuuucucaccuauugua

SEQ ID NO: 134162 - RNA, 52 nt, Homo sapiens
guuggcuuuuauuguauugaaugaaggcuauaauacugagugccagagaagu

SEQ ID NO: 134163 - RNA, 52 nt, Homo sapiens
aaaacaacuucagcaaaugguaaaaugaacaugugcaguguuaaaggcaggc

SEQ ID NO: 134164 - RNA, 60 nt, Homo sapiens
cuuaggcuccuucauguuuguugugagguugugugugggaaguagucuuuggcuuauaag

SEQ ID NO: 134165 - RNA, 56 nt, Homo sapiens
cagugagaauucgugcaucucugcucugugggguuuggagaaaugcuuuggcagaa

SEQ ID NO: 134166 - RNA, 41 nt, Homo sapiens
guaaguguguugugacuggaaauugauucauuagaacccag

SEQ ID NO: 134167 - RNA, 48 nt, Homo sapiens
aaugcaguuaguuugauaaaaccauguggguuuuuuuuuuagggcuag

SEQ ID NO: 134168 - RNA, 35 nt, Homo sapiens
gcacagaaaguccuaggcaagaaacuugauuuuuu

SEQ ID NO: 134169 - RNA, 30 nt, Homo sapiens
uuuuuuaaaugguauguccauuucuaaaaa

SEQ ID NO: 134170 - RNA, 60 nt, Homo sapiens
uugaaaagaaagagcagcgagccaagcgcuuccauuuucgaucggaaguaaaucuugccc

SEQ ID NO: 134171 - RNA, 60 nt, Homo sapiens
aaagaaauguagccuuggaccgagacaugaugaagaaagguacaggguguuuugugggaa

SEQ ID NO: 134172 - RNA, 44 nt, Homo sapiens
cuucuggccuugccuugcguguccacuccuuauccaagcacucu

SEQ ID NO: 134173 - RNA, 692 nt, Homo sapiens
uaguaaaaaaagccgggugugguggcucaugccuguaaucccagcacuuugggaggccgaggcaggcggaucaccugaggucgggaguucgagaccagccugaccaccauggagaaacgucgucucuacuaaaaauacaaaauuagcauggcgugguggcgcaugccuguaaucccagcuacuugggaggcuuagacgggagaauagcuugaaccugggaggcagagguugcagugagccgagauugcaccauugcauuccagccugggcaacaagagugaaacuccaucucaaaaaaaaagaaaaaaaaaaaaagguaguuaaaaaaguacgcaauuggcugggcgccguggcucacaccuguaaucccagcacuuuaggaggccaaggcggguggaucacgagggcaagggauggagaccaugcugaccaacauggugaaaccccaucucuuaaaaauacaaaauuagccggguguggugguacgcuccuauagucccagcuacuggggaggcugaggcaggagaaucgcuugaacccagaaggcggagguugcagugagccgagaucgugccacugcacuccagccuggcgacagagcgagacuccaucucaaaaaauaaaaaguaugcaguccugauaaggcuaaguuucuuuuuugaccauagccuucaaccuuucugccuccucag

SEQ ID NO: 134174 - RNA, 46 nt, Homo sapiens
acuggagacaaucuauauuugcggaguagaugagaugagcacccaa

SEQ ID NO: 134175 - RNA, 55 nt, Homo sapiens
uuaucaauaugagcucccugccugcacaggauaagaucagaagcagggaugccag

SEQ ID NO: 134176 - RNA, 46 nt, Homo sapiens
aagcaggaagacaguucagaugaugaugaagcugaagaaggagagg

SEQ ID NO: 134177 - RNA, 46 nt, Homo sapiens
uucguccagcuaacaaacuugcuaaaggaaauagguuauucaugag

SEQ ID NO: 134178 - RNA, 49 nt, Homo sapiens
uauaauauucugcgcuuaugaaauaauugcuugccaccugaguuggaau

SEQ ID NO: 134179 - RNA, 38 nt, Homo sapiens
aggcacacacuguacuacuauugucuagucuggucagu

SEQ ID NO: 134180 - RNA, 70 nt, Homo sapiens
aggaacuuggagcagccagaagaagucaguauuacaugaaauaugggaauccaaauuauggaggcaugaa

SEQ ID NO: 134181 - RNA, 47 nt, Homo sapiens
aagcgaagauaucauucccgucguauucagcgggacgugaucaagaa

SEQ ID NO: 134182 - RNA, 47 nt, Homo sapiens
gggcuagugaauguucccgaggaacccauugaagaggaggaagagga

SEQ ID NO: 134183 - RNA, 46 nt, Homo sapiens
gagcgcgucuagacgauccagugccagcagcucagacucagaugaa

SEQ ID NO: 134184 - RNA, 45 nt, Homo sapiens
ccacgccuucaccaaagaaaagcaugaaaaugacuauguaugcug

SEQ ID NO: 134185 - RNA, 46 nt, Homo sapiens
cgacaucuauuagaugagaaacgucagcacucccguccacggccac

SEQ ID NO: 134186 - RNA, 53 nt, Homo sapiens
aauaauagaaauuaaguucggugguugucugaacaguuaagaguuugaacuag

SEQ ID NO: 134187 - RNA, 45 nt, Homo sapiens
gucgguggagacagaauggauaaagaacaggauagucuugugaag

SEQ ID NO: 134188 - RNA, 46 nt, Homo sapiens
gagcccucuucugaugugcauaguaggcuagguguucccaggcagg

SEQ ID NO: 134189 - RNA, 43 nt, Homo sapiens
aacagguaauuuauggacucgccuaggaucugcacccaagacc

SEQ ID NO: 134190 - RNA, 42 nt, Homo sapiens
acucugagcugcaaagggcauggggggcucugauuaaggaga

SEQ ID NO: 134191 - RNA, 46 nt, Homo sapiens
augaccgcuauguggccaucugcuucccccugcacuacaccgccau

SEQ ID NO: 134192 - RNA, 42 nt, Homo sapiens
uucaucuacagccugaggaacagagacaugaagggagcccug

SEQ ID NO: 134193 - RNA, 42 nt, Homo sapiens
gagguugcccccaguugugaccagauaggcaaagaggaggag

SEQ ID NO: 134194 - RNA, 46 nt, Homo sapiens
ccaccaacauccucuggacugucugacucaugcgggugcuguaggu

SEQ ID NO: 134195 - RNA, 42 nt, Homo sapiens
ccucagaggugggucacuuauaucucucacgcagauuuacua

SEQ ID NO: 134196 - RNA, 44 nt, Homo sapiens
gacuguuuuacaggcuguguaucaagagagugguaguugaagag

SEQ ID NO: 134197 - RNA, 23 nt, Homo sapiens
aaaagggaaagccucauucucag

SEQ ID NO: 134198 - RNA, 71 nt, Homo sapiens
ggucaggcuaccauucucgaguuaaagacacgaauguguuugaaugccuuagcaugguacuuagaugugaa

SEQ ID NO: 134199 - RNA, 42 nt, Homo sapiens
gauuucucuugagaagggauugucaguccaaacagggagcaa

SEQ ID NO: 134200 - RNA, 41 nt, Homo sapiens
auagaggagguuaauggauuucaauucuucacaaggggcac

SEQ ID NO: 134201 - RNA, 32 nt, Homo sapiens
gcaagacguuggacuguguuugaauuucuuuu

SEQ ID NO: 134202 - RNA, 46 nt, Homo sapiens
aacguacacugaauucugucaaggucggacaaugagaugggccuua

SEQ ID NO: 134203 - RNA, 45 nt, Homo sapiens
ugcagucaccaccaaguaagcgaagaaaauuagagaaaccgagaa

SEQ ID NO: 134204 - RNA, 46 nt, Homo sapiens
augaaggaauuaucccucaaagcaucaccucugcgcucggagacgg

SEQ ID NO: 134205 - RNA, 46 nt, Homo sapiens
guuuuggaaaguugucaaggcucuagcaacggagcccaggaccaag

SEQ ID NO: 134206 - RNA, 32 nt, Homo sapiens
gcaucaaucccacaaagggagcuguauggugg

SEQ ID NO: 134207 - RNA, 48 nt, Homo sapiens
aguaguaaguacuuauuguuugcuuguuucauuaugaaagaguggcac

SEQ ID NO: 134208 - RNA, 60 nt, Homo sapiens
gccgugcaguugucaaguuucugggaagauuagugggagcgcagccgcccgagcccgacg

SEQ ID NO: 134209 - RNA, 47 nt, Homo sapiens
aggcggacggcaucggggucggggaucugcacagcgggacggcaagg

SEQ ID NO: 134210 - RNA, 76 nt, Homo sapiens
gucucccgucugggcuccacgcgaaaggcccuuucuaaggugggcggagaggagucccuuuucuugaccuuguggg

SEQ ID NO: 134211 - RNA, 46 nt, Homo sapiens
ggcaucgcgccagccagcuccgaaagcagaagaaggaggcggugag

SEQ ID NO: 134212 - RNA, 46 nt, Homo sapiens
ccugcacagcagaauuucccugccagaggccaugcagcugcuucaa

SEQ ID NO: 134213 - RNA, 41 nt, Homo sapiens
gugcccccgcuugaaacaucggugguuuuucaccucagcaa

SEQ ID NO: 134214 - RNA, 46 nt, Homo sapiens
uccuguuccuccuugauccacuagaaggcugggacagcaccgguga

SEQ ID NO: 134215 - RNA, 45 nt, Homo sapiens
cuggccucccacugaagaaacaaauagauaccaggaagaagcuaa

SEQ ID NO: 134216 - RNA, 164 nt, Homo sapiens
ccuauuugcccaugcuguugauuuuguuccuagugaagagaauaacuuggugggcaccuugaaaauuucaggcuauguucgagggcagacucugaaugucaauagguugcugcauaucguuggauauggugauuuccagaugaaacagauagaugcccccggag

SEQ ID NO: 134217 - RNA, 46 nt, Homo sapiens
auccuagaggaauuaaaccccaaaaggacccagacauggcaaugga

SEQ ID NO: 134218 - RNA, 48 nt, Homo sapiens
accagcaguggaaguugagaaaguagacuagcaagcuucacauaagag

SEQ ID NO: 134219 - RNA, 46 nt, Homo sapiens
gagguuaucccagauccaauggagggagagcaaaccuggcccacug

SEQ ID NO: 134220 - RNA, 52 nt, Homo sapiens
aaaggaacauccaguuaccaagcugaauggauuuuggaugguggcagccaaa

SEQ ID NO: 134221 - RNA, 46 nt, Homo sapiens
agauguuuccagaugaaguggacacgccccgugauguggcugcucg

SEQ ID NO: 134222 - RNA, 44 nt, Homo sapiens
agaucucuuuucucuugguggccaguaguuguguauguuguggg

SEQ ID NO: 134223 - RNA, 47 nt, Homo sapiens
accaaggacaauuuuauaacuuuuucguacauagcugcuacauguag

SEQ ID NO: 134224 - RNA, 52 nt, Homo sapiens
acaacaacaacaacaacauaaaaauccuugcauaccuuuuucaauuggagaa

SEQ ID NO: 134225 - RNA, 50 nt, Homo sapiens
aacucuguucuuuaaagaccaagauuacauucucaauuagaaaacugcaa

SEQ ID NO: 134226 - RNA, 42 nt, Homo sapiens
aaucaaugaaacagacacaccugcacaguuggaaauggagga

SEQ ID NO: 134227 - RNA, 95 nt, Homo sapiens
agcugaggagauuccggcgcuugccauggccgacgaaaaacccaaggaaggagucaagacugagaacaacgaucauauuaauuugaagguggcgg

SEQ ID NO: 134228 - RNA, 45 nt, Homo sapiens
gagucccgacucucgaaucgcugcucgaggaacucgauggacuug

SEQ ID NO: 134229 - RNA, 41 nt, Homo sapiens
aggagccaauccggcuacugcgggagguggugcuguugacg

SEQ ID NO: 134230 - RNA, 46 nt, Homo sapiens
ggccgcccaugcucucagccuuucucccucccccgucucauuccaa

SEQ ID NO: 134231 - RNA, 44 nt, Homo sapiens
uccaccugcucccucucuccucacuggccuuucuuuccgucuag

SEQ ID NO: 134232 - RNA, 100 nt, Homo sapiens
cccccuucaccccuccuugcccgccuacccucccuccagaauagccccucacccuucuuccccuucuaguugauccuuuucaccucccugauccccuuca

SEQ ID NO: 134233 - RNA, 35 nt, Homo sapiens
gcgucgggcgccccuucccggcaggucccguccag

SEQ ID NO: 134234 - RNA, 50 nt, Homo sapiens
guucuuucgauuucggugagagggaagccacugggaccaggaggcuugga

SEQ ID NO: 134235 - RNA, 38 nt, Homo sapiens
gagucucaguacccaggcggcucccaggaaguggccca

SEQ ID NO: 134236 - RNA, 74 nt, Homo sapiens
caagaggucagcaguguucagugucaggaucagccaagugacauguugcugcuaauacuucagguuccaagugu

SEQ ID NO: 134237 - RNA, 45 nt, Homo sapiens
uaacagagcacagacacauggguauccagaaagguugcaacccaa

SEQ ID NO: 134238 - RNA, 46 nt, Homo sapiens
gacucugcagagaaaccuccaucgucugaaaaugaagaugcaagaa

SEQ ID NO: 134239 - RNA, 68 nt, Homo sapiens
gccucaucauccaucggcuuaugcguagauccuuuaaaaggucgcugucucguugccacaaaagauau

SEQ ID NO: 134240 - RNA, 45 nt, Homo sapiens
accaccgcaucacggccuagacagcaaaugggacaccagagucac

SEQ ID NO: 134241 - RNA, 46 nt, Homo sapiens
cacaguuccgugugacggaugcaguuaugccaaguauugcagccag

SEQ ID NO: 134242 - RNA, 40 nt, Homo sapiens
uuuugccacauugcccugagguugacucuuuuggugggau

SEQ ID NO: 134243 - RNA, 43 nt, Homo sapiens
agcaacaaucaggucaagacacuuaauuauggccuaggggaga

SEQ ID NO: 134244 - RNA, 46 nt, Homo sapiens
aaacucuacaugcuuagcucauuugaucucacauuaggucaucuag

SEQ ID NO: 134245 - RNA, 44 nt, Homo sapiens
auucuuguucuccuuagcaacagauaguaaaauugacaacaaaa

SEQ ID NO: 134246 - RNA, 42 nt, Homo sapiens
gggagagaucgcggauggccuggcccgggccugugcugccuu

SEQ ID NO: 134247 - RNA, 46 nt, Homo sapiens
agcccugagcacaauacagaaagcugaggagguucugucgcugcac

SEQ ID NO: 134248 - RNA, 52 nt, Homo sapiens
aacaguccgaagccuaggauaugagggcugaggaggacucaaaccguugcag

SEQ ID NO: 134249 - RNA, 62 nt, Homo sapiens
agaaaacccgagggacagcagauuccacaggacacgaaggcugccccuguaagguuucaaug

SEQ ID NO: 134250 - RNA, 43 nt, Homo sapiens
cugagggacacagacacaggggcccuucucuucauuggcaaga

SEQ ID NO: 134251 - RNA, 43 nt, Homo sapiens
ggugggcaggcugcagcccugggcugggggugguucccgcccc

SEQ ID NO: 134252 - RNA, 123 nt, Homo sapiens
agcugacucagguggaacaccgggcuggcuuugaguggaacgaggauggggcgggaaccacccccagcccagggcugcagccugcccaccucaccuucccgcuggacuaucaccuuaaccagc

SEQ ID NO: 134253 - RNA, 41 nt, Homo sapiens
aaaacccugccuuccccaacaccccaaccaagggaucccuu

SEQ ID NO: 134254 - RNA, 36 nt, Homo sapiens
aaagggaucccuugguugggguguuggggaaggcag

SEQ ID NO: 134255 - RNA, 92 nt, Homo sapiens
caucuucuuccugccccugaaagugacccagaauuugaccuugauagaggagagccucaccuccgaguucauucaugacauagaccgagaac

SEQ ID NO: 134256 - RNA, 47 nt, Homo sapiens
cucuccucuaucaaggucaaauucugggucacuuucaggggcaggaa

SEQ ID NO: 134257 - RNA, 57 nt, Homo sapiens
aacuguuaaccuuucuugggccacggcuaucacacggaucucucugggaaucugacg

SEQ ID NO: 134258 - RNA, 46 nt, Homo sapiens
aaggcuguuuuacgcuauggcuuggauucagaucucagcugcaagg

SEQ ID NO: 134259 - RNA, 50 nt, Homo sapiens
uaggguccgacaucauggggacccucacgguccucucuucauccaaguag

SEQ ID NO: 134260 - RNA, 46 nt, Homo sapiens
uccagaaagacuucccucgaggauuucuacuuggaugaagagagga

SEQ ID NO: 134261 - RNA, 46 nt, Homo sapiens
caaaggaaauucccgaugagaucagcauucuccuucucgguguggc

SEQ ID NO: 134262 - RNA, 95 nt, Homo sapiens
guggaccuggcgagcuucccuuucaucugcgccugcacccaguuguugaucucuugcagguccaagcgaggguugcccgucaggacucugggccu

SEQ ID NO: 134263 - RNA, 70 nt, Homo sapiens
uuuguggcaccucuggaaaagucauaugggaccaggcccagaguccugacgggcaacccucgcuuggacc

SEQ ID NO: 134264 - RNA, 77 nt, Homo sapiens
cuugagguucuucuggggggcagugaccgugucaaggagcuccuuauagguaccauggaugucugggcugcugauca

SEQ ID NO: 134265 - RNA, 82 nt, Homo sapiens
gggcucucuacuaugacuugaucagcagcccagacauccaugguaccuauaaggagcuccuugacacggucacugcccccca

SEQ ID NO: 134266 - RNA, 48 nt, Homo sapiens
agacaggagcacguuggucguggggcucgugcuggaucgcacccggua

SEQ ID NO: 134267 - RNA, 41 nt, Homo sapiens
gcugccagcuuguucacggggacuuugaagaaaggauccuc

SEQ ID NO: 134268 - RNA, 42 nt, Homo sapiens
gagcccuccucgggcacagcagcugccagaacccugccagcc

SEQ ID NO: 134269 - RNA, 39 nt, Homo sapiens
cagggaguccuauucuuggggcugcugcuucuggggugu

SEQ ID NO: 134270 - RNA, 34 nt, Homo sapiens
ucccggacccgguccagccguggcgccccccgcu

SEQ ID NO: 134271 - RNA, 42 nt, Homo sapiens
aguccuggccugcagcaggacugacaucgccuggggccagca

SEQ ID NO: 134272 - RNA, 43 nt, Homo sapiens
gacccagugaaaggaaugacagcagaugacuaaagccgccuuu

SEQ ID NO: 134273 - RNA, 35 nt, Homo sapiens
aaggaggaauagguuuucugacuccauagugagcu

SEQ ID NO: 134274 - RNA, 46 nt, Homo sapiens
caggcaacuuucgauuccuuacuguagcuaauucuagaugcccuuc

SEQ ID NO: 134275 - RNA, 68 nt, Homo sapiens
ucaaccuugggguaaacugagguauuuugcuuccugggaagaucuucgcaauuuugagugcuccugug

SEQ ID NO: 134276 - RNA, 49 nt, Homo sapiens
uacaguuguauauauggacaacucucaguuguccccauuugugagagaa

SEQ ID NO: 134277 - RNA, 54 nt, Homo sapiens
ucuuuguuguuauuuaaugcagugagugaacauuaaacacaguggaggggagaa

SEQ ID NO: 134278 - RNA, 65 nt, Homo sapiens
acugaggaaaugacaacuauuuccauagagagugcuggaugggagggcaggacacagacggaagu

SEQ ID NO: 134279 - RNA, 63 nt, Homo sapiens
gacguggccccgcaggaagcugagugcuuaggccccauuugucucuuccccgcauccgcuccu

SEQ ID NO: 134280 - RNA, 46 nt, Homo sapiens
gcccacgaggggaugaggcccaugcgggccgucuucacgcgccagg

SEQ ID NO: 134281 - RNA, 42 nt, Homo sapiens
gcccaaaaggggacuggaugucagcaagugugagaucgcccg

SEQ ID NO: 134282 - RNA, 43 nt, Homo sapiens
auuuauaauugcaccuuaaaaaaaucuugcaggccuccccucc

SEQ ID NO: 134283 - RNA, 38 nt, Homo sapiens
uauugugaaucaggggaaaggaggcaucuggggcacaa

SEQ ID NO: 134284 - RNA, 57 nt, Homo sapiens
aggcgagaguaguccuugggguagagucagaauggugguuaccucuggggugcacgg

SEQ ID NO: 134285 - RNA, 42 nt, Homo sapiens
uucaugagcugcugcaccuuugccuccgauguagccagggcc

SEQ ID NO: 134286 - RNA, 25 nt, Homo sapiens
acagugcuguggaaaggcugcagcc

SEQ ID NO: 134287 - RNA, 43 nt, Homo sapiens
guggggauuaaugucuggaguggcccagcuccuauggccagug

SEQ ID NO: 134288 - RNA, 51 nt, Homo sapiens
cucaguccuccacccuagccagcacacauucccccuccacgcaggagcagg

SEQ ID NO: 134289 - RNA, 42 nt, Homo sapiens
gcccugaccuuccugcuggugcugcucacccuggccacgcuc

SEQ ID NO: 134290 - RNA, 41 nt, Homo sapiens
gcgccuggaggcaaugccagcuccaggacagaggcucaggu

SEQ ID NO: 134291 - RNA, 45 nt, Homo sapiens
agccugggcugcccacuggcugaugaggaggcggaggaggaagca

SEQ ID NO: 134292 - RNA, 40 nt, Homo sapiens
ggggccaccagggagggagggcgcgccggcagccggaagg

SEQ ID NO: 134293 - RNA, 46 nt, Homo sapiens
uacauuucauuauuaaaacuaauuaggaaucugguuaauaccccaa

SEQ ID NO: 134294 - RNA, 41 nt, Homo sapiens
uugaaguauauuccaacccuguuuuuguacuuacgccccac

SEQ ID NO: 134295 - RNA, 47 nt, Homo sapiens
ucuccugaucauagaugguuaucugaaaugagauugaauggcgcaag

SEQ ID NO: 134296 - RNA, 51 nt, Homo sapiens
cuaggccaggucauggggaaccugggcuucuggagcuguagggcucaggag

SEQ ID NO: 134297 - RNA, 41 nt, Homo sapiens
cacauuuuccuugaggcuacccacugcugucagguuccugg

SEQ ID NO: 134298 - RNA, 34 nt, Homo sapiens
cugggcucagugucuucaucuauauauggucauu

SEQ ID NO: 134299 - RNA, 46 nt, Homo sapiens
cucucaucacauggccaucaaccugguaccagguucccagccccag

SEQ ID NO: 134300 - RNA, 23 nt, Homo sapiens
gauggagaaggccagcuguucuc

SEQ ID NO: 134301 - RNA, 41 nt, Homo sapiens
cccagggcgccgccggcaccagaaacaggacgaagagccaa

SEQ ID NO: 134302 - RNA, 39 nt, Homo sapiens
agaacaaguuucugauuauuuuacaauggugggcgaggg

SEQ ID NO: 134303 - RNA, 46 nt, Homo sapiens
uuguccauaauacacaguagcuaccuguagugcaaccgcugcagaa

SEQ ID NO: 134304 - RNA, 53 nt, Homo sapiens
uugucuccuuuuuuuguucucuugccacuucucuccucuuccuccugccccug

SEQ ID NO: 134305 - RNA, 58 nt, Homo sapiens
acuauguacauugguacugguugugggggugggaggagaggagggaaccaggggcagg

SEQ ID NO: 134306 - RNA, 34 nt, Homo sapiens
gucucauucccauagggaaguuugguaggggagg

SEQ ID NO: 134307 - RNA, 41 nt, Homo sapiens
gcuguugcuagcagggagauuucucuuccugcccucacuuc

SEQ ID NO: 134308 - RNA, 40 nt, Homo sapiens
gcccauuggugggagcaaugucacccugccuccagcuagc

SEQ ID NO: 134309 - RNA, 44 nt, Homo sapiens
uauccaacagaagcuucuggugcccaaagaaucuuaugugguaa

SEQ ID NO: 134310 - RNA, 46 nt, Homo sapiens
cacuagccagacaccagaagagaucugugccaacauuauccgagag

SEQ ID NO: 134311 - RNA, 30 nt, Homo sapiens
uuuuguaagauaaauguaugauauugugga

SEQ ID NO: 134312 - RNA, 84 nt, Homo sapiens
aauauguaauggacaacugaagaauaagcaugggguugcauuuagccacagaaaccauguguucuacaucagugcacagaagaa

SEQ ID NO: 134313 - RNA, 94 nt, Homo sapiens
ccaacugugguaaaauuaaauucugcaguggauuauugagggguucuggcuugccuggauggcuacaugaauauagcccuggagcaggcagaag

SEQ ID NO: 134314 - RNA, 23 nt, Homo sapiens
accagcccauguggcuugggggu

SEQ ID NO: 134315 - RNA, 58 nt, Homo sapiens
ugagcaguucucauuuucuguguaguguccccuagagagagagaaugggaaggagagc

SEQ ID NO: 134316 - RNA, 40 nt, Homo sapiens; identical to SEQ ID NO: 36564

SEQ ID NO: 134317 - RNA, 41 nt, Homo sapiens
cacauaacuuaaaacuggucuucagucacauugcuucagau

SEQ ID NO: 134318 - RNA, 41 nt, Homo sapiens
uggggagggagaaaggguaguucaaagagucugucuugaga

SEQ ID NO: 134319 - RNA, 44 nt, Homo sapiens
gcuuugccaacagugcccuaagcuggcaauggcacggcaugugg

SEQ ID NO: 134320 - RNA, 55 nt, Homo sapiens
cccaaggcugccuguugccugccccaaccaauguggugugggcacuguggcucgg

SEQ ID NO: 134321 - RNA, 42 nt, Homo sapiens
agcaugccaccucugagugccccaagcgcacucagcccugca

SEQ ID NO: 134322 - RNA, 49 nt, Homo sapiens
cugcagucagcucugacccuggccaguucccccaucccuacccccagau

SEQ ID NO: 134323 - RNA, 42 nt, Homo sapiens
aacaggcuccuugggugcugacggccagguaggguuuggugc

SEQ ID NO: 134324 - RNA, 46 nt, Homo sapiens
aggccuaccucacccauuucuucuugcguuaugugaaccagaggac

SEQ ID NO: 134325 - RNA, 59 nt, Homo sapiens
gugaugaucauaaucuacuuuucccgccuccuccgcucugacuucugcccugagcaugu

SEQ ID NO: 134326 - RNA, 44 nt, Homo sapiens
ggacacugggacuuagccccaagccuggguguccucugaggcca

SEQ ID NO: 134327 - RNA, 55 nt, Homo sapiens
gaguccagcugccuaauucugaauauauauauauauauaucuuuucaccauauac

SEQ ID NO: 134328 - RNA, 45 nt, Homo sapiens
cacacuuguguucauuguggauguuaaagccaacaagcaccagau

SEQ ID NO: 134329 - RNA, 64 nt, Homo sapiens
gaagauccgcacgucacccaccuuccggcggccgaagacacugcgacuccggagacagcccaaa

SEQ ID NO: 134330 - RNA, 65 nt, Homo sapiens
uguggccaggguggcccacugcaguucuuggggccggaagugaccgauuucuaaaucccgcaccc

SEQ ID NO: 134331 - RNA, 39 nt, Homo sapiens
ccgggccgcucuguaaugguagggcagccucagccccga

SEQ ID NO: 134332 - RNA, 42 nt, Homo sapiens
gggugaucgucgggucuccacgcgcccgggucgcugacgcgg

SEQ ID NO: 134333 - RNA, 43 nt, Homo sapiens
uucccagucucgguucgacgacuccauuuuccucggugggggc

SEQ ID NO: 134334 - RNA, 42 nt, Homo sapiens
aagaaauggcccgcccacucccggugacagggagccggaaau

SEQ ID NO: 134335 - RNA, 99 nt, Homo sapiens
aacucggccccuccccggaaccggaagcuaauggcgaaaccacggagagaaggaagugaagaagcccgagucugaucuuuaugguuuauuugacuagag

SEQ ID NO: 134336 - RNA, 46 nt, Homo sapiens
caguggaagaguguuugaaccgcaccucaccaucucucacccagua

SEQ ID NO: 134337 - RNA, 46 nt, Homo sapiens
uccgcugacaccacuugguggccaaccggaccacaagccaccugca

SEQ ID NO: 134338 - RNA, 48 nt, Homo sapiens
uugcugguguugcugaaacuuaagacugacauucuggauccaaaaaaa

SEQ ID NO: 134339 - RNA, 42 nt, Homo sapiens
ucaauaaggaugggcugaaggacaguuccuuuugauccaccc

SEQ ID NO: 134340 - RNA, 42 nt, Homo sapiens
gacugcuaaugcccaccuuuagacacagguccagggccagug

SEQ ID NO: 134341 - RNA, 72 nt, Homo sapiens
cuggugccgguagugaaugaugcaaguguucagaacuagggaggcugagaggucaaugguggucaccugaaa

SEQ ID NO: 134342 - RNA, 46 nt, Homo sapiens
acaggugaacuagacccuuggguuuccagugcuagcaggugcagcc

SEQ ID NO: 134343 - RNA, 40 nt, Homo sapiens
aggcgcacaguuuuauaaugcccuaaugcacuuccugcug

SEQ ID NO: 134344 - RNA, 42 nt, Homo sapiens
uucaguuguguuguauggauccuaugaccacccccgagaauu

SEQ ID NO: 134345 - RNA, 46 nt, Homo sapiens
gcacagccacugcagguccagugucaugcagaggucaggcagguga

SEQ ID NO: 134346 - RNA, 46 nt, Homo sapiens
gugccgagucagauccaucuugauggagagauugagguucuccgag

SEQ ID NO: 134347 - RNA, 45 nt, Homo sapiens
cuucuugcuggguuucagguuauugaagagcuuuccccugcagau

SEQ ID NO: 134348 - RNA, 46 nt, Homo sapiens
acugccugcccacucuccaucagcuccugcacagaguccagacuac

SEQ ID NO: 134349 - RNA, 44 nt, Homo sapiens
ugcugggcuugcugugccucagcuggcugguuccaaucugggaa

SEQ ID NO: 134350 - RNA, 57 nt, Homo sapiens
uugucaguauguuacagagaaggugaguccacaccugggcacacaaacauacugcag

SEQ ID NO: 134351 - RNA, 42 nt, Homo sapiens
acaaugcuggggcugccacugaggaguucaucaagcgggcug

SEQ ID NO: 134352 - RNA, 52 nt, Homo sapiens
aauucuuaggauuucuuuuccuccgccacugcagugauuguuagagguaguu

SEQ ID NO: 134353 - RNA, 46 nt, Homo sapiens
ccaagguaccugaccugagagucuuagugcuguuuauacauucaag

SEQ ID NO: 134354 - RNA, 52 nt, Homo sapiens
uaucaaccuccugaauaacaguacaaagugcuuuaaagaaacagaucccaca

SEQ ID NO: 134355 - RNA, 42 nt, Homo sapiens
guuguugcuucuguuguacagcagcuucaccacgggcuguga

SEQ ID NO: 134356 - RNA, 45 nt, Homo sapiens
caugggagagggaagagaagacacgaaccagcugagacagcccag

SEQ ID NO: 134357 - RNA, 48 nt, Homo sapiens
uggaggcagucucccagacuccugcccuggucaccucaucagccuccc

SEQ ID NO: 134358 - RNA, 97 nt, Homo sapiens
acaguagggggaaguugguuugaugucaagucagggaaggcaggcguuagaugauaacaaagguggauuucauacuaauugcuauauaguauaugaa

SEQ ID NO: 134359 - RNA, 46 nt, Homo sapiens
caacaaagggcaaacagccgcggagguggaaagaggaggggucuaa

SEQ ID NO: 134360 - RNA, 44 nt, Homo sapiens
ccccucgggccucuguuucccagcaggcucuguggaaugggggc

SEQ ID NO: 134361 - RNA, 42 nt, Homo sapiens
agagagaagcucaacagcagcaacuucaagcccuaauagcag

SEQ ID NO: 134362 - RNA, 46 nt, Homo sapiens
gaccaauuuauuuuucagaaaugaacugaaaauuucgcuuuuauag

SEQ ID NO: 134363 - RNA, 45 nt, Homo sapiens
auacguugcaaugggaaagaaaggcagcugaaacacaagcucgca

SEQ ID NO: 134364 - RNA, 52 nt, Homo sapiens
uuaaaugggaucuuuaugauaugaugcugagcaccuuuuaaguguauuuugu

SEQ ID NO: 134365 - RNA, 73 nt, Homo sapiens
cuggaaccugugacuauuacuuuauuuggcaaaagggacuuugcagauguaauuaaggauuuugaaaugggag

SEQ ID NO: 134366 - RNA, 46 nt, Homo sapiens
gcaaugugaugacccgaagcagagauugaagugacgugaacacaag

SEQ ID NO: 134367 - RNA, 46 nt, Homo sapiens
aagauaucugugccaaaguugcguccuuuguccuggcugaugacau

SEQ ID NO: 134368 - RNA, 55 nt, Homo sapiens
ccacgauggcugguccucagaggaccagcugggaggacugguugugcugcuggag

SEQ ID NO: 134369 - RNA, 39 nt, Homo sapiens
uccgugacccuccuaacuggggacgagcgaacccuaagg

SEQ ID NO: 134370 - RNA, 76 nt, Homo sapiens
ugccccgagagcuucaagugcacacucacugcacaucuuugugaugcccuacaacgucgucccccauauccugaug

SEQ ID NO: 134371 - RNA, 44 nt, Homo sapiens
uacauugaguguucaucugaauguacguugaauaugcggugagu

SEQ ID NO: 134372 - RNA, 47 nt, Homo sapiens
aauuaauuuuugcaagugaagauaguugaaauguuagcuaaaaugau

SEQ ID NO: 134373 - RNA, 46 nt, Homo sapiens
gcagcaguuuggccacuacaaaucauucuccuuaucuuguguccag

SEQ ID NO: 134374 - RNA, 46 nt, Homo sapiens
gccugcagauguggaucuaaugauugacugccuuguuucuugcuuu

SEQ ID NO: 134375 - RNA, 141 nt, Homo sapiens
gugcauccucuucuacucuaaugagcacugcauguguggaggguggagugugucuguaucagagaucaaguuauaugaaaaucuguuuuuauaaagaaaaaaacuacauugaauaauuuuuaaacauuaaguaucaguaac

SEQ ID NO: 134376 - RNA, 90 nt, Homo sapiens
auacaguagauuuauauuguugauguuuuacucauguuuaugucagacuuaauuuauauuuguagaaucuacuguuucugaugauuuaga

SEQ ID NO: 134377 - RNA, 36 nt, Homo sapiens
gaagaauuacuacguacuccuggagccucucuccgg

SEQ ID NO: 134378 - RNA, 47 nt, Homo sapiens
ugcccaacuauaacacauucauggaguuugccucugucagcaauaug

SEQ ID NO: 134379 - RNA, 32 nt, Homo sapiens
auuuuacauuuuuuguacuuuugucauggaag

SEQ ID NO: 134380 - RNA, 44 nt, Homo sapiens
uucuuuacugcacacaaacuagggugugacaguaagguagccag

SEQ ID NO: 134381 - RNA, 87 nt, Homo sapiens
augcaauucaaauaaaaacgaaacugugucaauuaguugaaguaaugauggcaaggagagaugaccucucauuuugccaagagauga

SEQ ID NO: 134382 - RNA, 56 nt, Homo sapiens
uuuauuacugcuuuuuuuugacugauagacuuucaguaaaauuaaaugugaaagag

SEQ ID NO: 134383 - RNA, 46 nt, Homo sapiens
uucacuucuagcuggucucccucugcagccugaagaaggagauggu

SEQ ID NO: 134384 - RNA, 42 nt, Homo sapiens
aaggcacagaauuugacacacuugcagaaacaguauuggcug

SEQ ID NO: 134385 - RNA, 51 nt, Homo sapiens
augucaaguaaugauuauguacagaaugugcagggcugauugucuucuuuu

SEQ ID NO: 134386 - RNA, 27 nt, Homo sapiens
ugccaaucauguucucuucacaaaaga

SEQ ID NO: 134387 - RNA, 46 nt, Homo sapiens
agguuuuuccuugauauagcaucugauuguccuacaagugaugcag

SEQ ID NO: 134388 - RNA, 69 nt, Homo sapiens
aaacguuaaguauuuucuaccaagcugggacuuccaaagcugggaauccuauuuuuuauuauguugcac

SEQ ID NO: 134389 - RNA, 45 nt, Homo sapiens
guuuggcuugccaggagcauauauuguuuuuguaagaauaauuaa

SEQ ID NO: 134390 - RNA, 57 nt, Homo sapiens
auaauuagugaggaagucauguguucuaaacuugaccugccauuugcucuuuggaag

SEQ ID NO: 134391 - RNA, 45 nt, Homo sapiens
cuggaaugaaugugaacuuauuguugugcagguaaagauguguga

SEQ ID NO: 134392 - RNA, 40 nt, Homo sapiens
uuuucucugggaaacuuaaaggucgucuuguucuguagag

SEQ ID NO: 134393 - RNA, 39 nt, Homo sapiens
gaacaguuauuuguuuucuagaagggaucuggacagaug

SEQ ID NO: 134394 - RNA, 46 nt, Homo sapiens
gacuuuguuugccaaaaccacaguugauagaaauagaaagguacag

SEQ ID NO: 134395 - RNA, 46 nt, Homo sapiens
caaagccauaugaaauuguaguggaccuuacccauaccgggccuag

SEQ ID NO: 134396 - RNA, 46 nt, Homo sapiens
uuaaccauugcaaaccagggcacgccgcucaccuucaugcaccagg

SEQ ID NO: 134397 - RNA, 231 nt, Homo sapiens
guauaacuuagaauuccugggaauuaguaaaagauacaagcugagcacuggcacuguagucccagcuacucgggaggcugaggcgggaggacagcuugagcucaggaguucaaggcugcagugugcuauaaucaugucugugaauagccaaugcacaccagccuggggaacauagugagacucugacuaaaaguuuuuuaaaaaagaaaaaagauauguaaacagaaauaa

SEQ ID NO: 134398 - RNA, 46 nt, Homo sapiens
aaaacagauguacccaucuauucaagcaaaaauauggggaagccuu

SEQ ID NO: 134399 - RNA, 98 nt, Homo sapiens
acugcgcuagacacuagggauagaguuguaaaaaacacaguuuccuccuucagaaagcauguagacacucacccagcucuucaucugguucaaaauug

SEQ ID NO: 134400 - RNA, 45 nt, Homo sapiens
caucuucccuaccucuuccacguuguuacuuucuuaguagccaca

SEQ ID NO: 134401 - RNA, 84 nt, Homo sapiens
gccaaguacuguuuuaggcgcuagagauagaguacuaacaaagcccauaaaacucacugccuucauggagcuuacuuucugggg

SEQ ID NO: 134402 - RNA, 46 nt, Homo sapiens
cauuuuguuggacucaauuucaacucuaacuuuaacuuugcauugg

SEQ ID NO: 134403 - RNA, 43 nt, Homo sapiens
auuacauaaucauaaucaaguuucaauuuuccaacuaauggag

SEQ ID NO: 134404 - RNA, 45 nt, Homo sapiens
agcagggaaugggacucugagacauauuagauaaauaccuauaag

SEQ ID NO: 134405 - RNA, 46 nt, Homo sapiens
guuguguuucccaaagucuuuccuguuguguaaguaucuccuuuug

SEQ ID NO: 134406 - RNA, 46 nt, Homo sapiens
auuguuaaguuucuugaugccuugauugacacguaccugccuggaa

SEQ ID NO: 134407 - RNA, 38 nt, Homo sapiens
gccauuugcacagagcucugccuucugugguuuucccu

SEQ ID NO: 134408 - RNA, 65 nt, Homo sapiens
accauagaggucaagccucagugacuugacaccauaaagccacagacaagguacuugggggggag

SEQ ID NO: 134409 - RNA, 42 nt, Homo sapiens
aucuuaacauuacugaauuaaaacuauggcuucuaaguccuu

SEQ ID NO: 134410 - RNA, 52 nt, Homo sapiens
uuuuuucuccaguugauuaucuuuuaauuuuuaauuuugcuaaaggugguuu

SEQ ID NO: 134411 - RNA, 48 nt, Homo sapiens
ugcauuagcuccauagcaaaauggaaugguacgugacauuuaggguag

SEQ ID NO: 134412 - RNA, 65 nt, Homo sapiens
ggccaucuaaggccucaggcccugcauggggggccuggggccaugggccucaaaugggcacuggc

SEQ ID NO: 134413 - RNA, 42 nt, Homo sapiens
uuaauaugcagaccuuuuucagauuucccuauuugaccccaa

SEQ ID NO: 134414 - RNA, 92 nt, Homo sapiens
caaaagucauuguuuugugucuucuuuugaguucaauuacuuuuucuucugagaugggagccgccagcauuucuagagcuaagcgggguggg

SEQ ID NO: 134415 - RNA, 46 nt, Homo sapiens
ggauggugguggagccaguagggauaaggguugguaagggauggug

SEQ ID NO: 134416 - RNA, 52 nt, Homo sapiens
ccagcaccuaccaccaucaaccccugaaagagugccuggcauguaagaggug

SEQ ID NO: 134417 - RNA, 42 nt, Homo sapiens
uuagcuucacaguaaauccagauguauacaugccuaccugau

SEQ ID NO: 134418 - RNA, 46 nt, Homo sapiens
uuaagucaucaaauacugaauuuaccaccugggaugaaagcugaga

SEQ ID NO: 134419 - RNA, 49 nt, Homo sapiens
acuuccugagcguggagucaauggaccucugagagagaggugagagagg

SEQ ID NO: 134420 - RNA, 48 nt, Homo sapiens
ccgucccucugggaugguggagguggggaguccucggggccagcccag

SEQ ID NO: 134421 - RNA, 46 nt, Homo sapiens
auauguuuuagguauggguaaggagggggugaaggggguaggagag

SEQ ID NO: 134422 - RNA, 40 nt, Homo sapiens
gugucuacccucugcaccagacucaagucucccuccuaga

SEQ ID NO: 134423 - RNA, 48 nt, Homo sapiens
accucuggggaacuuauauaauuuguccaguuccuccaaggaugcagg

SEQ ID NO: 134424 - RNA, 46 nt, Homo sapiens
guggaguugacuggccccauucuguaggugaggagccaggugcuca

SEQ ID NO: 134425 - RNA, 46 nt, Homo sapiens
ggaggaggaggcgcggcgccaccgcgaggccuacggcaagcuggag

SEQ ID NO: 134426 - RNA, 38 nt, Homo sapiens
cggcagcuggcccaagagagguggcugggacacgggag

SEQ ID NO: 134427 - RNA, 44 nt, Homo sapiens
agcuuagaacaacagugacucggcucaagucucaaacagagaaa

SEQ ID NO: 134428 - RNA, 46 nt, Homo sapiens
aggcgaguucaaugccagggcccgcgagguggagcucgagcacgag

SEQ ID NO: 134429 - RNA, 47 nt, Homo sapiens
uuuguggccccuuugcaaggggcagaggguacuggaagugggaggag

SEQ ID NO: 134430 - RNA, 34 nt, Homo sapiens
caccuuucaagccccaguguucaagcucagagag

SEQ ID NO: 134431 - RNA, 46 nt, Homo sapiens
uggcuucuuuuuaaucuuuuguuggggauuaguuucaugcugcaca

SEQ ID NO: 134432 - RNA, 90 nt, Homo sapiens
acgcgggucuccuugggcucccccaaggguucugcgaagaggcaguggaagaaggcaugaggagagggucucuugagaauuugccaauag

SEQ ID NO: 134433 - RNA, 87 nt, Homo sapiens
uggaauuucagagaaggcugcagaggccuggguuacacagccugagucacaacgugggaaggaaucucugccacgggaaaggugggc

SEQ ID NO: 134434 - RNA, 58 nt, Homo sapiens
cugaggucugcugcgccaaggggccucaaguuagaagggccaugccguucaguggaug

SEQ ID NO: 134435 - RNA, 44 nt, Homo sapiens
caucgccacuguacaggauuuuccacauugcccacugccuccuu

SEQ ID NO: 134436 - RNA, 46 nt, Homo sapiens
gaauccugcaauauggcgaacauaagagaauauuaugagagagcuu

SEQ ID NO: 134437 - RNA, 32 nt, Homo sapiens
uaauuuuucacaaauuuguacaauuggauugu

SEQ ID NO: 134438 - RNA, 69 nt, Homo sapiens
aagagcagccuacaacgaaacaagccaaagcaguggaggucggccggaaggaggagaggugcugugcug

SEQ ID NO: 134439 - RNA, 60 nt, Homo sapiens
augauccucucacuugggauuauguggcaaggcgagaauuagagauugagucacagacag

SEQ ID NO: 134440 - RNA, 45 nt, Homo sapiens
gugucacugcuuucgauugcacagcuauuugacuuugccaaagau

SEQ ID NO: 134441 - RNA, 47 nt, Homo sapiens
agaauccugauuauucugaagaaauccuuaagggcgaguuggcaugg

SEQ ID NO: 134442 - RNA, 46 nt, Homo sapiens
uuaggauggagcugaugcaugcugaaaaacugaggaaggagaagga

SEQ ID NO: 134443 - RNA, 59 nt, Homo sapiens
uuugaauccuuugugggacauuuuauuuggaggcagucaaaucugaggaauuuuagaag

SEQ ID NO: 134444 - RNA, 44 nt, Homo sapiens
guauucucugccauguuggcgauucauuccaacaaaccagguau

SEQ ID NO: 134445 - RNA, 106 nt, Homo sapiens
cugcauuaaaccaacuggauagauaacaaaguuuuuuuggagcauugugagugggaguugggggaaagguugaauuaucauaguuaagagaucggaggccuuugug

SEQ ID NO: 134446 - RNA, 49 nt, Homo sapiens
cucuaaugaugguaucauuacucaaaacauuuuuugagccacuuaacaa

SEQ ID NO: 134447 - RNA, 66 nt, Homo sapiens
aagaaggaugagauugagaauucuauuguacaccggguacaagguguuuuccagcgugccucagca

SEQ ID NO: 134448 - RNA, 59 nt, Homo sapiens
uaaauauuuugauaacaguguacuguaaguugauuguaguaccuuguacugcuguaggg

SEQ ID NO: 134449 - RNA, 45 nt, Homo sapiens
auuggaacagcuggagcgcauuggacuguucagucaugcggagau

SEQ ID NO: 134450 - RNA, 48 nt, Homo sapiens
ugugaauuauuuuuuucauuucauuuuuaccaguauaguaaaaaagua

SEQ ID NO: 134451 - RNA, 45 nt, Homo sapiens
gguuacuugaucagucuugugguucucuuuacuuuggaugcucau

SEQ ID NO: 134452 - RNA, 46 nt, Homo sapiens
gaguggacagcugguuuugagggguacagucugagcagucgaagaa

SEQ ID NO: 134453 - RNA, 46 nt, Homo sapiens
ccacauuuuuaagcauggaacaguagcaucucgcccaccaguacag

SEQ ID NO: 134454 - RNA, 46 nt, Homo sapiens
uuguuuggugguuuggauauuuuuaggguuccagucauuuucagaa

SEQ ID NO: 134455 - RNA, 31 nt, Homo sapiens
aggaaaaugauuuccuuuuccuugagagagg

SEQ ID NO: 134456 - RNA, 123 nt, Homo sapiens
ggaggcauugauuuuagagagccugaggaagaggugggacagugaccugggagagcugaaaguggagacaaaauggauauuggaaggggaggacuaaggggcgagagugagggagagguaggg

SEQ ID NO: 134457 - RNA, 44 nt, Homo sapiens
augacacaucuaccugcaaaacaauuacaaaauauuuaucacca

SEQ ID NO: 134458 - RNA, 46 nt, Homo sapiens
aaauccuaaacaagggaccacaaaaaaugacuucaaaaaguugaga

SEQ ID NO: 134459 - RNA, 42 nt, Homo sapiens
gaauacuacaagccaugcaaacucuagagauaacguaacuga

SEQ ID NO: 134460 - RNA, 46 nt, Homo sapiens
cugucgacgaaauagucaaaagugguuauauaagugaaucagaaaa

SEQ ID NO: 134461 - RNA, 73 nt, Homo sapiens
aaauggaaaauaguuuaucugauccugagaaugaacagacaguucagaaaagaaaaucuaauguuguuauaca

SEQ ID NO: 134462 - RNA, 55 nt, Homo sapiens
aauaaaaagcuaaagaagaagaauaagaaaacauuagauacuggggcuauuccag

SEQ ID NO: 134463 - RNA, 46 nt, Homo sapiens
uaaaggcuuccacucaaaaagcagccaacuuaucggaaaagcacag

SEQ ID NO: 134464 - RNA, 46 nt, Homo sapiens
aagcaaaacaauugauugaaaaagcaaaagcuuuacacaucaguag

SEQ ID NO: 134465 - RNA, 46 nt, Homo sapiens
cgcuccucuagacaucagacacuuccugaaaggaagaaauugucag

SEQ ID NO: 134466 - RNA, 51 nt, Homo sapiens
ugaaaagaaaggaaaguuuguuaauauuuguuuguuuuaaacaacuggaag

SEQ ID NO: 134467 - RNA, 45 nt, Homo sapiens
aaaauucuaagucaaaaagaaagaaaccaaaugaguauucaaaaa

SEQ ID NO: 134468 - RNA, 46 nt, Homo sapiens
gaauuggaagaaaggcagaaucugaagggaaaaagagaugagaaac

SEQ ID NO: 134469 - RNA, 46 nt, Homo sapiens
uuuuugaaugcaaucaaaacauucauggcaacaacuaaacgaccug

SEQ ID NO: 134470 - RNA, 29 nt, Homo sapiens
ugguagguaacaaugauuuuacuucaguu

SEQ ID NO: 134471 - RNA, 29 nt, Homo sapiens
gguaaauacacaaauauuucaaggaaacc

SEQ ID NO: 134472 - RNA, 41 nt, Homo sapiens
gacaaagaaaucuauuccuuguccuccuaaaacaacugcag

SEQ ID NO: 134473 - RNA, 46 nt, Homo sapiens
uuacaaguggacuuugugaugaguuuagucuugagaguaaugaugg

SEQ ID NO: 134474 - RNA, 43 nt, Homo sapiens
auuguggagguagaaaggcaugcccguggagagccauggaacu

SEQ ID NO: 134475 - RNA, 358 nt, Homo sapiens
acacaaagaaagcugucaguuaacaguugcuguuguacgggugugguggcucacaccuauaaucccagcacuuuggggggcugaggcugguggauugcuugagcccagaaguucaagagcagccugggcaacauggugaaaccccgucuuuacaaaaaauacaaaaauuagcugggugugauggcaugcgccugucgucccagauacuucgggggcuggggugggaagaucaccugagccugugagaguguggcugcaaugagcugagaucgcaccacugcacuccagccagggugagagugagacccuaccucaaaaaaaaaaaaaaaguugcuguuaucauuagugaagucuugga

SEQ ID NO: 134476 - RNA, 43 nt, Homo sapiens
ucucagugcuuagacaauuaagagcuaguaauguacucuggag

SEQ ID NO: 134477 - RNA, 48 nt, Homo sapiens
ccagagcggagauuuguccucacuugccccagugagaaggaacagcag

SEQ ID NO: 134478 - RNA, 46 nt, Homo sapiens
ggggcauucugcuaaacaucugacccagacucuucaaaaaugaaga

SEQ ID NO: 134479 - RNA, 35 nt, Homo sapiens
cuuuuaggugaaaaugcuggaguuuuaaaacagug

SEQ ID NO: 134480 - RNA, 46 nt, Homo sapiens
gaggauuggaugcaagcuuuuuuaaauggugccaaaggagguaacc

SEQ ID NO: 134481 - RNA, 46 nt, Homo sapiens
cucucauaggcuuugaguuacacuccuguugaaguuaaagaaucag

SEQ ID NO: 134482 - RNA, 70 nt, Homo sapiens
agcaacaaugcaacuccuacucuaguccacacugcccauuccccacugagaagcuggggagcuuuccaau

SEQ ID NO: 134483 - RNA, 24 nt, Homo sapiens
guuucacucucccgccacacacac

SEQ ID NO: 134484 - RNA, 41 nt, Homo sapiens
uaccuucaagauggcaaugcagugggacaugagaccccugg

SEQ ID NO: 134485 - RNA, 43 nt, Homo sapiens
uagugaauaccauagugcagaaucuuuaaaacuaauggggaag

SEQ ID NO: 134486 - RNA, 52 nt, Homo sapiens
aucauaacaauuuaaaaucuaagacugccucuuucuucuccuggguuucagg

SEQ ID NO: 134487 - RNA, 43 nt, Homo sapiens
cacucacagcuaaggcaugucugcuucugggguacaaaaauca

SEQ ID NO: 134488 - RNA, 32 nt, Homo sapiens
caagguggugguuagggugggguuauccuggc

SEQ ID NO: 134489 - RNA, 50 nt, Homo sapiens
acagggcugggcuuuucauuuaacaaauuuguucugauggauguguauag

SEQ ID NO: 134490 - RNA, 24 nt, Homo sapiens
gggaugaggguaggucuuccauca

SEQ ID NO: 134491 - RNA, 114 nt, Homo sapiens
acucagccaagauucucugggugcacagauuccucuuggcccccugcacugacucaggcuccagugaggucuucccugggugcuggggguaacaauagacaggguugagaggua

SEQ ID NO: 134492 - RNA, 36 nt, Homo sapiens
gcuucaguuugagaauuggauguuucuggguuaguc

SEQ ID NO: 134493 - RNA, 50 nt, Homo sapiens
uaugagcagcaggcacagaagggcggcagagacuuucaugcuggaggcga

SEQ ID NO: 134494 - RNA, 50 nt, Homo sapiens
accugcuguuauaacuucaccaauaggaagaucucagugcagaggcucgc

SEQ ID NO: 134495 - RNA, 48 nt, Homo sapiens
agccucugcacugagaucuuccuauuggugaaguuauaacagcaggug

SEQ ID NO: 134496 - RNA, 48 nt, Homo sapiens
ugcugaccccaagcagaaguggguucaggauuccauggaccaccugga

SEQ ID NO: 134497 - RNA, 73 nt, Homo sapiens
gcagcuaacuuauuuuccccuagcuuuccccagacacccuguuuuauuuuauuauaaugaauuuuguuuguug

SEQ ID NO: 134498 - RNA, 48 nt, Homo sapiens
uaaguuuaucuuucaugguacuaguguuuuuuagauacagagacuugg

SEQ ID NO: 134499 - RNA, 40 nt, Homo sapiens
gcccaugcccucacccuccaacaugaaagccucugcagca

SEQ ID NO: 134500 - RNA, 52 nt, Homo sapiens
auacccuguccuuucucagagugguucugagauuauuuuaaucuaauucuaa

SEQ ID NO: 134501 - RNA, 50 nt, Homo sapiens
auauuuuaauuuaaucuuccauggauuuugguggguuuugaacauaaagc

SEQ ID NO: 134502 - RNA, 51 nt, Homo sapiens
acuacauuugcuacauuuuuuuaaguuuccucaaccguaucugucuuuuuc

SEQ ID NO: 134503 - RNA, 45 nt, Homo sapiens
aggaagagcaaacaacugggccuuguuagguaagcaaagaacagg

SEQ ID NO: 134504 - RNA, 49 nt, Homo sapiens
ucucaauuccaugaaagcuacugaauacaaacuauuuacuagggagucu

SEQ ID NO: 134505 - RNA, 67 nt, Homo sapiens
aaacaugcauuuaaugugguaccacucuuucauaucacccccagacucugagaagggauugggcacc

SEQ ID NO: 134506 - RNA, 38 nt, Homo sapiens
aaagcaaauagaguaaaauguuaauagguaaauauggg

SEQ ID NO: 134507 - RNA, 45 nt, Homo sapiens
cggggauugguacuggugacaaaugaggcgccuuucacuggagaa

SEQ ID NO: 134508 - RNA, 48 nt, Homo sapiens
cuaguucaauguucucuuacugauaaggggacugaggucugagaagag

SEQ ID NO: 134509 - RNA, 41 nt, Homo sapiens
ugguauuuagcuuuauuuaaucuccccgaauagacuuuugg

SEQ ID NO: 134510 - RNA, 48 nt, Homo sapiens
gacaguccuuaugccuggggucacauuugcuugaagacagacuucucu

SEQ ID NO: 134511 - RNA, 45 nt, Homo sapiens
ggucuucguguuguagcuaggauuaucggccaccauggcgcauaa

SEQ ID NO: 134512 - RNA, 41 nt, Homo sapiens
guugcugcucauccuccuuggugagcuuggacagccgcaga

SEQ ID NO: 134513 - RNA, 39 nt, Homo sapiens
aaaucacaggagaggcaaaggaugagugaauacugggua

SEQ ID NO: 134514 - RNA, 46 nt, Homo sapiens
cccuccaaucccuccuggaucacccggguuaucaugucagccaagu

SEQ ID NO: 134515 - RNA, 45 nt, Homo sapiens
cccagggggcagaggccacccugaccuuugcucccuugcccauag

SEQ ID NO: 134516 - RNA, 42 nt, Homo sapiens
cugugcaccacuucuggcugccagggucguagcagcccauga

SEQ ID NO: 134517 - RNA, 43 nt, Homo sapiens
gcuuucugucaggaguaagccagcaggucaucacugguuaaga

SEQ ID NO: 134518 - RNA, 40 nt, Homo sapiens
aagaacuaagaggguagggauugcugauaaugcucccuga

SEQ ID NO: 134519 - RNA, 16 nt, Homo sapiens
cgacagaggaguggcu

SEQ ID NO: 134520 - RNA, 45 nt, Homo sapiens
cucaagaccacaaauguaauauauggaagaggccauggaacaacc

SEQ ID NO: 134521 - RNA, 46 nt, Homo sapiens
cuaauucuuagaauuauuccguagcuuuugcugauuacucugagau

SEQ ID NO: 134522 - RNA, 47 nt, Homo sapiens
uaugcuguugacuggaguccagauggccagagaguggcaaguggugg

SEQ ID NO: 134523 - RNA, 45 nt, Homo sapiens
cagcagugacagcacacugaaggugugggaugugaaggcccagaa

SEQ ID NO: 134524 - RNA, 48 nt, Homo sapiens
ccuuauuccugugguccccagcagaggacaaaaagccucucacucgga

SEQ ID NO: 134525 - RNA, 42 nt, Homo sapiens
gcugaggccucaguuaauccccaagaccuccaaggauccugu

SEQ ID NO: 134526 - RNA, 45 nt, Homo sapiens
cucugccucccaggaccgcaccaucaaagucuggagagcucauga

SEQ ID NO: 134527 - RNA, 50 nt, Homo sapiens
cacaacugcaggccgcugugagcgcauccucaccgggcacacccagucgg

SEQ ID NO: 134528 - RNA, 46 nt, Homo sapiens
cagggaagcaggugggcaggacccucgcuggccacagcaaguggau

SEQ ID NO: 134529 - RNA, 46 nt, Homo sapiens
cuuaggacacagacacuggguccuuaguauauccuggucuccagau

SEQ ID NO: 134530 - RNA, 96 nt, Homo sapiens
aggagaugcugaugcugcugcucugacgaccacacuugaagaaccacugcuauaccacagauuaguuaagugaccuuguguguguagggcauguuc

SEQ ID NO: 134531 - RNA, 46 nt, Homo sapiens
gcucuggagacaccaccgugcgcuucugggaucucagcacagagac

SEQ ID NO: 134532 - RNA, 42 nt, Homo sapiens
accauagacccaagcucuggacucagcuugcaauuaagggac

SEQ ID NO: 134533 - RNA, 55 nt, Homo sapiens
gucccaggcaguggagacagagaagguccuagacaucaucuaccagccacaggcu

SEQ ID NO: 134534 - RNA, 42 nt, Homo sapiens
acaucaccccggacaggcugcagcucgugugcaacgcgcuac

SEQ ID NO: 134535 - RNA, 43 nt, Homo sapiens
gaaauggcuuaacuucauacauugaacauauuaaguaugagau

SEQ ID NO: 134536 - RNA, 46 nt, Homo sapiens
uguacuccaagaaaggccuggaacauaaaaaggaacuccagcaacu

SEQ ID NO: 134537 - RNA, 45 nt, Homo sapiens
aucaacaaccuaaacugagauagucucaugccauuguacacaugc

SEQ ID NO: 134538 - RNA, 49 nt, Homo sapiens
gauuauuaaaaacuuuacuuuggagcaaauagugaccuauguggcagac

SEQ ID NO: 134539 - RNA, 46 nt, Homo sapiens
agggaaauggcuuaacuucauacauugaacauauuaaguaugagau

SEQ ID NO: 134540 - RNA, 74 nt, Homo sapiens
gccacuucuggucuacuuuucaaggauggaggaauuaugucuguaaaaggaauaaaaacauucaccugguagaa

SEQ ID NO: 134541 - RNA, 44 nt, Homo sapiens
uccagguacugacugccaguuuuuacaucaggagagaaggaagu

SEQ ID NO: 134542 - RNA, 40 nt, Homo sapiens
gaguugguucuagaugugggaagagucacucuuggagaga

SEQ ID NO: 134543 - RNA, 49 nt, Homo sapiens
aucuguuccaaaccuagauguucucaugccaugguacacaugccccuca

SEQ ID NO: 134544 - RNA, 87 nt, Homo sapiens
ucaguuucacuguaauccucaggcccuuccagucacccguugccuuggcaaugucaucaccaaccuuuuuuggagacagacccaggg

SEQ ID NO: 134545 - RNA, 60 nt, Homo sapiens
ggccgaucuugggggccagggcagaaguggcaccgacuucaccuccggugcaccucaggu

SEQ ID NO: 134546 - RNA, 79 nt, Homo sapiens
aauuaugccgaguugguucuagaugugggaagagucacucuuggagagaacaguaggaaaaaaaugaaggauuguaaac

SEQ ID NO: 134547 - RNA, 46 nt, Homo sapiens
cgaaaaguccauuaggaagaugccugugcaucacuucuguauggag

SEQ ID NO: 134548 - RNA, 45 nt, Homo sapiens
aguguuugcuaaagagccugauuccuggcaugugaaagauaaccg

SEQ ID NO: 134549 - RNA, 46 nt, Homo sapiens
aauuaugccgaguugguucuagaugugggaagagucacucuuggag

SEQ ID NO: 134550 - RNA, 84 nt, Homo sapiens
cacgagcuaugugugcucugcucaauucuggagggggagugaucaaggcugaaauugagaaugaagacuauaguuauacaaaag

SEQ ID NO: 134551 - RNA, 79 nt, Homo sapiens
uuugcuaaagagccugauuccuggcaugugaaagauaaccgugugaugcaguugaccaggaaggaauggauccaguuca

SEQ ID NO: 134552 - RNA, 57 nt, Homo sapiens
auugaugaaaaaaggcuucaugcaaaagauggcauuuugaaggguugcaaacugcag

SEQ ID NO: 134553 - RNA, 47 nt, Homo sapiens
uuugaauuacugauauucucauguuuuccuccuuagguugagaugaa

SEQ ID NO: 134554 - RNA, 46 nt, Homo sapiens
aacauccauuaagcaucaacuaugugccaggcccagggccagagac

SEQ ID NO: 134555 - RNA, 37 nt, Homo sapiens
uuacagguuugcugcaaauggugcugucugaggagag

SEQ ID NO: 134556 - RNA, 48 nt, Homo sapiens
aaguucagguuugcgugagaaugcugaagcuggacacacggaucaaga

SEQ ID NO: 134557 - RNA, 39 nt, Homo sapiens
gacagucaauuguggaaauaaacuaacuuuaaggauuaa

SEQ ID NO: 134558 - RNA, 46 nt, Homo sapiens
gcagguggugggccaggagagcccgcagggcggaagagaaacugac

SEQ ID NO: 134559 - RNA, 42 nt, Homo sapiens
aagacaacgcauuucgcuaagggccacagcauucacugguua

SEQ ID NO: 134560 - RNA, 50 nt, Homo sapiens
guggguggauguaccugccugggaggcuggcugugcaugugcacaugugu

SEQ ID NO: 134561 - RNA, 72 nt, Homo sapiens
ccgagccugcgggaccuaugaaaugccugaugccuucgagcaucuagaaaguccucuucccagcccaacaga

SEQ ID NO: 134562 - RNA, 46 nt, Homo sapiens
gucgcaggacgacgccaaggacucggagagcgccaacgugucggac

SEQ ID NO: 134563 - RNA, 49 nt, Homo sapiens
gcuacggaggggggcucuccgcggcuauguuuguuuaccaacagcgggg

SEQ ID NO: 134564 - RNA, 24 nt, Homo sapiens
caaacagccagcaaaugggauuag

SEQ ID NO: 134565 - RNA, 41 nt, Homo sapiens
ucaguuuuagaaauguuagguuugaaaugcccgccugacag

SEQ ID NO: 134566 - RNA, 38 nt, Homo sapiens
agauggggauuuuggccacaacuccuuucccaugucaa

SEQ ID NO: 134567 - RNA, 41 nt, Homo sapiens
acacucgguggccagacaugcuggguggggagaggaagggg

SEQ ID NO: 134568 - RNA, 53 nt, Homo sapiens
accaccauagagcaacuaugcaggauuugagcaguggcugugugcuuccucac

SEQ ID NO: 134569 - RNA, 46 nt, Homo sapiens
ugaugacucuauagcugauuuucucaauagugaugaggaagaagac

SEQ ID NO: 134570 - RNA, 49 nt, Homo sapiens
auuuaaguucccuaggaggggguugguugggggauguacugaaagagau

SEQ ID NO: 134571 - RNA, 42 nt, Homo sapiens
ggaccaguguugaucuguaauguaauagaaaaucugauagac

SEQ ID NO: 134572 - RNA, 50 nt, Homo sapiens
cagcauguaccgcauguguaaguagucuggcccacauuuucaaccuagua

SEQ ID NO: 134573 - RNA, 44 nt, Homo sapiens
ggaccucaguuaaccaauuaccuuuucccggauuccagggaauu

SEQ ID NO: 134574 - RNA, 46 nt, Homo sapiens
augacaugaaucaguaugaaaaugcugagaaacuuuauuugcgauc

SEQ ID NO: 134575 - RNA, 45 nt, Homo sapiens
acuuauuuuagaggagauugcaauugauugucauaauaaggaaac

SEQ ID NO: 134576 - RNA, 71 nt, Homo sapiens
acuuucuaucaauauuauauuacagauugugauuuuuaaaauuccuaaaucauuuguaacuaaaaagaaau

SEQ ID NO: 134577 - RNA, 43 nt, Homo sapiens
gacuuuuugacaacuaccccgcccaccaauauagguugcauca

SEQ ID NO: 134578 - RNA, 30 nt, Homo sapiens
acauaaaauaacaaauguuacaauaggagg

SEQ ID NO: 134579 - RNA, 46 nt, Homo sapiens
ugcuucaugugcgaaauggaaacugcaaauaucauuugggugaaga

SEQ ID NO: 134580 - RNA, 13967 nt, Homo sapiens
uuucaggcaauuucuuauuaaaguuuuugcuaccuuuuuuguuuauuuuguuuuauuauuuuauuuugagacaggguuucacugugucacccaggcuagagugcaguggcacaauuguauuaaucuguuuucaugcugccauuaaagacauacccgagacuggguaauuuauaaagcaaaaagagguuuaauggacuuauaguuccacaugacuggggaggcuucacaaucauggcggaagguggaaggcaugucuuauaugguggcagacgagaaugagagccaagagauaggggaaaccccuuauaaaaccaucagcucucaugagacuuauucacuagcaugaaaacaguguuggggaaccggcccuaugauucaguuaucuuucaccaggucccucccacaacacgugggaauuaugggaacuauaauucaaaaugagauuuggguggggacacagccaaaucauaucauuccacccuggccccucgcaaaucucauguccucacauuucaacaccaaucaugccuucgcaacaguccuccaaagucuuaacucauuucagcauuaacucaaaaaguccacaguccaaagucucaucugagacaaggcaagucucuucugccugugagccuguaaaaucaaaagcaaguuaguuauuuccuagauacaguggggguacaugcauuggauaaauacaaccauuccaaauggaagaaauuggccaaaaugaaggagcuaaaggccccaugcaagucuggaauccaguggaguagucaaaucauaaagcuccaaaaugaucuuuucugacuccaugucucacauccaggucaugcuguugcaagagguggguucccauggucuugggcagcuccgccccuguggcuuugaaggguacagccucccucccagcugcuuucacggacuggcgucgagugucugugguuuuuucaggcacacggugcaagcuuucaguggaucugccauucuguggucuggagcacaguggcccucuucucauagcuccacuaggcagugccccaguggggacucuguguaagggcuucaacccaauauuucccuuccacacugcccuagcagagguuuuucaugaggaccucacccugcagcaaacuucugccuggacaugcaggcguucccauacauucugaagucuaggcagagguucccaaaccucaauucuugacuucugggcacccacaggcucaacaccaugugggagcugcuaaggcuugggacuugcccccuuggaagcuauggucuaagcuguacguuggucccuuuuagcuaugaguagagcagcugggacacagggguccaagucccuagucugcacacagcaggggggcccugggcucaacucacaaaaccauuuuuuccuccuaggccucugggccugugauaggaggggcugccacaaaguucucugaaauguccuggagacauuuucuccauugucuuggagauuagcauuuggcugcucguuacucaugcaaauuucugcugccagcuugcaguucuucucacaaaaugaguuuuucuuuucuaucgcauccugaggcugcaaauuuuccaaacuuuuaugcucuguuuuccuuuuaaaacugaaugcugacugggugcaguagcucacaccucuagucccagcacuuugggaggccaagguggguggauuguuuugauaucaggaguuugagaccagccuggccaacauggugaaaccguaucucuacuaaaaauacaaaaacuagccgggccuguuggcgggugccuguaaucucagcuacucgggaggcugaggcaggagaaucacuugaaccuggaaggcagagguugcagugaguugaaaucgccucacuguacugcugagaucaccccacugcacuccagccugggugacaaagcaaaacuucaucucaaaaaaauaaaaauaaaaaaauaaaaauaaaugagacaaugcuuuuaacagcacuccagucaccucuuaaaugcuuuguugcuuggaaauuucuucugccagauacccuaaaucaucucccucaaguuaaagguuccacacaucucugaggcagggacaaaaugucaccagucuuuuggcuaaaauauagcaagagucaccuuuacuccaguuuccaacaaguuccucaucuccaucugagaccaccucagccuggauuucacuguccauaucauuaucagcauuuugaucaaagcuauucaacaagucucuaggaaguuccaaacuuuuccuacauuuuucugucuucuucugagcccuccaaacuguuccaaacuuugccuguuacccaguuccaaaguugcuuccacauuuucagguaucuuuauagcagcuccccacucugcuggcaccaguuuacuuuauuaguucauuuucaugcugcuguuaaagacauaccugagacuggauaauuuauaaaggaaaaugagguuuaauggacucauaguuccacguggcuggggaggccucacaaucaugguggaagguaaaaggcacaucuuacaugguggcaggcaaaacagaaugagccaaaugaaaggggaaaccccuuauaaaaccaucagaucucgugagacuuacuaccacaagaacaguauuggggagacugcccccaugauucaguuaucucccaccaggucccucccauaaugugggaauuaugggagcuacaauucaagaugagauuuguguggggacacagagccaaaccauaucaacaaucauagcucacuguaacuucaaacuugggcucaagcagucuuccugcuucagcuucccgaguagcuaggacaacaggcaugugucaacauacacagcuaauuuuuauuuuuguugagacaaggucuugcuauguugcccaggcuggucuugaacuccugggcucaagcauucuucccaaacuacuggaauuacaggcaugagccacugcacuuggcucuuuuuucucuauuaaacaaacuuuuuuugaagugacuguagauucauaggaaguugcaaaagaguacccagaguucuuugaaccauuccuccagcuucccccaguggucacauauuauauaacuguagggcaauaucaaaaccaagaaauugacacugguguuauaccauuaacuagacuacuggccuuacuuaguuuucaccaguuuuuacgugcacucauuuguuuguaugugugucugugcgguggauuccauguagagucguacaaccaccaucacuaucaagauacaguacuauuugaucaccacaaacuauuuuuguuuggggguuuuuguuuuguuuuguuuuguuuuguuuuguuuucugagauggagucucacucuaucacccaggcuggagugcaguggcaugauuuuugcucacugcaacuuccgccucuuguguucaagcuauucuccuuccucagccucccaaguagccgagauuacaggcgugugccaccacacccaacuaauuuuuguauuuuuaguagagacgggguucaccauguuggccagacuggucucaaacuccugacgucaagugguccacccaccucugccaccaaaagugcugggauuauaggcgugagccacugcacccagcccuacuuuuguuuuuaacuucucucauuacugugugcaugugccauguauguguuuucugucuuaaaguguacacacgugcguauacauccuucccaacaacuuuuaacagucauuuuuaaucuuuuuuuuuuuuuuuuuuuuugagacauggucccacucugucgcccagacuggagugcaguggcacgaucucagcucacugcagccuccgccuccuggguugaagugauucugcugccucagccucacagguagcugggacuacaggcaugcgccaccacacucaucuaauuuuuguguuuuuaguagagaugguguuuuaucauguuggccaggcuggucucaaauugcuaaccucaggugaucuguccaccucagccucccaaagugcugggauuacaggccugaggcaccgugccuggccuguuuaaucuuagaauaauucuuuguaguagccaaagacagguugccgaagggacuucagagcauauuuuuuugaaaaggacccucauuauuucuuuuuuuuuauuugagacagagucuuguacugucgcccaggcuggagugcaauagugugaucucagcucacugcaaccuccuccucccggguucaagccauucuccugccucagccucccgaguagcugggauuauaggcaccugccaccauacccagcuaauuuuuuguauuuuuaguagugaugagguuucacuauguugggcaggcuggucucaaacucaugacuucgugauccacccagcucagucucccaaagugcugggauuacaggcaugagccaccgugccuggccagcauuuauuuuuuaaauagucuuauggaaaugucaguagcgacaaagaauuguccaaagaaagucucucaaaacuugugaucuugacuaauguuaaggaugauaucccuuuaguucuauaugaucauguaaaaaugugugugugagagaaauuuaguaugaaagaagaugaaaggaagacuaguguucauugagguccucuaucaucuccacaucuacuuaugccaaucuggccauuauaaugacccaacuagauaccuuggagagagaaccaaguccuggcaaacucacaguuaucagucuuaauccuaaaauuacccaagaggaaaaagucauaccagaagaguuuugcagacaucaccacaaaaaguuuuagaacauuauuuccuccccaaaaagaaaacaguacccauuagcagucacucccauuucucuccaacaccaggcaaacaucaucuacuuucugucucuauagauuugccuguucuggacauuuuauauaaguguacucuugaaauacauggucuuugugacuggcuuguuuuauuuaccauaauacuuucaaaauccauccauguuauagagacagaauuuaauauaaauaauauuuuuugaccucuggggucagggcauagcugaacaaaaggcagcagaaacuucugcagacuuaaacaucccugucugacagcucugaagagagcagugauucucccagcacggaguuugagcucugagaacagacagacugccuccucaagugggucccugacccccguguagccuaacugugagacaccucccaguaggggcugacugacaccucauacagccaggugccccucugagacgaagcuuccagaggaaggaucaggcagcaauauuugcuguucugcaauauuugcuguucugcagcuuucgcuggugauaccccagcaaguaaggucuggaguggaccuccugcaaacucccaacagacugcagcugagggaccugacuguuacaaggaaaacuaacaaacagaaaggaauagcaucgacauaaacuaaaaggacauccacaccaaaaccccaccuguaggucaccaucaucaaagaccaaaggcagauaaaaccacaaagauggggagaaaccagagcagaaaagcugaaaauucuaaaaaccagagugccuuuucuccuccaagggauugcagcuccucgccagcaauggaacaaagccagauggagaaugacuuugacaaguugacagaaguaggcuucagaagguugguaauaacagacuucuccaagcuaaaggaggauguucgaacccaucgcaaggaagcuaaaaaccuugaaaaaagauuagacaaauggcuaacuagaauaaacaguguagagaagaccuuaaaugaccugauggagcugaaaaccauggcgcgagaacuacaugacacaugcacaugcuucaguagccgauucgaucuaguggaagaaaggguaucagugauugaagaucaaauuaaugaaaugaagugagaagagaaguuuagagaaaagagaguaaaaagaaacaaacaaagccuccaagaaauacaggacuaugugaaaauaccaaaucuacguuugauugguguacccgaaagugacggggagaauggaaccaagcuggaagacacuucaggauauuauccaggagaacuuccccaaccuagcaaggcaggccaacauucaaauucaggaaauacagagaacaccacaaagauaauuccuugagaagagcaaccccaagacacacaauugucagauuccccaagauaaaaaugaaggaaaaaauguuaagagcagccagaaagaaaggucagguuacccacaaagggaaccccaucagccuaaccguggaucucucagcagaaacucuacaagccagaagagagugggggccaauauucaacauucuuaaagaaaagaauuuucaacccagaauuucauauccagccaaacuaagcuucauaagugaaggagaaauaaaauccuuuacagauaagcaaaugcugagagauuuugucaccaccaggccugccuuacaagagcuucugaaggaagcacuaaagauggaaaggaacaaccgguaccagccacugcaaaaacaugcaaaauuguaaagaccaucgaugcucggaagaaacugcaucaacuaauggccaaaauaaccggcuaacaucauagugacaggaucaaauucacacauaacaauacuaaccuuaaauauaaaugggcuaaaugccccaauuaaaagacacagacuggcaaacuggauaaagacgcaaaacccaucagugugcuguauuuaggagacccaucucacaugcagagacacacguaggcucaaaauaaagggauggagaaagaucuaccaagcaaguggaaagcaaaaaaaagcagggguugcaauccuagucucugauaaaacagacuuuaaaccaacaaagaucaaaagagacgaggccaucacauaaugguaaagggaucaauucgacaagaagagcuaacuauccuaaauauauaugcacccaauacaggagcacucagauucauaaggcaaguccuuagagaccuacaaagagacuuagacucccacauaauaauaaugggagacuuuaacaccccacugucaauauuagacagaucaaugagacagaagguuaacaaggauauccaggauuugaacucaguucugcaccaagcagaccuaauagacaucuacagaacucuccaccccaaaucaacagaauauauucuucucagcaccacaucguacuuauuccaaaauugaccacauaguugaaaguaaagcacuccuuggcaaauguaaaagaacagaaaucacaacaaacugucucucagaccucagugcagucaaauuagaacucaggauuaagaaagucgcucaaaaccacacaacuacguggaaacugaacagccugcuccugaaugacuacuggguaaauaacgaaaugaaggcagaaauaaagaugucuuugaaaccaauaagaacaaagacacaacgaaccagaaucucugggacacauuuaaagcuguguguagagguaaauuuauagcacuaauagcccacaagagaaagcaggaaagaucuacaauucacacccuaccaucacaauuaaaagagcuagagaagcaagagcaaacaaguucgaaagcuagcagaaggcaagaaauaacuaagaucagagcagaacugaaggagauagagacacaaaaaacccuucaaaaaaaucagugaauccaggagcuggguuuuugaaaagaucaacaaaauugauagaccacuagcaagacuaauaaagaagaaaagaagaaucaaauagaugcaauaaaaaaugauaaaggggauaucaccacugauccuacagaaauacagacuaccaucagagaauacuauaaauaccucuaagcaaauaaacuagaaaaucuaaaagaaauggauaaaugcccggacacauacacccucccaagacuaaaccagaaagaaguugaaucucugaauagaccaauaacaggcuccggaauugaggcaauaauuaauagccuaccaaccaaaagaagucuaggaccagacugauucacagccaaauucuaccagagcuacaaagaggagcugguaccauuccuucugaaacuuuuccaaucaauagagagggaacucucccuaacucauuuuaugaggccagcaucauccugauaccaaagccuggcagagacacaacaaaaaaagagaauuuuagaccaauaucccugaugaacaucgaugcgaaaauccucaauaaaauaccggcaaacugaauccagcagcacaucaaaaagcuuauccaccaagaucaaguuggcuucaucccugggaugcaaggcugguucaacauaugcaaaucaauaaacguaauccauaacauaaacagaaccaaagacaaaaaccacaugauuaucucaauagaggcaggaaaggccuuugacaaaauucaacucucaauaaauuagguauuuauggaauguaacucaaaauaauagccguuuaagacagacccacagccaguaucauacugaaugggcaaaaacuggaagcauucccuuugaaaacuggcacaagacaguuuucugucuuucucucaucacuccuauucaacauaguguuggaaguucuggccagggcggucaggcaagggaaagaaauaaaggguauucagauaggaagagaggaagucaaauugucccuguuugcagaugacaugauuguauauuuaggaaaccccaucaucucagcccaaaaucuccuuaagcugauaagcaacuuccuuaaagucucaggauacaaaaucaaagugcaaaaaucacaagcauucuuaugcaccaauaacacauaaacagccaaauuaugagugaacucccauucacaguugcuucagagagaauaaaauaccuaggaauccaaccuacaagggaugugaaggaccucuucaaggagaacuacaaacuacugcucaacaaaauaaaagaggacacaaacaaauggaagaacauuccaugcucaugaauaggaagaaucaguaucaugaaaauggcuguacugugcaagguaauuuauagauucaaugccaucuccaucaagcuaccaaugacuuucuucacaggauuggaaaaaacuacucuaaaguucauauggaaccaaaaaagagcccgcauugccaagccaauccuaagccaaaagaacaaagcuggaggcaucacacuaccugacuucaaacuauacuacaaggcugcaguaaccaaaacagcgugguacugguaccaaaacagauauagaccaguggaacagaacacagcccucauaaauaauaccacacaucuacaaccaucugaucuuugacaaaccugacaaaaacaagaaaugaggaaaggauucccuauuuaauaaauggugcugggaaaacuggcuagccguagguagaaagcugaaacuggaucccuuccuuacacguuauacaaaaauuaauucaagauggauuaaagacuuaaauguuagaccuaaaaccauaaaaaccguagaagaaaaccugggcaauaccauucaggacauaggcacgggcaaggacuucaugucuaaaacacgaaaagcaauggcaacaaaagccaaaauugacaaaugggaucuaauuaaacuaaagagcuucugcacagcaaaagaaacuaccaucggcuaggugcgguggcucacgccuguaauccuagcacuuugggaggccgaggcgagcggaucacgaggucgggagaucgagaccauccuggcuaacauggugaaaccccgucucuacuaaaaauacaaaaaaauagccaggugugguggugggcgccuauagucccagcuauuugggaggcucaggcaggagaauggcgugaacccaggaggcagagcuugcagugagccgagauugcgcuacugcacuccagccugggcgacagagcaagucuccaucucaaaaaaaaagaaacugucaucagagugaacaggcgaccuacagaauggagaaaauuuuugcaaucuaccuaucugacaaugggcugauacccagaaucuacaaagaacuuaagcgaauuuacaagaaaaaaucaaacaaccccaucaaaaagugggcaaaggacaugagcagacacuucucaaaagaagacauuuaugcagccaacagacacaugaaaaaauacucaucaucacuggucaucagagaaaugcaaaucaaaaccacagugagauaccaucucacaccaguuagaauggugaucauuaaaaaaucaggaaacaggugcuggagaagaugcggagaaauaggaacacuuuuacacuguuggugggaguguaaacuaguucaacuauuguggaagacaguguggcgauuccucaaggaucuagaacuagaaauacuauuugacccugcaaucccauuacuggguauauacccaaaggauuauaaaucaugcuacuauaaagacauaugcacauguauguuuauuacggcacuucacaauagcaaagacauggaaccaacccaaauguccaucaaugauagacuggauuaagaaaauguggugcauauacaccauggaauacuaugcagccagaaaacaggaugaguucauguccuuuguagggacauggaugaagcuggaaaccaucauucugagcaaacuaucacaaggacagaaaaccaaauaccacauguucucacucaggugggaauugaacaaugagaacacuuggacacagggcagggaaccucacacaccagggccuguugugggguggcggucugggggagggauagcguuaggagaaauaccuaauguaaaugacgaguugaugggugcagcaaaccaacauggcacauguaaccugcacguugugcacauguacccuagaacuuaaaguauaauaauaauaaauuuuuaauccuaaaaaauaaaaaagaauugucuuuuagaaaggacugcauuacuaaguaggacuaucacccuggacauucaagcccuuuucugacaggccacaucuuuauugggaugaggcuauucaaagggaaaauuaaacauuucuuaacaggaauauguuuuuaaaaugguuuggauucauuuauuucuuguuuauaaguauuuaauuugaugcuuauagucaaggaacacauuucuuaaaauuaaguuuuuaaucgaaguaguaacccggccggacgcgguggcucacaccuguaaucccagcacuuugggaggcugaggugggcggaucuccugagguuagaaguuugagaccagccugaccaacauggagaaacccgucucuacuaaaaauacaaaauuagccgggcgugguggcacaugccuguaaucucagcuacucaggaggcugagguaggagaaucacuugaacccaggaggcggagguugcggugagccgagaucacgcuauugcacucuagccugggcaacaagagcaaacucugucucuaaaaaaagaaauaguaaccuauccugugguuacuggauugauacuucuauuaacagcaaauguccacuucauuuucaagcacaaauggucauuguaagaagcuguaacagcugccacaauugugcuguugucuucuuuuccuaacuucuuuugaaaacaaggaucucauuuguuuugaacagagaaaauaaauuugguucuggauuugacuuagcugaagcccagcucuauuguaguauuuuccuugaguuuaggugaauucuagggucaauauuacaaguuuugacuuugucaugcucuagaauaaaccuaaauuuuuagggauugucaaacuaagaaccaaauaaaauuaaguacauuguauaaauuuucuccuucucaacaagauguggaugaaguagauguuauaucugaauaguucauuucacuaggcuauaaaaucaauuaucagcauaaaaaauauuuauuuauuuaggagacagggucucacuguguuacccaggcuggucuugaacucuuggccucaagggauccuuccaccuuggccuccaaaagugcuggaauuacaggcaugagccacuguaccuggccuaauacaaaucguuuuuaaccagauacuagagaacuaaagaggcaaaaagggaacaguaggguauuauggacaaagcagcugugagaauuggcuaccauaccuauggcuuggggaaccaaggaaagagauuggaauuauuaaaaaguaggaguuggagggguuugccccaugaagcugggauacugcuaggcuguuacuggugccucagaggucugaaaagagggcccgugggucuaggaucuagaccucuaggaggagcaaccuggauggcuauugcugauguuugauggagugcugugaaacugguuuugcaagcauuggaaaacugcaacugguauugacuauuauuuaauggaaugaacuaccaccaaagaaaagaagcacacccugggguguuuuugucagcaggaaccucacuaacagauacaggaaggagaguguccauugcucuuccagucaugcagcccauuucuccagugccuccuauucgcugagccaaacggagccagcuagcaaaggagaaaugugguuugcagaguccuugcucagcauccucaaacagacucuaguaguauggguuugaagcugagagacaguauucuaauaaccagcacaauauacaauauguugggaugauaaguagaauauugcuuaguaugaauaugaauaaucucauuauucugcucaacuuggugaggaagcuagaaaguuuuaaagcacaguucucuccaauuaaaaaaaugcuuaauuacauguaguuuuaauuaaauauaaaacaugagucuaagcaaaauauaauauuuugucaacucauacauuaauacuauuaagacaccauauuuuuugugugccaagaaaaagccacuuauuguaauauaccauuacuuuuaugacguacucuaauuucagaguuuuguuguuguuguuguuugagacaaggucuggcuggcucuguugcccaggcuggagggcaguggugugaucuccgcucacugcagccucugccucccaggcucaagccauucucccaccccagccuccugaguagcugggacuacaggcacucgccaccacauccggcuuacuuuuguaucuuuuguagagacaggauuuugccauauugcccaggcuggucucagauaauuucagagauuuuuuaaugugcaaaaaaauguguuuuagaacauaccaugaugguauguuacuuuguguuuucugguuauuguaacuaauccugaauagcacuaagaaauuauuccuuaauaacuguugcaguauagggacuacagacuuagccucugaagucacauugugugcaucugaaucuuuucacuuacuggauuauaagcuuugguuuuucugugacucaaguguuuucaucuguuacguuggggcaguuauuuaagucgaagguguguugugaaaguuaaaugagugaguucguguaguuauguaguuaccacaauacgaaguguuuuacaugguguaguaacaguguauuaaauguuagucauauuuaggaggcagaauccucaaaaagauaauaugcugaggaaauacugcccaggacaguaauuucuuguuuaaaaaaauaauaagauaaucgauuaaggaucacagucuuuuuuuaucuguguauccuccguuaugugcugcuauacuaaguauauucagauuuaucuucuuugggauuguguauugggagaugcuaaaguuauauguacacuccaagaugaaaauaguaaaauaauuuaguuagcucauuagcuggaaaguaacaacucuuaggccauggaguauucuuagaagguucaaacuuuugacuccuuauucaaggucuuagccuuaacccuccuucccguaguucaaaaccuuuauauaaaaaucucacaguu

SEQ ID NO: 134581 - RNA, 44 nt, Homo sapiens
aauguuuuuaaccauaauugucaugaaucaagcucagccagaau

SEQ ID NO: 134582 - RNA, 101 nt, Homo sapiens
gucaauggcccaucuccaguuuguucuaauuucucaccacacauuuguagauauuucucaccacacauuuguagaucuaggaccacagaccuuugcuguau

SEQ ID NO: 134583 - RNA, 46 nt, Homo sapiens
augugaguauuuuaaggcuuggagucaaaguauuuuucuaacacgc

SEQ ID NO: 134584 - RNA, 30 nt, Homo sapiens
uuugucugucuggggacuucauggguuuca

SEQ ID NO: 134585 - RNA, 47 nt, Homo sapiens
aggacaaauuagauuugucuuucucagccugggaaacugcagcuuug

SEQ ID NO: 134586 - RNA, 46 nt, Homo sapiens
gaucuguaaguuggcuggaacaguguaaacugauauuuuaacagau

SEQ ID NO: 134587 - RNA, 45 nt, Homo sapiens
ugugaaaaugggagugcugaucaacuguuugaagaggacagggag

SEQ ID NO: 134588 - RNA, 33 nt, Homo sapiens
uucuccgaccagggcgggaggaaguacauggag

SEQ ID NO: 134589 - RNA, 45 nt, Homo sapiens
uuugcgcugccauccgcaaaggcuuucucgcuugucaccuugcca

SEQ ID NO: 134590 - RNA, 41 nt, Homo sapiens
auuagcuucuuuuggagagcuuucugcuuuucugagcacuu

SEQ ID NO: 134591 - RNA, 52 nt, Homo sapiens
aggaauauauuugugaauuguggcugauacuacuuuaaaaaauuccaaaaag

SEQ ID NO: 134592 - RNA, 52 nt, Homo sapiens
cguuuaucccccucagcaaugugcuaaauaugaaguaaaagguuaccaaagg

SEQ ID NO: 134593 - RNA, 55 nt, Homo sapiens
auguugugaaaauaggaccugcuaagccauugaaaggauuuucaauauauuguac

SEQ ID NO: 134594 - RNA, 47 nt, Homo sapiens
gaaacgcuuaaguaaaaaaauauucauuuuaaggucaucuguuuaua

SEQ ID NO: 134595 - RNA, 44 nt, Homo sapiens
cgggccgcaagagcgcggaucccgugcagggggcuucgaggggc

SEQ ID NO: 134596 - RNA, 42 nt, Homo sapiens
cggccgccuccuugcgccccucguccuuccuccgagcuucgg

SEQ ID NO: 134597 - RNA, 45 nt, Homo sapiens
agacagucagguccuacugggcauuucagaccuggcaucccaggu

SEQ ID NO: 134598 - RNA, 40 nt, Homo sapiens
gggaaggcacuuugcaaagucuccuucugccugcucaugg

SEQ ID NO: 134599 - RNA, 42 nt, Homo sapiens
cggcugcggcggcggcagcugcagcacuaguggcgggcaaag

SEQ ID NO: 134600 - RNA, 55 nt, Homo sapiens
ugcugaaugguuugguggccacugagguguuaugugguuuuaugucggagagauc

SEQ ID NO: 134601 - RNA, 46 nt, Homo sapiens
uuguuggaccaugugugaucagacugcuaucugaauuaaauaagau

SEQ ID NO: 134602 - RNA, 51 nt, Homo sapiens
gccgaaggauuuugcaguccucugucaguaacuuccauugauuaggcagac

SEQ ID NO: 134603 - RNA, 62 nt, Homo sapiens
uauauaaaaugagugucauaauaguacuuuggucauucauaagauuguaggaauucaaugaa

SEQ ID NO: 134604 - RNA, 46 nt, Homo sapiens
ucagugccuuaucuguugucucuugcaccaaauguacauugcagau

SEQ ID NO: 134605 - RNA, 46 nt, Homo sapiens
uauacucagaaugaccugaugauagauccucucauuguccuaaggu

SEQ ID NO: 134606 - RNA, 29 nt, Homo sapiens
uuaguucuauuauauuacuaaugcuauuu

SEQ ID NO: 134607 - RNA, 46 nt, Homo sapiens
agccaagcuccuugagcaggaugaagacaaucuucacacaggaaau

SEQ ID NO: 134608 - RNA, 38 nt, Homo sapiens
uagggcaggaaaaauaauuucuaccaaaaauaacuuca

SEQ ID NO: 134609 - RNA, 42 nt, Homo sapiens
uguggauauggagcccaaugugucuguguauucggggcugaa

SEQ ID NO: 134610 - RNA, 46 nt, Homo sapiens
cagagaaaaagagagaccagcaguucuguccuuuggcagaugagaa

SEQ ID NO: 134611 - RNA, 43 nt, Homo sapiens
auuuaaucauuuuuaaguauauaauucaguggcauuaaguaua

SEQ ID NO: 134612 - RNA, 42 nt, Homo sapiens
uuugacauuggaucauacuaaaaaugaagcuugugaggaugg

SEQ ID NO: 134613 - RNA, 48 nt, Homo sapiens
ccauuguugucauggauuuuacuuuuacaugaauuauaaaccuuagag

SEQ ID NO: 134614 - RNA, 26 nt, Homo sapiens
gcauuguuguccguggacuuucaugc

SEQ ID NO: 134615 - RNA, 46 nt, Homo sapiens
ucuugauugugccaggaacauugccaacauagggaccuauuaaaga

SEQ ID NO: 134616 - RNA, 38 nt, Homo sapiens
cgcuaaugagacgcgucuuucucacauagcacccacac

SEQ ID NO: 134617 - RNA, 23 nt, Homo sapiens
agcguccgcuucucuggccucag

SEQ ID NO: 134618 - RNA, 71 nt, Homo sapiens
acuuaagccaaguaaggacauaccucaaaauuauugugaucauuuugaaauaguuuuugcugcaaaaauuu

SEQ ID NO: 134619 - RNA, 47 nt, Homo sapiens
aaguuuuuaaaugcuauugcaucauauaauuugcuauucauccacua

SEQ ID NO: 134620 - RNA, 46 nt, Homo sapiens
acuguaauaucagaauacuauguugcauuauuuaaaauguucaaau

SEQ ID NO: 134621 - RNA, 24 nt, Homo sapiens
ucaauugucaguauggcacagauu

SEQ ID NO: 134622 - RNA, 47 nt, Homo sapiens
cuuuuuuuuugugcagguauccaugauuauuaagcaggguggaaguu

SEQ ID NO: 134623 - RNA, 67 nt, Homo sapiens
uauauccauucaaacucaauggaaaguuauuaaauaaccauuagaaaagcucaguagacuuauuuga

SEQ ID NO: 134624 - RNA, 42 nt, Homo sapiens
uugggaaucagggaauaguucccaaauauacaggauuuauug

SEQ ID NO: 134625 - RNA, 44 nt, Homo sapiens
uuugacuuuuuuuuuuaaauuaaagauugggaauguaugugaga

SEQ ID NO: 134626 - RNA, 45 nt, Homo sapiens
aauuuguauugucucgauguacaguuuaacggggauagaggggga

SEQ ID NO: 134627 - RNA, 42 nt, Homo sapiens
uuacuucaacaaauauuguuuugacuuggggggaggggcuau

SEQ ID NO: 134628 - RNA, 43 nt, Homo sapiens
ugcaagaaaagaacaaggaaaaauggauguuucgcugcaggau

SEQ ID NO: 134629 - RNA, 46 nt, Homo sapiens
caauuuagugccuccuuaaacauuuacuuugcacaucuaggcaaau

SEQ ID NO: 134630 - RNA, 46 nt, Homo sapiens
gguucuggucagcauguccucaagcacaauaucaguguccccuuuu

SEQ ID NO: 134631 - RNA, 49 nt, Homo sapiens
uuaauauaugaaaugcaauacuauuuuuccuuggaaauuagcaagaguu

SEQ ID NO: 134632 - RNA, 45 nt, Homo sapiens
uaaugcugcaggauccaugucuacacaagcaaauacaguucagag

SEQ ID NO: 134633 - RNA, 55 nt, Homo sapiens
ugacuucagguguugccauaucuacuucaguugccacagcuaauucaacuuugac

SEQ ID NO: 134634 - RNA, 47 nt, Homo sapiens
cauuggacagcucucuacuuucccagccaaauuuaguugccccuaca

SEQ ID NO: 134635 - RNA, 45 nt, Homo sapiens
augaagcauuuucuaaacucaagcuuuaugcacaagucugcagau

SEQ ID NO: 134636 - RNA, 42 nt, Homo sapiens
ucuacugcaucaaagaaacuaucagaaaaguugguagcagaa

SEQ ID NO: 134637 - RNA, 62 nt, Homo sapiens
uguuguauauacagcauacugggcaguucaguugauugggacacagugaugaugucagauua

SEQ ID NO: 134638 - RNA, 58 nt, Homo sapiens
uguguccagaaaaugaagccuuguuaaauggagcaaaaagcuuuuuuagagaucuuac

SEQ ID NO: 134639 - RNA, 51 nt, Homo sapiens
ccacauauguacuauuuuagauguauggucagauaagauacuacugaggag

SEQ ID NO: 134640 - RNA, 45 nt, Homo sapiens
ugaagcacuugugaaaaguucaugcuuacaccccugguccaaaag

SEQ ID NO: 134641 - RNA, 60 nt, Homo sapiens
agcgugacuguugcaaugacugcuaccuugcauuagaacaugggcgucaguucauggaua

SEQ ID NO: 134642 - RNA, 46 nt, Homo sapiens
ggaaucugaaaaauuaucugaugauuugauauuauugcuacaagau

SEQ ID NO: 134643 - RNA, 46 nt, Homo sapiens
cagaaaaacguuuugaagcucucagggcuaccucugcugaacaugu

SEQ ID NO: 134644 - RNA, 45 nt, Homo sapiens
gcacugcagaucuucauaaaauguauccuacaccaccaucauugg

SEQ ID NO: 134645 - RNA, 59 nt, Homo sapiens
aauccuaaaauguguauagggucacaaaaggcccugaauggcuaaagcagucuugagca

SEQ ID NO: 134646 - RNA, 36 nt, Homo sapiens
agaggacuagaauaguaaaagaugaagaggagaaga

SEQ ID NO: 134647 - RNA, 56 nt, Homo sapiens
ugaaggaagugagcgaguuggccaugcagauauuuggaaggagaauguuccccaua

SEQ ID NO: 134648 - RNA, 40 nt, Homo sapiens
gcuuuuauguucuagugugagugacagucaacuaugaaua

SEQ ID NO: 134649 - RNA, 46 nt, Homo sapiens
auaucaggaagcuguagaaccuacaguauauguugguacagcagua

SEQ ID NO: 134650 - RNA, 42 nt, Homo sapiens
cuuaugcccauuuggacuaaauggcacucucacaggacaggc

SEQ ID NO: 134651 - RNA, 53 nt, Homo sapiens
uuauuuuauuauauuagguauuugaucuuuuauugaaagauccuuauuugacu

SEQ ID NO: 134652 - RNA, 43 nt, Homo sapiens
agccauuuagcugagugugcgguaaaguuuguguauuuagcaa

SEQ ID NO: 134653 - RNA, 70 nt, Homo sapiens
ucuugggucuuugaugcuuuaaaacuuaggagaaauauguugguagugguuucuuauguagaacaagugu

SEQ ID NO: 134654 - RNA, 48 nt, Homo sapiens
uuugccauauguucccuucuccuuccccucccuauuauaaugcuggug

SEQ ID NO: 134655 - RNA, 45 nt, Homo sapiens
aaaaauuucaagaaacacugaugauuaagaacuguaaugcuaaua

SEQ ID NO: 134656 - RNA, 46 nt, Homo sapiens
uagucgcugccuuaaggcagauguacuugguguuuggcggcgagau

SEQ ID NO: 134657 - RNA, 63 nt, Homo sapiens
acagaguaaaugaguuucugaaucuacauuaccuguuuuugaggugaaggaauagagggaugg

SEQ ID NO: 134658 - RNA, 46 nt, Homo sapiens
gaaaagagcaaggcuuugcuuuuugaaauugcaacucaaaugagau

SEQ ID NO: 134659 - RNA, 45 nt, Homo sapiens
guuucagagagucaaugucauuacauagaacacuucagacacagg

SEQ ID NO: 134660 - RNA, 47 nt, Homo sapiens
ugcguaugaaucuaugacagagcaaugcuuuuaaugaauuuaaggca

SEQ ID NO: 134661 - RNA, 46 nt, Homo sapiens
auacccaauggaaacaaguggcauagagcagauggaugugacaaug

SEQ ID NO: 134662 - RNA, 63 nt, Homo sapiens
uuaaauguauauauaucucauugaggguuuugggggucagguguagagguaaagagaccaguu

SEQ ID NO: 134663 - RNA, 87 nt, Homo sapiens
ugagugaggagaagggcagagguuuggaaaaguauuuuauuuuaaaugcaauagaaagcuguuuugagcaggggagaguaaaaugau

SEQ ID NO: 134664 - RNA, 53 nt, Homo sapiens
uguguguaucuauauaguacuauaauacaggaauugucccuguccugaugaag

SEQ ID NO: 134665 - RNA, 128 nt, Homo sapiens
ucauacucucuuugguugacauaagcacagcaucuauaucuuacauugcaaaggacuagucugacuaaucuaugauguuauaugguuuaccuucccucccaaaaguaagcagccauacuggcaaaugu

SEQ ID NO: 134666 - RNA, 85 nt, Homo sapiens
agaggauguaagucaguuugauuccaaguuuacacgucagacaccugucgacagcccagaugacucaacucucagugaaagugcc

SEQ ID NO: 134667 - RNA, 45 nt, Homo sapiens
uguaucugguaaaaagucccuguuccagccaacaccaucccccag

SEQ ID NO: 134668 - RNA, 36 nt, Homo sapiens
ggagguacuguagguagguugguuggcuccuuacag

SEQ ID NO: 134669 - RNA, 46 nt, Homo sapiens
aggcaggcaguaucgaugcgcucucuccgaaauugauaaaauagcg

SEQ ID NO: 134670 - RNA, 44 nt, Homo sapiens
aaauagauaaucaaaauguacauacagauuccacacauuuuuaa

SEQ ID NO: 134671 - RNA, 60 nt, Homo sapiens
ucuugggagacagcggggaguacaagaugauucuugugguucgaaaugacuuaaagaugg

SEQ ID NO: 134672 - RNA, 45 nt, Homo sapiens
gaauacuguggccagcccaaggugguggucaaagcuccugaugaa

SEQ ID NO: 134673 - RNA, 45 nt, Homo sapiens
gcugggacugacuguaaguuuaauucaagaugcuggacguacuca

SEQ ID NO: 134674 - RNA, 45 nt, Homo sapiens
uaugacagcacaggagaaaaauugcaacugugaaugaugccacaa

SEQ ID NO: 134675 - RNA, 44 nt, Homo sapiens
uaaaauaaauuacuggacuguggaaauaacauagaauugaaguu

SEQ ID NO: 134676 - RNA, 47 nt, Homo sapiens; identical to SEQ ID NO: 37186

SEQ ID NO: 134677 - RNA, 87 nt, Homo sapiens
cccuuauguugugcuguauccugugcuuuuucugugggaccauuccauucaggagcaaagagcaccaugauuccaaucuugugugug

SEQ ID NO: 134678 - RNA, 46 nt, Homo sapiens
gccaaaaaauggacauuucauaugguacuuauacuacauaauaguc

SEQ ID NO: 134679 - RNA, 49 nt, Homo sapiens
uuuggagcuugucuguuuaccuguuacgaucuuuuaaggccagaugucg

SEQ ID NO: 134680 - RNA, 26 nt, Homo sapiens
cuucugaaucuaaagauacugaauug

SEQ ID NO: 134681 - RNA, 46 nt, Homo sapiens
aucugugaaugaaucauugaacaaucuuuuuauuacagaagaagau

SEQ ID NO: 134682 - RNA, 46 nt, Homo sapiens
gauaaugccauaauuaccaugaugaaucauccaacugaugccugga

SEQ ID NO: 134683 - RNA, 56 nt, Homo sapiens
cucacaugggaauguuuacugaauuagcuauucuauacucuaaauuuaagccucag

SEQ ID NO: 134684 - RNA, 46 nt, Homo sapiens
ggcuauuuugaagagcugaucaccauguuggaagcagcacugggac

SEQ ID NO: 134685 - RNA, 42 nt, Homo sapiens
uggacuucauauuguuguacaugcagaugaauuagaagaacu

SEQ ID NO: 134686 - RNA, 46 nt, Homo sapiens; identical to SEQ ID NO: 37196

SEQ ID NO: 134687 - RNA, 45 nt, Homo sapiens
gacagaacugauauucgcacuggcuaaaacaaaccgccuugcaga

SEQ ID NO: 134688 - RNA, 45 nt, Homo sapiens
ugggaagaacuggugaaguacuugcagauggcccguaagaaggcu

SEQ ID NO: 134689 - RNA, 81 nt, Homo sapiens
uaauuaugaugccccagauauugccaauaucgccaucagcaaugagcuguuugaagaagcauuugccauuuuccggaaauu

SEQ ID NO: 134690 - RNA, 41 nt, Homo sapiens
gcugaccguacacguguuauggaguauauuaaccgccugga

SEQ ID NO: 134691 - RNA, 45 nt, Homo sapiens
acaaacagcuuugucugagacucaggacccugaagaagugucagu

SEQ ID NO: 134692 - RNA, 76 nt, Homo sapiens
ucucgcuaccugguacgucgaaaggauccagaauuguggggcagcgugcugcuggaaagcaauccuuacaggagac

SEQ ID NO: 134693 - RNA, 46 nt, Homo sapiens
cccggagagauuucuucgugaaaaucccuacuaugacagucgcguu

SEQ ID NO: 134694 - RNA, 47 nt, Homo sapiens
ggaagcaaaacuaacagaucagcuaccacuuaucauugugugugauc

SEQ ID NO: 134695 - RNA, 33 nt, Homo sapiens
gaguauuagaggcugguuguauagauuggaugu

SEQ ID NO: 134696 - RNA, 45 nt, Homo sapiens
uguggaauguaacaggacauguaucagguaaaugcccaguacagg

SEQ ID NO: 134697 - RNA, 51 nt, Homo sapiens
agagaaagcaacugcuacgauccugagcgagucaagaauuuucuuaaggua

SEQ ID NO: 134698 - RNA, 42 nt, Homo sapiens
ucauauugcucaacugugugaaaaggcuggccuacugcagcg

SEQ ID NO: 134699 - RNA, 48 nt, Homo sapiens
agguccuuuacagacgcgguuacuugagaugaaccuuaugcaugcgcc

SEQ ID NO: 134700 - RNA, 46 nt, Homo sapiens
gauacacuccagauuggauauuucugcugagaaauguaaugcgaau

SEQ ID NO: 134701 - RNA, 42 nt, Homo sapiens
ucuccucuacuucaguacuuugguauccuuuuggaccaggga

SEQ ID NO: 134702 - RNA, 77 nt, Homo sapiens
uacguaauaacuuagccggugcugaagaacucuuugcccggaaauuuaaugcucuuuuugcccagggaaauuacucg

SEQ ID NO: 134703 - RNA, 47 nt, Homo sapiens
uucuuuccuccagaagcacaaaaugauuuuccuguugcaaugcaggu

SEQ ID NO: 134704 - RNA, 47 nt, Homo sapiens
ucaacguuauuuuguuuugcaguucggggccaagcuggagggaaggu

SEQ ID NO: 134705 - RNA, 62 nt, Homo sapiens
ucagcccauugaaggacaugcagcuagcuuugcacaguuuaagauggaaggaaaugcagaag

SEQ ID NO: 134706 - RNA, 42 nt, Homo sapiens
ucuagccuugcagggugccagauuaucaauuaccguacagau

SEQ ID NO: 134707 - RNA, 50 nt, Homo sapiens
gauuauuggguucuagaaauggcuugaauuuacaguaauuguuuaaagug

SEQ ID NO: 134708 - RNA, 46 nt, Homo sapiens
agaccaauuucagcagacagcgccaucaugaauccagcuagcaaag

SEQ ID NO: 134709 - RNA, 46 nt, Homo sapiens
uacccugacuauggagucugacaaauucaucugcauuagagaaaaa

SEQ ID NO: 134710 - RNA, 52 nt, Homo sapiens
cauauuuuccucauugucccuaaauguuguuugguuuaaaucagaauccaag

SEQ ID NO: 134711 - RNA, 63 nt, Homo sapiens
aagcaaaccuauuacuccuuuaauuauguggcgucuguaggcacaaacagauagauuaugaau

SEQ ID NO: 134712 - RNA, 55 nt, Homo sapiens
agccccuuaaccccuuacaggcacucgaauauuaguucuuccccuccacccugga

SEQ ID NO: 134713 - RNA, 23 nt, Homo sapiens
uucuuaagugugaggggaaaacg

SEQ ID NO: 134714 - RNA, 26 nt, Homo sapiens
uuaaccccucuuugguucuggaaggu

SEQ ID NO: 134715 - RNA, 23 nt, Homo sapiens
ggaacgaggguagaaugggagaa

SEQ ID NO: 134716 - RNA, 45 nt, Homo sapiens
gugacaggaggagaccauaacccccgacagcgccauggcccagau

SEQ ID NO: 134717 - RNA, 43 nt, Homo sapiens
ccaguuuccugcguccccggagaggauccugcugagcccagcc

SEQ ID NO: 134718 - RNA, 45 nt, Homo sapiens
aauaaagcuauuccuggaaagagaagugcgguuguaaugggaaga

SEQ ID NO: 134719 - RNA, 45 nt, Homo sapiens
cugauccacaagcaggaggagauaauccagaaguucauggucaag

SEQ ID NO: 134720 - RNA, 22 nt, Homo sapiens
guguauuuagguaagguuuuug

SEQ ID NO: 134721 - RNA, 45 nt, Homo sapiens
agggcggagggagcgcggcuggcggaccggagccuccauggcggg

SEQ ID NO: 134722 - RNA, 43 nt, Homo sapiens
cgccaccgucuggugucuaaaccgccucggguaagggguuaca

SEQ ID NO: 134723 - RNA, 45 nt, Homo sapiens
aaagucugagaaaggaugcuagacuuguaugcacaacuuccuaac

SEQ ID NO: 134724 - RNA, 47 nt, Homo sapiens
gaugcuaauucugcuuuuaacagguuguuugcuucucaaauuggcug

SEQ ID NO: 134725 - RNA, 42 nt, Homo sapiens; identical to SEQ ID NO: 127444

SEQ ID NO: 134726 - RNA, 42 nt, Homo sapiens
ucuagagauugggggcuggugaaggggguuuggcuucaauga

SEQ ID NO: 134727 - RNA, 40 nt, Homo sapiens
acuccuuaauuuuagaugcuuggcauaaaaaacaagggau

SEQ ID NO: 134728 - RNA, 46 nt, Homo sapiens
gaauccaaagcuuuacacugccggucuucaguuuuuggcagaauau

SEQ ID NO: 134729 - RNA, 61 nt, Homo sapiens
uguugugguugcaguuuucaguggcuugccugcgguugagaaaaggaggaaaauggucacc

SEQ ID NO: 134730 - RNA, 67 nt, Homo sapiens
agggcuaaugcuaaaggaggucaucuggaaggacugcagaugacugauuuggaaaauaauucugaaa

SEQ ID NO: 134731 - RNA, 45 nt, Homo sapiens
aggaggcaccucgcagcucagucuagaaaggagucgcgucucugc

SEQ ID NO: 134732 - RNA, 45 nt, Homo sapiens
gggaccugguuguagggcccaugggggaccaaggucggggaaaga

SEQ ID NO: 134733 - RNA, 58 nt, Homo sapiens
ggugaacuuacguuggagccgaaagacacugggagucagaggcggguggggauccgcu

SEQ ID NO: 134734 - RNA, 48 nt, Homo sapiens
gaauagauaaaacggaauugggaacgagagaggaaggagugggagggu

SEQ ID NO: 134735 - RNA, 46 nt, Homo sapiens
ccagguguauaugcggugucagucacuggucgccugccccaaggua

SEQ ID NO: 134736 - RNA, 46 nt, Homo sapiens
aagaaucacaucaagcaacuuucuucauuaucagccugcugccgag

SEQ ID NO: 134737 - RNA, 46 nt, Homo sapiens
uguggaaauauacgaucgacaauguuuccccccacgcacagccgga

SEQ ID NO: 134738 - RNA, 41 nt, Homo sapiens
uggccggcacaaggaguaucucagcagccucguaggcaccg

SEQ ID NO: 134739 - RNA, 82 nt, Homo sapiens
agacaugcacaaauaauuaaaaaagaaaacucccugguuucuugaccucagccaucuaaagggaagagggcguucuggcuuc

SEQ ID NO: 134740 - RNA, 29 nt, Homo sapiens
gcccaccugccuuaucccauuaaauucuc

SEQ ID NO: 134741 - RNA, 46 nt, Homo sapiens
acaggagagggagguucguauucuucaugcaaguggcgcucaguaa

SEQ ID NO: 134742 - RNA, 47 nt, Homo sapiens
cuuaguggaggaggcaagacaugacacagggccuggagaauuuggag

SEQ ID NO: 134743 - RNA, 40 nt, Homo sapiens
gagaauaaaaugcaacaggggaguaacuguagguaaagcc

SEQ ID NO: 134744 - RNA, 51 nt, Homo sapiens
uuauuaaguauauaacaauaguaauuauuguuauaugugguagguacuguc

SEQ ID NO: 134745 - RNA, 60 nt, Homo sapiens
ggaaaggagcaguccugcagccugugcccuuagaacaggagcacgugcugccagucaucu

SEQ ID NO: 134746 - RNA, 45 nt, Homo sapiens
cuugaacagagcagaucuuuuuuuauuucuuaaggccuaccagca

SEQ ID NO: 134747 - RNA, 37 nt, Homo sapiens
acuaacuacacaauaaaauagggcacuuaagaacuaa

SEQ ID NO: 134748 - RNA, 848 nt, Homo sapiens
uccuccgacuucuucacugcauguuaacuggccagacucaguuuaaagcacuggcuuccaaaacggguugugccuucuuugguugucauucuuaauagauucgugaaguuauuuaauuuacuguagugauaagaaugauguaaaaaauacauguaaguuaugggaugagauacugccucaauuuaauagccccugcucuuaaagaaggcuggccacugcagcccaggccuaccccagugccccgccccugcccccuacguuugaggccucuggcugcagggcuguugagcuugagcucuaguuuuuagagagcugacguagccugagggucauucugauuggagauauccucccaccgcacacccacuccugggagcuccucccaguuccaacccagcuggcuuguucuuuccgucucuguccuggccaagccugagcuguggccauugucaggugcccaucuuccccuccauccagguucucgccugugugguuaacagccucuguuucccucaucuguaagaugagauaaccucauaaggcaauuuaaucauggaaaugcccucugcuucuacagugcuuggucccagggagcuccccugcaguuccuuagccacuauuggcuuuaaguccuggcaggaauugggugugacuuuggccaggucaccauacacccaggucuaagcuuuuccucuauaauccagcauugcuggagcaugaaaaggucuacggaagccuuccgacuaacuuagggaaugcucacagagccuggugugcagauuuagcuuuuaucuccagggaaccauugagggguuucaaacauuaaaacaugcuucuggugcagggag

SEQ ID NO: 134749 - RNA, 52 nt, Homo sapiens
cagggccccuguggcuuccugcacacuggacaggugacuguaugguagagac

SEQ ID NO: 134750 - RNA, 24 nt, Homo sapiens
caaagggaacucaagauucuucca

SEQ ID NO: 134751 - RNA, 44 nt, Homo sapiens
aacuucauuuaggucucuaaacacagacuuuuuaaauugcaacu

SEQ ID NO: 134752 - RNA, 66 nt, Homo sapiens
uuccccucuucuuccuucuaucuccuuccccggcaaaaaccaaacaaacuggcagacaggccaggg

SEQ ID NO: 134753 - RNA, 47 nt, Homo sapiens
uguccucuccagaaaguccuuucuuucuccauacuguaguccuauug

SEQ ID NO: 134754 - RNA, 46 nt, Homo sapiens
acgaugaccaguuuucaccggaagcagaugccgccaugagcgagau

SEQ ID NO: 134755 - RNA, 44 nt, Homo sapiens
agagucuuagccccggugguugagggcgugcuggucacugauac

SEQ ID NO: 134756 - RNA, 48 nt, Homo sapiens
ucaaugccgggcaccuguucgugcagcagcacacacacccuaccuucc

SEQ ID NO: 134757 - RNA, 45 nt, Homo sapiens
aaguucaaagagcugaaccucaccaauaucuacgcucccccauug

SEQ ID NO: 134758 - RNA, 21 nt, Homo sapiens
uggcagagguaucauuugaaa

SEQ ID NO: 134759 - RNA, 82 nt, Homo sapiens
gcgcuaugugaguuuucugaagcaaacaucuggugccaagaucuacauuucaacccugccuuacacccagagcguccagauc

SEQ ID NO: 134760 - RNA, 44 nt, Homo sapiens
ggcaggcuccaacccuaagaaggucgaccucaucaucugggaga

SEQ ID NO: 134761 - RNA, 41 nt, Homo sapiens
uggggugcugaagggggaguugucagacuugggggcugagg

SEQ ID NO: 134762 - RNA, 46 nt, Homo sapiens
uggaagaugccaccugugucaccugcaugucagacagcagccaaag

SEQ ID NO: 134763 - RNA, 69 nt, Homo sapiens
acagcagaggcagcuguugccccgccggaugcuggccuccccuugccaggccuaccagcagagggcuca

SEQ ID NO: 134764 - RNA, 174 nt, Homo sapiens
cgccagcacccccagucgcagacgccaaagcccaggauagaggugucgagggagaacugggcaaugaggagagcuuggauagaaaugaggagggcuuggauagaaaugaggagggcuuggauagaaaugaggagagcuuggauagaaaugaggagggcuuggauagaaaugagg

SEQ ID NO: 134765 - RNA, 53 nt, Homo sapiens
ggaagaagauaaggggaagagcagcucaucccaggugguggggccagugcagg

SEQ ID NO: 134766 - RNA, 123 nt, Homo sapiens
gagaagcguagcucuggggagagggcaagagagacagguggggccgaagggacuggugaugccguguugggggaaaaggugcuugaagaagcucuguugucucgggagcaugucuuggaauug

SEQ ID NO: 134767 - RNA, 62 nt, Homo sapiens
ugcccccuuucauccccaaaggguguacuauucuccagcaaaucagcugagguguguaagca

SEQ ID NO: 134768 - RNA, 45 nt, Homo sapiens
caccacagacaugagauugcgaccaggaacacgcagagaugacag

SEQ ID NO: 134769 - RNA, 46 nt, Homo sapiens
ucucagcugcuuguggcgcaggggugugugugugagugagugagag

SEQ ID NO: 134770 - RNA, 48 nt, Homo sapiens
agcaccugguaguggauucaggguuuucauuuuggccguagaaggcuu

SEQ ID NO: 134771 - RNA, 389 nt, Homo sapiens
gguaccagggaguggugaaaaugggucccccccaacuuuuuuuuuuuuuuuuuuuuuuuaaagacaggucucacugucccccaggcuggagugcaguaaugccaucauagcucacugcagccuugauuuccugggcucaagugauccucccaccucagccugcucaguagcugggacaagaggcauguacuacuaugcccgacuaauucuuuuaaauuuuuuuuuguagagaugaggucucaccacauugcccaggcuagucucgaacuccugggcucaaguaaucuuccaacuucccaaaguguugggauuacaggugugagccaucgugccuggcugaagaugggucuugaaugaaagucuauauauugaauggggcaucccaacuc

SEQ ID NO: 134772 - RNA, 47 nt, Homo sapiens
uggagagcaagguuguuuuuugcaaagucugauucaaagaaguggca

SEQ ID NO: 134773 - RNA, 61 nt, Homo sapiens
gugagggagauauucccuauuacagaacaucuucauuuuaugggaaacugaaguacaggau

SEQ ID NO: 134774 - RNA, 83 nt, Homo sapiens
gaccugggcuggggcgugcuccccaccuccuccucugccccugccgccccccaugcucauugguuguugcuuauuuacugccc

SEQ ID NO: 134775 - RNA, 48 nt, Homo sapiens
gcccaguugcacuugggagcaaagaagggcccugaggugaguccugga

SEQ ID NO: 134776 - RNA, 70 nt, Homo sapiens
cauucuguccgggucuucaccaucugguuguuuuuccggcuugguuugauaguuugcagcagucaguggu

SEQ ID NO: 134777 - RNA, 30 nt, Homo sapiens
auggagaucauauuugugauacuggggacu

SEQ ID NO: 134778 - RNA, 41 nt, Homo sapiens
ggacuucgcuccaggugcgagucgaggccucucaagcuggg

SEQ ID NO: 134779 - RNA, 46 nt, Homo sapiens
gccccagaacugaagccgaagcgcuggcggaugagacuaaugagau

SEQ ID NO: 134780 - RNA, 46 nt, Homo sapiens
ugucucucacaaggcgcgcgcucucggcggggggcaagagcccccc

SEQ ID NO: 134781 - RNA, 46 nt, Homo sapiens
ugcugacagucugaucugugacagcuuuugguuccagauccaagac

SEQ ID NO: 134782 - RNA, 45 nt, Homo sapiens
guaaggaugaaagaauuucuauaucuacuugcugggucucuggau

SEQ ID NO: 134783 - RNA, 46 nt, Homo sapiens
ucgagagcacuggaugaugugagaaacaggcagcaggaugugcggg

SEQ ID NO: 134784 - RNA, 105 nt, Homo sapiens
cucucagaugacugcaaacagaaagguggagcagcuacaacaagaauacacggaaaugaaggcucucuuggacgccucagagaccaccucgacaaggaagauaaa

SEQ ID NO: 134785 - RNA, 46 nt, Homo sapiens
gagggucaacagcaaguuugacaccauuuaucagauucuccucaag

SEQ ID NO: 134786 - RNA, 34 nt, Homo sapiens
aaacgagcugaagcagugcaucgggcggcuccag

SEQ ID NO: 134787 - RNA, 23 nt, Homo sapiens
guuucucacuguuacccuccucc

SEQ ID NO: 134788 - RNA, 52 nt, Homo sapiens
uuccuaauuacaacccaugaaauuuuaauaccacccaucuacugcauaacug

SEQ ID NO: 134789 - RNA, 59 nt, Homo sapiens
uuuuuuccuuuauggaaauauaauuuaccugcaguaaaucucuuuuuucccugcaguaa

SEQ ID NO: 134790 - RNA, 45 nt, Homo sapiens
gauggguauauggauacauggguagauggauagauggauggaugg

SEQ ID NO: 134791 - RNA, 43 nt, Homo sapiens
cccauuguucuggaaaucuccaggcugcugggcagcugggcag

SEQ ID NO: 134792 - RNA, 34 nt, Homo sapiens
ucucugggguagccuucagaucuugguguuuuga

SEQ ID NO: 134793 - RNA, 40 nt, Homo sapiens
agugaggccacuucccuggcaaaugugcagcucaggauag

SEQ ID NO: 134794 - RNA, 75 nt, Homo sapiens
ccagcacacuuaguccugcccuauauagaguuccucuucgggaagcuuuugauaaggaauucucagaccgauagg

SEQ ID NO: 134795 - RNA, 46 nt, Homo sapiens
uucucuuugcauuuaggcaaaaaauaagaugaagcagaugcauaug

SEQ ID NO: 134796 - RNA, 58 nt, Homo sapiens
auauuugauguuuagaagcuauuucaguauaaaccucggucuaagaacugcacaaagg

SEQ ID NO: 134797 - RNA, 35 nt, Homo sapiens
auugucuuuauuuuaaaaccuuggccaaugccagg

SEQ ID NO: 134798 - RNA, 47 nt, Homo sapiens
gcaaaucauauugaugauuuucuuacaucucuauaaaaugaucuauc

SEQ ID NO: 134799 - RNA, 40 nt, Homo sapiens
gauacuuuacaacucugcaguguggagaggauuuccaacc

SEQ ID NO: 134800 - RNA, 45 nt, Homo sapiens
cacuaaauuuuauuauuucguauuuguacaauaagcuucccagga

SEQ ID NO: 134801 - RNA, 45 nt, Homo sapiens
uacguggaugauaauaaugaaaauggaugugaguuggauaaggag

SEQ ID NO: 134802 - RNA, 41 nt, Homo sapiens
aaauguaucguacaaguuaaaaugcacgggcccaaggggga

SEQ ID NO: 134803 - RNA, 44 nt, Homo sapiens
gcuggucuggcagaguaguuaauuagacaaaaagacauuuuaag

SEQ ID NO: 134804 - RNA, 45 nt, Homo sapiens
cucccuuugugccuuaugggcuucuccggugcacagguagcuuca

SEQ ID NO: 134805 - RNA, 42 nt, Homo sapiens
cagugccuggacaaaugaugccauggcagacaguagacagaa

SEQ ID NO: 134806 - RNA, 57 nt, Homo sapiens
uggggcaagaggggcuggaggggauggacaggcaggccccagcagccccaggguuua

SEQ ID NO: 134807 - RNA, 34 nt, Homo sapiens
gguuggggggguggggauccaggccaggagaaga

SEQ ID NO: 134808 - RNA, 46 nt, Homo sapiens
ccccucuccggaucgcccggggccccggcuggccagaggauggacg

SEQ ID NO: 134809 - RNA, 72 nt, Homo sapiens
gaggaguuucccaguuuucaaagcaguaugaccaagugaucucagauaauccaaucuacacaacccccuuug

SEQ ID NO: 134810 - RNA, 44 nt, Homo sapiens
cagggguuauugguaagggcgagggucuccaggcugucgaaggg

SEQ ID NO: 134811 - RNA, 360 nt, Homo sapiens
uuucgguuccugaccaagauguggcacccuaacaucuacgaggugagcgcggcccccacgggccucaaguccucauccuccgggacccagggugcugggagccucacguccucauccuuccgggacccggggcgcugggagccucacguccucguccuccgggacccggggcgcugggagccucacguccucguccuuccgggacccgaggcgcugggagccucauguccucguccuuccgggacccggggcgcugggagccucacguccucguccuccacguccucauccuccgggaccuggggcacugggagcccgugcugaccucugaccuguucugaccugucuucuucuugugca

SEQ ID NO: 134812 - RNA, 714 nt, Homo sapiens
cagaacgucagguaagccggcccaacccccuguguccacccagaacaucagguaggccgggcuccgucccguauccacccagaccaucagguaggccgggcucccccacaggcuguggcgccaaggccugauucgggaccugccagcuggcgguccugggccucgcuguaccugcacgguaggugcuuucacggggccugcggcaccgugugucggugcagacucccaccaggaccccaggccggccccaccgucuggaaccaccuagaggugucccgccauccucaguccuggggccuucuccuuacccagccgucucuggguuggucaccucgugccacgugugccgccugggccucguccccagguacaagcacugggccguguugcccguguguccuggaguguagucuaggcaggacgugcgggugugagggcagccccgggucugacggaggggucugcaccuugcugcccucccuggucuuggcgugggagggaggagacugaugcagguccagccccugcuguucugggggccugagacagaagcagaggccaugaggccaggugaaggucaccugcuggguggguccaggcguccccgugacccucagggccagagaagagccggaaggcuggggugccccgggccgccccacuccgacccacucuccccacaggaccauucuccugagugugaucucccuccug

SEQ ID NO: 134813 - RNA, 42 nt, Homo sapiens
guuugcgggcgagaagguguugggcucguucaggagggagau

SEQ ID NO: 134814 - RNA, 47 nt, Homo sapiens
ccugacaccaccagaauaaacuugccgaguuuaccucacuagggccg

SEQ ID NO: 134815 - RNA, 58 nt, Homo sapiens
uagcguccgcucaugcguggccucacacuccgcgugccuccugcuccgaccccgagga

SEQ ID NO: 134816 - RNA, 57 nt, Homo sapiens
agcaggaggcacgcggagugugaggccacgcaugagcggacgcuaacccccucccca

SEQ ID NO: 134817 - RNA, 44 nt, Homo sapiens
uccugcuccucuuagcggccaccgcccuccugacgcacggccaa

SEQ ID NO: 134818 - RNA, 68 nt, Homo sapiens
acugucuucgucuuggcccucgacuuggccuuccucuuggccgugcgucaggagggcgguggccgcua

SEQ ID NO: 134819 - RNA, 85 nt, Homo sapiens
aucacgucaucgcacaacaccuugccguugucgcagacgcagauccggcagggcucggguuuccacacgucucggucaugguacc

SEQ ID NO: 134820 - RNA, 116 nt, Homo sapiens
ccggaucugcgucugcgacaacggcaagguguugugcgaugacgugaucugugacgagaccaagaacugccccggcgccgaaguccccgagggcgagugcugucccgucugccccg

SEQ ID NO: 134821 - RNA, 25 nt, Homo sapiens
agaagggaggacugugaggagucac

SEQ ID NO: 134822 - RNA, 82 nt, Homo sapiens
ccccccuggccgagauggcaucccuggacagccuggacuucccggaccccccggaccccccggaccucccggacccccuggc

SEQ ID NO: 134823 - RNA, 59 nt, Homo sapiens
cuccccagcugucuuauggcuaugaugagaaaucaaccggaggaauuuccgugccuggc

SEQ ID NO: 134824 - RNA, 59 nt, Homo sapiens
ucuagggucccauggguccccgaggucccccaggucccccuggaaagaauggagaugau

SEQ ID NO: 134825 - RNA, 41 nt, Homo sapiens
gguuuggauggugccaagggagaugcugguccugcuggucc

SEQ ID NO: 134826 - RNA, 46 nt, Homo sapiens
uacagggugagccuggcagcccuggugaaaauggagcuccugguca

SEQ ID NO: 134827 - RNA, 41 nt, Homo sapiens
agggcccuguugguguucaaggacccccuggcccugcugga

SEQ ID NO: 134828 - RNA, 47 nt, Homo sapiens
gguccagggaaucccaucacaccagccugaccacgggcaccaggugg

SEQ ID NO: 134829 - RNA, 41 nt, Homo sapiens
cuggugugaugggauucccuggaccuaaaggugcugcugug

SEQ ID NO: 134830 - RNA, 45 nt, Homo sapiens
ggcucucccuguggagaaagggaguuaggguugagggggcugaag

SEQ ID NO: 134831 - RNA, 46 nt, Homo sapiens
ccagggggucccugagcuccagccucuccaucuuugccagcaggac

SEQ ID NO: 134832 - RNA, 38 nt, Homo sapiens
aagaagucacccagacuagcaaucaugcagcccccacu

SEQ ID NO: 134833 - RNA, 42 nt, Homo sapiens
gagcguggugugcaaggucccccugguccugcugguccccga

SEQ ID NO: 134834 - RNA, 71 nt, Homo sapiens
gcaaagguccccguggugagacuggcccugcuggacguccuggugaaguuggucccccuggucccccuggc

SEQ ID NO: 134835 - RNA, 47 nt, Homo sapiens
agguauugcuggacagcgugguguggucggccugccuggucagagag

SEQ ID NO: 134836 - RNA, 26 nt, Homo sapiens
aucacaggacuuggaguggggcggag

SEQ ID NO: 134837 - RNA, 46 nt, Homo sapiens
cuggcaaacaaggucccucuggagcaaguggugaacgugguccccc

SEQ ID NO: 134838 - RNA, 43 nt, Homo sapiens
uggugcuccuggugccccuggccccguuggcccugcuggcaag

SEQ ID NO: 134839 - RNA, 57 nt, Homo sapiens
ccccaaggcccccguggugacaagggugagacaggcgaacagggcgacagaggcaua

SEQ ID NO: 134840 - RNA, 61 nt, Homo sapiens
cuugagguggcuggggcaggaagcugaagucgaaaccagcgcugggaggaccagggggacc

SEQ ID NO: 134841 - RNA, 62 nt, Homo sapiens
ugaccucgagguggacaccacccucaagagccugagccagcagaucgagaacauccggagcc

SEQ ID NO: 134842 - RNA, 48 nt, Homo sapiens
agaguggcacaucuugaggucacggcaggugcgggcgggguucuugcg

SEQ ID NO: 134843 - RNA, 61 nt, Homo sapiens
cagagggcagccgcaagaaccccgcccgcaccugccgugaccucaagaugugccacucuga

SEQ ID NO: 134844 - RNA, 63 nt, Homo sapiens
uacuggauugaccccaaccaaggcugcaaccuggaugccaucaaagucuucugcaacauggag

SEQ ID NO: 134845 - RNA, 76 nt, Homo sapiens
ggucaugcucucgccgaaccagacaugccucuuguccuugggguucuugcugauguaccaguucuucugggccaca

SEQ ID NO: 134846 - RNA, 45 nt, Homo sapiens
cccaguguggcccagaagaacugguacaucagcaagaaccccaag

SEQ ID NO: 134847 - RNA, 47 nt, Homo sapiens
uggacaucaggcgcaggaaggucagcuggauggccacaucggcaggg

SEQ ID NO: 134848 - RNA, 51 nt, Homo sapiens
cgccugauguccaccgaggccucccagaacaucaccuaccacugcaagaac

SEQ ID NO: 134849 - RNA, 45 nt, Homo sapiens
acuggcaaccucaagaaggcccugcuccuccagggcuccaacgag

SEQ ID NO: 134850 - RNA, 25 nt, Homo sapiens
cgaucucguuggagcccuggaggag

SEQ ID NO: 134851 - RNA, 49 nt, Homo sapiens
ggcgggaggucuuggugguuuuguauucaaucacugucuugccccaggc

SEQ ID NO: 134852 - RNA, 56 nt, Homo sapiens
ccaucaucgauguggcccccuuggacguuggugccccagaccaggaauucggcuuc

SEQ ID NO: 134853 - RNA, 99 nt, Homo sapiens
uuccuguaaacucccuccaucccaaccuggcucccucccacccaaccaacuuuccccccaacccggaaacagacaagcaacccaaacugaacccccuca

SEQ ID NO: 134854 - RNA, 54 nt, Homo sapiens
ucaucucucaaacuuaguuuuuaucuuugaccaaccgaacaugaccaaaaacca

SEQ ID NO: 134855 - RNA, 82 nt, Homo sapiens
cuugcuugaagacccaugcggggguaagucccuuucugcccguugggcuuaugaaaccccaaugcugcccuuucugcuccuu

SEQ ID NO: 134856 - RNA, 65 nt, Homo sapiens
ccccaagggggguguggagaaaggagcagaaagggcagcauugggguuucauaagcccaacgggc

SEQ ID NO: 134857 - RNA, 59 nt, Homo sapiens
ucuccacaccccccuuggggccuccccuccacuccuucccaaaucugucuccccagaag

SEQ ID NO: 134858 - RNA, 50 nt, Homo sapiens
guuuccugugucuucuggggagacagauuugggaaggaguggaggggagg

SEQ ID NO: 134859 - RNA, 46 nt, Homo sapiens
agccaugggagcgccagauggcaaggcuucuuuggcagucugagaa

SEQ ID NO: 134860 - RNA, 46 nt, Homo sapiens
agccuugccaucuggcgcucccauggcucuugcaacaucuccccuu

SEQ ID NO: 134861 - RNA, 45 nt, Homo sapiens
ugccugggggcggggaugggggcaggguggaagcggcuccccauu

SEQ ID NO: 134862 - RNA, 35 nt, Homo sapiens
gacuugugaauuuuucuaaaggugcuauuuaacau

SEQ ID NO: 134863 - RNA, 46 nt, Homo sapiens
ggaggaggguuucagaggagagaggucggagagcagaggccugaga

SEQ ID NO: 134864 - RNA, 48 nt, Homo sapiens
ccgaccucucuccucugaaacccuccuccacagcugcagcccauccuc

SEQ ID NO: 134865 - RNA, 46 nt, Homo sapiens; identical to SEQ ID NO: 37429

SEQ ID NO: 134866 - RNA, 43 nt, Homo sapiens
cccagcuaacagagggcacuucuugccggaagggagagcgcac

SEQ ID NO: 134867 - RNA, 42 nt, Homo sapiens
gagaagccgggcgcccaggagacaaagagcgggagggagcga

SEQ ID NO: 134868 - RNA, 45 nt, Homo sapiens
aggagaccugacgggaggaugcuccgugugugugugcgugugcgu

SEQ ID NO: 134869 - RNA, 44 nt, Homo sapiens
aucccgggggugggggugaggucggcgggaagggucccagagcc

SEQ ID NO: 134870 - RNA, 46 nt, Homo sapiens
gguggcuaguuucucuccaaaccaucagcacaacuccccgccgggc

SEQ ID NO: 134871 - RNA, 40 nt, Homo sapiens
ccccgaccgcuagucuccuuucccauccaccucuucccgg

SEQ ID NO: 134872 - RNA, 90 nt, Homo sapiens
ccacccuugugcaguuaccuggcugaaugggggugugugugugugugugugugugugugugugagagagugugcggggugugugugggag

SEQ ID NO: 134873 - RNA, 36 nt, Homo sapiens
uuuuuuuuguuuugguucaagguuuuuuggugggaa

SEQ ID NO: 134874 - RNA, 48 nt, Homo sapiens
uccugaacagcucuuguucagaaaggcagguggugagggcaccaguga

SEQ ID NO: 134875 - RNA, 28 nt, Homo sapiens
gugcagccuugggcuuggagcaucuggg

SEQ ID NO: 134876 - RNA, 55 nt, Homo sapiens
aguuaagccaggagagcaacugggguggcuuagggguugucuacagaacgaaaca

SEQ ID NO: 134877 - RNA, 42 nt, Homo sapiens
ucuuaucgaggccgaugguggggcuggcgggcucaggaggac

SEQ ID NO: 134878 - RNA, 42 nt, Homo sapiens
agccaucuggaggacauggggcuagaaccaagccagguuagu

SEQ ID NO: 134879 - RNA, 45 nt, Homo sapiens
uccacucugagugaugacuccacgccccccagcagcagccccaag

SEQ ID NO: 134880 - RNA, 49 nt, Homo sapiens
acaggaacugauagggacagaggacaccacuuccaccagccaaggccua

SEQ ID NO: 134881 - RNA, 31 nt, Homo sapiens
ucugcuaucugugcugggagaggggcuucgg

SEQ ID NO: 134882 - RNA, 46 nt, Homo sapiens
ccugcugaaaugcccacgaaaucaccucgauucggagguuuccuaa

SEQ ID NO: 134883 - RNA, 61 nt, Homo sapiens
gcaaugagaaggacccacggaaguugcgggaaagcggagggaagcagccaccgagaggcag

SEQ ID NO: 134884 - RNA, 44 nt, Homo sapiens
cugaaaaucuaaagagauucuaaaaugaaacuuuuuuaaagggc

SEQ ID NO: 134885 - RNA, 48 nt, Homo sapiens
uacacgugcuaacgcagaaccuucccaccgaaguugaaccucgcaggc

SEQ ID NO: 134886 - RNA, 43 nt, Homo sapiens
uucucuggucuucuauuuuugguguuguucaagugaaggaaga

SEQ ID NO: 134887 - RNA, 46 nt, Homo sapiens
accccucccaagggcacuuaaagugaccugucauuccgagccagcg

SEQ ID NO: 134888 - RNA, 46 nt, Homo sapiens
cuguggacauugucagcacucugcaagcccuucagaugcucaaaua

SEQ ID NO: 134889 - RNA, 47 nt, Homo sapiens
uucucaaauccagaguugccaacacuuuaauucuuauaaaagucaag

SEQ ID NO: 134890 - RNA, 46 nt, Homo sapiens
aagaaguacuucuccgcuaccugcauaauuuucaaggcaaagagau

SEQ ID NO: 134891 - RNA, 45 nt, Homo sapiens
ugccaaaaccugugccuguuggccaaacuuuuucuggaccacaag

SEQ ID NO: 134892 - RNA, 45 nt, Homo sapiens
gaugagauauaucgcaaagguucaaucucuguguuugaaguggau

SEQ ID NO: 134893 - RNA, 45 nt, Homo sapiens
augaaugaaggaaucaugcuaucuacaguaguaguaauaguagua

SEQ ID NO: 134894 - RNA, 46 nt, Homo sapiens
agcagauagaagaaaggaugcugucucacaggcaagaugacaacaa

SEQ ID NO: 134895 - RNA, 86 nt, Homo sapiens
caauucuaagacuagguuggauucaggauacguuuuagaggggagcaacccguuaggcuugcugauugauuugaugugagguguga

SEQ ID NO: 134896 - RNA, 34 nt, Homo sapiens
uguggaccuuggcacaggaguauauuuuuguucu

SEQ ID NO: 134897 - RNA, 45 nt, Homo sapiens
uggcauuugaucugggacgugaaugauggcaaagaagcaguugug

SEQ ID NO: 134898 - RNA, 56 nt, Homo sapiens
aauaaguaaauaauuuuguguagugauaaauauugugaggaaaaaaagacgaauga

SEQ ID NO: 134899 - RNA, 50 nt, Homo sapiens
cuagugcauugauauuuucuguugaaaauuggcuucgaagacugcuaggg

SEQ ID NO: 134900 - RNA, 52 nt, Homo sapiens
aagaaaagaaugaguguaaguuauagcccuaccagccuuauguuugguggau

SEQ ID NO: 134901 - RNA, 47 nt, Homo sapiens
aaugcgccuucuucugagucugacauagacaucuccagccccaaugu

SEQ ID NO: 134902 - RNA, 27 nt, Homo sapiens
uuuccaucuaguuuugauuauccauga

SEQ ID NO: 134903 - RNA, 46 nt, Homo sapiens
cgaucugcucgagucacccgcuccucagccaggcuaagccagaguu

SEQ ID NO: 134904 - RNA, 45 nt, Homo sapiens
cucauuuccuggcagguuacccuuaagauacuuggaaaacugggu

SEQ ID NO: 134905 - RNA, 103 nt, Homo sapiens
cgcaagccacucaggcaguggcagauccagaauauagaacaaaucuaacucaauucaacaaaugucuauugacuacuuucugcgcggugguugcuguggauuc

SEQ ID NO: 134906 - RNA, 50 nt, Homo sapiens
cucguuaccuuccaggugaggggcacaacaaagcagaagacuggguggug

SEQ ID NO: 134907 - RNA, 42 nt, Homo sapiens
accuuguucagcuacccucucuucuguccauacccaacagaa

SEQ ID NO: 134908 - RNA, 42 nt, Homo sapiens
gcugcagcuggaaggggaucguggcccugagcggcugcagcc

SEQ ID NO: 134909 - RNA, 85 nt, Homo sapiens
ugccguggaaggagccauugggggagggggggcgcgugaccgcgggagggggacggggagaagugugaggggaaaguggaugggg

SEQ ID NO: 134910 - RNA, 46 nt, Homo sapiens
aacuuuggucuucauucaaugugugaucaaugcuguguuugccaag

SEQ ID NO: 134911 - RNA, 39 nt, Homo sapiens
acauuuuuuucuuucccuuugaguuucuuuuguguguca

SEQ ID NO: 134912 - RNA, 42 nt, Homo sapiens
ugccaggguggaucguacccggagcuggcucuaugcugccug

SEQ ID NO: 134913 - RNA, 33 nt, Homo sapiens
ucauuugaaaaggacuaagaguucuucccucag

SEQ ID NO: 134914 - RNA, 44 nt, Homo sapiens
cuguuaauuguggcuggaguggcccuuuucauguacaaacccaa

SEQ ID NO: 134915 - RNA, 52 nt, Homo sapiens
uugucaugggaagacacucaguaguaaaacacagggagguaccugggaacuu

SEQ ID NO: 134916 - RNA, 76 nt, Homo sapiens
uuuaacaagacagaguggugguuuuuguucuucaugcccuggagcagucuaugguaaauaaaagagggagggaaga

SEQ ID NO: 134917 - RNA, 36 nt, Homo sapiens
accuugcaacacacagacacacgcacacacacacac

SEQ ID NO: 134918 - RNA, 43 nt, Homo sapiens
agaggccaugauucgcccaaagccagacagcaacggggaggcc

SEQ ID NO: 134919 - RNA, 47 nt, Homo sapiens
ccucaacccucccucagccccucuugccccccaccccagccuaagau

SEQ ID NO: 134920 - RNA, 59 nt, Homo sapiens
guacuagggggaagugacaaggccccagagacucagagggaggaaucgaggaaccagag

SEQ ID NO: 134921 - RNA, 54 nt, Homo sapiens
cagagagagaagugccccugcugccuccccaacccugccccugccccgucacca

SEQ ID NO: 134922 - RNA, 90 nt, Homo sapiens
ccccgccccgccccacauuccgacaaccgaugcuccagccaaccccuguggagcccgcacccccacccuuuggggggggcccgccuggca

SEQ ID NO: 134923 - RNA, 31 nt, Homo sapiens
ggagcuuucaggguaggugggggcagaugug

SEQ ID NO: 134924 - RNA, 46 nt, Homo sapiens
cgugcccaccuuagccaagcacaggccccaaggagauggggugguu

SEQ ID NO: 134925 - RNA, 27 nt, Homo sapiens
gcaauccuaugaugcagguacugucau

SEQ ID NO: 134926 - RNA, 63 nt, Homo sapiens
ucaauucaucuaaggauccuuccaccuuaguuccuuguaagccuugaaauggccaaaacaaaa

SEQ ID NO: 134927 - RNA, 109 nt, Homo sapiens
gggaggagggaccggaucccagaggggcaacgacuugggcuccgggucugggcaagagcgaggguccccgcgcgaagacccaaggaaggaggggagcugggcguggagg

SEQ ID NO: 134928 - RNA, 42 nt, Homo sapiens
ggggcgucggagggagagguuggggagcgggagagagguuga

SEQ ID NO: 134929 - RNA, 54 nt, Homo sapiens
uuuccccucagcaucucggucucuggagagucgugggacagaaccaaggcgaga

SEQ ID NO: 134930 - RNA, 42 nt, Homo sapiens
gccaggccaaacuugccaauggacucaaacacuuuggcagcc

SEQ ID NO: 134931 - RNA, 53 nt, Homo sapiens
uguggccucucuaagccuuagccaaccugagcuuauuucccugucuaugagaa

SEQ ID NO: 134932 - RNA, 46 nt, Homo sapiens
auuugcuacaauuuauaagcaaaucugcugauuauaagaucccaga

SEQ ID NO: 134933 - RNA, 23 nt, Homo sapiens
aagggccagcugagggcagcaaa

SEQ ID NO: 134934 - RNA, 59 nt, Homo sapiens
gcuccuguauauuacucugucacucucaguacagugaccucauguagcaaauggcaccg

SEQ ID NO: 134935 - RNA, 57 nt, Homo sapiens
cugauuaucccggaagaagggaugacagaugaugaauuuccaggccacccagcaaau

SEQ ID NO: 134936 - RNA, 46 nt, Homo sapiens
aauacuccaggagaaacauuuuuauuuguaagagaguguuuuugau

SEQ ID NO: 134937 - RNA, 45 nt, Homo sapiens
aggagcacggacugccccgcuggcagguaggugauguuccgagag

SEQ ID NO: 134938 - RNA, 46 nt, Homo sapiens
ucagccgcacaugcccucauccgcaaaccuuccaucagugacagga

SEQ ID NO: 134939 - RNA, 42 nt, Homo sapiens
ccagcaggaugcaauccuucaaguuggaauuccacuggguau

SEQ ID NO: 134940 - RNA, 45 nt, Homo sapiens
gguugaauggaucuguguguaugagcaaucccagccucaaaaaua

SEQ ID NO: 134941 - RNA, 46 nt, Homo sapiens
uggggugggguggggagaacgggugcucaggggagaggugggagag

SEQ ID NO: 134942 - RNA, 44 nt, Homo sapiens
ucagugcgcacgcgcgagagucgggcagaaaaauaaauguguug

SEQ ID NO: 134943 - RNA, 374 nt, Homo sapiens
gaaggaaucuuaaaagcaggcaggcaggccagacgcuguagcucacgccuguaaucccagcacuuugggaggcugaggcagguggaucacgaggucaggaguucaagaccagccuggccaagauggugaaacccugucucuauucaaaauacaaaaauuagccgggcaugguggcaggugccuguaaucccagcuacuugggagguugaggcaggagaauaacuugaaccugggaggcggagguugcagugagcagagaucacagaacugcacuccagccugggugacagagugagacuccgucucaaaaaacaaaacaaaacaaaacaaacaaacacacacaaaacacaaaaaacaggaaggcuuccugaagg

SEQ ID NO: 134944 - RNA, 37 nt, Homo sapiens
aggaagacuuugaaagggcccagagguaucuucugga

SEQ ID NO: 134945 - RNA, 41 nt, Homo sapiens
aggcccuagguucgggucucggaacuuuguuuggggugcag

SEQ ID NO: 134946 - RNA, 45 nt, Homo sapiens
ugcccaggccaaacaugcauaugaugcaaccccacccuacauuua

SEQ ID NO: 134947 - RNA, 50 nt, Homo sapiens
caauggauagggugaccauauaauuuauuauccaaacaggagcauuuuug

SEQ ID NO: 134948 - RNA, 32 nt, Homo sapiens
uuuuauuacaaccuugaaaaguagacacagag

SEQ ID NO: 134949 - RNA, 48 nt, Homo sapiens
guagccuguguuucuggaagaggcguaagaguggacagcuuugggaca

SEQ ID NO: 134950 - RNA, 48 nt, Homo sapiens
guggggccugcgggcagcaucuagcaagguugggguggggaaggggaa

SEQ ID NO: 134951 - RNA, 54 nt, Homo sapiens
gggggaggguggccggaauggagacggagggcucacgggagguugucgaggggc

SEQ ID NO: 134952 - RNA, 32 nt, Homo sapiens
guggcagaugucagcucccaugauggcgucuc

SEQ ID NO: 134953 - RNA, 36 nt, Homo sapiens
gugaggaaauacccaggccgaaggccaggagggggg

SEQ ID NO: 134954 - RNA, 48 nt, Homo sapiens
uuuagggaacacauucuuccccaacccuccccgcacacucccaaacag

SEQ ID NO: 134955 - RNA, 46 nt, Homo sapiens
uggcuguuuguggcucuaagugcagacccauauucguggugugugg

SEQ ID NO: 134956 - RNA, 44 nt, Homo sapiens
accggcggaugaaaaugaagaaaaugaauaaggagcagggcaaa

SEQ ID NO: 134957 - RNA, 42 nt, Homo sapiens
aguacaagaaaaggcagcacgugguuuuaugaagcuaucuua

SEQ ID NO: 134958 - RNA, 44 nt, Homo sapiens
gaggggagagaggauugggaggggaaaugaggacgcagcgagag

SEQ ID NO: 134959 - RNA, 19 nt, Homo sapiens
uugcagagccgguggggag

SEQ ID NO: 134960 - RNA, 41 nt, Homo sapiens
ccaggggcgcugggggugagggaggcggcugagccugauug

SEQ ID NO: 134961 - RNA, 46 nt, Homo sapiens
gccaaccuccacccuuccuuucucuccccacccucccaacccccuu

SEQ ID NO: 134962 - RNA, 46 nt, Homo sapiens
uuuucccuuccacucaaucucuuccuccccaaaucucgccugcaag

SEQ ID NO: 134963 - RNA, 49 nt, Homo sapiens
gcugccgacucccgcgggcuggaggccgcuugcaggcgagauuugggga

SEQ ID NO: 134964 - RNA, 45 nt, Homo sapiens
cuaauuguccugaugggaauaaugggggagcgggguuggcuggag

SEQ ID NO: 134965 - RNA, 41 nt, Homo sapiens
gugcugaugucagcccuccugggaaggagacaagggaggag

SEQ ID NO: 134966 - RNA, 89 nt, Homo sapiens
cggaaagacagaucaagauuugguuucagaaccggcgcaugaaguggaaaaaggagaacaagaccgcgggcccggggaccaccggccaa

SEQ ID NO: 134967 - RNA, 88 nt, Homo sapiens
gaaucaggaaacucaaaucgaauagggaaguaaaaaaacaaaacaaaaaacaaaaaaaacaaaaaaaaaacccuauuuaaaugaaagg

SEQ ID NO: 134968 - RNA, 46 nt, Homo sapiens
guacuucaguaucagcucgauagagcaaaagagagagaggacgaga

SEQ ID NO: 134969 - RNA, 47 nt, Homo sapiens
gcaaggacuuaaaaaugggguaagggagcuucuggggaagcuuccag

SEQ ID NO: 134970 - RNA, 44 nt, Homo sapiens
ugggcgccggccgggggucucucgcuguguccccuauuaggcag

SEQ ID NO: 134971 - RNA, 45 nt, Homo sapiens
gcaccaggaaaggggugguagucagaggagggaggaggaauaagg

SEQ ID NO: 134972 - RNA, 46 nt, Homo sapiens
aucuacgucauuacggauuaacggccuggauuuaucauuggguugg

SEQ ID NO: 134973 - RNA, 46 nt, Homo sapiens
ugaaguggaaaaaggagagcaaacugcucagcgcgucucagcucag

SEQ ID NO: 134974 - RNA, 41 nt, Homo sapiens
auucucucucucuuuuuugucuucucggcuuuccuucucug

SEQ ID NO: 134975 - RNA, 44 nt, Homo sapiens
caggcuugugggaaccgguccccagcgggcggcggcagagcggg

SEQ ID NO: 134976 - RNA, 45 nt, Homo sapiens; identical to SEQ ID NO: 37569

SEQ ID NO: 134977 - RNA, 45 nt, Homo sapiens
ugcagccccagcuacgggccuucucaguacuacccucugggucaa

SEQ ID NO: 134978 - RNA, 45 nt, Homo sapiens
aagugaguagcgaaccauuuucacagauuaccucaggcugcuuag

SEQ ID NO: 134979 - RNA, 45 nt, Homo sapiens
gccacauugagaugauccuuacggaaaaggaacagauuguuccua

SEQ ID NO: 134980 - RNA, 41 nt, Homo sapiens
aucccagaagaaacugaagaaacaaaaacuuauggcacggg

SEQ ID NO: 134981 - RNA, 46 nt, Homo sapiens
uuuaguucagaguggaggggcuuuggccugaaauaaaaugcaagua

SEQ ID NO: 134982 - RNA, 70 nt, Homo sapiens
cuuugauuuuuuuuucggggggggggggguuccuuccuuccuuccuucuaucccuccuuccugaaaugag

SEQ ID NO: 134983 - RNA, 44 nt, Homo sapiens
uccaccaccaccccugccucacaggaaagggguagggugaggac

SEQ ID NO: 134984 - RNA, 57 nt, Homo sapiens
ggcauuuaaguccccgcuguagguccagguccagguccagguccagcccuucuccag

SEQ ID NO: 134985 - RNA, 41 nt, Homo sapiens
ggcacugggugccauguuguaugugugguuguggcccacgu

SEQ ID NO: 134986 - RNA, 45 nt, Homo sapiens
cagauccagggucucagagucagagcuguagccaaccgcaccuuc

SEQ ID NO: 134987 - RNA, 45 nt, Homo sapiens
auuggcugugccauugagcugggguggaaagaagagcccugucag

SEQ ID NO: 134988 - RNA, 73 nt, Homo sapiens
gcagccccccagggacgccugaugcaggcugacauucugauugaugggaguguugggggcaaggcuguaguug

SEQ ID NO: 134989 - RNA, 45 nt, Homo sapiens
cuucuggcggugacuauagucaaaaaccucacgcccagcccccag

SEQ ID NO: 134990 - RNA, 41 nt, Homo sapiens
ugagaugggacucccaccccaugcuccgugcucaagcugca

SEQ ID NO: 134991 - RNA, 47 nt, Homo sapiens
uauaaaggccugagaugaggaaaagcacaaccuucacgagggccaag

SEQ ID NO: 134992 - RNA, 42 nt, Homo sapiens
ggcagaacugggccccaggaugaucucccggagugggggaag

SEQ ID NO: 134993 - RNA, 66 nt, Homo sapiens
caaaucaaggccacugcucugccgcuccagccagcagguuacccuccucagugucaaaccccguac

SEQ ID NO: 134994 - RNA, 42 nt, Homo sapiens
cugcuggaggaagagggggacacuuacucucaguccggcugg

SEQ ID NO: 134995 - RNA, 41 nt, Homo sapiens
cgucuacaagaacagcauugaccucuuccuauacguggugg

SEQ ID NO: 134996 - RNA, 41 nt, Homo sapiens
agccacagggaggcucaggagcuuguguccaccuucaggaa

SEQ ID NO: 134997 - RNA, 84 nt, Homo sapiens
aagcgcugguugcuggagaacauggacggagccuucuuggugcuggacgagauuguggauggcgggugaggaggggacagucag

SEQ ID NO: 134998 - RNA, 47 nt, Homo sapiens
augagaggaaaaaccaggaggcaaaucaguggcacaauccuccccuc

SEQ ID NO: 134999 - RNA, 65 nt, Homo sapiens
aaaugaaggcuguggauucaaggcucccugccccccagaucauuuccccaauccuggcaaaagcc

SEQ ID NO: 135000 - RNA, 45 nt, Homo sapiens
aaggucuccagccagggcuucugagaugcaaagguuuggccucag

SEQ ID NO: 135001 - RNA, 25 nt, Homo sapiens
ucuggcuuccccuugaugcaaggcu

SEQ ID NO: 135002 - RNA, 45 nt, Homo sapiens
uuaaauccaucuuccaugagcuaacacucucuuucccuuuccaga

SEQ ID NO: 135003 - RNA, 46 nt, Homo sapiens
agauugccaagugccagcagcugcagcaagaauacagccgcaagga

SEQ ID NO: 135004 - RNA, 50 nt, Homo sapiens
gccaaucuuguccuuaagauggugucuguuugacuaccccaguccguugc

SEQ ID NO: 135005 - RNA, 41 nt, Homo sapiens
ugcaggguggugguugggacguugaaaugagcgcgcgagug

SEQ ID NO: 135006 - RNA, 40 nt, Homo sapiens
ucuccagccugaagcggaaguggaggaaagauggaggugu

SEQ ID NO: 135007 - RNA, 75 nt, Homo sapiens
gaagcuguccccaggagaugccaggagauguccccaggagauguccucucucuccagcccagugaaaacagugaa

SEQ ID NO: 135008 - RNA, 45 nt, Homo sapiens
gaggcugagugcuacuuccacucccgccccaagagcagccagauu

SEQ ID NO: 135009 - RNA, 52 nt, Homo sapiens
ccacagccagccaucaggacagggagaggaggccuccggcaugcagggaaaa

SEQ ID NO: 135010 - RNA, 40 nt, Homo sapiens
aagccuuaaaccccaaugugacuguauuuggagaagggga

SEQ ID NO: 135011 - RNA, 29 nt, Homo sapiens
ggggagaugagggaggcaagggguugugu

SEQ ID NO: 135012 - RNA, 50 nt, Homo sapiens
gacacagcauuuaaacucaaaucuggauucagauaacagcaccugcacau

SEQ ID NO: 135013 - RNA, 47 nt, Homo sapiens
aaaacaugcauuucacuccgucgaggagcaaagugagccccuacccc

SEQ ID NO: 135014 - RNA, 45 nt, Homo sapiens
gggcaagaagaagcacgugugccacauccccgacuguggcaagac

SEQ ID NO: 135015 - RNA, 97 nt, Homo sapiens
cugcaaauggaacaagcccuggccggagagacccagcccggggagaagcggcgccgcauggccugcacgugucccaacugcaaggauggggagaaga

SEQ ID NO: 135016 - RNA, 42 nt, Homo sapiens
agcagcugacagugcagaauguuucugggaacaaccugacca

SEQ ID NO: 135017 - RNA, 51 nt, Homo sapiens
guacguccaccugcagcuucucaccuaguccuuacaauagcacucagagau

SEQ ID NO: 135018 - RNA, 52 nt, Homo sapiens
aaugguguccagguccagggcgugccugucaccaucaccaacacaggcggug

SEQ ID NO: 135019 - RNA, 55 nt, Homo sapiens
ccugaaugcagcccaguuggcggcagcugcccaggcaaugcagaccaucaacauc

SEQ ID NO: 135020 - RNA, 46 nt, Homo sapiens
aauaacuuauuuuugauuauagaauuacucaaaacauuagcaagaa

SEQ ID NO: 135021 - RNA, 43 nt, Homo sapiens
agccccccaaccccgcugucuaagacuaacaagaaagcaagga

SEQ ID NO: 135022 - RNA, 41 nt, Homo sapiens
gucccuaucaaaccugccccucucccucucagccccggcaa

SEQ ID NO: 135023 - RNA, 49 nt, Homo sapiens
uacugagaaacuauggccauuuaccuaaggugccgcaguugggccaggg

SEQ ID NO: 135024 - RNA, 47 nt, Homo sapiens
cuguaagcaaggaaagacagcugcagacacugaaguuuuucaaggau

SEQ ID NO: 135025 - RNA, 47 nt, Homo sapiens
ggugcagccugguuggagcagguuuaagaaaagcuagcgggagagaa

SEQ ID NO: 135026 - RNA, 292 nt, Homo sapiens
aaguaaagaaaguguuucaaggaagaagaggccaggcgcgguggcucacgccuguaaucccagcacuuugggaggccgaggcgggcagaucacuugagguuaggaguucgagaccagccuggcgaacauggugaaaccccaacucuauuaaaaauacaaaaaauuagccgggcguggugucaggcccguguaaucccagcuaccugggaggcugaggcagcagaaucacuugaaccggggggcggagguugcagcgagccaagaccaaaaggaagagcaaucaacugucaga

SEQ ID NO: 135027 - RNA, 55 nt, Homo sapiens
agaguccuggggcaacccaaucauuuagaauuugagaggagaggaagaaccagca

SEQ ID NO: 135028 - RNA, 56 nt, Homo sapiens
ccuauuaauacauccaaguggagcuaucaguaggcaguuggauauaccagucgaga

SEQ ID NO: 135029 - RNA, 37 nt, Homo sapiens
uaaggauaacucccaagguuuuaaggcugaggagcug

SEQ ID NO: 135030 - RNA, 118 nt, Homo sapiens
augguuucauuuaagugugaugggucuuacucuggauguguugagaauagacugauggggucaaggucagaagcacagcuaggagguuaauccgugggagacaugauagaaaccugga

SEQ ID NO: 135031 - RNA, 94 nt, Homo sapiens
acagcagggagccagcauggcuaaagcagugagagagggagagugacagggcaggugaaagagguuaggucacacaggggccuuuugugucaca

SEQ ID NO: 135032 - RNA, 39 nt, Homo sapiens
auaucucugcucucaauugauaauuaggaaucuucuuag

SEQ ID NO: 135033 - RNA, 47 nt, Homo sapiens
acuuaggauauuuuggaucagguggacaauggcuauggaaugaaaga

SEQ ID NO: 135034 - RNA, 65 nt, Homo sapiens
caccaaccuuuucuagcaguguuuuucaaacugccagucaugaucaacaagaaggagaauaagau

SEQ ID NO: 135035 - RNA, 45 nt, Homo sapiens
aagcaugaaagauacaccaguaagaguguguccucugguggaugc

SEQ ID NO: 135036 - RNA, 50 nt, Homo sapiens
gcuguaacucuucaaagguaaacaccaacaauaaagcuuggguuguagcu

SEQ ID NO: 135037 - RNA, 64 nt, Homo sapiens
gcaggggaggggcagaggcagagagaagaugcugcuacccggggagguaagaggagcugguugg

SEQ ID NO: 135038 - RNA, 43 nt, Homo sapiens
agaggaagcaacaggcuguagcacacggaagacuuaaccaagu

SEQ ID NO: 135039 - RNA, 44 nt, Homo sapiens
uguccgugccaaugcucagcugguuggagauguugcgggccccc

SEQ ID NO: 135040 - RNA, 43 nt, Homo sapiens
gcagggggcaucacggcagaggugaugaugggcauccucagag

SEQ ID NO: 135041 - RNA, 52 nt, Homo sapiens
auggggacggcauaccccucccaggccucucccucugccuuucuguucuuaa

SEQ ID NO: 135042 - RNA, 42 nt, Homo sapiens
augaagggggaggucccaaaaggccauggggcaucaggagga

SEQ ID NO: 135043 - RNA, 47 nt, Homo sapiens
gucaaguaacuuaaccucuguaagccucaguuuucucaucuguaaaa

SEQ ID NO: 135044 - RNA, 42 nt, Homo sapiens
cuuugggggacguuauagcaugauggucaguagccuggacuu

SEQ ID NO: 135045 - RNA, 45 nt, Homo sapiens
ggggugagguggcuggggcagcugggggcagcuuugagcaaggau

SEQ ID NO: 135046 - RNA, 43 nt, Homo sapiens
ucacugaacccaguccccucuuaccagaccagcagugaaucuc

SEQ ID NO: 135047 - RNA, 32 nt, Homo sapiens
ugggacuggugggugggaccccucagcuaggc

SEQ ID NO: 135048 - RNA, 48 nt, Homo sapiens
gagaaauagagcucaaaccucuuuccgccuaaguccucuccccuaaga

SEQ ID NO: 135049 - RNA, 42 nt, Homo sapiens
uuuguugggccuugucugcugaucucaggagagagaagccug

SEQ ID NO: 135050 - RNA, 41 nt, Homo sapiens
ugacuuggagacagagcugagggagauggugaggccugggg

SEQ ID NO: 135051 - RNA, 46 nt, Homo sapiens
ucaccuauuuaauccaaugaguuuuaaaucuaaaucucauucccuu

SEQ ID NO: 135052 - RNA, 53 nt, Homo sapiens
uaguuuaguuuuccuccuugccuucccuucugugugaccgaccccuuggccaa

SEQ ID NO: 135053 - RNA, 48 nt, Homo sapiens
ucacauaguuggagucagugcauaauuccaaguggcuuuuuuuuuuuu

SEQ ID NO: 135054 - RNA, 50 nt, Homo sapiens
guuaacugguuccugcucacacuccagaauuaaauucuauugaaaaagga

SEQ ID NO: 135055 - RNA, 56 nt, Homo sapiens
cagucuggcugcaauguggauaauaguuuggaauggggaagagaagauguugggaa

SEQ ID NO: 135056 - RNA, 47 nt, Homo sapiens
auccagacuaauaaagguaugugaaaaacuuugaguagcuugcuaau

SEQ ID NO: 135057 - RNA, 43 nt, Homo sapiens
uuuuuuuaggaagagguacguccacaggacacuguaucgguaa

SEQ ID NO: 135058 - RNA, 47 nt, Homo sapiens
aggaaaagcaggacauaaggcaacguuagaagaagcccgucgucggu

SEQ ID NO: 135059 - RNA, 82 nt, Homo sapiens
uuuaaaggaguuuugcugagaagaucagagaaaagggguagaugagagagacgugggguaaaggaaggaauuuuuuaaguug

SEQ ID NO: 135060 - RNA, 157 nt, Homo sapiens
gcaaaagagauggacuggccagugagguagaaggagagccaggagagaggggggguaucccagaauuuaaauaaauaguagaugaaaagaaacaguagaugaaggcagagggaaugugaucagcugugucagaugcuacuacacuaagucaaacaga

SEQ ID NO: 135061 - RNA, 39 nt, Homo sapiens
ucuaauaaggugauauugagcauaaacugagacauggag

SEQ ID NO: 135062 - RNA, 31 nt, Homo sapiens
uuacauucuaaugggagacauagcaaauaau

SEQ ID NO: 135063 - RNA, 43 nt, Homo sapiens
uagcuaguaaaugccauauacuauucuaagagcuggugaaaca

SEQ ID NO: 135064 - RNA, 47 nt, Homo sapiens
aauccaggaguuugugaaagaugucuuuucaccuauaggggagagac

SEQ ID NO: 135065 - RNA, 48 nt, Homo sapiens; identical to SEQ ID NO: 37684

SEQ ID NO: 135066 - RNA, 46 nt, Homo sapiens
ggaaaguuuauuaccaggcauucgugaccuuucucugcccccugug

SEQ ID NO: 135067 - RNA, 41 nt, Homo sapiens
ccaucucccgccgccgcuccucgcgcuucuuccgggccagc

SEQ ID NO: 135068 - RNA, 21 nt, Homo sapiens
cauauuguugaaguauuuugu

SEQ ID NO: 135069 - RNA, 45 nt, Homo sapiens
cuagugguaaaccuauagcagcugugaugaauaccuggaccaaac

SEQ ID NO: 135070 - RNA, 86 nt, Homo sapiens
aagaaaucuaauguucuucaccuccaugucuuccucaucacuccucugcaacuaccccaaaaauaaacagaaccauaguggcuucu

SEQ ID NO: 135071 - RNA, 45 nt, Homo sapiens
guuucugcugauuacacccgugcccaggagcuugacgccuuagau

SEQ ID NO: 135072 - RNA, 41 nt, Homo sapiens
auauuaggaaauauuuuccuaauaucucuaaagccuaacuu

SEQ ID NO: 135073 - RNA, 45 nt, Homo sapiens
guggguuucaauaugaauuauaauaacauauuuauuagaugguua

SEQ ID NO: 135074 - RNA, 45 nt, Homo sapiens
auugaccggaaaccauacccugaugaugaaaauuuaguggaagug

SEQ ID NO: 135075 - RNA, 46 nt, Homo sapiens
caaagcaacuuuugauaucucauugguuguuccuaaagacagagua

SEQ ID NO: 135076 - RNA, 27 nt, Homo sapiens
aucucuauagaaaggagggaauuaagg

SEQ ID NO: 135077 - RNA, 42 nt, Homo sapiens
uacguugauauguuacuauuguuagguauaaaagcacaaaga

SEQ ID NO: 135078 - RNA, 46 nt, Homo sapiens
uugaaaauguugcagucuugauuucgucuugucaguccagucagaa

SEQ ID NO: 135079 - RNA, 25 nt, Homo sapiens
ucuagcugguuuugaaaauuuguua

SEQ ID NO: 135080 - RNA, 36 nt, Homo sapiens
gcacaauaggcauuuaugauacuauguaacaggaag

SEQ ID NO: 135081 - RNA, 60 nt, Homo sapiens
ggcuguggaggcggcggcgagaggagcggcugaagacgagaaggaggaggggaggaggcg

SEQ ID NO: 135082 - RNA, 48 nt, Homo sapiens
cuuccuuuucuccuugcacccccgccucucccuccucuucuccccgug

SEQ ID NO: 135083 - RNA, 64 nt, Homo sapiens
gaagaacuucccaacuuggcaccugggggaggagcagcugggagcaaauguggaacugucugag

SEQ ID NO: 135084 - RNA, 74 nt, Homo sapiens
cacgcugggcaggggaaugggcauugguuuuggagaaggaaguugguuagaggcaaggccuccgaguggaagaa

SEQ ID NO: 135085 - RNA, 32 nt, Homo sapiens
gaaauaggugcccacaccuucgucuuaacuaa

SEQ ID NO: 135086 - RNA, 24 nt, Homo sapiens
acuuugucaucaauacccuaacuu

SEQ ID NO: 135087 - RNA, 46 nt, Homo sapiens
agcguggcgggaagagccccgggccacagcauucagggauguccca

SEQ ID NO: 135088 - RNA, 45 nt, Homo sapiens
caaaggacuagagccaguuccagcagugggggcugcuccccaguc

SEQ ID NO: 135089 - RNA, 83 nt, Homo sapiens
aacaggaagucugugugacagagcuaaaucccacccuagccucggccucagaguccccuagcucaaccugagacgcucaggug

SEQ ID NO: 135090 - RNA, 41 nt, Homo sapiens
aaaaaccaaagccccaugccugagguggggcagagggaggg

SEQ ID NO: 135091 - RNA, 53 nt, Homo sapiens
aauggggaaaauauagcacaccuaguucuuaggguugguggggggaccacaca

SEQ ID NO: 135092 - RNA, 37 nt, Homo sapiens
gcuauagagcaccacgcgcgugaacauaacaccugca

SEQ ID NO: 135093 - RNA, 46 nt, Homo sapiens
aagcucccagaaggcccaaagguucgggaggacagaccucccaggc

SEQ ID NO: 135094 - RNA, 70 nt, Homo sapiens
ucuuucuggggucacaugcaggugauggguguccgaccuuugggaagaaaggggagaggggaucagauau

SEQ ID NO: 135095 - RNA, 40 nt, Homo sapiens
acccucccaccccgggcacagcccugcacucacaccgugu

SEQ ID NO: 135096 - RNA, 70 nt, Homo sapiens
cggcccgucccgccggugucuggcuugccucagcucacaggcuuuucccgagcgccagucccugccagga

SEQ ID NO: 135097 - RNA, 50 nt, Homo sapiens
aaccacugugcuccacucccccugagcuccugcagccugcccugcccugc

SEQ ID NO: 135098 - RNA, 46 nt, Homo sapiens
cgcaugguggcacucuguaccugcaaggccacucagaggcccccgu

SEQ ID NO: 135099 - RNA, 44 nt, Homo sapiens
augguuugguggccacugagguguuaugugguuuuaugucggag

SEQ ID NO: 135100 - RNA, 27 nt, Homo sapiens
uggccuggagcugcggccggagccugc

SEQ ID NO: 135101 - RNA, 35 nt, Homo sapiens
uauguuugagcuguagaugggauugagaacagaaa

SEQ ID NO: 135102 - RNA, 45 nt, Homo sapiens; identical to SEQ ID NO: 37769

SEQ ID NO: 135103 - RNA, 45 nt, Homo sapiens
gaacugagcuuuaaauuuugaguuuaaaaauguacaucaggagca

SEQ ID NO: 135104 - RNA, 41 nt, Homo sapiens
ugcagcaauaucaugaauucucagaagcccuuucagggagc

SEQ ID NO: 135105 - RNA, 46 nt, Homo sapiens; identical to SEQ ID NO: 37772

SEQ ID NO: 135106 - RNA, 44 nt, Homo sapiens
cccguugguuucugcaggaaaaaaaaaaaaauuuaugugguuuu

SEQ ID NO: 135107 - RNA, 38 nt, Homo sapiens
cacaacucuucuggguuaaaaaaaaaaagccaggugau

SEQ ID NO: 135108 - RNA, 52 nt, Homo sapiens
agagaucauaggaauauuaggaguuaccucucuguggagguauugacuugua

SEQ ID NO: 135109 - RNA, 51 nt, Homo sapiens
augguauccgaccacuuccagaauacagcacagagaaacauaagaagcaca

SEQ ID NO: 135110 - RNA, 46 nt, Homo sapiens
cagugguuccacuccaaagcaugagcguggcucucccagccauagu

SEQ ID NO: 135111 - RNA, 42 nt, Homo sapiens
gggagcacagguguggcaaaaauuaucaucaguaagcaugau

SEQ ID NO: 135112 - RNA, 42 nt, Homo sapiens
ccauccuauguccuccaaacauaacaugucaggaggagaguu

SEQ ID NO: 135113 - RNA, 45 nt, Homo sapiens
acaagcuugccucuccaaugaagccuguuccuggaacuccuccau

SEQ ID NO: 135114 - RNA, 46 nt, Homo sapiens
auuccuaagggaacagugauggugggcaagccuuccucucacaguc

SEQ ID NO: 135115 - RNA, 44 nt, Homo sapiens
uuaccccaccuaccaguacagguggaucuaaaucgccaggcagu

SEQ ID NO: 135116 - RNA, 45 nt, Homo sapiens
uuagacagcaaaccagggaagcgcagucggaccccuucuaaugau

SEQ ID NO: 135117 - RNA, 57 nt, Homo sapiens
aucuuauggagcaucacagugguagucaggguccuuuacugaccacuggggacuuag

SEQ ID NO: 135118 - RNA, 45 nt, Homo sapiens
uacuuugggggugccaaugcuuggaggugauaauggggagaccaa

SEQ ID NO: 135119 - RNA, 46 nt, Homo sapiens
caaagugguuuuggagaagaauauuuugaugaaagcagccaaagug

SEQ ID NO: 135120 - RNA, 46 nt, Homo sapiens
ccaagccaguguagcacucccccaacaacuuacccacaaccaguac

SEQ ID NO: 135121 - RNA, 43 nt, Homo sapiens
ccgaugcucaugaaccuucuuaaagauaauccugcccaggauu

SEQ ID NO: 135122 - RNA, 37 nt, Homo sapiens; identical to SEQ ID NO: 37789

SEQ ID NO: 135123 - RNA, 38 nt, Homo sapiens
auccuaaaucugaucagacaccaaguggccuauaacac

SEQ ID NO: 135124 - RNA, 42 nt, Homo sapiens
uggucagcagcacugcuauuuccucaacaaggaugcuccucu

SEQ ID NO: 135125 - RNA, 41 nt, Homo sapiens
aaggaccccuuccuucuccucaaucaccagugccaacagug

SEQ ID NO: 135126 - RNA, 33 nt, Homo sapiens
acuuuuaccugauauuaccauuuaguauagaug

SEQ ID NO: 135127 - RNA, 44 nt, Homo sapiens
uaaauagcuuggguuuagguuuuuccaugagccacuguagagau

SEQ ID NO: 135128 - RNA, 59 nt, Homo sapiens
cagugccaguggcacugaauguuacaucacgucagauauguucuauguggaagugcagu

SEQ ID NO: 135129 - RNA, 35 nt, Homo sapiens
uucauccuuuuauaguaacaucuuuaccagcaaug

SEQ ID NO: 135130 - RNA, 45 nt, Homo sapiens
ggccugguuaauuuucaccucaaauguuuucccacuugacacagg

SEQ ID NO: 135131 - RNA, 54 nt, Homo sapiens
agaguuugcguuuaucauccacuucaaugaguuucuggcagccaguggcuggga

SEQ ID NO: 135132 - RNA, 44 nt, Homo sapiens
acccuggagugaaaccauuaagcuugugcgucaagucaugguaa

SEQ ID NO: 135133 - RNA, 40 nt, Homo sapiens
gcucagggggaaaccgaggguaagugacuguaggggaaag

SEQ ID NO: 135134 - RNA, 40 nt, Homo sapiens
acacucucucccucacacagacccagucacacacuagauu

SEQ ID NO: 135135 - RNA, 37 nt, Homo sapiens
gagggacaaagggggcgugaggcaccuaggccgcggc

SEQ ID NO: 135136 - RNA, 45 nt, Homo sapiens
cgggaguuucaucuucgcuacaagaggaagguaaaauugcgugug

SEQ ID NO: 135137 - RNA, 27 nt, Homo sapiens
ccgaguagugcauagaguagugguagc

SEQ ID NO: 135138 - RNA, 35 nt, Homo sapiens
cugguacugggaguuucagagaggccugcgagguc

SEQ ID NO: 135139 - RNA, 46 nt, Homo sapiens
gggguccccagcccguccccuccgccugggacuggcgcccgggugc

SEQ ID NO: 135140 - RNA, 41 nt, Homo sapiens
aacuggaucuucuugcgguccuugggguccauggcgcgcgg

SEQ ID NO: 135141 - RNA, 45 nt, Homo sapiens
ucaaaccccaaacggccuuggccuuaauucucagggaagagagga

SEQ ID NO: 135142 - RNA, 37 nt, Homo sapiens
guuaguaccuuucugaaggaaauagaaagggggaaau

SEQ ID NO: 135143 - RNA, 45 nt, Homo sapiens
uuuacaaagauuuauuacagcacgggagggguucaggccuggagu

SEQ ID NO: 135144 - RNA, 46 nt, Homo sapiens
gguauuaccgaggcgaagaguggacugggcuuucgugggcacuuac

SEQ ID NO: 135145 - RNA, 66 nt, Homo sapiens
ggcacacaggcgaggccucccucagguucccuggaguugacccaggguuggggaauugcuuaagga

SEQ ID NO: 135146 - RNA, 45 nt, Homo sapiens
gcuucgaggcgaccuaccuggagcuggccagugcugugaaggagc

SEQ ID NO: 135147 - RNA, 54 nt, Homo sapiens
aagcaggcuuggaggguuaauuuacccacagaaugugauaguaauaggggaggg

SEQ ID NO: 135148 - RNA, 44 nt, Homo sapiens
gucgagacuuagaagaauggggccacauagcagcagaggacugg

SEQ ID NO: 135149 - RNA, 71 nt, Homo sapiens
ugcaacccaccguggguccugguugggaguggggagggucagguuggggaaagaugggguagaguguagau

SEQ ID NO: 135150 - RNA, 45 nt, Homo sapiens
ccugcacacggugaaggggacacccuuugagaccccggaccaggg

SEQ ID NO: 135151 - RNA, 42 nt, Homo sapiens
gugucccugucgucuggacccucaccaaccucauucacaaca

SEQ ID NO: 135152 - RNA, 34 nt, Homo sapiens
ccagcucucuaugggaguuacagguguuggccac

SEQ ID NO: 135153 - RNA, 52 nt, Homo sapiens
agaggggagacugaggugaggaugggcaggacagagaagaacgggggcagga

SEQ ID NO: 135154 - RNA, 28 nt, Homo sapiens
aguggggcaugcgauucucuugacucac

SEQ ID NO: 135155 - RNA, 46 nt, Homo sapiens
gaccugcuguugggagcauggccauaaauuggcauaguccuggagu

SEQ ID NO: 135156 - RNA, 46 nt, Homo sapiens
aguuaaguagugguugaaagaaggagguaaggacugugaaggccag

SEQ ID NO: 135157 - RNA, 40 nt, Homo sapiens
cacaggugagcaaucucaaaaccaccaagggccaggaaca

SEQ ID NO: 135158 - RNA, 42 nt, Homo sapiens
uccugaaaauguucugaugugucccaugacuaauccagccag

SEQ ID NO: 135159 - RNA, 43 nt, Homo sapiens
auuuguuaggauuagggaguuuauauauggaagcagacagaag

SEQ ID NO: 135160 - RNA, 61 nt, Homo sapiens
ccaggaguagggguuagucauggaaggcguccugaaagagguaagcaugggacagauggug

SEQ ID NO: 135161 - RNA, 45 nt, Homo sapiens
gggcugugugucccauuauuguccccauaggggacguacacgaag

SEQ ID NO: 135162 - RNA, 46 nt, Homo sapiens
gcggcugagcacucccagcgagagcuggacacagucaccuuggagg

SEQ ID NO: 135163 - RNA, 58 nt, Homo sapiens
acagacacaaacacugguuuccagcgggaacaaucagucauauauuggaggcgcuaaa

SEQ ID NO: 135164 - RNA, 96 nt, Homo sapiens
agcagauuuuuguuguccuagcugccuuuagcacacucccccgaaugaaccauuucgaccuaguaucuuguuuccuacuucucuaacugaaguguc

SEQ ID NO: 135165 - RNA, 55 nt, Homo sapiens
uuugcagcuggucagagaggguguggcagggaccugcuguucuagcccccaaggg

SEQ ID NO: 135166 - RNA, 45 nt, Homo sapiens
cgcugcagaugauccgccagcuggcagggccacuguuuagugaga

SEQ ID NO: 135167 - RNA, 64 nt, Homo sapiens
cccggaaauucaucaagugaggaaggccaagccccugaccccagggcgugcagggaggcugcgc

SEQ ID NO: 135168 - RNA, 46 nt, Homo sapiens
cauccagcccaacauccagcugauccuccgggcggagcccacuguc

SEQ ID NO: 135169 - RNA, 46 nt, Homo sapiens
acaagaaugcuagaaugggcuacucucgaggcuucaggaccugguu

SEQ ID NO: 135170 - RNA, 46 nt, Homo sapiens
ucaguuauaaauaaacaaaacgcucgccggaacguuauggucaucc

SEQ ID NO: 135171 - RNA, 42 nt, Homo sapiens
ggacauccagcucccccugcagguugguauccagcaagguuc

SEQ ID NO: 135172 - RNA, 46 nt, Homo sapiens
gaaaaggaaauugggagguauaguuacagggcuggagaagguggag

SEQ ID NO: 135173 - RNA, 41 nt, Homo sapiens
uagaaagugagcuucuugacaagugccaaaauggcgaugcc

SEQ ID NO: 135174 - RNA, 42 nt, Homo sapiens
ucuggcgucacuggguugguuuuauguccaugaaugcaggug

SEQ ID NO: 135175 - RNA, 37 nt, Homo sapiens
auguguguguggaagggguguacuugguggugccuag

SEQ ID NO: 135176 - RNA, 38 nt, Homo sapiens
cuaagcgaggcccucccacccgugagugcagguuccag

SEQ ID NO: 135177 - RNA, 41 nt, Homo sapiens
ugaccuggacugccuaggucugaaucccagcucugucacuu

SEQ ID NO: 135178 - RNA, 41 nt, Homo sapiens
ugaucaggauccccucuccaaaccccuuuuauuuagcccug

SEQ ID NO: 135179 - RNA, 40 nt, Homo sapiens
cacccaccaguggucaugggggauggaugugaccugggag

SEQ ID NO: 135180 - RNA, 42 nt, Homo sapiens
cuuggcaguacccagacacauuuggaguuaaggcugggcagg

SEQ ID NO: 135181 - RNA, 49 nt, Homo sapiens; identical to SEQ ID NO: 37876

SEQ ID NO: 135182 - RNA, 44 nt, Homo sapiens
ccaggcaaagcccuaaggcccacaacugggucccuggaggguag

SEQ ID NO: 135183 - RNA, 49 nt, Homo sapiens
agaagaggacagcagguucuuccaggcagaggggaugacaaggucauag

SEQ ID NO: 135184 - RNA, 39 nt, Homo sapiens
ggaucaccuccuaaaaaugcaaggccuuccaagaaacag

SEQ ID NO: 135185 - RNA, 45 nt, Homo sapiens
gcccugggacagggcaaacaacugaacuugcuauggaaaggacag

SEQ ID NO: 135186 - RNA, 43 nt, Homo sapiens
gggaggauugagaagggacaagccaccuugaccguaggggaag

SEQ ID NO: 135187 - RNA, 34 nt, Homo sapiens
aagaaaaacuagacagagagaaaaauacaaaaaa

SEQ ID NO: 135188 - RNA, 34 nt, Homo sapiens
ggggagagagggagagaggaggugguccucccau

SEQ ID NO: 135189 - RNA, 49 nt, Homo sapiens
caucccuccauccccaccccaaccccuccauccccauucucagccaugg

SEQ ID NO: 135190 - RNA, 78 nt, Homo sapiens
uucccccucggugaugugggguguaugugugcguuccucugcgugaaugugugagugaguacacaugguaggggagga

SEQ ID NO: 135191 - RNA, 41 nt, Homo sapiens; identical to SEQ ID NO: 37887

SEQ ID NO: 135192 - RNA, 44 nt, Homo sapiens
accuugggcaaggcauucaccaaaguuaaucugcucuugucuag

SEQ ID NO: 135193 - RNA, 42 nt, Homo sapiens
gggcauagacggugcccguugcuguuggacugguggcagcug

SEQ ID NO: 135194 - RNA, 41 nt, Homo sapiens
uugaaguugccaggugagcugcccagcuugucaugggcgua

SEQ ID NO: 135195 - RNA, 45 nt, Homo sapiens
gaggggaccggagcaggggguggcgaggggcccauggggccuggg

SEQ ID NO: 135196 - RNA, 42 nt, Homo sapiens
aggcgugcacaccguaguggaagcccgaggcaacguccccac

SEQ ID NO: 135197 - RNA, 42 nt, Homo sapiens
uguccuccauggccacuuguagacucccaggggggcucccau

SEQ ID NO: 135198 - RNA, 43 nt, Homo sapiens
gcuggaccccgaacgauagcagggccaggacaaccuaggggag

SEQ ID NO: 135199 - RNA, 45 nt, Homo sapiens
gcccugcagaaggguuggacguugaggcaacggaguucugcuuug

SEQ ID NO: 135200 - RNA, 44 nt, Homo sapiens
ccuuguguagcuucugggaggcuuacauaaacacuggcugggau

SEQ ID NO: 135201 - RNA, 30 nt, Homo sapiens; identical to SEQ ID NO: 37897

SEQ ID NO: 135202 - RNA, 46 nt, Homo sapiens
gauagcucuguuuccucucucucuucaguuucauagcccugaaaca

SEQ ID NO: 135203 - RNA, 47 nt, Homo sapiens
uuuuuucuuuuuggacacguuacgaagaaauaucacauagguaagag

SEQ ID NO: 135204 - RNA, 53 nt, Homo sapiens
ggauuuggcgcgagcgcggcuggaguuugcugcugccgcugugcaguuuguuc

SEQ ID NO: 135205 - RNA, 51 nt, Homo sapiens
cgggguaguucuagcaguuaugcguggugugaaggaggugaaaguuguagg

SEQ ID NO: 135206 - RNA, 48 nt, Homo sapiens
caggaauuucuugagggaacacaucugugggaaaaaagcuggaagccu

SEQ ID NO: 135207 - RNA, 41 nt, Homo sapiens
ugaggccaaaauaacucccauauuugcauuuuuuuuuccag

SEQ ID NO: 135208 - RNA, 48 nt, Homo sapiens
cuugaggacugcccaggcuguauucccagcuauugcucaggagauuug

SEQ ID NO: 135209 - RNA, 45 nt, Homo sapiens
augaugaggaaauuggaaaaacauaugacugcagagaagggcccc

SEQ ID NO: 135210 - RNA, 63 nt, Homo sapiens
ucucaauauaggugaaagcaaagccugauaaauaagggagaauuggguaaaagaauugugaag

SEQ ID NO: 135211 - RNA, 48 nt, Homo sapiens
uuugugguaauguaauauuauagaaguaaauuguuguggggcaacugc

SEQ ID NO: 135212 - RNA, 27 nt, Homo sapiens
ggugcuaucugcuagcauauccaauga

SEQ ID NO: 135213 - RNA, 46 nt, Homo sapiens
gagccucugauucccaagaggguuggucuuauucacauaucccaag

SEQ ID NO: 135214 - RNA, 46 nt, Homo sapiens
caguaaagucugucgcaaacagcagguggcggcuguggaccaguca

SEQ ID NO: 135215 - RNA, 36 nt, Homo sapiens
cacccgaaaguauucagcuggcauuuagagagcuac

SEQ ID NO: 135216 - RNA, 380 nt, Homo sapiens
ccucuucguuugcucaaacaugaguggguauuuuuuuguuuguuuuuuuuguuguuguuguuuuugaggcgcgucucacccuguugcccaggcuggagugcaauggcgcguucucugcucacuacagcacccgcuucccagguugaagugauucucuugccucagccucccgaguagcugggauuacaggugcccaccaccgcgcccagcuaauuuuuuaauuuuuaguagagacaggguuuuaccauguuggccaggcuggucuugaacuccugacccucaagugaucugcccaccuuggccucccuaagugcugggauuauaggcgugagccaccaugcucagccauuaagguauuuuguuaagaacuuuaaguuuag

SEQ ID NO: 135217 - RNA, 69 nt, Homo sapiens
aagugucugggacuauaaggguuaacaugcauaauugcaaagauuguccgaaggcugauggaaagcaga

SEQ ID NO: 135218 - RNA, 46 nt, Homo sapiens
cuccgaggagaagcuggcgcgcugccgcccccccgugggcugcgag

SEQ ID NO: 135219 - RNA, 78 nt, Homo sapiens
ccccugcacacacugaugcacgggcaaggcgugugcauggagcuggcggagaucgaggccauccaggaaagccugcag

SEQ ID NO: 135220 - RNA, 37 nt, Homo sapiens
uggcacccagcauaucugggaagggggguccuggggg

SEQ ID NO: 135221 - RNA, 58 nt, Homo sapiens
uccacaccucugcauccugguacugauccuagacucauggaaucugggggaguggaca

SEQ ID NO: 135222 - RNA, 50 nt, Homo sapiens
aggaagauggugaugaagaagcugaugcugggacuuagggaagcgguagg

SEQ ID NO: 135223 - RNA, 41 nt, Homo sapiens
gggacaagucaaggacuucaagaggaauauucuccugagag

SEQ ID NO: 135224 - RNA, 82 nt, Homo sapiens
ggugaccaccccaacaacagcuucagccccuguagcgcccaugaccgcaggugccugcagaagcacuucgccaaaauucgag

SEQ ID NO: 135225 - RNA, 46 nt, Homo sapiens
aggaccucuacaucauccccauccccaacugcgaccgcaacggcaa

SEQ ID NO: 135226 - RNA, 46 nt, Homo sapiens
ugucacccagcucuggaugggcagcguggcaagugcuggugugugg

SEQ ID NO: 135227 - RNA, 40 nt, Homo sapiens
ugccagcaggccagggacucagcguccccugcuacuccug

SEQ ID NO: 135228 - RNA, 54 nt, Homo sapiens
uggagucugagucugaguccugucucugccugcggcccagaaguuucccucaaa

SEQ ID NO: 135229 - RNA, 139 nt, Homo sapiens
cacucauccagccaccuaaaaacauuuacugaccauguacuacgugccagcucuaguuuucagccuugggagguuuuauucugacuuccucugauuuuggcauguggagacacuccuauaaggagaguucaagccugug

SEQ ID NO: 135230 - RNA, 42 nt, Homo sapiens
gacauguaccuugaccaucguccuuccucucaagcuagccag

SEQ ID NO: 135231 - RNA, 91 nt, Homo sapiens
ccuuuaggucugguuguugcaccaucugcuugguuggcuggcagcugagagcccugcugugggagagcgaagggggucaaaggaagacuug

SEQ ID NO: 135232 - RNA, 66 nt, Homo sapiens
aagcacagagggcuagggaggugggguacauuucucugagcagucagggugggaagaaagaaugca

SEQ ID NO: 135233 - RNA, 42 nt, Homo sapiens
aucuaguccauuacaagaauauuaaauuccuugagcuuugug

SEQ ID NO: 135234 - RNA, 44 nt, Homo sapiens; identical to SEQ ID NO: 37936

SEQ ID NO: 135235 - RNA, 73 nt, Homo sapiens
acucuaguuaugcugacaguauacagcugugcuguccaauauagaagccacuagccacaugugguuauuaaac

SEQ ID NO: 135236 - RNA, 44 nt, Homo sapiens
cagcugcaauuuucuccauauccacuucuacuuucagaccgcac

SEQ ID NO: 135237 - RNA, 48 nt, Homo sapiens
gcucuagcaguuguauaauauaggauauuccagagcagcuggugaggc

SEQ ID NO: 135238 - RNA, 45 nt, Homo sapiens
gaauuuccucuucuucuccuggugucguuccucuauuugaagaag

SEQ ID NO: 135239 - RNA, 44 nt, Homo sapiens
aauauuauaguuaucauuucuauuccauuaacauagauaaucaa

SEQ ID NO: 135240 - RNA, 46 nt, Homo sapiens
caugagaaccaaggcauaaugcauagaaagaauauaguagagagag

SEQ ID NO: 135241 - RNA, 74 nt, Homo sapiens
aaguuacacaaggaccuaauuaguagugaaaaguagacuagccugaaauuuaggugguggggguauggaaggaa

SEQ ID NO: 135242 - RNA, 36 nt, Homo sapiens
gauauuuagaaauguacuuucagguuuuuucuugug

SEQ ID NO: 135243 - RNA, 74 nt, Homo sapiens
cuuuaucauacaaaguuucaugcucaccuaagaauaugcaaugcaacaaaaaaaugcagaguuggagguaagaa

SEQ ID NO: 135244 - RNA, 42 nt, Homo sapiens
guuugaggaacagaaagauuuauuggcuacacgaggaccaua

SEQ ID NO: 135245 - RNA, 46 nt, Homo sapiens
uuaagaaugaaaggggaagcacagcaaaauugugcugauuucugaa

SEQ ID NO: 135246 - RNA, 105 nt, Homo sapiens
cugcugccagaccagcuucuguggauuuccuagcuucucaaccggugggacuugugacucuagcugcugccagccaagcugcugugaaacuagcugcugccagcc

SEQ ID NO: 135247 - RNA, 42 nt, Homo sapiens
aaagugguuguugagggcaaugacagccccagcauugaaggu

SEQ ID NO: 135248 - RNA, 45 nt, Homo sapiens
uggaaacugugaggaggggagauucaguguggugggggacugagu

SEQ ID NO: 135249 - RNA, 62 nt, Homo sapiens
aagggaucgcugaugauuacgauaaaaagaaacuagugaaggcguuuaagaaaguaggucuu

SEQ ID NO: 135250 - RNA, 45 nt, Homo sapiens
guguaacuccuucaugcaauaaacugaaaagagccaugcugucua

SEQ ID NO: 135251 - RNA, 48 nt, Homo sapiens
ugaaaccaagcaauaccgucauguuucagccaagcccagagcccuaag

SEQ ID NO: 135252 - RNA, 44 nt, Homo sapiens
aggugauaggacaucuggcuugccacaaaggucuguucgaccag

SEQ ID NO: 135253 - RNA, 47 nt, Homo sapiens
agucccuaccuacuguuuguaaccacaagugucucugugugugggug

SEQ ID NO: 135254 - RNA, 44 nt, Homo sapiens
ccaggcuauggggacaaaggccuucaccagcaagggccacaguu

SEQ ID NO: 135255 - RNA, 35 nt, Homo sapiens
ggaggacagggccagccacccucccacggccuggg

SEQ ID NO: 135256 - RNA, 50 nt, Homo sapiens
uaucauuugcauagacaccucugauccccuucagugggaaccguaguguc

SEQ ID NO: 135257 - RNA, 49 nt, Homo sapiens
cccugccgccagccggacaagcugcagaucgucgugccgaugaaaagag

SEQ ID NO: 135258 - RNA, 45 nt, Homo sapiens
cagcagcuggccaacuggcaagaugcccauuacaggcggcagcug

SEQ ID NO: 135259 - RNA, 44 nt, Homo sapiens
gcccagguaugauuuucgcuacagugaggaucgagagcaggugc

SEQ ID NO: 135260 - RNA, 42 nt, Homo sapiens
gugccugugucucagccuugguggcugauugagaucccaguu

SEQ ID NO: 135261 - RNA, 42 nt, Homo sapiens
uguugagugccgagggguaaggggaggauguggggggcagga

SEQ ID NO: 135262 - RNA, 43 nt, Homo sapiens
caugugaggcuccgugagggucaccugccugucccugcagcug

SEQ ID NO: 135263 - RNA, 42 nt, Homo sapiens
agaccaguguugucucccgggacacugacacagccgccaagu

SEQ ID NO: 135264 - RNA, 42 nt, Homo sapiens
aaucaggccugugucugccuucuccuugaauagcccagagaa

SEQ ID NO: 135265 - RNA, 68 nt, Homo sapiens
agucuagugguuccagggcccugaccaguaggugcucaauaaauguuuguuguugaaugagucauagu

SEQ ID NO: 135266 - RNA, 46 nt, Homo sapiens
cacuucuaugucucuggaccacaggauggugguggcauugcagguu

SEQ ID NO: 135267 - RNA, 55 nt, Homo sapiens
gagggggagggugacuacgaggagggcauguaugcugacugguggcaggagccgg

SEQ ID NO: 135268 - RNA, 41 nt, Homo sapiens
cgggagcugcuggaguucacccacauguaccugcagucaga

SEQ ID NO: 135269 - RNA, 39 nt, Homo sapiens
gauaaggagcccauuagguauucugggagguggcugggu

SEQ ID NO: 135270 - RNA, 41 nt, Homo sapiens
gggcugugaagcucuacaacagcggggauuuccgcagcagc

SEQ ID NO: 135271 - RNA, 45 nt, Homo sapiens
cgagucccucacggaccuagaggcccagcccuacgagguggggug

SEQ ID NO: 135272 - RNA, 45 nt, Homo sapiens
ugcagaugggggauuuugugcgcuaccacuacaacggcacuuuug

SEQ ID NO: 135273 - RNA, 42 nt, Homo sapiens
cgccguccuggaccaugcgggggcaguggggcgggcgcagca

SEQ ID NO: 135274 - RNA, 45 nt, Homo sapiens
gccccacugcccccgcaugguccaggacggcgacuuuguccgcua

SEQ ID NO: 135275 - RNA, 43 nt, Homo sapiens
aucaagggcauggaccaggggcugcugggcauguguccuggag

SEQ ID NO: 135276 - RNA, 45 nt, Homo sapiens
ccucaagacccuccugaccuggaaucgaagagggugccguccauc

SEQ ID NO: 135277 - RNA, 47 nt, Homo sapiens
augucgaggagaugaaauucucugcuucgcaggggaagggaagguga

SEQ ID NO: 135278 - RNA, 45 nt, Homo sapiens
gggccccccaggaggcgacucucggggccaacaaggugaucgaag

SEQ ID NO: 135279 - RNA, 45 nt, Homo sapiens
gggagagaggcggcagcucaucgugcccccgcaccuggcccacgg

SEQ ID NO: 135280 - RNA, 42 nt, Homo sapiens
cccgugggccaggugcgggggcacgaugagcugccgccucuc

SEQ ID NO: 135281 - RNA, 51 nt, Homo sapiens
cuccugccaaccuguuugaagacauggaccucaacaaggauggcgaggucc

SEQ ID NO: 135282 - RNA, 46 nt, Homo sapiens
cccggcucuccccugccccaguucuccaccuucaucaaggcucaag

SEQ ID NO: 135283 - RNA, 69 nt, Homo sapiens
aggagacauguuccagaaccaggaccgcaaccaggacggcaagaucacagucgacgagcucaagcugaa

SEQ ID NO: 135284 - RNA, 51 nt, Homo sapiens
ugggaacaccagagaugucuccucugccauuguuuuaguuggcuccuggac

SEQ ID NO: 135285 - RNA, 43 nt, Homo sapiens
ggagccugggguuggauagggccauggcuggucccccaccaua

SEQ ID NO: 135286 - RNA, 37 nt, Homo sapiens
auggauaacaagcucagcugugucagugauguggagg

SEQ ID NO: 135287 - RNA, 42 nt, Homo sapiens
uccaucuccccaaacuuucucuuucuuuguacuucuugucau

SEQ ID NO: 135288 - RNA, 75 nt, Homo sapiens
cuuucccuaaggaaccauagaagagaggaagaaaacaaagggcaugugugagggaagcugcuuggguggguguua

SEQ ID NO: 135289 - RNA, 49 nt, Homo sapiens
uaaacuggugucaguccuuuuuuccuuuguuccaaauaaaagauuaaac

SEQ ID NO: 135290 - RNA, 62 nt, Homo sapiens
auucuaaacuggaaauaacuucccagaguauuuggaaagguucuaaguacaaggaucaggcc

SEQ ID NO: 135291 - RNA, 44 nt, Homo sapiens
gcucuacaacgagguuguggcauaggaggaagaagcauccaccu

SEQ ID NO: 135292 - RNA, 46 nt, Homo sapiens
ugccucuucguuuucuaaacaauaacucuugggacaacaugaugcu

SEQ ID NO: 135293 - RNA, 46 nt, Homo sapiens
ucaauaagcggcaaagauuccacaucuugccacugucgagucucug

SEQ ID NO: 135294 - RNA, 46 nt, Homo sapiens
aaccaugaucacauccauguuuugcccauaacgaggcaauagugac

SEQ ID NO: 135295 - RNA, 45 nt, Homo sapiens
agaaucaacuguaauuuccaaaucugaaagccagucucuaaugag

SEQ ID NO: 135296 - RNA, 44 nt, Homo sapiens
gaaauuucuccguaucauaucagcagccuucagagcaaguuggc

SEQ ID NO: 135297 - RNA, 46 nt, Homo sapiens
cucggaaaacuggcccgagagcaggggcgugaaguacucgguggcg

SEQ ID NO: 135298 - RNA, 24 nt, Homo sapiens
gaaaucacuagaagcugugugugu

SEQ ID NO: 135299 - RNA, 49 nt, Homo sapiens
ccaaugccgaagaccgagggcaggggagggaggcggggguggacaggga

SEQ ID NO: 135300 - RNA, 45 nt, Homo sapiens
uuuuuucaauuuggcuaaugaagggcaaccacccagaacccagaa

SEQ ID NO: 135301 - RNA, 48 nt, Homo sapiens
aucacaagccaacacacucauugccucuuaggcagcucuuugggaguc

SEQ ID NO: 135302 - RNA, 42 nt, Homo sapiens
cauaguggagccagugcugagguucagaaggaggaggagaag

SEQ ID NO: 135303 - RNA, 66 nt, Homo sapiens
ggacaagaaugccucugaggacgagaucaagaaagcuuaucggaaacgggccuugaugcaccaucc

SEQ ID NO: 135304 - RNA, 44 nt, Homo sapiens
uagaacacaaacagcuccuaaaaaaugcgcagcuggaacugaag

SEQ ID NO: 135305 - RNA, 50 nt, Homo sapiens
cacagaacaguaugaagaagcaguacgagacuaugaaaaaguauaccaga

SEQ ID NO: 135306 - RNA, 47 nt, Homo sapiens
augcagugaagcuugaugacacuuacauaaaagccuacuugagaaga

SEQ ID NO: 135307 - RNA, 45 nt, Homo sapiens
uagcauaugaacuguacacagaagcccuggggauagaccccaaca

SEQ ID NO: 135308 - RNA, 86 nt, Homo sapiens
uaacauaggucucauugguauuuuugguaacucuuuuccuguccacucuguaggaagcucaaaugagcaacagauagcccagauug

SEQ ID NO: 135309 - RNA, 42 nt, Homo sapiens
ucacggugaugucacaaaugaagaauuaugauccuggcaggg

SEQ ID NO: 135310 - RNA, 47 nt, Homo sapiens
caggagagauuuucuggaucacuuaaguuugugacuacuauccaagg

SEQ ID NO: 135311 - RNA, 50 nt, Homo sapiens
agaaucucaaaacauaugcucaaucccuggcaaugcauugccuuuauuuc

SEQ ID NO: 135312 - RNA, 90 nt, Homo sapiens
gaagcagagacuuucaaggaacaaggaaaugcauacuaugccaagaaagauuacaaugaagcuuauaauuauuauacaaaagccauaggu

SEQ ID NO: 135313 - RNA, 41 nt, Homo sapiens
guagcaagauuucaguugguucuuuaaaucuugcaauuggg

SEQ ID NO: 135314 - RNA, 60 nt, Homo sapiens
uucgacuaacaagcuuuauacugcugacacagugucuccccagguaccuagaugucuucg

SEQ ID NO: 135315 - RNA, 61 nt, Homo sapiens
uuuauagaggauacuguauggaaaguaccuggccucaguaguuauuaguaacuguccacca

SEQ ID NO: 135316 - RNA, 51 nt, Homo sapiens
cucgacuggucucgcagggucaggcccacugguuaaagcuuguuguguauu

SEQ ID NO: 135317 - RNA, 47 nt, Homo sapiens
guuugcccugagacaguuaaccaccuguugaacuaaggaaccaagac

SEQ ID NO: 135318 - RNA, 56 nt, Homo sapiens
uuaaccaucucucuugauucuaauauuacuuuuggagagagugugaggggcaagca

SEQ ID NO: 135319 - RNA, 47 nt, Homo sapiens
agugcgaugugguaauggcggcgaccgagccggagcugcucgacgac

SEQ ID NO: 135320 - RNA, 37 nt, Homo sapiens
gacacacuccaaggucggaaagguagcaguggggacu

SEQ ID NO: 135321 - RNA, 49 nt, Homo sapiens
cugcaggaucggguccggaggacccuuggcuggagugucucaagcugag

SEQ ID NO: 135322 - RNA, 69 nt, Homo sapiens
agaauccgagguggagacauuccaggucagggcugcggcccaaagaugggccuacuugucaaugaggcc

SEQ ID NO: 135323 - RNA, 50 nt, Homo sapiens
ggcaguacucgcuguccgggggguuguacucgcgacaguuggcgaugacc

SEQ ID NO: 135324 - RNA, 45 nt, Homo sapiens
uucuucacaggcuccaugaagggccaggcacuggggugagacugg

SEQ ID NO: 135325 - RNA, 25 nt, Homo sapiens
ucuugaugaugugggacagcuccgu

SEQ ID NO: 135326 - RNA, 41 nt, Homo sapiens
gggcagugagaaguaagaaugcucaaaggaugaaccucaga

SEQ ID NO: 135327 - RNA, 42 nt, Homo sapiens
ugcgaugccccggguccuucggcacaggcaccuggcccagug

SEQ ID NO: 135328 - RNA, 44 nt, Homo sapiens
gcucugcuccccacuacgagguguuuguggcgcugagggggcug

SEQ ID NO: 135329 - RNA, 45 nt, Homo sapiens
cgggcaguggggcagugggcgggggccaagcugcuggaccauggc

SEQ ID NO: 135330 - RNA, 46 nt, Homo sapiens
gccgccugggugauguggugcgagugguuggugccuacaaucagug

SEQ ID NO: 135331 - RNA, 46 nt, Homo sapiens
cauucaugagagggagccucuggcagaggugaaaagaccggcaggg

SEQ ID NO: 135332 - RNA, 44 nt, Homo sapiens
cugaggcgccuaccugcauucugccaccccucacacagccaaac

SEQ ID NO: 135333 - RNA, 45 nt, Homo sapiens
guugaccucggagugcgcuaccucccccaugugaggagcugagaa

SEQ ID NO: 135334 - RNA, 35 nt, Homo sapiens
cucaguuaucccugggaaugggacacugggugaga

SEQ ID NO: 135335 - RNA, 69 nt, Homo sapiens
gggaggccagguccuuuccugcccagcgaugucagcguuuccucaggggccaggcacucaucaggagaa

SEQ ID NO: 135336 - RNA, 54 nt, Homo sapiens
uauuagcugcaugggaguaugguuuacacuagaguagaagagcugggagcauca

SEQ ID NO: 135337 - RNA, 91 nt, Homo sapiens
uggucuaucucuauccugacauucccaaggaggaggcauucggaaaguauugucggccagagagccaggagcauccugaagcugacccagg

SEQ ID NO: 135338 - RNA, 44 nt, Homo sapiens
aggaggcgucacuuucacuuggguggagaaggacaucagcggua

SEQ ID NO: 135339 - RNA, 32 nt, Homo sapiens
gaccuagagguaaguucugcagcagaaucggu

SEQ ID NO: 135340 - RNA, 38 nt, Homo sapiens
cucucugcagaauucaaacacuugguaugugggaggag

SEQ ID NO: 135341 - RNA, 26 nt, Homo sapiens
gugugcauugacaaguaaguacuccu

SEQ ID NO: 135342 - RNA, 41 nt, Homo sapiens
ggaccccauuguacagcaccggccgaugcuggaggagagaa

SEQ ID NO: 135343 - RNA, 42 nt, Homo sapiens
ggagcuggcugacuggaagaggcggcaacagauugccugcau

SEQ ID NO: 135344 - RNA, 45 nt, Homo sapiens
gaaucuccaggaugacuuugauuucaacuauaaaacccucaagag

SEQ ID NO: 135345 - RNA, 46 nt, Homo sapiens
gugacggagaagcagcagaugcuggagcagcaccuucaggaugucc

SEQ ID NO: 135346 - RNA, 42 nt, Homo sapiens
agugacagcuucccaauggagcugcggcaguuucuggccccu

SEQ ID NO: 135347 - RNA, 45 nt, Homo sapiens
acuuuuaugccuggcauuuuucuuuccuucucuguugucccagac

SEQ ID NO: 135348 - RNA, 50 nt, Homo sapiens
uuauuuuccccuguagaauaacuauuaaaguauuaccuauggugauuaga

SEQ ID NO: 135349 - RNA, 65 nt, Homo sapiens
gaaggaaggcaugugugagggccaguggcaggcaggagccugguguuuuugaggaccugaagaag

SEQ ID NO: 135350 - RNA, 62 nt, Homo sapiens
aaugauuagaguugguugugucucaggaagaagccaacaggaggaaccuuauuuugagucag

SEQ ID NO: 135351 - RNA, 108 nt, Homo sapiens
cuggcccagcccuuauugauuaugguguaaagaauuaauauggugguuauauacucuuuguuagacaccuuggcuuacaagacguaagcguaaaguguagugcgcuuu

SEQ ID NO: 135352 - RNA, 42 nt, Homo sapiens
cauccccgaauccugaagaacuucugguguucuggagcagcc

SEQ ID NO: 135353 - RNA, 38 nt, Homo sapiens
guccaaaccuucuuagcuuaugguuuucuuaggugaug

SEQ ID NO: 135354 - RNA, 44 nt, Homo sapiens
ucuuuuauauguggauuuagacuguguuaugacuugguucagcc

SEQ ID NO: 135355 - RNA, 52 nt, Homo sapiens
gggggccucugggaccuuggggauguugugauggacgcugcaguggggccgg

SEQ ID NO: 135356 - RNA, 44 nt, Homo sapiens
cuuucucgguucucuucucuccucugaauggcugaagaccccuc

SEQ ID NO: 135357 - RNA, 52 nt, Homo sapiens
agguucucaagacacgaguccccuuguuccuccccauuaaaggggguuuguc

SEQ ID NO: 135358 - RNA, 203 nt, Homo sapiens
ugcagcuuuaggauacuagcucuagggaaggauuuuuuccuuuuuaaacagcguaucacucuguugccuaggauggagcacagaggcacccucauagcucacugcagccucaaacuccugggcucuggcgauccucccgccucagccucccaaguagcugagaccacaggcacgugccaccaugcuccuagggaaggagcuug

SEQ ID NO: 135359 - RNA, 43 nt, Homo sapiens
cagaaaauuagggucccagaagggggcagcagcaggcugggag

SEQ ID NO: 135360 - RNA, 48 nt, Homo sapiens
cacacuguccucccucuugauucugaaaaaugguccugcugcccaugg

SEQ ID NO: 135361 - RNA, 50 nt, Homo sapiens
ucuuacugugguucuccaugggcagcaggaccauuuuucagaaucaagag

SEQ ID NO: 135362 - RNA, 90 nt, Homo sapiens
gcaugugagggauggcacacugauguguuuaugcaccuguacacaggagcgcauggccauggcuuuggaaaggagaauggaaaaauagaa

SEQ ID NO: 135363 - RNA, 116 nt, Homo sapiens
gagcagaaugagcccucacccuggcuggggguccagcacaggcuguaucugcagagggucccagaggaacgcuggagccaagagaagcccugggaaggagggguggggaacgacau

SEQ ID NO: 135364 - RNA, 49 nt, Homo sapiens
auucucacccugaucccugggggacucaaagccaaaacugcccaaagag

SEQ ID NO: 135365 - RNA, 46 nt, Homo sapiens
aggugccacccuucaccuuccacgucaagaagauccgcgagggcca

SEQ ID NO: 135366 - RNA, 110 nt, Homo sapiens
gacgcgccucaagaccaaggaaaaccuggagaagacgcggcacacccuggagaagcgcaugaacaagcugggcacgcgccuggugcccgccgagcggcgcgagaaacuga

SEQ ID NO: 135367 - RNA, 61 nt, Homo sapiens
cgcguggacgacuucaagaaggccuucuccaaggagaagauggagaagaccaaggugcgua

SEQ ID NO: 135368 - RNA, 25 nt, Homo sapiens
agugaagcugccggccaaacugagc

SEQ ID NO: 135369 - RNA, 31 nt, Homo sapiens
cgaauggugacuaaacagaccgcgggagcag

SEQ ID NO: 135370 - RNA, 84 nt, Homo sapiens
uaauugcacuugggcuaaaaucucuguggucguccaacccuguccugaucccuuuccacccguagaugauauuaaaccacuacg

SEQ ID NO: 135371 - RNA, 46 nt, Homo sapiens
uucuaucccaaaguagggaagucacaaccagaagaaauguccagac

SEQ ID NO: 135372 - RNA, 45 nt, Homo sapiens
ccaggaaaaccagccagcucagccuuuaggggugggguggagcag

SEQ ID NO: 135373 - RNA, 33 nt, Homo sapiens
agagggccaucaugaggcucaggccuggggucu

SEQ ID NO: 135374 - RNA, 46 nt, Homo sapiens
guggacgggugccggguacugugagaacacuggcguuaugcaaagu

SEQ ID NO: 135375 - RNA, 46 nt, Homo sapiens
ccaagaagaagccgaaugcacccucugaccuggccacacccaagau

SEQ ID NO: 135376 - RNA, 693 nt, Homo sapiens
uugaucuuuacaauaugaaaaauaaaaauaaaaaggccgcguggcucacgccuguaaccccagcacuuugggcggccaaggcaggaguaucacuuaugcccaggaauucgagaccagccuaagcaacaguggggacccucuagaaaaaacauuuaggcugagcacaguggcucccaccuguaauuccagcacuuugggaggcugaggcagguggaucaccugaggucaggaguucgagaccagccuagccaacauggugaaaccccgucucugcuaaaaauacaaaaauuagccaggugugguggcacaugccuguaaucccagcuacuuaggacggugaggcaugaaaauugcuugaauccaggagguggagguuacagugagcugagaucacgcuacugcacuccggccugggugacagagcaagacucugucaaagaaagaagagagagagagagagagagaaaagaagaaaagaagaaggaaagaaggccggaaggaauuuaaaaauuagcugggcaugguggcuugugccuguaguaccagcuacuugggaggcugagauggugagaugggaggauugcuugagccuaggaguuugaggcugcagugagcuaugauaccaccacuccagccugggcugcagagcuaagauccuuucucaaaaaaaaaaaaaaaaaaaaaaaaagggag

SEQ ID NO: 135377 - RNA, 54 nt, Homo sapiens
acccaacauccucccccuucagccggacuuuaccauaaaugcugcugcccccaa

SEQ ID NO: 135378 - RNA, 47 nt, Homo sapiens
aggcgcacgccaccacgagcaauacggugagcaagcugcuggagaag

SEQ ID NO: 135379 - RNA, 47 nt, Homo sapiens
agauccagcugacucaagcacagcuggaggagcggcaggcggagaug

SEQ ID NO: 135380 - RNA, 59 nt, Homo sapiens
cucuauauugucgagcggccgcuucccggguaccccgacgccgaggccccggagccuuc

SEQ ID NO: 135381 - RNA, 97 nt, Homo sapiens
agccgugcgggaccggccggguggggcuggagcuggagcgggagacccggagagaagcaggagcggaagggaggagagcuagcgggcgagagcggag

SEQ ID NO: 135382 - RNA, 80 nt, Homo sapiens
ucucuccgggucucccgcuccagcuccagccccacccggccggucccgcacggcuccggguagccauggaggaccccacg

SEQ ID NO: 135383 - RNA, 44 nt, Homo sapiens
gggagccucuuccugcgagagcugaucaaagaguuuggcacaga

SEQ ID NO: 135384 - RNA, 42 nt, Homo sapiens
acagucccuacuacauucacguccagcacagaggccacggcg

SEQ ID NO: 135385 - RNA, 42 nt, Homo sapiens
cgucagaauccuacugaccaauauccgaaccaagagcaccuu

SEQ ID NO: 135386 - RNA, 45 nt, Homo sapiens
acggacauuauguggccaauuaucgcaaagcuggcccgagaggag

SEQ ID NO: 135387 - RNA, 25 nt, Homo sapiens
ugaagccggcuggcagaaccugguc

SEQ ID NO: 135388 - RNA, 41 nt, Homo sapiens
gugcuuucuacaaaaagcccuggaaaagagaggccccaauc

SEQ ID NO: 135389 - RNA, 47 nt, Homo sapiens
gugcaaaaacugaauguagucaauggcuagggugggggcaagaaaaa

SEQ ID NO: 135390 - RNA, 59 nt, Homo sapiens
ggagggugugcaaugaaguugccucagaaguucugguuccccccauucagcaccccucu

SEQ ID NO: 135391 - RNA, 26 nt, Homo sapiens
ugcugcagcagcuccgcccacccaag

SEQ ID NO: 135392 - RNA, 46 nt, Homo sapiens
uuaaguaucuuuuguacgcuuuucaccccacccccaaguccuggga

SEQ ID NO: 135393 - RNA, 49 nt, Homo sapiens
ggucugggcuggagaauauaaauuugauauguguguuuagagaaucgga

SEQ ID NO: 135394 - RNA, 41 nt, Homo sapiens
uacagggagaaaagauccaugaggacauuuuugacaucaua

SEQ ID NO: 135395 - RNA, 42 nt, Homo sapiens
ccuaagaagcuggugcagacauacucaguguuucccaaccag

SEQ ID NO: 135396 - RNA, 45 nt, Homo sapiens
auugccacagaccgccugcacauccagaacccauccuucucccag

SEQ ID NO: 135397 - RNA, 46 nt, Homo sapiens
gugucuaccaucaugucagccagcaccaccacccugcgcuacccug

SEQ ID NO: 135398 - RNA, 53 nt, Homo sapiens
ccaccccacggcuccacuuccucaugaccggcuacaccccucucacuacggac

SEQ ID NO: 135399 - RNA, 58 nt, Homo sapiens
uccuggaugucaugaggcggcugcugcagcccaagaacgugaugguguccacaggccg

SEQ ID NO: 135400 - RNA, 42 nt, Homo sapiens
ccguggggccccgccagcauccagguggcccugucgaggaag

SEQ ID NO: 135401 - RNA, 30 nt, Homo sapiens
uguuccacuggccaccuucaucaucuuccc

SEQ ID NO: 135402 - RNA, 49 nt, Homo sapiens
acagccagcgacugucugagaccugcugggcccuagggacaaucaccga

SEQ ID NO: 135403 - RNA, 23 nt, Homo sapiens
uuguuaagugcuuacuaugaguc

SEQ ID NO: 135404 - RNA, 64 nt, Homo sapiens
gauuugaagaaaguuuuccaacuuuugggagacuucaacucauccuucaacuucugggagacua

SEQ ID NO: 135405 - RNA, 46 nt, Homo sapiens
gagaaaauucaugaagacaucuuugacaucauagaccgagaagcag

SEQ ID NO: 135406 - RNA, 45 nt, Homo sapiens
auugccacagaccgccugcacauccagaacccguccuucucccag

SEQ ID NO: 135407 - RNA, 46 nt, Homo sapiens
guguccaccaucaugucggccagcaccaccacccugcgcuaccccg

SEQ ID NO: 135408 - RNA, 51 nt, Homo sapiens
accccacggcuccacuuccucaugaccggcuacaccccgcucacuacagac

SEQ ID NO: 135409 - RNA, 46 nt, Homo sapiens
accacgguccuggaugucaugaggcggcugcugcagcccaagaacg

SEQ ID NO: 135410 - RNA, 42 nt, Homo sapiens; identical to SEQ ID NO: 135400

SEQ ID NO: 135411 - RNA, 46 nt, Homo sapiens
uggccuuggcucccaagcccaggcacagcuucuguggagcaccccg

SEQ ID NO: 135412 - RNA, 45 nt, Homo sapiens
gggacacagagcugcgcccugggaggaaggcaugaaccaggggaa

SEQ ID NO: 135413 - RNA, 42 nt, Homo sapiens
ccuggcguggggagcagaggcggacacuguguuuccgaccag

SEQ ID NO: 135414 - RNA, 45 nt, Homo sapiens
ggggaaagaugaggugggaggagcagaagggagaagaggacaggg

SEQ ID NO: 135415 - RNA, 42 nt, Homo sapiens
uagccagacgcugaggggggcucagugucugggcccccggag

SEQ ID NO: 135416 - RNA, 61 nt, Homo sapiens
gaggucuggaagcuuacgagaaucaguuggcagggaaauguaccaggaaagcuugguacaa

SEQ ID NO: 135417 - RNA, 44 nt, Homo sapiens
gucccggaacucgccuucaccgaagggaccuucucagccgcugc

SEQ ID NO: 135418 - RNA, 49 nt, Homo sapiens
cucacugcucgcucgcucccucccucugugccguccgcccgcccgccgg

SEQ ID NO: 135419 - RNA, 44 nt, Homo sapiens
caggcagcaggcugccggcgggcgggcggacggcacagagggag

SEQ ID NO: 135420 - RNA, 33 nt, Homo sapiens
cacugguuggaaauggccugacuacaaaucaag

SEQ ID NO: 135421 - RNA, 56 nt, Homo sapiens
ugcaguuccugccaggagguaggaaaauggacagcuuagugcuugcaugcaggcug

SEQ ID NO: 135422 - RNA, 45 nt, Homo sapiens
uguaugaccaagugcugaguuaggcagugcagguuauggaugcug

SEQ ID NO: 135423 - RNA, 47 nt, Homo sapiens
cagggacuguuugguaguccagugcuaauagaacuuucuguagugau

SEQ ID NO: 135424 - RNA, 45 nt, Homo sapiens
cuucuuugaugaggaccccuccaucuucuccccuggcagugucua

SEQ ID NO: 135425 - RNA, 45 nt, Homo sapiens
accacggcuucuaguccugaggguguggcgggcggcgugguuagg

SEQ ID NO: 135426 - RNA, 40 nt, Homo sapiens
uaauuuacaggucaacagcuuuggcuaaaggauuggaggu

SEQ ID NO: 135427 - RNA, 45 nt, Homo sapiens
ugugcccuggagcccugagcaccagcugcagaggcugcaggugac

SEQ ID NO: 135428 - RNA, 46 nt, Homo sapiens
cccucuggggguagauaggcaaugggcgauaugaugggaaauguca

SEQ ID NO: 135429 - RNA, 56 nt, Homo sapiens
acugaaggaauugaaagaccaguagaugcuccucuacucuuugagacaucucuggc

SEQ ID NO: 135430 - RNA, 46 nt, Homo sapiens
uggcuccuauugcuuguuugcugccagccuucuccucggccccaga

SEQ ID NO: 135431 - RNA, 47 nt, Homo sapiens
cagcugccuuuguguguuugugucaauaaaaagccaaacccuggguc

SEQ ID NO: 135432 - RNA, 46 nt, Homo sapiens
ggcagcuuaucaaacucagcccaaaacucuguuuacaugggugggg

SEQ ID NO: 135433 - RNA, 45 nt, Homo sapiens
ucagugccuuagcaacgaaaaccugugcuuguguguguguggcgg

SEQ ID NO: 135434 - RNA, 46 nt, Homo sapiens
gccucugggcuugaccaguucccaaucucguccucuguccccaacu

SEQ ID NO: 135435 - RNA, 66 nt, Homo sapiens
cagagaaggagaacuagggcaaguggcugugagacccuagagaccagcgaagggagaaguugggaa

SEQ ID NO: 135436 - RNA, 369 nt, Homo sapiens
uucuuuuuuuuuucuuuuucuuuuuuuuuuuuuuuuuuuuuagacggaguuucgcucuuguugcccaggcuggagugcaauggcgcgaucucggcucaccgcaaccucugccucccggguucaagcgauucuccugccucagccucucgaguagcugggauuacaggcaugcgccaccaugccuggcuaauuuuguauuuuaguagagauggguuucuccaugucggucagucuggucucgaacucccgaccucaggugaucugcccaccucggccucccuaagugcugggguuacagacauaagccacugcgcuuggccaggaguuuccuuuuuaaaucagaccccucaaugagaggccccacagaug

SEQ ID NO: 135437 - RNA, 36 nt, Homo sapiens
acagcuucauaaauaauuuugcuugcugaaggaaga

SEQ ID NO: 135438 - RNA, 69 nt, Homo sapiens
uaccugauaccccagaucccccacagccacuacugacugcagccagccacagguacagagccacaggac

SEQ ID NO: 135439 - RNA, 906 nt, Homo sapiens
caaggccuuauguccugaagcauugccuuuuuuuuuuuuuuuugagguggagucucacucugucacuuagcaggcuggagugcaguggcccagucuuggcucacugcaaccuccgccuccuggguuuaaaugauucuccugccucagccucagggcggaucaccugacaucaggaguuugagaccagccuggccaauauggcgaaaccccaucucuacuaaaaauacuaaaaaaaauuagccaggcaugguggcacgcacuuguagucccagcuacuugggagacugaggcaggagaaucgcuugaacccaggauguugagguugcagugagcugagaucacaccaucacaauccagccugagugacagagugagacuccaucugaaaaaaaagaaaaaacaauuagccuggcaugguggcaggcaccuguaaucccugcuacuugggaggcugaggcaggagaauugcuugaacccgggagguggagguugcagugagcugagaucgugccauugcauuccaggcugagcaacaagagcaagacuccgucucaaaaaaaaaaaaaaaaaaaaaaaaaggccaggugcaguggcucacgccuguaaucccagcacuuugggaggccaagguggguggaucaccugaggucaggaguuccagagcagccuggccaacauugugaaacccccgucucuacuaaaaauacaaaaauuagcugggugugauggcaugugccuguaauuccagcuacucaggaggcagagacaggagaauugcuugaacccaggaggcggagguugaaugagccgagauugcgccaucacacucuagccucggcgacagagcaagacuccgucucaaaaaaaaaaaaaaaaaauuagcuucuaccucauuaauccuaagaa

SEQ ID NO: 135440 - RNA, 43 nt, Homo sapiens
gaucccacgauggggguuccucagauugcugaaauguucuaga

SEQ ID NO: 135441 - RNA, 55 nt, Homo sapiens
auccuugugguaauuggugguguggagaugguuaaaaacaagguugguuugggau

SEQ ID NO: 135442 - RNA, 77 nt, Homo sapiens
aaugcaacaguaaauaagacuaacuaagucccugguaggauucagguucugucgaggggagauacacaauaaagaug

SEQ ID NO: 135443 - RNA, 651 nt, Homo sapiens
ugaggaucaucaagaauuaugcaggccugcacuguggcucauaccuauaaucccagcgcuuugggaggcugaggcgcuuggaucaccugaugucgggaguucaagaccagccugaccaacauggagaaaccccguuucuacuaaaaauacaaaauuagccgggcuugguggcacuugccuguaauuccagcuacucgggaggcugaggcaggagaaucacuugaaccugggaggcggggguugcagugagcugagaucgcaucauugcacucuaaccugggcaacaagagcaaaacuccaucaaaagaaaaaaaaaaucgggugcaguggcucaugccuguaauccuaacacugugggaggccaagacaggcagauugccugagcucaggaguucgagaucagccugggcaacauggugaaacccugucucuacuaaaauacaaaaaauuacucagcgugguggcaugcgccuuuaguuccagcuacucaggaggcugaggcaggagaaucucuugaacccgggagguggagguugcaaugagccaagaucgugccacugcacuccaaccuggcaacagagcgagacuccgucuuaaaaaaaaaaaaaauuuugcagcgcaaaccaggauauccucuguucucauuuguuc

SEQ ID NO: 135444 - RNA, 46 nt, Homo sapiens
uaccuuaagcuauagguuugcaucaaaguuaaugaaagguaaaaag

SEQ ID NO: 135445 - RNA, 366 nt, Homo sapiens
gugugggccaggcacgguggcucacaccuguaaucucagcacuuugggaggccgaggcggguggaucaccugaggucaggaguucgagaccagccuggccaacguguugaaaccccgucucuacuaaaaauauaaaaauuaggugggcgugguggcaggcaccuguaaucccagcuacucaggaggcugaggcagcagaaucgcuugaacccaggagguggagguugcagugacccaagaucgcaccauugcacuccagccuggggacaagagcgagauucuugucucaaaaaaaaaaaaaaaaaaaaaagguuuggaggguggugagcugagauagucaacuauuaacuccuaucuaccugcugg

SEQ ID NO: 135446 - RNA, 397 nt, Homo sapiens
accccuguaauuaauugucauugucaucacuucauaauaaaaauaauugcauggccgggcaugguggcucaagccuguaaucccagcacuuugggaggcugagguggucagaucaccuaaggucaggagaucaagaccagccugaccaacaugaagaaaccccaucuuuacuaaaaauacacaauuagccgggcgugguggcgcaugccuauaaucccagcuacucaggaggcugaggcaggagaauugcuugaacccgggaggcggagguugcggugagccgagauugcaccauugcacuccagccugggcaacaagagcgaaacucugucucaauaauaagaagaagaauugcgugaauauuucuuuaaaacuaugaugagauaacauaccagau

SEQ ID NO: 135447 - RNA, 42 nt, Homo sapiens
acaaaagaauguccaugguggugucuggccugaccccagaag

SEQ ID NO: 135448 - RNA, 45 nt, Homo sapiens
guauuaacuucacagaaaaguagugaauacccuauaagccagaau

SEQ ID NO: 135449 - RNA, 44 nt, Homo sapiens
uuuuuucuuucaugucugacacucaugucuuguuuacccccgac

SEQ ID NO: 135450 - RNA, 60 nt, Homo sapiens
cacucccuagcuuuaaaagaaaauaaccaacuucaaaaggacaucacaauaacaucaagu

SEQ ID NO: 135451 - RNA, 41 nt, Homo sapiens
ucagaugaugaagaaagaggaacgggcuuggaagaaaauaa

SEQ ID NO: 135452 - RNA, 29 nt, Homo sapiens
uacacauuuggcucaggguuaccgaagag

SEQ ID NO: 135453 - RNA, 44 nt, Homo sapiens
gguagaaacagagggccaaaauugaaugcuaugcuuagauuagg

SEQ ID NO: 135454 - RNA, 46 nt, Homo sapiens
uugaggaacauucaaugucaccugaaagagaaaugggaaaugagaa

SEQ ID NO: 135455 - RNA, 51 nt, Homo sapiens
caaaguccaaaagucacuuuugaaugugaacaaaaggaagaaaaucaagga

SEQ ID NO: 135456 - RNA, 49 nt, Homo sapiens
auccauugggacaugaaguuaaccacagucgggaaacaagcauagaaau

SEQ ID NO: 135457 - RNA, 46 nt, Homo sapiens
gcaaaaacagaaccaaauaaaugugugagucagugugcagcauuug

SEQ ID NO: 135458 - RNA, 28 nt, Homo sapiens
uggagaaaggguuuugcaaacugaaaga

SEQ ID NO: 135459 - RNA, 46 nt, Homo sapiens
aauaccagugaacuuaaagaauuugucaauccuagccuuccaagag

SEQ ID NO: 135460 - RNA, 65 nt, Homo sapiens
caacucauggaagguaaagaaccugcaacuggagccaagaagaguaacaagccaaaugaacagac

SEQ ID NO: 135461 - RNA, 46 nt, Homo sapiens
cccaccuaauuguacugaauugcaaauugauaguuguucuagcagu

SEQ ID NO: 135462 - RNA, 42 nt, Homo sapiens
auggaacucgaauuaaauauccacaauucaaaagcaccuaaa

SEQ ID NO: 135463 - RNA, 30 nt, Homo sapiens
gaugaauauuacuaauaguggucaugagaa

SEQ ID NO: 135464 - RNA, 51 nt, Homo sapiens
gccauguaacugaaaaucuaauuauaggagcauuuguuacugagccacaga

SEQ ID NO: 135465 - RNA, 48 nt, Homo sapiens
aaccagucucaguguccaacucucuaaccuuggaacugugagaacucu

SEQ ID NO: 135466 - RNA, 45 nt, Homo sapiens
gcuauaauuuugcaaaaaaggaaaauaacucuccugaacaucuaa

SEQ ID NO: 135467 - RNA, 25 nt, Homo sapiens
ugugcuugagggggauccugagaug

SEQ ID NO: 135468 - RNA, 62 nt, Homo sapiens
uccgaggaggaauccuccugauaggaacuggaaugugccuugaaggggacaccauguguaua

SEQ ID NO: 135469 - RNA, 50 nt, Homo sapiens
agauaccuacaacuccuaggaagacuacgauucccauccagccccacgag

SEQ ID NO: 135470 - RNA, 46 nt, Homo sapiens
uucauuugaucugaauacuauucaaauaaaauaccuggaugaggaa

SEQ ID NO: 135471 - RNA, 42 nt, Homo sapiens
uaauucacuguugcuuuuuuuccuuuuauagguauccaucaa

SEQ ID NO: 135472 - RNA, 45 nt, Homo sapiens
guuuuuuauauauaggaugaugccuuugaauggacccuaaggaca

SEQ ID NO: 135473 - RNA, 48 nt, Homo sapiens
uuuaacuauaauauguuccucauguuguacaguccaucuuuaggauug

SEQ ID NO: 135474 - RNA, 22 nt, Homo sapiens
ggaaaaguaaaugcuuaauuau

SEQ ID NO: 135475 - RNA, 42 nt, Homo sapiens
caguaucauaguagauccuuuccccuccgaagagagcccuga

SEQ ID NO: 135476 - RNA, 42 nt, Homo sapiens; identical to SEQ ID NO: 38265

SEQ ID NO: 135477 - RNA, 82 nt, Homo sapiens
aaauugguugcuuucauccuuuagugacauuugccuugccugaaggaccacuuggaaaugagaaggaggagauuauccauau

SEQ ID NO: 135478 - RNA, 41 nt, Homo sapiens
cagcucugcgcucucacagccaggccuggagcgaggugcug

SEQ ID NO: 135479 - RNA, 50 nt, Homo sapiens
uuccgucuuauucuuguuucuucuaaaggcuuugagcaacacugaacaaa

SEQ ID NO: 135480 - RNA, 65 nt, Homo sapiens
aguaauuuugcauacauuuuuauuuaagggaaaaaauauagguauugugaaauauuuugcuaauc

SEQ ID NO: 135481 - RNA, 43 nt, Homo sapiens
augcuugaaguccguucacagguaucuagcccuagaaugccua

SEQ ID NO: 135482 - RNA, 58 nt, Homo sapiens
ccagguucucacucuguuuacagaaguguguugaguacaguuggugaaggaagaggua

SEQ ID NO: 135483 - RNA, 75 nt, Homo sapiens
agggagauacuuaacuauccuuggguucccugcaaaaaccugcccuccuucccugguuguauucuccagccccuu

SEQ ID NO: 135484 - RNA, 43 nt, Homo sapiens
agcaaggguucaggguccccagccucugcuuguuuggaccuug

SEQ ID NO: 135485 - RNA, 35 nt, Homo sapiens
guguuggcaagagugcaaaaguccagggaagccag

SEQ ID NO: 135486 - RNA, 23 nt, Homo sapiens
acagcagcagaugcugcgaugac

SEQ ID NO: 135487 - RNA, 45 nt, Homo sapiens
accaccuuugauacuuuuaaggcuucucucgucaaaaauggugca

SEQ ID NO: 135488 - RNA, 46 nt, Homo sapiens
aacaagauccaguuguuaaaccuaaaacagaaaaagaaaagcugaa

SEQ ID NO: 135489 - RNA, 28 nt, Homo sapiens
aggagcaggagucagaguccccccaaag

SEQ ID NO: 135490 - RNA, 45 nt, Homo sapiens
gcgggagggucguguggccaauguagcugaugucgugagcaaagg

SEQ ID NO: 135491 - RNA, 46 nt, Homo sapiens
ggccaaagaaaggcgggaacucaaacaggcccagcgggaagcugag

SEQ ID NO: 135492 - RNA, 445 nt, Homo sapiens
acugggagauguugaaaaguucuuuuguuguuguuguuuuuguuucugagacagaguuuugcucuuguugccuaggcuggagugcaacaccaugaucuugacucacugcaaccuccaccucccugguucaagugauucuccugccucagacucccagguagcugggauuacaggcaugcaccaccacgccuagcuaauuuuuuguauuuuuaguagagacgagguuccuccauguuggucaggcuggucucgaacucgcgaccucaggugaucccccccccaucucagccucccaaagugccgggauuacaagugugagccaccgugcccagccagauguugaaaguuugcagcuggcacauggcaugaccagaguugcauuuccaaaggaugauugagggugcccugcagaaugaguuggauggggcacaugugaugauuuaga

SEQ ID NO: 135493 - RNA, 40 nt, Homo sapiens
aagagagagaaugguggcuugaacauggagguagcaaaga

SEQ ID NO: 135494 - RNA, 41 nt, Homo sapiens
guuucugguaugagcacuaggaugaaugaugggaacacugg

SEQ ID NO: 135495 - RNA, 72 nt, Homo sapiens
uggaagaagcaugccuuugggggcaacaaagccucuuacggaaaaaagacccagaugucaauccuugagcag

SEQ ID NO: 135496 - RNA, 47 nt, Homo sapiens
uuaggugggcuacaccauucgauuugaggacugcacuagcccugaaa

SEQ ID NO: 135497 - RNA, 45 nt, Homo sapiens
guggaagaacagugacagugccaagcugagacuaauaauccucca

SEQ ID NO: 135498 - RNA, 44 nt, Homo sapiens
uuucucauagccauagccuuguggaggaaauuggggguugcuca

SEQ ID NO: 135499 - RNA, 42 nt, Homo sapiens
cuguguggagguacauugaugcgcacccggugacaucugugg

SEQ ID NO: 135500 - RNA, 35 nt, Homo sapiens
gcccugugcacgcgcgcgugugugugugugugugu

SEQ ID NO: 135501 - RNA, 42 nt, Homo sapiens
gauuugucugggggggucauaggcacuggaguugagaaggag

SEQ ID NO: 135502 - RNA, 46 nt, Homo sapiens
ggucugugcggggacucuggggcuccuucuugauccuggugguggg

SEQ ID NO: 135503 - RNA, 49 nt, Homo sapiens
aaagcucugccuguaaauuggagcugggcaugcaggacuugcagggucg

SEQ ID NO: 135504 - RNA, 49 nt, Homo sapiens
acuuuuguuguucuuuuggcuuggacaguaaauuguuuggugcuggggg

SEQ ID NO: 135505 - RNA, 58 nt, Homo sapiens
gucuccuggaagugacuuagauccuggaagagaucugagggguaaauaguggaauugg

SEQ ID NO: 135506 - RNA, 50 nt, Homo sapiens
uguggcggaggagggucgcgguuugucucucuugcucuuuaccuucagag

SEQ ID NO: 135507 - RNA, 45 nt, Homo sapiens
uccaaguauccggcuuucauccuccgcuccauccggccgcucccu

SEQ ID NO: 135508 - RNA, 22 nt, Homo sapiens
gcggaggcggguggugagagug

SEQ ID NO: 135509 - RNA, 41 nt, Homo sapiens
gcuucaucuagaagcagagaggguugaaaucuaacaggagg

SEQ ID NO: 135510 - RNA, 46 nt, Homo sapiens
caggcuagaaagaacaacgugcuauugucuuuacucagcccucaga

SEQ ID NO: 135511 - RNA, 60 nt, Homo sapiens
cucugacugugcucuggugguuucuccuugccuagagcacucuccccuuccccguacuuc

SEQ ID NO: 135512 - RNA, 42 nt, Homo sapiens
cgaaagucucugugggggcaugagggagaaaaggccauuggg

SEQ ID NO: 135513 - RNA, 61 nt, Homo sapiens
cugcucccugaagcuggauucuuucauacgauacucuuucucaagaagggggcucccuggg

SEQ ID NO: 135514 - RNA, 41 nt, Homo sapiens
guaacccuguaaaguuaguagagcuuguucuuguauuguga

SEQ ID NO: 135515 - RNA, 40 nt, Homo sapiens
cagggguccucaccacaggucugggcccuccgaccugcgg

SEQ ID NO: 135516 - RNA, 46 nt, Homo sapiens
uucuuugaugucagcaauggcagucaggaaguuggccgcacaaaga

SEQ ID NO: 135517 - RNA, 70 nt, Homo sapiens
cuuuccacagggucauaaaggauuucaugauuuaggguggagauuuuguuaauggagaugguacuggagu

SEQ ID NO: 135518 - RNA, 46 nt, Homo sapiens
gacacucagcuccaggccugcuuuccacggcaaacagcggucccag

SEQ ID NO: 135519 - RNA, 51 nt, Homo sapiens
gaaccaccuaaguuagccugucuggccaacacugagguuuggccucugaug

SEQ ID NO: 135520 - RNA, 41 nt, Homo sapiens
cccucagggagccccagucugagucaaagaggacagagaca

SEQ ID NO: 135521 - RNA, 41 nt, Homo sapiens
cuccucccuccgaccuuggacuccgggacaucuuuggggga

SEQ ID NO: 135522 - RNA, 45 nt, Homo sapiens
caccacugcagcaggucugucuccaccgagacgaugccgccguag

SEQ ID NO: 135523 - RNA, 44 nt, Homo sapiens
uucgcucggcguucuugaacagggucccggacccuggaggagga

SEQ ID NO: 135524 - RNA, 65 nt, Homo sapiens
gcagggcugggaugcggcuacugagagugggagagugggagacagaggaaggaagauggagauug

SEQ ID NO: 135525 - RNA, 76 nt, Homo sapiens
gcuuuuuuaaaauuguuuuuugcaguuaagaggcagcucauuuguccaaauuucugggcucagcgcuugggagggc

SEQ ID NO: 135526 - RNA, 41 nt, Homo sapiens
gggagcaguggagccugugggaacucaaggggucucaagcu

SEQ ID NO: 135527 - RNA, 45 nt, Homo sapiens
gaggaaacgccuuuacaaagguuuguccccugcgcugcccaguag

SEQ ID NO: 135528 - RNA, 45 nt, Homo sapiens
cacucggugaugaggcugauccagagcaccgcgaugcccacacgg

SEQ ID NO: 135529 - RNA, 55 nt, Homo sapiens
uuuuuuuccccuugagcaucuuugugcagcuuggacucaaaccucagaguccaac

SEQ ID NO: 135530 - RNA, 48 nt, Homo sapiens
ucaccuaaggggcgugucuaaaauguaaauaucccauccucaucucac

SEQ ID NO: 135531 - RNA, 77 nt, Homo sapiens
acucucaggccccgggccagagcuacugaaucaaaaucugcauuuuaacaagguucccaggugauucccugugcgua

SEQ ID NO: 135532 - RNA, 52 nt, Homo sapiens
acagggaaucaccugggaaccuuguuaaaaugcagauuuugauucaguagcu

SEQ ID NO: 135533 - RNA, 47 nt, Homo sapiens
ugguggguccaugagucugguuacuacagccaggcuccagcccaggu

SEQ ID NO: 135534 - RNA, 46 nt, Homo sapiens
cgaguggccaccugcgaagacagggccgucauuaugggccagaggg

SEQ ID NO: 135535 - RNA, 42 nt, Homo sapiens
gggugaugccuagccuggcuuauugcaccuuccuuuuggcgg

SEQ ID NO: 135536 - RNA, 44 nt, Homo sapiens
aggcaccagccucaucuauuggacccucuuuacacugggccugg

SEQ ID NO: 135537 - RNA, 46 nt, Homo sapiens
cauggggcugcugggcccccuggacuggcugggccaccccccucag

SEQ ID NO: 135538 - RNA, 54 nt, Homo sapiens
cccauccacucuuccugacuucuugugugccucccuuuccuuucccucccacaa

SEQ ID NO: 135539 - RNA, 36 nt, Homo sapiens
uuaggggcuggaaggggauggggcugccuccuggag

SEQ ID NO: 135540 - RNA, 43 nt, Homo sapiens
gcaaggaguggguuuacaugagaaccagaccagccacagggag

SEQ ID NO: 135541 - RNA, 46 nt, Homo sapiens
aagagugacagugacagaagugcucagagagacagcaagaccucag

SEQ ID NO: 135542 - RNA, 25 nt, Homo sapiens
aaguugguggcuuugaggggccuga

SEQ ID NO: 135543 - RNA, 42 nt, Homo sapiens
ccucuccaagcugcuagagggaccauucagagcagcccucaa

SEQ ID NO: 135544 - RNA, 33 nt, Homo sapiens
caucuauaguacguuugacuugaugaccucuag

SEQ ID NO: 135545 - RNA, 42 nt, Homo sapiens
aauggccucuucacucucugcucuaguuauagagaaucucua

SEQ ID NO: 135546 - RNA, 50 nt, Homo sapiens
cugagccccacacuguucguuugagguugucuggguagagguggugccau

SEQ ID NO: 135547 - RNA, 51 nt, Homo sapiens
aaacaucaccauccccuguccagauggacaggcgcuaucuuugugccacac

SEQ ID NO: 135548 - RNA, 42 nt, Homo sapiens
gaaaagggcuggcaaucugcgauucuguucaggguccggucu

SEQ ID NO: 135549 - RNA, 46 nt, Homo sapiens
uuauuaaccaugauuuacaggaaaagaaacugcggcaaagaaagac

SEQ ID NO: 135550 - RNA, 68 nt, Homo sapiens
ggucucucugaagccacuuuggaggcugcuuaggaggcauauuugcuugaccaagcgauagaaauccu

SEQ ID NO: 135551 - RNA, 70 nt, Homo sapiens
uuccugcugauccacacucauugggaaguuggaguuugagagaggaaggucacagaacgugaaagcaaga

SEQ ID NO: 135552 - RNA, 39 nt, Homo sapiens
aggaagguuugugcccccuucuacacaacacugaacucc

SEQ ID NO: 135553 - RNA, 50 nt, Homo sapiens
gaagggaggacacccuauuccugcuaagggguagaggaagaaggugaagg

SEQ ID NO: 135554 - RNA, 45 nt, Homo sapiens
cuuuguaaacgcuguguauucccucugcccccauggcugcuggug

SEQ ID NO: 135555 - RNA, 46 nt, Homo sapiens; identical to SEQ ID NO: 38368

SEQ ID NO: 135556 - RNA, 46 nt, Homo sapiens
gggugggaagagaggguggccucugugccccagguugucaguggag

SEQ ID NO: 135557 - RNA, 43 nt, Homo sapiens
ccuccugggguggccccguguuccuccugcccacccugcccca

SEQ ID NO: 135558 - RNA, 41 nt, Homo sapiens; identical to SEQ ID NO: 38371

SEQ ID NO: 135559 - RNA, 81 nt, Homo sapiens
gucuggaauuagguuucccggcccauaguguccugggaccaucugcucuggacaccuuugggccaucucugcuugugcuau

SEQ ID NO: 135560 - RNA, 46 nt, Homo sapiens
aagcuaugguaucucccauuccagaaccccaauuccccucgaagau

SEQ ID NO: 135561 - RNA, 42 nt, Homo sapiens
accccccggccccgggcccugggccccggggagaggcgagga

SEQ ID NO: 135562 - RNA, 27 nt, Homo sapiens
cuguacuuaauuccaggauuaggacaa

SEQ ID NO: 135563 - RNA, 45 nt, Homo sapiens
guccucgucauccucauccucuucaucauccuccucggacuccuu

SEQ ID NO: 135564 - RNA, 39 nt, Homo sapiens
cgcuugggcuucucggagccgcccuguccaggugcagag

SEQ ID NO: 135565 - RNA, 36 nt, Homo sapiens
gcagggagcaaagcuggggguggcugcgcgucagug

SEQ ID NO: 135566 - RNA, 47 nt, Homo sapiens
gagcccaaccccugccucuuauagaagcaccaggcauagaaaggcag

SEQ ID NO: 135567 - RNA, 51 nt, Homo sapiens
uaguauacccccaucuuauaacgggucucuucuacucuuuacuagacuaaa

SEQ ID NO: 135568 - RNA, 25 nt, Homo sapiens
gagccaaggagagggcgggaggacg

SEQ ID NO: 135569 - RNA, 42 nt, Homo sapiens
agccgccgggagggcuaggggugggggcgcgcggggcuggag

SEQ ID NO: 135570 - RNA, 43 nt, Homo sapiens
gggggguaguuacagggaaaaaaaaagcgagaaagaagcucuu

SEQ ID NO: 135571 - RNA, 38 nt, Homo sapiens
cugugagaaccaggaagugacacugugugagggggaag

SEQ ID NO: 135572 - RNA, 42 nt, Homo sapiens
ucaucggaggaguuugucaauuuugcagccauuuuagagcag

SEQ ID NO: 135573 - RNA, 51 nt, Homo sapiens
gugcccaacaacugugugagcagcaucgagaacauggagaacaucagcaca

SEQ ID NO: 135574 - RNA, 46 nt, Homo sapiens
agcuucugucuaaagggggaaguccuggacgggaagacccccgugg

SEQ ID NO: 135575 - RNA, 46 nt, Homo sapiens
ugacggacgaggaggagcggcacagcgccgagagcagcacgagcga

SEQ ID NO: 135576 - RNA, 74 nt, Homo sapiens
gucaccgaugaggacagcugguacagcaaguggcacaagauggagcagaaguuccgcaucgucuacgcgcagaa

SEQ ID NO: 135577 - RNA, 47 nt, Homo sapiens
uucagcugcagcuggaggaggcggcggcgcagaaccagcgcgagaaa

SEQ ID NO: 135578 - RNA, 44 nt, Homo sapiens
cuggucaaucaauggcccucacugggaacgcuuaauggggccga

SEQ ID NO: 135579 - RNA, 30 nt, Homo sapiens
cuguggggacaggcaggccagcacucaggg

SEQ ID NO: 135580 - RNA, 46 nt, Homo sapiens
ggaaacacgaagggggcagcuggaagauuuggucuugaacuugggg

SEQ ID NO: 135581 - RNA, 45 nt, Homo sapiens
ccaggacaccauugcaauacaggaggcacuucccuguggauugga

SEQ ID NO: 135582 - RNA, 42 nt, Homo sapiens
gcuggccauggagggccgcugagacugcaggcgaaccuucac

SEQ ID NO: 135583 - RNA, 46 nt, Homo sapiens
ccggugccugaggccaccauuugcuggagggggcugaugcccgcag

SEQ ID NO: 135584 - RNA, 46 nt, Homo sapiens
ugcccccaagacacugugugugaccugauccagaguaagugccucu

SEQ ID NO: 135585 - RNA, 46 nt, Homo sapiens
ggaccacauacacugcugucccgcgggguuuacgugugacacgcag

SEQ ID NO: 135586 - RNA, 46 nt, Homo sapiens
cccuggauggagaaggccccagcucaccucagccugccagacccac

SEQ ID NO: 135587 - RNA, 45 nt, Homo sapiens
cugcugcccccagggcuacacguguguagcugaggggcaguguca

SEQ ID NO: 135588 - RNA, 46 nt, Homo sapiens
ccgcgcugggacgccccuuugagggacccagccuugagacagcugc

SEQ ID NO: 135589 - RNA, 51 nt, Homo sapiens
cccccuaaccaaauucucccuggaccccauucugagcuccccaucaccaug

SEQ ID NO: 135590 - RNA, 45 nt, Homo sapiens
uuccagcuguauuucuaaagauuugugggacucugcccuggggag

SEQ ID NO: 135591 - RNA, 71 nt, Homo sapiens
gucuuuucccucuaucuuuccccucccagugauccaaaagcuacgccugauuuggagaggggguggcaagu

SEQ ID NO: 135592 - RNA, 47 nt, Homo sapiens
ccucagcccagccccgccuccagaguccccugagcuuggaucaugag

SEQ ID NO: 135593 - RNA, 45 nt, Homo sapiens
aauguuaagcaagaggcaaaggccuguaacaccauacauuaucag

SEQ ID NO: 135594 - RNA, 46 nt, Homo sapiens
gaguugccaccaggaugaucuggaacacccagaagcguacauggga

SEQ ID NO: 135595 - RNA, 46 nt, Homo sapiens
cagaacagugagccagaucuuccccacaaauguggaaugguuguga

SEQ ID NO: 135596 - RNA, 46 nt, Homo sapiens
uaaaauucaccaaacugacaaauuauguggaacucaaaagucuagg

SEQ ID NO: 135597 - RNA, 47 nt, Homo sapiens
caaaacugauaaauacuacaaacaugugaaugaaaauaaucucuaua

SEQ ID NO: 135598 - RNA, 41 nt, Homo sapiens
gagccgccuccuccgccgggccucggcccgucccgccgguc

SEQ ID NO: 135599 - RNA, 79 nt, Homo sapiens
uugggaauggagcccggcagaggccacagaaggaagcaggaggccaaaugcuccucucucacuggggcucuggguugga

SEQ ID NO: 135600 - RNA, 66 nt, Homo sapiens
caaauauaagaaagcccgagguggucgcagacuaagcaaggagacuauccaagaccuguguucagu

SEQ ID NO: 135601 - RNA, 46 nt, Homo sapiens
aagccaaaagagucgauggccgggauaaaagcuuugaugguguaca

SEQ ID NO: 135602 - RNA, 61 nt, Homo sapiens
ugucuugcagucaugaaagacaugguacagaaaucaaaugggaggugggcguucuaacuga

SEQ ID NO: 135603 - RNA, 45 nt, Homo sapiens
gucaaccccgguucccuggcacggggacagggcgcgcugggcccg

SEQ ID NO: 135604 - RNA, 52 nt, Homo sapiens
ggcuuggagccugccgucacuuuugggggcucugacuauaaucauaagagau

SEQ ID NO: 135605 - RNA, 31 nt, Homo sapiens
agaaacucuuugugugcuuagcugggaaaac

SEQ ID NO: 135606 - RNA, 60 nt, Homo sapiens
ggccagaaacccagggagagauggaaaaggcagacacaggagagagauggacaagaaaca

SEQ ID NO: 135607 - RNA, 43 nt, Homo sapiens
cccgcgggcgcggaugcugcuucucccuguuccauacgccaga

SEQ ID NO: 135608 - RNA, 45 nt, Homo sapiens
guugcacguaaacuugccgcuggccgcgucguaguuguugccuag

SEQ ID NO: 135609 - RNA, 45 nt, Homo sapiens
ccugaccggcggcagcugcucaacgccaucacccaccccgagauu

SEQ ID NO: 135610 - RNA, 42 nt, Homo sapiens
guuccagcagcugggcugugcggugauugacguggacgugau

SEQ ID NO: 135611 - RNA, 42 nt, Homo sapiens
uggugaccgagucuggaggagacagacccagguggucaggcg

SEQ ID NO: 135612 - RNA, 58 nt, Homo sapiens
gcagccccaggcugucccaggagccccucugccugccuaggaccugacuuaggagaca

SEQ ID NO: 135613 - RNA, 41 nt, Homo sapiens
uugcugagaagggaucucagaagaaagugggugcagaacag

SEQ ID NO: 135614 - RNA, 43 nt, Homo sapiens
ggucauggauggaaccguccccaggcucaggugggugggcagg

SEQ ID NO: 135615 - RNA, 45 nt, Homo sapiens
agccuucggaucuggagaggacugaggcacagccacgauccuggg

SEQ ID NO: 135616 - RNA, 42 nt, Homo sapiens
uggcugcauccacagggcaguucccccgcacgcccugcacag

SEQ ID NO: 135617 - RNA, 55 nt, Homo sapiens
ggaggcugcaacugacugcugccccuggggaaggugggacgggggccagauucac

SEQ ID NO: 135618 - RNA, 46 nt, Homo sapiens
gguuuggguugcggggggaggggcgaugugugcccgagaguuuggg

SEQ ID NO: 135619 - RNA, 34 nt, Homo sapiens
cuaaauguagcaauucucagggguuaggaggagu

SEQ ID NO: 135620 - RNA, 43 nt, Homo sapiens
agcccugaaggauucaggggcuuggaaaagaaagagauuugga

SEQ ID NO: 135621 - RNA, 49 nt, Homo sapiens
gccuuggagggaggggagucuuggggggaggacucaucgacgucgcggu

SEQ ID NO: 135622 - RNA, 42 nt, Homo sapiens
uauauuugcaauucauuaaaggauauggaaaauccaaauaag

SEQ ID NO: 135623 - RNA, 50 nt, Homo sapiens
ugaaccaugcugcuguuguaccuuaaacaaaaacucagugauaaccagua

SEQ ID NO: 135624 - RNA, 46 nt, Homo sapiens
guagcaggaauuuaugugccagaggugagagucuuucugguacuga

SEQ ID NO: 135625 - RNA, 49 nt, Homo sapiens
aaauuuuuagagaaauuuuaguuguuaacauuuuauuaagugccagugu

SEQ ID NO: 135626 - RNA, 50 nt, Homo sapiens
caccauaugaaucagaaggagaacacuaaaguggagagacuuuuaagaga

SEQ ID NO: 135627 - RNA, 47 nt, Homo sapiens
accuucauuucuagguucuucaagaaugguguuugcaagugccagau

SEQ ID NO: 135628 - RNA, 72 nt, Homo sapiens
uucuuuaaucucccuuuguuggaaaguaucaugaaaggaagaguuaugcuuuaucuugaaggaaccauuaga

SEQ ID NO: 135629 - RNA, 46 nt, Homo sapiens
cagcaugacagaugcggaugacacacaacuucaugcagcugaaagu

SEQ ID NO: 135630 - RNA, 47 nt, Homo sapiens
uucacgacucuuuacuagugacagcuccacaaccaagguaauuuaaa

SEQ ID NO: 135631 - RNA, 35 nt, Homo sapiens
uuaacucuaaagaacaauauccuuagguuuuggaa

SEQ ID NO: 135632 - RNA, 46 nt, Homo sapiens
aguuuauuaggaggaccagcagcucuuaguccauuaaccccaaggu

SEQ ID NO: 135633 - RNA, 46 nt, Homo sapiens
uaauuucaccugauacugucccacugggaacaggaacuuccauauu

SEQ ID NO: 135634 - RNA, 64 nt, Homo sapiens
ccccaggacacaauuguaagugucuuauauucuaguguucaaaauauuaugaaaacuacaaaga

SEQ ID NO: 135635 - RNA, 65 nt, Homo sapiens
gcacaacacaaguaccuaaucauaguuuaucucacagacagccugagacaguucuuacggaaaca

SEQ ID NO: 135636 - RNA, 45 nt, Homo sapiens
agaggaaaauagauguucaaagacuacaaauuauuugagaggagu

SEQ ID NO: 135637 - RNA, 45 nt, Homo sapiens
uuuuuauuaucacauuaaacguucugucauaaaauuugagcauua

SEQ ID NO: 135638 - RNA, 34 nt, Homo sapiens
acuuauccuuacugauaauagcuacagcugcccu

SEQ ID NO: 135639 - RNA, 51 nt, Homo sapiens
aguuuaaaaaaccuauguugaucaguguuuaucaaauauuacuuggcugag

SEQ ID NO: 135640 - RNA, 32 nt, Homo sapiens
cuccacuucggguauucccgugucccgcucgg

SEQ ID NO: 135641 - RNA, 35 nt, Homo sapiens
gaggaauuguuguagcccauuuacauguuuuauau

SEQ ID NO: 135642 - RNA, 46 nt, Homo sapiens
aguugugucuaggcagaggguuuguugugucuggggcccuagggaa

SEQ ID NO: 135643 - RNA, 51 nt, Homo sapiens
cagccuaggaauuaggggugcagucagugaggaaaugggcgcagcuaggac

SEQ ID NO: 135644 - RNA, 47 nt, Homo sapiens
uaacugugccccagaauccaucgaguucccagugagugaggcccgag

SEQ ID NO: 135645 - RNA, 48 nt, Homo sapiens
ggucacucaagucaguccccagaggauugcacuccggcuccggccagg

SEQ ID NO: 135646 - RNA, 42 nt, Homo sapiens
uuagaauggaaaagaagagguuaaaaauaggagggucaagag

SEQ ID NO: 135647 - RNA, 33 nt, Homo sapiens; identical to SEQ ID NO: 38483

SEQ ID NO: 135648 - RNA, 52 nt, Homo sapiens
gcuugaacuaaucagcuaugagacuguuuucugaagagaaugaaacuccuga

SEQ ID NO: 135649 - RNA, 54 nt, Homo sapiens
ggauuaccaacaagaaggccacuccaggugggagacagugggccagaucacugc

SEQ ID NO: 135650 - RNA, 98 nt, Homo sapiens
aggauuaucccucuuuggggcugaugacugagaagcuaucccagaaaaacaucaauuugaucuuugcagugacugaaaauguagucaaucucuaucag

SEQ ID NO: 135651 - RNA, 42 nt, Homo sapiens
auggauuccagcaauguccuccagcucauuguugaugcuuau

SEQ ID NO: 135652 - RNA, 44 nt, Homo sapiens
aauccguucuaaaguagagcuggaagugcgugaccucccugaag

SEQ ID NO: 135653 - RNA, 45 nt, Homo sapiens
caggugagcuucagcauugaggccaaggugcgaggcuguccccag

SEQ ID NO: 135654 - RNA, 48 nt, Homo sapiens
ccaggcccaagcugaaccuaauagccaucgcugcaacaauggcaaugg

SEQ ID NO: 135655 - RNA, 84 nt, Homo sapiens
aucccagugugagugcucagaggaggacuaucgcccuucccagcaggacgaaugcagcccccgggagggucagcccgucugcag

SEQ ID NO: 135656 - RNA, 46 nt, Homo sapiens
guacugcgagugugacgacuucuccuguguccgcuacaagggggag

SEQ ID NO: 135657 - RNA, 44 nt, Homo sapiens
gaugaucuuugcugcugucaucacaucugauauaguuauguggg

SEQ ID NO: 135658 - RNA, 46 nt, Homo sapiens
uaucaugucccuuucagaggaaggauuaggaaccaaaaagggccua

SEQ ID NO: 135659 - RNA, 53 nt, Homo sapiens
uauaagaaugaggaugacugugucgucagauuccaguacuaugaagauucuag

SEQ ID NO: 135660 - RNA, 46 nt, Homo sapiens
ggccuugccgcccugcucaucuggaaacuccucaucaccauccacg

SEQ ID NO: 135661 - RNA, 46 nt, Homo sapiens
guauaaagaggccacgucuaccuucaccaauaucacguaccggggc

SEQ ID NO: 135662 - RNA, 93 nt, Homo sapiens
gauuuggggcucagagugggguagguugggagaaugucaguauguggaagugugggucuguguguguguaugugggggucuguguguuuaugu

SEQ ID NO: 135663 - RNA, 39 nt, Homo sapiens
cccugaagagaagggcagggcugaggccucucauuccag

SEQ ID NO: 135664 - RNA, 86 nt, Homo sapiens
ucaugaugagguuuucuuaacuuaaaagaacauguauauaaacaugcuugcauuauauuuguaaauuuaugugauggcaaagaagg

SEQ ID NO: 135665 - RNA, 44 nt, Homo sapiens
ucuuuugucccagaaaagcaguggcuccauugguguugacauac

SEQ ID NO: 135666 - RNA, 43 nt, Homo sapiens
uuuuaguugggagaucugagagaccuggcuuuggcaagagcag

SEQ ID NO: 135667 - RNA, 84 nt, Homo sapiens
uccaugagaguguuaaugggacauuuucuuuagauaagauguuuuauaugaagaaacuguaucaaagggggaagaaaauguauu

SEQ ID NO: 135668 - RNA, 49 nt, Homo sapiens
ugucuagcucuuuuggagaaaauuuauguccagucucaggaucugugga

SEQ ID NO: 135669 - RNA, 54 nt, Homo sapiens
ccccacccccggggcggggucuggaggaucagcaaaaccgcgggaaaggugaca

SEQ ID NO: 135670 - RNA, 43 nt, Homo sapiens
ggaaagcaguuuggccuggcugggauggaggggcuguugggga

SEQ ID NO: 135671 - RNA, 51 nt, Homo sapiens
agcccagcuggcugcagaugauccugaguguuucacagaauggaggaaaga

SEQ ID NO: 135672 - RNA, 29 nt, Homo sapiens
cauccacauagccagagguacacaauaca

SEQ ID NO: 135673 - RNA, 46 nt, Homo sapiens
acaaaacaagcaauaauuuuuuuccuuuuccggccccaggccccuu

SEQ ID NO: 135674 - RNA, 87 nt, Homo sapiens
gccaggcaccaacaccacggccucccugggcauguaugagugugaccgggaagcacugaaucuucgcuggcauugucguacacuggg

SEQ ID NO: 135675 - RNA, 50 nt, Homo sapiens
uugagcguggugaccagacccgcaguggccaguggcgcaucuacggcagc

SEQ ID NO: 135676 - RNA, 89 nt, Homo sapiens
aauaugacaaccagugguuccacggcugcaccagcacgggccgcgaggauggucaccuguggugugccaccacccaggacuacggcaaa

SEQ ID NO: 135677 - RNA, 13 nt, Homo sapiens
cugaaggagaggg

SEQ ID NO: 135678 - RNA, 45 nt, Homo sapiens
ggccagcugcgagcagcagggugcggaucugcugagcaucacgga

SEQ ID NO: 135679 - RNA, 45 nt, Homo sapiens
ggagaacuguggagugauccgcacugaguccucgggcggcuggca

SEQ ID NO: 135680 - RNA, 48 nt, Homo sapiens
ccacagcauggcggagcuggaauucaucaccaagcagaucaagcaagg

SEQ ID NO: 135681 - RNA, 46 nt, Homo sapiens
agagguggaggagcuguggaucggccucaacgauuugaaacugcag

SEQ ID NO: 135682 - RNA, 45 nt, Homo sapiens
aguggcagucauuugccuuaggggaugcuauuuaagaauuuuaaa

SEQ ID NO: 135683 - RNA, 39 nt, Homo sapiens
uggugagacuuguccauggaaucuggaggccuggugcuc

SEQ ID NO: 135684 - RNA, 46 nt, Homo sapiens
cagaacccgagauccacgagcagcacugguucuggaucggccugaa

SEQ ID NO: 135685 - RNA, 45 nt, Homo sapiens
cacacagcuggacuggaucugcaagauccccagagguuggccgga

SEQ ID NO: 135686 - RNA, 47 nt, Homo sapiens
cccaggagcagcacugguggaucggccugcacaccucugagagcgau

SEQ ID NO: 135687 - RNA, 21 nt, Homo sapiens
uaguuacuaaauaauggcagc

SEQ ID NO: 135688 - RNA, 42 nt, Homo sapiens
aucugcaagcgcagcaacgucaccaaagaaacgcagccccca

SEQ ID NO: 135689 - RNA, 49 nt, Homo sapiens
ggauccaguuccucaacaagguaggagguggcaauggggcacccaaggg

SEQ ID NO: 135690 - RNA, 42 nt, Homo sapiens
ugaacagcaagaggcccagcuggucaccaucacaaaccccuu

SEQ ID NO: 135691 - RNA, 42 nt, Homo sapiens
guagaccccucccugagcccguccccagcagcgcugcccccc

SEQ ID NO: 135692 - RNA, 45 nt, Homo sapiens
uacuccugggucucagaggagccgcugaacuacgugggcuggcag

SEQ ID NO: 135693 - RNA, 45 nt, Homo sapiens
agaauguguuugucugggagcaccugcagagcuaugagggccaga

SEQ ID NO: 135694 - RNA, 44 nt, Homo sapiens
uagagccaggcgcgugggcagggccagggcgggaggagcugggg

SEQ ID NO: 135695 - RNA, 40 nt, Homo sapiens
ccacccucccacaagggcugggcugagacccagcugagug

SEQ ID NO: 135696 - RNA, 68 nt, Homo sapiens
caggacccccuucuuugcagagcccgaggagccuccccuguccccucgggcagaucuguugugucucu

SEQ ID NO: 135697 - RNA, 67 nt, Homo sapiens
cuucccaccuggcagccucagcucugugccccucacccugcucccucucgccccuucucucccaccc

SEQ ID NO: 135698 - RNA, 89 nt, Homo sapiens
cugugccugcugggguggcuguggggcguggcaggaggggccuagguggguugggccugagaaccagggcacggguguggugucugcug

SEQ ID NO: 135699 - RNA, 65 nt, Homo sapiens
cuaguggauccaggaggagcagcacccgagcccuggaguggcccaguacccuuccaagaggccac

SEQ ID NO: 135700 - RNA, 83 nt, Homo sapiens
agucccagccaggacaaaguaugcggcccauccuggugcgacagcgugggacaaugugaacauggacucgaagacauggcccu

SEQ ID NO: 135701 - RNA, 47 nt, Homo sapiens
aggaaaaaagaaaagcaaacaaauaaaacaccuuuaagaggcuugaa

SEQ ID NO: 135702 - RNA, 60 nt, Homo sapiens
uaaggauaugugaggaucaagggagcucaucugugcagagcacuuagaacagugccucug

SEQ ID NO: 135703 - RNA, 58 nt, Homo sapiens
agccugaauaacacguggcacaaaugggcccggccuuuggcagaggagcaagugauau

SEQ ID NO: 135704 - RNA, 42 nt, Homo sapiens
uuaccgugucuucaggaacgaagcuaaacgcaccaccaaggu

SEQ ID NO: 135705 - RNA, 54 nt, Homo sapiens
cugucacguugaagagggagaagcugcaggcccugacuuggguggggcagugag

SEQ ID NO: 135706 - RNA, 54 nt, Homo sapiens
agcaggaacagugggggcugcagauggaaacgggcaggaucaugccaugcaguu

SEQ ID NO: 135707 - RNA, 28 nt, Homo sapiens
cagggcaccgcgaggguaaggaggcucc

SEQ ID NO: 135708 - RNA, 48 nt, Homo sapiens
cagccaggcucucuggggaugaaucuaauaaaggaggcggcgaccugg

SEQ ID NO: 135709 - RNA, 41 nt, Homo sapiens
aggcuuggagaagggacuuggcuuguccaggagcugauggu

SEQ ID NO: 135710 - RNA, 48 nt, Homo sapiens
gggcugaaggcccggggcucucacgagggaacucagcccugcucagcc

SEQ ID NO: 135711 - RNA, 31 nt, Homo sapiens
agcaggugccaguaagccuuuguuggaagaa

SEQ ID NO: 135712 - RNA, 42 nt, Homo sapiens
cccguacugcggccccguggccaccaugucccugcacggcaa

SEQ ID NO: 135713 - RNA, 45 nt, Homo sapiens
cuugccugggucaggcagcuauuucgggguggaaacaggucuuaa

SEQ ID NO: 135714 - RNA, 58 nt, Homo sapiens
guaguaagucuugcuggacauacaucaauuugagaauccuuuauagaagcacggugua

SEQ ID NO: 135715 - RNA, 64 nt, Homo sapiens
aucaauuuuggaaagagaugaauuucuggucagaaauauuauaaagcacacaacaugcuaaacu

SEQ ID NO: 135716 - RNA, 56 nt, Homo sapiens
ugcagguaccucaagcauugauacgacaugcaccaucugggggcuggagacagggc

SEQ ID NO: 135717 - RNA, 55 nt, Homo sapiens
agguguuagggcgagugaaucucgugucuggccacgugaagacccagcugaucgc

SEQ ID NO: 135718 - RNA, 59 nt, Homo sapiens
aauguaucaaaaacgggaaaacaacacuauuguaaacuaaugcuuuuuuuuggcuaaug

SEQ ID NO: 135719 - RNA, 59 nt, Homo sapiens
gucuaugauauugcauuuagccgggccgggggguggcagggacauguuugccucugugg

SEQ ID NO: 135720 - RNA, 69 nt, Homo sapiens
gugcugauggcucggugcggauguuugaccuccgccaucuagaacacagcaccaucauuuacgaagacc

SEQ ID NO: 135721 - RNA, 68 nt, Homo sapiens
uaacuaccuggccaccauggccauggauggaauggaggugagcacuccucucaggcuaccaugggccc

SEQ ID NO: 135722 - RNA, 24 nt, Homo sapiens
agaggugaauuguggguggggaga

SEQ ID NO: 135723 - RNA, 90 nt, Homo sapiens
guucccugcacaccugucgccagguuaaacaaccaucgagcaugugucaauggcauugcuugggccccacauucauccugccacaucugc

SEQ ID NO: 135724 - RNA, 58 nt, Homo sapiens
aaugccccgagccauugaggacccuauccuggccuacacagcugaaggagagaucaac

SEQ ID NO: 135725 - RNA, 62 nt, Homo sapiens
aaugugcagugggcaucaacucagcccgacuggaucgccaucugcuacaacaacugccugga

SEQ ID NO: 135726 - RNA, 47 nt, Homo sapiens
guccauguccauguucguguuagcacuuacgugggaacaaauaccaa

SEQ ID NO: 135727 - RNA, 45 nt, Homo sapiens
guuuaacaaauuuuaacuuuguauauuuguuaucuaucaggcuaa

SEQ ID NO: 135728 - RNA, 43 nt, Homo sapiens
acaacuugaaaaaaaaauaauaauuagaacauauuugcauaag

SEQ ID NO: 135729 - RNA, 45 nt, Homo sapiens
aaaaacaacucuguaauuuguugagguucucaaacugacagccag

SEQ ID NO: 135730 - RNA, 59 nt, Homo sapiens
gguuccuguguauuuuacuaccccucuugucagugaccuuccuuccccaccccacccag

SEQ ID NO: 135731 - RNA, 27 nt, Homo sapiens
aacaaaauaucauucuggacuugcuca

SEQ ID NO: 135732 - RNA, 34 nt, Homo sapiens
gacauauccugaauaagaauggguaagugugcgu

SEQ ID NO: 135733 - RNA, 67 nt, Homo sapiens
gaggcccgcggggcgcugcggagccgggagcgcggagccggggcgggggacagacaaaggcggggac

SEQ ID NO: 135734 - RNA, 62 nt, Homo sapiens
aacagggaaaucuugcaaaucaacaagaaauggacagcaaagcaagaaaaaugggccaaaga

SEQ ID NO: 135735 - RNA, 46 nt, Homo sapiens
ggaccugaugacugugaaucuagcaagguacaaaccaacaggagag

SEQ ID NO: 135736 - RNA, 42 nt, Homo sapiens
aaacaggaggucaugaguagcuuucugccagagggagggugu

SEQ ID NO: 135737 - RNA, 51 nt, Homo sapiens
accuucaccccacucccaucccacccccaguuuucucuacuaaccuauuuu

SEQ ID NO: 135738 - RNA, 52 nt, Homo sapiens
caagcagauuaacauuugaugggaacagguccuugucuccucauuuguagac

SEQ ID NO: 135739 - RNA, 48 nt, Homo sapiens
aauaguucauucuuuuuaucugaguuuagaccuguucuaaaacugaaa

SEQ ID NO: 135740 - RNA, 61 nt, Homo sapiens
augcuuuccaaucugaagaccaaaaacguucccuauaggcucaguuagcuauuuuucuaga

SEQ ID NO: 135741 - RNA, 28 nt, Homo sapiens
uguugcuauuuuaaaacuuuuugcccuu

SEQ ID NO: 135742 - RNA, 30 nt, Homo sapiens
caguuuggugauuuuuaucacuuuuacaga

SEQ ID NO: 135743 - RNA, 50 nt, Homo sapiens
uuuaagauaauuagaaauguauaaucaccccaauauuuuacaguuaaaaa

SEQ ID NO: 135744 - RNA, 42 nt, Homo sapiens
ucacuacuuuuuuguugacuaaaucaaucuauagcaauuggc

SEQ ID NO: 135745 - RNA, 356 nt, Homo sapiens
cugccuccucucauuuugaaugaugugaaacgauguaagagagacaagaggccgggcgcgguggcucaugccuguaaucccagcacuuugggaggccgaggcaggcagaucacaugaggucaggaguucaagaccagccuggccaauauggcaaauccccgucucuacuaaaaauacaaaaauuaaccgggugcgguggcacaaaccuguaauccuagcuacucaggaggcugaggcaggagaaucgcuugaacccaggaggcagagguugcagugaaccaagauugcaccacugcacuccagccugggcaauagagcaagacuuccgucucaaaaaaaaaaaaaaaaaaagaguu

SEQ ID NO: 135746 - RNA, 47 nt, Homo sapiens
uguuauuaaaauaacuaacauaaaacuuaauuacuuuaauauuauau

SEQ ID NO: 135747 - RNA, 47 nt, Homo sapiens
uguaccagguaauuuuugccggggauggguaaggguuggguuuucug

SEQ ID NO: 135748 - RNA, 41 nt, Homo sapiens
ugagcuuuccuaaacuauugagaguucuuuccaccucuugc

SEQ ID NO: 135749 - RNA, 50 nt, Homo sapiens
cguugcuucucccucugcuuuuaucuuuuccacaguugaggcuggguaug

SEQ ID NO: 135750 - RNA, 59 nt, Homo sapiens
aauaggaagucuguaggcauuaggauacugacauguacauggaaaauucuagggacagg

SEQ ID NO: 135751 - RNA, 88 nt, Homo sapiens
uagaacacuguauguaguaaugaaauuucagggacccagaacauaauguaguauauguuuuuaggugggagaugcugauaacaaaauu

SEQ ID NO: 135752 - RNA, 46 nt, Homo sapiens
aaccaagcaguugaaauggcuauaaagacugacucuaaaccaagau

SEQ ID NO: 135753 - RNA, 52 nt, Homo sapiens
auuauaauacaaaucaucagugcuuuuaguacuucaguguuuaaagaaauac

SEQ ID NO: 135754 - RNA, 50 nt, Homo sapiens
aguccauuucucaaccuuaaauuucagacagucuugggcaacugagaaau

SEQ ID NO: 135755 - RNA, 56 nt, Homo sapiens
acaugugcaaagacaggaagcagcacagucucggcgggaggagaaaaaaagagcag

SEQ ID NO: 135756 - RNA, 46 nt, Homo sapiens
agggcaaacaaaaagcagauaagaaccgugcccgaguagaagagaa

SEQ ID NO: 135757 - RNA, 45 nt, Homo sapiens
uuuuucagaccaguucucugguccaaaaauuaugcaagaguacgu

SEQ ID NO: 135758 - RNA, 46 nt, Homo sapiens
ggagcaaaguauggacugccggacucuuuggccauccugucagaga

SEQ ID NO: 135759 - RNA, 47 nt, Homo sapiens
uauuugcuguuggcacacggaaagccuuggugcgacuacagaaagag

SEQ ID NO: 135760 - RNA, 47 nt, Homo sapiens
cggggagggaaucuuaagggucauuuagaaaucugccuaucacagaa

SEQ ID NO: 135761 - RNA, 163 nt, Homo sapiens
ccagccccccaauucagcaucuuaucccuucauguuugacuuaaaaugaggucuaaaagugauauuuauacuaacuggcaaaugugucguaaaguauauuugaugaagcauuugauucuccuucaaggccuuuuuuuuauacuaaguaggaguugcaguugga

SEQ ID NO: 135762 - RNA, 43 nt, Homo sapiens
gggaugauggaacuaacaaagaagccacaagcacaggaaaguu

SEQ ID NO: 135763 - RNA, 47 nt, Homo sapiens
aacagugcuaaucuauuucagucccuguccaaacaguucuauaagac

SEQ ID NO: 135764 - RNA, 55 nt, Homo sapiens
cugguuuaacacucauagggagcuuuuggagagcaacuuuacuuuaguggguaag

SEQ ID NO: 135765 - RNA, 57 nt, Homo sapiens
ugcuuauaucaugaauuacaucauugggaagaauaaaaacagucgccuugcacaggc

SEQ ID NO: 135766 - RNA, 49 nt, Homo sapiens
ugaagguuaugaagacaaaccagauacuucuucuagcaaaaauaaagac

SEQ ID NO: 135767 - RNA, 121 nt, Homo sapiens
ggaagacucuguuacugaaucuccucaacgggucauaaucacugaagaugaugaagaugagaccacuguggaguuggaagggcaggaugaaaaccaagaaggagauuuugaagaugcagau

SEQ ID NO: 135768 - RNA, 68 nt, Homo sapiens
uugaugauuuugaggaugaggaggacauaguagaguaugaugauaaugacuucgcugaauuugaggau

SEQ ID NO: 135769 - RNA, 58 nt, Homo sapiens
gccuuccacacuuucuguguuguccuucugguguuugggagugucucugaagccaagu

SEQ ID NO: 135770 - RNA, 64 nt, Homo sapiens
aggcauccggggcaguaaaaccgcugcgaucgcggaggcggcggccaggccgagaggcaggccg

SEQ ID NO: 135771 - RNA, 28 nt, Homo sapiens
gucgcucuaguaguauaugcaacaguuu

SEQ ID NO: 135772 - RNA, 88 nt, Homo sapiens
cccccuucagcaacgggccgugaggcgguggcggugguggcgguggcggcggcggugguggugguggcggcggcggcggcgaaggggg

SEQ ID NO: 135773 - RNA, 24 nt, Homo sapiens
guuuuucuuucuccugggccagac

SEQ ID NO: 135774 - RNA, 41 nt, Homo sapiens
aaaacucaccaacucgccagcaauuccauuccaagccagua

SEQ ID NO: 135775 - RNA, 45 nt, Homo sapiens
caggcagcuagagacaugaagaggcuugaagaaaaggacaaggaa

SEQ ID NO: 135776 - RNA, 46 nt, Homo sapiens
cuauucccccaaaguuuauagagaaaaaauauugacguacacuugu

SEQ ID NO: 135777 - RNA, 78 nt, Homo sapiens
auccccuuccaccugcccugcacuggugguguugcuugccgguugccuuaggaauagcaagcgcucuagguuaggcag

SEQ ID NO: 135778 - RNA, 69 nt, Homo sapiens
ugauagacaccccacuccaggaaggcuguggaacagacagauuuguaagucuucuauuaaacaaguugc

SEQ ID NO: 135779 - RNA, 76 nt, Homo sapiens
uauuuucgauacauggcagaaaacccaacugcuggugugguucaggaggaagaggaagacaaucuagaauaugaua

SEQ ID NO: 135780 - RNA, 44 nt, Homo sapiens
gacuauccaccauuugaaaaaaacuuuuacaaugagcaugaaga

SEQ ID NO: 135781 - RNA, 39 nt, Homo sapiens
uuuuuuuaauugugauaagauacacacaaaauugauuau

SEQ ID NO: 135782 - RNA, 48 nt, Homo sapiens
aaacuuuuggaaaguauuauguguuaaauauuuucuauauaaccaaau

SEQ ID NO: 135783 - RNA, 41 nt, Homo sapiens
gguuuggaaaagcauauaaucuucgaucaguggccguauau

SEQ ID NO: 135784 - RNA, 42 nt, Homo sapiens
ccagagacauccugaucgacccuauucgaguggugcagggag

SEQ ID NO: 135785 - RNA, 46 nt, Homo sapiens
auguaaugagcaauuaugaggccuacaagccuuccacaggagcuau

SEQ ID NO: 135786 - RNA, 56 nt, Homo sapiens
uggggcaaguggguggacuagugcagggagcuugaauucuguuccaacuaacucag

SEQ ID NO: 135787 - RNA, 57 nt, Homo sapiens
gcuucagggaauaacagccgagaagggacugggggcagcaacgggaaaagagagaga

SEQ ID NO: 135788 - RNA, 61 nt, Homo sapiens
gacauggaggaagcgcaggccggcauggggagaaccggggugcaaaugauggucggaaugg

SEQ ID NO: 135789 - RNA, 46 nt, Homo sapiens
agccgccuaaacgcaagaaaagucgaugggacaguuagaggggaug

SEQ ID NO: 135790 - RNA, 44 nt, Homo sapiens
cuggguugggguccaaaguguaaggacccccugcccuuagugga

SEQ ID NO: 135791 - RNA, 48 nt, Homo sapiens
uuucuugggaagcuguuuugguccuuggaagcagugagagcugggaag

SEQ ID NO: 135792 - RNA, 69 nt, Homo sapiens
aagggagaugucugauucuaaaugggaguugaugcucagguccccagccagguuugcauccagcccuga

SEQ ID NO: 135793 - RNA, 42 nt, Homo sapiens
uccggaagcucccccucauccucauuaaauguguaccugagu

SEQ ID NO: 135794 - RNA, 45 nt, Homo sapiens
ugaggucucucuuggccuuuuuggaagaggcaauaacagcaccua

SEQ ID NO: 135795 - RNA, 42 nt, Homo sapiens
uguccagugccuuugcuuguucuuucagcuucuuggccacau

SEQ ID NO: 135796 - RNA, 34 nt, Homo sapiens
gauguuuccguauaaagggggaaggaagagagag

SEQ ID NO: 135797 - RNA, 46 nt, Homo sapiens
gauugagcuggaucagcuugaaagcagaucgggaacgguaaccugg

SEQ ID NO: 135798 - RNA, 45 nt, Homo sapiens
ugguccgucaagcgccaucuucucucuucagcagagaccgccggc

SEQ ID NO: 135799 - RNA, 64 nt, Homo sapiens
cuuuggagcuuggugaggagggugggccuagggcuuggcgagugccacaucuggcagguuugga

SEQ ID NO: 135800 - RNA, 48 nt, Homo sapiens
gcugguuuuuuccuuuccuuuggguauuugcacuauuuugggagcaag

SEQ ID NO: 135801 - RNA, 45 nt, Homo sapiens
cuggguuugcauguuuacagacucccccuggggcgagggucagag

SEQ ID NO: 135802 - RNA, 43 nt, Homo sapiens
ucauccaggaauggcuccguucccagcgccgagaccucaaggu

SEQ ID NO: 135803 - RNA, 46 nt, Homo sapiens
ccucuaccaccaaucagcaggagaucgccucccuugaugucaaggu

SEQ ID NO: 135804 - RNA, 41 nt, Homo sapiens
gagcgggaguacaucaacugcaaccguuacuuccgccaggu

SEQ ID NO: 135805 - RNA, 41 nt, Homo sapiens
gugccccaggcgcagccucccaugccugcccagcgccgggg

SEQ ID NO: 135806 - RNA, 87 nt, Homo sapiens
ugcacgggcggacuuuacuccugaggcagggccaggcgccuucgcugggaggacuccagcuuagaccagagacggugguggccuggc

SEQ ID NO: 135807 - RNA, 42 nt, Homo sapiens
cagggaggaccgaggggucuugaagcugcugucauggaagga

SEQ ID NO: 135808 - RNA, 43 nt, Homo sapiens
caugaggagcaaaccagaguuagcaaccaggaccguggaagaa

SEQ ID NO: 135809 - RNA, 70 nt, Homo sapiens
cgaccuccggggcccacccagccagacgacccgccaggaauacaaccugaccucccggaaccugcaggcg

SEQ ID NO: 135810 - RNA, 46 nt, Homo sapiens
guguuagacugcugacgcgggugaugcgaacuggagucugagccug

SEQ ID NO: 135811 - RNA, 49 nt, Homo sapiens
cugcuuugccaccccauucccgucaauaaagugguuugaacccaacccu

SEQ ID NO: 135812 - RNA, 47 nt, Homo sapiens
cucuaccaugcugaaggcugaaagacaggaagauggugccaucagca

SEQ ID NO: 135813 - RNA, 46 nt, Homo sapiens
cagcaaggccagaugcacaucccuggaaggacauccauguuccgag

SEQ ID NO: 135814 - RNA, 30 nt, Homo sapiens
gguguguugaaaucaaaaugaccuuugagg

SEQ ID NO: 135815 - RNA, 45 nt, Homo sapiens
ccaauguuaagcuaugaucguuucugggaucuggguggugaccuu

SEQ ID NO: 135816 - RNA, 90 nt, Homo sapiens
ggucaguuccagagcaaugcaggacaagaaggaggugauagaaggcaaagucuugauggugaauuguucuauuccagagguaaaguccca

SEQ ID NO: 135817 - RNA, 53 nt, Homo sapiens
agggaaauagaaguacauuuugguucagaacaacaaggagaaaaccacgccag

SEQ ID NO: 135818 - RNA, 83 nt, Homo sapiens
uagugcaucauagaugccagcaccaccuuguacaucaagccucagcaccuggugcuuuuuuagaaggauggcacaacauuuuu

SEQ ID NO: 135819 - RNA, 45 nt, Homo sapiens
aaauggcagcgucgagaaaauguggcgcagagagaaaugcgagac

SEQ ID NO: 135820 - RNA, 43 nt, Homo sapiens
uaaagaauauuaaauuaaaauaauuuaaaaacuuaugaagcaa

SEQ ID NO: 135821 - RNA, 45 nt, Homo sapiens
caggcaagaacgguguuuuguuugcgaccaucucagugucaagag

SEQ ID NO: 135822 - RNA, 40 nt, Homo sapiens
gcucaacaagauugaaguaaguuuucgggagcuacagaaa

SEQ ID NO: 135823 - RNA, 39 nt, Homo sapiens
ucucagguuugugauuauuugauauauacugauuuuauu

SEQ ID NO: 135824 - RNA, 46 nt, Homo sapiens
ucuacuucuggaugcaaauuuuacuguuguuguaaugaugccagaa

SEQ ID NO: 135825 - RNA, 47 nt, Homo sapiens
ugugcugaacaccaaaucaaccuaauuaagguugaugacaacaagaa

SEQ ID NO: 135826 - RNA, 42 nt, Homo sapiens
agucaguuuuugacuauaguauaaauucuguacaugaugaga

SEQ ID NO: 135827 - RNA, 46 nt, Homo sapiens
cuucccgcuaccaccaccuuaauauaaucacaugcuuauuggaaca

SEQ ID NO: 135828 - RNA, 45 nt, Homo sapiens
ugcuugcagacccccagcagaaaauugaaacuguuaucucugaug

SEQ ID NO: 135829 - RNA, 42 nt, Homo sapiens
uuuagagagugagggacuuucuugauagcucgcuaagaaucu

SEQ ID NO: 135830 - RNA, 44 nt, Homo sapiens
ugaggucuggaaucuggcuugcuugccuuccuguaaaggcauau

SEQ ID NO: 135831 - RNA, 44 nt, Homo sapiens
gcggagcucgagcucaaguuucucacagcuucagaaagagaucg

SEQ ID NO: 135832 - RNA, 37 nt, Homo sapiens
aaagaaguaaaaggcagguugggggugguaaugguga

SEQ ID NO: 135833 - RNA, 45 nt, Homo sapiens
ggcggacggcggcucggagcgggcugacgggcgcaucgucaagau

SEQ ID NO: 135834 - RNA, 58 nt, Homo sapiens
agcgccacgguggaucagcgccuacccgagugugcgaagcuagccaaggugaggagag

SEQ ID NO: 135835 - RNA, 51 nt, Homo sapiens
auuucaggaccugagugaauagacaggaaaaagaggaggauguuuagccau

SEQ ID NO: 135836 - RNA, 63 nt, Homo sapiens
cuuccgauaugguaucgacaucccguaucuuaguugcaguagugaagaugugcuaugaggcua

SEQ ID NO: 135837 - RNA, 44 nt, Homo sapiens
gcuguugccaaaaugguucaacagugcuguacuuauguugagga

SEQ ID NO: 135838 - RNA, 56 nt, Homo sapiens
auugagcgugcgcgacugacuaaaacauuagcaacuauaaaagaacaaaaugguga

SEQ ID NO: 135839 - RNA, 46 nt, Homo sapiens
gcaaaugaggcucugccuagcugugaaggauuacauucgaacacaa

SEQ ID NO: 135840 - RNA, 95 nt, Homo sapiens
uggaucaacaugagggauccuauuugucuauuuguaagcacuacagagcaauauaugauacucccuguauacaggcagaaagugaaaaauggcag

SEQ ID NO: 135841 - RNA, 72 nt, Homo sapiens
gguucccuugagaguccugcaacggauguuuuugguucuacagaggaaggugaaaaaagguggaaagacuug

SEQ ID NO: 135842 - RNA, 47 nt, Homo sapiens
aucuacaauaagggucuuagugcuuuagaaaaaaguuaaaauuggaa

SEQ ID NO: 135843 - RNA, 91 nt, Homo sapiens
ucuuaaauuuuaaaauagugaauauguuugagacucccuuugaccuuucaguuccccaaguucauuguuaacuuugcauuugcaauuggug

SEQ ID NO: 135844 - RNA, 44 nt, Homo sapiens
uaaggaaugagaaguacucauauacucacagcagagcggugggc

SEQ ID NO: 135845 - RNA, 30 nt, Homo sapiens
cacuuuacaaacucuaucauccaaaauauc

SEQ ID NO: 135846 - RNA, 42 nt, Homo sapiens; identical to SEQ ID NO: 38803

SEQ ID NO: 135847 - RNA, 70 nt, Homo sapiens
gugagaguuguuucuugccacuuggaaaauuauagucugauugggaggaauagaucauauacauaaaggg

SEQ ID NO: 135848 - RNA, 56 nt, Homo sapiens
ucuccauuuaaacugauauaaauagcuaacuacagguauuuuuggcuagcccugau

SEQ ID NO: 135849 - RNA, 40 nt, Homo sapiens
acagagggacuuauuuguuuaccuugucaauaugaauuag

SEQ ID NO: 135850 - RNA, 46 nt, Homo sapiens
gacacauucaucagucaugucccaggugacuaacaccacacaagaa

SEQ ID NO: 135851 - RNA, 74 nt, Homo sapiens
aaagacuguugucaaccaucaaaaaaaaaaaaaaaaaaaaaaaaaaaaaaaaaaaaaaggcagcccucugaggu

SEQ ID NO: 135852 - RNA, 43 nt, Homo sapiens
uaacauauuucucagaucauccugaggaccuggacaggggagg

SEQ ID NO: 135853 - RNA, 52 nt, Homo sapiens
uuauugugccccuagcuuuguuuagcaauaaaagguaauauagaaagcagca

SEQ ID NO: 135854 - RNA, 47 nt, Homo sapiens
aacuacuccaagacuagaucuccagaugcuggugaagaaucacagau

SEQ ID NO: 135855 - RNA, 57 nt, Homo sapiens
gagaaaagucagguaugucaagaacaaucccugguuaguucacugaaaagccccacu

SEQ ID NO: 135856 - RNA, 40 nt, Homo sapiens
caucaaagaacuuuaaaucuaaauuacuuuuuuagagacu

SEQ ID NO: 135857 - RNA, 48 nt, Homo sapiens
gacacuugugugauauuuccucagaauuaaaugagaaggcauucagau

SEQ ID NO: 135858 - RNA, 44 nt, Homo sapiens
cacaugagaagaucugguuugacaaguucaaauaugacgacgca

SEQ ID NO: 135859 - RNA, 41 nt, Homo sapiens
acggcgccagcgugauccuccaugacauugugagagccaga

SEQ ID NO: 135860 - RNA, 55 nt, Homo sapiens
aguccuccauccugcuggaugucaagccuugggacgaugagacggacauggccca

SEQ ID NO: 135861 - RNA, 45 nt, Homo sapiens
gugguggaggacgacaagguggggacuuacuugcuggaggaggag

SEQ ID NO: 135862 - RNA, 44 nt, Homo sapiens
gcagagugucgauaucgcagcuuucaacaagaucugaagccuga

SEQ ID NO: 135863 - RNA, 42 nt, Homo sapiens
ugcucuaaucauagccucucuuccaugccuggcuguacccag

SEQ ID NO: 135864 - RNA, 77 nt, Homo sapiens
uccagcccuaacucggucauuuuaacuggaguuugagucaacaggacagaauugcuuaaugguagcaacagacaggg

SEQ ID NO: 135865 - RNA, 46 nt, Homo sapiens
uccuugcugagaaaauaauuggagcacuauuggcuuggcuuaagau

SEQ ID NO: 135866 - RNA, 46 nt, Homo sapiens
gucaaacaugccuuuaagggcugggguggggcugauggccauggag

SEQ ID NO: 135867 - RNA, 75 nt, Homo sapiens
guaaacacaggaacguagguaaugccuauacagagaauaaauaggaauauacaaguauacauauaaaaacacaag

SEQ ID NO: 135868 - RNA, 73 nt, Homo sapiens
uguguguguguguauguguuuguaggagauggggagaagagagagacagagugcacaagaccuagcaaauagg

SEQ ID NO: 135869 - RNA, 38 nt, Homo sapiens
aauaaaaucccauuugggucuugaugguuguguuggaa

SEQ ID NO: 135870 - RNA, 499 nt, Homo sapiens
cgucuauaauggaauauuuaggaaaauaaaaaguaaauaaauaaaauaaaauaaaaaaugauugcuggcccuaacccuagaccugaaacugacaauccagguugggauccgugaaacuguaguuuuuuuguuuguuuguuugguugguugguugguugguugguugauuuuuuucagacagaauccugcucugucacccaggcuggaaucuaguggcacaaucucagcucacugcaaacccaaacucugccucccagguucaagccauucuccugccuuagccucccaaauagcugggauuacagucgugugccaccacacccagcuaauuuucuauauuuuuaguagagacaggguuucaccauguuggccaggcuggucuugaacuccugaccucaagugauccaccugccucagccucccaaauugcugggauuacaggcaugagccaccgugcccggccccaaaacuguaguuuuuaaaagcugucuauggccag

SEQ ID NO: 135871 - RNA, 41 nt, Homo sapiens
ccggggccagggcacggggaagcccagggagaagcuggugg

SEQ ID NO: 135872 - RNA, 51 nt, Homo sapiens
aaacuggguggauuugagaugucuggggugggacauccaagggucucaggu

SEQ ID NO: 135873 - RNA, 29 nt, Homo sapiens
ugucugccucggcaggaagggccccaagc

SEQ ID NO: 135874 - RNA, 99 nt, Homo sapiens
aaaggugaaaaggagagacuuugagaucuacaggugugagacggggugaauggaggaugauacggaggucuguggggcgagaggaaagucugagucgaa

SEQ ID NO: 135875 - RNA, 48 nt, Homo sapiens
gagacugaaggggugucuuccugcuggcgagaucccggugguguacgg

SEQ ID NO: 135876 - RNA, 47 nt, Homo sapiens
agcagggcgccuuuggggcuggaugggagcgcggggaggccugcgag

SEQ ID NO: 135877 - RNA, 59 nt, Homo sapiens
cuucaccuuccccaaaaccugcacccucuccuccagcccccaagcaggguagauuaaug

SEQ ID NO: 135878 - RNA, 42 nt, Homo sapiens
gcuucugaagaaggcauggguguagccucagcaggggcugga

SEQ ID NO: 135879 - RNA, 46 nt, Homo sapiens
auuagguauuugccuguguggcuguuccuaggcauagguaguggga

SEQ ID NO: 135880 - RNA, 44 nt, Homo sapiens
aguugccucagcugggaaaagggaccaaaaagcccacccuuugg

SEQ ID NO: 135881 - RNA, 26 nt, Homo sapiens
ggggcugguggagguggugggaccac

SEQ ID NO: 135882 - RNA, 38 nt, Homo sapiens
ugucuauacuucccguuccaaggaaaaguaggggagag

SEQ ID NO: 135883 - RNA, 55 nt, Homo sapiens
agagcucuugacauucucaugacguggagcacucuuuacaauagaugaauugaaa

SEQ ID NO: 135884 - RNA, 47 nt, Homo sapiens; identical to SEQ ID NO: 36421

SEQ ID NO: 135885 - RNA, 50 nt, Homo sapiens
aaaaaaaacaacaacauaaaaauccuugcauaccuuguucaauuggagaa

SEQ ID NO: 135886 - RNA, 44 nt, Homo sapiens
uuuuuuaacuaaacagccaaugguauguuuugauugacaucaag

SEQ ID NO: 135887 - RNA, 50 nt, Homo sapiens; identical to SEQ ID NO: 134225

SEQ ID NO: 135888 - RNA, 82 nt, Homo sapiens
gggaugaauaugcacuuggcacgucaguuuugucgugcacuugguauauugauagcucgugaaaacccuuaggaugauuugg

SEQ ID NO: 135889 - RNA, 45 nt, Homo sapiens
aagacugagaacaacgaucauauuaauuugaagguggcggggcag

SEQ ID NO: 135890 - RNA, 49 nt, Homo sapiens
ucuuaaccgaaaauaaaaaugaagcugcuaauagaggagaacguuaacu

SEQ ID NO: 135891 - RNA, 36 nt, Homo sapiens
uuuacuuucuggagcguuuuagggcuacagaauugc

SEQ ID NO: 135892 - RNA, 44 nt, Homo sapiens
cagcugaggagacuccggcgcucgccauggccgacgaaaagccc

SEQ ID NO: 135893 - RNA, 46 nt, Homo sapiens
gagaaaacucuucaaugaaucccauggaaucuuucugggccuccag

SEQ ID NO: 135894 - RNA, 42 nt, Homo sapiens
gguucgagugaguaaaaacuaccgaucagucaucagagcaug

SEQ ID NO: 135895 - RNA, 51 nt, Homo sapiens
ucuccuugacuggguccggcuccaugugugcgagguggacaguuugucggc

SEQ ID NO: 135896 - RNA, 39 nt, Homo sapiens
ccaggguaaaaggaaauuugauuucuuuguggaucuaag

SEQ ID NO: 135897 - RNA, 53 nt, Homo sapiens
gauggcgagagcuuucagacuaguugaaauccggugcccuuagcugagagcag

SEQ ID NO: 135898 - RNA, 53 nt, Homo sapiens
uggacacaugugccucuguuccccuuaaccuguguaauucacacaccaccuuc

SEQ ID NO: 135899 - RNA, 45 nt, Homo sapiens
ucaucaaagcugcuccagcagggaaaacaaguucuguguuugaag

SEQ ID NO: 135900 - RNA, 24 nt, Homo sapiens
ccagggcccucugccgcaagaaac

SEQ ID NO: 135901 - RNA, 49 nt, Homo sapiens
aguuuccuggaggaaauucccaagucaaugugcucccucuuuacaagga

SEQ ID NO: 135902 - RNA, 61 nt, Homo sapiens
cuuauacaaaauguauaaaaagcaguuucuggugugacuugugcucugccuccaccccuug

SEQ ID NO: 135903 - RNA, 37 nt, Homo sapiens
gugguggguugugguggggaaaggggcucagggcagg

SEQ ID NO: 135904 - RNA, 54 nt, Homo sapiens
acucaaagucuggaagggaaaagucuuugggugaggcagagacuccacugccag

SEQ ID NO: 135905 - RNA, 67 nt, Homo sapiens
ccuuucuucuacccaccucuaaagcuggcaguggagucucugccucacccaaagacuuuucccuucc

SEQ ID NO: 135906 - RNA, 83 nt, Homo sapiens
agacaacgccagcugcccacaaguauuacuacagcgaagucuccgacuaggccuccagaucagggcuuccucaccagcacugg

SEQ ID NO: 135907 - RNA, 45 nt, Homo sapiens
uugucuuccagccggccgcccggaacucaaugaucuccagcagca

SEQ ID NO: 135908 - RNA, 55 nt, Homo sapiens
uuggugcugcagcugcaccggguuggggagcagcuggagaaaaugaaugggcagc

SEQ ID NO: 135909 - RNA, 59 nt, Homo sapiens
ugaguggagccuggccagaugagggaccucaggcaagucccggaacucauuucuuucug

SEQ ID NO: 135910 - RNA, 45 nt, Homo sapiens
uagcuguggguacagacggccccaaagccaaaccagggucaggca

SEQ ID NO: 135911 - RNA, 49 nt, Homo sapiens
ggugaacccugucuaugacugccucuuccggcuggcccagccagacagu

SEQ ID NO: 135912 - RNA, 40 nt, Homo sapiens
augggcauguuguucaccugugaggaagaggaggggucag

SEQ ID NO: 135913 - RNA, 59 nt, Homo sapiens
cccagguuggacugcuccccuuggccacuaagccuggugcucugaccccuccucuuccu

SEQ ID NO: 135914 - RNA, 45 nt, Homo sapiens; identical to SEQ ID NO: 38917

SEQ ID NO: 135915 - RNA, 46 nt, Homo sapiens
gagcacgcucccugcagggcugggucugcuaugucaccuuuaucug

SEQ ID NO: 135916 - RNA, 58 nt, Homo sapiens
uuuugcuugcugcugauaguaauggcaguuguuuauugaguaccuacuauaugucaaa

SEQ ID NO: 135917 - RNA, 41 nt, Homo sapiens
aaacacacccuggucugagaucauuagagugacggcugcca

SEQ ID NO: 135918 - RNA, 17 nt, Homo sapiens
gucccugagcagcgcuc

SEQ ID NO: 135919 - RNA, 46 nt, Homo sapiens
cuugaacaccaaaccaggaaccuggaggacugacuuucaacucagg

SEQ ID NO: 135920 - RNA, 32 nt, Homo sapiens
gagguuccucaccauccugggugcucaugcaa

SEQ ID NO: 135921 - RNA, 49 nt, Homo sapiens
ucagcugagccuggcagcacacacaccccacacuccuuuccaucuccag

SEQ ID NO: 135922 - RNA, 49 nt, Homo sapiens
gggcgguggugggggcugcacguaucccauggccccguccaucaugggg

SEQ ID NO: 135923 - RNA, 44 nt, Homo sapiens
guacauuccauuggcgacuggcgggggauagacauaggccccgc

SEQ ID NO: 135924 - RNA, 76 nt, Homo sapiens
aggggaaagagaaaugagcguggccugccuuggggcggggagagggcagccccgcugccugcagaugggagcuacu

SEQ ID NO: 135925 - RNA, 35 nt, Homo sapiens
ccaggggaaggcaagggaggucaagggcaaggcug

SEQ ID NO: 135926 - RNA, 28 nt, Homo sapiens
agugccaggguccagcagccccauggcu

SEQ ID NO: 135927 - RNA, 67 nt, Homo sapiens
cugcauccaacucuauagagauuuugcagcagcggcucuggaauugacauggguucacugcccagug

SEQ ID NO: 135928 - RNA, 38 nt, Homo sapiens
cgggggccccauaccagguccccaugcagacgucccac

SEQ ID NO: 135929 - RNA, 54 nt, Homo sapiens
ccacagugugggccucuggagcugugucuuuacucuugcugccgaucaauccca

SEQ ID NO: 135930 - RNA, 43 nt, Homo sapiens
uugaagagcaggaaggcaagacgguggaugccggagccucggg

SEQ ID NO: 135931 - RNA, 51 nt, Homo sapiens
auguuacacucagaaaugaugaaaccaaaucuuauauuaaaaggcaaagau

SEQ ID NO: 135932 - RNA, 68 nt, Homo sapiens
aaacuggcaacgucaccccagaauuacggucagccuuauuccccuucaccucccagugaacgcuaaga

SEQ ID NO: 135933 - RNA, 54 nt, Homo sapiens
auccugucuccuguaccuccugggaaaggggccgcugcugucuggugcccugug

SEQ ID NO: 135934 - RNA, 75 nt, Homo sapiens
gcauuccuacaucuugugucuguacacguucuuaagcagcgugucaggagagcacccuguugucuucugguaaau

SEQ ID NO: 135935 - RNA, 50 nt, Homo sapiens
aaaagaaacaaaaaccaccacaggaaaaccugaaguacugcucucagacu

SEQ ID NO: 135936 - RNA, 36 nt, Homo sapiens
ggguagcacgauggggcccagccaggauggaaggca

SEQ ID NO: 135937 - RNA, 96 nt, Homo sapiens
cuaccugacuuacaucaagcuaucaacggcaaucaagcguaaugagaacauggccaaaggucugcagagggcucugcugcagcagcagccagagga

SEQ ID NO: 135938 - RNA, 41 nt, Homo sapiens
auccuugaaggagagccagggaaggugucuaaucuucaaua

SEQ ID NO: 135939 - RNA, 42 nt, Homo sapiens
caaugcucagcgagugucgggacgccauccaggugguucggg

SEQ ID NO: 135940 - RNA, 49 nt, Homo sapiens
caaguuagugaacaacaggaaagucaaguaacuuauaaguggaaaagua

SEQ ID NO: 135941 - RNA, 48 nt, Homo sapiens
uuccuucauugcuuuuuaggauguuuguaaaauucccagugggaacuu

SEQ ID NO: 135942 - RNA, 188 nt, Homo sapiens
cuucuguaugugucugaagguuguccuguguguuuaagauguaguggcucguugguauucaguucucauaaaacaaacuuuuaaugcuguuuuggauuugguaaguacggagaugugccuuauugaauaaaauuauuuugaaaacugaguuuauagaggaauucuuaauguuuagagggcaaagaaau

SEQ ID NO: 135943 - RNA, 82 nt, Homo sapiens
guggagagggagaacgguuccagugaagauugacaaagugcgcauuuucuuauuaggacuggcugauaacgaagcagcuauu

SEQ ID NO: 135944 - RNA, 60 nt, Homo sapiens
gucuucgaaaaacacucaacuucaagauggguaacagacacaaauucacagggaagaaag

SEQ ID NO: 135945 - RNA, 42 nt, Homo sapiens
ggcggcggcgguagcggcgguggacguggugccggaggggaa

SEQ ID NO: 135946 - RNA, 42 nt, Homo sapiens
gaagcccugcacauggacagguaccuguugcugcacccagac

SEQ ID NO: 135947 - RNA, 47 nt, Homo sapiens
ucuaaaggguuggacagguggggacagccuuagcuaucaccuggaga

SEQ ID NO: 135948 - RNA, 41 nt, Homo sapiens
gcaaucgggguuucaagaacgugccucuugggaaggugagc

SEQ ID NO: 135949 - RNA, 70 nt, Homo sapiens
ccagaacccucaggaccacaaugagcccagacaaugggaaggggaggguaagcagacccugagaacagaa

SEQ ID NO: 135950 - RNA, 43 nt, Homo sapiens
gaggauuucuggaagcuucuguaacuguagggaagaaagcugu

SEQ ID NO: 135951 - RNA, 30 nt, Homo sapiens
cacagucauugccuucaacacagagccacg

SEQ ID NO: 135952 - RNA, 51 nt, Homo sapiens
uucucaguggucccagggcuggcagugugucuugguucauaaaagacgggc

SEQ ID NO: 135953 - RNA, 45 nt, Homo sapiens
ugaggggaaaccaguacaagaagaugaugaccaaagaggagcugg

SEQ ID NO: 135954 - RNA, 68 nt, Homo sapiens
cuggggaggcugucaggaggcacgucccguuugccuucccccucccgccuccaccuccuccauuggag

SEQ ID NO: 135955 - RNA, 55 nt, Homo sapiens
cugggacaugccucauccaguugcaaauacggauuuagagaguggagccugcgug

SEQ ID NO: 135956 - RNA, 55 nt, Homo sapiens
gaaucaacauucccaggccauguuaaggugucagagaugcuguggcugccaagaa

SEQ ID NO: 135957 - RNA, 319 nt, Homo sapiens
aagauguucuuaaagcuggaugagggcugggugugguggcuucugccuguaaucccagcacuuugggaaguugaggcaggagaauggcuugaccccaggaguuugagaccacucugagcaacauagugagacccaaucucuacaaaaaauaagaaaacuagcuggguguuguggcacacuccugugaucccagcuacuuaggaggcugaggggggaggguugcuuaagcccagggagguugaggcugcagugagccaugauugcaccacugcacuccagccugggcuacagaaugaguccgucuccccaaaaaggauga

SEQ ID NO: 135958 - RNA, 49 nt, Homo sapiens
ggaaagcuggcuuuucuuuuucagccaauuugaaguccagauuucagag

SEQ ID NO: 135959 - RNA, 62 nt, Homo sapiens
ggugcugcuggcaaaauuuugggugauggcgauaguagugucgagauugaggacaacaugcc

SEQ ID NO: 135960 - RNA, 45 nt, Homo sapiens
ccugguuuuuguaagauuuccagggguuugaauucagguggccag

SEQ ID NO: 135961 - RNA, 42 nt, Homo sapiens
augaguucccugggagugcugguaggaaacaggcaccagcgc

SEQ ID NO: 135962 - RNA, 42 nt, Homo sapiens
gauucccucuuggacacugggggaggacuccuggaccgagac

SEQ ID NO: 135963 - RNA, 45 nt, Homo sapiens
uguagcgagaucggcugcgagaccuggaacgacuccgacuccggg

SEQ ID NO: 135964 - RNA, 39 nt, Homo sapiens
aggaaagacuucuuccgggaauuuacuuuaggucagggu

SEQ ID NO: 135965 - RNA, 45 nt, Homo sapiens
ccugcugcuacucaaccugcugagccugcugcucaccgcaagcuu

SEQ ID NO: 135966 - RNA, 57 nt, Homo sapiens
cuuguguggggcacgccuuuggcacauccucagcccccugcccaggccuccccaggg

SEQ ID NO: 135967 - RNA, 41 nt, Homo sapiens
cagcucagccaguccagagugcaguggggcagcucugggag

SEQ ID NO: 135968 - RNA, 46 nt, Homo sapiens
ggccuuggagccuuuccucuguucugugcaucuagacagacguccc

SEQ ID NO: 135969 - RNA, 45 nt, Homo sapiens
ccccuccgcaggucccagccuggugccugggaaggggguuugccc

SEQ ID NO: 135970 - RNA, 42 nt, Homo sapiens
caggcccuugaggcuauuaggagaugcuugaagaacucaaca

SEQ ID NO: 135971 - RNA, 62 nt, Homo sapiens
aaaaaacaagaaacaaacaaaaaaauagagaaaaaaaccaccccaacacacaacugcccugu

SEQ ID NO: 135972 - RNA, 76 nt, Homo sapiens
ugugggggggggcaacuaaacaaacacaaaguauucugugucagguauugggcuggacagggcaguuguguguugg

SEQ ID NO: 135973 - RNA, 42 nt, Homo sapiens
ccgagcccugcacagcccucccuccugccugggugggggagg

SEQ ID NO: 135974 - RNA, 115 nt, Homo sapiens
uggucagcuggucuccuuuuccuacucauacuauaccuuccuguaccuggguggauggagcgggaggauggaggagacgggacaucuuucaccucaggcuccugguagagaagac

SEQ ID NO: 135975 - RNA, 107 nt, Homo sapiens
gcuucccccuuaaaacggaggaagggcccugggcucucaggcaccagguagacuuuggaaccuguguuuucggugacugucccggaggagaggaugugggguaccag

SEQ ID NO: 135976 - RNA, 49 nt, Homo sapiens
ccugagagcccagggcccuuccuccguuuuaagggggaagcaacauuug

SEQ ID NO: 135977 - RNA, 54 nt, Homo sapiens
gugacaugcuccucucccuggcuccggggagaagggcuuggggugaccugaagg

SEQ ID NO: 135978 - RNA, 52 nt, Homo sapiens
uucaggucaccccaagcccuucuccccggagccagggagaggagcaugucac

SEQ ID NO: 135979 - RNA, 40 nt, Homo sapiens
gguacucccccuucccuccaacacauuccagguccgccug

SEQ ID NO: 135980 - RNA, 38 nt, Homo sapiens
cucccucugcccucucccugcagaauguggcaggcgga

SEQ ID NO: 135981 - RNA, 42 nt, Homo sapiens
agaggggccggcucaacaccagggggaucuucucgcccccgg

SEQ ID NO: 135982 - RNA, 42 nt, Homo sapiens
caccuuucugauccgcgacagcucggaccagcgccacuucuu

SEQ ID NO: 135983 - RNA, 44 nt, Homo sapiens
cgcggaucagaaaggugccggcgggcucggcacugagcagcagg

SEQ ID NO: 135984 - RNA, 45 nt, Homo sapiens
gcacggagccagcguggaucugcgcggcggcggcugcagcugcuu

SEQ ID NO: 135985 - RNA, 53 nt, Homo sapiens
uccccaaggcgacgcggcggcgagacggccagcgguggcccgcgcugcgccca

SEQ ID NO: 135986 - RNA, 44 nt, Homo sapiens
gucccucgagcuuccccugggcgcccgcccugcccccugcgcac

SEQ ID NO: 135987 - RNA, 54 nt, Homo sapiens
ugggccgggcgggcggcuggcggcuggcugcgugcggggccgaagcggcagcag

SEQ ID NO: 135988 - RNA, 37 nt, Homo sapiens
cgugcgacagucaccugcgggcagauuccagagggga

SEQ ID NO: 135989 - RNA, 56 nt, Homo sapiens
acaagaguuguugaaaguugacaagcagacugcgcaugucucugaugcuuuguauc

SEQ ID NO: 135990 - RNA, 42 nt, Homo sapiens
guaauuuaaagcucuguugauuuuguuuccguuuggauuuuu

SEQ ID NO: 135991 - RNA, 85 nt, Homo sapiens
uuaagaaggcucuccauuuggcaucguuuaauuuauauguuauguucuaagcacagcucucuucuccuauuuucauccugcaagc

SEQ ID NO: 135992 - RNA, 37 nt, Homo sapiens
cuuuuaaccgugcugagcagaaaacaaaacagguuaa

SEQ ID NO: 135993 - RNA, 47 nt, Homo sapiens
gucuuuccuuugguucuuugagcaucuuugcuuucauucgucucccg

SEQ ID NO: 135994 - RNA, 52 nt, Homo sapiens
uugcacuuuuuuaaaaaaagguuucugcaucguggaagcauuugacccagag

SEQ ID NO: 135995 - RNA, 48 nt, Homo sapiens
ugauuguuuuuuuaauguuuugguuuguuuuugacaucagcuguaauc

SEQ ID NO: 135996 - RNA, 48 nt, Homo sapiens
accuguuaagacuccugacccccaaguggcaugcagcccccaugccca

SEQ ID NO: 135997 - RNA, 32 nt, Homo sapiens
cugacgauauacaggcacauuauguaaacaua

SEQ ID NO: 135998 - RNA, 44 nt, Homo sapiens
gggaaccuauguguucccucagugugguuuccugaagccaguga

SEQ ID NO: 135999 - RNA, 46 nt, Homo sapiens
gggucuugcugugcccucccaggcuuaguguucccucccucaaaga

SEQ ID NO: 136000 - RNA, 46 nt, Homo sapiens
uggaaccaguggcuaguucuugaaggagccccaucaauccuauuaa

SEQ ID NO: 136001 - RNA, 42 nt, Homo sapiens
uugagagggacauggcccuuguuuucugcagcuuccacgccu

SEQ ID NO: 136002 - RNA, 48 nt, Homo sapiens
ugucuggggcuucgauccuugggugcaggcagggcugggacacgcggc

SEQ ID NO: 136003 - RNA, 40 nt, Homo sapiens
cucaucccauggguccaaauuaauaugauucugcuccccc

SEQ ID NO: 136004 - RNA, 41 nt, Homo sapiens
gcggcgccccccaagcaggaguuucucgacaucgaggaccc

SEQ ID NO: 136005 - RNA, 46 nt, Homo sapiens
acaucuccuccccggacgagugccucuggauggacugggucacaga

SEQ ID NO: 136006 - RNA, 45 nt, Homo sapiens
cugugacuucaucgugcccugggacacccugagcaccacccagaa

SEQ ID NO: 136007 - RNA, 103 nt, Homo sapiens
aaagggccugagaaggauauagaguuuaucuacacggcccccuccucggcaguguguggggucucgcuggacguuggaggaaagaaggaauaucucauugcag

SEQ ID NO: 136008 - RNA, 75 nt, Homo sapiens
gagaaggaaguggacucuggaaacgacauuuauggcaacccuaucaagaggauccaguaugagaucaagcagaua

SEQ ID NO: 136009 - RNA, 53 nt, Homo sapiens
ugcuuguccucagguuaccaggaguggaacagaauccuggcuuaauugcuagg

SEQ ID NO: 136010 - RNA, 77 nt, Homo sapiens
gacgacgaccggcacagucagaugauccgagaccagcagcagcagaucuuacagcaaaacagguugcacaagcaguu

SEQ ID NO: 136011 - RNA, 46 nt, Homo sapiens
cagaaccaaaaauaucagggcacggucaagcccacguuuagaaaug

SEQ ID NO: 136012 - RNA, 46 nt, Homo sapiens
gaggaggacgggccagggaaaaugagccugacucgcaggggcccau

SEQ ID NO: 136013 - RNA, 63 nt, Homo sapiens
uucucugcuggggcuucucccaccagccccauuugggggcuccccgaucaagccaggguggga

SEQ ID NO: 136014 - RNA, 35 nt, Homo sapiens
cccccucccuccucucccuuucuuucccucucuuu

SEQ ID NO: 136015 - RNA, 42 nt, Homo sapiens; identical to SEQ ID NO: 39046

SEQ ID NO: 136016 - RNA, 87 nt, Homo sapiens
caccaggacgcccucgagguugcucugggauccccccacagccccuggucagucugcccuugucacuggucugaggucauuaaaauu

SEQ ID NO: 136017 - RNA, 65 nt, Homo sapiens
gguggugagaaccggagaaccccaggacgcccucacugcaggcuccccuccucggcuuccuuccu

SEQ ID NO: 136018 - RNA, 65 nt, Homo sapiens
uccugggguucuccgguucucaccacccuugggccacgccgucuaguccacaccugaggaguugg

SEQ ID NO: 136019 - RNA, 83 nt, Homo sapiens
cgauuucgagggcuggaaggcugcgauucccagugcccuggacaccaacagcucgaagagcaccuccuccuuccccugcccgg

SEQ ID NO: 136020 - RNA, 46 nt, Homo sapiens
cguaggcaauggugcgaucugagccgccagacuuggugaggcccag

SEQ ID NO: 136021 - RNA, 47 nt, Homo sapiens
ggccucaccaagucuggcggcucagaucgcaccauugccuacgaaaa

SEQ ID NO: 136022 - RNA, 94 nt, Homo sapiens
cuuuggucaaauauucuucugauuacuuccaagcccccucugacuacagauacuaccccuaccaguccuuccagacuccacaacaccccagcuu

SEQ ID NO: 136023 - RNA, 68 nt, Homo sapiens
ugccuuugugacagacaguuccuggagugcacggaagucacaacuggucuaucaguccagacgggggc

SEQ ID NO: 136024 - RNA, 44 nt, Homo sapiens
acuuccgugcacuccaggaacugucugucacaaaggcacuccag

SEQ ID NO: 136025 - RNA, 42 nt, Homo sapiens
uaccgggccagcaacuggaagggcacaguguggaauuccagg

SEQ ID NO: 136026 - RNA, 46 nt, Homo sapiens
ugaggagcucuuugagcugcaguucaaccugucccuguacuggagc

SEQ ID NO: 136027 - RNA, 46 nt, Homo sapiens
cucagggagcaucauggggaagcggaucuucuccaccaagcccucc

SEQ ID NO: 136028 - RNA, 42 nt, Homo sapiens
auacagguccaggggcaucuggaacgagggguccugggggag

SEQ ID NO: 136029 - RNA, 45 nt, Homo sapiens
agaucuuugacagccagcggggcugcgaccuguccaucagcguga

SEQ ID NO: 136030 - RNA, 61 nt, Homo sapiens
uuggugaccaaggcuggggagugggggcuccggagucaguaccaccaagucuccaugcgga

SEQ ID NO: 136031 - RNA, 46 nt, Homo sapiens
cuggcugaagagcaacugcaggcacgagagagacgcuggugugguc

SEQ ID NO: 136032 - RNA, 42 nt, Homo sapiens
ucauccccaacaccgacgaccagaucauuguggcccucaaau

SEQ ID NO: 136033 - RNA, 47 nt, Homo sapiens
ggaaacucuacuccguggaugaccggacgggggucgucuaccagauc

SEQ ID NO: 136034 - RNA, 46 nt, Homo sapiens
acccuucccaaggggagacgaggagcaaguaggcuugagggaaaag

SEQ ID NO: 136035 - RNA, 47 nt, Homo sapiens
uuggaaaugugaggcucuuggugucaagugaauccggcuagcucucc

SEQ ID NO: 136036 - RNA, 24 nt, Homo sapiens
aacaacaacagaaaucaaaaauaa

SEQ ID NO: 136037 - RNA, 20 nt, Homo sapiens
aaaaaaaaaauccaaaauag

SEQ ID NO: 136038 - RNA, 54 nt, Homo sapiens
agaaggaaccagaugauagagaggauaggcagaggcaggguggcagaauuaggg

SEQ ID NO: 136039 - RNA, 45 nt, Homo sapiens
ugagcugaggcggagaucgauuggagauuuguacaaaucuuagaa

SEQ ID NO: 136040 - RNA, 27 nt, Homo sapiens
agcaggacggaggggcggcagggacag

SEQ ID NO: 136041 - RNA, 46 nt, Homo sapiens
gugcuguaccuaaagggaaucaggaagaagugggcaucagucccag

SEQ ID NO: 136042 - RNA, 32 nt, Homo sapiens
ggaggucaggggcaguucccgggggaauaucu

SEQ ID NO: 136043 - RNA, 53 nt, Homo sapiens
acuugggaagguccuaguagaaggcauuccuucugagucuccuggcccuacag

SEQ ID NO: 136044 - RNA, 69 nt, Homo sapiens
uaaugccugcuuuggagcacuccuuccccacccgccugcuccaggggaauagcgucccugguccuagca

SEQ ID NO: 136045 - RNA, 37 nt, Homo sapiens
cugccucugccccugccugucacuagugggcaugggc

SEQ ID NO: 136046 - RNA, 48 nt, Homo sapiens
ugcgugugucuggcucguguuuaauaaggugucgcuguuucccuguuc

SEQ ID NO: 136047 - RNA, 44 nt, Homo sapiens
acacgaucgugaaugagcugguacgugugaccagugagggagcu

SEQ ID NO: 136048 - RNA, 36 nt, Homo sapiens
gugucccugucuccaacuucaccuacagccccgaca

SEQ ID NO: 136049 - RNA, 53 nt, Homo sapiens
cccaacgugucuaggagagcuuucucccuagaucgcacugugggccggggccc

SEQ ID NO: 136050 - RNA, 50 nt, Homo sapiens
auguaaauaauacauuguucuaagucuuuuucauuaaaaauuuaaaacuu

SEQ ID NO: 136051 - RNA, 71 nt, Homo sapiens
cugaucuuaucugaagcagcagaucagugggaugagggagacuguucaccugcuguguacuccuguuugga

SEQ ID NO: 136052 - RNA, 44 nt, Homo sapiens
uaacuaugaucucccuaauaacagagaauuguacauacacaggu

SEQ ID NO: 136053 - RNA, 44 nt, Homo sapiens
ggacauccaacccccuggcccagacaucuguagaaauaagcacu

SEQ ID NO: 136054 - RNA, 45 nt, Homo sapiens
gccaacuucacuguauccucaaugcauggagacaugccccagaaa

SEQ ID NO: 136055 - RNA, 55 nt, Homo sapiens
cguuggcugaagguggaacccaggccugaguaguuuuagauccccaggugauggu

SEQ ID NO: 136056 - RNA, 40 nt, Homo sapiens
cagaagaugaccgccugagugauggucagugugucguaga

SEQ ID NO: 136057 - RNA, 45 nt, Homo sapiens
aggcaucaagcaauuuuucguggcaguggagagggaagaguggaa

SEQ ID NO: 136058 - RNA, 44 nt, Homo sapiens
ggugguucucaucagugccacgcugccacacgagauucuggaga

SEQ ID NO: 136059 - RNA, 60 nt, Homo sapiens
aggacacgugcuaucaaaauguugguuuuggaugaagcugaugaaauguugaauaaaggu

SEQ ID NO: 136060 - RNA, 46 nt, Homo sapiens
aaaccaacauuuugauagcacguguccuuaggcuucugcgacgaau

SEQ ID NO: 136061 - RNA, 105 nt, Homo sapiens
uuucuugggagccucaggugugauuauuucaaaaucucauagaugugauuugucguaaguauuucaaaaucucauguuauagauaugauucgucgcagaagccua

SEQ ID NO: 136062 - RNA, 46 nt, Homo sapiens
ccgcgacaacaugcuguccguaauccagcuuccugauguccucgcc

SEQ ID NO: 136063 - RNA, 45 nt, Homo sapiens
gaauguccagugccaugccugcauuggaggcaccaauguuggcga

SEQ ID NO: 136064 - RNA, 48 nt, Homo sapiens
cacauuuacaguuuuaaagauucuucugggugucuguagauuugaggu

SEQ ID NO: 136065 - RNA, 45 nt, Homo sapiens
cacaggggacuucuuucaguuccuggaaugcagcuggcuaagggc

SEQ ID NO: 136066 - RNA, 39 nt, Homo sapiens
gaaagcgccgacacagccaggcgugagggcgaggacggg

SEQ ID NO: 136067 - RNA, 45 nt, Homo sapiens
ccgcagcagguccucccgcaggcccauggugucgaacgugggggu

SEQ ID NO: 136068 - RNA, 46 nt, Homo sapiens
uucacugggaaaaucuagaaauugugagcucuggggaugaggugaa

SEQ ID NO: 136069 - RNA, 45 nt, Homo sapiens
guucuuugugggagggagagaagaagugagucaagaucacaggcc

SEQ ID NO: 136070 - RNA, 35 nt, Homo sapiens
cccugcccagcccccagcgugcaccuacuugagcu

SEQ ID NO: 136071 - RNA, 53 nt, Homo sapiens
cuauuguaaaagcuuuuuauuuuaguaaaauauacagaaguucuuuuucugaa

SEQ ID NO: 136072 - RNA, 65 nt, Homo sapiens
ugcccugccuccacccaccucgggagcagaagcccggccuggacaccccucggccuggacacccc

SEQ ID NO: 136073 - RNA, 46 nt, Homo sapiens
aaaugaggaccguaucuucgucuauuucaucacaaaacugucccgg

SEQ ID NO: 136074 - RNA, 54 nt, Homo sapiens
ggggagguggcagagguggcagaggaggccauggaaacagaaaguucugagaag

SEQ ID NO: 136075 - RNA, 43 nt, Homo sapiens
ucagguucagaguauugaguucacccagaucgaaaugaaagug

SEQ ID NO: 136076 - RNA, 61 nt, Homo sapiens
cagggguuguccucucugugggccccugccucaguccgccaaauucucauggugcccccag

SEQ ID NO: 136077 - RNA, 63 nt, Homo sapiens
aggugaguccggugggcccggagaucaccgcccucgccucccccgcagagggggcgucuggcu

SEQ ID NO: 136078 - RNA, 106 nt, Homo sapiens
auuguccccaggcgcgcgcuccggguuggggcuaccccgcccccuuaugugcugagaaggugguguggagugaggccuuuguuucauucuggucaccuguagacau

SEQ ID NO: 136079 - RNA, 36 nt, Homo sapiens
gggcggucggggggauacccucuucuguuuacgaug

SEQ ID NO: 136080 - RNA, 108 nt, Homo sapiens
auguccaggugggauuuuaaagucugcauugguuauaauaacaguuaucaguaauuccugcccagaagacuuuuauuuauuuuuuuuuaagauaaaaacugcacaaaa

SEQ ID NO: 136081 - RNA, 39 nt, Homo sapiens
uucagugcuuuuuguuuggccucccugcccccauguuuu

SEQ ID NO: 136082 - RNA, 42 nt, Homo sapiens
uguccugggcucccugacccacugaagcuucucagcacguuc

SEQ ID NO: 136083 - RNA, 52 nt, Homo sapiens
aggacagccagccccuuguuccuccagggcugcccacuauggggcaguuaca

SEQ ID NO: 136084 - RNA, 45 nt, Homo sapiens
ugcagugcugacaggcccacauggcugcaguggccgugugugugg

SEQ ID NO: 136085 - RNA, 24 nt, Homo sapiens
guggggguacucacugcacagcug

SEQ ID NO: 136086 - RNA, 48 nt, Homo sapiens
gcgcugcuuccccagcggcugcacuugcugccgcccccgcgcucgccg

SEQ ID NO: 136087 - RNA, 45 nt, Homo sapiens
agauuaugaggagccgccaagagaugaaaaacccgaucaguaaca

SEQ ID NO: 136088 - RNA, 48 nt, Homo sapiens
acuagauaaaguccgacggaaaaaggaggaaaaggcggcagacaggcu

SEQ ID NO: 136089 - RNA, 33 nt, Homo sapiens
gcuacaccuggguaggagagaggcaggccaugc

SEQ ID NO: 136090 - RNA, 42 nt, Homo sapiens
uggcuccaggccacccacagagccaacgauugacugcacggc

SEQ ID NO: 136091 - RNA, 46 nt, Homo sapiens
guuggcucuguggguggccuggagccaggccagcaccccugcuaag

SEQ ID NO: 136092 - RNA, 41 nt, Homo sapiens
cauccugugugcagcucuuaggucuccuuucugcagaacaa

SEQ ID NO: 136093 - RNA, 46 nt, Homo sapiens
ccuugacucccggguggggagguggccaaggaugcuggagcugaau

SEQ ID NO: 136094 - RNA, 49 nt, Homo sapiens
ccugcagugucgccaugacugaucauggcucuugcauuuuuggguaaau

SEQ ID NO: 136095 - RNA, 40 nt, Homo sapiens
uacaugagucuguccagagugcuugcuaccguguucggag

SEQ ID NO: 136096 - RNA, 145 nt, Homo sapiens
gcugccgagaccccucgggggcugcacacccagcagcagcgcacgccuccgaagccugcggccucgcuugaaggagggcgucgccggaaacccagggaaccucucugaagugacaccucaccccuacacaccguccguucacccc

SEQ ID NO: 136097 - RNA, 44 nt, Homo sapiens
ggaucucgaggaccuggaagaagcagaggagccagacauggagg

SEQ ID NO: 136098 - RNA, 47 nt, Homo sapiens
gggaacgcacgcuggaugguuuuaagaaauuccuggagagcgguggc

SEQ ID NO: 136099 - RNA, 46 nt, Homo sapiens
gcacagcuuccccacacucaaguucuuuccugccagugccgacagg

SEQ ID NO: 136100 - RNA, 35 nt, Homo sapiens
aguuggcucccauuugggauaaacugggagagacg

SEQ ID NO: 136101 - RNA, 90 nt, Homo sapiens
gaugagccaggagcugccggaggacugggacaagcagccugucaaggugcuuguugggaagaacuuugaagacguggcuuuugaugagaa

SEQ ID NO: 136102 - RNA, 87 nt, Homo sapiens
ucaucacccuggaggaggagaugaccaaguacaagcccgaaucggaggagcugacggcagagaggaucacagaguucugccaccgcu

SEQ ID NO: 136103 - RNA, 70 nt, Homo sapiens
gaccacaccgacaaccagcgcauccucgaguucuuuggccugaagaaggaagagugcccggccgugcgcc

SEQ ID NO: 136104 - RNA, 45 nt, Homo sapiens
aacugagcaacuucaaaacagcagccgagagcuucaagggcaagg

SEQ ID NO: 136105 - RNA, 80 nt, Homo sapiens
acuuaaguuuauaacacagacagccccgaagauuuuuggaggugaaaucaagacucacauccugcuguucuugcccaaga

SEQ ID NO: 136106 - RNA, 62 nt, Homo sapiens
ggagaaccugcuggacuuuaucaaacacaaccagcugccccuugucaucgaguucaccgagc

SEQ ID NO: 136107 - RNA, 60 nt, Homo sapiens
ucagggcccucuuucuguccacaguuugaugaaggccggaacaacuuugaaggggagguc

SEQ ID NO: 136108 - RNA, 46 nt, Homo sapiens
cugaaugggguuuucccgauucggaccagggagucaaguucuagga

SEQ ID NO: 136109 - RNA, 61 nt, Homo sapiens
guggccgcccuggugcgcgccgacgcccccgaggaggaggaccacguccuggugcugcgga

SEQ ID NO: 136110 - RNA, 42 nt, Homo sapiens
aggagcguuuccgaauccggggccaggccuggugugaguguc

SEQ ID NO: 136111 - RNA, 33 nt, Homo sapiens
uguauacauuuaacaugggaguaccucccuuuu

SEQ ID NO: 136112 - RNA, 39 nt, Homo sapiens
cuggagaauggcugcuccgcucccuccugaagccaggcc

SEQ ID NO: 136113 - RNA, 49 nt, Homo sapiens
uggggggcacagaaagggcagcagaggccuggcugcggccucucucccc

SEQ ID NO: 136114 - RNA, 52 nt, Homo sapiens
gaggaggggggucggaggcacucgguugagccaggccagggaggcggaccag

SEQ ID NO: 136115 - RNA, 46 nt, Homo sapiens
ccacacccuccuucagcacaaacgacugcuucuugaagcucuccag

SEQ ID NO: 136116 - RNA, 50 nt, Homo sapiens
ugggcuccugcucagccaugcucaagcuuagccugggucgggacaccugu

SEQ ID NO: 136117 - RNA, 42 nt, Homo sapiens
cgcgccuuccccuuuaagcgccggccggccgcgucgccgcuu

SEQ ID NO: 136118 - RNA, 46 nt, Homo sapiens
gcgccggccguucggggccagcaccgacaccgcggagccuccgccg

SEQ ID NO: 136119 - RNA, 55 nt, Homo sapiens
cccuguuucugccugggacaccaguccgugucuggguacagaagacaauggauag

SEQ ID NO: 136120 - RNA, 21 nt, Homo sapiens
aggcggggcgggcgcggcccg

SEQ ID NO: 136121 - RNA, 46 nt, Homo sapiens
uccuggggguccacgucgaucugcaugggcuccacggcccccugca

SEQ ID NO: 136122 - RNA, 42 nt, Homo sapiens
ugcgcaucaggccgcuguagcuggccgcguacuguuccagau

SEQ ID NO: 136123 - RNA, 37 nt, Homo sapiens
cagcuccccuuggaaucaaagcccugcaugcacacac

SEQ ID NO: 136124 - RNA, 51 nt, Homo sapiens
guagucccgggcccgggaauagcacuugagggcguugcugagguccccaca

SEQ ID NO: 136125 - RNA, 46 nt, Homo sapiens
ucucugaggagguggcccguaccucggcaaucucugggguggacuc

SEQ ID NO: 136126 - RNA, 36 nt, Homo sapiens
cagagaccuggcgucacaggcagugaagggccaggc

SEQ ID NO: 136127 - RNA, 33 nt, Homo sapiens
ccuggaugagggcacgguugcgaaucugggugu

SEQ ID NO: 136128 - RNA, 45 nt, Homo sapiens
ggcuggaccugcccuguccucagcacgcgugugcaaaagugaaca

SEQ ID NO: 136129 - RNA, 46 nt, Homo sapiens
uugcugcuaagucaggucuugaggggcuggggugacuuaggagugg

SEQ ID NO: 136130 - RNA, 46 nt, Homo sapiens
ccacggggcacagcucugcuacacgcccaugcugcaugcccagguc

SEQ ID NO: 136131 - RNA, 45 nt, Homo sapiens
ccuggaguccaucaucagcaucauccacagcucccuggcugagcc

SEQ ID NO: 136132 - RNA, 30 nt, Homo sapiens
caggugcuggaggcgcugcugccgcugaag

SEQ ID NO: 136133 - RNA, 54 nt, Homo sapiens
caggguggguccuggacaccccugaggccgcaggacccagaguacugggcagga

SEQ ID NO: 136134 - RNA, 46 nt, Homo sapiens
guggggcgccaucggcgacgugggcauuuugguggagacgaugagc

SEQ ID NO: 136135 - RNA, 42 nt, Homo sapiens
ucuccucugugagcugcgggcguggcaaugcgggacagagca

SEQ ID NO: 136136 - RNA, 86 nt, Homo sapiens
caggucuugagagauggcuugcuggagaaccagaccccagaguucuuccaggacgucugcaagcccaaguacagcggcacccugaa

SEQ ID NO: 136137 - RNA, 42 nt, Homo sapiens
gaggugugggcgcuugugcaggccggcauccgggauggggug

SEQ ID NO: 136138 - RNA, 46 nt, Homo sapiens
acagcaccagcuucgccaacucccgggacacauccuucgagcagca

SEQ ID NO: 136139 - RNA, 43 nt, Homo sapiens
gugccuucgaggugucagagaacggcaaccugguagugagugg

SEQ ID NO: 136140 - RNA, 42 nt, Homo sapiens
ugaggauguggugcugcaccaggccaccauccugcccaagac

SEQ ID NO: 136141 - RNA, 45 nt, Homo sapiens
ugaguucguggagcagcugaggaaggaggguguguuugccaagga

SEQ ID NO: 136142 - RNA, 45 nt, Homo sapiens
ggcucugggcccccaaccugcacuuccauagccccaacccugaga

SEQ ID NO: 136143 - RNA, 50 nt, Homo sapiens
ccggcggguguacgccaccauccugaacgccggcaccaauacagauggcu

SEQ ID NO: 136144 - RNA, 46 nt, Homo sapiens
ccugccgccaucguggggggcaucaauguccugcugaagcccaaca

SEQ ID NO: 136145 - RNA, 42 nt, Homo sapiens
gcccagcaucgcacuggacacagccugcuccuccagccugau

SEQ ID NO: 136146 - RNA, 46 nt, Homo sapiens
gcauggugggcugccagcgagcgaugauggccaaccggcucuccuu

SEQ ID NO: 136147 - RNA, 26 nt, Homo sapiens
gugcucccuccccgggcggagaagga

SEQ ID NO: 136148 - RNA, 42 nt, Homo sapiens
ucaucggcgguguggacauggucacggacgaugaccgucgcu

SEQ ID NO: 136149 - RNA, 45 nt, Homo sapiens
aaggcugccuuucuagacuuuaaagacuugcuggagucagaggac

SEQ ID NO: 136150 - RNA, 59 nt, Homo sapiens
ucaaggcugccuuucuagacuuuaaagacuugcuggagucagaggacugggaagaagac

SEQ ID NO: 136151 - RNA, 80 nt, Homo sapiens
ucuuaccaguugauugucacauaguucuggauguguuggccugaauggcuguugugcugcuugugacauggggggcaggg

SEQ ID NO: 136152 - RNA, 39 nt, Homo sapiens
cuucuguguuuucuagucucucccccaggggcugcccag

SEQ ID NO: 136153 - RNA, 42 nt, Homo sapiens
ggauauauauuuaauuuucuuaaauucccguuaaacucuauu

SEQ ID NO: 136154 - RNA, 49 nt, Homo sapiens
gggacgcuuauaagaauauuugauacuucaucagggcauuuaauccagg

SEQ ID NO: 136155 - RNA, 46 nt, Homo sapiens
ccaugugcagcuuguggaccuggccagcacggagaagccacccgug

SEQ ID NO: 136156 - RNA, 49 nt, Homo sapiens
uauugaaauagaauuuucuacagaagucaaggcagucaagcugcggcga

SEQ ID NO: 136157 - RNA, 52 nt, Homo sapiens
uccaggacuggucacuggggaggaagcaggcgaagagggcaccaggucucua

SEQ ID NO: 136158 - RNA, 23 nt, Homo sapiens
auuuagcuuuaguugguggugga

SEQ ID NO: 136159 - RNA, 42 nt, Homo sapiens
agacacuggccuuuggcgcggcgcuggaagcguucggcgaga

SEQ ID NO: 136160 - RNA, 61 nt, Homo sapiens
gcgcgccucggguggggagggcagcagccuguccguuccguggacgccguggacagagcgg

SEQ ID NO: 136161 - RNA, 53 nt, Homo sapiens
cuuuccucuuauuuucuugaugguuuuguagcccguucauuaaugcggaugaa

SEQ ID NO: 136162 - RNA, 42 nt, Homo sapiens
cccuuuggaauucuauuaaauucacaaauucauguaggggag

SEQ ID NO: 136163 - RNA, 51 nt, Homo sapiens
aacaggccugugcacaagacgcauggcaggugugggggagggaggucccag

SEQ ID NO: 136164 - RNA, 46 nt, Homo sapiens
uugaacauggcugcccuccgugugcugagccugcgggggcacggcu

SEQ ID NO: 136165 - RNA, 74 nt, Homo sapiens
acccuauuucccuugcuauccuuauugauugagaauugugcauauugauuuggguaauaauaacuagcacuugg

SEQ ID NO: 136166 - RNA, 53 nt, Homo sapiens
gggcccuugacaacggagggcuguauucuugggggugugaugugagagcuccu

SEQ ID NO: 136167 - RNA, 41 nt, Homo sapiens
gcuguaauguuccuuuuggugguguccagcugucuggcaag

SEQ ID NO: 136168 - RNA, 34 nt, Homo sapiens
agccaugcaccugcuggguccugaguaauccucg

SEQ ID NO: 136169 - RNA, 26 nt, Homo sapiens
agcaucucucacagaacaccugugau

SEQ ID NO: 136170 - RNA, 50 nt, Homo sapiens
ucuguuuuaauccuuuguguuccuugugaggugcugcauccagaggaaag

SEQ ID NO: 136171 - RNA, 41 nt, Homo sapiens
uguucagagcuauuggauaguuuccuuauuuuaaaccuguu

SEQ ID NO: 136172 - RNA, 51 nt, Homo sapiens
ugggaugcugcuggugcgagccucccugcccaggagcccugcgcacccggg

SEQ ID NO: 136173 - RNA, 41 nt, Homo sapiens
aaaccuguuuguauuuauuucucgaugagccaguuuuguuc

SEQ ID NO: 136174 - RNA, 49 nt, Homo sapiens
ucuuauuagggcacuuucccucaugguauugauauuuugaccacagcug

SEQ ID NO: 136175 - RNA, 50 nt, Homo sapiens
ucaagagguucuucuaauucugauguuuucauuccuuuucaggggucugg

SEQ ID NO: 136176 - RNA, 45 nt, Homo sapiens
acuuugagacaucuccaucucaucucaagucacucccgccagcag

SEQ ID NO: 136177 - RNA, 329 nt, Homo sapiens
uaacgcugaucucauugcauagauaagaaaccaugggcccggcgcaguggcggguggaucacuugaggucaggaguucgaggccagccuggccaacauggugaaaccccaucucuacuaaaaauacaaaaauuagcggggcgagguggcgcgugccuguaaucccagcuacucaagaggcugaggcaggagaauugcuugaacuugggaggcgaagguugcagugaaccgagaucacgccauugcacuccagccugggugacaagagcaagacccugccucaaaaacaaaaacaaaaacaaaaacaaaaaaaaccaugguuaccaacgu

SEQ ID NO: 136178 - RNA, 41 nt, Homo sapiens
agugaccugcucugucccuggccgggggcuucuccgagcag

SEQ ID NO: 136179 - RNA, 43 nt, Homo sapiens
ugaccucuccccggguguccuuccuggguuguaccaggggcca

SEQ ID NO: 136180 - RNA, 46 nt, Homo sapiens
uaaguuuugcugaguccaggagagacggcuugaaggccauugcgag

SEQ ID NO: 136181 - RNA, 33 nt, Homo sapiens
ggcccuccugcagcugugucugcuccucugcca

SEQ ID NO: 136182 - RNA, 80 nt, Homo sapiens
gaugagagccucuccaccuugcgcuuugccaaccgagccaagaacaucaagaacaagccccaggugaacgaggaccccaa

SEQ ID NO: 136183 - RNA, 92 nt, Homo sapiens
ggacacacugcugcgggaauuccaagaggagauugcccgccugaaggcccagcuggagaagagggggaugcuggggaagcggccccggagga

SEQ ID NO: 136184 - RNA, 47 nt, Homo sapiens
guacccugagggcccagugauugaggccuggguggcagaagaggagg

SEQ ID NO: 136185 - RNA, 46 nt, Homo sapiens
ggaggagaaggcagccauccaggaugaccgcagccuggugagcgag

SEQ ID NO: 136186 - RNA, 46 nt, Homo sapiens
uguaaguugcuucucucuuuucucaggccucaguuuaccuuucugu

SEQ ID NO: 136187 - RNA, 41 nt, Homo sapiens
uucugaguuauggcaucaacuccgcuucuucccugaccagc

SEQ ID NO: 136188 - RNA, 53 nt, Homo sapiens
caaggaguuggacuagaugauuccuaaaacuuugauuuuagcuacuuaaagga

SEQ ID NO: 136189 - RNA, 49 nt, Homo sapiens
ggaucacaccaacgaacagcagaagauguuggaacugaagaggcaggag

SEQ ID NO: 136190 - RNA, 46 nt, Homo sapiens
auggagcuccggggcaccuacacaucccugcagcaggagguggagg

SEQ ID NO: 136191 - RNA, 58 nt, Homo sapiens
ugggccuggagcagggccaggggaauacagagaggcugaggaggagacuggaaccccg

SEQ ID NO: 136192 - RNA, 41 nt, Homo sapiens
ugaggccuugcccggcugaaccaugggcccuuaauugcaaa

SEQ ID NO: 136193 - RNA, 42 nt, Homo sapiens
ggaacaagguggacagauggccuaccaggagaaagcagccag

SEQ ID NO: 136194 - RNA, 45 nt, Homo sapiens
agggucagcagggaccacuaaugggguacggcaccuuuuuauaug

SEQ ID NO: 136195 - RNA, 50 nt, Homo sapiens
aggcuuuuguuuuuguuugguguuggagccgaaagugcaggagguguuua

SEQ ID NO: 136196 - RNA, 44 nt, Homo sapiens
uuacaagugaaugaucggcaagggcauuccaggcagagggaaga

SEQ ID NO: 136197 - RNA, 52 nt, Homo sapiens
guggccaagaaaggguuuuuuucccucauucucucccucuugguuuuuuccu

SEQ ID NO: 136198 - RNA, 59 nt, Homo sapiens
gguuacuaauuuggggaauuguggauauugcugggaugggaagggacaguuuaauuuuu

SEQ ID NO: 136199 - RNA, 45 nt, Homo sapiens
cacacaaacuccagaggugaagagggcaucuucuauaagguucca

SEQ ID NO: 136200 - RNA, 45 nt, Homo sapiens
ucacauggaacuuucuguauuucuuuuugguuuuagcuguucuag

SEQ ID NO: 136201 - RNA, 49 nt, Homo sapiens
gaaauaauagaaaaauauaggguguguauuuuaagaaaguguauaacau

SEQ ID NO: 136202 - RNA, 48 nt, Homo sapiens
aagauuucuuuuuuauuuaauucuugcuacuuacuaaccaauauucag

SEQ ID NO: 136203 - RNA, 46 nt, Homo sapiens
gugccugcauaugaauguuguauauaauuuuuaucuucggauauag

SEQ ID NO: 136204 - RNA, 47 nt, Homo sapiens
augauuaauccuaauuggaugccuacauuuucagaaagaugugccgg

SEQ ID NO: 136205 - RNA, 45 nt, Homo sapiens
uucugagaacagcagcagcagcagugaugguggcagcaacaagga

SEQ ID NO: 136206 - RNA, 29 nt, Homo sapiens
gugcuccagcucuucaucccuuccugccu

SEQ ID NO: 136207 - RNA, 48 nt, Homo sapiens
agcuugaauauccuuuuagauuugagugaugauaggugaguugucuuu

SEQ ID NO: 136208 - RNA, 106 nt, Homo sapiens
cucauucauuuaagucccuucagaaugguuacuaugccuauauuagaaaaauaguuauaauucacuaccaucccucuguuaauguuuuugcuacuccuggagagaa

SEQ ID NO: 136209 - RNA, 42 nt, Homo sapiens
caguagugaaaagagguguaguccagggcccuccauucccug

SEQ ID NO: 136210 - RNA, 55 nt, Homo sapiens
agauucauguuuucuggaugggauugggacagggaaaucaauauuaaagaaaguc

SEQ ID NO: 136211 - RNA, 34 nt, Homo sapiens
aaauauugcauuaugaagcaacuguaggacuauu

SEQ ID NO: 136212 - RNA, 27 nt, Homo sapiens
agacaaguuauugugagauguagcuua

SEQ ID NO: 136213 - RNA, 27 nt, Homo sapiens
cuuaauuucaauaauuauauugguaug

SEQ ID NO: 136214 - RNA, 40 nt, Homo sapiens
aucgucguccuccccgcagucaggcugcccaucacccacc

SEQ ID NO: 136215 - RNA, 43 nt, Homo sapiens
uuuuuaaauuauauuuacuuacacaauccuuguacugccaaaa

SEQ ID NO: 136216 - RNA, 47 nt, Homo sapiens
gagaccacagcugggcaagagaugucagcaaauuuugagagaugaaa

SEQ ID NO: 136217 - RNA, 39 nt, Homo sapiens
cuuugaggaugccaguucuugguuagaacaaguuaggag

SEQ ID NO: 136218 - RNA, 41 nt, Homo sapiens
ccugagaugcaggugagaauucgacaagagauugagaagga

SEQ ID NO: 136219 - RNA, 78 nt, Homo sapiens
cucucuuaucagaauaguuccaguagucucccagucagaguguaaagaagaagcauugcaaaugucaucaccaggcag

SEQ ID NO: 136220 - RNA, 49 nt, Homo sapiens
gagccccugcuuuccucagcucucaauacacaugagcuuagcagcauuc

SEQ ID NO: 136221 - RNA, 47 nt, Homo sapiens
aauuauaacaaaagugaaagccaagaaucuuuaguuacaucgccaag

SEQ ID NO: 136222 - RNA, 47 nt, Homo sapiens
ggagacuaauaugaaagaaccucuagcaacucuuguugaucagagcc

SEQ ID NO: 136223 - RNA, 46 nt, Homo sapiens
cugggagaagaggccacgugucacugagaaucgccagcaccagcag

SEQ ID NO: 136224 - RNA, 41 nt, Homo sapiens
gacaagguccaggagaggguggugaagggcagacugcuaga

SEQ ID NO: 136225 - RNA, 41 nt, Homo sapiens
gggccccacacuggaacuggcaggaacuggaagcaggggag

SEQ ID NO: 136226 - RNA, 42 nt, Homo sapiens
gcacaguugagcucaaagcagguccuaguaagaauauaccua

SEQ ID NO: 136227 - RNA, 41 nt, Homo sapiens
gggagcgcucauagcuaccaacacaacagaaaauagcacca

SEQ ID NO: 136228 - RNA, 44 nt, Homo sapiens
aaucuucuuaaauugaaauuuuugguaaggaauucauuucacag

SEQ ID NO: 136229 - RNA, 46 nt, Homo sapiens
ugaauaccagucuauuuaucaguugguuucaacacagagguuucaa

SEQ ID NO: 136230 - RNA, 52 nt, Homo sapiens
aggcauuaugccugaugcauacgccucccgugcaccccuaucuagccuucag

SEQ ID NO: 136231 - RNA, 52 nt, Homo sapiens
acugaagcuaucugugguauuucauguaacauuucuaagaauaagagcuggc

SEQ ID NO: 136232 - RNA, 79 nt, Homo sapiens
uguaauguuuggaaaaaucacugauggacuucuagugaugagaaagauucagaauguucccacaggccccaacaauaag

SEQ ID NO: 136233 - RNA, 46 nt, Homo sapiens
cacucagcuccaggccugcuuuccacggcaaacagcggucccagua

SEQ ID NO: 136234 - RNA, 70 nt, Homo sapiens
uuccacagggucauaaaggauuucaugauuuaggguggagauuuuguuaauggagaugguacuggagucg

SEQ ID NO: 136235 - RNA, 60 nt, Homo sapiens
ucugcagacguugugccuaagacgaccgagaacuuuggguaguucugcacuagagaauuc

SEQ ID NO: 136236 - RNA, 355 nt, Homo sapiens
ccgggcaggugggccagcacccagcucccuacaugugguuucuguuuuuuuuuuuuuucuuuuugagaccgaguuucacucuguugcccaggcuagagugcaguggcgcgaucuuggcuaacugcaaccuccgccucccagguucaagugauucucaugccucaggcucccaaguagcugggauuacagaugugcaccaccacgcccggcuaauauuuguauuuuuaguagagaugggguuuuaccauguuggccaggcucaucucaaacuccugaccucaggugauccacccacaucggccucccagagugcuaggauuacaggcgggagccacuacacccggcccccacaugu

SEQ ID NO: 136237 - RNA, 360 nt, Homo sapiens
gugggggccggguguaguggcucccgccuguaauccuagcacucugggaggccgauguggguggaucaccugaggucaggaguuugagaugagccuggccaacaugguaaaaccccaucucuacuaaaaauacaaauauuagccgggcgugguggugcacaucuguaaucccagcuacuugggagccugaggcaugagaaucacuugaaccugggaggcggagguugcaguuagccaagaucgcgccacugcacucuagccugggcaacagagugaaacucggucucaaaaagaaaaaaaaaaaaaacagaaaccacauguagggagcugggugcuggcccaccugcccggcaacaucag

SEQ ID NO: 136238 - RNA, 43 nt, Homo sapiens
auccuaccucaccacccugacuucagccggugccuccccaggg

SEQ ID NO: 136239 - RNA, 44 nt, Homo sapiens
cccaucaauccggccacagcugcugccuacccaccugcccccuu

SEQ ID NO: 136240 - RNA, 42 nt, Homo sapiens
gguggguaggcagcagcuguggccggauugauggggccccca

SEQ ID NO: 136241 - RNA, 1291 nt, Homo sapiens
gccgcauucucagauccuucaccaucaccugcagcaggauggccagguaauagcccuuccccuucucuccuuucccuuccucuuccuuccuaucccuuaaaacugccuucccuuuccuuuucuuacccuuccucaccaccaccuucacccaaucccuccccagcgccagucaugggcacacagcacauacagacacaagcgcacauaacacgagcggccggcaaaggaaaucucagagaagggccggguugaaaccuuuuuugcccaauuccuuuggugcccuucuccuccugugccacaguuguccucaucccaucagaccugggucacaccuucccucuuuccucucccagccuucccucuucccugacauuuuagcuuucccuucuaaugguggaguucuauugucaaaguuugucccuuuauuuuccauauauccugguucugccucagcuaccauauuugcagaugauucucuguugccagcgccagcaggaggagcagguaaugaaauugaaugaucauaugcuugaacccacuccuuuucaguccccauuucaccuucacagccucagggaacuugaaaagacugcgcggucacaaaucgggauacacaaacacaaacaccuugcugagcucucuggccuccccuuccucucuccuccuccccuccccaacacccucuuuaucuuuguacccuuccccagcuguggaaaacauucgguuaccagaauggaaaagauucuuggggcagcaucuggagccugaggccucagacugccucucauaccugccugaaaugggcucacagaugugaugugugguagggguggggaucuguggggcgaugcaaguggccucuugagagcuccauuauagguggcuggagcuagaauaagggcuuccuuccucaaagacagcuuuccaaauugaggcauuaauggggaucaauggaaaugaaauugccuugugaucacccaucuccaagagcaggggagagaggggguagugugagaauguagaauugaaaaugaguagaacucacucacuaccuugucucuaaagguaucuugcccucuucaucuuuucccuauuuaaaagucaaaaaugccuuccugcuuguaagaaaggggcuuuagcagcuaugcagaccaaauuuucuaugguucuaauaguagugaggggaaugggagagcaagacaguuugcacaucuccaccugaagauguuacaaauuuguaccacuaacuagacaccuuuuuccuccucaugauccucccauuccccugcag

SEQ ID NO: 136242 - RNA, 1290 nt, Homo sapiens
uugcccgcugcccgucugcaggggaaugggaggaucaugaggaggaaaaaggugucuaguuagugguacaaauuuguaacaucuucagguggagaugugcaaacugucuugcucucccauuccccucacuacuauuagaaccauagaaaauuuggucugcauagcugcuaaagccccuuucuuacaagcaggaaggcauuuuugacuuuuaaauagggaaaagaugaagagggcaagauaccuuuagagacaagguagugagugaguucuacucauuuucaauucuacauucucacacuacccccucucuccccugcucuuggagaugggugaucacaaggcaauuucauuuccauugauccccauuaaugccucaauuuggaaagcugucuuugaggaaggaagcccuuauucuagcuccagccaccuauaauggagcucucaagaggccacuugcaucgccccacagauccccaccccuaccacacaucacaucugugagcccauuucaggcagguaugagaggcagucugaggccucaggcuccagaugcugccccaagaaucuuuuccauucugguaaccgaauguuuuccacagcuggggaaggguacaaagauaaagaggguguuggggaggggaggaggagagaggaaggggaggccagagagcucagcaagguguuuguguuuguguaucccgauuugugaccgcgcagucuuuucaaguucccugaggcugugaaggugaaauggggacugaaaaggaguggguucaagcauaugaucauucaauuucauuaccugcuccuccugcuggcgcuggcaacagagaaucaucugcaaauaugguagcugaggcagaaccaggauauauggaaaauaaagggacaaacuuugacaauagaacuccaccauuagaagggaaagcuaaaaugucagggaagagggaaggcugggagaggaaagagggaaggugugacccaggucugaugggaugaggacaacuguggcacaggaggagaagggcaccaaaggaauugggcaaaaaagguuucaacccggcccuucucugagauuuccuuugccggccgcucguguuaugugcgcuugugucuguaugugcugugugcccaugacuggcgcuggggagggauugggugaaggugguggugaggaaggguaagaaaaggaaagggaaggcaguuuuaagggauaggaaggaagaggaagggaaaggagagaaggggaagggcuauuaccuggccauccugcugcaggugauggugaag

SEQ ID NO: 136243 - RNA, 45 nt, Homo sapiens
guauauccugaagggcagggacaucuugccuagaggcccacuagc

SEQ ID NO: 136244 - RNA, 45 nt, Homo sapiens
guccacacugucaauggccgaugacagggacuggcaggggagggu

SEQ ID NO: 136245 - RNA, 43 nt, Homo sapiens
aaugcucacauggauagugguaaggaaucaagaagccuggguu

SEQ ID NO: 136246 - RNA, 65 nt, Homo sapiens
cuagacuaguguuuguucuguggcauagaaagagaagcaugccuccccuggcacuggccuaagag

SEQ ID NO: 136247 - RNA, 43 nt, Homo sapiens
agcuuuuaaccaaauugcagcuaaauuaaucucacuuuaaagu

SEQ ID NO: 136248 - RNA, 40 nt, Homo sapiens
gauuguuauaaggaaguuucaccuuugugguuucaccuaa

SEQ ID NO: 136249 - RNA, 80 nt, Homo sapiens
aaagaaaggaauggacagauguaugcuuuacaaggcacuuccacggcgagugacucauucaugcuuaggacaacccaggg

SEQ ID NO: 136250 - RNA, 45 nt, Homo sapiens
cgaaggcaaguucagaaaucagguagagagacucauauugaagac

SEQ ID NO: 136251 - RNA, 42 nt, Homo sapiens
ggccguauuucauacuaagaaguuuggacuuuaacuuguaau

SEQ ID NO: 136252 - RNA, 46 nt, Homo sapiens
ggggcauuaaugagugcuuuaagaaaaaacuaguagcuguguggaa

SEQ ID NO: 136253 - RNA, 44 nt, Homo sapiens
gcauuaucuccauuuaagagaggaagaggcagauaaagcccaug

SEQ ID NO: 136254 - RNA, 45 nt, Homo sapiens
aggacaaacggaaagccaacuaugagcgagggaacauggagcugg

SEQ ID NO: 136255 - RNA, 82 nt, Homo sapiens
gaauggaagaaacaacuugaauuagaaaaacgcuuagagaagcaacgggaauuggagagacaacgagaggaagaaaggagaa

SEQ ID NO: 136256 - RNA, 45 nt, Homo sapiens
uuagaaugggagagaauucggcgacaggagcuucucaaucaaaag

SEQ ID NO: 136257 - RNA, 37 nt, Homo sapiens
uauuaaaugaaagaauuaaaaacaugcaguucaguaa

SEQ ID NO: 136258 - RNA, 48 nt, Homo sapiens
uuacagaucuugacaaaagcacuaugaucaagaugagcucugaaacau

SEQ ID NO: 136259 - RNA, 31 nt, Homo sapiens
auaaaauaguuaucucugaaaagaaauggag

SEQ ID NO: 136260 - RNA, 46 nt, Homo sapiens
ccuuaggaacugagagaaaccuacaacacacagcaguuagcccuug

SEQ ID NO: 136261 - RNA, 46 nt, Homo sapiens
gaaauugaaaggaaaagauuagaacuaaugcagaaaaagaaacuag

SEQ ID NO: 136262 - RNA, 47 nt, Homo sapiens
aagcaaagcaaggaaaagaaaacuuauggaaagaaaaucuuagaaag

SEQ ID NO: 136263 - RNA, 130 nt, Homo sapiens
aucuccacugcugccgggccuggcggguguggggaggcuguagggggucaggagggaaguggaucggcucuugguggguagggggcgggaaggaggagauucaggcgugcagagaggaugaggagaaugg

SEQ ID NO: 136264 - RNA, 42 nt, Homo sapiens
ugcccagacacagcagcacaccagaccacaccagcacacugg

SEQ ID NO: 136265 - RNA, 45 nt, Homo sapiens
aauuccagauuucuuccaugacccgaagccagaaggacuuuaggc

SEQ ID NO: 136266 - RNA, 47 nt, Homo sapiens
gcuggcgguggucuggccuugcugcugucccuggacuuggacgggcg

SEQ ID NO: 136267 - RNA, 45 nt, Homo sapiens
ccugcugaccuucuccaaccugcgucgucacgggcguggucuggc

SEQ ID NO: 136268 - RNA, 46 nt, Homo sapiens
acaaaaaauauugcaucuuucuguuggagaaucucggcccccaggc

SEQ ID NO: 136269 - RNA, 100 nt, Homo sapiens
gcagcuacacauauugaccuaauucaaucugaggguagaacaacauggcaaaucuugggggcagcagcuguuccaagggucaagaaauaucguacaccca

SEQ ID NO: 136270 - RNA, 29 nt, Homo sapiens
cgagggccggggagggggcagccacgcgg

SEQ ID NO: 136271 - RNA, 50 nt, Homo sapiens
agguaugaggagugcccugcucagcagguuggucugggugguggugguuu

SEQ ID NO: 136272 - RNA, 23 nt, Homo sapiens
gagggggugaugccagcagcggg

SEQ ID NO: 136273 - RNA, 58 nt, Homo sapiens
ccaccaggguucaaguagcauccagagcaagugcuucucugucuguugcuugcucagg

SEQ ID NO: 136274 - RNA, 34 nt, Homo sapiens
aaucugggaguggaucaaguugcccagagaacag

SEQ ID NO: 136275 - RNA, 42 nt, Homo sapiens
acagggaaugaugaagaggcuuucgacuuuuuugaggagcaa

SEQ ID NO: 136276 - RNA, 75 nt, Homo sapiens
agcgccgguacaccugucaccuguuacagcuuccuagagcaggcgauucuggagguggggcagccccuggcccug

SEQ ID NO: 136277 - RNA, 42 nt, Homo sapiens
aggggggcugcuccacagaacccaaguguuaacuagaacaau

SEQ ID NO: 136278 - RNA, 45 nt, Homo sapiens
ggcacuuaccaaagcugcuuucugcccuccugaguccuagcccug

SEQ ID NO: 136279 - RNA, 41 nt, Homo sapiens
ugguagagcaaguacaaucccacuuuauagaagagacugag

SEQ ID NO: 136280 - RNA, 46 nt, Homo sapiens
ugagugaccguaacacugccagggcuuuuugcccacccaccagugg

SEQ ID NO: 136281 - RNA, 55 nt, Homo sapiens
ggaaggcaaauggguggagccggugcuggagcugucccagagcuggcucagagcc

SEQ ID NO: 136282 - RNA, 32 nt, Homo sapiens
uccacccauuugccuucccccuucacacccgc

SEQ ID NO: 136283 - RNA, 37 nt, Homo sapiens
uugucuuguuuuuuauuuuuuaaauaaacugacaaau

SEQ ID NO: 136284 - RNA, 52 nt, Homo sapiens
auggggggauguuauauaaauauagauauaauuuuauuuucggagcuaagau

SEQ ID NO: 136285 - RNA, 50 nt, Homo sapiens
ugcgcauccaagccuacgacuaccucgagugcucugccaagaccaaggaa

SEQ ID NO: 136286 - RNA, 26 nt, Homo sapiens
gacuuuucuaauaggaaaaaaaaaaa

SEQ ID NO: 136287 - RNA, 38 nt, Homo sapiens
gcggaugccggcgggugcacguggagggggagggggag

SEQ ID NO: 136288 - RNA, 44 nt, Homo sapiens
uuugaacuuuacccaaaaccuuuacaauauauaucauugcccca

SEQ ID NO: 136289 - RNA, 32 nt, Homo sapiens
gaaguaaauugggaccugagagagcagggugg

SEQ ID NO: 136290 - RNA, 48 nt, Homo sapiens
uaauccuguucccucucccagagcucccaccuacccgcaguggccuag

SEQ ID NO: 136291 - RNA, 55 nt, Homo sapiens
ugauggcgggggguagaugggcaaccucucggguuagcgacugggcccgcugccc

SEQ ID NO: 136292 - RNA, 39 nt, Homo sapiens
uuuccuuaaaacugauugggucaacugguagggcugggg

SEQ ID NO: 136293 - RNA, 35 nt, Homo sapiens
gagauguuguagaucggauguggccuuguguggag

SEQ ID NO: 136294 - RNA, 48 nt, Homo sapiens
cggccuggaggcuacagcugccuccaccuccacccugccggcuggaga

SEQ ID NO: 136295 - RNA, 41 nt, Homo sapiens
gccucaccgcccgggagcaggaggccaccccccgacccagg

SEQ ID NO: 136296 - RNA, 60 nt, Homo sapiens
ccacacagaggauggagguccuucugccaccgagagggcugcugaggauggagccuccag

SEQ ID NO: 136297 - RNA, 55 nt, Homo sapiens
ggaucagggggccacgggggccucacagggccuccuggacaggaaagaggugcug

SEQ ID NO: 136298 - RNA, 45 nt, Homo sapiens
ugcugugugccugguggguuucaugcuguaccgcaugaagaagaa

SEQ ID NO: 136299 - RNA, 26 nt, Homo sapiens
aggaguccacuuuguuucguggggag

SEQ ID NO: 136300 - RNA, 45 nt, Homo sapiens
uguccaugcgcucagggccaugcugaggccugggccgcugccacg

SEQ ID NO: 136301 - RNA, 53 nt, Homo sapiens
cacccacuagaucuacuuccuuuggccuaccugauuuuccccucagccuggga

SEQ ID NO: 136302 - RNA, 42 nt, Homo sapiens
gcgcgaagaagcuggcaggggcacgagccgggggcggguuug

SEQ ID NO: 136303 - RNA, 41 nt, Homo sapiens
uuggcugcggguggagaacguuugucaggggcccggccaag

SEQ ID NO: 136304 - RNA, 51 nt, Homo sapiens
uuucguauuuuagcuagaaaagaagcauaccugguuaaguaacaggaaauu

SEQ ID NO: 136305 - RNA, 58 nt, Homo sapiens
aaauucuggcauuccugaaaugguuuucucuaucauuuauugaagaauuugaagccag

SEQ ID NO: 136306 - RNA, 46 nt, Homo sapiens
ccacagugaaauuaaacuugaagugucucuaguacuaaaagaagau

SEQ ID NO: 136307 - RNA, 48 nt, Homo sapiens
uaaaaggaaaaugcauuuccuguguguuuaucauucaaggugaaacag

SEQ ID NO: 136308 - RNA, 35 nt, Homo sapiens
auucagauauuauaaugggauuucagcaggcuguu

SEQ ID NO: 136309 - RNA, 46 nt, Homo sapiens
uggagcauguguaaagaggaagacaaaagggaaauagguagcuagg

SEQ ID NO: 136310 - RNA, 59 nt, Homo sapiens
ugugaaaaaauuagugaacauggauuaauggagaguuggaacaaccugaggaagaguug

SEQ ID NO: 136311 - RNA, 46 nt, Homo sapiens
cuguucuuauguuuauaaucaguucaaugcugguuuauggagcaau

SEQ ID NO: 136312 - RNA, 43 nt, Homo sapiens
caguugccugguugcuauuaguucucucaccuauuugccaaga

SEQ ID NO: 136313 - RNA, 46 nt, Homo sapiens
uuuucccuacaaagaugaccuccuggccuuggacuccagcugccuc

SEQ ID NO: 136314 - RNA, 46 nt, Homo sapiens
guguuuggaacugcuauaaauacaucaacaaccgaaacgugccgga

SEQ ID NO: 136315 - RNA, 81 nt, Homo sapiens
uuaguacguuuugccaaccuaugaaauggccgugaaaaugccugaaaaagaaccaccaccuccuuacuuaccugccugaag

SEQ ID NO: 136316 - RNA, 48 nt, Homo sapiens
uauaaaauauguugucuuuuguuuaagcauuuauuuucaaacacuaag

SEQ ID NO: 136317 - RNA, 57 nt, Homo sapiens
uuguuaagucuuuuacauuuuaauaguuuuugaagacaaucuagguuaagcaagagc

SEQ ID NO: 136318 - RNA, 65 nt, Homo sapiens
uuguuacuugcuacccugaguacuuucaggaagacugacuuaaauauucggggugaguaaguagu

SEQ ID NO: 136319 - RNA, 83 nt, Homo sapiens
uggguauaagaucugaacuuuucaucugcagaggcaagaaaaauauuugacauugugacuugacuguggaagaugaugguugc

SEQ ID NO: 136320 - RNA, 25 nt, Homo sapiens
ggcccccgacggacaccaccaggcc

SEQ ID NO: 136321 - RNA, 41 nt, Homo sapiens
agcaauugauuccugaagcagagcaaagcucauagugcagc

SEQ ID NO: 136322 - RNA, 67 nt, Homo sapiens
gcuucauacauguaggcccucaaaaaauguuuuuggugaaugaauaagucaaaagagagaugaccaa

SEQ ID NO: 136323 - RNA, 45 nt, Homo sapiens
uugagcucuaugcugugggcguggaccgggcagacauggcguccc

SEQ ID NO: 136324 - RNA, 39 nt, Homo sapiens
auugcucagaggguggugagcucacuggagcaaacauag

SEQ ID NO: 136325 - RNA, 61 nt, Homo sapiens
acuuuuaagggagguacagauaauuggaaagaaucaauuuccaaauccuucacuugcuuaa

SEQ ID NO: 136326 - RNA, 51 nt, Homo sapiens
cauugccauuuuuaauucauucuggucuuugaaagaaauguacuacuaaag

SEQ ID NO: 136327 - RNA, 87 nt, Homo sapiens
caaaaucuaauguugucuuuuuaauguuagugauccaccugccucagccucccaaagugcugggauuacaggcuugaaagucuaacu

SEQ ID NO: 136328 - RNA, 44 nt, Homo sapiens
uuuuuuggguucugguacaggauauuuugaugaugcuuuggaag

SEQ ID NO: 136329 - RNA, 45 nt, Homo sapiens
uucaagaugcuacuuugagcuuaaaacagacuauucuagacaaag

SEQ ID NO: 136330 - RNA, 43 nt, Homo sapiens
cuagagagacauaacauuuaggcuuaaaaauaaacauguccua

SEQ ID NO: 136331 - RNA, 44 nt, Homo sapiens
auuacugcuauggaaaagcuguucugugguggaaauuacccgaa

SEQ ID NO: 136332 - RNA, 49 nt, Homo sapiens
gcgcaggguaacuucuguggccucagaugcaaucagcagcagcagccuu

SEQ ID NO: 136333 - RNA, 48 nt, Homo sapiens
auugauacaauuaaaacacauaguuuauccuuuuuaaaaucacaagaa

SEQ ID NO: 136334 - RNA, 49 nt, Homo sapiens
uugguccugauaaaaaauuuaaauugcucauaaaauguuuuaguaccca

SEQ ID NO: 136335 - RNA, 46 nt, Homo sapiens
ggacuucuugaauaaagucgaugacuacaucaaguguuaaugccag

SEQ ID NO: 136336 - RNA, 42 nt, Homo sapiens
uggaccucgccucgcugcgcucggugcgcgccuucugccagg

SEQ ID NO: 136337 - RNA, 49 nt, Homo sapiens
cugagaggaguccaaaaagccacuuugaggcggccgggaagcugcaggg

SEQ ID NO: 136338 - RNA, 52 nt, Homo sapiens
cuguggaguaggcauuauuaucaucccuguuuuacaacgcgaggaaacugag

SEQ ID NO: 136339 - RNA, 58 nt, Homo sapiens
gggauagaauuuuaguaguuugcaaguauuuuuaaacauuuuaucauagguacacuua

SEQ ID NO: 136340 - RNA, 46 nt, Homo sapiens
caccugagguagaaggagugucaggaagauacuuuggggauuguaa

SEQ ID NO: 136341 - RNA, 45 nt, Homo sapiens
gcuauggaugaaucuguugcaagaaaacucugggauaucagugaa

SEQ ID NO: 136342 - RNA, 59 nt, Homo sapiens
uuguaaaauuauaacugggcaagcauggaugacauauuaauauuugucagaauuaagug

SEQ ID NO: 136343 - RNA, 53 nt, Homo sapiens
uccagcugagcaaagaguuucauuuucuguuuauauacagcuuguuugaacag

SEQ ID NO: 136344 - RNA, 45 nt, Homo sapiens
cacaguguguuccacguauucuuuuccugccuaaauuacauccag

SEQ ID NO: 136345 - RNA, 57 nt, Homo sapiens
uuucacuacucagcguggaaacaagaugaaauuccauuuguagguagggagacgaaa

SEQ ID NO: 136346 - RNA, 102 nt, Homo sapiens
ugcacccuggauuugccuacauucuucaagaucccauuugaauuucuuagugacuaaaccauugugcauucuagaaugcauauaugcauauuuugccuguua

SEQ ID NO: 136347 - RNA, 60 nt, Homo sapiens
ucaacuuagcauuuucugcaucuccacuuggcauuagcuaaaaccuuccaugucaagauu

SEQ ID NO: 136348 - RNA, 46 nt, Homo sapiens
gaaacacugccacuugcugugccaaauggaacacagaggauaaaau

SEQ ID NO: 136349 - RNA, 73 nt, Homo sapiens
gacugucacuugggcuaagcagauuguguggaaugguccugugggggguauuugaaugggaagcuuuugccca

SEQ ID NO: 136350 - RNA, 46 nt, Homo sapiens
uaggcaagguaaucuucacaccauucuucucagcuugggacauuag

SEQ ID NO: 136351 - RNA, 179 nt, Homo sapiens
uauuggugguggaacggcuuuuaccuuccuuaaggugcucaacaacauggagacuggcacuucucuguuugaugaagagggagccaagauugucaaagaccuaaugucccaagcugagaagaauggugugaagauuaccuugccuauugacuuugucacugcugagaaauuugaugaga

SEQ ID NO: 136352 - RNA, 63 nt, Homo sapiens
cccauagcgacccuuccuggccauucuggguggagcuaaauuugcagacaagauccaccugau

SEQ ID NO: 136353 - RNA, 72 nt, Homo sapiens
ugggaacaagguuaaagugagcccgccaaaauagaagcuuuccgagcuucacuuuccaagcuagggaaugug

SEQ ID NO: 136354 - RNA, 67 nt, Homo sapiens
ugcugggucugucauccugcuggagaaccuccacuuucauguggaagaagaagggaagggaaaacuc

SEQ ID NO: 136355 - RNA, 46 nt, Homo sapiens
cuucugggccuacacagucuuucaagaacagaacauccuugcccag

SEQ ID NO: 136356 - RNA, 114 nt, Homo sapiens
ccagccugauggugucccuaugccugacaauacuccuuagagccauuugcuguagaauucaaaucucugcugggcaaggauguucuguucuugaaagacuguguaggcccagaa

SEQ ID NO: 136357 - RNA, 53 nt, Homo sapiens
augagaguggacuucaauguuccuguguagaauaaccagauaacaaacaacca

SEQ ID NO: 136358 - RNA, 45 nt, Homo sapiens
uagaaagcgacauuuuggaaauggagagaggucgaugauucagac

SEQ ID NO: 136359 - RNA, 46 nt, Homo sapiens; identical to SEQ ID NO: 39612

SEQ ID NO: 136360 - RNA, 38 nt, Homo sapiens
gauuuuuuuugggggguggggggguauagaggaggagg

SEQ ID NO: 136361 - RNA, 48 nt, Homo sapiens
ucauguacagguaauggcuguagccagagaauagguuugauugacaaa

SEQ ID NO: 136362 - RNA, 47 nt, Homo sapiens
uaccagcaguaccaggacgccacggccgacgaacaaggggaguucga

SEQ ID NO: 136363 - RNA, 46 nt, Homo sapiens
ggccucggugaacuccaucucguccaugcccucgcccguguaccag

SEQ ID NO: 136364 - RNA, 45 nt, Homo sapiens
cugguacacgggcgagggcauggacgagauggaguucaccgaggc

SEQ ID NO: 136365 - RNA, 44 nt, Homo sapiens
uguccaugaaggagguggacgagcagaugcucaacgugcagaac

SEQ ID NO: 136366 - RNA, 44 nt, Homo sapiens
uacugcuggcugccccggcuggucaggggcgcgaagccgggcau

SEQ ID NO: 136367 - RNA, 42 nt, Homo sapiens
gguggugaccccgcucaugguggccgacaccaggugguugag

SEQ ID NO: 136368 - RNA, 46 nt, Homo sapiens
agggcuccaccaccgugucugacaccuugggugagggcaugacgcu

SEQ ID NO: 136369 - RNA, 46 nt, Homo sapiens; identical to SEQ ID NO: 43718

SEQ ID NO: 136370 - RNA, 45 nt, Homo sapiens
ggucuggguacucuucccggaucuugcugaugagcagggugccca

SEQ ID NO: 136371 - RNA, 441 nt, Homo sapiens
gcacgauggauucgguuaggucuggaccauucggccagaucuucagaccagacaauuucguguuuggugagugccugguguggcugagagcaugagggauucauuuuacgcugggcaguggaggcugaagaggugugauugccagagggaaagcaugaagaacauccgcggugugccaacuuagcuuuaauauaguguaaaauuguuugccuuucagcugcuaagagcuugguguccuggccuuccuuauuuauaauuauauucaugaacaaauauuuuaacguuuggccauuuuggugauaaucugaaauagucuuaucugagcauugacucacugaucuauauugagggguuugagguaagguauuuaguacaaucaccggugacuuaagauuucucuuucccucuggcaggccagaguggagccgggaauaacugggc

SEQ ID NO: 136372 - RNA, 42 nt, Homo sapiens
cccacuggcaguuaccauggagacagugauuugcagcuggag

SEQ ID NO: 136373 - RNA, 45 nt, Homo sapiens
ugguaacugccaguggggucaaucccaugcucaucacugaugacc

SEQ ID NO: 136374 - RNA, 45 nt, Homo sapiens
gccagcucucugcucuccacagggcuccccgccccacccggccug

SEQ ID NO: 136375 - RNA, 87 nt, Homo sapiens
uucguguucgccgugguggccgaaaacgcccaguuccuaagggugcaacuuacggcaagccuguccaucaugguguuaaccagcuaa

SEQ ID NO: 136376 - RNA, 46 nt, Homo sapiens
cacauacaaauuuuuugagguuauccucauugauccauuccauaaa

SEQ ID NO: 136377 - RNA, 47 nt, Homo sapiens
agggccauaaguuccaccacacuauugguggcucucgccgggcagcu

SEQ ID NO: 136378 - RNA, 45 nt, Homo sapiens
aaauuagauagaaauuuguccuauggaugugugaagucacuucuc

SEQ ID NO: 136379 - RNA, 45 nt, Homo sapiens
ucguuugaggaucagcucgcuggacugagcccucccgggacccag

SEQ ID NO: 136380 - RNA, 36 nt, Homo sapiens
cuugguuuuaacucuucccuucagcuuaagacacag

SEQ ID NO: 136381 - RNA, 42 nt, Homo sapiens
ggguucuugcagaucaugcccggcaugguggacguggagcag

SEQ ID NO: 136382 - RNA, 41 nt, Homo sapiens
cccguucguuuuaauaccgggggugcuuccuucccgugggg

SEQ ID NO: 136383 - RNA, 40 nt, Homo sapiens
gggaauuucuuuucgcagaagccauuacuccccccgguaa

SEQ ID NO: 136384 - RNA, 42 nt, Homo sapiens
uagcgcuugcucggcuccaacacaguucccaggagccccccg

SEQ ID NO: 136385 - RNA, 41 nt, Homo sapiens
auauuauuaacugaaaaaucugacacacccggggggcgggg

SEQ ID NO: 136386 - RNA, 47 nt, Homo sapiens
gacuuucauuacucaaaucuuauucaguaaauguaaaaaucagaagg

SEQ ID NO: 136387 - RNA, 46 nt, Homo sapiens
auacagcuucauccaggaccaggaaucuaacuugagauaaguucag

SEQ ID NO: 136388 - RNA, 44 nt, Homo sapiens
gagggcuugguuuuucauauguggugguauuucaaaugccagac

SEQ ID NO: 136389 - RNA, 46 nt, Homo sapiens
uucaugccucucuccugucacuauggauaaacugugcugccuaagg

SEQ ID NO: 136390 - RNA, 41 nt, Homo sapiens
aaacacuuccuucaccaggacuguaggacccaugcuuucuu

SEQ ID NO: 136391 - RNA, 45 nt, Homo sapiens
cauagucaaugcucaauaaauauuaguucaaguaaaggcagggag

SEQ ID NO: 136392 - RNA, 56 nt, Homo sapiens
uggggggauuuuuaaaaaccacaauuauugaauaucauguaucuuuucacuacuaa

SEQ ID NO: 136393 - RNA, 46 nt, Homo sapiens
ucuuuccuguuccaccaaagccaaauccaaacuugucaguaccuag

SEQ ID NO: 136394 - RNA, 46 nt, Homo sapiens
cugcaugguagaccacccgacccugcauaacccuuggucaugacag

SEQ ID NO: 136395 - RNA, 45 nt, Homo sapiens
ucugacccaauugcuggauuugagaagaaaacacagaaaaacacg

SEQ ID NO: 136396 - RNA, 45 nt, Homo sapiens
gauccucugucauauggguucaucugccauuuguucagcacuaaa

SEQ ID NO: 136397 - RNA, 28 nt, Homo sapiens
acaucaaaucuacugagcguggcacugu

SEQ ID NO: 136398 - RNA, 46 nt, Homo sapiens
caccggagaaggccgccaucuucaccccguccuccgcggcuucgcc

SEQ ID NO: 136399 - RNA, 47 nt, Homo sapiens
uuugccuaucccccguuuuuuggucauguuucaauuaauugugagga

SEQ ID NO: 136400 - RNA, 45 nt, Homo sapiens
cccccacauuugcaacuagaagagguugcccauaaaauugcucug

SEQ ID NO: 136401 - RNA, 44 nt, Homo sapiens
uucaaguccuuacugcugugaagaacaaauaccaacugugcaaa

SEQ ID NO: 136402 - RNA, 47 nt, Homo sapiens
uaagaaacuuugucucguacugaaagacuacauucagugugggucag

SEQ ID NO: 136403 - RNA, 43 nt, Homo sapiens
ucaggauuuggugugcccccugcuagcaugaggcgagcugcug

SEQ ID NO: 136404 - RNA, 45 nt, Homo sapiens
uacccaauggacuugggaggaagaaauuuucuauccacaccucag

SEQ ID NO: 136405 - RNA, 1230 nt, Homo sapiens
gauaacccaggguaaauagcaggccuaggauggaaugaauauaugcaaaugugaguagccacaccugacgaggacacagcuacuacggggacuaaaguggguaaggauacacugacaagggcuuuauauaaauccucuggaaggucacugcaaaauuucuaggaucaaucuagcauuauucccacuauacuuaaaccuuccuaucuaaaacuagacuuaauuguguauuuguaacuggaaggacacaguacuuugcccacaggucugaugcaauacaggcccugcugaacugcuauaaacagacagcuucaaaaagcagaugaguguccuacagaugcuacuaaaagcaaggcccaugagagaaucacacuaagauuccagccaacaaauugcuacaaauaaaauaaacauaccccaucuuuuuagguucuucuuuuacauaucuugcaaaauuccucugaauuuuuaucucauuaugcauugauaucuuaaacuaauacucucccaaauaagaaagcucuccagaugaacucaacauuugagccccuuaccaaauccaagacaucauaccaagagcuaaaggaguugcaagaaacuucacaaacuaggaaagagaggguuauacucaaauaacuuuacagcuacaugugcuaaguacuaaagagaaacacaaaguauugaaaaagcccaaacguaagacuaauucuaggcaggagauucaggaaauauguucaguuccaacucaaauuaagaauggguaggauuuauacaaagaagagaaucaagauguuacagguggaaaauugugaaagaauguacaaagagaaguguuugggggcaaaaacaaucuguuucagcuacaguauaaagcaaauaacagggaacgagggagggauaagaacagauuuuuaaagcaggguuucacaugaguuaucucuccuucucucuaacacagacacauaagaucacucagggacauaaccuugaggggcccgagguacagagggagugaagaaacaaaggccagcaacggacuccaggcuggcuaauuaaauagagcugggauugaggagggcagaaaggggcuugccuaugguacacugcucugcagugaccccuucuggaugagucagaaaguacaucucuggacugaagagggauuucugcagacaaaugaaaaggacacuuuuccaaccaaggcaaaguaccuuaaaucguguuccaaaccaa

SEQ ID NO: 136406 - RNA, 25 nt, Homo sapiens
uggaggccaaucacugccaccuuuu

SEQ ID NO: 136407 - RNA, 46 nt, Homo sapiens
guuaaaacaucagcuggaccaacuaaucuucgaaucgaauaccaag

SEQ ID NO: 136408 - RNA, 41 nt, Homo sapiens
gaagccccccggaacggcacuguucaccuuuaucugaccaa

SEQ ID NO: 136409 - RNA, 39 nt, Homo sapiens
uacuuggaagaauauaaauuccagguauaaauguuucuc

SEQ ID NO: 136410 - RNA, 36 nt, Homo sapiens
aacaugucucacauagaguaucuccgaaugcagcua

SEQ ID NO: 136411 - RNA, 80 nt, Homo sapiens
auauccgguacaagucauugucagggaaaagggcaagcuggauacauacacugugcucuuacuuggagccaauccaccac

SEQ ID NO: 136412 - RNA, 40 nt, Homo sapiens
aacuguuuguuguuuauugcccugguacaguuuuguucag

SEQ ID NO: 136413 - RNA, 46 nt, Homo sapiens
uuuuucggacaggcauaacuuaaguguccauuuuccccacauucau

SEQ ID NO: 136414 - RNA, 53 nt, Homo sapiens
ucuuggaugcuuuaugccugcgcagcaggagcccuguccucacguucccagga

SEQ ID NO: 136415 - RNA, 51 nt, Homo sapiens
ggccacuuccgccuaccccacuuuucauuuuguuccaaaauaguugcagau

SEQ ID NO: 136416 - RNA, 33 nt, Homo sapiens
aagacacacucuuaaguuucuugguucagagca

SEQ ID NO: 136417 - RNA, 42 nt, Homo sapiens
cuccgacaagcauggcugcccggcuuacguaagcccagagau

SEQ ID NO: 136418 - RNA, 44 nt, Homo sapiens
uacccuggagaguccuacuuuccugucagcaaccaugauggacc

SEQ ID NO: 136419 - RNA, 30 nt, Homo sapiens
aaggaaaggagcacguaguguuggauacau

SEQ ID NO: 136420 - RNA, 45 nt, Homo sapiens
ucuugccuagaugccgugaacuccagauagaauguuggaguuggg

SEQ ID NO: 136421 - RNA, 46 nt, Homo sapiens
uggugcugcgggaccucaagcugcggaaauucaucuuuaaggacga

SEQ ID NO: 136422 - RNA, 40 nt, Homo sapiens
ugcgaaaaagaaaauaacuauaauagagcauacuacuacc

SEQ ID NO: 136423 - RNA, 45 nt, Homo sapiens; identical to SEQ ID NO: 39686

SEQ ID NO: 136424 - RNA, 80 nt, Homo sapiens
ucucgcucccuuuuaaaaucaguggcaccgaggcgccugcagccgcacucgccagcgacucaucucuccagcggguuuuu

SEQ ID NO: 136425 - RNA, 48 nt, Homo sapiens
guaacugcccucucccgcaccccccccuuacacgccccccacccuuuc

SEQ ID NO: 136426 - RNA, 34 nt, Homo sapiens
uuggagagcucgcgaucuuggaaaagccucagac

SEQ ID NO: 136427 - RNA, 25 nt, Homo sapiens
gaaagccaacaaaucaauguaguuc

SEQ ID NO: 136428 - RNA, 36 nt, Homo sapiens
uaauuuagcaaagagcuucuuuuuccuuugguucag

SEQ ID NO: 136429 - RNA, 45 nt, Homo sapiens
auacauuauuccuucacacaguggauuuugaguaacugaaccaaa

SEQ ID NO: 136430 - RNA, 75 nt, Homo sapiens
ugugcaaucaggagaccuggacagagcagaggagggaggacugcaggggagggcucgcaccagagaaccagccag

SEQ ID NO: 136431 - RNA, 29 nt, Homo sapiens
gcuuccaauccucggaggacauuaucagg

SEQ ID NO: 136432 - RNA, 26 nt, Homo sapiens
gcggggcgggcccgggggcggggugc

SEQ ID NO: 136433 - RNA, 45 nt, Homo sapiens
uguagucaccaacaagaucagaaguggcaugauaaacaguacaag

SEQ ID NO: 136434 - RNA, 71 nt, Homo sapiens
gcugggaaaaguaggaguugaagccaaaaagccaaauucugccauuaggaagugugucaggguccagugga

SEQ ID NO: 136435 - RNA, 48 nt, Homo sapiens
uuuggucaaaaaggucaugcuguuggugauauuucuggaguucgcuuu

SEQ ID NO: 136436 - RNA, 40 nt, Homo sapiens
ggccuggucuuuuccccgcagcgcggccaacuuuguccag

SEQ ID NO: 136437 - RNA, 95 nt, Homo sapiens
guguggcaauagugaaucugugauuaaaugucucugggccaggaugucagguuacaguuuuaaaauuggguauugcagguguuuuagcagaagac

SEQ ID NO: 136438 - RNA, 111 nt, Homo sapiens
gccugggcuagcaggagugugugugugggugggggggugggugucaccaaagagcuuuaaaugaagcaauggcguuauuuuuuuuuucugguuuuuuuuuuuuuuucccau

SEQ ID NO: 136439 - RNA, 45 nt, Homo sapiens
caguuaaauauuauuaacacuggcagauguuggaaagccaagcaa

SEQ ID NO: 136440 - RNA, 46 nt, Homo sapiens
uuuacaguguauaauuccaaagcucuuuuuguaugcugugcaggag

SEQ ID NO: 136441 - RNA, 54 nt, Homo sapiens
uguggagcauauacaugcauuccaggcccgcacugucugaugaggcagccuaag

SEQ ID NO: 136442 - RNA, 51 nt, Homo sapiens
cauuuuaaagacuucacugugguucuagggaaaacagacuagcagggcaug

SEQ ID NO: 136443 - RNA, 48 nt, Homo sapiens
ucugugcugcuugaugugacugguuauaggacuuguguugggaccagu

SEQ ID NO: 136444 - RNA, 25 nt, Homo sapiens
gaauugggauuucauucacagacug

SEQ ID NO: 136445 - RNA, 33 nt, Homo sapiens
ggaccuggugacugacuagauuugcaggaugag

SEQ ID NO: 136446 - RNA, 45 nt, Homo sapiens
ggucaacuuuggcugagaaccccgaacagacugggagaguccagg

SEQ ID NO: 136447 - RNA, 46 nt, Homo sapiens
ucagcucaaaugucacuuccucccagaagccuuuccugauuguccu

SEQ ID NO: 136448 - RNA, 27 nt, Homo sapiens
gcuccugauguagagggaaaaagauuu

SEQ ID NO: 136449 - RNA, 41 nt, Homo sapiens
ggaagggagcugaagcuuggucagcuuuaaggggccuuaga

SEQ ID NO: 136450 - RNA, 43 nt, Homo sapiens
acuaacucucaguuauggucaucuaccccugcuaguagguuac

SEQ ID NO: 136451 - RNA, 360 nt, Homo sapiens
cccagcucagcaaaguugcucaugucauuaacaaaugaguguaggccgggcgcgguggcucacgccuguaaucccagcacuuugggaggccgaggcggguggaucacgaggucaggagaucgagaccauccuggcuaacaaggugaaaccccgucucuacuaaaaauacaaaaaauuagccgggcgcgguggcggcgccuguagucccagcuacucgggaggcugaggcaggagaauggcgugaacccgggaagcggagcuugcagugagccgagauugcgccacugcaguccgcaguccggccugggcaacagagcgagacuccgucucaaaaaaaaaaaaaaaaaaaaaacaaaugag

SEQ ID NO: 136452 - RNA, 51 nt, Homo sapiens
gugggagacacauaccuaugugauuguaacuuuuucuauagccgcauugaa

SEQ ID NO: 136453 - RNA, 49 nt, Homo sapiens
ccuaggagaggggcuuagcugcaggggccguguggguccagcggucacc

SEQ ID NO: 136454 - RNA, 46 nt, Homo sapiens
ccacauucuucuguuguguuuaugcugcuagaccuggaaccuuagg

SEQ ID NO: 136455 - RNA, 45 nt, Homo sapiens
uggaguuagccaaaccuuaaagcagguucuugugcauguguguau

SEQ ID NO: 136456 - RNA, 97 nt, Homo sapiens
cacugaggugaguggauucuuaaggcagugauccucaacucccagggccuagaacuucacagaagguggcucauuuugauaaugaaaaaugcagggg

SEQ ID NO: 136457 - RNA, 45 nt, Homo sapiens
uagagcaugcuggcaggcgucauccccaagccccaggguggguca

SEQ ID NO: 136458 - RNA, 42 nt, Homo sapiens
agcuggugccuacuguuuagaauucacaaacacagaguucaa

SEQ ID NO: 136459 - RNA, 52 nt, Homo sapiens
gggcagagucugugaguccaggggccaccguuggcugugguuugaggcacau

SEQ ID NO: 136460 - RNA, 145 nt, Homo sapiens
guguggcaauagugaaucugugauuaaaugucucugggccaggaugucagguuacaguuuuaaaauuggguauugcagguguuuuagcagaagacgccugggcuagcaggagugugugugugggugggggggugggugucaccaa

SEQ ID NO: 136461 - RNA, 69 nt, Homo sapiens
aagcaauggcguuauuuuuuuuuucugguuuuuuuuuuuuuuucccauuugaacaaagcaucugcuauu

SEQ ID NO: 136462 - RNA, 22 nt, Homo sapiens
uccauuuaauuuggcggaagag

SEQ ID NO: 136463 - RNA, 49 nt, Homo sapiens
ugggagaugacuugccagagggcgcauccgagucugcagaagagucaga

SEQ ID NO: 136464 - RNA, 41 nt, Homo sapiens
ccaccccucuagagagagcagcuuuuuauuuggcuguagac

SEQ ID NO: 136465 - RNA, 23 nt, Homo sapiens
ugaaguccaggcaguuaccugug

SEQ ID NO: 136466 - RNA, 66 nt, Homo sapiens
cugaaaugccaaugggcgggaucauggaaggacugaaggaaggucaggguguguggggaggagugg

SEQ ID NO: 136467 - RNA, 53 nt, Homo sapiens
uuggggaaggaauuuggauuuuguucuagugugaugggaagcuguugaagggu

SEQ ID NO: 136468 - RNA, 60 nt, Homo sapiens
ucugcagccccuccccaccagccucauuccuuagcuggggucagaccugggguccucacu

SEQ ID NO: 136469 - RNA, 67 nt, Homo sapiens
uucccuggagaaagauccuccaguccccugcucggaggcugaucccggcuggcugcccgcuugcuca

SEQ ID NO: 136470 - RNA, 51 nt, Homo sapiens
uuguucuccuguccagugucuuuccagagaagauuccucccccaagcuuug

SEQ ID NO: 136471 - RNA, 35 nt, Homo sapiens
cucccacccggggcaguuuaucaaaggcaaaauaa

SEQ ID NO: 136472 - RNA, 44 nt, Homo sapiens
ccgcggccuggucuuuuccccgcagcgcggccaacuuuguccag

SEQ ID NO: 136473 - RNA, 45 nt, Homo sapiens
ccgccucagccagggcggccuggcugcgcuccacccgugcccgga

SEQ ID NO: 136474 - RNA, 54 nt, Homo sapiens
aaagccguggggaaaggggcagagucugugaguccaggggccaccguuggcugu

SEQ ID NO: 136475 - RNA, 39 nt, Homo sapiens
ucggcucagaauagguuuacaagucacacguguggcaau

SEQ ID NO: 136476 - RNA, 29 nt, Homo sapiens
uauuaggaauugcuugaaaaaaaauccag

SEQ ID NO: 136477 - RNA, 60 nt, Homo sapiens
guuguccuugguuaccuuggcaaucccauugcugucauaagcacaggguucuaacugcag

SEQ ID NO: 136478 - RNA, 62 nt, Homo sapiens
ggaaaaggcccugaaaugccaaugggcgggaucauggaaggacugaaggaaggucagggugu

SEQ ID NO: 136479 - RNA, 55 nt, Homo sapiens
cauuuuaaagacuucacugugguucuagggaaaacagacuagcagggcaugaaag

SEQ ID NO: 136480 - RNA, 46 nt, Homo sapiens
aacccuaugaauguaaacagugugguaaagccuucaguuguuccag

SEQ ID NO: 136481 - RNA, 69 nt, Homo sapiens
ugcagcuggccucuggcagcguucucaggcuagcccucccugcugaaaagagaaccgugugggacucac

SEQ ID NO: 136482 - RNA, 51 nt, Homo sapiens
uguuguucuccuguccagugucuuuccagagaagauuccucccccaagcuu

SEQ ID NO: 136483 - RNA, 32 nt, Homo sapiens
uggcugcauauccagagcugggcuuaacuggc

SEQ ID NO: 136484 - RNA, 31 nt, Homo sapiens
ggcagauggacaccaacaaugacgguagugc

SEQ ID NO: 136485 - RNA, 50 nt, Homo sapiens
acgcugccaccuuguccaccuacagcagcucuguggagacucagccccac

SEQ ID NO: 136486 - RNA, 55 nt, Homo sapiens
aagaaaggacuacaucacagccaaguacaucgagaggagauacgcaaggaagaag

SEQ ID NO: 136487 - RNA, 43 nt, Homo sapiens
uuuuucaggagccggaugaaacggcccuccaccuugcagucag

SEQ ID NO: 136488 - RNA, 46 nt, Homo sapiens
ucaugauauucuuauacuuuaguuacacuuuuggaauuugauacaa

SEQ ID NO: 136489 - RNA, 52 nt, Homo sapiens
ucuggaugggcugcauuuacugugugaaggauaaaaaucauuagccuggauu

SEQ ID NO: 136490 - RNA, 36 nt, Homo sapiens
uauacauugucucuaaauugugggucuauuucuagu

SEQ ID NO: 136491 - RNA, 45 nt, Homo sapiens
cuccuuuaaacugcagcgucagaaucguguugacagcaaagaaac

SEQ ID NO: 136492 - RNA, 46 nt, Homo sapiens
aauggacaccauccaggaagaccccagcacagacucacauauggac

SEQ ID NO: 136493 - RNA, 37 nt, Homo sapiens
ccuuuccugcgccccagacuccaggccgccugcagcc

SEQ ID NO: 136494 - RNA, 53 nt, Homo sapiens
ggcugauggaaggucauguugcagcaggaagggucuagguuggaauguuuacc

SEQ ID NO: 136495 - RNA, 41 nt, Homo sapiens
gauguaauugaacgauuuugggauuucauugaccagcugag

SEQ ID NO: 136496 - RNA, 48 nt, Homo sapiens
cuuauguaugcccacauggcucacagaugcccgguguuuuauccugug

SEQ ID NO: 136497 - RNA, 46 nt, Homo sapiens
uccagguaauagcagugagugcccgccuccaggaaaugcugaagau

SEQ ID NO: 136498 - RNA, 46 nt, Homo sapiens
uuuucaaacugcaguaaacaaucaaucuauaagaccauugaaagua

SEQ ID NO: 136499 - RNA, 62 nt, Homo sapiens
auccggauggucuagcagaaugugccccgaaugaggaccagggagggaaauaugucauguau

SEQ ID NO: 136500 - RNA, 42 nt, Homo sapiens
aagaacaagcaggaagucuuuguccucauggaugucaccuca

SEQ ID NO: 136501 - RNA, 84 nt, Homo sapiens
uuggcacaccuuuucacauaccaagauuuugauaugggaacucuuggauuagcuuauguuggcucucccagagcaaacagccau

SEQ ID NO: 136502 - RNA, 45 nt, Homo sapiens
uccacaagagguaaaaccuggugaaaagcacuacaacauggcaaa

SEQ ID NO: 136503 - RNA, 64 nt, Homo sapiens
uugaugacaucuaucggaacacuucaugggauaaugcagguuuuaaaggcuauggaauacagau

SEQ ID NO: 136504 - RNA, 85 nt, Homo sapiens
acccagaucccaugaagaacacguguaaauuauuggugguagcagaucaucgcuucuacagauacaugggcagaggggaagagag

SEQ ID NO: 136505 - RNA, 45 nt, Homo sapiens
ucacguuugcagucuccaaaagugugugguuauuuaaaaguggau

SEQ ID NO: 136506 - RNA, 46 nt, Homo sapiens
agcccacauaagagaugaugauguuauaaucagaaucaacacagau

SEQ ID NO: 136507 - RNA, 46 nt, Homo sapiens
acugaacguuuuucacaaaauuucaaggucguggugguggauggua

SEQ ID NO: 136508 - RNA, 49 nt, Homo sapiens
uucgauagcaguggaaggcaaaguaauuuaaaccaagaucauugcauua

SEQ ID NO: 136509 - RNA, 45 nt, Homo sapiens
ucuguuguaaagccuguaaaaaauugagauuacuagugguuagaa

SEQ ID NO: 136510 - RNA, 42 nt, Homo sapiens
uagaaugugugugcaagaaaggagggguagggggaugaaaaa

SEQ ID NO: 136511 - RNA, 47 nt, Homo sapiens
cugguaauuguggaaguagucucauugccuaaccugaaacuugcauc

SEQ ID NO: 136512 - RNA, 359 nt, Homo sapiens
uauaacauguccaaaauuaguuaccuuuuuuuuuuuuuugagacagagucucacugucacccaggcuggagcgcaguggcgcaaucuuggcuuacugcaaccuccacuucccagguucaagugauucucgugccucagccucacgaauagcugggauuacaggugucccccaccacgccuggcuaauuuuuuuuuuuuuuuuuuuuuuguauuuuuaguagagaugggguuucaucauauuggacaggccuguguugaacuccugaccucuggugauccaccugccucagccucccaaagugcugggauuacagacgugaaccacugccccagccaguuaccuauucuuuugauuacaa

SEQ ID NO: 136513 - RNA, 46 nt, Homo sapiens
uuuucuauuugugagauaauaaguguauacagcuggaaguguaaug

SEQ ID NO: 136514 - RNA, 56 nt, Homo sapiens
gaauuuagaggcuagaaaguagaggguuccuauuucauuagauuuuccagagagau

SEQ ID NO: 136515 - RNA, 46 nt, Homo sapiens
ggcagucggcuucuccguucauccuccagcuguccagccaccuccu

SEQ ID NO: 136516 - RNA, 34 nt, Homo sapiens
ugcuauuaggaauugcuugaaaaaaaauccagaa

SEQ ID NO: 136517 - RNA, 72 nt, Homo sapiens
acacguaggaacgaagaagcuugguugaaaauuaaagccguggggaaaggggcagagucugugaguccaggg

SEQ ID NO: 136518 - RNA, 44 nt, Homo sapiens
gccucagccagggcggccuggcugcgcuccacccgugcccggag

SEQ ID NO: 136519 - RNA, 25 nt, Homo sapiens
gaauguaagcacuugguaaagccuu

SEQ ID NO: 136520 - RNA, 45 nt, Homo sapiens
uuaugauaacuuaaagguacaugaaagaauucacucuggagagaa

SEQ ID NO: 136521 - RNA, 38 nt, Homo sapiens
caucugcuauuaggaauugcuugaaaaaaaauccagaa

SEQ ID NO: 136522 - RNA, 73 nt, Homo sapiens
aacacguaggaacgaagaagcuugguugaaaauuaaagccguggggaaaggggcagagucugugaguccaggg

SEQ ID NO: 136523 - RNA, 52 nt, Homo sapiens
uuugaggcacauccucaccugcaguccuccuuuuccuuacccaucaaacggg

SEQ ID NO: 136524 - RNA, 78 nt, Homo sapiens
uuaaaauuggguauugcagguguuuuagcagaagacgccugggcuagcaggagugugugugugggugggggggugggu

SEQ ID NO: 136525 - RNA, 41 nt, Homo sapiens
aacaaagcaucugcuauuaggaauugcuugaaaaaaaaucc

SEQ ID NO: 136526 - RNA, 47 nt, Homo sapiens
guugggcaugaacaucaaacuuuuguuccacuaauauggcucuguuu

SEQ ID NO: 136527 - RNA, 2408 nt, Homo sapiens
gccgggcccgacgagggcgagguggacuccugccugcggcaauauccuugcauucaccgcccuccccaccccagcccagcccagcccgcccuucuccugggacccgggagccugcaggauccgcggggcaccggcgcggagcugcccucucaaccugcggcuuaaccugucucuuugggaucgcccgcucugagagggcaagggggaagcccccguuuccuacccagucggcaggagacgcgagggucccacucuuggaagccugcccucccccgcgcgccuuccacgcccccagauuccucagguugcacccgagugccugccugccucgggaacuggucccgccggccgcgcccucgcggcgcuggggaaggcggccccggcugguggggaaggcuggugccgagcgccuuaguuuuucuuccuagaacucugauuuccuggggucacauuagcuccagaaauuucugauuguggggaaccugcaucuuuccuuagugguuuuguuuuuuguuguguuuuuguuauugguagcguuaagguaguuuauuccuuaccggggggcggggggagaugggacuguucgaaaauugagggucccugugcuuucagcccauuggccuuuuuaaaaaaaaaaaaaaaagaagaagaagaaggggauuuggcaaaauauacauuguacagaauuuguuaacugggggaggggaaugaauacaaaaaauacaaaacuccuagaaggaagcuuggagccuuuuaccugcuaagaaaaggacaauagaaaaaacaacggggaaugcguguggagaauccuuggaaauauuuaaaauaaaccccaaugaauaagauagaagaugagucauucguauaaagcagaaucauuuuuguaauccuaaaauuguuuccauuuuaguuaaaauauggcagucaguucccgguuucuguuuuugcauauuugaauauucauaacuuuggcuucgcauuugcauuacaucuuuuuuagaaaaauguaaauguugcaaaaaaaccgaagcuguaguuuuagaaaaucucagacacugaauuuguaugcauuucuaauucuuggguguauucauaaggaagacucucaacaauguccuguuauaguggggaaauaugagagugaaaauauuuaauggcaacaauauccuuuuuuaaaggcaccuaaauagagcauuagacauuuaucaauauauagauagugcuuugccacaacuuucacaauuaauuagcuguugcucuuuugcauuauuuaaauacuuaagugcuuggaguuauaaaaaaugagcuaaucuacaucaggcaugcuucucuagaaaucccugcagccuugaaaauaacagcuugucaaccagagauuuuguguaagaacuuuuucuuuagaaaauaaauggugaacaugcuuccuaaaaacauuauuugugauggauagaugguguuuuaugaaaccccaguguauuuuagguaauuuguggugacuuuuaaaugguacugcuguauccauaucaguggaucugcuuuuugaucaguucaucuuaaaauauaaagauacugucucuucuuaccguuacauacagccaggaaagacagcccuaguggugggguacuagaguuggaggaacaagugaacucugugguuuuccuuuuaggggaauguuuguacauucugacagucugauuggccuucuguuucucaugcuugcuaacucacuagugcuuucaaagagagccugaauuuaauagguauggucuaacacaguuugaauaaccuuugugaaauaugagagaaaauaucuaaagcaaaaaauuaagcugccaccuaagggacauaugaauuauuacaucuucugugaugccucuuuucaucaauauugagagauugcuaauguguaucauucagauugcuaaucugccagcauguucuaccagcauuucagauaauacagaauaugguucuagcaaaaguuuggucuuuauuuuuucaauuagaaucacaggaaaagacauauuuugguugauaauagguuauuucauuugggggacuaauaauucugauauauauuuuaggauuucuuuaacaccacucuagguaauguuugcauauguaucucacugggaaaugaaagacuaucaagguguucacuugauaguuagaaccaagggugaaacagucuuugcuuuauuaaaaaaaagucuaauguucuauuuugcuuuugauauuuugccuuugauuaacauccuggaaaccaacacauugaauuuccaguauugaacauagugaccaaaguaauuuucuuuuuauauguaaaucaagucauaagaaccagugguuauaaugcuuuccugggggccauccuuugcuguuacacccuuaacuuccaucacaggaa

SEQ ID NO: 136528 - RNA, 44 nt, Homo sapiens
gucggcccgcuuccggaagguggacguggaugaauaugacgaga

SEQ ID NO: 136529 - RNA, 54 nt, Homo sapiens
uucugcacguacuaguccacuagaaauaaguauguuaaacagaagcaacuuaac

SEQ ID NO: 136530 - RNA, 42 nt, Homo sapiens
guaacucagugaggcuugugccuggaaauguaaugcccaagu

SEQ ID NO: 136531 - RNA, 26 nt, Homo sapiens
ucugcuucgcugcgccuccacuaugc

SEQ ID NO: 136532 - RNA, 43 nt, Homo sapiens
gcgggacacggagggagagcauaguggaggcgcagcgaagcag

SEQ ID NO: 136533 - RNA, 45 nt, Homo sapiens
cugcagcucucgccgcugaaggggcucagcuuggucgacaaggag

SEQ ID NO: 136534 - RNA, 39 nt, Homo sapiens
uaaaucaacaauuagugaguccuaaaaaucuuggcauac

SEQ ID NO: 136535 - RNA, 46 nt, Homo sapiens
uaauaaguucauuagaaaaugugaggccaggcaucaguccucguuu

SEQ ID NO: 136536 - RNA, 35 nt, Homo sapiens
uauuauccuacuuugugaauuuuuauaauuuauau

SEQ ID NO: 136537 - RNA, 49 nt, Homo sapiens
agccacagcauuucaccauuuugcccuuaauagcacauuauaauuucac

SEQ ID NO: 136538 - RNA, 42 nt, Homo sapiens
ggauggacagcucuuaugugggcauguuacaaaggccguacu

SEQ ID NO: 136539 - RNA, 74 nt, Homo sapiens
agggaauaagaagaaaagacugaugauguggcaggagauuauugaguaagggccugggugaaagaggaccauag

SEQ ID NO: 136540 - RNA, 45 nt, Homo sapiens
ucauuuggaaugugugaaacauuuauuggccaugggagcugaugu

SEQ ID NO: 136541 - RNA, 45 nt, Homo sapiens
uuagaauucaaugacugcacuuauuguggcagugaaaggagguua

SEQ ID NO: 136542 - RNA, 47 nt, Homo sapiens
gauugcaucaaaggagggacauacggagauugugcaggaucugcucg

SEQ ID NO: 136543 - RNA, 58 nt, Homo sapiens
uguaggucauuuucauuuaguguccuggagaucaguguggaugagaacugagaauuua

SEQ ID NO: 136544 - RNA, 72 nt, Homo sapiens
uaguuuuuauuuuugcauguggaaacaauaugcauaugcauaauauuuguuguuuguguuaaugcaaaccac

SEQ ID NO: 136545 - RNA, 35 nt, Homo sapiens
ucuuuugucaucuuccuuuuuaucauuggcugcau

SEQ ID NO: 136546 - RNA, 46 nt, Homo sapiens
agaaaacgccuccauaaugcagccuccaaacugcacaaauugaaaa

SEQ ID NO: 136547 - RNA, 46 nt, Homo sapiens
ccugcuagcucauuucuuuuuagcauggcuaaugugccauugucug

SEQ ID NO: 136548 - RNA, 42 nt, Homo sapiens
cauaguccacuugccuguguuccuuaauagucguggacuaag

SEQ ID NO: 136549 - RNA, 35 nt, Homo sapiens
gaaggcagaugcagaggaccaucacucgccagaug

SEQ ID NO: 136550 - RNA, 42 nt, Homo sapiens
uugguacuuaaguuccuuuaagugaguucucaagccucacug

SEQ ID NO: 136551 - RNA, 49 nt, Homo sapiens
ucauauuauauuuggaagagacugaagguauuccagaucaaaugacauu

SEQ ID NO: 136552 - RNA, 50 nt, Homo sapiens
uauaauagaaaucauguuuuaucuggacagaaauaaaugacauuuguaua

SEQ ID NO: 136553 - RNA, 62 nt, Homo sapiens
aaucaugccuacuuuuguuguguggagaaaacaaugaaaugcauuaaacugacguguuuggc

SEQ ID NO: 136554 - RNA, 47 nt, Homo sapiens
uauuuuguuguuguuacuagauuuccagcaacauccaaagaugugag

SEQ ID NO: 136555 - RNA, 44 nt, Homo sapiens
uccaacaacuaaggauguugagccacuucuugaaauugauggag

SEQ ID NO: 136556 - RNA, 44 nt, Homo sapiens
ucuuuuugccaugcacuguaaaccuagaucccaaacuacgggaa

SEQ ID NO: 136557 - RNA, 46 nt, Homo sapiens
uuggaggacuggcguaccccccgcucccucuacaugaggguccucc

SEQ ID NO: 136558 - RNA, 47 nt, Homo sapiens
gggcccuucgcagguggaguggugucaccacagccucacagcagcua

SEQ ID NO: 136559 - RNA, 46 nt, Homo sapiens
caacaucucaucucacguccaucaguaaaaacgaguuugcccagag

SEQ ID NO: 136560 - RNA, 37 nt, Homo sapiens
acacagcuccagugugcuguuaccuuuaccuuuagau

SEQ ID NO: 136561 - RNA, 47 nt, Homo sapiens
ggcuaaucaguuuugugcuuauuuaauaaauuuaccaaagaugauaa

SEQ ID NO: 136562 - RNA, 42 nt, Homo sapiens
uuagaaaacaaaaacuaacaguuuuguuguugcucaugacag

SEQ ID NO: 136563 - RNA, 42 nt, Homo sapiens
cacucaacuucagcuucgaagagcugaacacgcuuggccugg

SEQ ID NO: 136564 - RNA, 46 nt, Homo sapiens
ccuagagcaagaaaaggggaaggauagugaaccaaagcccgaugau

SEQ ID NO: 136565 - RNA, 50 nt, Homo sapiens
gaaucccacauagccugaguggccugcaagauccaauuauagcucggaug

SEQ ID NO: 136566 - RNA, 128 nt, Homo sapiens
aaagcccuuccgaaugcagcuugauagccagcagcccugaagaaaacuggccugcaugccagaaagccuacaaccugaaccgaacucccagcaccgugacucugaacaacaauagugcuccagccaac

SEQ ID NO: 136567 - RNA, 85 nt, Homo sapiens
uccuccggagcuccaugcagcagccucuucugagagcacaggcuuuggagaagaaagagaaagcauucuuugagaaaaacaagca

SEQ ID NO: 136568 - RNA, 46 nt, Homo sapiens
gcugacagauaacuaaccgaugaugaggccgagguaaaagagacau

SEQ ID NO: 136569 - RNA, 54 nt, Homo sapiens
gcgcauuaccccauaaaacuuuuugagacgaggugagaucugaguauaaagaua

SEQ ID NO: 136570 - RNA, 35 nt, Homo sapiens
cacagccugugacgcuacagggagaggcugaguaa

SEQ ID NO: 136571 - RNA, 46 nt, Homo sapiens
ggcuggcaguagugugacggggcuguccugagcuguuaggagagua

SEQ ID NO: 136572 - RNA, 43 nt, Homo sapiens
uauguagaaugaauucuggugguuuaccccaagucacaguuag

SEQ ID NO: 136573 - RNA, 42 nt, Homo sapiens
gaggguuuagcaucucauuaauuaccaaucccugcuuacacc

SEQ ID NO: 136574 - RNA, 45 nt, Homo sapiens
gcucaccuucuuguucugggggaugcugggcaccagcuccuugag

SEQ ID NO: 136575 - RNA, 31 nt, Homo sapiens
gaaauaauuuucggccaugugggaaaguuaa

SEQ ID NO: 136576 - RNA, 45 nt, Homo sapiens
cacugagcgagcucccugguuguugcauggaauggcaauguccac

SEQ ID NO: 136577 - RNA, 74 nt, Homo sapiens
cuucagauuuaugauauagaugccaucacuuuuccuuuuauagauguacuguuccaucuggaagucaagauugg

SEQ ID NO: 136578 - RNA, 98 nt, Homo sapiens
uaacaccugacacauaauccaaaggagagcaggcugaagugcggguaaaagaacuaguccugaguuuacuacagucauugcuaugguggcgcauggag

SEQ ID NO: 136579 - RNA, 80 nt, Homo sapiens
guccaaaugaaccuuuaugagccggcugccaucuaguuugacgcggauucucuugcccacaauuucgcuugggaagacca

SEQ ID NO: 136580 - RNA, 26 nt, Homo sapiens
gcuuauuuuuuguacggcuuuuucga

SEQ ID NO: 136581 - RNA, 52 nt, Homo sapiens
uggcacuucauuccccauagacuucaguuugcaccaaucccccauccgaacu

SEQ ID NO: 136582 - RNA, 23 nt, Homo sapiens
accaaugcagucuaaauacaagc

SEQ ID NO: 136583 - RNA, 46 nt, Homo sapiens
caugcuucccacugaacuuuuucuccaauucgcguacuagccggac

SEQ ID NO: 136584 - RNA, 45 nt, Homo sapiens
uaccuuagcugccguaauauucagcucccugagcugagccuugag

SEQ ID NO: 136585 - RNA, 50 nt, Homo sapiens
gaacucguccggcuucucgccauugggcuucacgaucuuggcgcucgaac

SEQ ID NO: 136586 - RNA, 45 nt, Homo sapiens
ccaucggaaagcacagggcggguaaucggcuguauccccacccug

SEQ ID NO: 136587 - RNA, 46 nt, Homo sapiens
cuaccuugccgagcgccggcuuaggaagagacccaaaucucgcgag

SEQ ID NO: 136588 - RNA, 85 nt, Homo sapiens
gcguugcguugggguugacacccuguccugcgggccgucccgcgucacggucuccacagcaggaauccccaucccuccgccccgc

SEQ ID NO: 136589 - RNA, 58 nt, Homo sapiens
cucccaggggucgccgaguuugcaggcugcuuccuggaggcccuggggcggggcgggg

SEQ ID NO: 136590 - RNA, 50 nt, Homo sapiens
cuacaauucuugacauuuuuuuuuucugguaggauuuuuaguacauuaag

SEQ ID NO: 136591 - RNA, 42 nt, Homo sapiens
cagaucaagaggauaccuaguggagcauuugaagacuuggaa

SEQ ID NO: 136592 - RNA, 62 nt, Homo sapiens
gccugugugggugcugccuggggagcuggccccgggacggggcgggcccuggcagccgcacu

SEQ ID NO: 136593 - RNA, 45 nt, Homo sapiens
gacgcagaugugaccucggggaacaccguguacuucaccugcaga

SEQ ID NO: 136594 - RNA, 45 nt, Homo sapiens
acuugcuggacgaugggacccugaugauccagaacacacaggaga

SEQ ID NO: 136595 - RNA, 53 nt, Homo sapiens
cacuaucugccuucuccuuuccuugcaccccaaaauaagaaugaacauugaag

SEQ ID NO: 136596 - RNA, 53 nt, Homo sapiens
cagcucgacccacuuuuguaauccagccacagaauacagaggugcugguuggg

SEQ ID NO: 136597 - RNA, 154 nt, Homo sapiens
cgucacgcuggagugcagcgccacaggccaccccccgccgcggaucuccuggacgagaggugaccgcacacccuugccaguugacccgcgggugaacaucacgccuucuggcgggcuuuacauacagaacgucguacagggggacagcggagag

SEQ ID NO: 136598 - RNA, 47 nt, Homo sapiens
ccggaagcucuuccucaguucacugugacgccucaggacagagucgu

SEQ ID NO: 136599 - RNA, 45 nt, Homo sapiens
augggguucaggugacagaaaguggaaaauuucacaucagcccug

SEQ ID NO: 136600 - RNA, 59 nt, Homo sapiens
caaugacguuggcccugcagacgcaggucgcuaugaguguguggcccggaacaccauug

SEQ ID NO: 136601 - RNA, 23 nt, Homo sapiens
guaugccuuguggcuaaugaugu

SEQ ID NO: 136602 - RNA, 46 nt, Homo sapiens
agcgauugcgacuguugacagagcuauaaacucaacccgaacacau

SEQ ID NO: 136603 - RNA, 75 nt, Homo sapiens
aacagugucagccuggacuggucaacgugggucgggcuccaucgguuaggggucucccagaggagagcugcuggu

SEQ ID NO: 136604 - RNA, 50 nt, Homo sapiens
aaccugucgggcuguaccgcccaccggcgcgugaacaacugcucggacau

SEQ ID NO: 136605 - RNA, 41 nt, Homo sapiens
auccguguacgagaauggcuucaacaccccucggggcauca

SEQ ID NO: 136606 - RNA, 59 nt, Homo sapiens
acaugcugaugcaguggggccaguuccuggaccacgaccucgacuccacggugguggcc

SEQ ID NO: 136607 - RNA, 50 nt, Homo sapiens
agcaacgacccccccugcuucucugucaugaucccccccaaugacucccg

SEQ ID NO: 136608 - RNA, 71 nt, Homo sapiens
ggagcagaucaaccagcucaccuccuacauagacgcauccaacguguacgggagcacggagcaugaggccc

SEQ ID NO: 136609 - RNA, 45 nt, Homo sapiens
cagcacaucaccuaccagcacuggcucccgaagauccugggggag

SEQ ID NO: 136610 - RNA, 49 nt, Homo sapiens
ggcacacacguucgaggaccugaaaaaugagauuaaaaacccugagauc

SEQ ID NO: 136611 - RNA, 64 nt, Homo sapiens
guuguauggcucgacacucaacaucgaccuguuuccggcgcucgugguggaggaccuggugccu

SEQ ID NO: 136612 - RNA, 46 nt, Homo sapiens
ugugucuucucagcacacaguucaagcgccugcgagauggggacag

SEQ ID NO: 136613 - RNA, 50 nt, Homo sapiens
cgcuggccaggauccuaugcgacaacgcggacaacaucacccgggugcag

SEQ ID NO: 136614 - RNA, 72 nt, Homo sapiens
acggucucuugaguucagcuaccaggaggacaagccgaccaagaaaacaagaccacggaaaauacccaggua

SEQ ID NO: 136615 - RNA, 67 nt, Homo sapiens
aucugggacaaaugacuucagagaguuuguucuggaaaugcagaagaccaucacagaccucagaaca

SEQ ID NO: 136616 - RNA, 44 nt, Homo sapiens
uguaggagaguucagacaugaaguccuguucuuaagccucuuau

SEQ ID NO: 136617 - RNA, 66 nt, Homo sapiens
acggcucaguaccacagagugcguggaugccgggggcgaaucucacgccaacaacaccaaguggaa

SEQ ID NO: 136618 - RNA, 46 nt, Homo sapiens
caccugcuucguggaagcuugccccccugccaccugugcugucccc

SEQ ID NO: 136619 - RNA, 44 nt, Homo sapiens
gggaggcuccucagaguuugucugcugugccaucgugagaucgg

SEQ ID NO: 136620 - RNA, 41 nt, Homo sapiens
gaaggcagugcaggaggcuuccaaccagagcaucugcggag

SEQ ID NO: 136621 - RNA, 49 nt, Homo sapiens
uagacuucucagguuuuuauuuaauucuuuuaaaaugaaaaauuggugc

SEQ ID NO: 136622 - RNA, 97 nt, Homo sapiens
gggacacugucugggggugcagugcaagcccccggccucuucccugggaaccucugaacuccuccuuccucugggcucucuguaacauuucaccaca

SEQ ID NO: 136623 - RNA, 53 nt, Homo sapiens
cucuccgugugucagcuccuuccacaccugauuagaacauucauaagccacau

SEQ ID NO: 136624 - RNA, 46 nt, Homo sapiens
acauguggacuucuuuugaaauagcaagucaaauguagugaccaaa

SEQ ID NO: 136625 - RNA, 49 nt, Homo sapiens
cugugauuuaccaaaaaaaauucuguaauucaaaccaaaaugucugcgg

SEQ ID NO: 136626 - RNA, 46 nt, Homo sapiens
aacugcuccaacagccaaaugccuuuuuuaugaccauuguauucag

SEQ ID NO: 136627 - RNA, 46 nt, Homo sapiens
guuugcacuuuguaaugaugccuuucaguucaaauaaaugggucac

SEQ ID NO: 136628 - RNA, 46 nt, Homo sapiens
ucagccauggcugcgugcagcugcugggucugaaugaaggcagccc

SEQ ID NO: 136629 - RNA, 46 nt, Homo sapiens
cacauuaauuccagacuuaaucguuuucuucagcaucucuagcaau

SEQ ID NO: 136630 - RNA, 48 nt, Homo sapiens
gagcauccuucugcuucacuuggagagaaauuagcccaucauccacgu

SEQ ID NO: 136631 - RNA, 46 nt, Homo sapiens
ccaaacuucagguccuggauguccuucuccaacauggcagacaggu

SEQ ID NO: 136632 - RNA, 53 nt, Homo sapiens
gcuugugguggaucaccacgagcuaccauaaucccaucgcuggccuccaggau

SEQ ID NO: 136633 - RNA, 45 nt, Homo sapiens
cacauccucuagcaucugaguggcaagaugacaggcuucccagcu

SEQ ID NO: 136634 - RNA, 45 nt, Homo sapiens
gcacgugggcaguaucuggccaccuggugggcacaccugcagacu

SEQ ID NO: 136635 - RNA, 45 nt, Homo sapiens
ucgccgggugaggagaacaaaguggcugcacgauuuuccccacuu

SEQ ID NO: 136636 - RNA, 51 nt, Homo sapiens
cucuucucucuuugaacauuugccuuuuuuccccuccuuuccaccucucca

SEQ ID NO: 136637 - RNA, 40 nt, Homo sapiens
ggggcuugggagagggacuggauggaaaugacgccccugg

SEQ ID NO: 136638 - RNA, 46 nt, Homo sapiens
gugcgggcugcacaagcccgaacccuacuguaucgucagccacuug

SEQ ID NO: 136639 - RNA, 46 nt, Homo sapiens
uuguaggaggacaaaaaaugcuucauaugcaauucccaagauccuu

SEQ ID NO: 136640 - RNA, 46 nt, Homo sapiens
ucucauugaaaauguggucacuacauuugcuccaaaccgccuuaag

SEQ ID NO: 136641 - RNA, 39 nt, Homo sapiens
uuuggagagaauacuugugugccgggggcugucugggga

SEQ ID NO: 136642 - RNA, 50 nt, Homo sapiens
cucaaagaagugaaccuaacccuggccguuaaaaagccuggagacuacua

SEQ ID NO: 136643 - RNA, 126 nt, Homo sapiens
aaagggcugaaucaaaaauuacuuagggcugcucugcuuauggaguagccauucuuuucuuccuuuacuuucuuaauaaacuugcuuucacuuaaaaaaaaauuaguuagucaagugaaauaacua

SEQ ID NO: 136644 - RNA, 46 nt, Homo sapiens
cgaugacauaauuugugauucucgauauucugacauugaacccuca

SEQ ID NO: 136645 - RNA, 44 nt, Homo sapiens
cuuuagauccugcuuucaaaauagaagauccuuauagcccaagg

SEQ ID NO: 136646 - RNA, 45 nt, Homo sapiens
uuuuuaaccaaggccccaaaaaacuuccaagcuugaagcaaggaa

SEQ ID NO: 136647 - RNA, 45 nt, Homo sapiens
aauuaccaacuugagaaucaaguuugugaaacugcauacuuuggg

SEQ ID NO: 136648 - RNA, 42 nt, Homo sapiens
uucugcuauggucaugccagcgaaugugccccuguggaugga

SEQ ID NO: 136649 - RNA, 46 nt, Homo sapiens
ugucacuuugacauggcuguuuaccuggccacggggaacgucagcg

SEQ ID NO: 136650 - RNA, 82 nt, Homo sapiens
uauacugauuuuucuacuggucucauugcuggccagugucgguguaaauuaaauguggaaggagaacauugugauguuugca

SEQ ID NO: 136651 - RNA, 65 nt, Homo sapiens
uugugcuugcaauccucugggaacaauuccuggagggaauccuugugauuccgagacaggucacu

SEQ ID NO: 136652 - RNA, 41 nt, Homo sapiens
caaugauuuggauggaugucgaccaugugacugugaccuug

SEQ ID NO: 136653 - RNA, 82 nt, Homo sapiens
ggucaguuuaggagauuguuagaguaacagguauggggugaugccauccuggacugacgcaguggcaguggcagugacaaug

SEQ ID NO: 136654 - RNA, 47 nt, Homo sapiens
uacuacuuugccacccuggaucacuaccucuaugaagcggaggaagc

SEQ ID NO: 136655 - RNA, 34 nt, Homo sapiens
gaacauucauuauaucaaguuucuucacuugaaa

SEQ ID NO: 136656 - RNA, 100 nt, Homo sapiens
ggacuggagccggcuucguccgagugccugaaggggcuuauuuggaguuuuucauugacaacauaccauauuccauggaguacgacauccuaauucgcua

SEQ ID NO: 136657 - RNA, 46 nt, Homo sapiens
gaccacugggaaaaagcugucaucacagugcagcgaccuggaagga

SEQ ID NO: 136658 - RNA, 69 nt, Homo sapiens
agauaugucguccuuccucggccggugugcuuugagaagggaacaaacuacacggugagguuggagcug

SEQ ID NO: 136659 - RNA, 60 nt, Homo sapiens
ccucaguacaccuccucugauagcgacguggagagccccuacacgcugaucgauucugua

SEQ ID NO: 136660 - RNA, 49 nt, Homo sapiens
uaaaucacuggacaucuucaccgugggagguucaggagauggggugguc

SEQ ID NO: 136661 - RNA, 55 nt, Homo sapiens
augucuagagaacagcagaagcguugugaaaacaccgaugacagauguuugcaga

SEQ ID NO: 136662 - RNA, 45 nt, Homo sapiens
caacucugccuccccuuucuucccuuccgcucaucauagggauga

SEQ ID NO: 136663 - RNA, 45 nt, Homo sapiens
cacaacaacauugacacgacagacccagaagccugugacaaggag

SEQ ID NO: 136664 - RNA, 80 nt, Homo sapiens
aggugucucaagugccuguaccacacggaaggggaacacugucaguucugccgguuuggauacuauggugaugcccucca

SEQ ID NO: 136665 - RNA, 47 nt, Homo sapiens
guucacggggcagugccagugcaugccuggguuuggaggccgcaccu

SEQ ID NO: 136666 - RNA, 50 nt, Homo sapiens
ggagccagacugcccacauucacuucaagcaauugguacuccuguauuag

SEQ ID NO: 136667 - RNA, 108 nt, Homo sapiens
cugugacugugaccccaggggcauugagacgccacagugugaccaguccacgggccagugugucugcguugaggguguugaggguccacgcugugacaagugcacgcg

SEQ ID NO: 136668 - RNA, 44 nt, Homo sapiens
ucucugggaugugaucauugccgagcugaccaacaggacacaca

SEQ ID NO: 136669 - RNA, 47 nt, Homo sapiens
gcagcagagccacugaaaaacauugggaaucucuuugaggaagcaga

SEQ ID NO: 136670 - RNA, 41 nt, Homo sapiens
aagugaaauuaucugacacaacuucccaaagcaacagcaca

SEQ ID NO: 136671 - RNA, 46 nt, Homo sapiens
cagacagaagccgaaagccuagacaacacugugaaagaacuugcug

SEQ ID NO: 136672 - RNA, 62 nt, Homo sapiens
uaccaaguauuuccagaugucucuugaggcagaggagagggugaaugccuccaccacagaac

SEQ ID NO: 136673 - RNA, 57 nt, Homo sapiens
ccaacagcacuguggagcagucagcccucaugagagacagaguagaagacgugauga

SEQ ID NO: 136674 - RNA, 48 nt, Homo sapiens
uguuccgagacugaauguggcgggccaaacugcagaacugacgaagga

SEQ ID NO: 136675 - RNA, 65 nt, Homo sapiens
gcugaagacauucuguugaagacaaaugcuaccaaagaaaaaauggacaagagcaaugaggagcu

SEQ ID NO: 136676 - RNA, 46 nt, Homo sapiens
auggagaugccuagcaccccacagcaguuacagaacuugacagaag

SEQ ID NO: 136677 - RNA, 86 nt, Homo sapiens
ugaaagccuuucucaaguagagguuauucuucagcauagugcugcugacauugccagagcugagauguuguuagaagaagcuaaaa

SEQ ID NO: 136678 - RNA, 47 nt, Homo sapiens
gugcaacagauguuaaagucacugcagauaugguaaaggaagcucug

SEQ ID NO: 136679 - RNA, 48 nt, Homo sapiens
aggaaaccuuguucaacgcgucccagcgcaucagcgaguuagagagga

SEQ ID NO: 136680 - RNA, 47 nt, Homo sapiens
gaauauauugaaaaaguaguauauacugugaagcaaagugcagaaga

SEQ ID NO: 136681 - RNA, 71 nt, Homo sapiens
gugaacuugaugaaaaguauaaaaaaguagaaaauuuaauugccaaaaaaacugaagagucagcugaugcc

SEQ ID NO: 136682 - RNA, 53 nt, Homo sapiens
cagauuuagaaagaaaauaugaagacaaucaaagauacuuagaagauaaagcu

SEQ ID NO: 136683 - RNA, 57 nt, Homo sapiens
caagaauuagcaagacuggaaggagaaguccguucacuccuaaaggauauaagccag

SEQ ID NO: 136684 - RNA, 83 nt, Homo sapiens
uugaucuucagugaacugggguaaugaguuaggauuauaauggugaggagggggugcaguuacagguggaccaccauguugag

SEQ ID NO: 136685 - RNA, 46 nt, Homo sapiens; identical to SEQ ID NO: 40185

SEQ ID NO: 136686 - RNA, 51 nt, Homo sapiens
uucaggaugauggugagcaggugcuggggcaggagguggugguucucuagc

SEQ ID NO: 136687 - RNA, 53 nt, Homo sapiens
ugugcggaguggagcuaacgggagcggauagaaaccgagggaggggaagagag

SEQ ID NO: 136688 - RNA, 54 nt, Homo sapiens
gacaugauggaggugcugcugacauuaucaggagagaggaacuggugaagaaag

SEQ ID NO: 136689 - RNA, 98 nt, Homo sapiens
aacuaacccaaugugucaaauguuguacagaugucaaacagaacaaacgacgucucucuuccuagaaaucagaauaaagcuaguaaccuuugagacaa

SEQ ID NO: 136690 - RNA, 33 nt, Homo sapiens
agcugcaagugccauuaaagggaaauugcaaga

SEQ ID NO: 136691 - RNA, 46 nt, Homo sapiens
agaaccagaugaucucauugacgaagaccucaacuuugugcaggag

SEQ ID NO: 136692 - RNA, 46 nt, Homo sapiens
guugccugugguaaguucaguuguuaaaguaaaaaaauucaaucau

SEQ ID NO: 136693 - RNA, 42 nt, Homo sapiens
accgagcagugacuuaagcaacggagcgcggugaagcucauu

SEQ ID NO: 136694 - RNA, 31 nt, Homo sapiens
gaagccgaguucaacauccuccuggccaccg

SEQ ID NO: 136695 - RNA, 40 nt, Homo sapiens
cuuucuaaaacugaagaaagaauaauugauugccuaagca

SEQ ID NO: 136696 - RNA, 43 nt, Homo sapiens
cauacuuuauuguauauaguaaggaauuaaggacacugacgac

SEQ ID NO: 136697 - RNA, 49 nt, Homo sapiens
guauuauaaaagaagacaaagauaaguaguauuuugaaauccaggaggg

SEQ ID NO: 136698 - RNA, 64 nt, Homo sapiens
caucaauggaaauauauucaucuuaggauucuuguacuaagcuaugaagauucuugaggauaga

SEQ ID NO: 136699 - RNA, 62 nt, Homo sapiens
aaugaacacucacuuuuuacuuuuucuuucuuaaaagcagauaaauuuuuuacaugguggcu

SEQ ID NO: 136700 - RNA, 53 nt, Homo sapiens
aaauuugugcuaaggaagaccucuucguauuuuaaacucauaaggauuugaug

SEQ ID NO: 136701 - RNA, 71 nt, Homo sapiens
uauccacccaacacaagcaaaguuuauuccuacuuugaaugccgugaaaagaagacagaaaacuccaaauu

SEQ ID NO: 136702 - RNA, 46 nt, Homo sapiens
acaaacaucauauaaguggguacucgacuuuuauccucauuuacgg

SEQ ID NO: 136703 - RNA, 23 nt, Homo sapiens
guuagacuaaaggaacuuuauuc

SEQ ID NO: 136704 - RNA, 46 nt, Homo sapiens
uuguucaguccugguauccaaucacaguggccacaaauucuagaga

SEQ ID NO: 136705 - RNA, 41 nt, Homo sapiens
cauaggagcaucugcucacuugguuaacuucaaaggaacag

SEQ ID NO: 136706 - RNA, 45 nt, Homo sapiens
auggaacgaaagauccuguuccaggcuauucuguuccagcagcag

SEQ ID NO: 136707 - RNA, 73 nt, Homo sapiens
gccuguaucuguggucagcgauagcuaugacauuuauaaugcgugugagaaaauauggggugaagaucuaaga

SEQ ID NO: 136708 - RNA, 47 nt, Homo sapiens
ucugcagggagaagggggaggaccuuacacauagcaaucucagcuga

SEQ ID NO: 136709 - RNA, 49 nt, Homo sapiens
uaccuagccaucauauauuaaagacaagcaaguauauaaucacugacca

SEQ ID NO: 136710 - RNA, 45 nt, Homo sapiens
uuaucuuuacauaggacgccagcagggaauuuuguuacacuggag

SEQ ID NO: 136711 - RNA, 47 nt, Homo sapiens
ggaacaaggcaggguuuaccaggcuuuuuugcugcacacucacaaug

SEQ ID NO: 136712 - RNA, 39 nt, Homo sapiens
gaacuggaagcagcacaucauuaggcuuuaugacugggu

SEQ ID NO: 136713 - RNA, 47 nt, Homo sapiens
uauuguacagaugugugggguuuguguuuuaugauacauuacagcca

SEQ ID NO: 136714 - RNA, 47 nt, Homo sapiens
accuuacugccccuuguagaauauguauuaaucauucuacauuaaag

SEQ ID NO: 136715 - RNA, 46 nt, Homo sapiens
auuuuauaugucagagauugccuguggcucuaauaugcaccucaag

SEQ ID NO: 136716 - RNA, 47 nt, Homo sapiens
uuucauauucuauaguugguaugacuuaaaugaauuacuggaguggg

SEQ ID NO: 136717 - RNA, 57 nt, Homo sapiens
caucuguuuuaaauaguuacaugagaaaaugaucacuagaauaaccuaauuagaagu

SEQ ID NO: 136718 - RNA, 46 nt, Homo sapiens
cgguuaacacgaauguccacuagaacucugcugugugucacccuua

SEQ ID NO: 136719 - RNA, 53 nt, Homo sapiens
agauuuaaguauaaagaaaaccaugauuaaagcauuuaaaaauugcaagagga

SEQ ID NO: 136720 - RNA, 50 nt, Homo sapiens
uguaauaaacugugauaaagguguaugcaaagaauaguagaagaaaugag

SEQ ID NO: 136721 - RNA, 61 nt, Homo sapiens
ggaaucugggcccuuuccuuaggaaaaugcauaugugcaggguauggaauauuggaguguu

SEQ ID NO: 136722 - RNA, 53 nt, Homo sapiens
uauagcagauaucugccugcaaaggagagaaggaaugguuaggaaaauugagg

SEQ ID NO: 136723 - RNA, 46 nt, Homo sapiens
agccaaggagguauuccaccuccuaccggaauauaauuaaagggag

SEQ ID NO: 136724 - RNA, 48 nt, Homo sapiens
agauguaaauguauucucacauguaaauuugaaaguucaggggucuau

SEQ ID NO: 136725 - RNA, 46 nt, Homo sapiens
ucuaaaugacccgugguacuuaauagguguacuaaaauuguguugg

SEQ ID NO: 136726 - RNA, 45 nt, Homo sapiens
uauuuugaguuuagcauugauauugugaaaauaagugcaauuugg

SEQ ID NO: 136727 - RNA, 46 nt, Homo sapiens
agcucagcugcgucuaagaugguuuguacucacucucuuccucccu

SEQ ID NO: 136728 - RNA, 37 nt, Homo sapiens
uugccaguuuuucaacuggguuguucguauucuuauu

SEQ ID NO: 136729 - RNA, 21 nt, Homo sapiens
guuuuagaaaacagcaaauuc

SEQ ID NO: 136730 - RNA, 44 nt, Homo sapiens
gauauucacaacacaaaaccaccagagaacuggucuccagacuu

SEQ ID NO: 136731 - RNA, 29 nt, Homo sapiens
caggagaaggggcugaagacccauauagc

SEQ ID NO: 136732 - RNA, 72 nt, Homo sapiens
gcuggggagucagaagaaaggccacacaaggagagggcaggaaauggaagucguaaguuaaagucacaagga

SEQ ID NO: 136733 - RNA, 67 nt, Homo sapiens
gaagaaggcaguguccuggaagaaagauggaaugggaguuaucauugggaugaugagaugucaaagg

SEQ ID NO: 136734 - RNA, 68 nt, Homo sapiens
gagaugaugguagccuggacucggguggaggcuggccauggagaggaguggcuacauuuaaccguuuu

SEQ ID NO: 136735 - RNA, 65 nt, Homo sapiens
gcaagcugacaugaugagauaggcauuuugaacagguaccucuggcugcuguacaggcaauggac

SEQ ID NO: 136736 - RNA, 46 nt, Homo sapiens
gaauugcuggguaugugcauuuuuaauuuuaauaguucugccagau

SEQ ID NO: 136737 - RNA, 49 nt, Homo sapiens
ggcucucagagaaccacugcauggacuuugcuccagggucagcagagcg

SEQ ID NO: 136738 - RNA, 25 nt, Homo sapiens
guuuccagagaaggagaaaauggac

SEQ ID NO: 136739 - RNA, 47 nt, Homo sapiens
cugcauucugauagaagucugaacaguuguuuguguuuuuuuuuuuu

SEQ ID NO: 136740 - RNA, 46 nt, Homo sapiens
cauuaggaugcaugcaaggggaaggagauagaaaugaauggcagga

SEQ ID NO: 136741 - RNA, 50 nt, Homo sapiens
ucacagugaaaaaaaucugucuggauaguauagggacacuuucaugaaaa

SEQ ID NO: 136742 - RNA, 45 nt, Homo sapiens
aaccaggaaagaaauauauugccagaagcuacagaauuuugccag

SEQ ID NO: 136743 - RNA, 56 nt, Homo sapiens
auuaaaaaaauacaaauuggguaaaagugaugguggaaaaaauauaaagaaggcaa

SEQ ID NO: 136744 - RNA, 46 nt, Homo sapiens
ugacuuggagguauggucucauacaaaugauacaauugguucagua

SEQ ID NO: 136745 - RNA, 46 nt, Homo sapiens
gaaugugacagugauuaucaugaggaaagaacaauucucccuaugu

SEQ ID NO: 136746 - RNA, 42 nt, Homo sapiens
guuaauugugcaagacaggaagcuguucgaaugguucgagua

SEQ ID NO: 136747 - RNA, 43 nt, Homo sapiens
guuuaaauugcucaguaagugucugauacuuuuuuuccccaca

SEQ ID NO: 136748 - RNA, 47 nt, Homo sapiens
auuacucuacugagacugaauuaugauucucgagucugggaaguuuu

SEQ ID NO: 136749 - RNA, 49 nt, Homo sapiens
auccuggggcuuaugggucucauaggagcacccguaugcugaagaaagg

SEQ ID NO: 136750 - RNA, 49 nt, Homo sapiens
uuuaaagcauaguuuuaguaauauauuuacuaaaaaccuuagacauuau

SEQ ID NO: 136751 - RNA, 43 nt, Homo sapiens
uauugcaguucucugguuugucuggaguguuugcaagucaguc

SEQ ID NO: 136752 - RNA, 69 nt, Homo sapiens
gaaaucuccuuguugcauuaaaagagacuccacacaguguagugggcggucacaaagcugacuuugcag

SEQ ID NO: 136753 - RNA, 46 nt, Homo sapiens
ugacuacgagaggcuggaagccuuccaacagagaaugcugaacgag

SEQ ID NO: 136754 - RNA, 58 nt, Homo sapiens
aggaauaagcaaagccugguaacagugaccgacaaacacuagucauggaaguagcuag

SEQ ID NO: 136755 - RNA, 83 nt, Homo sapiens
gagucucuggguggagagaacgucauuauacuuggugcagaguuugccuggcaucucucgcugguuugaaguggaaaagcgug

SEQ ID NO: 136756 - RNA, 46 nt, Homo sapiens
uccucuggaaaaugcaauugaagugcuagaaaauaagaaucagcag

SEQ ID NO: 136757 - RNA, 45 nt, Homo sapiens
uacuaggcauucuuugucaaagaauauaucuuaagucacccugaa

SEQ ID NO: 136758 - RNA, 42 nt, Homo sapiens
uggagccuucgcagguacuccuuguaggguagagaaacuaga

SEQ ID NO: 136759 - RNA, 40 nt, Homo sapiens
uaugcaaaguaguugggugaauaaagugccuguguuugca

SEQ ID NO: 136760 - RNA, 46 nt, Homo sapiens
uggaugagagagagugggauuuggcuucauugguuugucuuugcug

SEQ ID NO: 136761 - RNA, 70 nt, Homo sapiens
agugcuaucacacaugcuguguuccagguguaggacuugaaaaucuagugagaaaaagcaaacaguucac

SEQ ID NO: 136762 - RNA, 74 nt, Homo sapiens
ucuucuuggccacgaugaugaaauccauagagacccaccaccaggggauaaugggaagaccugaguacaagcau

SEQ ID NO: 136763 - RNA, 53 nt, Homo sapiens
aaagucaacagcuguuccccaagaacugcucccuagcaucucacaccuaaaag

SEQ ID NO: 136764 - RNA, 46 nt, Homo sapiens
cccgcaaggucucucaguuauaagucacuuuucuauguaccugcga

SEQ ID NO: 136765 - RNA, 42 nt, Homo sapiens
guucaagcaggcgagcaagacaguauacuuaagggguugcaa

SEQ ID NO: 136766 - RNA, 47 nt, Homo sapiens
gaaggaggauugcuguagacuucucuagcuugaauauugcaacauag

SEQ ID NO: 136767 - RNA, 44 nt, Homo sapiens
guuuucagguuggucaaaaguaacuucaugaauauagccuguga

SEQ ID NO: 136768 - RNA, 27 nt, Homo sapiens
uauggaguauaauguggaaaagugcag

SEQ ID NO: 136769 - RNA, 52 nt, Homo sapiens
aaacuuaacgaaauauugccaagagauuguuauguguuugguuccagccuaa

SEQ ID NO: 136770 - RNA, 46 nt, Homo sapiens
cacuugucaaaauaguucacagaaaauuguuuagcaucaaagauaa

SEQ ID NO: 136771 - RNA, 47 nt, Homo sapiens
cacuaaauccaacugguugacucuuccucauuaucuuugaugcuaaa

SEQ ID NO: 136772 - RNA, 46 nt, Homo sapiens; identical to SEQ ID NO: 40317

SEQ ID NO: 136773 - RNA, 42 nt, Homo sapiens
uggagguggauuauuugaugacauguuugaagauauggagaa

SEQ ID NO: 136774 - RNA, 48 nt, Homo sapiens
cacagaugcuuugauuccugaauaaauauaugaaagaauaauagauaa

SEQ ID NO: 136775 - RNA, 43 nt, Homo sapiens
aaugauagcuaagaaguguuuguauuugaagguuuuguggaga

SEQ ID NO: 136776 - RNA, 42 nt, Homo sapiens
cucaugaugaacagaauuuaagauuucugcuaaagcugccag

SEQ ID NO: 136777 - RNA, 46 nt, Homo sapiens
ccuuuuagaaaaguuguuuuguugaaauacuguacguacgcuuaau

SEQ ID NO: 136778 - RNA, 46 nt, Homo sapiens
uaggcuuuuuacucaauuauguacaaaccacaaaucagguacugua

SEQ ID NO: 136779 - RNA, 26 nt, Homo sapiens
acuaggccagaggcguggcugcccca

SEQ ID NO: 136780 - RNA, 51 nt, Homo sapiens
gccgcagaggagaaccuguggucacuuguggccaaggugaagaagaaagac

SEQ ID NO: 136781 - RNA, 46 nt, Homo sapiens
ugcaccggucgcccaaggcgaaggagaaacuggccgagcugcagag

SEQ ID NO: 136782 - RNA, 45 nt, Homo sapiens
uggagugcuggugggaagcgugggugaccuccaccggccuucagg

SEQ ID NO: 136783 - RNA, 78 nt, Homo sapiens
acuugaccuccagccauauucuuuuguagacaacguuggcuuuaacaggcugcuugaauacuugaaaccucaguacuc

SEQ ID NO: 136784 - RNA, 77 nt, Homo sapiens
agacauuuacagcgguuccauagcaacgugcugaaaacugaggucucggagacggcucggcccuccucuccggacac

SEQ ID NO: 136785 - RNA, 45 nt, Homo sapiens
uuugaaucuggcgccaucuuccagcagaauaaaaaggucaugaaa

SEQ ID NO: 136786 - RNA, 43 nt, Homo sapiens
acgggggcacgggcaucccgccacuguacuccaccccucccac

SEQ ID NO: 136787 - RNA, 44 nt, Homo sapiens
aacuccaaagcugucugcauucacugcaugaacgaguucagccg

SEQ ID NO: 136788 - RNA, 41 nt, Homo sapiens
uccagaaaguggcgucuaagaucccgucccccgaucgaaua

SEQ ID NO: 136789 - RNA, 40 nt, Homo sapiens
gauggugagaagagaagagagggaaggagagagagagagu

SEQ ID NO: 136790 - RNA, 55 nt, Homo sapiens
uuuauucacaauugaauaaagugaaaacuucaauuaauuguggauuugaucagau

SEQ ID NO: 136791 - RNA, 45 nt, Homo sapiens
acauguacccucaagacuucaaaaaacuuuuugaaacuauagugu

SEQ ID NO: 136792 - RNA, 32 nt, Homo sapiens
uucuugccaagacuguguugaucuucagauac

SEQ ID NO: 136793 - RNA, 85 nt, Homo sapiens
uaguaacgguuccugaauucucuuaaauucuuugagauccaaagauggccucuucagugacaacaaucucccugcuacuucuugc

SEQ ID NO: 136794 - RNA, 45 nt, Homo sapiens
uuaccuuugucugugucuaaagcaauaagccgggcagcauuggag

SEQ ID NO: 136795 - RNA, 53 nt, Homo sapiens
aaauagguugacauguaaaaaaaauaauucaaggaagagagugguguauguca

SEQ ID NO: 136796 - RNA, 29 nt, Homo sapiens
ugccaagguacuuuugaauaaugggagua

SEQ ID NO: 136797 - RNA, 46 nt, Homo sapiens
cacguggacaaccccaacggugauggucgcugcaucaccugcaucu

SEQ ID NO: 136798 - RNA, 90 nt, Homo sapiens
ucacccuuccucaagccaugcuuugcuuagugguaccaucauuuguuaaaucuucauugcugacgucgccucacaguuucaccuucugaa

SEQ ID NO: 136799 - RNA, 62 nt, Homo sapiens
ccagccuguaauuguuuguggcuuaagcgacuuucauuauuggcucugugguggcucuuaua

SEQ ID NO: 136800 - RNA, 15 nt, Homo sapiens
ggguaguuaaugauc

SEQ ID NO: 136801 - RNA, 42 nt, Homo sapiens
cuauuauuuguaccagcauauuuaauuuuccagaacuagaau

SEQ ID NO: 136802 - RNA, 48 nt, Homo sapiens
gccucaugaccuccaucuuugcuucccugcuuuugcucuucauuucuu

SEQ ID NO: 136803 - RNA, 45 nt, Homo sapiens
ucgcaggauccaagugcaagaaaugcagucaggguucucagaagc

SEQ ID NO: 136804 - RNA, 38 nt, Homo sapiens
auugaagugggucaguugaguacauuugaagaaaaaaa

SEQ ID NO: 136805 - RNA, 53 nt, Homo sapiens
acccugucagaaggugaucgugaauugaaaauaaaauuuauccugucccaccc

SEQ ID NO: 136806 - RNA, 44 nt, Homo sapiens
ucuaggagcagaauuugcucugagggaggucaggauuaauuggu

SEQ ID NO: 136807 - RNA, 46 nt, Homo sapiens
ccggcgucuccaagcgacaccugcggggcgaccagaucacguggau

SEQ ID NO: 136808 - RNA, 57 nt, Homo sapiens
agaaugguacuuuuauaaacauuaguguauuuauuuccuauguguuaauaugaagau

SEQ ID NO: 136809 - RNA, 42 nt, Homo sapiens
aagcuaauugaaugccuugaaaguauuauccacuggucagau

SEQ ID NO: 136810 - RNA, 45 nt, Homo sapiens
ucaaaaagagaaagaaagcaguucucuucuguuuaagcgaugaca

SEQ ID NO: 136811 - RNA, 24 nt, Homo sapiens
gcuucgagugacugaccccagugg

SEQ ID NO: 136812 - RNA, 47 nt, Homo sapiens
uucagcugcccuaugaugacuguguguuuggaggccagcgucugacg

SEQ ID NO: 136813 - RNA, 46 nt, Homo sapiens
ugacacuagaaaaccuucagaugcugccagagagugaggaugagga

SEQ ID NO: 136814 - RNA, 40 nt, Homo sapiens
gaaaauaugugugcaaagugccuauuggaugccuuuauaa

SEQ ID NO: 136815 - RNA, 41 nt, Homo sapiens
gugccgcgcggcucggagcccuggaagcagcagcucaccga

SEQ ID NO: 136816 - RNA, 41 nt, Homo sapiens
guuggaucaggaaggugguaaaggcuuaaggcaguuucccc

SEQ ID NO: 136817 - RNA, 48 nt, Homo sapiens
cuguuuuccuuuuuccuaaaugauucccaagaccuuagaccguagggg

SEQ ID NO: 136818 - RNA, 30 nt, Homo sapiens
ggcaccuggcaagggcauccuggcugcaga

SEQ ID NO: 136819 - RNA, 127 nt, Homo sapiens
ucccugggagugucacaugggaauuaggggaucagccugccacucccaacccugcacccuccacccauucugucuccugcccgcaccaguggacucaucugcagccaggaugcccuugccaggugcc

SEQ ID NO: 136820 - RNA, 46 nt, Homo sapiens
ugggggaagggacgcccaucauccgccuucugguagagugucucau

SEQ ID NO: 136821 - RNA, 1025 nt, Homo sapiens
aaguuaucaaauccaagggcgguguugugggcaucaagguaaggggagggccuccggacgugagguuugagauggaaguggaggaaggaaauccagguuagugaggcagggaaugaaugcuggauugguggccuagagacuugcauggagccugcuucaggcuuagggcauuuacucgacauuuuuaauccucacaauucugagagaacaguaucauucccacuuuacacaugaaaaucucagaagcucagggaagugaaguguuuugcucagaguaaguggcagagccccagucugacacccaauucacucaacauuucuguugucaaauaacaucccaguguauccugucucagaggauuguuacuaagugaacuaagugaaaauauuuuaauuuaauuguaacuaaguauuugaguaacuaaacauuuuaaguaaauuuuuuuuuuuuuuuuuuuugagauggagucucgcugucucccaggcuggagugcaguggugcgaucucuuggcucacugcaaguuccgccucccagguucacgccauucuccugccucagccucccgaguagcugggacuacaggcgcccgccaccacccggcuaauuuuuuuuguauuuuuaguagacacuggguuucaccauguuagccaggauggucucgaucuccugaucucgugaucugcccaccucggccucccaaagugcugggauuacaggcgugagccaccaugcccggcuuaaguaacuaaauauuuuaauuguaacuaagugaaaauauuugccagcccugagaugcaguuuaagggauuaaguaaaugugggggaagacuggggcuaaagaagaggaaagaggggcacgcccagcuaccuaggaggcugaggcgggaggaucacuugaguccaggaaguggaggcuucagugagcugagauuccaccacuguacuccagccggggcgacaguggaaagggugcuagaggucauuuccugugucuuaauguuguuacccugaccccaacaggua

SEQ ID NO: 136822 - RNA, 368 nt, Homo sapiens
ucaggcuccacgaugggcacaaugccauucugcagggcgagggacagggucacugugaggccuccuaacccagagucccaccuacaucucuccacagccacuggucaagaccguaucuugaugaugccagggacucaggcuucaaagcccucagauuacaggagacaagagccgccucagauccacccaccaucccuccuuggccccucugccuucaacagcccuugaguguccuccacgggccaaagcuaaugcuugcuuuuggggagguaggcaucauggcagguaauaggcaaauuaacaacacuggaaccaaaugagguaggagguugccuauugaggaccugcaggcccaccugcuggcagau

SEQ ID NO: 136823 - RNA, 41 nt, Homo sapiens
ggcugcugucuacaaggcucugagugaccaccacaucuacc

SEQ ID NO: 136824 - RNA, 42 nt, Homo sapiens
gaggcguccaucaaccucaaugccauuaacaagugcccccug

SEQ ID NO: 136825 - RNA, 376 nt, Homo sapiens
gauuaggagaacaaggggaauuuuuuuuuuuuuuuuuuuuuuuuuuuuaagauggugucuugcucugucgcccaggcuggagugcaguggugcagucucggcucacugcaaccuccgccucccggguucaugccauucuccugccucagccucccaaguagcugggacugcaggcaccugccaccacacccggcuaguuguuuguguuuuuaguagagacuggguuucaccauguuagccaggauggccuugaucuccugaccucuugauccacccgccucggccucccaaagugcugggauuacaggcaugagccaccacgccuggccaagggcaauuauauuugcaucaaguguauaaaaagccaccucuuagg

SEQ ID NO: 136826 - RNA, 47 nt, Homo sapiens
ucugccuucaaauucacauuucccacaaaaguaucucucucucuaga

SEQ ID NO: 136827 - RNA, 57 nt, Homo sapiens
aacacacaccucaagcugccacucuuauucuuuaccuuaaccaccagacuuucuaug

SEQ ID NO: 136828 - RNA, 46 nt, Homo sapiens
caauaguaucucagauuuuuuuuuaauguauuuaggugguccagug

SEQ ID NO: 136829 - RNA, 46 nt, Homo sapiens
uucuuaauuuaguuucuagaguugugaauacauacggaccacagac

SEQ ID NO: 136830 - RNA, 46 nt, Homo sapiens
uugacagacgaauaucugcauuuauugaaagaaagcaagcugaaau

SEQ ID NO: 136831 - RNA, 48 nt, Homo sapiens
auccauuuugauccagaaguaguucagauaaaggcuggaaaagcagaa

SEQ ID NO: 136832 - RNA, 42 nt, Homo sapiens
cucuagaacucaaaugagaccucauuguggggagugggggag

SEQ ID NO: 136833 - RNA, 44 nt, Homo sapiens
auuuacauccggauuuaaucuaaaucuguuaauuucaguaguga

SEQ ID NO: 136834 - RNA, 39 nt, Homo sapiens
uaaaaugcuguuggcguuagaacugucguuauuuaacua

SEQ ID NO: 136835 - RNA, 47 nt, Homo sapiens
aaacccggcuccgagagaggcaggcuuggagagaaugaauguggaaa

SEQ ID NO: 136836 - RNA, 44 nt, Homo sapiens
gucgugugcuuuggacucaucgacaugauucggcggcggcugga

SEQ ID NO: 136837 - RNA, 45 nt, Homo sapiens
gguaaacaccuuuaaguuucacuugucaggauuuuuaggucucaa

SEQ ID NO: 136838 - RNA, 40 nt, Homo sapiens
ugcuuucuccuuagcuguuuuagucuccucugcgcgccag

SEQ ID NO: 136839 - RNA, 29 nt, Homo sapiens
uucagacuccucggaagccagaaauuggg

SEQ ID NO: 136840 - RNA, 98 nt, Homo sapiens
cacuaccgcaguccagcuauacacccguaacccaacagcggcucaacccugggcgccaacuaccgcugcguccuccgccgcuuuucgcagguggaggc

SEQ ID NO: 136841 - RNA, 51 nt, Homo sapiens
ggaacaaugaauuaaauuggaaaccuccuuagccaauccccccgccccccc

SEQ ID NO: 136842 - RNA, 48 nt, Homo sapiens
aauuaaguccauacacaauauacauguauuucauuuaaagacaucugc

SEQ ID NO: 136843 - RNA, 38 nt, Homo sapiens
guggaucauuaaacuucgcaggaaaaaaauugguuugg

SEQ ID NO: 136844 - RNA, 49 nt, Homo sapiens
aaugaaauaaaaauaguuguugggauuuuauuaugcuguugacgguuug

SEQ ID NO: 136845 - RNA, 46 nt, Homo sapiens
uugaaguccagcuuaugcugcugcuccgaggaggacaugagguugu

SEQ ID NO: 136846 - RNA, 49 nt, Homo sapiens
gcuggcuuccagggcccccucaucgccuccuccauccacgccaggcggu

SEQ ID NO: 136847 - RNA, 46 nt, Homo sapiens
uguccacguacaaccugaacuucaucauccuuucggaugggcaugg

SEQ ID NO: 136848 - RNA, 44 nt, Homo sapiens
uucggucggaagucacaaagggauuaaacuucauuuuggccacu

SEQ ID NO: 136849 - RNA, 49 nt, Homo sapiens
uauugaaacaguauuauauaauguuugcuuaauuauaucaugugaugcu

SEQ ID NO: 136850 - RNA, 45 nt, Homo sapiens
guuuagagaugaaagguuuuuuuggguaacaaucccgcagcugac

SEQ ID NO: 136851 - RNA, 61 nt, Homo sapiens
agacaacauauggaaaauguucacauuuguagauuaagcuggaauuauaaugagagcaaua

SEQ ID NO: 136852 - RNA, 39 nt, Homo sapiens
uuggacucaacaauguauuuguuauuuuggauguaugau

SEQ ID NO: 136853 - RNA, 53 nt, Homo sapiens
aagccccaguggaugaugcacaggaaauucuucacuccagauuuccaaugcca

SEQ ID NO: 136854 - RNA, 45 nt, Homo sapiens
accauagcacaguggcggaagucaggauaccaggauaugccugag

SEQ ID NO: 136855 - RNA, 44 nt, Homo sapiens
ucucauggacacauucuuccagauuuugauuuaucauggugagg

SEQ ID NO: 136856 - RNA, 46 nt, Homo sapiens
uaagaagaucuucuuuccugcaaguuuuuaacaauaguccugauga

SEQ ID NO: 136857 - RNA, 46 nt, Homo sapiens
gcugccauucuuauggcccggcuagcaauauauagagcagaaacag

SEQ ID NO: 136858 - RNA, 45 nt, Homo sapiens
ugucucuagcuuucaaacaugcuauauuuuauuuuuacaggagau

SEQ ID NO: 136859 - RNA, 46 nt, Homo sapiens
gugugucacucaauucuaaaggacccugugugucugaaaauguaag

SEQ ID NO: 136860 - RNA, 46 nt, Homo sapiens
gaauuuucauuaaauauuuauuaaucuuguuuuauugaaugcuugc

SEQ ID NO: 136861 - RNA, 46 nt, Homo sapiens
acaugcauggacaguuuaaaaugggcuuuggugguacgcuagaaau

SEQ ID NO: 136862 - RNA, 41 nt, Homo sapiens
ucuguagcuauuuuaaacauuccauacccuugaacauaggc

SEQ ID NO: 136863 - RNA, 40 nt, Homo sapiens
agaggaacaaaagauuugucugccaaacaacugcagguaa

SEQ ID NO: 136864 - RNA, 53 nt, Homo sapiens
cuagaacauuauagauucugucucuuacagccucuuauuccaucucugguagu

SEQ ID NO: 136865 - RNA, 46 nt, Homo sapiens
cuacaagaaugguuguuccuguggcagcccuguuuacaccacugaa

SEQ ID NO: 136866 - RNA, 54 nt, Homo sapiens
uauaauagaugugauuuagcaagcaaauugaucuuagagcagggagauugagag

SEQ ID NO: 136867 - RNA, 41 nt, Homo sapiens
gaguugaugccucggcuauugccgguagagccuugcgacuu

SEQ ID NO: 136868 - RNA, 44 nt, Homo sapiens
uucaggucuauucaggauucuggauuacauccuaacgugggcga

SEQ ID NO: 136869 - RNA, 49 nt, Homo sapiens
cagcucaauguccagauguugugguagcucaaauugacccaaagaaguu

SEQ ID NO: 136870 - RNA, 32 nt, Homo sapiens
ucaugucaauuuuaauucacaauaucuugggg

SEQ ID NO: 136871 - RNA, 46 nt, Homo sapiens
uuggaauaucugaguaauugguuuggagaaagagacuuuacuccag

SEQ ID NO: 136872 - RNA, 91 nt, Homo sapiens
gagauaacaccuggcucuccaaaugaggcuuucuugucuauacccaaacauaauauaguuaaauguucuaugaauuuauucauagcagaua

SEQ ID NO: 136873 - RNA, 46 nt, Homo sapiens; identical to SEQ ID NO: 40435

SEQ ID NO: 136874 - RNA, 44 nt, Homo sapiens
cgugucagcugccaaagaauagacuuaaugaagaagugcccaca

SEQ ID NO: 136875 - RNA, 67 nt, Homo sapiens
acuucuagccuuuuuuuuucugggcuauacaaccauguuuccuuuuccaauuucaauauauuucuaa

SEQ ID NO: 136876 - RNA, 45 nt, Homo sapiens
ugaaacccaguauaccacuagagaggauucauuuugauagcuaua

SEQ ID NO: 136877 - RNA, 45 nt, Homo sapiens
ugaaaguacuuaacuggauucuaauugaguuauaaaauagaaacc

SEQ ID NO: 136878 - RNA, 41 nt, Homo sapiens
aaaagaggcuccuuagggauagccucaaaguuacugagaag

SEQ ID NO: 136879 - RNA, 47 nt, Homo sapiens
gagaguuuacuuuguuauuauuuacuuuaaaaagcccauuuacagaa

SEQ ID NO: 136880 - RNA, 42 nt, Homo sapiens
uucaagggugcugaucuucagagaggacaauuggcauuuugu

SEQ ID NO: 136881 - RNA, 82 nt, Homo sapiens
cuuugugcugaauuccuuuauacaguucauacaauucagacuguuauuuuguuuuguuccaguuauuuucaugucccucagg

SEQ ID NO: 136882 - RNA, 47 nt, Homo sapiens
uuauuccaguugccugugcguuuccacagcuuuucgcaagacauucu

SEQ ID NO: 136883 - RNA, 33 nt, Homo sapiens
gaaucuguuagaaauaguucauggugagggaag

SEQ ID NO: 136884 - RNA, 43 nt, Homo sapiens
gaagguuucauauguuuguguucaaaguaaaauauccucauug

SEQ ID NO: 136885 - RNA, 69 nt, Homo sapiens
gccauuaaugaaaagaugaauaaagucaacuguguaaaaauguuuaacaaauuuuaccugguaccaacc

SEQ ID NO: 136886 - RNA, 45 nt, Homo sapiens
aggcaucccuuagaaugcuuaccugguuuaauucaggauaaggaa

SEQ ID NO: 136887 - RNA, 58 nt, Homo sapiens
uaaaaggaaagcugaaguuaagaaaaccaaagcaggaaacaccaaagaagcagugguu

SEQ ID NO: 136888 - RNA, 49 nt, Homo sapiens
acgugacuuacuuacugucaaccggaaaauaaaaauaucuaaccuugaa

SEQ ID NO: 136889 - RNA, 65 nt, Homo sapiens
aaacauggcauuauuuaaaguauucuggaaacuugaaggagagcuuucauucaguguagggaaug

SEQ ID NO: 136890 - RNA, 60 nt, Homo sapiens
gucuacauuguuuaugguuuauaauguguauaguaguaauguguauaguauaguauucuu

SEQ ID NO: 136891 - RNA, 65 nt, Homo sapiens
cagacacuauaguugaugcuggugaaagacagaagaauuugauuuauucuugcccuuguggagcu

SEQ ID NO: 136892 - RNA, 45 nt, Homo sapiens
agagacgucacuaacauauauuggcacaguaauguaauuauagag

SEQ ID NO: 136893 - RNA, 46 nt, Homo sapiens
gguuccaugaaagauacauguaaaauuguacuugcaacaccaagac

SEQ ID NO: 136894 - RNA, 45 nt, Homo sapiens
uuaaugguuucugauagugagaggacaacagaagggacuucgcaa

SEQ ID NO: 136895 - RNA, 46 nt, Homo sapiens
uuggcuguagaagcccgaaacaagacauuaacuagagcucaguugg

SEQ ID NO: 136896 - RNA, 46 nt, Homo sapiens
acuccuaacagaguugaaaaaaaaaaauugcagcauaccuaccuau

SEQ ID NO: 136897 - RNA, 69 nt, Homo sapiens
acuaccucuaacaguucucuugauaucagugcuauaaagcccaacaaggauggauuaaaaaauaaagca

SEQ ID NO: 136898 - RNA, 46 nt, Homo sapiens
uuggugaaauaucagaacuccuccuuaaaauugaaugaccauaaaa

SEQ ID NO: 136899 - RNA, 67 nt, Homo sapiens
ugaauuuucuguuagaagaacuugguugcuacuuucuugucaagaugauugcaacaccuuugaaaca

SEQ ID NO: 136900 - RNA, 86 nt, Homo sapiens
accgcggguccccgcagauggugggcgucugcccuuuaagcaucucggcucacgcgguuuuauuuauuuuuuuuguagauuucugg

SEQ ID NO: 136901 - RNA, 67 nt, Homo sapiens
ucucuccgcgcggagccgagccggaacugcggcagucucucccugccaggcucuucauccaagguac

SEQ ID NO: 136902 - RNA, 27 nt, Homo sapiens
ggcgcuccuuucaaccaauacucgguc

SEQ ID NO: 136903 - RNA, 66 nt, Homo sapiens
uguaaccaaaggaggcauuauggguccagaaaaaucucaaggaaaaguauugcagcaacaguaguu

SEQ ID NO: 136904 - RNA, 28 nt, Homo sapiens
ucacgcuaacugguugaaucccuccacc

SEQ ID NO: 136905 - RNA, 45 nt, Homo sapiens
aaauaauuuccauauuucucucuuauaauaaacuaaugauaacua

SEQ ID NO: 136906 - RNA, 46 nt, Homo sapiens
auggcuuuccaaaggacauggggaauacagagaaaucccuagugaa

SEQ ID NO: 136907 - RNA, 45 nt, Homo sapiens
uacuagcacugguaaaagaugggaaaacacaagauuauguuguug

SEQ ID NO: 136908 - RNA, 37 nt, Homo sapiens
aguuguucugacauucuuaauuacagguaacuuuuaa

SEQ ID NO: 136909 - RNA, 49 nt, Homo sapiens
agguacguugaccaucuuugcagcagggcuguuuugucuauaugaugaa

SEQ ID NO: 136910 - RNA, 43 nt, Homo sapiens
cucgccuuucgcagcucucgccuaacaggaaagggaagaaaca

SEQ ID NO: 136911 - RNA, 24 nt, Homo sapiens
aagccgcaggcggccaccacgagc

SEQ ID NO: 136912 - RNA, 46 nt, Homo sapiens
cauuccucagggucugaucaaaguucagcugguacaccagggaccg

SEQ ID NO: 136913 - RNA, 46 nt, Homo sapiens
gagguauucgggccgguuaugcaccuggaccaccagcaccagcucc

SEQ ID NO: 136914 - RNA, 42 nt, Homo sapiens
caccccggcgaucagcugauugaucucggucgaccagaaguc

SEQ ID NO: 136915 - RNA, 45 nt, Homo sapiens
uggaagacaagauacagucaaguauugaagaguccagucccaguu

SEQ ID NO: 136916 - RNA, 72 nt, Homo sapiens
gaagucuuccauuauuuucagcaagcauuuaggaggugacugcacuauaaggagaauaacccacaguagcac

SEQ ID NO: 136917 - RNA, 45 nt, Homo sapiens
uuuccuuguucccgaagauuuuggauagcaccuuccccaucgcgu

SEQ ID NO: 136918 - RNA, 46 nt, Homo sapiens
gagccucaucgaugcggucgcggucggcgcaguccacuacgaagau

SEQ ID NO: 136919 - RNA, 81 nt, Homo sapiens
aacugcuguguuucccccaucccaucugcuggaagucaacaagagcaucuagcaacuuuguguucaugucaaaugucagau

SEQ ID NO: 136920 - RNA, 45 nt, Homo sapiens
agauauaaaaggucacauuugaaauuacuaaguuagaacucauaa

SEQ ID NO: 136921 - RNA, 26 nt, Homo sapiens
aagaacaguuuucaguguuuauuaaa

SEQ ID NO: 136922 - RNA, 45 nt, Homo sapiens
aucuuuguagugauuucccuucaggggggcuguaugugacucuuc

SEQ ID NO: 136923 - RNA, 44 nt, Homo sapiens
aaaagaauauauuuuuuguuuuugauuuaaaaauuuuucuacuc

SEQ ID NO: 136924 - RNA, 25 nt, Homo sapiens
gauguuguagucaccgaucuugagg

SEQ ID NO: 136925 - RNA, 45 nt, Homo sapiens
aaaggacaauggcagcgucccacacaacgcaacccacgccaccgg

SEQ ID NO: 136926 - RNA, 50 nt, Homo sapiens
uuucauacagaauuaccuuaaaagggagucuuauguuuucaacuacagau

SEQ ID NO: 136927 - RNA, 46 nt, Homo sapiens; identical to SEQ ID NO: 40520

SEQ ID NO: 136928 - RNA, 46 nt, Homo sapiens
cagugugaggauuguuauucuagagacaguuauauucaacugagac

SEQ ID NO: 136929 - RNA, 51 nt, Homo sapiens
gcaacugauuuacaaaucauuguguuguaaccacuacuguagagugcauuu

SEQ ID NO: 136930 - RNA, 44 nt, Homo sapiens
uacugaaugaggggaauuaguguuuauuuuaaaaauagcccgua

SEQ ID NO: 136931 - RNA, 46 nt, Homo sapiens
gcccauauucaaacucacagguuuccagaccgaauacuaccaaggu

SEQ ID NO: 136932 - RNA, 35 nt, Homo sapiens
guacauguguguuuagcugccuggcuagcugggua

SEQ ID NO: 136933 - RNA, 46 nt, Homo sapiens
uucaaaaguuuuugauggcuguccuuugaaaauuaauugugcaaca

SEQ ID NO: 136934 - RNA, 55 nt, Homo sapiens
gugccauaaaauaguggauuacaaaaggaaagaauaugagacugucuugguagua

SEQ ID NO: 136935 - RNA, 46 nt, Homo sapiens
auguuacaguggaauccuuuuguugauggugcaaauacuggcaagu

SEQ ID NO: 136936 - RNA, 47 nt, Homo sapiens
uaauauuagcccaaaauacuaauauccucauagaguaaguucugguu

SEQ ID NO: 136937 - RNA, 42 nt, Homo sapiens
ccauaauuuugucaaaauagcacuaaccaaaaacccaaaaaa

SEQ ID NO: 136938 - RNA, 38 nt, Homo sapiens
gguugauuucccaaacacuuuugagacuuucucuaacc

SEQ ID NO: 136939 - RNA, 34 nt, Homo sapiens
ccaguaauuuuacucccaaaacucauuuuaagga

SEQ ID NO: 136940 - RNA, 43 nt, Homo sapiens
guguuguucucuaauauuuuccaaaaugggagauuuggcugau

SEQ ID NO: 136941 - RNA, 36 nt, Homo sapiens
guagacuuacuauuuugcauucuucuguucccggag

SEQ ID NO: 136942 - RNA, 52 nt, Homo sapiens
cuuuccuuggacuugcagggaauacuuuaacuuguuuccugaaaguauaagc

SEQ ID NO: 136943 - RNA, 47 nt, Homo sapiens
cugagcucaucgcauauguuucugccuacucuacuaugccucuguuu

SEQ ID NO: 136944 - RNA, 24 nt, Homo sapiens
cuauugugacuugcauccuccaug

SEQ ID NO: 136945 - RNA, 32 nt, Homo sapiens
ggaauaaauguauaaugcauuagucacucaua

SEQ ID NO: 136946 - RNA, 75 nt, Homo sapiens
ucuaguuguggaagauuuuaauuuuuuuaagagagcaauaaccuuccuacaaccaugauugucuauucaacaaau

SEQ ID NO: 136947 - RNA, 26 nt, Homo sapiens
uuaauuaggucagagaaugaaaaguc

SEQ ID NO: 136948 - RNA, 41 nt, Homo sapiens
aagauuccuccccucauggaacucaaauuuuagugggggga

SEQ ID NO: 136949 - RNA, 45 nt, Homo sapiens
ugguuagagugaggcauguuaaugaaugggagcugggauggagaa

SEQ ID NO: 136950 - RNA, 37 nt, Homo sapiens
ucuacuuguauauauucucuucucccuacuacaauaa

SEQ ID NO: 136951 - RNA, 55 nt, Homo sapiens
uuucaagguagugguauuaucaaacagcccuagcacuguuugauucuacugagau

SEQ ID NO: 136952 - RNA, 45 nt, Homo sapiens
ccucuucaaggggucuacauggaaacugugaggaggggagauuca

SEQ ID NO: 136953 - RNA, 43 nt, Homo sapiens
ucuuacuccuuggaggccaugugggccaugagguccaccaucc

SEQ ID NO: 136954 - RNA, 46 nt, Homo sapiens
gccagucaggaauuucugcaguaugauauggauuugcagguaccag

SEQ ID NO: 136955 - RNA, 39 nt, Homo sapiens
ugugaggaucacaagucagcaguacaagccagaugcugg

SEQ ID NO: 136956 - RNA, 46 nt, Homo sapiens
acauaauagguuccaaauucggaugacucaacucguucccauccag

SEQ ID NO: 136957 - RNA, 44 nt, Homo sapiens
auaauauuuucucccucucauuguccaguccacagaccagccag

SEQ ID NO: 136958 - RNA, 57 nt, Homo sapiens
augcccauuaugaugguuuucauaaaacuagucgguauuacuauuaaggaauuauaa

SEQ ID NO: 136959 - RNA, 38 nt, Homo sapiens
gguuucucaggugaaaggagcaauagaugacgauguag

SEQ ID NO: 136960 - RNA, 80 nt, Homo sapiens
guagaacuuauucauucuggagaauuaguaggaacuggagauacagguggcagagucauaauccuucaacaggagcagau

SEQ ID NO: 136961 - RNA, 46 nt, Homo sapiens
ugaaccagaguuugacuacuugaaaaguuuagaaauagaagaaaag

SEQ ID NO: 136962 - RNA, 45 nt, Homo sapiens
gugaaagggacaaaagaccagaaggguauaacuugaaagaggagg

SEQ ID NO: 136963 - RNA, 54 nt, Homo sapiens
cauacauaucacaucaacucaauuucuauuaauagugauuaugaaacauauuua

SEQ ID NO: 136964 - RNA, 46 nt, Homo sapiens
ccaaacagcuguaacacauuuguauacagcagcaguaaaggaacua

SEQ ID NO: 136965 - RNA, 46 nt, Homo sapiens
uugacagccuagacuucaauaagaaaauccuucacacagccuggca

SEQ ID NO: 136966 - RNA, 45 nt, Homo sapiens
caaggacucuuccauucaguguagauuaacaacuauuugcacaca

SEQ ID NO: 136967 - RNA, 65 nt, Homo sapiens
gcacgggcggcggagcaacguucgcgucaucacggacgagaacuggagagaacugcuggaaggag

SEQ ID NO: 136968 - RNA, 50 nt, Homo sapiens
ugcuugucaaaaucuucaaccggaaugggaaaguuuugcugaauggggag

SEQ ID NO: 136969 - RNA, 46 nt, Homo sapiens
gguccaaggacuaagaaggacuucauaaacuuuauaagugauaaag

SEQ ID NO: 136970 - RNA, 76 nt, Homo sapiens
augguuuauucugccuuauuaacccaauccuuccuugcggguguccccucccuggccccaccauucuugauugccu

SEQ ID NO: 136971 - RNA, 46 nt, Homo sapiens
agaaaaauuauuaucagaaucugcacaaccuuugaaaaaaguggag

SEQ ID NO: 136972 - RNA, 50 nt, Homo sapiens
cuagauugucauuaaauugaagagucuacauucagaacauaaaagcacua

SEQ ID NO: 136973 - RNA, 84 nt, Homo sapiens
aauaagauuuauguauauuuguuuaauaauaaccuauuucaagucugaguuuugaaaauuuacauuucccaaguauugcauuau

SEQ ID NO: 136974 - RNA, 52 nt, Homo sapiens
cuuacauuaauuaauuacaguuuucuacacaugguaauacaggauaugcuac

SEQ ID NO: 136975 - RNA, 34 nt, Homo sapiens
gauuuucucuuguauuuuucuuacuuacuauggg

SEQ ID NO: 136976 - RNA, 113 nt, Homo sapiens
uugaacaaucuguuguaauuuaaaauuuuggccacuuuuuucagauuuuacaucauucuugcugaacuucaacuugaaauuguuuuuuuuuuuuuuucuuuuuggaugugaag

SEQ ID NO: 136977 - RNA, 64 nt, Homo sapiens
uuuuuauauuuuuuaaaagacaaacuucauauuauccuguguucuuuccugacugguaauauug

SEQ ID NO: 136978 - RNA, 71 nt, Homo sapiens
ugugggauuucacagguaaaagucaguaggauggaacauuuuaguguauuuuuacuccuuaaagagcuaga

SEQ ID NO: 136979 - RNA, 49 nt, Homo sapiens
uuucuuuaaagcccucuccuuuagaauuuaaaauauuguaccauugaag

SEQ ID NO: 136980 - RNA, 34 nt, Homo sapiens
cgggggagagagagaaagagagagagaggccaca

SEQ ID NO: 136981 - RNA, 47 nt, Homo sapiens
guaucuagcacuuaaucaugugaccaauugcuguacuaagacuaggg

SEQ ID NO: 136982 - RNA, 46 nt, Homo sapiens
uacauucucuccugacggaagaguuuuucaaguugaauaugcuaug

SEQ ID NO: 136983 - RNA, 82 nt, Homo sapiens
cagcuauuggaaucagaugcaaagaugguguugucuuugggguagaaaaauuaguccuuucuaaacuuuaugaagaagguuc

SEQ ID NO: 136984 - RNA, 54 nt, Homo sapiens
aggugagggagagggcuggggaguaugcguagaaaugagaucuuggcagcacac

SEQ ID NO: 136985 - RNA, 84 nt, Homo sapiens
ggaucacugucaaaguaaagaugccaucagauagcgaacaccuuuauauaagguggaacaucaggaaaggauguuuaaugaaaa

SEQ ID NO: 136986 - RNA, 52 nt, Homo sapiens
gcagguuuguuggcagaugcucguucuuuagcagacauagcaagagaagaag

SEQ ID NO: 136987 - RNA, 48 nt, Homo sapiens
ccuuugaguuguuuaucaucagucauauuuaauuacuaagauauuaaa

SEQ ID NO: 136988 - RNA, 46 nt, Homo sapiens
uuggggcugugccaucggcaaagccaggcaagcugcaaagacggaa

SEQ ID NO: 136989 - RNA, 46 nt, Homo sapiens
uagaugaaagaaaugaccugccgugauaucguuaaagaaguugcaa

SEQ ID NO: 136990 - RNA, 46 nt, Homo sapiens
uuucauuuccauaagaacuuaauauguaggcacauauaaucucaug

SEQ ID NO: 136991 - RNA, 52 nt, Homo sapiens
guaacuaauggaagacaugaaauuguuccaaaagauauaagagaagaagcag

SEQ ID NO: 136992 - RNA, 64 nt, Homo sapiens
cuauuguauuuuaaauuucuacuccaguccaauguaacuauuuagcccuggauuauacauacug

SEQ ID NO: 136993 - RNA, 46 nt, Homo sapiens; identical to SEQ ID NO: 40617

SEQ ID NO: 136994 - RNA, 43 nt, Homo sapiens
ugcugcccgaggucccggugcaguuggaagcuuuggagguggg

SEQ ID NO: 136995 - RNA, 46 nt, Homo sapiens
ugucagugccaaguaccgaggugccuucugugaggcaaagauuaag

SEQ ID NO: 136996 - RNA, 50 nt, Homo sapiens
agcacugcucuaaagaacguuuagauauugaaggaaguggaucacauaaa

SEQ ID NO: 136997 - RNA, 73 nt, Homo sapiens
gggggcagcuugguuggggugggcggggggugagggauuagguaaaugucgguuaaaugauacaaaauuucag

SEQ ID NO: 136998 - RNA, 46 nt, Homo sapiens
auccagagcauuuuggaacuccaguaauugcaaagaagacgaacag

SEQ ID NO: 136999 - RNA, 38 nt, Homo sapiens
ucagagugcagcagauuggaagaugugucaaaaggaaa

SEQ ID NO: 137000 - RNA, 81 nt, Homo sapiens
aauccuugagucauccaguagugaugaugaagauggcccagcugaagaaaaugaugaagagaaggaaaaggaggccaaaaa

SEQ ID NO: 137001 - RNA, 47 nt, Homo sapiens
guccguuucuagcauugcuuaauuuggguguugaggaagcauuuugg

SEQ ID NO: 137002 - RNA, 78 nt, Homo sapiens
uuacaagaaaauacuuuucagguuaguuaaucaacaagugcaaacugguuuuuuuggggucuuuuccaaaacaaccca

SEQ ID NO: 137003 - RNA, 47 nt, Homo sapiens
agggaaagcaaauauuugcaagucagacugaaaaauguccagacccu

SEQ ID NO: 137004 - RNA, 49 nt, Homo sapiens
caccuuugaaauugaucaaaaaguccauguaaacauaaguaaucauauc

SEQ ID NO: 137005 - RNA, 47 nt, Homo sapiens
uugauccugaagagagggacaacuuccuccagcagcuuuauaaguuu

SEQ ID NO: 137006 - RNA, 38 nt, Homo sapiens
gaaucaguuacaccugacaguaguaaaauauuuggaau

SEQ ID NO: 137007 - RNA, 42 nt, Homo sapiens
aucucuucaaacucuucagacugguuuaucaucaggguggau

SEQ ID NO: 137008 - RNA, 45 nt, Homo sapiens
uaguggugcuguauggaagcaaauuuauauggaccuuggcauucc

SEQ ID NO: 137009 - RNA, 104 nt, Homo sapiens
aguucagaacuguucaucaccaugaaccaaaaguaaaagaggaaaaaaaagacuuagaagaaucaauggaagaggcucucaaauuagaucaagaaaugccuuua

SEQ ID NO: 137010 - RNA, 67 nt, Homo sapiens
acagaagugaagagugaaccugaggaaaauaucgauucaaacagugaaagugaaagagaagagauag

SEQ ID NO: 137011 - RNA, 49 nt, Homo sapiens
aauuuacuuauuuauucuguuuauugugauuaucuauuuugccccacuc

SEQ ID NO: 137012 - RNA, 68 nt, Homo sapiens
ccacgaggucagggauuaguguuuauuucguuuauugacagaugccacgcauuuagaauagugccugg

SEQ ID NO: 137013 - RNA, 42 nt, Homo sapiens
ugaugcguacauguaugcugguuguaucuuccaacuuugcuc

SEQ ID NO: 137014 - RNA, 48 nt, Homo sapiens
acgaaggagaauugcucgagauguaaauucuauuaaaaaggaaauuga

SEQ ID NO: 137015 - RNA, 46 nt, Homo sapiens
aaaauuaaaaaacaggaggauucugacaaagacucagaugaagagg

SEQ ID NO: 137016 - RNA, 40 nt, Homo sapiens
agaaaauuucacagacuugaauguaagaacaauauuaucu

SEQ ID NO: 137017 - RNA, 70 nt, Homo sapiens
aaaauauggacgagggaagacucagaaaauuuaugaagccaguauuaaaagcacugaaauugaugacgga

SEQ ID NO: 137018 - RNA, 77 nt, Homo sapiens
gugggugaaggcugacaggauaaucuggccuuuggacaaagguggaccaaagaaaaaacagaagaaaaaagcuaaag

SEQ ID NO: 137019 - RNA, 47 nt, Homo sapiens
agaauaaagaagauagugaaaaggacgaaaagagagaugaggagagg

SEQ ID NO: 137020 - RNA, 24 nt, Homo sapiens
aaaucaccuaggauuuuaaucuca

SEQ ID NO: 137021 - RNA, 72 nt, Homo sapiens
auuuaauaaaugaagaacuuucucuuaaagaugaacuagaaaaaaaugaaaauuugaaugaugauaagcuag

SEQ ID NO: 137022 - RNA, 46 nt, Homo sapiens
aaaaacagaagaaguuaagaaagaagccgaaaaaucuccaaaagga

SEQ ID NO: 137023 - RNA, 86 nt, Homo sapiens
cacuaaaagaagaugaggaugcaaugccucugaucgggccugaaaccuugguuugccaugaaguagauuuggaugauuuggaugaa

SEQ ID NO: 137024 - RNA, 45 nt, Homo sapiens
aauguugccucugguaccuguaguauaauuguacaagagagagag

SEQ ID NO: 137025 - RNA, 46 nt, Homo sapiens
aaagcguaccccaaagcgaacaagugcugcagccaaaaaugaaaag

SEQ ID NO: 137026 - RNA, 89 nt, Homo sapiens
gagagaaucucauuucuccaagaaaaacuacaggaaaucagaaaauauuauaugucuuugaagucugaaguugcaaccauagacaggag

SEQ ID NO: 137027 - RNA, 40 nt, Homo sapiens
acacacauucuguccucacacacacuguccucacacgcac

SEQ ID NO: 137028 - RNA, 46 nt, Homo sapiens
acacacacucuguccucacacacacacacuccguccucacacacac

SEQ ID NO: 137029 - RNA, 46 nt, Homo sapiens
acauacccucuguccucacacacacacacucuguccucacacacac

SEQ ID NO: 137030 - RNA, 44 nt, Homo sapiens
acucuguccucacacacacacacuccguccucacacacacacac

SEQ ID NO: 137031 - RNA, 47 nt, Homo sapiens
aguauauccuguauacuuuuccaggcuggauuguaucuauuccccuc

SEQ ID NO: 137032 - RNA, 26 nt, Homo sapiens
cggugcgggucucgggcguucuggag

SEQ ID NO: 137033 - RNA, 44 nt, Homo sapiens
uuuaagcccgccacuacauguguuugguuuugcccuaccagcuc

SEQ ID NO: 137034 - RNA, 37 nt, Homo sapiens
uggguaaauaugacuuuauagucagcucuaauccugg

SEQ ID NO: 137035 - RNA, 49 nt, Homo sapiens
agaaaguuuuuccguccuuaagugugggacuuguuuugugaccaacaau

SEQ ID NO: 137036 - RNA, 48 nt, Homo sapiens
uagaagaacaggcuucuugaagaagguaguacuugcauugcaccuuaa

SEQ ID NO: 137037 - RNA, 26 nt, Homo sapiens
guucacagucaguuacagaccaaacu

SEQ ID NO: 137038 - RNA, 47 nt, Homo sapiens
aaaacuagaacucaaggcugcugaccuaacucagccuuauguuagua

SEQ ID NO: 137039 - RNA, 42 nt, Homo sapiens
caccagcaccucgcagauuugcuccuguaccuguuucaaggg

SEQ ID NO: 137040 - RNA, 45 nt, Homo sapiens
aucagaaagacaguggaugaauggauuaaaacuauuucugcagaa

SEQ ID NO: 137041 - RNA, 79 nt, Homo sapiens
gcaguagcagaacuuacaaaaugguacuaacaugauagucaucuaccuuuucuuguaaauguuauuuguuuuugugggg

SEQ ID NO: 137042 - RNA, 36 nt, Homo sapiens
ucucucugagucuucauguuaaaaauugaacagauc

SEQ ID NO: 137043 - RNA, 62 nt, Homo sapiens
auaauuuguaagaugacugaccuuauugcauauuuaaauguaaauuauaaguuguauaagag

SEQ ID NO: 137044 - RNA, 27 nt, Homo sapiens
aaggguuccucaauaugauaugucuga

SEQ ID NO: 137045 - RNA, 45 nt, Homo sapiens
gucuuauuuugaguuuaggaguucuuuuaagcuuuucauuagacu

SEQ ID NO: 137046 - RNA, 42 nt, Homo sapiens
gggcauuuaaugugcccauuuuuaucacuaaauucuguagua

SEQ ID NO: 137047 - RNA, 52 nt, Homo sapiens
ccauuacuuuuuauauacucaguuugugugugugugcaaaaaggcugauuuu

SEQ ID NO: 137048 - RNA, 48 nt, Homo sapiens
auuaucucggcaauuugacacaguuucagguagacaccaaaauauuuu

SEQ ID NO: 137049 - RNA, 41 nt, Homo sapiens
augcuauaugaauuucaguagcacucugcauucaggacuau

SEQ ID NO: 137050 - RNA, 48 nt, Homo sapiens
aggugcugcaaguauugauuugggggguuauaaauacguuuuagcgag

SEQ ID NO: 137051 - RNA, 54 nt, Homo sapiens
uauaguguuagggagauaaauuaaguuucaacaaaauuguuucucuucagugaa

SEQ ID NO: 137052 - RNA, 23 nt, Homo sapiens
aaauauuuaucuuuggcaaaaag

SEQ ID NO: 137053 - RNA, 47 nt, Homo sapiens
acauuuaauuuuuguuuccauauuuaguuaggaauggcuagagaugu

SEQ ID NO: 137054 - RNA, 41 nt, Homo sapiens
cguaucacugcagaagucaagauccucccccaguuuugacu

SEQ ID NO: 137055 - RNA, 45 nt, Homo sapiens
uggcauaaaaagaaacagaucuuucacauuaacgauugcuuuuua

SEQ ID NO: 137056 - RNA, 42 nt, Homo sapiens
guaauaggauucauaugccuaaaagauauuuugggauaagau

SEQ ID NO: 137057 - RNA, 57 nt, Homo sapiens
ccuucuucaucaagucuuucauuuauucucaaacacuggggcuaugauguugcaaau

SEQ ID NO: 137058 - RNA, 72 nt, Homo sapiens
cuguaggacuggguuaaguaugugaggagaauugaauacagcaggauaguuuagcagcugcuuacacaggaa

SEQ ID NO: 137059 - RNA, 49 nt, Homo sapiens
acugcauugcuggaacucagggcugauuuuaaagacaagaucuggucag

SEQ ID NO: 137060 - RNA, 37 nt, Homo sapiens
gguucagcagucauuucaagguccacuguuugcccag

SEQ ID NO: 137061 - RNA, 40 nt, Homo sapiens
uaguuuuucuuuuacuuaguuuuauaaaucugacauccaa

SEQ ID NO: 137062 - RNA, 29 nt, Homo sapiens
uuuuugaccacuuacugagugcuaagcuc

SEQ ID NO: 137063 - RNA, 41 nt, Homo sapiens
auccuacuggagaucgagaguuuuuucaaauucaggauggu

SEQ ID NO: 137064 - RNA, 41 nt, Homo sapiens
accuguuuucagugaaucugccaaaauccacauuguccuag

SEQ ID NO: 137065 - RNA, 56 nt, Homo sapiens
agcuguguuaaaguauuuauaaggagaaaauuucagaacuaaguugaguaauauag

SEQ ID NO: 137066 - RNA, 42 nt, Homo sapiens
ggauaaaacaaaacccagcauuaaccugcuuuagugacacau

SEQ ID NO: 137067 - RNA, 45 nt, Homo sapiens
agucuuauuucacuuucagaggccagacauguguuuugugccugu

SEQ ID NO: 137068 - RNA, 45 nt, Homo sapiens
gcacauuuuucaaauugcaucauuagagguguguuaacuacauua

SEQ ID NO: 137069 - RNA, 40 nt, Homo sapiens
aauaagaugaagguaugauaaggaggucaauaucacugga

SEQ ID NO: 137070 - RNA, 46 nt, Homo sapiens
ucagugguugccagaguuuagcagagggagcgugaauaggcagagc

SEQ ID NO: 137071 - RNA, 58 nt, Homo sapiens
auguaccacucuggugcaggauguugauuguaggggaagcugugcauguguugggggc

SEQ ID NO: 137072 - RNA, 60 nt, Homo sapiens
aaacaaaaauaaggaauuauaaaaaggguauauucagaaaaccaaaaguccuagaaguca

SEQ ID NO: 137073 - RNA, 31 nt, Homo sapiens
acagaaguuuccuggggguggaaaaaaagag

SEQ ID NO: 137074 - RNA, 49 nt, Homo sapiens
aauucugcaacaagaaaaaaguaaaagggaugguagaaaauuauuaaca

SEQ ID NO: 137075 - RNA, 48 nt, Homo sapiens
uccuuuuguuucaaguuaaaagagacaaguauauacaagaggaagaca

SEQ ID NO: 137076 - RNA, 51 nt, Homo sapiens
auaaagacaagaaaagaaaagcaacaucgaauucaaauuguagcauggcua

SEQ ID NO: 137077 - RNA, 48 nt, Homo sapiens
auaguagguaagaaaaaguauuuuacauuguguccguucauguauuaa

SEQ ID NO: 137078 - RNA, 50 nt, Homo sapiens
cuguuugaaauuccuauuauauaccauggcaaaaaaauaaauuauuugca

SEQ ID NO: 137079 - RNA, 46 nt, Homo sapiens
uaauuuaacauggcagugggagacugguaucuggcagagaaugaaa

SEQ ID NO: 137080 - RNA, 79 nt, Homo sapiens
auucuguauucuaaugccuuuauaugaaaauuuuaauauuuuacaauuggugauuaaugcccuuuccugaaauuuggaa

SEQ ID NO: 137081 - RNA, 75 nt, Homo sapiens
uguagguguguaaauuuauuccuguaccauacuguaugaagaaucagucugguucuaaucuguaaaaucuguuug

SEQ ID NO: 137082 - RNA, 48 nt, Homo sapiens
aggaagggaggccuuuugugcaagugaacaaauauuuuuaauacuuag

SEQ ID NO: 137083 - RNA, 62 nt, Homo sapiens
cugacucugcugaaaugcuauuuuguauaguucccagaugcuagaauccccccugcucaugu

SEQ ID NO: 137084 - RNA, 45 nt, Homo sapiens
uggaggaaggauggaagcuaauacauuuauugagcuaacauuuaa

SEQ ID NO: 137085 - RNA, 46 nt, Homo sapiens
cuguaacaaugauguuuuucuccaauuuuccauucucauggauucg

SEQ ID NO: 137086 - RNA, 41 nt, Homo sapiens
ccaguacaucaacauguuugauuuuuauauucccaggacua

SEQ ID NO: 137087 - RNA, 46 nt, Homo sapiens
guaaucuguuguccugcuuugccaagcugucagucaggacaagcaa

SEQ ID NO: 137088 - RNA, 42 nt, Homo sapiens
gucagggggcgggcaagggcggaggcgcgcucgggcgcgcgg

SEQ ID NO: 137089 - RNA, 44 nt, Homo sapiens
auccaaaucaccuaaaaagggcacaagaagaggaaaauaauuag

SEQ ID NO: 137090 - RNA, 43 nt, Homo sapiens
uuuccugaauguguuagcucaauuucuaauaagcacucuaugu

SEQ ID NO: 137091 - RNA, 44 nt, Homo sapiens
uuugcucaaaauacacacugcauaucuuugaaauucucuaagua

SEQ ID NO: 137092 - RNA, 45 nt, Homo sapiens
caagucaagaguaauaaugagcuaaugaauucaauggcaggagug

SEQ ID NO: 137093 - RNA, 113 nt, Homo sapiens
uggggcaggagucuaguaaaauagaucaaaugaaaaauuaaauuuugauguacauaauauucacaagccaaagagcuaagugaagaguucaugaauauacaagagccauguau

SEQ ID NO: 137094 - RNA, 53 nt, Homo sapiens
aaauuacgggggcaaaaauauuuaagcaaauacauuuaagaaaacuauaaaca

SEQ ID NO: 137095 - RNA, 43 nt, Homo sapiens
gaagaaauaccuuaaggacacuuugaagcacaauuuccaacag

SEQ ID NO: 137096 - RNA, 127 nt, Homo sapiens
accauaagucugaguuaccuuuacaauccacuauugauaccgcgucuuaaucucuauggcauaaaagacaaaaggcaauaccaaccuuuuuauacauuaaaauguucucuacuuuaaaauugcaguu

SEQ ID NO: 137097 - RNA, 404 nt, Homo sapiens
gucaucaguuucugugucuguggggaaaaaauaugagucaaucuaaaguauagaaggauuuuuuuuuuuuuuuacccaagacagagucuugcucuguugcccaggcuggagugcaauggcgcaaucuuggcucacugcaaccucugccucccagguucaagcaauuccccugccucagccucccaaguagcugggauuacaggcgcacaccaccacgcccagcuaacuuuuguauuuuugguagagacgggguuucaccaugguggccaggcuggucucgaacuccuaaccucaagugauccacccgccucggccucccaaagugcugggauuacaggcgugagccacugcgcccggccacaaggauuuucacauauaaaaaauuuauguucuuuuucacaaaa

SEQ ID NO: 137098 - RNA, 113 nt, Homo sapiens
uuuggcguuucagcgguggguaauggagacauugccaaauuuauauucuguaauuuuucguugggugaggggagcauuacaucauuauauaaugguacuuccucaaguugcug

SEQ ID NO: 137099 - RNA, 66 nt, Homo sapiens
ggauuugguucuaauuuuaaugcaacuucuugauugagugcagggucagcacuacuucgaaguggc

SEQ ID NO: 137100 - RNA, 41 nt, Homo sapiens
guucauuaguucauuuuaaccuuacuuaaguucccaagaca

SEQ ID NO: 137101 - RNA, 47 nt, Homo sapiens
agaaaagcaaaaccuacuacucauacuuacaauuccuacugcuugaa

SEQ ID NO: 137102 - RNA, 49 nt, Homo sapiens
aaaaaggugcauuuuuuaaaaugaugcuacugcaaugcaaugguuuaaa

SEQ ID NO: 137103 - RNA, 58 nt, Homo sapiens
aaguuucuacaaagcgaguaauuuuaaguucaucuuuucuguacagaggcuucuagga

SEQ ID NO: 137104 - RNA, 50 nt, Homo sapiens
uauuuuuguaucgaauuccacuaauuucacuauuucucuguaaaauaauc

SEQ ID NO: 137105 - RNA, 42 nt, Homo sapiens
gucugggcagcgucuuggaaaaacuauccacuacagguaaga

SEQ ID NO: 137106 - RNA, 57 nt, Homo sapiens
uuuucucuccgugcuucagauugaaugauuugacuugucuucaaguucaugaauuau

SEQ ID NO: 137107 - RNA, 65 nt, Homo sapiens
uuaaucccauucaauaacuuuaauuuuagauguaguauuuuucaguucuaacauuucuccuuggu

SEQ ID NO: 137108 - RNA, 69 nt, Homo sapiens
uuuaauggaaaccgugaaguguuugccacaucacucuauucuugcaagacuugaacuuugaacucagga

SEQ ID NO: 137109 - RNA, 57 nt, Homo sapiens
cagauuucuagcucuuugcccuagaaucauggggguuuuugccuugcuugcagccaa

SEQ ID NO: 137110 - RNA, 23 nt, Homo sapiens
agauaaguccuggccuggucaau

SEQ ID NO: 137111 - RNA, 32 nt, Homo sapiens
aguguuaucaccccacagaccucuaauccaug

SEQ ID NO: 137112 - RNA, 52 nt, Homo sapiens
uuccuuguuuuccuuuuuuccuuuuaauuggaugcacugaccuggcccagga

SEQ ID NO: 137113 - RNA, 67 nt, Homo sapiens
uauggaaagaaacaaaaaaaguauauuuagagcuuuaaaagcuuuuuuauuuuuuuguggggaugag

SEQ ID NO: 137114 - RNA, 42 nt, Homo sapiens
uauaucucaucacagcgccagcccuguuuuuagccggaaagg

SEQ ID NO: 137115 - RNA, 46 nt, Homo sapiens
gacaacaacauuacuaaccuguggagucacacguuuauguaguaga

SEQ ID NO: 137116 - RNA, 46 nt, Homo sapiens
aaagaaagaaaaggagcgugaagaauuguggaaaaaauuggaggau

SEQ ID NO: 137117 - RNA, 39 nt, Homo sapiens
ugaaagccgugugauaacugagcauaaugcucaguugga

SEQ ID NO: 137118 - RNA, 62 nt, Homo sapiens
aucauccauaagcagaugucagcuuuguauaucauaaagcuauggaccuuagaggacccaga

SEQ ID NO: 137119 - RNA, 49 nt, Homo sapiens
uacugaaggguuguuaaguggggaaguggucugacuagguuuucauuuu

SEQ ID NO: 137120 - RNA, 45 nt, Homo sapiens
agguuauuaggggguuaaugaaauuuuggccuaaaacauguaguc

SEQ ID NO: 137121 - RNA, 41 nt, Homo sapiens
aauagauauucaacacauuuuuugaggaaggaagaagggga

SEQ ID NO: 137122 - RNA, 45 nt, Homo sapiens
auuuuuuagauaucucuauuuuuuauauaaaaaaaauaagcauau

SEQ ID NO: 137123 - RNA, 42 nt, Homo sapiens
uugggugcuuucauggcacugaaguuuuagguaacacuuccu

SEQ ID NO: 137124 - RNA, 45 nt, Homo sapiens
agccaagaauuccaacccagcauugccaaaaaauauauagaucag

SEQ ID NO: 137125 - RNA, 42 nt, Homo sapiens
agucagaauauccuuagguugcucgacaaauagcaaggggga

SEQ ID NO: 137126 - RNA, 58 nt, Homo sapiens
aauggaagcaaauuuacuauuuaggaccuugguuuuuaaccauuuuuagaucuuggaa

SEQ ID NO: 137127 - RNA, 45 nt, Homo sapiens
aggaagggugcaugggggcgaaacaggagauucgcuggaaagucu

SEQ ID NO: 137128 - RNA, 45 nt, Homo sapiens
agcuagaaagcaaaugaacagugguuacuaccuugguccaucaga

SEQ ID NO: 137129 - RNA, 55 nt, Homo sapiens
auuuuuuuugcauaagcaaauuaaauuacuugaauuagcagaaguuacuggagaa

SEQ ID NO: 137130 - RNA, 46 nt, Homo sapiens
ugaacaugcuuuauuuuucuauuuuauuuuauacuaagacccacua

SEQ ID NO: 137131 - RNA, 47 nt, Homo sapiens
guuugaucuugaaauaggagccgaauggaagcggaggguucaugguc

SEQ ID NO: 137132 - RNA, 51 nt, Homo sapiens
aggucacagacacacacagagacgugcacauagacacagaguauaagagac

SEQ ID NO: 137133 - RNA, 37 nt, Homo sapiens
uacaccacaguggugcaugaugagcaggaaaaagcug

SEQ ID NO: 137134 - RNA, 46 nt, Homo sapiens
guuguucagaguuuuuaauauacuuaaaauuguuugacagcuguga

SEQ ID NO: 137135 - RNA, 45 nt, Homo sapiens
gaaugauuucaccagugaaaccauuugggcuagaguuucucugug

SEQ ID NO: 137136 - RNA, 3681 nt, Homo sapiens
uaaacaaaucacaugcacaccucguuuuauugcacuucauagauauuggggguugcuuuuuuuuuuuuuuuuuuuugacgaagucuuguucugucacccaggcuggagugcaauggcacgaucuuggcucacugcaaccucccgccuccgggguuuaagcaauucuccugccucagccuccugaguagcuggcauuauacacgggagccaccacgccuggcuaauuuuuguauuuuuaguagagacaggguuucaccauguuggucaggcuagucucgaacuccugaccucaugaucuacccaccucagccucccaaagugcugggauuacaggcgugagccacugugcccaaacaaauugaagguuuguggcaaccuuguguggaacaaaacuguugguaccauuuuuuccaacagcauaugccccuuucauaucuuugugucacauauugauaauucuugcaauauugcaaaccuuugcauuguuacuauaucuguuauagugaucugugaugagagaucuuugaaguuacuuuuuaaaaauuauuuauuuauuuauuuauuuuugagauggagucccgcucugucgcccaggcuggagugcaguggcucugucucggcucauugcaagcucugccuccgggguucacaccagucuccugccucagccuccugaguagcugggacuacaggcgcccgccaccacgccuggcuaauuuuuuguauuuuuaguagagacaggguuucaccauguuagccaggauggucucuaucuccugaccuugugauccacccaccuuggccucccaaagugcugggauuacaggcgugagccaccgcgcccgaccugaaguuacuauuuuaauugcuuugggacaccaugaaaugugccccuacagcaaacuuaaucgauaaauguuguauguguugugacugcucugcugagcgguuguuccucagccucugucccucuucucaggccucccuauuccccgagacacaacaguauugaaauuaggccaauuaauaacccuauaauggccuuuaaguguuccaaugaaaggaagagucacaugucucucauuuuaaaucaaaagcuagaagugauuuagcuuagugaggaaggcaugucaaaagcugaaacagaccaaaagcuaggccucuugcaucagacaauuagacaaguugugaauuuaaagguaaaguucuugaaggaaauuaaaacuacuacuccaguaaacaugugaaugauaagaaaguaaaacaaccuuauugcugauaauugagaaaguuucaguggucuggauagaauaucaaaccagccacaacguuccuuaugccaaagccuaacccagagcaaggccuuggcucucuucaguuguauaaaggcugagagaguugaggaagcugcagaagaaaaguuggacaguaacagagguugguuggcuuaugagguuuaaggaaaauagccaucucucuaacauaaaagugcaaggugaagcacuaaaugcuguuguagaagcuaaagcugccgcaaguuguccagaagacuuagcugagacauugaugaagguggcuacaccaaacaacagaguuucaauguggaugaaacaaccaucuauuagaagauguuaccaucucugacuuuuacagcugcagaggagaaaucagugccaaagcuugggccaggcugacucucuuguuaggaacuaaugccacuggugacuuaaguugaagccagugcucauuuaccauucugaaaaucuuagggcgucuaacaaccaugcuaaaucuacccugccuaugcucuguaaauggaacagcaaagccuagaugacaacacuucuguuuacacaugguccaccaaauauucugaauucacuguugaggcccacugcuuagaaaaacguuuuguuuuucuuuucccccaaaguauuacuacucauugacuauccaccuuguuacccaagagcucuaauggagauauacaaggagaugaauguuguuuucuuuuucuuuuuuuuuuuuuuuuuuugagauggagucucacucugucccccaggcuggagugcaguggcuuuaucucagcucacugcaagcucugccuccuggguucacgccauucuucugccucagccucccgaguagcugagacuacaggcgccugccacugcgcccagauaauuuuuuguauuuuuaguagagacgggguuucaccauguuagccaggaugaucuugaucuccugaucucgugguccacccgccucggccucccaaagugcuggaauuacaggcgugagccaccgugcccggccgaauguuguuuucaugccugcugacauaccauccaaucuucagcucaugggucaaggaguaauuuugauuuucaagucuuauuauuuaagaaauucauuucuuaaggcuguagcugccauagauaguaauuccucugauggaucugggcaaaacaaaucgaaaaccuucugaaaaggauucaccauucuagaugccauuuagaacauuugugauucacaggaggaagucgaaauaucagcauuaacaggaguuuggaagggguugauuccaacccucauggaugaccuugagagcuucgacuucaauagagagaguagcugcagugcagaugugaugggaauagcaagauaacuagaaugagaaguagagccugaagauuugacugaauugcugcaaucucaugaucaaacuucaacaaaugaggaguugcuucuuauggaugagcaaagaaagugguuucuugagagggaaucaacuccugaaaauguugugaacauuguugaaaugacaacaaaggauuuagaacauuauguaaacuuaguugaucaagcaguggcaggguuugggaggauugacuccaauuugaaaagaaguuccauuguggauaaaaugcuaucagacagcaucacaugcuacagagaaauuuuucaugaaaggaagagucaaucgaagccacaaacuucauugucauuuuuuuuuuuuuuugagacggagucucacucuauugcccaggcuggagugcaauggcacaaucuccgcucacugcaaccuccgccuccuggguucaagugauucuucugccucagccucccgaguagcugggauuacaggcgcucaccaccacgcuuagcuaauuuuuguauuuuaguagagaugggguuucaccauguuggccaggcuggucuugaacuccugacccugugaucugcccgccucagcuucccaaagugcugggauuacaggcgugagaccaccacaccuggccucauugucaucuuauuuuaagaacgugccacaaccaccucagccuucagcuaccaccgcuaugaugaguuagcagccaucaacaugaaggcaagacccuccaccagcaaaaaagauuacaacucgcuaaaggcucagaugauuguuagcauuuuuuagcaauaaaguauuuuuaagguauauccauuuuuguuuuuuuagacauaaagcuauugugcacuuuauagacuacgguguauuguaaacacaacuuuuacaugcaccaggaaaccaaaaaugugugugacuacuuuauugagauauuugcuuuauugugauggccuggaacugauccuauaauguaugugaggugugccuguaaagcaaaauagcccauaaag

SEQ ID NO: 137137 - RNA, 48 nt, Homo sapiens
caauuaaaugaagucuggauaccaccuacagacuucuagaauuaggaa

SEQ ID NO: 137138 - RNA, 62 nt, Homo sapiens
cuuuugauccaacuugaugggacuuguacuuugagaacugguauuccuguuaggggaagaaa

SEQ ID NO: 137139 - RNA, 42 nt, Homo sapiens
uauuuauaaaaguuuuagaacagucucuaacauguggcaagu

SEQ ID NO: 137140 - RNA, 49 nt, Homo sapiens
aauugagaggaaaguacagagauuucucauaugccccugucccugcaca

SEQ ID NO: 137141 - RNA, 42 nt, Homo sapiens
uuuggagagcuaagcaaauguagucggcacagugcuagaauu

SEQ ID NO: 137142 - RNA, 46 nt, Homo sapiens; identical to SEQ ID NO: 40852

SEQ ID NO: 137143 - RNA, 39 nt, Homo sapiens
ugcacaguggugaaggguccaggcuuuggagccaaucca

SEQ ID NO: 137144 - RNA, 66 nt, Homo sapiens
cauaucuuuagguuucagugacugucuuacccuuggagacggauguuuuguggcuaggaaaccagc

SEQ ID NO: 137145 - RNA, 28 nt, Homo sapiens
agguuugggaucagugagcagguguguu

SEQ ID NO: 137146 - RNA, 58 nt, Homo sapiens
ucagucccuugaacuguuucugaguuaugugucaaaaaucaaucuaccaccaaaaauu

SEQ ID NO: 137147 - RNA, 112 nt, Homo sapiens
aaaauugcucccugguagaaauguuuaaaggauguguguguguguguguguguguguguguguguguaauggggaaagaaagauggguggggucgggggaggagaaaucagg

SEQ ID NO: 137148 - RNA, 34 nt, Homo sapiens
ugaauacuugaccaucauuacugguuaaucuuau

SEQ ID NO: 137149 - RNA, 50 nt, Homo sapiens
cugaauaaagguuaaaaugucaugggaaaaugggaaaacuuaagcaggag

SEQ ID NO: 137150 - RNA, 47 nt, Homo sapiens
uuuauauuucauagucucugccagugguuucuaauuuugggccacga

SEQ ID NO: 137151 - RNA, 45 nt, Homo sapiens
ggggagacaauauguuccuauaagaaaaauucauagugcccaaaa

SEQ ID NO: 137152 - RNA, 60 nt, Homo sapiens
gcaauucugguaguuucaguauaccuaagagaagacagguuauuaaugauuuucagaugu

SEQ ID NO: 137153 - RNA, 47 nt, Homo sapiens
ucucuguggaacucugucaagugagaggggaugcagcugguccagau

SEQ ID NO: 137154 - RNA, 49 nt, Homo sapiens
agcucucaguuucugaggagggcgaccacgaccacgucugccauuugac

SEQ ID NO: 137155 - RNA, 60 nt, Homo sapiens
uaauggaaauauuugcagucuacacaggccuagagaagaagugaaggauuuuaagcagca

SEQ ID NO: 137156 - RNA, 46 nt, Homo sapiens
caaguggauccuauaaaguugaucucuuuguaugcuacguuuaggg

SEQ ID NO: 137157 - RNA, 48 nt, Homo sapiens
aguggcuaauguaauuauuuucaagggaaauuccauuuauggagcauu

SEQ ID NO: 137158 - RNA, 45 nt, Homo sapiens
ugcauuuaaggaagaaaaauauggaguauauacagcugugagaau

SEQ ID NO: 137159 - RNA, 61 nt, Homo sapiens
ugcaucuacccuuaccauaaaacacuguaagccauaaacagcauucaucauaaugugcguc

SEQ ID NO: 137160 - RNA, 62 nt, Homo sapiens
auguaauggguguuaacuucuguaucuguaaaggacuucauucugaggaagccaguuaaauu

SEQ ID NO: 137161 - RNA, 40 nt, Homo sapiens
uaaaaaugaaaauagucauuaugaggcuuuggaaagaaaa

SEQ ID NO: 137162 - RNA, 41 nt, Homo sapiens
ucgggcauaagggguaaaugauuuuuuuaaaagcuaccuau

SEQ ID NO: 137163 - RNA, 39 nt, Homo sapiens
ggccaccucgcccgucucccgccccuccaagccacagau

SEQ ID NO: 137164 - RNA, 38 nt, Homo sapiens
cuucuuuugaaauaucaagucauagcacaaaacuucag

SEQ ID NO: 137165 - RNA, 86 nt, Homo sapiens
acgggagcguggcaggcgcuggacucgacagcagauguggaacuggagagcuuggcgcgcccucauacuuugucacacaccuacgc

SEQ ID NO: 137166 - RNA, 47 nt, Homo sapiens
acgggaaggagaucuccgcguaagcaccugacauuguuguugagugu

SEQ ID NO: 137167 - RNA, 49 nt, Homo sapiens
ugagaauauucugcauuccacuugaccucugccuguucuacccuugcgg

SEQ ID NO: 137168 - RNA, 41 nt, Homo sapiens
uggagagcaaauuaaauauguuuaucaacuccauaagggca

SEQ ID NO: 137169 - RNA, 49 nt, Homo sapiens
uccagauucacccaguagggagauauucaauacauauuuuuacggacaa

SEQ ID NO: 137170 - RNA, 45 nt, Homo sapiens
uuguuuauauuucuaaucguucuauguuuuauacuacccuacgau

SEQ ID NO: 137171 - RNA, 46 nt, Homo sapiens
uuuuacaaauaaaugguuauaaugauaaacuauaaauauguucaug

SEQ ID NO: 137172 - RNA, 38 nt, Homo sapiens
ccauauauaauuuguauaucacacagaaaucaaaaggu

SEQ ID NO: 137173 - RNA, 45 nt, Homo sapiens
aguuccaagcaucccuuaggcguacaaggaaugaaacagucauug

SEQ ID NO: 137174 - RNA, 46 nt, Homo sapiens
gacugcccaucuggaugaggagguaggguguccagaggagagguaa

SEQ ID NO: 137175 - RNA, 85 nt, Homo sapiens
aaaggugacauccuggugguugcaacuggucagccugaaaugguuaaaggggaguggaucaaaccuggggcaauagucaucgacu

SEQ ID NO: 137176 - RNA, 45 nt, Homo sapiens
accugggacauaauugauuccacagucgaugacuauugccccagg

SEQ ID NO: 137177 - RNA, 127 nt, Homo sapiens
aagucuuuuuucucccuucccaucucaaguuucagauguagacgcugagcugccaggaacauuagucacugucaagccuucaccguuuuuaaccucccucccacucucccuaccgugcuuuuaagac

SEQ ID NO: 137178 - RNA, 422 nt, Homo sapiens
ccucacuuugaauacuugcgauaugacauucaagcucagucuuuuuauuuauuuauuuuuuuaauuuuuuuuuuuuuucuugagacggagucucgcucuguugcccaggcuggagugcuguggcgcgaucucggcucacugcaagcuccgccuugcggguucaugccauucucccgccuccgccucccgaguagcugggacuacaggcgcccgccaccacgcccggcuaauuuuuuuuguauuuuuaguagagacgggguuucaccauguuagccaggauggucucgaucuccugaccucgugauccgcccaccuuugccucccaaagugcugggauuacaggcgugagccaccgcacccagcaagcucagucuuuuuaaaaccucgcaucuucuguaucauauuucugcuuuuggcauuuu

SEQ ID NO: 137179 - RNA, 48 nt, Homo sapiens
auuguguuccccaaaggauggcagaaucacucaguuacagaccagcaa

SEQ ID NO: 137180 - RNA, 64 nt, Homo sapiens
aaaguauuggccagagaaacacauaaaagugcucuuccugcuuggcuuacuaaagauaaauuga

SEQ ID NO: 137181 - RNA, 61 nt, Homo sapiens
gaccagaugauaaaaaaccaaaugggagaaaaguugugggugauguggcauacgacgaggc

SEQ ID NO: 137182 - RNA, 45 nt, Homo sapiens
acaguagagagugccaagcguuuccuggagaaauuuaagccagga

SEQ ID NO: 137183 - RNA, 45 nt, Homo sapiens
uccacuuuccuggcuuaaauuucuccaggaaacgcuuggcacucu

SEQ ID NO: 137184 - RNA, 45 nt, Homo sapiens
aagugacauugauauaucacgaucuuguaaaccgaagcccauugg

SEQ ID NO: 137185 - RNA, 45 nt, Homo sapiens
ccaauuucucgagccagcuuaccaaugggcuucgguuuacaagau

SEQ ID NO: 137186 - RNA, 46 nt, Homo sapiens
gaauuauauggugaaacaaaggccaaaguucugcugucagcacuag

SEQ ID NO: 137187 - RNA, 42 nt, Homo sapiens
auucugguagagaugggcaccaagggcuugcacuagcccgau

SEQ ID NO: 137188 - RNA, 46 nt, Homo sapiens
ucuuccauaggaaugaccugggaguagccgccuccugcagcgccac

SEQ ID NO: 137189 - RNA, 339 nt, Homo sapiens
uuuuuuuccccaugacggagucuugcucuguugcccagagcuggagugcaauggcgcaaucucggcucacugcaaccucugccucccagguucaagcaacucuccugcgucagccucccgaguagcugggauuacaggcaugcaccaccacgcucagcuaauuuuguauuuuuaguagagacgggguuucaccguguuggccaagcuggucuugaacuccugaccucgugauccgcccaccucggccucccaaagugcugguauuauaggcgugagccaccgcacccagccuagauucuuuauuauagcuuuuucucucuggagauuagccuuuuuugu

SEQ ID NO: 137190 - RNA, 46 nt, Homo sapiens
acauaaaagacuaauuaucuguccacagaagaaucuccucccaaau

SEQ ID NO: 137191 - RNA, 30 nt, Homo sapiens
ggacagauaauuagucuuuuauguuuucuu

SEQ ID NO: 137192 - RNA, 42 nt, Homo sapiens
acgagguuauuagcugcagugauggcauggaugucaccugug

SEQ ID NO: 137193 - RNA, 45 nt, Homo sapiens
uuuaaggcucucuuuaaucguuuggugccaucaguaaauggagug

SEQ ID NO: 137194 - RNA, 44 nt, Homo sapiens
ucagagacuaggcauugaaaagacugacccuaccacacugacag

SEQ ID NO: 137195 - RNA, 42 nt, Homo sapiens
uuccucaggaaucuaucauugguauccaacacuacagcagac

SEQ ID NO: 137196 - RNA, 47 nt, Homo sapiens
ugacaacucagggucuuggaauaauuaauuaauauauuuuuuugcua

SEQ ID NO: 137197 - RNA, 56 nt, Homo sapiens
uaagaaaggagagcccgucagugccgaagaucugguggguacccagacacgccagg

SEQ ID NO: 137198 - RNA, 57 nt, Homo sapiens
caauuuaauccuauuuugcuaauuacaagauaauuaugaaauguuuaaaaaguacau

SEQ ID NO: 137199 - RNA, 39 nt, Homo sapiens
acucuugauguucucugcaaauugaagucauacacccac

SEQ ID NO: 137200 - RNA, 50 nt, Homo sapiens
ccuucuccacuugcucaucucuuucuucucauucuuccucacaccuguga

SEQ ID NO: 137201 - RNA, 26 nt, Homo sapiens
aagaucugaaaaauguacaaugccua

SEQ ID NO: 137202 - RNA, 62 nt, Homo sapiens
guucccuuccauugucuucccugcauuggcuggguaaguuccaaaugccauucagaucagaa

SEQ ID NO: 137203 - RNA, 46 nt, Homo sapiens
uggugucuucauuuaagaaauucuacuuauuuaaaacuguucuuga

SEQ ID NO: 137204 - RNA, 41 nt, Homo sapiens
gguaaggguaacuaauuccuuucaaacagcaaauaagcuau

SEQ ID NO: 137205 - RNA, 42 nt, Homo sapiens
gcugcucucuggacggccugagccagggcuaaggcacccuug

SEQ ID NO: 137206 - RNA, 41 nt, Homo sapiens
guguugagcuucgggaaguaauucaaugucaucugcuccau

SEQ ID NO: 137207 - RNA, 45 nt, Homo sapiens
cucuggguugugagacaaagacaaguguguuuuagccaugcagau

SEQ ID NO: 137208 - RNA, 45 nt, Homo sapiens
ugguuuucuguaccccuuaguaggaacgguaagugcaugcugcaa

SEQ ID NO: 137209 - RNA, 45 nt, Homo sapiens
aaaauaucaaaaauccuacucaucacuguuuagggaaccaucuuu

SEQ ID NO: 137210 - RNA, 45 nt, Homo sapiens
uguaagagguaaggaggugcuaggugugagacaaguaggagagag

SEQ ID NO: 137211 - RNA, 80 nt, Homo sapiens
uauucauuauauaggacauuguuacagauaaaaauauacggaguuuucacuugcaagccguacauauuugcaucuaagua

SEQ ID NO: 137212 - RNA, 53 nt, Homo sapiens
aaguuuaguuuuagaaggccauuuugggccaguaagaauggugauuauaaaac

SEQ ID NO: 137213 - RNA, 53 nt, Homo sapiens
aaugagaguuggcaauaaccaaugaauugaaauauuuauauuucaacacauuu

SEQ ID NO: 137214 - RNA, 26 nt, Homo sapiens
agccaagagaagucagccccugccca

SEQ ID NO: 137215 - RNA, 24 nt, Homo sapiens
guuccuuuuccuuuguguaaacaa

SEQ ID NO: 137216 - RNA, 78 nt, Homo sapiens
cggucauaacggucccggccuauuucaacgacucgcagcgccaggccaccaaggacgcaggcaccaucacggggcuca

SEQ ID NO: 137217 - RNA, 45 nt, Homo sapiens
ccucgauggucaggauggacacgucgaaagugccaccgcccaggu

SEQ ID NO: 137218 - RNA, 24 nt, Homo sapiens
uugucgaaguccucaccgcccagg

SEQ ID NO: 137219 - RNA, 44 nt, Homo sapiens
cggaggaguucaagcgcaagcacaagaaggacauugggcccaac

SEQ ID NO: 137220 - RNA, 24 nt, Homo sapiens
ucguccacgcaggcgagcaucgag

SEQ ID NO: 137221 - RNA, 28 nt, Homo sapiens
cuucuccaccggcuccagggucccgcga

SEQ ID NO: 137222 - RNA, 48 nt, Homo sapiens
gguggagaaggcgcugcgcgacgccaagcuggacaagggccagaucca

SEQ ID NO: 137223 - RNA, 46 nt, Homo sapiens
gcaaggacgacauugaccggauggugcaggaggcggagcgguacaa

SEQ ID NO: 137224 - RNA, 39 nt, Homo sapiens
aaacaaaaaaaaagagagagagagaaaggcaaagagguu

SEQ ID NO: 137225 - RNA, 46 nt, Homo sapiens
ggauauuccuucuccacacagucgccacacaucgcgacgcagucaa

SEQ ID NO: 137226 - RNA, 73 nt, Homo sapiens
gguccuuauaggacaguucuucgagauaaugcaauaccaacaauauuugaucuuaacagucauuugaacaacc

SEQ ID NO: 137227 - RNA, 50 nt, Homo sapiens
uguucaaaaacacagcagaggcagaugcuagagaucugugagagcuguau

SEQ ID NO: 137228 - RNA, 51 nt, Homo sapiens
ggaaccugaagaaugaggugcuguauuguacgggucuaguuuggagaaggg

SEQ ID NO: 137229 - RNA, 22 nt, Homo sapiens
gcagucuagagugcaacugcgc

SEQ ID NO: 137230 - RNA, 37 nt, Homo sapiens
cucuacuugggaaccagccagaggacaugagaugcug

SEQ ID NO: 137231 - RNA, 54 nt, Homo sapiens
ucagacaugcucugggccugaccuggagguggagcuacuuucucacugcacaag

SEQ ID NO: 137232 - RNA, 43 nt, Homo sapiens
ggagaugguauaaccuuggcuguaagcagguggaaaggcagau

SEQ ID NO: 137233 - RNA, 78 nt, Homo sapiens
ggauaagagcaacuaucaguuaaugcagccuagguagcccagcaagggacuugggcaguuggacaugcagaugcaaca

SEQ ID NO: 137234 - RNA, 43 nt, Homo sapiens
ucgauuuugguucuaaagauggaaagaaaaauuggcuaagaaa

SEQ ID NO: 137235 - RNA, 80 nt, Homo sapiens
guucaagccagaauguaucuccugauucugcugaaacaggcccucuccagccaccuucacccagacccagcugaggacca

SEQ ID NO: 137236 - RNA, 48 nt, Homo sapiens
cauaaaaucugagguguugguggagaaaggcaggggacuuggcaagaa

SEQ ID NO: 137237 - RNA, 46 nt, Homo sapiens
uagaagccagaugccucaggcuucuuggcaugguucaggcccccag

SEQ ID NO: 137238 - RNA, 42 nt, Homo sapiens
ccugugguacuuggucaucuccucaguacuggguuugugagg

SEQ ID NO: 137239 - RNA, 46 nt, Homo sapiens
cuucauuggauggucuugucuauaauauuaauuuccaacauccccg

SEQ ID NO: 137240 - RNA, 47 nt, Homo sapiens
ccauagagacaugcuaagcacuacaucaugcuaagaagaacaguuau

SEQ ID NO: 137241 - RNA, 85 nt, Homo sapiens
uggaaaauggugcuuuaaaagguagucucuuaccauauaaggaauaaguaaaacauuagcuugugauuucucauuauucagguca

SEQ ID NO: 137242 - RNA, 41 nt, Homo sapiens
ucccaucacuuguuuggagugugcuauucuaaaagauuuug

SEQ ID NO: 137243 - RNA, 55 nt, Homo sapiens
agauggagcaaaccagugccauccagucuuuaugcaaaugaaaugcugcaaaggg

SEQ ID NO: 137244 - RNA, 50 nt, Homo sapiens
ccucccaauagacuaacaggcagugccaguuggacccaagagaagacugc

SEQ ID NO: 137245 - RNA, 48 nt, Homo sapiens
uugauugaagccuuaagauuuuugcacuggcucuucuuucugccugca

SEQ ID NO: 137246 - RNA, 24 nt, Homo sapiens
gaccugaaauuuuaaggaaguagc

SEQ ID NO: 137247 - RNA, 69 nt, Homo sapiens
cugggaaggauccacuuccauaaccugcagggcgagaaauucuacaaugcaggccuggccuacugucac

SEQ ID NO: 137248 - RNA, 45 nt, Homo sapiens
gucacuuccuccuaacccaucugcugcuagagaaacuaaaggaau

SEQ ID NO: 137249 - RNA, 34 nt, Homo sapiens
acaguggaaagaacuaaagcaaaccucagccaga

SEQ ID NO: 137250 - RNA, 43 nt, Homo sapiens
ggacuuuuauaguugucucuuucauuccugcugguuaaggaga

SEQ ID NO: 137251 - RNA, 43 nt, Homo sapiens
aaccacucugcaggaccagggccugggaccugcaagugaagcc

SEQ ID NO: 137252 - RNA, 46 nt, Homo sapiens
uuuuguaacgacuauuugcaguuuaaaaaucaauaaaccccguuuu

SEQ ID NO: 137253 - RNA, 47 nt, Homo sapiens
cgccaugcuuucuucccuggguuuuaaacuucauauaacuuucagaa

SEQ ID NO: 137254 - RNA, 44 nt, Homo sapiens
aggcccuacauuaacaagguuaagcucaaccccuuucccccagc

SEQ ID NO: 137255 - RNA, 44 nt, Homo sapiens
agggaccuccugccuacuccagccccuacccugcacccacaucc

SEQ ID NO: 137256 - RNA, 42 nt, Homo sapiens
gggcugcuggacagccccacguccaucaccccacccccuauu

SEQ ID NO: 137257 - RNA, 74 nt, Homo sapiens; identical to SEQ ID NO: 41074

SEQ ID NO: 137258 - RNA, 41 nt, Homo sapiens
accccugcuggugggggcuucccucggaggcacucagucac

SEQ ID NO: 137259 - RNA, 47 nt, Homo sapiens
agauauuuugaguugaagaaucuauuugacuaguaaaaaaguugaac

SEQ ID NO: 137260 - RNA, 51 nt, Homo sapiens
aggccaggguuuugaggggcgaaguuugccuggcagggcagcccgggggcu

SEQ ID NO: 137261 - RNA, 45 nt, Homo sapiens
aaggcuacugaaaggugaacaggagcagcccuuccaugcccacgu

SEQ ID NO: 137262 - RNA, 42 nt, Homo sapiens
uugccaagccccgcuaaguguucuugcgaagguagcagaagc

SEQ ID NO: 137263 - RNA, 45 nt, Homo sapiens
cggcaugguguaacucccaccuccggaaggcggggacacagaucg

SEQ ID NO: 137264 - RNA, 44 nt, Homo sapiens
gugugaacgcacagcuugaagacacugggcagaccagugucagc

SEQ ID NO: 137265 - RNA, 47 nt, Homo sapiens
aguuugguggcugggggcagggagaggauguggggugggagugcaga

SEQ ID NO: 137266 - RNA, 40 nt, Homo sapiens
gggaccugcuccuggacccggccugggagaagcagcagag

SEQ ID NO: 137267 - RNA, 44 nt, Homo sapiens
gcugcauguaaucguugguuugcugagaaucauaaugguccaug

SEQ ID NO: 137268 - RNA, 37 nt, Homo sapiens
gcugggcugggcugggcuggcggggccgggcucgcuc

SEQ ID NO: 137269 - RNA, 46 nt, Homo sapiens
ucacuucuaagcaagggcucgauuugaucccacucugccuccugag

SEQ ID NO: 137270 - RNA, 29 nt, Homo sapiens
cagcacuaccuucacuguucucugcuaug

SEQ ID NO: 137271 - RNA, 45 nt, Homo sapiens
cacccgccaccccagcaguguuggcgucucuggguaucugcagac

SEQ ID NO: 137272 - RNA, 93 nt, Homo sapiens
ucagaaaggggugaagcuaaaaaucuugcaguucuggggcaggaggagugcaacaagcaggcaacaaacagcaugaaaggaaaagcugaguga

SEQ ID NO: 137273 - RNA, 49 nt, Homo sapiens
cccaggcuucagaggagacagagaaguccucauauugcaaccugaccag

SEQ ID NO: 137274 - RNA, 66 nt, Homo sapiens
ugggcuguguggcugcacgucaucccuacuccauugccugaugcaaaacuacuccaggacugggac

SEQ ID NO: 137275 - RNA, 42 nt, Homo sapiens
aagacauagaaaauacaagcccaaauguauuguuaaauucaa

SEQ ID NO: 137276 - RNA, 16 nt, Homo sapiens
ugcagaccaguuugag

SEQ ID NO: 137277 - RNA, 46 nt, Homo sapiens
ucuuuucucuuagaaaauacacauugaagcaucuggggauaaaggg

SEQ ID NO: 137278 - RNA, 49 nt, Homo sapiens
aguuucugucucacauagcuuaacgcugucuuucucauuuucacuuuag

SEQ ID NO: 137279 - RNA, 78 nt, Homo sapiens
uugcgcaucucuacauguauuccuagaguccagaggggaggugagguuaaaaccugaguaauggaaaagcuuuuagag

SEQ ID NO: 137280 - RNA, 46 nt, Homo sapiens
ccaccauguaagacuggugcuuuagcaucuaugccacaugcguuga

SEQ ID NO: 137281 - RNA, 48 nt, Homo sapiens
cugggauuagggucaggaaaaugauagcaagacacauugaaagcucuc

SEQ ID NO: 137282 - RNA, 43 nt, Homo sapiens
auugacacaaucacuaaucugguaauuuaaacaauugagauag

SEQ ID NO: 137283 - RNA, 24 nt, Homo sapiens
cuuuagauguggaugccuuaaugc

SEQ ID NO: 137284 - RNA, 47 nt, Homo sapiens
augguuuuacaucucacauaugguaagcacguagauacuggauggcg

SEQ ID NO: 137285 - RNA, 50 nt, Homo sapiens
aauguucaauuuuuguccuuugcccccucccucauucuaccaaguggcac

SEQ ID NO: 137286 - RNA, 41 nt, Homo sapiens
gcgugaccggaagaucgcggcgcucaugcuggcgcggcacc

SEQ ID NO: 137287 - RNA, 48 nt, Homo sapiens
cugggauuccugaugacaguaauagauucucaguggguuugcagacgg

SEQ ID NO: 137288 - RNA, 43 nt, Homo sapiens
accuacugccagcagugacuugccuucacccacagaaauuuaa

SEQ ID NO: 137289 - RNA, 36 nt, Homo sapiens
aagugugcauaugcaggcuaccuaaugauuuaacgg

SEQ ID NO: 137290 - RNA, 46 nt, Homo sapiens
uaaugcaaauuugauucucaaauccuaagaguuuccaaagguugag

SEQ ID NO: 137291 - RNA, 26 nt, Homo sapiens
auagguaugugucugacaacuaaaag

SEQ ID NO: 137292 - RNA, 45 nt, Homo sapiens
uuuauggcagguaaagaauauguggauucgaaaguuggguggggg

SEQ ID NO: 137293 - RNA, 44 nt, Homo sapiens
gaggguagggccaggugggaguugcaguggaggggcacuuggga

SEQ ID NO: 137294 - RNA, 69 nt, Homo sapiens
uguuuaguuugauaucuuggucucaucacuuucuaucuguguaagcuuggauagguuauuuagcccuuc

SEQ ID NO: 137295 - RNA, 46 nt, Homo sapiens
auaauaauucugugauuauccugagguuucauguuucuggaguagg

SEQ ID NO: 137296 - RNA, 87 nt, Homo sapiens
gugaaccauuggaggugaaaggcgaccugauaguacuuugggagugcaguucccaguaggauuuuggguggccuggagcacagcagc

SEQ ID NO: 137297 - RNA, 45 nt, Homo sapiens
acucuggugaccaagaccugagagaaaguggaaaggucaggaagg

SEQ ID NO: 137298 - RNA, 31 nt, Homo sapiens
agaggguuacacucaaagcuaaugagugcuu

SEQ ID NO: 137299 - RNA, 41 nt, Homo sapiens
cugugugugggugcuggagagccuuggauaaugcugaguug

SEQ ID NO: 137300 - RNA, 52 nt, Homo sapiens
gcagagaauugguggucucugcaggaguuuauuaccugcggaaaugcagcau

SEQ ID NO: 137301 - RNA, 20 nt, Homo sapiens
uugcuuccuuccagucagag

SEQ ID NO: 137302 - RNA, 46 nt, Homo sapiens
uggcuuaagaggaaagcugaggguaauguuugugauuuggaggcug

SEQ ID NO: 137303 - RNA, 56 nt, Homo sapiens
gacucccuaaucuaugcauauaaagccuuauuaauggagaagggggugugugugug

SEQ ID NO: 137304 - RNA, 47 nt, Homo sapiens
guugcuaccaauguuuuucccuuucuuuggaguagcuucuaggggag

SEQ ID NO: 137305 - RNA, 46 nt, Homo sapiens
uuuuagaauagcagggaaaacagccaucugcauuucuacaugacag

SEQ ID NO: 137306 - RNA, 49 nt, Homo sapiens
auucggccuuguugacccuggcuaugguaagaggcaccagagaauguca

SEQ ID NO: 137307 - RNA, 46 nt, Homo sapiens
ggaucagccugucaguguuuccugagcacuggucuaggcacagagg

SEQ ID NO: 137308 - RNA, 48 nt, Homo sapiens
ucuucagccagugcagccccacuaaggcuccuugauaacugugcaugg

SEQ ID NO: 137309 - RNA, 46 nt, Homo sapiens
caguagcagugugugggggcuucccacugagugaugguuccucaua

SEQ ID NO: 137310 - RNA, 38 nt, Homo sapiens
gggugaggauuucgaacccaguguggauccuguuaggu

SEQ ID NO: 137311 - RNA, 38 nt, Homo sapiens
guuuuguauuuucaugaguguuaacuccuuaagcaagu

SEQ ID NO: 137312 - RNA, 113 nt, Homo sapiens
cucagcuugaauuggucauggaaggcuuuucugagggagagaagucuacacugagaucuaaaggcaagugaguuaacgaguauggggagacaagguggcauagucaggugaag

SEQ ID NO: 137313 - RNA, 51 nt, Homo sapiens
aagcacaguuugaggaagcacccagauaggacugagaugcugcuaguggag

SEQ ID NO: 137314 - RNA, 52 nt, Homo sapiens
ggaguauccuaaggaucaaagaguuaaagaaaaaacaaacucuagcuaauga

SEQ ID NO: 137315 - RNA, 56 nt, Homo sapiens
ggucuuacuugaugagaagaggacuaagaguguuuaggaugaaaccaaggaggaau

SEQ ID NO: 137316 - RNA, 344 nt, Homo sapiens
cucagaguuacucauguuacucuguuacgccgggcgugguggcuuacgccuguaaucccagcacuuugggaggccgaggcggguggaucacaaggucaggagaucgagacuauccuggcuaacacggugaaaccccgucucuacuaaaaauacaaaaaaaauuagcugggcguggugguggacgccuguagucccagcuacuugggaggcugaggcaggagaauggcaugaaccugggaggcggagcuuccagugagccaagaucacgccaccgcgcuccagccugggccacagagugagacuccgucucaaaaaaaaaaaaaaaaagaaaaguguuuuuacag

SEQ ID NO: 137317 - RNA, 45 nt, Homo sapiens
aagacuuaugguaagguccauucuucuuagcaauauaacccucau

SEQ ID NO: 137318 - RNA, 114 nt, Homo sapiens
uccaacucaaauguuguucccccuuugucugcugggggagaucuuuuuugucucucagacccuacaaaacucaacaaguaugaauucuaugaggaugauuccuuuagucuuccc

SEQ ID NO: 137319 - RNA, 46 nt, Homo sapiens
ccauaaauuuuauuuacaguguuggccccaguuguuuugcagccua

SEQ ID NO: 137320 - RNA, 42 nt, Homo sapiens
uuucauuacuucuugagaauggucgcuauaaagaugggaaaa

SEQ ID NO: 137321 - RNA, 51 nt, Homo sapiens
uagccagcagaagcauuuagacuuguagaaaguggcagccuuuggacgauu

SEQ ID NO: 137322 - RNA, 44 nt, Homo sapiens
uugaggaaggaaccauugugcuacuaauauuauuccacugcaag

SEQ ID NO: 137323 - RNA, 46 nt, Homo sapiens
caacuuugguggaaugccuuugaguaggggcuuuuagucucagcag

SEQ ID NO: 137324 - RNA, 58 nt, Homo sapiens
gggauguaggcagacuuauaugggcagcuucuucagugggauugguacuauuuagcag

SEQ ID NO: 137325 - RNA, 82 nt, Homo sapiens
guaacagugggagggggagggguucccagccccagcuggcagccuguuucccugggucccugagcugcaagaacaagaggag

SEQ ID NO: 137326 - RNA, 30 nt, Homo sapiens
gcuguauugucgagaacgggaagugaaaaa

SEQ ID NO: 137327 - RNA, 40 nt, Homo sapiens
uuucuuuuuaccaaagccuuugcccauuccaaaaaucaga

SEQ ID NO: 137328 - RNA, 48 nt, Homo sapiens
gacccuuucaaguaugcaguuuuguuagucuucuaaaaaaaccugugg

SEQ ID NO: 137329 - RNA, 54 nt, Homo sapiens
guuaaaaaugaggaaacugaggaauaggaagaucuccccaggacuacccagugg

SEQ ID NO: 137330 - RNA, 60 nt, Homo sapiens
ucuuaggaaggcaguggugggggcccgagaagagccacaggagguauccugagccauggg

SEQ ID NO: 137331 - RNA, 41 nt, Homo sapiens
aggaggcuucagaagaaaccuuuugaccauaucagauguca

SEQ ID NO: 137332 - RNA, 46 nt, Homo sapiens
augccacggaaaugaaccaauuagacacaguccaaggagagccagg

SEQ ID NO: 137333 - RNA, 46 nt, Homo sapiens
cuaaaagucacuuaacuuuuguggcccucagugucuucuucuucaa

SEQ ID NO: 137334 - RNA, 46 nt, Homo sapiens
uaccccugcucucucccugucuuugcagugugcccccuaccaccgg

SEQ ID NO: 137335 - RNA, 42 nt, Homo sapiens
guugaagggcgauuacaaauaccugacguguaagaauggcga

SEQ ID NO: 137336 - RNA, 26 nt, Homo sapiens
aacagcugccggaccaaggggccugc

SEQ ID NO: 137337 - RNA, 52 nt, Homo sapiens
gggguggggucuguccucuuguuauaaauguuauguuccugaaaggucagga

SEQ ID NO: 137338 - RNA, 42 nt, Homo sapiens
cccugugggauugagcacccuguacucuccagccaccuuacc

SEQ ID NO: 137339 - RNA, 85 nt, Homo sapiens
ugcugcccccugccacacagggggccgggccugggucuguccuguuuccuuugaggguugccccuacugcccuuugcaggaacag

SEQ ID NO: 137340 - RNA, 47 nt, Homo sapiens
acaagcuccuggcccuguugaguugagaguuuccaagaagcauccag

SEQ ID NO: 137341 - RNA, 42 nt, Homo sapiens
uggguuuuaucccagauagcucuggcuuucuugcugcccaca

SEQ ID NO: 137342 - RNA, 46 nt, Homo sapiens
caucuggucacuggcagucugggcagguugccccuuucuggguuug

SEQ ID NO: 137343 - RNA, 53 nt, Homo sapiens
uaacugugcccaggaaguggccugcugcuugcugugcugcugcuuuuccuacu

SEQ ID NO: 137344 - RNA, 97 nt, Homo sapiens
ucuucccuggcccccugggggaagggcugagaaacaguccgugugcaccccaaccuuaauggccugaggugggcagagggguguggagcagccugga

SEQ ID NO: 137345 - RNA, 65 nt, Homo sapiens
ggccuagaagaugaggggaguggucuucucccagccuuuuacccucuugccuccugccuccgcgc

SEQ ID NO: 137346 - RNA, 61 nt, Homo sapiens
gccuguuggccacucccacacuuccccucccccaggagcccucaucugcugugcugagucc

SEQ ID NO: 137347 - RNA, 78 nt, Homo sapiens
uagggccuggcugagagacaaggguagcagcagguggcaggcuguuaaaagacaggcugccugaggagccuggagcag

SEQ ID NO: 137348 - RNA, 52 nt, Homo sapiens
ggccagcaccaaaggacauuuaaaagaguuuuuggguuuuuuuguuuguuug

SEQ ID NO: 137349 - RNA, 46 nt, Homo sapiens
uccuggugacuugcagucacauucuaaugacuuucaagggccagaa

SEQ ID NO: 137350 - RNA, 64 nt, Homo sapiens
ccauuucuguauuuuaugugcuguguucccguuucacuggguaugaacugugaaaucgacugaa

SEQ ID NO: 137351 - RNA, 52 nt, Homo sapiens
cuaauauuuucuuucccauucaucuugcccucccccuccucccgccagcuuu

SEQ ID NO: 137352 - RNA, 47 nt, Homo sapiens
cccacauaacaaugucgccuccauuuccgaggaacauccuugcguag

SEQ ID NO: 137353 - RNA, 48 nt, Homo sapiens
agcuaguagaaggggaugcaggggcaaagcacucaguugccaagcaag

SEQ ID NO: 137354 - RNA, 41 nt, Homo sapiens; identical to SEQ ID NO: 41208

SEQ ID NO: 137355 - RNA, 48 nt, Homo sapiens
uucuauguauauaacugcauuucuaaauaauuaaaaaaaaguucuuau

SEQ ID NO: 137356 - RNA, 44 nt, Homo sapiens
cuuaacucgucuacgccacuccacaacugacgcacuuagcagcu

SEQ ID NO: 137357 - RNA, 38 nt, Homo sapiens
gcaaugacugucacagagaaacgccugauuaaacaauc

SEQ ID NO: 137358 - RNA, 45 nt, Homo sapiens
cuggccgcuggauuuagucucccgaugaauacccgacagccacuc

SEQ ID NO: 137359 - RNA, 48 nt, Homo sapiens
agacucuuaacauuggcuuuagaagaguauucuacaacacauuaagag

SEQ ID NO: 137360 - RNA, 51 nt, Homo sapiens
gccuagccccuacugacuacaugccaacagcauccucucucaaccaguugu

SEQ ID NO: 137361 - RNA, 55 nt, Homo sapiens
uuuaccacacuggcuuucagaauugcuuugggaccagaauccaggccaccagggg

SEQ ID NO: 137362 - RNA, 26 nt, Homo sapiens
aauuuuuuucaagucuaaagucucuu

SEQ ID NO: 137363 - RNA, 350 nt, Homo sapiens
aaugaagcccaugggacagugggaccuaaaauaauaccuaucuccaggcaugcaguggcucacaccuguaauccuagcacuuuggaaggcugaggcagguggaucacuugagcucauuaguucaaaacuagccugggcaacaugguaaaacccugucuccagaaaaguuaaaucagcuggucaugguggcuugugccuauagucccaguuacuuggggggcugaggcaggaggaucaguuaaacccuggagguugaggcugcagugagcugagaaugugcuacuccccuccagccugggcaacagagugagacccuuucuuaaaaaaaaaaaaaauaccuaccguccauu

SEQ ID NO: 137364 - RNA, 37 nt, Homo sapiens
gagagauccagacacaagcccugcauuuaugagagag

SEQ ID NO: 137365 - RNA, 45 nt, Homo sapiens
agaaaugguagaaaaguuaaauguccagucuuauguagcugcgac

SEQ ID NO: 137366 - RNA, 47 nt, Homo sapiens
cgauucaaaguacaaucauagacagcaauucuacauaaagaacaaag

SEQ ID NO: 137367 - RNA, 51 nt, Homo sapiens
gaggcuguuauguuuauugugcagaacagacagugauaauacacuagagaa

SEQ ID NO: 137368 - RNA, 61 nt, Homo sapiens
gcugccuguccucugggcacucuugucccaggucuauuguuuucaugacccaccaggaugg

SEQ ID NO: 137369 - RNA, 45 nt, Homo sapiens
aauacuuuuccuugagauuuuucuggacccauaaugccuccuuug

SEQ ID NO: 137370 - RNA, 46 nt, Homo sapiens
guaggauggcagaaaaccagagaucgucccugggaagccccaggcu

SEQ ID NO: 137371 - RNA, 61 nt, Homo sapiens; identical to SEQ ID NO: 137368

SEQ ID NO: 137372 - RNA, 45 nt, Homo sapiens
uuccaggcccauggaaacuuggauauggguaauuugaugacaaau

SEQ ID NO: 137373 - RNA, 47 nt, Homo sapiens
cuugaaaaaaaacugaaagagaauaaaauaucuuuagagucggaaua

SEQ ID NO: 137374 - RNA, 45 nt, Homo sapiens
cuccaucuuacuaucauccaggagugagccagguccuggcuugac

SEQ ID NO: 137375 - RNA, 44 nt, Homo sapiens
uaauuuuuaaauuaaauacuagacauuauuuauaaacaauuaua

SEQ ID NO: 137376 - RNA, 45 nt, Homo sapiens
cacugaaaaggaaagcuaaaugacucuguuacuuuaaugacauau

SEQ ID NO: 137377 - RNA, 46 nt, Homo sapiens
guuggagguucuuuuggucuucgugaguuuucucaaauccgauaug

SEQ ID NO: 137378 - RNA, 29 nt, Homo sapiens
accagaagucuuccaugcugugauaaaau

SEQ ID NO: 137379 - RNA, 42 nt, Homo sapiens
cucucuuugggccugaauaaagaccagaacugauagacagcu

SEQ ID NO: 137380 - RNA, 54 nt, Homo sapiens
gggacuguaccaaacucugauugguacauuauuucaugucucauaacucuggga

SEQ ID NO: 137381 - RNA, 42 nt, Homo sapiens
auuaaagggguaccaugcaaaacacgaugcagcaacaaagaa

SEQ ID NO: 137382 - RNA, 45 nt, Homo sapiens
caagagggaggaaaagaguuuuguuugcuuuaggagguagggaaa

SEQ ID NO: 137383 - RNA, 46 nt, Homo sapiens
aagggaugaucuuaacugaagaauuuaaagagauacuuaaacagag

SEQ ID NO: 137384 - RNA, 46 nt, Homo sapiens
aggaguuauauauuuuacuaggacuuuugauagaaauucagcuaca

SEQ ID NO: 137385 - RNA, 41 nt, Homo sapiens
ugcuauucugccaugucuuucccucucucugcauagccaga

SEQ ID NO: 137386 - RNA, 46 nt, Homo sapiens
auggaccuauaggacaucgaggugaaggggacccaagugguauucc

SEQ ID NO: 137387 - RNA, 46 nt, Homo sapiens
uggugacccucuuaaccaaaucuuuaguguucauaggagaacucca

SEQ ID NO: 137388 - RNA, 41 nt, Homo sapiens
uagauucauucaccaacuguauuggcaagagagagaguaga

SEQ ID NO: 137389 - RNA, 40 nt, Homo sapiens
aaagguuacaaggaggaaauucaguagaugaauagaaagu

SEQ ID NO: 137390 - RNA, 44 nt, Homo sapiens
guggaugguuucaccuugaaaaggaaauagaucuaauucagaga

SEQ ID NO: 137391 - RNA, 46 nt, Homo sapiens
aguuuguuccagcuugggagagguggguuggccuuggcccccuugu

SEQ ID NO: 137392 - RNA, 44 nt, Homo sapiens
uuuuuuucguauuuuauguuauuggccccuaacacuuacccauu

SEQ ID NO: 137393 - RNA, 47 nt, Homo sapiens
aggagauuuugcauuucuacuguauauuuauucauucuuucucuguc

SEQ ID NO: 137394 - RNA, 45 nt, Homo sapiens
gcucuuuuaaacaggcuuaggguccagaccuauagucaggaguuc

SEQ ID NO: 137395 - RNA, 45 nt, Homo sapiens
aaucaccacuagaaacuuccacauaauuuugauggucccauaagg

SEQ ID NO: 137396 - RNA, 58 nt, Homo sapiens
gauuuauuuuauuuauuuauuuauuuuuuaugaacaccucaugugauuuugagcagcc

SEQ ID NO: 137397 - RNA, 45 nt, Homo sapiens
cgagcuguaaaacaugaacggaagaguggauuauuuggucacuga

SEQ ID NO: 137398 - RNA, 43 nt, Homo sapiens
auuaagagaaaugggggaugaugaaagaaaaguauuuggguuu

SEQ ID NO: 137399 - RNA, 46 nt, Homo sapiens
caaagaaagaggcagaaccuauaccagaaacuguaaaaccugagga

SEQ ID NO: 137400 - RNA, 46 nt, Homo sapiens
gugguagugauugugguagugaaaagaugaauugggagggaaaaag

SEQ ID NO: 137401 - RNA, 23 nt, Homo sapiens
agggcauguaaauccagaaagau

SEQ ID NO: 137402 - RNA, 32 nt, Homo sapiens
ucacaggugguaacaaaacuagaauaugaaac

SEQ ID NO: 137403 - RNA, 45 nt, Homo sapiens
ucauccuuccaaaggguauugguggcacuucaaagaucaugaaga

SEQ ID NO: 137404 - RNA, 46 nt, Homo sapiens
aggauguacucgauuccaaccaucugacugaaaacagaacacagac

SEQ ID NO: 137405 - RNA, 47 nt, Homo sapiens
cuggaaaaaguaggaguugaagccaaacagccaaauucuaccacuag

SEQ ID NO: 137406 - RNA, 86 nt, Homo sapiens
uuuugagcuuucagagcuggaguuuuguucuacacacguaucucugcaacaacauuagggcuauucuauuggagugaaggaauggc

SEQ ID NO: 137407 - RNA, 43 nt, Homo sapiens
uucaucaccaucagagugaggcaaagauguauccuggccuagu

SEQ ID NO: 137408 - RNA, 83 nt, Homo sapiens
guuaacaaagagagguguggaaaagcucagcuccuauaaccagcugggccccaaagcucuucucucuauccagcucaaggccc

SEQ ID NO: 137409 - RNA, 46 nt, Homo sapiens
auauuugguaaaaguugcgugugagcuuuuuacaaaaggguaagaa

SEQ ID NO: 137410 - RNA, 46 nt, Homo sapiens
cuggcaagccauggaacuguagcaccuaggguuuuugggugggagg

SEQ ID NO: 137411 - RNA, 46 nt, Homo sapiens
aacaaauggaaauuucaucucaaggauggcauuaugaaucuuaaug

SEQ ID NO: 137412 - RNA, 39 nt, Homo sapiens
agaagaugaagaugaagaagaagacuaugaugaugauga

SEQ ID NO: 137413 - RNA, 1212 nt, Homo sapiens
agguaauuaggaaugauggaaccauuuuaaaauguaauucagaaaauuguacuaucuagcccuuagguuuugucuucuuugaaagacagaaaauacuaauauuucuuuuaccauuugguuuagguuauuaaaauaacuuuauuugagggcuguaacacauauaacuguaaucguuguugaggauacaguaaagaagaugaaaauuguacuugaaccuuugaucugugcaugauaacccuauuauugaaguaugauuauauaaaaaugcuuacuuaguuuuuuacugaacacauuuaacaugccaagugaguauuaaacuucuuugaacuugugauaucaaaguaauuccuagagcauauuaagagcaaauuuauuguaugcuauuauuauacauaguaucucuucauugacaaaagaccaaugucuagcucauguguuuuggcauauuggugcuugaaaaauuuauuuacauggauuuuaaguguucccuauaaucuugauuauauaguuauuauuuauuuucuauucuguguauguuauuuuuguuaauuuguaaauuugugaaauuaggggcuugucuugcuacauauuuuaauaagauguaauuugcuuuuuaaucaauucaagauucuggguugucuaaaggaacauauugggggaauuugauucugugugaauuguaugacaaugaugauaacugguucugugaacuuuuauugcuuuuaccaauuuugaagcaaaguucuuuggugcuuuguuugguucaagauauuaaaugagcuauuaagcuuuuguuccuuuaaagcuuuaaaaaugaacagcucccgaagugucugaucuuacugcucuuucuucacuccuaagguuagcaaagauaauguaagcuuuagucaagucucauaaucuguuguuaaaaccuuguuggaaauagcugaaugaggauguaaauaugaaaaauaaaacauuuuaaggaauguauuugaacauggcgagaagucagagaaggggaggauuaugcauacuguguaugaaugacaaccuuuaauaaaauuguuaguuuucuugauaauuucuugugccuuuggugguaugaaauuaaauaugaauucauuucuuuugagauggucacugcuaaaaugauaacucggaaugcaugcuuuuugcuuuaggccagcuucuucagguggucagagcagccaauggugcccaaua

SEQ ID NO: 137414 - RNA, 4020 nt, Homo sapiens
acucggcaaauacaaacaccgugguaaggacgugguucgguggccggcgggggcuucguucaggcugcagcaacggccggaccgggcgggggcggggacggcggcgacucccggccucgacucuucagccgcccgcgcggccgccgccgccgccgcuucccgccucgggcggaucgggccggagcgccgggcggcgggcgcgggggggcgccgagggcucgcggcgcggggagggcgggggcgccgguggggccuggggccgccgcgggccgggccgggccgcggaggcgguugggcccggucgggcgcgcagccccggccccagaacccggccgccgggagggagggcgggaggggagccgccgcuuccccccgaggggcccguccgcgcuggcuugacgagggcuccccgaguggcuacagaacaaaaacuguguguggggaaucgggcgaacccccgagacccaucgugauccacuuuaaugcaguggaagauuaaugguuacuuuggggguuucuuagguuguuuuuggcggcugugcuuugggaaccuucucugaggccauuuuauguuuaaaaaaaggacgaagguugguugaaaagcacuuaucucaguuccuuccgaauggguaaaauggcgaaggggaagacccccaucguaucuucgccuagcagaagcaccaaaacaaacaaaaaaagccugcagugguccaaguguccccgcuuucgccuugaaauuuaccuacuucuucccguuggucccuuuuuguuacuugcgaucacguagguuugcaaaaagcagucacauaaauaaccuuuucagucaccaacgcagugugaucacuaguccacccaacucuuauuuuuaugaugacaauaaaacacguuuuuugcccggucccaaaugccgcagaccagcccgcggccgcccgacaccguaccguuggcgacucgggucuaaccaucauggcugcggccgcuuacccugcuuuucagucccugagccuugugguccuccucccuuuggcugcccuguuuauauagagccauugccgcucucuaauauagacucugccaggaugggaaggugcuuuucaggccuacgucaccgccucuccauuuaaacaccagauccggcuuuaaauagugagagcugcugagagcggggcugggaggugcgugcucccgaggcaagagccaggcgugugcagagcucaguuuauuucuagguccuuuuuucacccugugauuucgcacccgucgcgggcugcuuucagagccccaaguuuugguuuuguucccagcagcagcuaggauuugccuucuuuguuugcuagggggaauauauccgaaucgcugucccuuuuuguuuacaauuuucaaaauuaauuauuuaaaacaaagaguuuuagaucagauggucuagccauuuuucuuaugugcauuauuuucgggaauuuaaaaaacugcuuucuacauggaaaauguuagcugcagaggacuugguuuugguaguguuuuguucaaguauucaggaaauaauguuagaaauauagcuccuaauauuucauuauguuuuccuauaguaaauauaaaagacacgaggcuuuucagagaaauagauaaguaccuaaagcuucaguauaggaccauuuauguguaggagaaucgugaguagagggaagagacagacugcaaacuagauuaaaaaaaaaucuaaguagaacuuuauugccuuggauauuaacauggguauccgguauaaaaauuauuccaauuuauuuuccagcauugcaucagggaauuaacauuuuugaaggaaaccuaacaaaugacuuaauaaugccacuaguggcccucugauuuaccaguucuuaaguuugaaauaaccuguuuuuuaaaaauuaggacaaacuuaaauuguauuucgugaaagaaacuuugccucaaguauuaguguagaauuuuaagcaauaauuuagaaauugcuuauuucaaauacuccuaugugcccacauacuuuucaaaaauuaguaucuugaaggcuuuucaaauugugaacaauucugcuaaauuacucguuaggcauauauuuugugaagaauacacauuucccuuccuucaccuauagggcuuaugaagcuguuaaguggucaaguugugaguucauuaaggcacaaaaauaaaaucuuaaugauuuauuaaguugagaguacuagaagaaagcagauuuauaccuacacaugucuggaucuccaagcaaaagguuuuuagagguaacugacuucagaaacgccaaaacaccaucuaguuuacugaaaagcauacauauugucaauuugagauuuauacucccaauuuaaaauacauugcccuccuaacgccucgaggaguaauuauugguuaaaaaaaaaaaagcacuuuauagagauacuuuuguaauucaguuaagucacuuuaggcaagaugauguccauagucagauauacuuuccuuauauauagaauuagaauguuaaaguagggacuauagaaaugugcauuuuacagaugaauaaacuucaagaggcggauuuggcaaaauaaagcagguuagugagugaacaguaaagcaagaacccagauauuugaauugguuuucuuguaaugagaaggauuaaauaguauuuaaugguugagguaaauuguauugacaaacucauuuguauuuguuuguuuucugagacagggucugggccugucacccaggcuggagggcaguggugcaaucuuggcucacugcacccucucccuccugggcucaagccauccucccaccucagccucccaagcagcugggacuacaggcacgugccaccacuccuggcuaauuuuuuguggagauuggguuucacuauguuacccaggcuggucuugaacucuugagcucaagcgauccucccaaaauugguuuuauuugauagcgauuaaccuuaagcaagguaugaaacagaaguaaugagaaaacaucuaaaaagcuuguuaaccauaacccucugauaauggggaggauuuauaaccaggcaacucuaguuuugucaaggcagcucuaguuuugucaucugacaugacuuccuuuugucuaacagguuaaaaauaggaugugggggaaaaaauaggauguggauugggcuaauuguucuaucucccacuuuguaguuuuuaaaaaauauuuuauacuuuuugaaaguucuuucacaucuauucucauuuuacucauuuuaccauucaaccuucuagaagccagcuucuuuacuucccgcuccuccaaguaguaucaacggugcuaauuguaauaauaauaguaaacauuuagaggguucauguucauuauaauguuucauagcauuaccugggcaguaguagaggagaaauccugggaaggaaaucaguauaccuuguuccuugggaccuuaagaccugccauugugaguguaugaguaguuuaaugguacagcuugaaaguacagacugggucacacaacagaaguuaggugauuuuuaaaccugaauguucauuagguugcagauuauuaccaggcagaugacucccggacauaagauucuccaaagucuaagauacaguggugagguaguaagacauacaacagaguucaaaccaagcauggaauaguagaagccagacauaagcaacccguaaagcuauuauugaacauuacauuagguauuuugacuacaacauaggaaauuauaauuggaaauuguauggaccuuguagucuuaggggccuucuguuuaugaacugcauuaaucuuaaaauuuuuauuaaagugugcagucaucaaauccaguuuauggcaaaugaugguggucguaucuuuaaagucauauauagauaguuggcaaaaugacuauucguuuugaauuugugaaaaccuguuauacauuauaagcugugaaaaacugucuuuuucaagucuuuuauuuuuccuuuaaagccuaaauuauacagaucugugau

SEQ ID NO: 137415 - RNA, 30 nt, Homo sapiens
gggagaugaagacauugaauucguagaugu

SEQ ID NO: 137416 - RNA, 40 nt, Homo sapiens
cuggaaaauuccacaagaccucacaaaaugcgcgagugag

SEQ ID NO: 137417 - RNA, 64 nt, Homo sapiens
cggccacggugaugacgagucuccgucaaccucgucuggcacagcugggaccuccucugugcca

SEQ ID NO: 137418 - RNA, 130 nt, Homo sapiens
ccugaaaagaaacgcuacuuccgcuugcucccuggacauaacaacugcaacccccugacgaaagagagcauccggcagaaggagauggagagcaagagacugcggcugcuccaggaagaagacagacgga

SEQ ID NO: 137419 - RNA, 82 nt, Homo sapiens
cuuuguuauguuuucuucaugaauguucuuuuccuguuucuuauuuucaugguauaagaauccagucuggauagaccaugug

SEQ ID NO: 137420 - RNA, 43 nt, Homo sapiens
aucuguuccucacccugcgaaacaagaggcggccguauccugg

SEQ ID NO: 137421 - RNA, 45 nt, Homo sapiens
uagcccacgagcugcgucucagcugcauggagaggaaaaaggucc

SEQ ID NO: 137422 - RNA, 46 nt, Homo sapiens
gcagauaccaacagugaccggcucuucacagugaacgauguuaaag

SEQ ID NO: 137423 - RNA, 44 nt, Homo sapiens
ggggaaaucuuugccauugaucugcguuguggaaaucaaggcaa

SEQ ID NO: 137424 - RNA, 45 nt, Homo sapiens
ccucugugcggauccuccaagaugagcaauaccugauggcuucag

SEQ ID NO: 137425 - RNA, 45 nt, Homo sapiens
ccaaggccgacauucccaguguggccuucucgucgcggcuggggg

SEQ ID NO: 137426 - RNA, 26 nt, Homo sapiens
acuuuuugaccaaaaccaaaaacugg

SEQ ID NO: 137427 - RNA, 53 nt, Homo sapiens
cuccaaaaucaucccugaaaacuagcauauaaauguauauucccaccaccaga

SEQ ID NO: 137428 - RNA, 46 nt, Homo sapiens
cuggagguacagguggaggaaauccuggaaacugcgggggugggau

SEQ ID NO: 137429 - RNA, 46 nt, Homo sapiens
aggagccauaaugcucauugguacaggaaucauuggggucccuaag

SEQ ID NO: 137430 - RNA, 26 nt, Homo sapiens
guugccaacaaaaacagugguaguag

SEQ ID NO: 137431 - RNA, 49 nt, Homo sapiens
ucucuccaauuugcaggucauguaauaaucugagugcacggaggguaga

SEQ ID NO: 137432 - RNA, 46 nt, Homo sapiens
ccuccuucuuuuccuucuucuucuuccuggggugagaaucagauuc

SEQ ID NO: 137433 - RNA, 41 nt, Homo sapiens
aaccuuagugaugaguggauaagggaucaguggggccacug

SEQ ID NO: 137434 - RNA, 45 nt, Homo sapiens
uaaugcauuuaaaacaacuuuaaaaagcaaucuuaccugucagau

SEQ ID NO: 137435 - RNA, 45 nt, Homo sapiens; identical to SEQ ID NO: 41379

SEQ ID NO: 137436 - RNA, 49 nt, Homo sapiens
ggaaucuccaaucuuggaugcugggagauugugucagguguggcuggcc

SEQ ID NO: 137437 - RNA, 46 nt, Homo sapiens
agaguuaacucuguagcuccaguauucagauuuuucccggcgcaaa

SEQ ID NO: 137438 - RNA, 40 nt, Homo sapiens
ucuuucuccuuuucucguucacguucucuuucccuuucuc

SEQ ID NO: 137439 - RNA, 90 nt, Homo sapiens
auccuuauuacgaucugagcuccuuucucuaucccggucacgaucucucucucgaucccgaucucggucucucucuuuuguccggucacg

SEQ ID NO: 137440 - RNA, 51 nt, Homo sapiens
ccguucucguucucgcucucguucucucucucucucucuuucccgcucucg

SEQ ID NO: 137441 - RNA, 46 nt, Homo sapiens
uucucggucccguuuuuugucuuuuucucuuucucgcucccguucc

SEQ ID NO: 137442 - RNA, 56 nt, Homo sapiens
gaagagcacuuccucuguaaaagugaaugauaaaaggcuucauuuaauacuccgau

SEQ ID NO: 137443 - RNA, 84 nt, Homo sapiens
ugaguuuucaugaggaauaauaauaccacagggagacucauccccaggaguguuagguguugcauugccacuggcagaggaaac

SEQ ID NO: 137444 - RNA, 63 nt, Homo sapiens
cuugacucuguaaaauuucugcucuuuuaagaagugucuaauauuuuaauauauaaaauaaau

SEQ ID NO: 137445 - RNA, 29 nt, Homo sapiens
ucacaguguuaacuacaugcuaccacuga

SEQ ID NO: 137446 - RNA, 94 nt, Homo sapiens
gguuaugccacaucugcuaagauugcauugaccaaagcaagucacaugaucaugcccaaagacuuaggaguggguaguagacugcaaccaccau

SEQ ID NO: 137447 - RNA, 49 nt, Homo sapiens
auauucauuaugauuguacaaugcaaggauaaguguagaaguucuaagg

SEQ ID NO: 137448 - RNA, 56 nt, Homo sapiens
uuauagaaugacaauagagaacggcaggagcacaacgacagacggagccuuggcca

SEQ ID NO: 137449 - RNA, 70 nt, Homo sapiens
cccugagccauuaucuaauggacgaccccaggguaacucccggcaggugguggagcaagaugaggaagaa

SEQ ID NO: 137450 - RNA, 43 nt, Homo sapiens
gaaauuauauuuuaaucucaugguuuaaauuuucauccuuaaa

SEQ ID NO: 137451 - RNA, 55 nt, Homo sapiens
aaugugggaggagagagagaaauaaagcaagggcuauuugccccacucucucggg

SEQ ID NO: 137452 - RNA, 43 nt, Homo sapiens
auuucaaagugggagaggaaucaucuuuuuggaugguaccuga

SEQ ID NO: 137453 - RNA, 43 nt, Homo sapiens
cucaaaggagaguauccaaaaauuccaaguauaaugcagaaag

SEQ ID NO: 137454 - RNA, 46 nt, Homo sapiens
aggaacuuuccagcaguauccucgcuggugaagacccagaggaaag

SEQ ID NO: 137455 - RNA, 38 nt, Homo sapiens
uagaaucacagcucugacuccaaaugacucaauuucuc

SEQ ID NO: 137456 - RNA, 47 nt, Homo sapiens
aauuccaaaaaaaaucuaauaucugucucaagcagaacgacaugguc

SEQ ID NO: 137457 - RNA, 46 nt, Homo sapiens
aucccuggcuggagcacacuaaugagguccuagaggaguggcaggu

SEQ ID NO: 137458 - RNA, 46 nt, Homo sapiens
ucugaugcugaauuuuuagaaagauugcaccucuuccuagcuagag

SEQ ID NO: 137459 - RNA, 42 nt, Homo sapiens
ccacgccccgcgaccacaccccggcggcucucggcccagcgc

SEQ ID NO: 137460 - RNA, 58 nt, Homo sapiens
uccucugcugccuucguuucugguccucggccguccucgccgcccgcccagaggaguc

SEQ ID NO: 137461 - RNA, 50 nt, Homo sapiens
aaaaaauaaagugauucuacucuucuaagcuuacagagaccagaccaggu

SEQ ID NO: 137462 - RNA, 81 nt, Homo sapiens
agccagaaaguauucauacugcuacuccuuaugagauagccaagaagcaucaugucaguaacugggaguggagagggaguu

SEQ ID NO: 137463 - RNA, 67 nt, Homo sapiens
gaguguuucucucuugucacacucccugguaacuggagcucuguacuccuuuuucgugcaguuugua

SEQ ID NO: 137464 - RNA, 55 nt, Homo sapiens
caacacucagagcaucugggggacauuguaccaacuuuacaaaguagaucugggg

SEQ ID NO: 137465 - RNA, 46 nt, Homo sapiens
uuaggauuugugcuauucucaacagcuccuuuucuacuugcuccag

SEQ ID NO: 137466 - RNA, 46 nt, Homo sapiens
auagggacugggggcaggauuggggguuucggagcuuguguaacag

SEQ ID NO: 137467 - RNA, 52 nt, Homo sapiens
uguacucaacccucgcagaacaguaaaacugaagauuauuguuucugaaugu

SEQ ID NO: 137468 - RNA, 36 nt, Homo sapiens
uuuuugguugucacagcuggggagagggguacuacu

SEQ ID NO: 137469 - RNA, 93 nt, Homo sapiens
gcacugaggauaagaaauccuguacuagaaguuguaaguuuuucaucccccaugggcuagaucugauaugcagauguauuuuauuuugcccau

SEQ ID NO: 137470 - RNA, 56 nt, Homo sapiens
caggacacuacggaaaaccacagggaacuuaggguugagggugugauuuuuauagg

SEQ ID NO: 137471 - RNA, 42 nt, Homo sapiens
gcaucucuggucuugugacgagaccucuucaaaaacccacag

SEQ ID NO: 137472 - RNA, 46 nt, Homo sapiens
ucagggacugaugggcacacuuuccggagugccuguuuaccgagau

SEQ ID NO: 137473 - RNA, 45 nt, Homo sapiens
ggaccuagggggagccuccacccaaaucacguuccugccccaguu

SEQ ID NO: 137474 - RNA, 45 nt, Homo sapiens
agggggagaggggcaggaucagugaaagaucuaacuaaaggaacu

SEQ ID NO: 137475 - RNA, 41 nt, Homo sapiens
guaaaggagaucuucaggaagucaccuuuccugguaccaaa

SEQ ID NO: 137476 - RNA, 45 nt, Homo sapiens
uaccuucaguauuccaccacugccaaagcauugugaugacucuga

SEQ ID NO: 137477 - RNA, 47 nt, Homo sapiens
cuuacugccagaacacaaagccaaggcucugcucuuugagguaaguu

SEQ ID NO: 137478 - RNA, 31 nt, Homo sapiens
uuagagguggccaaagacucaaucccccgaa

SEQ ID NO: 137479 - RNA, 45 nt, Homo sapiens
ucuuccugucuuccaugugccccaucaaugucagcgccagcaccu

SEQ ID NO: 137480 - RNA, 50 nt, Homo sapiens
ugcaacaaaagccuccacccagccacaucuugggaaaagaauggccacuu

SEQ ID NO: 137481 - RNA, 53 nt, Homo sapiens
cuggcaccagagucucaacaaaaagaauuggaaacagggcuuuguuggggggu

SEQ ID NO: 137482 - RNA, 46 nt, Homo sapiens
aacgugacuuagaaugaaacuccucaaaagguucaugauuaaagag

SEQ ID NO: 137483 - RNA, 51 nt, Homo sapiens
caugcccuaggugacaguuuggaaaagcauaccauuuagauuucauaccaa

SEQ ID NO: 137484 - RNA, 64 nt, Homo sapiens
auugcaguacaauaaaggagcuuucagugagcauuuuacuguaagccuaugucagugccuaaca

SEQ ID NO: 137485 - RNA, 42 nt, Homo sapiens
gggcgagagccagaaaagaggaggcuuaggaguaaaagggua

SEQ ID NO: 137486 - RNA, 45 nt, Homo sapiens
ccgccgccaauagcgccgccauggcucucggccgcccuagcuccg

SEQ ID NO: 137487 - RNA, 30 nt, Homo sapiens
acaugggccaccaggucucaguaaggcugu

SEQ ID NO: 137488 - RNA, 46 nt, Homo sapiens
gccuccaccucuuccagccccaccacaggggcaaaguacugguggc

SEQ ID NO: 137489 - RNA, 142 nt, Homo sapiens
aagauuugacugaauacuagucuucauauuuaaccuuuucccaaacuggagauaugagguguuggguucccuuuauucuauaagcaggggugccccucauuauuauuucaacaauuagaaucugggauuuaucuguccugga

SEQ ID NO: 137490 - RNA, 37 nt, Homo sapiens
ucuucccuccacccaugcccucucacccccagauaga

SEQ ID NO: 137491 - RNA, 45 nt, Homo sapiens
gaggcucaaauuucuucagcuguaaaauagagauaauaucaccuc

SEQ ID NO: 137492 - RNA, 27 nt, Homo sapiens
cucuuacaaccaucaggcucaggaaug

SEQ ID NO: 137493 - RNA, 42 nt, Homo sapiens
gacauugacgcuguaagacuguccuuugcucagcuggcaggg

SEQ ID NO: 137494 - RNA, 50 nt, Homo sapiens
uugaacugcaccgguucggccugggcagcggugcugagcgccaggagcag

SEQ ID NO: 137495 - RNA, 45 nt, Homo sapiens
cggucacaagacaaaccugucggggcgggcccggggaggagccca

SEQ ID NO: 137496 - RNA, 57 nt, Homo sapiens
cuggacacgccgcgacugcugcgcgcgggacggccuccuggccuccgccucgguggg

SEQ ID NO: 137497 - RNA, 44 nt, Homo sapiens
cgugagggucacgccugagccuggcgcggugauggcugccggua

SEQ ID NO: 137498 - RNA, 40 nt, Homo sapiens
ucgaguacccgggccccggcgaggccucaggaagcgccac

SEQ ID NO: 137499 - RNA, 46 nt, Homo sapiens
gcagcagaugcaccagaagcaaaugcagugcgugcuucagccccac

SEQ ID NO: 137500 - RNA, 74 nt, Homo sapiens
agacuggcagccgccaccgccaccgaugcccccgccacccgggccggcccucagcuaucagaagcagcagcagu

SEQ ID NO: 137501 - RNA, 81 nt, Homo sapiens
cugcugcuucugauagcugagggccggcccggguggcgggggcaucgguggcgguggcggcugccagucuccguagccgcc

SEQ ID NO: 137502 - RNA, 43 nt, Homo sapiens
gacccaggcggcacagggggagauucagggggggauuccagcu

SEQ ID NO: 137503 - RNA, 50 nt, Homo sapiens
gguccuauaugcccccaucucagucuuacaugcccccaccucagccgcca

SEQ ID NO: 137504 - RNA, 48 nt, Homo sapiens
aagguggggacugcgaaggggacggcugagcaggaggcagguagggcu

SEQ ID NO: 137505 - RNA, 46 nt, Homo sapiens
uccccuucgcaguccccaccuucccaauccuaccuggcgcccaccc

SEQ ID NO: 137506 - RNA, 58 nt, Homo sapiens
acgguggugguggagcuaguaguugggauuuagaauggcccugggaggggcgggaagg

SEQ ID NO: 137507 - RNA, 42 nt, Homo sapiens
gcggcuugcugcuguucaguacucuuguuuuuggccccacuc

SEQ ID NO: 137508 - RNA, 42 nt, Homo sapiens
aaaacaagaguacugaacagcagcaagccgccccugagccag

SEQ ID NO: 137509 - RNA, 31 nt, Homo sapiens
guaucuaagggaaccaaugaaagaauggcca

SEQ ID NO: 137510 - RNA, 54 nt, Homo sapiens
ggugaguacagacaacucuuucaagaaguuugacugaaggagagagagaaugag

SEQ ID NO: 137511 - RNA, 45 nt, Homo sapiens
uaccugggguuccucaggugggagaggagguggcacuuccucauu

SEQ ID NO: 137512 - RNA, 25 nt, Homo sapiens
ugaaaagugacaaaaaaagaaacgg

SEQ ID NO: 137513 - RNA, 46 nt, Homo sapiens
acuauggaauuuauaaacuccuuuguauuaguauccauaauaguau

SEQ ID NO: 137514 - RNA, 46 nt, Homo sapiens
uuuccaguaucagggaauaaugcagaagcacacucaguuacagcag

SEQ ID NO: 137515 - RNA, 47 nt, Homo sapiens
ugaaagccacucagagcuaucuccaggagaaagucaauucauuucag

SEQ ID NO: 137516 - RNA, 80 nt, Homo sapiens
uucucagaugccuccaccucuaccuacaaugcccccuccaguguugccuccuucauugccaccaccagugaugcccccug

SEQ ID NO: 137517 - RNA, 46 nt, Homo sapiens
guggcccugcagaagacagggaagguggggggagaacugguggugg

SEQ ID NO: 137518 - RNA, 48 nt, Homo sapiens
ccccuggaguuccacaagggauaccuccucaguuaacagcagccccag

SEQ ID NO: 137519 - RNA, 49 nt, Homo sapiens
acuggggcugcuguuaacugaggagguaucccuuguggaacuccagggg

SEQ ID NO: 137520 - RNA, 58 nt, Homo sapiens
ugucuuuugguucugccccaccgacaacuuaccauccuccguugcaaucagcuggucc

SEQ ID NO: 137521 - RNA, 85 nt, Homo sapiens
agaaauggguacuccuuauacaaaauucaaacauuacagaaaaguguagaaaaaagugaaagucaccuaauuccaccaucuggag

SEQ ID NO: 137522 - RNA, 47 nt, Homo sapiens
ccugugaaguaggcagauuauucuccauuuacucuuaacaaaauggc

SEQ ID NO: 137523 - RNA, 43 nt, Homo sapiens
aaaucucccucaucccccucaguuauuuucuaauaccccaaag

SEQ ID NO: 137524 - RNA, 44 nt, Homo sapiens
uuaccacaccacauuuccuuucuguucuuagaaauauauuguca

SEQ ID NO: 137525 - RNA, 60 nt, Homo sapiens
uuucaguguaauguucagcacuuuuaacuacuuucauugccacaaauuucuucccccuaa

SEQ ID NO: 137526 - RNA, 33 nt, Homo sapiens
uuuguucuuugucuuucagaauguacaaacaag

SEQ ID NO: 137527 - RNA, 71 nt, Homo sapiens
aucucuugcauuucagacacacuucacuucaccuguauugugcaauagucacucaaauuccucuugaaagu

SEQ ID NO: 137528 - RNA, 48 nt, Homo sapiens
auugagaaagagagucuugucuggggggccuugugucuagcuacagga

SEQ ID NO: 137529 - RNA, 48 nt, Homo sapiens
aucagcagagcauguuuggaagugcaaauaguuuagcauggcuaaugc

SEQ ID NO: 137530 - RNA, 40 nt, Homo sapiens
auuaucuuuauauuuuguuguaaacucuuugagggcacau

SEQ ID NO: 137531 - RNA, 46 nt, Homo sapiens
uucaggaaacaaagaaccauuagcagacaccaguaguaaccagcag

SEQ ID NO: 137532 - RNA, 81 nt, Homo sapiens
uaccccauucagaaaacaaccaagauaaaggccugccucggccagauaauagagauaauagauuagaaggcaauagaggca

SEQ ID NO: 137533 - RNA, 81 nt, Homo sapiens
ggcccaggauuggucaagcaagaagacuuucgggauaagaugauggguagaagagaagauagucgagagaagaugaacaga

SEQ ID NO: 137534 - RNA, 46 nt, Homo sapiens
uccauaucaccgggaugagccuccuagggcuccauggaaccaugga

SEQ ID NO: 137535 - RNA, 45 nt, Homo sapiens
ugugaacgugacuaucaagaugauacacuagagcucuauaacaga

SEQ ID NO: 137536 - RNA, 48 nt, Homo sapiens
augauggagauaggcgaggcccuuggugggaugauugggagagagacc

SEQ ID NO: 137537 - RNA, 64 nt, Homo sapiens
cucuuccaccuuuaccgccccucccaccucuuccaccuuuggauagauaucgggaugauagaug

SEQ ID NO: 137538 - RNA, 48 nt, Homo sapiens; identical to SEQ ID NO: 41543

SEQ ID NO: 137539 - RNA, 45 nt, Homo sapiens; identical to SEQ ID NO: 41544

SEQ ID NO: 137540 - RNA, 46 nt, Homo sapiens
caugaaaucauuuugaaagcugcacaagaacugaaaaugcuucggu

SEQ ID NO: 137541 - RNA, 33 nt, Homo sapiens
aaaauacggugaagaaaagguaaugaugaaaga

SEQ ID NO: 137542 - RNA, 51 nt, Homo sapiens
uaauacuaccuuaucuuugcaggccuuugagauagacagacugacauaaua

SEQ ID NO: 137543 - RNA, 48 nt, Homo sapiens
ucuaccaccucaggaaucaagauugcagaauacaucuucaagaccugg

SEQ ID NO: 137544 - RNA, 46 nt, Homo sapiens
uggagcagagggucuuacaauugaaccuggugguuugcccauagga

SEQ ID NO: 137545 - RNA, 46 nt, Homo sapiens
cuguuccugugaccaggccaccugucccaauaccaccaccuccacc

SEQ ID NO: 137546 - RNA, 45 nt, Homo sapiens
ggaauggaagagugaacaggugggggugguaauacuggagcagau

SEQ ID NO: 137547 - RNA, 45 nt, Homo sapiens
aaaguugaacagauaccuuauggagaaagaauaacucuacgccca

SEQ ID NO: 137548 - RNA, 46 nt, Homo sapiens
guuaugauagagaaagagaucgugagccuuauuuugaucgucaaag

SEQ ID NO: 137549 - RNA, 44 nt, Homo sapiens
auauuuggcugaaaugagugcagauaaccagacuuguggcaaga

SEQ ID NO: 137550 - RNA, 46 nt, Homo sapiens
cuagauauucguucuuugcugcaagaugcugcuauugaagagguga

SEQ ID NO: 137551 - RNA, 56 nt, Homo sapiens
auuacuaaaacagagacuacuaaaugaaaaacagguuuggacgaacaauauuuugg

SEQ ID NO: 137552 - RNA, 49 nt, Homo sapiens
aaaaaagacugaguuaacauuuagcaaaauauugacucccucauugaga

SEQ ID NO: 137553 - RNA, 44 nt, Homo sapiens
augcaaauaucgaagaacagaaagaagaaaagaaagaugcagag

SEQ ID NO: 137554 - RNA, 47 nt, Homo sapiens
uucuuugcuacaagaucuccaaauuugaguuucugucaacagaggca

SEQ ID NO: 137555 - RNA, 58 nt, Homo sapiens
caaaauacuaccuaguaaguugaaauugaauuauuaguucuggcugguagacuagaaa

SEQ ID NO: 137556 - RNA, 48 nt, Homo sapiens
gguaauggucauagaucuuucugcuauaagaggaacaaauuuccuaaa

SEQ ID NO: 137557 - RNA, 57 nt, Homo sapiens
aagaucauuucucucuucugguucucuuaaauauugauuauccuuuagggcaaagag

SEQ ID NO: 137558 - RNA, 55 nt, Homo sapiens
uuuagugugcauucuugaaagugcuuaguacuuugagguugguccauugagccaa

SEQ ID NO: 137559 - RNA, 101 nt, Homo sapiens
ccuguggcccaccuucagucccaccagacugguucuucccugcugggacacaggcaucauaaugcaagggcagguuguuacuugccacaucaggugguggg

SEQ ID NO: 137560 - RNA, 50 nt, Homo sapiens
auguggcaaguaacaaccugcccuugcauuaugaugccugugucccagca

SEQ ID NO: 137561 - RNA, 83 nt, Homo sapiens
ucauauaaaguacuuuugcuuuucucaucucagugucauuugucucuacucuugaguuguauauugguuuucuacaugucaga

SEQ ID NO: 137562 - RNA, 48 nt, Homo sapiens
uauaauacauacuguuucaaauaugugguaaaauucugugaccugcca

SEQ ID NO: 137563 - RNA, 42 nt, Homo sapiens
uuucuucagcccaagaaggaaacuuuaaacauauuugcacaa

SEQ ID NO: 137564 - RNA, 43 nt, Homo sapiens
guucuugcaguuuucacacugcccuucuguauugcugccuggc

SEQ ID NO: 137565 - RNA, 47 nt, Homo sapiens
ggaacugaaauaugaaauuuuuacuuugaaguauguuaaugucaaag

SEQ ID NO: 137566 - RNA, 44 nt, Homo sapiens
gcuccccgaugauuaugauacucgugcuucugagccugggaaga

SEQ ID NO: 137567 - RNA, 63 nt, Homo sapiens
uguacuuaguaaugggcaccauuacaaagaauccagguuucaaagcuuuuuaaaauacugcag

SEQ ID NO: 137568 - RNA, 110 nt, Homo sapiens
cuagacucaugccaaguggauaagguuagggaaaagacauuucaggaagaaugacuaguacauauaugcagaguuauagagacaugaaauggugcgaugcgcucugagug

SEQ ID NO: 137569 - RNA, 75 nt, Homo sapiens
agaugggcagaccuggaagagaagaaggaugcagauaggaaaagggccauagguuuuguggucggacagacugau

SEQ ID NO: 137570 - RNA, 46 nt, Homo sapiens
ggucaccuggcugaaaaagcccucaaucgaaccaaauauauaugag

SEQ ID NO: 137571 - RNA, 51 nt, Homo sapiens
uuucuuuuaacuguuuuggggagggagggagugauagcuuaacugcugaag

SEQ ID NO: 137572 - RNA, 35 nt, Homo sapiens
aguucugucuaccagaauucaaagccagaucagga

SEQ ID NO: 137573 - RNA, 58 nt, Homo sapiens
agacgcuagggauacaggaguggauacagaaguguacaguucuugcccucguggagcu

SEQ ID NO: 137574 - RNA, 371 nt, Homo sapiens
ggugacuuaaaaguuauggccauggccgggcgcgguggcugacgccuguaaucccagcacucugggaggcugaggcgggcggaucacgaggucaggagaucgagaccauccugguuaacacggugaaaccccaucucuacuaaaaaauacaaaaaauuagccgggcgugguggcaggcgccuguagucccagcuccucgggaggcugaggcacgagaauggcgugaagccgggaggcggagcuugcagugagccgaguucgcgccacugcacuccagccugggcgacagagcgagacuccaucucaaaaaaaaaaaaaaaaaaaaguuauggcuagcagaaugugacggagcuaacccagugaagcccagg

SEQ ID NO: 137575 - RNA, 69 nt, Homo sapiens
aaaaaaggugauuuggccggaguauuuugguuaagggagagaguggcaagagauagaagaugguauaga

SEQ ID NO: 137576 - RNA, 39 nt, Homo sapiens
augagagggugggaugauguagaccagcuugggaagguu

SEQ ID NO: 137577 - RNA, 52 nt, Homo sapiens
gauagacaugggaagaagccugucuggcaggaaagauagagugggcuggacg

SEQ ID NO: 137578 - RNA, 30 nt, Homo sapiens
ccuuggucuuugagguucguuuugaaugaa

SEQ ID NO: 137579 - RNA, 30 nt, Homo sapiens
aagaugaagugguuugugagauugaaacug

SEQ ID NO: 137580 - RNA, 42 nt, Homo sapiens
gagccaggagcuggcaaaggucugcguucagaacaucgggua

SEQ ID NO: 137581 - RNA, 49 nt, Homo sapiens
ucaggagaaaaugaacaggaugcggcagcgcauugcucagcgucugaag

SEQ ID NO: 137582 - RNA, 46 nt, Homo sapiens
ucuucaagauuucaauguguucaaguaucagcacugucaggaagag

SEQ ID NO: 137583 - RNA, 122 nt, Homo sapiens
aggguuuagucugcgaaucuacuuuucauuagagaaauuugcuuuucuuuggaaaggguuugaaaaauagggagaagggaguguuuucuugauagugcgcuguggcauuguucagaguaggg

SEQ ID NO: 137584 - RNA, 41 nt, Homo sapiens
gcccaggcucagucagggacuugggagauacuauacuuggg

SEQ ID NO: 137585 - RNA, 51 nt, Homo sapiens
ggaauguggaagcuaugaauuuugcagauauugaacggaccaucacugaac

SEQ ID NO: 137586 - RNA, 56 nt, Homo sapiens
uugcacugaggguaaguccuggucuuugaaauacuguaaauaugcagaggcaacau

SEQ ID NO: 137587 - RNA, 46 nt, Homo sapiens
ggcagagaggcugugacuuuccuccgcaaaaucaaggcagcgguag

SEQ ID NO: 137588 - RNA, 61 nt, Homo sapiens
cggguuagccuggugacaggcagacacaugcuguuggccucaagcaaggaagcagagcacu

SEQ ID NO: 137589 - RNA, 43 nt, Homo sapiens
cuagcaccuuguucuuagagcagauucuagcacaucauggcag

SEQ ID NO: 137590 - RNA, 50 nt, Homo sapiens
gcaggacacagaucuggaggacguggacugggguaggaaaccacccugag

SEQ ID NO: 137591 - RNA, 112 nt, Homo sapiens
uugacaccagggccaguagagagugcccuuuuguaucuuaagccaagaagugaggccugggggugggggaggggggaaggggugggagccaauacugagugccugcagcauc

SEQ ID NO: 137592 - RNA, 52 nt, Homo sapiens
cuuguaacuaaaguauuuaaagaaacugauuuuaaaugcaaauuaaagggca

SEQ ID NO: 137593 - RNA, 46 nt, Homo sapiens
ccuuguggaccaagaugcucaaggucaauacacaugaacaggugag

SEQ ID NO: 137594 - RNA, 33 nt, Homo sapiens
uacaggguggguagcuaaccuagacugcaggug

SEQ ID NO: 137595 - RNA, 39 nt, Homo sapiens
aucggggccaaggcagcggcguggcaauaaaagaaaaua

SEQ ID NO: 137596 - RNA, 101 nt, Homo sapiens
gcugaaacccugcagaggagggagacaggccacacacagccucagggccgagcccuccuuggccauggccuucucaccaggcaucaggcaggggcuucugg

SEQ ID NO: 137597 - RNA, 47 nt, Homo sapiens
gugaacacuaaaggaugagaaggaauuaaccaggaaaagugguuaga

SEQ ID NO: 137598 - RNA, 44 nt, Homo sapiens
aaaucaaacggcacaguggauacagcuugucuuugcucuguaag

SEQ ID NO: 137599 - RNA, 61 nt, Homo sapiens
ccugaaggccccgcuaugggugugugggagaaacaaaaggggcugggugaggggccgggcu

SEQ ID NO: 137600 - RNA, 30 nt, Homo sapiens
gccucgccgagcccagcccgcagcuccccg

SEQ ID NO: 137601 - RNA, 61 nt, Homo sapiens
agagcuucguggagacccugaagcgggguggugggccgcgcagcuccgaggaaauggcucg

SEQ ID NO: 137602 - RNA, 41 nt, Homo sapiens
ccgugggcaacauggugcggagagugcucaagauuauccgg

SEQ ID NO: 137603 - RNA, 46 nt, Homo sapiens
acuggcagcaaaacaccauuccaccccacucaucgucugugcaccu

SEQ ID NO: 137604 - RNA, 46 nt, Homo sapiens
gagaaggucagcgugcauugcccuguguuugacuacguucccccag

SEQ ID NO: 137605 - RNA, 33 nt, Homo sapiens
ucggguucgggggagucgggccggcggaggccu

SEQ ID NO: 137606 - RNA, 46 nt, Homo sapiens
cgaccagucugggggcgcuggcggccugcgcagccaccucaaggug

SEQ ID NO: 137607 - RNA, 15 nt, Homo sapiens
ugggcgugguaccaa

SEQ ID NO: 137608 - RNA, 687 nt, Homo sapiens
uggguuaaucaaaagggaguuuagucuggcuaggucuguccuaauuaggggagaccuucaaaaagggacuaggggccaggcaugauggcuuaugccuauaacccagcacuuugggaggcaagaggaccucuugagcccagggguuguagaacagcugaggcagcauaggaagacccccaucucuacaaagaaaaaauuguuuuaauuagccaggcaugguggcauaugccuguagucccagcuacuugggaggcugagcgggaggauggccuaagcccaggaguucgaggcugcagugagcugugaucgcaucacugcacuccagucugggugacagagugaaacccugucucaaaaauaaauaaauagccaggcacgcuggcucaugccuguaaucccagcacuuugggaggccgaggcagguggaucaccucaggucaggaguuugagaccagccuggccaacaugguaaaaccccaucucuacuaaaaauacaaaauuagcugggcauggugguacaugccuguaaucucagcuacucaggagacugacaugggagaaucacuugaacccaggagguagagauuggagcaagccaagaucauaccauugcacuccagccugggcaacaagagcaaaacucuaucucaaaauaaauaaauaauaaaacccugaaaacaaaaaggg

SEQ ID NO: 137609 - RNA, 22 nt, Homo sapiens
ccgacuguucugcaggccccgg

SEQ ID NO: 137610 - RNA, 53 nt, Homo sapiens
ggauuuggucaaaaaggucaugcuguuggugauauuucuggaguucgcuuuca

SEQ ID NO: 137611 - RNA, 49 nt, Homo sapiens
cugggaaaaguaggaguugaagccaaaaagccaaauucugccauuagga

SEQ ID NO: 137612 - RNA, 41 nt, Homo sapiens
uuacuccagggcuggcguugugaagaccaugacaggaggcc

SEQ ID NO: 137613 - RNA, 22 nt, Homo sapiens
ccuaaguuucuuaccgcaugcu

SEQ ID NO: 137614 - RNA, 46 nt, Homo sapiens
aagaugagaagucugcuuugcagaccgagauugccaaccugcugaa

SEQ ID NO: 137615 - RNA, 45 nt, Homo sapiens
auuugaaugaaaaauuuaagcauuguuugcuuauuguuccaagac

SEQ ID NO: 137616 - RNA, 87 nt, Homo sapiens
uucugagagugaugucaggucaucacccauagaagaaaggaagugaaagaaaaaguucaugccuucuuggagugcagaugcucagag

SEQ ID NO: 137617 - RNA, 46 nt, Homo sapiens
agagaggagcccaaccugcguggacaaccccuugaggcagcccuug

SEQ ID NO: 137618 - RNA, 55 nt, Homo sapiens
aaaucaaggcaugaaaauaaaagggaaaaaggggaaggcuggaaaagggagccug

SEQ ID NO: 137619 - RNA, 45 nt, Homo sapiens
caguuccauagacaaacaacucagagaggaaaugccccagggcaa

SEQ ID NO: 137620 - RNA, 46 nt, Homo sapiens
caauauacguugguuacuuugugccuuagccuagaaaaguagucac

SEQ ID NO: 137621 - RNA, 43 nt, Homo sapiens
uuuaaaaugauuguucaauccucccuuccucuuagucacccug

SEQ ID NO: 137622 - RNA, 45 nt, Homo sapiens
aaauggacacucucaguagagaggcucaggaagccaggaaaggcu

SEQ ID NO: 137623 - RNA, 48 nt, Homo sapiens
aauacaugaauugcccagggcaguguaaaaucaaugaaaaguauucag

SEQ ID NO: 137624 - RNA, 41 nt, Homo sapiens
ggaagcagccgucggcggcugcccugagccuuccuggggaa

SEQ ID NO: 137625 - RNA, 47 nt, Homo sapiens
ggaaauggcuucagagaaugguaaugaagagagugaccugggaaggg

SEQ ID NO: 137626 - RNA, 49 nt, Homo sapiens
cacagaccugcccaaggugagacacacgggucaggggggugauagcaca

SEQ ID NO: 137627 - RNA, 40 nt, Homo sapiens
agggacuccccagacaggaaggagaagaccgacgggaggg

SEQ ID NO: 137628 - RNA, 41 nt, Homo sapiens
ugccuuggggcuuuuaaaagucugauuuugaauaaagggaa

SEQ ID NO: 137629 - RNA, 45 nt, Homo sapiens
uccccagccugcccgucagcaugagauacccagugggaaagugag

SEQ ID NO: 137630 - RNA, 47 nt, Homo sapiens
gggcguggccucagcugccucugggagcuucccgggaaugacagggu

SEQ ID NO: 137631 - RNA, 28 nt, Homo sapiens
ggaugggguguauuuuguugcaaguuug

SEQ ID NO: 137632 - RNA, 42 nt, Homo sapiens
ggaauccggaauguuuugggggugcacuugguccaugcccgg

SEQ ID NO: 137633 - RNA, 42 nt, Homo sapiens
ggaacagcagaggcagcaguggauggcgaaccagagcgaggc

SEQ ID NO: 137634 - RNA, 32 nt, Homo sapiens
gguggggggaguaccgcagcgcuggccgggcc

SEQ ID NO: 137635 - RNA, 45 nt, Homo sapiens
ccagagcugaaccgucagagccccaauucuucuucagcggcggcg

SEQ ID NO: 137636 - RNA, 42 nt, Homo sapiens
cggcgguggagacucgcguucccuccagccccuggggcagaa

SEQ ID NO: 137637 - RNA, 41 nt, Homo sapiens
gaggcaacggcggccaccaccgggcacccucgcccccuccc

SEQ ID NO: 137638 - RNA, 46 nt, Homo sapiens
uccccggaggaccgggggaggggguggcagccgagaaaggaccuuc

SEQ ID NO: 137639 - RNA, 45 nt, Homo sapiens
gaggcgcgucucggcgcuccugcuccggcugcggcucgcgcuguc

SEQ ID NO: 137640 - RNA, 46 nt, Homo sapiens
ugugggcaaccaggcagaaagcgggaauaugaaaaaguggggaggg

SEQ ID NO: 137641 - RNA, 45 nt, Homo sapiens
ggggaaggucugugacgcgcacccggguggagggaagcugguuag

SEQ ID NO: 137642 - RNA, 74 nt, Homo sapiens
ccugguagggagugcguagcaggguggagucgcuguccggucgcgcuucacuucugcuccgcccucccugcucc

SEQ ID NO: 137643 - RNA, 28 nt, Homo sapiens
uuauaaaaacaugcagauucucgagccc

SEQ ID NO: 137644 - RNA, 72 nt, Homo sapiens
aaaaugagaaaagugggccagauaugggccauggcagaccugagagcgcauacgcugguugaugggggccau

SEQ ID NO: 137645 - RNA, 38 nt, Homo sapiens
aaaaacaaacagguguuguauauaaaauaucaugauuu

SEQ ID NO: 137646 - RNA, 47 nt, Homo sapiens
auuuugagugguggagcgggcugggagcuggcaucuggagucuggac

SEQ ID NO: 137647 - RNA, 53 nt, Homo sapiens
gucaugguaucguggugacccucagccucccaggaaauguccccucuggcaca

SEQ ID NO: 137648 - RNA, 44 nt, Homo sapiens
auugaugggcaccgucucguagucgaugccuuucaaggccagag

SEQ ID NO: 137649 - RNA, 53 nt, Homo sapiens
agucuuguauugagccucuccuaugugcuaggcaccuugacuguacacaggcg

SEQ ID NO: 137650 - RNA, 41 nt, Homo sapiens
auggcacagagaucccccugcagacgccuucucaggaagcu

SEQ ID NO: 137651 - RNA, 41 nt, Homo sapiens
ccuagggcagacaagaauuggaggugggaugggugaaagag

SEQ ID NO: 137652 - RNA, 58 nt, Homo sapiens
gcagguucacaaagaaauaggaacaguagguaacagaugccaaaugauacugcacaag

SEQ ID NO: 137653 - RNA, 31 nt, Homo sapiens
ugccccaucguccuucccuggacagcucccu

SEQ ID NO: 137654 - RNA, 50 nt, Homo sapiens
cuauuuucugaagggcuuucuuuggugccauguacucagaucagucaguu

SEQ ID NO: 137655 - RNA, 43 nt, Homo sapiens
auuuucccuuaacguaacgggaaguguuuugaaauucccagaa

SEQ ID NO: 137656 - RNA, 43 nt, Homo sapiens
uccggagcagcuucacaaucacucuuguacugacaugccaguu

SEQ ID NO: 137657 - RNA, 43 nt, Homo sapiens
aaacaaugaaaugaaaaccguuugcuuugauccucacccuguu

SEQ ID NO: 137658 - RNA, 63 nt, Homo sapiens
augaaugaaauguaaccaugcccaggacuucaaaagugaccagacccuaagaggcacacagag

SEQ ID NO: 137659 - RNA, 43 nt, Homo sapiens
uagugcugcagccaguggucaccagagcaccagcugcugggcc

SEQ ID NO: 137660 - RNA, 46 nt, Homo sapiens
aaucagguuuccaaaguuucugcauuuagcuuucuugcauugaggg

SEQ ID NO: 137661 - RNA, 45 nt, Homo sapiens
auucuuggucucugcauagcugggagaccacacugccuuuggagg

SEQ ID NO: 137662 - RNA, 42 nt, Homo sapiens
gagaggcuccaggagcuccuugcggggucgcuauggggaggu

SEQ ID NO: 137663 - RNA, 45 nt, Homo sapiens
agcguggugagguggugaccauccggguaccuacucauccagagg

SEQ ID NO: 137664 - RNA, 46 nt, Homo sapiens
uuugcccagcuugcuuuugaauuccuucaccuuggcaaagguccag

SEQ ID NO: 137665 - RNA, 79 nt, Homo sapiens
cugcagauuccaaaucagcugaaagaacaucuauagcuccuguauguucagacuggaucauaacgauguccccagaccu

SEQ ID NO: 137666 - RNA, 41 nt, Homo sapiens
gagcuauagauguucuuucagcugauuuggaaucugcagau

SEQ ID NO: 137667 - RNA, 46 nt, Homo sapiens
ccaaacccuuuauaagguccuuguccgccaacacccucgcagguug

SEQ ID NO: 137668 - RNA, 158 nt, Homo sapiens
gaggauguguggcagagugggagucaaacuaaacccuaggagcaagagcuauuaaugagaggagccacagggagguacugugcaggugagguaagaccaaggcauggcccagaaucacagucaaugcaaauacuguuaacaaccugcgaggguguugg

SEQ ID NO: 137669 - RNA, 39 nt, Homo sapiens
uagugacuucaagacugagacaaucuguagcccgaggug

SEQ ID NO: 137670 - RNA, 45 nt, Homo sapiens
gguauaauagcaugaaaccaggaacacuaaucugagugauuugaa

SEQ ID NO: 137671 - RNA, 41 nt, Homo sapiens
caccaaggccugagccuccaaaggaccaguugcuuuccgca

SEQ ID NO: 137672 - RNA, 38 nt, Homo sapiens
ucucaaacuugacacugugucauaggaggaaaaaauau

SEQ ID NO: 137673 - RNA, 49 nt, Homo sapiens
auaagcagaaccauguuuuuucagaguagcaugcacaaagacaaagaga

SEQ ID NO: 137674 - RNA, 57 nt, Homo sapiens
uuuuguuuuuuuuuuaaguuuaaaggaaaauaaaacucuauugugauccugaaguca

SEQ ID NO: 137675 - RNA, 34 nt, Homo sapiens
ucauguguuuauggcaaacguacccacgcguuuu

SEQ ID NO: 137676 - RNA, 89 nt, Homo sapiens
ucuaggucugacucuuuaugcguuucauccauaggggccuccaaaucuuugaaaaacucucccaucucucuggauguuuccgacuuuac

SEQ ID NO: 137677 - RNA, 25 nt, Homo sapiens
uuuucaggaauccuuguuucgggac

SEQ ID NO: 137678 - RNA, 42 nt, Homo sapiens
guggguuguugauugggguccucgauacggaagggucuggga

SEQ ID NO: 137679 - RNA, 45 nt, Homo sapiens
ccuaaccacacuauuuauaucaacaaccucaaugagaagaucaag

SEQ ID NO: 137680 - RNA, 67 nt, Homo sapiens
uaugccaagaccgacucagauaucauugccaagaugaaaggcaccuucguggagcgggaccgcaagc

SEQ ID NO: 137681 - RNA, 46 nt, Homo sapiens
cuuuaagaucacgcagaacaacgccaugaagaucuccuuugccaag

SEQ ID NO: 137682 - RNA, 42 nt, Homo sapiens
uacccagagucuguccccagacauugcaccuggcgcuguuag

SEQ ID NO: 137683 - RNA, 47 nt, Homo sapiens
cauuuuugacauaaacggcaguaucaucaaaucaaggaacugcccga

SEQ ID NO: 137684 - RNA, 44 nt, Homo sapiens
uauguccugaagccucuuuuugggucauuuuuccaggugcccag

SEQ ID NO: 137685 - RNA, 57 nt, Homo sapiens
uguggaugagaacuaaucgcugauagucaaauacaucaaauaaaguuauaaaauugc

SEQ ID NO: 137686 - RNA, 51 nt, Homo sapiens
uuucuucccuucuuuuugguuuugguucagagccaauucuuguuucauugg

SEQ ID NO: 137687 - RNA, 42 nt, Homo sapiens
gacaucccugugaauuuuccaaagaauggcugggcugcaauu

SEQ ID NO: 137688 - RNA, 43 nt, Homo sapiens
gaaaauaauuguacaaagcuuuuaaggguauuguagaguugaa

SEQ ID NO: 137689 - RNA, 46 nt, Homo sapiens
auuuuugcaaauggaucuuacaggguuacaggugauuuagguaacu

SEQ ID NO: 137690 - RNA, 46 nt, Homo sapiens
uacauagagaccccugacacaggagguguguucauugcaggaagag

SEQ ID NO: 137691 - RNA, 25 nt, Homo sapiens
guagaacuuccucucuuauaccuag

SEQ ID NO: 137692 - RNA, 46 nt, Homo sapiens
gcuacgccaaguucucaaccagagacccauuacaugggcugccgau

SEQ ID NO: 137693 - RNA, 89 nt, Homo sapiens
agcuguucacacucaccacucucaccacuggucgcaaaggcagcuacccgcuuccuccaaaaucccagcccuucccaaguaccuauaag

SEQ ID NO: 137694 - RNA, 30 nt, Homo sapiens
cuacagguaugguauaccaaacuuggaaaa

SEQ ID NO: 137695 - RNA, 46 nt, Homo sapiens
auuucaaugugucacaacaauuugccaccuuuguucuuaagggauc

SEQ ID NO: 137696 - RNA, 58 nt, Homo sapiens
ccacucaguuuacucaaccuggcugguauuaccugaagacaguuggccauuuagagaa

SEQ ID NO: 137697 - RNA, 101 nt, Homo sapiens
caaaaaauauaagaaaauuaagguuagacuuguauauuggacuuguauauucuaauauugagaauuauaugagaaaacuaagguuagacuuguauauugga

SEQ ID NO: 137698 - RNA, 35 nt, Homo sapiens
auuauucuaagaccaggcuuuuagaaaaguguagg

SEQ ID NO: 137699 - RNA, 57 nt, Homo sapiens
caaagcagaaaaaaacuuagagaagauuauauaaacugugugucuaugcguguuuua

SEQ ID NO: 137700 - RNA, 43 nt, Homo sapiens
cacacuggauuuuucaaaaugugaauaaauuuagacaacuuau

SEQ ID NO: 137701 - RNA, 39 nt, Homo sapiens
aaggcugacuguugaaaggaaaguagguaugcacaaagc

SEQ ID NO: 137702 - RNA, 36 nt, Homo sapiens
ucauuauccuggaacccauucagcaaaagaugcaaa

SEQ ID NO: 137703 - RNA, 57 nt, Homo sapiens
uaugucaaucuucagcugacugccuauuaugucgugaccuggauugugggcgccaag

SEQ ID NO: 137704 - RNA, 31 nt, Homo sapiens
ugugucugggguggggguggggagugagaug

SEQ ID NO: 137705 - RNA, 48 nt, Homo sapiens
aagauaauaaaaaaaggaugaaaugauaugcuuuuaucauccauccuu

SEQ ID NO: 137706 - RNA, 55 nt, Homo sapiens
cuuccuauaucaagacauauuauaggcuaaagguguggguucugagaacagggcu

SEQ ID NO: 137707 - RNA, 46 nt, Homo sapiens
gaacggacuauacguuucuucuaagcuguuaagcaccucugguuca

SEQ ID NO: 137708 - RNA, 46 nt, Homo sapiens
acauacaaggaugcaaguugguagaugcugcucacuauagucucuu

SEQ ID NO: 137709 - RNA, 31 nt, Homo sapiens
uuaacaccgcugccaaaaauugauggguugu

SEQ ID NO: 137710 - RNA, 44 nt, Homo sapiens
ggugaaaaacaggauacaaaagccacucauggcaaugacaaaag

SEQ ID NO: 137711 - RNA, 44 nt, Homo sapiens
ugggggagggucggggaacagagugacugacuguggaguccuga

SEQ ID NO: 137712 - RNA, 46 nt, Homo sapiens; identical to SEQ ID NO: 41813

SEQ ID NO: 137713 - RNA, 46 nt, Homo sapiens; identical to SEQ ID NO: 41814

SEQ ID NO: 137714 - RNA, 37 nt, Homo sapiens
caacauuaauuuaaacaguuccaagaucuugauagau

SEQ ID NO: 137715 - RNA, 44 nt, Homo sapiens
ugguagcauccuugaaacaacccaacauaaaaccaaccagaagc

SEQ ID NO: 137716 - RNA, 47 nt, Homo sapiens
aaaauaagaccauauaucaaaauaggacacaaucauuuauuccaaag

SEQ ID NO: 137717 - RNA, 45 nt, Homo sapiens
caugucguggugggacauuaauggugggaugguagaaugugcagu

SEQ ID NO: 137718 - RNA, 44 nt, Homo sapiens
gucgcuggaguugaucaauucuaggcucuaacuuguuauaaaaa

SEQ ID NO: 137719 - RNA, 75 nt, Homo sapiens
auggaguacuaugcaauguuggucaaaacugguguccaucacuacaguggcaauaauauugaacugggcgcagca

SEQ ID NO: 137720 - RNA, 35 nt, Homo sapiens
aaugcaugagcguaugaaugaaggaaugaaugaag

SEQ ID NO: 137721 - RNA, 28 nt, Homo sapiens
uucucuaccauaggccucugggagacga

SEQ ID NO: 137722 - RNA, 46 nt, Homo sapiens
gcacagccacacccaaccacagggugccacaugccacacaagagaa

SEQ ID NO: 137723 - RNA, 46 nt, Homo sapiens
ggagcaggagguggcccagcucgagaaggauaagaagcugcuggag

SEQ ID NO: 137724 - RNA, 46 nt, Homo sapiens
ccaagcuggcacagauggagagggagaaccagcagcuggagcguga

SEQ ID NO: 137725 - RNA, 45 nt, Homo sapiens
ggcagagaagcuggagagggagcuacagcgacuccaggaggagaa

SEQ ID NO: 137726 - RNA, 55 nt, Homo sapiens
cacuaucacaguuuucuucaacauaauugugaagucacagaaagaaaucucugca

SEQ ID NO: 137727 - RNA, 46 nt, Homo sapiens
gcgaaauuuuauucagaaauuauugguaauguuuggaagcuaaaaa

SEQ ID NO: 137728 - RNA, 52 nt, Homo sapiens
ggcgucgguuuaacucuuccagcgccaagagaugaaaggggaagcagaggga

SEQ ID NO: 137729 - RNA, 68 nt, Homo sapiens
cuaagcgguguccagagcuuagcaaccucguggucucucaacccaaaacgacgggaagagcccgagca

SEQ ID NO: 137730 - RNA, 203 nt, Homo sapiens
ucuucucggucaguugagggagagccccaguuucauacugggguugcaaggccgggcaugguggcucacgccuggaaucccagcacaggccaaaaugggaggaucucuugagcccaggaguucgacaccggccugggcaacauagugaaaccccgucuuuauuaaaaaaaaaaaaaaagaaagaaaaaagaaagggguuaaag

SEQ ID NO: 137731 - RNA, 54 nt, Homo sapiens
aauucugcagguguucaagucuuaaaaaauaaagauuuauaacagaacccaaau

SEQ ID NO: 137732 - RNA, 52 nt, Homo sapiens
guuaguuuugaggagcaggaagcucaugggggcuucuguagccccucucaaa

SEQ ID NO: 137733 - RNA, 48 nt, Homo sapiens
ugaagagcugccuccuggaagcuuuuccaagugugagcgccccaccga

SEQ ID NO: 137734 - RNA, 41 nt, Homo sapiens
uaugcguugagacauuuguacgugcuggucaaccuuuguga

SEQ ID NO: 137735 - RNA, 46 nt, Homo sapiens
uccuguccgagagagccccgcucacggggcacagcugcuacccaga

SEQ ID NO: 137736 - RNA, 42 nt, Homo sapiens
gagaagucagugcguaagaucgucuccuugcuggcagcgucc

SEQ ID NO: 137737 - RNA, 41 nt, Homo sapiens
ugccucucaccaucaugaaaaggaaacugaugaacaccaau

SEQ ID NO: 137738 - RNA, 76 nt, Homo sapiens
caugaaagugaugcaguuucaggguaugaaacgcaaagccaguucucccgucccccuaccuccagucacacaccuu

SEQ ID NO: 137739 - RNA, 96 nt, Homo sapiens
aacuacugcugccaaccccagagagucguccuacgccuguuacuaugaugagaagagguccacguaccugggggacugguacagcgucaacuggau

SEQ ID NO: 137740 - RNA, 31 nt, Homo sapiens
accaaaguaagcccauauuguucaaguuucc

SEQ ID NO: 137741 - RNA, 45 nt, Homo sapiens
agccugugagucuggguccaugaugaaccaccugccggauaacau

SEQ ID NO: 137742 - RNA, 42 nt, Homo sapiens
gcaguggcccccaggaucacguguucauuuacuucacugacc

SEQ ID NO: 137743 - RNA, 50 nt, Homo sapiens
guacguagcccacgugugcacuaguuuccugcugaauaauacuuuggaug

SEQ ID NO: 137744 - RNA, 343 nt, Homo sapiens
guuacuuaggacuuucagagguccuucuuaccuauauaugugguggcaguggugguagugguggcgguguugguggcgguguugguggcgguguugguggugguggugguguugguggugguggcggugauggcgguggcgguggcggcggcggcgguggcggcgguggcggcggcggcggcggcggcgguggcggcggcggcgguggcggugguggugguggcggugguggcgguggcgguggugguguugguggcgguggugguguugguggcggugguggugaugguggugguggugguggugguggcaguggcgguggugguggcgguggcggugguug

SEQ ID NO: 137745 - RNA, 26 nt, Homo sapiens
caaagaagaaaaagagggcaucuaug

SEQ ID NO: 137746 - RNA, 637 nt, Homo sapiens
uuguuuauauauugucucuggcuguaacuggcucauggguuaguaauucaucacuuccagaguccaauuaacaagagcaagaucugguacaaagaaagugauuuauuuccaaguugcuuaggggaagaaacacaggcaucccaccuuuagauguacugcuuugcuuuuggagcagaaagugggcacuuuuaaaaggcaggggaggaagcaagcaaggugggguguccacguguuagcuuggugucuuaucuacugugcugucugucgguugagcuggugacugcuggcaucuuugugggcaggacuaggccaaaaacuccccaggugggagggaguagcaggcaugcuuuuugacuaguaucucucaaggcaaccuccuggcaggugagaguucuguauugggcaugcuuuggucuguaaaucaacucuuaacucuugaggaguuaggugaacuugcccuguagggagugucuggugaaggaggggcggguaaaaggcuauauuuguguuucucaagggcuaagcaggaagcggggaaccagaggaaugauaaaaggagagacaaaaauaauucaaccaucucuuagaaaaaugcaaguacuuggugacuggcugcuuucaagauacaguggcagag

SEQ ID NO: 137747 - RNA, 64 nt, Homo sapiens
uagauuaaaaacauuuuuugacugcuucuuuugaaauacguguuacuugcuuauacuuuccaua

SEQ ID NO: 137748 - RNA, 44 nt, Homo sapiens
uggcuggaagggcucagugcucuggagggggaaacugaggcgcg

SEQ ID NO: 137749 - RNA, 76 nt, Homo sapiens
uucugcccuugacuucuacuucuccauaucaucccucacaauccccuuccuccaucucuucccccgccccccccac

SEQ ID NO: 137750 - RNA, 57 nt, Homo sapiens
uggaaaaaugaagacaggguuguccaggugugguagacagugugaacacaggcaugg

SEQ ID NO: 137751 - RNA, 55 nt, Homo sapiens
gaagauucagcaaguuccucucugggacugucauuuccuuuuaauuauaaagcgg

SEQ ID NO: 137752 - RNA, 61 nt, Homo sapiens
cacauagccuccccccaccaaccccagaagcuaggggugggugaugggugggcuggcuuug

SEQ ID NO: 137753 - RNA, 34 nt, Homo sapiens
ucuuccggggugggaagagcggagagcuggagca

SEQ ID NO: 137754 - RNA, 62 nt, Homo sapiens
ucccgggaggacagccuugaggcgggccugccccuccagguccgaggcuaccccgaggagaa

SEQ ID NO: 137755 - RNA, 42 nt, Homo sapiens
gggagcucaacucucccaaggagccguuuuagaaaaguuagg

SEQ ID NO: 137756 - RNA, 45 nt, Homo sapiens
gugugagugcaucggaugaugggaacaaaacauagguaaauagag

SEQ ID NO: 137757 - RNA, 42 nt, Homo sapiens
gccuccuggcagccagcccuggaucuggcccuggccccuacc

SEQ ID NO: 137758 - RNA, 32 nt, Homo sapiens
ugugagugccuggggugugaugaugcguacga

SEQ ID NO: 137759 - RNA, 36 nt, Homo sapiens
ccacgcuuacugugaaugccuggcauggugugagug

SEQ ID NO: 137760 - RNA, 19 nt, Homo sapiens
gaauggugcacgugugugu

SEQ ID NO: 137761 - RNA, 46 nt, Homo sapiens
ugucacggcaacuacuccaaauguacuugcuuuaucuccaagaauu

SEQ ID NO: 137762 - RNA, 45 nt, Homo sapiens
cauuuccucaauaauuuuuuagcaaugccucauaagcugacagca

SEQ ID NO: 137763 - RNA, 40 nt, Homo sapiens
ucaacugucagccgaacagcggcucggccccggcggaggc

SEQ ID NO: 137764 - RNA, 42 nt, Homo sapiens
acuucucggagucgcugccgcccaggacagcgcacgccucau

SEQ ID NO: 137765 - RNA, 40 nt, Homo sapiens
cccaaggcaccacgaucauaggggcgaggggaccuguaga

SEQ ID NO: 137766 - RNA, 74 nt, Homo sapiens
augaugguauacuaauagugcaaccuugcaaaaaggguucgaaacauugucagacuuggaagaguuccccagcu

SEQ ID NO: 137767 - RNA, 46 nt, Homo sapiens
caagaagggccuaaagaagaugcaggccaacaaugccaaggccaug

SEQ ID NO: 137768 - RNA, 55 nt, Homo sapiens
caauacagagauggcaacuuaguggucuucuggugaagaaaagguggagugugga

SEQ ID NO: 137769 - RNA, 47 nt, Homo sapiens
uucuugcaaagaugccaaaucaggagagugucaagauuucaaccgca

SEQ ID NO: 137770 - RNA, 41 nt, Homo sapiens
ugugcuuuccugcagcccuccgcuguaccagcugagcccug

SEQ ID NO: 137771 - RNA, 54 nt, Homo sapiens
auuacuaaaaucaaguaaaacuaaugcauauuauuugauugacaauaaaauauu

SEQ ID NO: 137772 - RNA, 46 nt, Homo sapiens
ggugacuuguuuuaaaaauauuuaauuccgauuuggaaccuuagau

SEQ ID NO: 137773 - RNA, 78 nt, Homo sapiens
augcuucguggaaugcugcauuuauauguaagugacauuugaauacuguccuuccugcuuuaucugcaucauccaccc

SEQ ID NO: 137774 - RNA, 51 nt, Homo sapiens
aucuuuggaaaaggaaaaaaaaaaaaacuucuuuaggcauuugccuaaguu

SEQ ID NO: 137775 - RNA, 37 nt, Homo sapiens
ucccggucgcuguugcaccugauaguaagggacagau

SEQ ID NO: 137776 - RNA, 33 nt, Homo sapiens
gaaggaugacuuaaaguugauauugagcuaaau

SEQ ID NO: 137777 - RNA, 46 nt, Homo sapiens
uuuuuacagcccggcugagagaacuuacgacgggaaggucagaguc

SEQ ID NO: 137778 - RNA, 45 nt, Homo sapiens
uucugcaaauguaccccguuccccugugcgagaauugcuugaaau

SEQ ID NO: 137779 - RNA, 47 nt, Homo sapiens
gaaguaacaaaagucauauauccaagaaaagaaacuacaucugugga

SEQ ID NO: 137780 - RNA, 47 nt, Homo sapiens
cucuuccaugucauugaugacuuugugcaguuucagcuugagaagaa

SEQ ID NO: 137781 - RNA, 46 nt, Homo sapiens
guccugacagaccugcggucugcccuggucaacaacaccaucuuug

SEQ ID NO: 137782 - RNA, 48 nt, Homo sapiens
ucucaaucucuugguuugugguaaauucauuucuauaauagcucaagu

SEQ ID NO: 137783 - RNA, 46 nt, Homo sapiens
ugaagauuccaccaagauguauguuugaucauccagaugcagauaa

SEQ ID NO: 137784 - RNA, 27 nt, Homo sapiens
auuuucaucagauuuugaggauuuuga

SEQ ID NO: 137785 - RNA, 45 nt, Homo sapiens
aggaggagagccugauguggagggcuccgaaggaagaggcugacu

SEQ ID NO: 137786 - RNA, 44 nt, Homo sapiens
agauaguaaagcuguuccauuaaugugaauaaacagaaaccuuu

SEQ ID NO: 137787 - RNA, 48 nt, Homo sapiens
cagccugcuacguuucaggcagagagggagaguacuuuuggcuauagu

SEQ ID NO: 137788 - RNA, 35 nt, Homo sapiens
agaggugguugcaggaagaaaguaucagaggcuug

SEQ ID NO: 137789 - RNA, 45 nt, Homo sapiens
cuuacccugaugcgcaugagggccgccuuucauauaugagaagca

SEQ ID NO: 137790 - RNA, 46 nt, Homo sapiens
ucuccccagcauacuuuaucgccuucacugccuuuugacugcagag

SEQ ID NO: 137791 - RNA, 46 nt, Homo sapiens
uaagcagugcugagaagaggaaagccaaaugggaaagucugcagaa

SEQ ID NO: 137792 - RNA, 58 nt, Homo sapiens
aaaguauacaaaagaaacacccuuuguuuuuaaauuagaagauuaccaagaugccguu

SEQ ID NO: 137793 - RNA, 71 nt, Homo sapiens
acuuuggauauugacuuuaaauucauggaagauauugagaagucugaagcucgcauaggcauucccaguac

SEQ ID NO: 137794 - RNA, 48 nt, Homo sapiens
auacagcuuugguaugaaacuuaucuguaucauguuuuaacaagcuaa

SEQ ID NO: 137795 - RNA, 53 nt, Homo sapiens
ucaccaguauauauucucacauauucuucggcuugaaaaaccugcacuagaau

SEQ ID NO: 137796 - RNA, 59 nt, Homo sapiens
gaguugaagaagucugguuucauguugucucuacaaaugcuugaguugauuacaagacu

SEQ ID NO: 137797 - RNA, 42 nt, Homo sapiens
auaccacaagaugcuuuggaauacugacggccaaacccauac

SEQ ID NO: 137798 - RNA, 45 nt, Homo sapiens
aacuggaugaccauuugaugccaguugggaaagagacuguuaaau

SEQ ID NO: 137799 - RNA, 50 nt, Homo sapiens
aaauauggacaguaacuguugacugcuuaaguuauugagugauuggaaaa

SEQ ID NO: 137800 - RNA, 36 nt, Homo sapiens
acaugagaccaaccugcuuauugcaacaaguauugu

SEQ ID NO: 137801 - RNA, 46 nt, Homo sapiens
cuggcaaacaagauccagagcuggcuuauaucaguagcaauuucau

SEQ ID NO: 137802 - RNA, 47 nt, Homo sapiens
gccagcuuucaguuacaggcacuguggguuaauacagaggagcaggc

SEQ ID NO: 137803 - RNA, 74 nt, Homo sapiens
guacauauacacacaaaguauaggcuaugaauuggugccagaauuuaccuaugucaugaguuaaguacaaagau

SEQ ID NO: 137804 - RNA, 53 nt, Homo sapiens
gugcaacauccguaugcuauuauguaacugucagugaucuuuuuuuagugaaa

SEQ ID NO: 137805 - RNA, 63 nt, Homo sapiens
agaaucagccauuuugccgaggagacuugguuucuuuucugcccacuuuguggauguauauuu

SEQ ID NO: 137806 - RNA, 39 nt, Homo sapiens
uuggaaggaagucuccaagucuagcccacccugguaggg

SEQ ID NO: 137807 - RNA, 33 nt, Homo sapiens
auugccaggagacggaccugggagagcgugacu

SEQ ID NO: 137808 - RNA, 47 nt, Homo sapiens
ucuguuugauuauuuuauugaaaaaaggagaugguucuaggcauaua

SEQ ID NO: 137809 - RNA, 54 nt, Homo sapiens
uguaaugucuuugaaccuucauuuccuucgucauccucccuguguguggauuca

SEQ ID NO: 137810 - RNA, 46 nt, Homo sapiens; identical to SEQ ID NO: 41950

SEQ ID NO: 137811 - RNA, 51 nt, Homo sapiens
gaaguaaaugcaucuuggacaaaagagagauggaaccaagaguuuacuaag

SEQ ID NO: 137812 - RNA, 46 nt, Homo sapiens
aaaccagguugcucaacaagugucagcugucagaacucauucagau

SEQ ID NO: 137813 - RNA, 51 nt, Homo sapiens
gaggaaaucagcuaugaagaagaaaggugguguaggguucucugaagcgag

SEQ ID NO: 137814 - RNA, 46 nt, Homo sapiens
auguucugcuucuguauuucuuuugaauggauugcuuuuggaacau

SEQ ID NO: 137815 - RNA, 43 nt, Homo sapiens
uccccagcuuuaaaaaauaaaacauuccuaauuuauuuuuaga

SEQ ID NO: 137816 - RNA, 35 nt, Homo sapiens
uauguucuuugcaacauuauucauaauagccaaaa

SEQ ID NO: 137817 - RNA, 74 nt, Homo sapiens
ugcugguuucauccuaaggcuggaucuuuucaugggucuguguaguguaauugcagcagcaaaugggacuaaua

SEQ ID NO: 137818 - RNA, 46 nt, Homo sapiens
cuuugaguuugguugauccagcaguuuauugaugucaucaaugacc

SEQ ID NO: 137819 - RNA, 44 nt, Homo sapiens
ucaaacauuaaaacgguaaaucugugauucaucauguggaaaga

SEQ ID NO: 137820 - RNA, 43 nt, Homo sapiens
guguucuugaauuauuuuauuuauaaacuaauucuauaaaaau

SEQ ID NO: 137821 - RNA, 58 nt, Homo sapiens
uauaauacuuuuugaaguauuuagaagcuaacacaguuuuguggggaagaauauugcu

SEQ ID NO: 137822 - RNA, 62 nt, Homo sapiens
ggaugucaguaagacuguuacuagaaguaagacaugacaggcuuaaguuuggccuuagaguu

SEQ ID NO: 137823 - RNA, 55 nt, Homo sapiens
aacguguguuggucuaaaaaguaagacugguuguaucgugguguauacuugauga

SEQ ID NO: 137824 - RNA, 47 nt, Homo sapiens
cauggagugaugugcuuuauugaaugccagaggaagauauuggugag

SEQ ID NO: 137825 - RNA, 73 nt, Homo sapiens
acacuaacuccugauuccauccuaccuucaaugccagagaaccaccauucuacuuccugucacugacuacugg

SEQ ID NO: 137826 - RNA, 43 nt, Homo sapiens
ucauauaguggguuguacaguacuuguagugcuaucuucuaga

SEQ ID NO: 137827 - RNA, 68 nt, Homo sapiens
cucugccuggaggucagagccagcaaaccacugaguguguccuuaggaaccugaagauccgcggaaac

SEQ ID NO: 137828 - RNA, 44 nt, Homo sapiens
cauccacgcaucaagagcaggacacuguaaaacaaagacaggau

SEQ ID NO: 137829 - RNA, 46 nt, Homo sapiens
agaucagaaacauagacgaaaaauagaaaagauaaaaaauauuaga

SEQ ID NO: 137830 - RNA, 48 nt, Homo sapiens
gcauaauuguuguuucagaaguccagcaucuggugcacuuaacaauag

SEQ ID NO: 137831 - RNA, 48 nt, Homo sapiens
ccauggcaaugcggugggcgcgcgcuugucguguuggucucuugggag

SEQ ID NO: 137832 - RNA, 46 nt, Homo sapiens
cugcggcugcacggcguccgcgauuacgcggccuacaacgugcugg

SEQ ID NO: 137833 - RNA, 46 nt, Homo sapiens
ggucuuugguuugugaauuuauuuucucuuguuuaauauaacugga

SEQ ID NO: 137834 - RNA, 65 nt, Homo sapiens
ccccaaauuuuguguagcuucuuuuguuauggaaaauggugaacaaaaaaagaaacugugauaac

SEQ ID NO: 137835 - RNA, 65 nt, Homo sapiens
ugagaauaggcagcccccaaauaaaaaauauucauggauuuauuuauuuuccuuuggagauaagg

SEQ ID NO: 137836 - RNA, 50 nt, Homo sapiens
uaguuuaucuaacuucgugcggaaucagcuucuauccuugacuuagauuc

SEQ ID NO: 137837 - RNA, 92 nt, Homo sapiens
cgccugcaaacgcugccugccgguaaacacgccugcaaacgcugccugcccguaaacacgccugcaaacgcugccugcccacacagguucac

SEQ ID NO: 137838 - RNA, 34 nt, Homo sapiens
gaaauacuagugcugugagggacagaagggacag

SEQ ID NO: 137839 - RNA, 34 nt, Homo sapiens
agcacuaccacuccugccaaggaggauuccauuu

SEQ ID NO: 137840 - RNA, 53 nt, Homo sapiens
ggcuacaggcagguccugcaggcccuggguagagcucauccucugucugucca

SEQ ID NO: 137841 - RNA, 46 nt, Homo sapiens
cguuuacuaugccugugucuucuccaccacgcuggggucugggagg

SEQ ID NO: 137842 - RNA, 59 nt, Homo sapiens
uguaggcuggccaggcucaggcccuggggugaaaggagacaggugcugccaagaccugg

SEQ ID NO: 137843 - RNA, 33 nt, Homo sapiens
guggaggacaugcuucucgagcugcugccagau

SEQ ID NO: 137844 - RNA, 42 nt, Homo sapiens
accuugaugugguacacuaagcgccagaaacuggagucugag

SEQ ID NO: 137845 - RNA, 50 nt, Homo sapiens
ucuacccugauggacgauaccgauccucagacuccaguuucuggcgcuua

SEQ ID NO: 137846 - RNA, 42 nt, Homo sapiens
gggcagccccugggagcuugggaugcccuaggaagggcgagg

SEQ ID NO: 137847 - RNA, 63 nt, Homo sapiens
gacgccauggccgagugcccgacacucggggaggcagucaccgaccacccggaccgccugugg

SEQ ID NO: 137848 - RNA, 53 nt, Homo sapiens
ugcaaggaaccuucugccccuacuucucagaagauccuccugccuaccaaaag

SEQ ID NO: 137849 - RNA, 41 nt, Homo sapiens
guucucugggaccucaccaaaauccaccccaacguccaggg

SEQ ID NO: 137850 - RNA, 48 nt, Homo sapiens
uaguaccuaaggccuuccaugaaugugaacaugauuuucuagaagaua

SEQ ID NO: 137851 - RNA, 49 nt, Homo sapiens
cugggcuuccaugaugaagaaagagacagcgcaggagcaaaauguccag

SEQ ID NO: 137852 - RNA, 53 nt, Homo sapiens
agcugcccugcucuucgagcgccccccacugcuuccugccccaagccccagag

SEQ ID NO: 137853 - RNA, 53 nt, Homo sapiens
uccaauaagcacauauugagcacuugcuguauaugcaguauugagcacuguag

SEQ ID NO: 137854 - RNA, 75 nt, Homo sapiens
acugggcacugccaccaccagaaagcuguucgacgagacggucgagcagggugcugugggugauauggacagcag

SEQ ID NO: 137855 - RNA, 81 nt, Homo sapiens
aucuggaggaagaaaacaggugaaagaagaaguaaaaaccauuuaguauuaguauuagaaugaagucaaacugugccacac

SEQ ID NO: 137856 - RNA, 42 nt, Homo sapiens
gaauuccaggaaggcaaagaagugguaaggggcccagcagac

SEQ ID NO: 137857 - RNA, 47 nt, Homo sapiens
ucaugcuaggcacacugcccccuugaauagacauuauaugcacaguu

SEQ ID NO: 137858 - RNA, 33 nt, Homo sapiens
ugcaggaaaucuuguuuacuggaagauagaguc

SEQ ID NO: 137859 - RNA, 30 nt, Homo sapiens
ugaauugcucucugacacgguugugccagu

SEQ ID NO: 137860 - RNA, 45 nt, Homo sapiens
ugaauuuauuauaugaagcuuuaagugaaguuaucaaaguuagug

SEQ ID NO: 137861 - RNA, 71 nt, Homo sapiens
acuccacaaaauuaucauauguuucucuaaugagcucguuuuuauuuuuaacuuugcuuugucauaguuua

SEQ ID NO: 137862 - RNA, 46 nt, Homo sapiens
cagagagauuaguugacuugcucaagaccacaguucguggccaagg

SEQ ID NO: 137863 - RNA, 21 nt, Homo sapiens
ucugugauguaugugugcugg

SEQ ID NO: 137864 - RNA, 42 nt, Homo sapiens
acaagucuuucugcagaaguagagcuucaaaugacuccagau

SEQ ID NO: 137865 - RNA, 26 nt, Homo sapiens
caauuguguuuuucaucauuauugcu

SEQ ID NO: 137866 - RNA, 41 nt, Homo sapiens
uaucuaacuucaggagaguuaaaguagggaaaauuacuaga

SEQ ID NO: 137867 - RNA, 47 nt, Homo sapiens
ugaugacuuuugcauucuuuuugcaccaaaagcagccaugcagguaa

SEQ ID NO: 137868 - RNA, 47 nt, Homo sapiens
ggagaagguaaucuuggcaaggucauuaacaucaacagagcacagac

SEQ ID NO: 137869 - RNA, 46 nt, Homo sapiens
guuacacuguuccagcgauguuguccauaucagaacgugcucagac

SEQ ID NO: 137870 - RNA, 43 nt, Homo sapiens
gugcguaaauaauuuuaaagcauuuuaacucugggauaaugcu

SEQ ID NO: 137871 - RNA, 17 nt, Homo sapiens
ugaauaacaugucuuga

SEQ ID NO: 137872 - RNA, 46 nt, Homo sapiens
acauuuauagguguuucacaauguauaaaugcuaauaacauaaaua

SEQ ID NO: 137873 - RNA, 110 nt, Homo sapiens
gcgaaugaaaaguaaggcagggauauucugcuuuuuagaauguaauauagagaauaaaguaauugcuuuugucagaguauucaggaaucaucaagagagugggauggagc

SEQ ID NO: 137874 - RNA, 50 nt, Homo sapiens
ggagugagggcuuuuccuccaggucagccuaggugaaaauccagcucugg

SEQ ID NO: 137875 - RNA, 52 nt, Homo sapiens
ucccuugaguaguguguaagucuguguuucauguauucaguuuuagccuaug

SEQ ID NO: 137876 - RNA, 49 nt, Homo sapiens
acagcuaacuagaaauuuaccagagauagcaccuucugacccagugcag

SEQ ID NO: 137877 - RNA, 46 nt, Homo sapiens
cacuuuuauagauacuguuuugagaauugaacaugugccagaaaau

SEQ ID NO: 137878 - RNA, 52 nt, Homo sapiens
gugagguuuuauuuaguccuuaugggaaaucagagguagugauauuugaauu

SEQ ID NO: 137879 - RNA, 37 nt, Homo sapiens
guguauccagccugugaauggucgucuggcccuagua

SEQ ID NO: 137880 - RNA, 44 nt, Homo sapiens
uugggaauuguuuggacccgagugugacacggcucagagaaaug

SEQ ID NO: 137881 - RNA, 56 nt, Homo sapiens
cuuaaaaggcuucaaugaagaaauaacauuaaguaauuugugucuuauuucuagga

SEQ ID NO: 137882 - RNA, 38 nt, Homo sapiens
augggugaguggcauuggggcauggacccuaggugagu

SEQ ID NO: 137883 - RNA, 45 nt, Homo sapiens
augcuucaacuagaacaauuuauugcaacagauugaaugcagaag

SEQ ID NO: 137884 - RNA, 49 nt, Homo sapiens
aaaguucuucaguuauaauuuccaauguaguggauauugguaagcauaa

SEQ ID NO: 137885 - RNA, 104 nt, Homo sapiens
guucugccuuaaacauguuuucaguccauauuuuuugguagagaaguuggaaggcaagguauuggaguugaguaaauuuaugagccuacucaguuccuaucccu

SEQ ID NO: 137886 - RNA, 37 nt, Homo sapiens
aauaauuaauauuuaaugcacauugagauacuuuaga

SEQ ID NO: 137887 - RNA, 33 nt, Homo sapiens
agaccuuuaaacagcaaauucuacugugaugaa

SEQ ID NO: 137888 - RNA, 47 nt, Homo sapiens
acuguaguuuaucugauugguuucaaagaagaauauuuagcaaguuu

SEQ ID NO: 137889 - RNA, 41 nt, Homo sapiens
guuaaguaguagcuauaaauuggggcaguugacucuguuaa

SEQ ID NO: 137890 - RNA, 55 nt, Homo sapiens
uuuggaauaaaguaaauaaaaauuuccagcuugcgucugauuuauuuccccauca

SEQ ID NO: 137891 - RNA, 63 nt, Homo sapiens
uagugagaaaguuaaaguagacaggagcuuuccaagcauuguuuauugugacaaugaaagccu

SEQ ID NO: 137892 - RNA, 35 nt, Homo sapiens
cagagaaacauauuacucgcacaaaacaaaaauag

SEQ ID NO: 137893 - RNA, 36 nt, Homo sapiens
acucuuuguuuggaacauuugaaaacugaaacucag

SEQ ID NO: 137894 - RNA, 76 nt, Homo sapiens
uaccucagcaucuugucuuuuaggaaaaugacuguugaccugauuccacauuaaucucucccuuuuaugaccccaa

SEQ ID NO: 137895 - RNA, 47 nt, Homo sapiens
uuuaggugcugauauugaugcguuguguguugcaccaagacauguug

SEQ ID NO: 137896 - RNA, 108 nt, Homo sapiens
acuuuuucaccucauucuaugauaaguugaaauuacaggaagaaguaaaagauuuaagagugcguaaauguucggggugaaaugggaugaguuaugaacauucauuua

SEQ ID NO: 137897 - RNA, 33 nt, Homo sapiens
ggcuguugaagaggcauucguaccaguuauuaa

SEQ ID NO: 137898 - RNA, 51 nt, Homo sapiens
gguugugauauuaauaacaauuaaggcuuuuaaauggaagugacugccuau

SEQ ID NO: 137899 - RNA, 40 nt, Homo sapiens
aaguaaugcuuugcuuugacuucauuuaaaaauugggaga

SEQ ID NO: 137900 - RNA, 1184 nt, Homo sapiens
aguguuuuaaguaaacguaaaaauaaucuguaauauaaaguauaaguugaggccucauuuuccuaaaaagaauauuacugacaaagaggacuuuuuuuuggaaggagaccugaccuaacuuuguaaacuuuacaggaucaagauggaaaguuagauggcuacuuaaaacauuuaauguguuaauuuucuauuauacaugcuauauuaaaaaauaauauuuuaggaacauaauauuuuaggaaauuuaguaaucauuuucacauuucaauauuuuuugaaguaauuccauccuuuaaaaaaugugucaguauuauuacugaguugcuuuuucaguuaccuaguuuuaugagccuauaaucuuuauuucuguccaaauugggggagacuuugaaaucuguucuuuuucauugaacaguuuauccuagaccacaaguacuuauuuguguaacaguacaauuuuuuuucuguagguauguuuaaaugauauuuuaaaaugugcuccuaaaauacugcuuuuuaaaaagugaucuaguagccaggcacgguggcucaugccuguaaucccagcacuuugggaggccaagguagguggaucacgaggucaggagaucaagaccguccuggccaacacguugaaacccugucuguacuaaaaauagaaaaaauuagccaggcaugguggcgugugccuguagucccagcuacuuaggagacugaggcaggagaaucacuugaacccgggaaguggagguugcagugauccaagauccugccacugcacuccagccugggcgacagagcaagacucugucuaaaacaaaaaaacaaacaaacaaaaaaaaagugaucuuauaaaaggcuuguuuacagcgacauccacauuuuuggaaccaugaaaucauacccucagggauaacuaccaaagcugugcuguuucuuugcacucucaccuuuccuuuagaaaagaaacaauuuugucagcggaauucuaugucuucaaaauuagccuuaacugugguuguuuuaggcuguacuuuccccaguguuuuuguuuuacuuaaaacucaguuggaaaaacauacuguaguauuacagacauaaaaguucucagauauaauggaaucucuuuauugagaauuauuuuuggcuaaauguaaggauguuugccuuauauuugaguacua

SEQ ID NO: 137901 - RNA, 49 nt, Homo sapiens
uacuuuuuaguauguaaucaauuuauaauucauauagaugaagagcuaa

SEQ ID NO: 137902 - RNA, 376 nt, Homo sapiens
uuucuguuuuaaaaauauugccauguuuguuuguuuuuuuuuuucuuuuuuuuuuuucugaggcagggucuuacuuuacccaggcuagaggcaguguugcaaucacaguucacuguagccucaaccuccugggcucaagggauccuccuaccucagcccccccaaguaggugggacuacaggcgcuugucaccaugccuggcuaauuuuuaauuuuuuuuguagagauggagucucacuauguuguccaggcugaucucgaagacagccucaagcagucuuccugccuuggcucccaaagugcugggacuaccggcgggagccacuacccccagccuauauugccauguuuuaaaauuaucuaauuaaaauaccua

SEQ ID NO: 137903 - RNA, 645 nt, Homo sapiens
uaaggaaaauuagguuuuuguuuugcuguuuugagucaggguuuuacuccugucacccaggcuggagugcgguggcaugguuuugacuuaccgcaaccuccgccuuccaggcucaaaugauuuuucugccucagccucccacaggugcaugggagguccauagcugagaccacaggugugugccacuacaccuggcuaauuuuuuuguaguuuuuguuuuugagacggaguguugcucugucacccaggcuguagugcaguggugcggucucggcucacugcaguucugccuccuggguucacaccauucuccugccucagccuccccaguaacugggacuacaggugcccaccaccaugcccggcuaauuuuuuuguauuuuuaauagagacgggguucaccguguuagccaggauggucucgaucuccugaccucgugauccgccugcccaggccucccaaagugcugggauuacaggugcgagccacugugccagaccuguauuuuuuuuauagagacaggguuucgccauguugcccaggcuggucuugcucaaguguuccaccugccucagccucccagagugcugggauuuuuuguuuguuuguuuuuucauagaaaugccuuaaaaguaguuugacag

SEQ ID NO: 137904 - RNA, 50 nt, Homo sapiens
ucugaauuuuagcagcuaagauccaauuuauugauagguugggaaaucag

SEQ ID NO: 137905 - RNA, 38 nt, Homo sapiens
uuauuggaagaauuuucuuuccugucacaaggacauac

SEQ ID NO: 137906 - RNA, 50 nt, Homo sapiens
ucaguugauauguguaggauuuuaaaucaugugaaauauaccugacauuc

SEQ ID NO: 137907 - RNA, 59 nt, Homo sapiens
uuuuuaaaugccgcuucugagauaauucaaguuaacauguaacuagcaguaaaucauua

SEQ ID NO: 137908 - RNA, 55 nt, Homo sapiens
ggucuugaauuacguaaacauagaauugcaaacauuuuugacuaagauaugccag

SEQ ID NO: 137909 - RNA, 49 nt, Homo sapiens
uuuuaacuauguuuuuaacuauuuuuauuggaaacuauauauuuuuaaa

SEQ ID NO: 137910 - RNA, 54 nt, Homo sapiens
uguaaaauaggggaccaugauuuuucguacaucaacaaaaugucuaauuuagau

SEQ ID NO: 137911 - RNA, 47 nt, Homo sapiens
ccuuuauaaauaaagaacauuguauaucauuuaagguuuuguugaag

SEQ ID NO: 137912 - RNA, 71 nt, Homo sapiens
uuauaaaauguguuagaaaguauuaggaagguuuuagacuuuucaaagaguaaaauaauuuuaaaauugug

SEQ ID NO: 137913 - RNA, 48 nt, Homo sapiens
aguuguaaauaguuuguuuuaaaaagacuucauuauuuauuugaucau

SEQ ID NO: 137914 - RNA, 101 nt, Homo sapiens
ugguuuaauauccagcacaaagcguguaaauaaaauaaauagcauguugucuuuaucuucaaaggcauuauauuguacuucuagcaagugcaccaacagaa

SEQ ID NO: 137915 - RNA, 42 nt, Homo sapiens
uuacacuggcucaugugaauccccagucauuuccagcaccca

SEQ ID NO: 137916 - RNA, 42 nt, Homo sapiens
gguuaguguuuaaaaaaacagaaaacucugaaaaccucagug

SEQ ID NO: 137917 - RNA, 46 nt, Homo sapiens
gcuacugaaguuucugugccacaaguaaauuccagugaaagcucag

SEQ ID NO: 137918 - RNA, 46 nt, Homo sapiens
agcauuccucaaacugccacacaaccagccauuucuccaccaccaa

SEQ ID NO: 137919 - RNA, 42 nt, Homo sapiens
ugaacucuuagugguuuuggaaauguacuuuagguggugauc

SEQ ID NO: 137920 - RNA, 54 nt, Homo sapiens
agguuuaauuauuuuauaguuuuaaaguuuauaaaguaaagcauugauuggcaa

SEQ ID NO: 137921 - RNA, 64 nt, Homo sapiens
uauugugaugagugaaacacauucugugccuuuaaaggagcuuauaauuaaguagacaagauaa

SEQ ID NO: 137922 - RNA, 47 nt, Homo sapiens
acccuguguuuucugaugaguagaaucagugcacugauuacuagaga

SEQ ID NO: 137923 - RNA, 46 nt, Homo sapiens
cuugaucccuccugucuuccaguuugucuucuuuauuagccaccaa

SEQ ID NO: 137924 - RNA, 28 nt, Homo sapiens
ccaacucaaccuguugucuucaaaugcu

SEQ ID NO: 137925 - RNA, 46 nt, Homo sapiens
uuuauggaauuguuuuauagugcauacaaaucagcgaucagccagc

SEQ ID NO: 137926 - RNA, 51 nt, Homo sapiens
aaucuguugucuucaaaacaaacaaacaaaaaaagcuucuugcgccuuucc

SEQ ID NO: 137927 - RNA, 46 nt, Homo sapiens
uuguaugcacaagguaggacuuacuucguaagaaacaaaaugccag

SEQ ID NO: 137928 - RNA, 106 nt, Homo sapiens
cauucuaucacaugugcauuuuucauguuaaacugcaauuacuuaaucucuuccccuauccuucuaaauuaauuuucugaaguuggaguguagucuuuucccccuu

SEQ ID NO: 137929 - RNA, 65 nt, Homo sapiens
caauauuucuacuucccacaucuuugcuuuacacagucaccuugcccuuccuuccaccaccgaag

SEQ ID NO: 137930 - RNA, 123 nt, Homo sapiens
uuggggaaaacaauucaguuuauuaaacguuucauguaacugcacccaaguuuugccaagcuggaaacuuggaccuuuucuguguagugacuuuuuaauuauaguuuucauaaccuggagauc

SEQ ID NO: 137931 - RNA, 48 nt, Homo sapiens
gucuuggcggaugagggucuaaagagagacuuggcagggaugggaaga

SEQ ID NO: 137932 - RNA, 47 nt, Homo sapiens
aggcggggcccgggucgagauucguccaaucaaagcucuggcggggg

SEQ ID NO: 137933 - RNA, 29 nt, Homo sapiens
auguuuauaaacagauuaauggauuuaua

SEQ ID NO: 137934 - RNA, 48 nt, Homo sapiens
uguacuugcggcacuugugguguaggcugaagagaugggggcuguugc

SEQ ID NO: 137935 - RNA, 45 nt, Homo sapiens
guaagagcacaauuuuagaaucuaugaucaggugaugaacagaaa

SEQ ID NO: 137936 - RNA, 43 nt, Homo sapiens
cugcucaaaugcaacucuuccuucaaggucauauauaguuugu

SEQ ID NO: 137937 - RNA, 64 nt, Homo sapiens
cauggaccacacucgcugaagcgagcucauaucuuaggugggaagcaguagacucugggaggau

SEQ ID NO: 137938 - RNA, 42 nt, Homo sapiens
cagagugagcgucagccccacucaggaggcaccacacgugca

SEQ ID NO: 137939 - RNA, 42 nt, Homo sapiens
cccugcggccccgcggcuggcagcccgcacccccaccacccc

SEQ ID NO: 137940 - RNA, 42 nt, Homo sapiens
ccuccucccgcccuccgggccggcgcuccgcuucccccuucc

SEQ ID NO: 137941 - RNA, 44 nt, Homo sapiens
uauccauaagcucuuuagcuucucuuuaguaauaauuccaaauc

SEQ ID NO: 137942 - RNA, 39 nt, Homo sapiens
agccccuuuauuccacuuccccccucuccuagguuuaag

SEQ ID NO: 137943 - RNA, 39 nt, Homo sapiens
auuuaacuuaaaaguuuacaucuuugugguauuuucagc

SEQ ID NO: 137944 - RNA, 30 nt, Homo sapiens
uauuuagcuuccaauuucugggaggcucaa

SEQ ID NO: 137945 - RNA, 33 nt, Homo sapiens
aggauugccaacuuugcucccugcagaacucaa

SEQ ID NO: 137946 - RNA, 46 nt, Homo sapiens
gcgaccccaacuccuccaucuuccucaccgacacggccaagcagau

SEQ ID NO: 137947 - RNA, 749 nt, Homo sapiens
aggacggauauccagugccuuaucccaugugccauugaccaggucagcaggcagaaaagcaaggcucucuaagucuggggcauugacagcagguuccucuuacucuucagcggggagagguauugaaagauaugaugggcagccaggcaggguggcucacgccuguaauaccagcacucugggaggccaaggcaggcggaucacuugaggccaggaguucaagaccagccuggccaacauggcgaaaccccgucucuacuaaaaauacaaaauuuagccacaugugguggcaggcgccuguaaucccagcuacucgccucgcuugaaccccagaggcagagguugcagcgagagcgcaucacugcacucuagccugggcgacagagcaaggcucugucucaaaaaaaaggaaagaaaguuggggaguggggcaaggggagggagagcauuaggacaaauaccuaaugcaugcggggcuuaaaaccuagaugacggguugaugggugcagcaaaccaccauggcacauguauaccuauguaacaaaccugcguguucuguacauguaucccagaacuggaaguaaaauuuaaaaaaaaaaaaggaaaagaugaaggggaggagggagugaauuucuuugguuggaagcaugagagccuucugggaagaugcucacagggacugcucauggcugaaagcuggcauguuuucuggccgcccucaucaggguccuuacucuccccacaggauc

SEQ ID NO: 137948 - RNA, 45 nt, Homo sapiens
aauggcacaugggauaaggcacuggauauccguccugucucggaa

SEQ ID NO: 137949 - RNA, 39 nt, Homo sapiens
uuuccugccauccaggcugcucccuccuucagcaacuca

SEQ ID NO: 137950 - RNA, 41 nt, Homo sapiens
aggagagcuggggcgcccacgagaggaucccucacccggug

SEQ ID NO: 137951 - RNA, 54 nt, Homo sapiens
ugccgagagccugccugauccuggguccugcugcuggaggcggccacuucgccu

SEQ ID NO: 137952 - RNA, 46 nt, Homo sapiens
aguccuuaagggugggcugggugguagggacuucaguucagaggag

SEQ ID NO: 137953 - RNA, 46 nt, Homo sapiens
gauuuccuguauuagaagccgccucuagaaucgcguuaauaguggg

SEQ ID NO: 137954 - RNA, 53 nt, Homo sapiens
gggcauauuugccucgccagcuguuggccagguuuuugguggaucgugggcgg

SEQ ID NO: 137955 - RNA, 44 nt, Homo sapiens
auccaaauacacagguuuagugcaguguggaccccaggcaaaau

SEQ ID NO: 137956 - RNA, 62 nt, Homo sapiens
agagagaggcugugacaaggucagugaggggccaucgugcgggggcuagaaauuguuguugu

SEQ ID NO: 137957 - RNA, 129 nt, Homo sapiens
caaggggccugcugcccaucuacaccucacgguacuucaacccuccugcuaucauuucauaaccaacguggcgggcagaaucucccaaccccaccaccauccuugcaccacccccagacccacuagcaa

SEQ ID NO: 137958 - RNA, 49 nt, Homo sapiens
acuaggagcacgguuuccuggaucccaccaacauacaaagcagccacuc

SEQ ID NO: 137959 - RNA, 35 nt, Homo sapiens
cuccaaggcccugggugggcuucuggaaugagcau

SEQ ID NO: 137960 - RNA, 53 nt, Homo sapiens
uaaaugagauaaaagaggccucaggcaggaucuggcauagaggaggugaucag

SEQ ID NO: 137961 - RNA, 50 nt, Homo sapiens
uuuuuauguaauauguguauguaaacgaggcagccucauuuccaggugag

SEQ ID NO: 137962 - RNA, 48 nt, Homo sapiens
uuggucacauugcuggcaacagaagggguuggaguuggacccagggug

SEQ ID NO: 137963 - RNA, 47 nt, Homo sapiens
ccaaaugcuguaacuacuaugaaagugcuuuguaaauugcuguggaa

SEQ ID NO: 137964 - RNA, 48 nt, Homo sapiens
caggaauuucuuucgucccguuuuaagccaaccaguuuuguccggaca

SEQ ID NO: 137965 - RNA, 45 nt, Homo sapiens
agacaauagcugcccagccucugaaaggggcugauuggauuaugu

SEQ ID NO: 137966 - RNA, 42 nt, Homo sapiens
gaggcuccacagauugggccccacuggaucauugaaccccug

SEQ ID NO: 137967 - RNA, 44 nt, Homo sapiens
ucugcauuucugacuuugcugugccggcagccuggagccuccca

SEQ ID NO: 137968 - RNA, 74 nt, Homo sapiens
gcucccccuucucucguucuuagcauccccuaggaacuugcacacccaggucucucgacuucuggaccugcuuc

SEQ ID NO: 137969 - RNA, 47 nt, Homo sapiens
uaggguuaaucgucuuuaucuggcaggucaggugggaugucucacag

SEQ ID NO: 137970 - RNA, 68 nt, Homo sapiens
aagcauucaugggaaaauacaacuggaggcaccacuagauuuucguauacauuagguucccacgggga

SEQ ID NO: 137971 - RNA, 42 nt, Homo sapiens
agugacaaaucccaggaagcuuucacaucaaaucacccuauu

SEQ ID NO: 137972 - RNA, 86 nt, Homo sapiens
ggauuccaguauucgucgcauaaggauccuucuuugucugcgaaggaaaaacacacugauuaucauaaugaggugaacuggccacc

SEQ ID NO: 137973 - RNA, 44 nt, Homo sapiens
auucucucaccugcgaguugcucauugcugcuuucagggccccu

SEQ ID NO: 137974 - RNA, 45 nt, Homo sapiens
ugaauuuccaaguacauuucuccaaauaaugucaaaaccuggcaa

SEQ ID NO: 137975 - RNA, 45 nt, Homo sapiens
cugucuguccucucagcucgcgucaccccugagcccuuggcgauc

SEQ ID NO: 137976 - RNA, 35 nt, Homo sapiens
ggacugugugugagagaggaguucauuaagggaga

SEQ ID NO: 137977 - RNA, 48 nt, Homo sapiens
cugagcgcagaugaguuuucccagguucugugaaugcgcccuuucaau

SEQ ID NO: 137978 - RNA, 31 nt, Homo sapiens
ggagcuccaaggcugcacaaugacgcacuua

SEQ ID NO: 137979 - RNA, 47 nt, Homo sapiens
gccugaugccugaaauauagccaaagagacagaauggggcugcgggg

SEQ ID NO: 137980 - RNA, 46 nt, Homo sapiens
cagaggcaccagggacaaagucccugccgugacaggaggggggcac

SEQ ID NO: 137981 - RNA, 50 nt, Homo sapiens
agccauaaguuguuuauaccaaagacaugccagaucaguuaggugcuguu

SEQ ID NO: 137982 - RNA, 42 nt, Homo sapiens
aaggccaaaauauuuuuauauugccacagacaaagccaccua

SEQ ID NO: 137983 - RNA, 45 nt, Homo sapiens
agguuucucauggggauggucauucaccacgguccagaggggcag

SEQ ID NO: 137984 - RNA, 71 nt, Homo sapiens
cuaagggguauguguaacucaaauauaugccucugacauuugacaaugaaaaagaaccuaaaugaaagaaa

SEQ ID NO: 137985 - RNA, 49 nt, Homo sapiens
agauuuugaggcccgucaaaaugaaaagaugcaaguuagggaacaagug

SEQ ID NO: 137986 - RNA, 64 nt, Homo sapiens
cccugggcaccccagcugcaugaaaaugaaggacaggagguauggaaagcuaugacagaagaga

SEQ ID NO: 137987 - RNA, 58 nt, Homo sapiens
uccacuaauagaggaauaaaugccuaauaaaaagagagcaagcaggaaggaaggaugc

SEQ ID NO: 137988 - RNA, 50 nt, Homo sapiens
aaaagaaugacagaaagaaagagggagugguggaaagaaacaauaggaug

SEQ ID NO: 137989 - RNA, 62 nt, Homo sapiens
uacaaacauauugaaugaauaaauaaagacauaaauaugugggagaguggaccacgcaagga

SEQ ID NO: 137990 - RNA, 46 nt, Homo sapiens
gagguccauaaauaaaagaauaaguauugaaaugaaagaaugacag

SEQ ID NO: 137991 - RNA, 79 nt, Homo sapiens
gaaaagaggcaggaagagaagugucagggagucaaagauagagcuaaggaaaggcaaaaaugaaacuaaaugaaagcga

SEQ ID NO: 137992 - RNA, 41 nt, Homo sapiens
agggaaaauggagaaaauauaaaaagaugugaaaaaggaaa

SEQ ID NO: 137993 - RNA, 71 nt, Homo sapiens
uaaauaaaagaauaaauacuuaaacgugaaaggugacuaaaugcggggaagaaagauugcaaauaaauaca

SEQ ID NO: 137994 - RNA, 87 nt, Homo sapiens
aaaaaauuaauaaggaaaacaaauacccaaaauaaggaagacugacaaaugagugaguggaugagagagugaauggugcuugacgua

SEQ ID NO: 137995 - RNA, 385 nt, Homo sapiens
ccaccugacuuuauaagaaccaagaauggcugggaaugguggcucacgccuguaaucccagcacuuugggaggccgaggugggcggaucaugaggucaggaguuugagaccagccaguuugagaucagccuggccaacauggugaaauuccaucucuacuaaaaaaauacaaaaauuaugggcgugguggcaccugucuguaauccuagcuacucgggaggcugagagaggagaauugcuugaacccgggagguggagguuguagugagccaagauugcaccacugcacuccagccugggcuacagagcaagacacuaucuuagaucaaaaaagaaaaaaaaaaaaagaaggagaaagaaccagagaaacauaaggaagagugag

SEQ ID NO: 137996 - RNA, 92 nt, Homo sapiens
uguuacugaaguccauaaacaaaggacucagaucuaaauggaugaacgaaugacuggaagaaagggugguaggaagguaggaagaaaggaag

SEQ ID NO: 137997 - RNA, 81 nt, Homo sapiens
acucccgcggcaugggucaccugcacaggagguuuugcccaccagggggcagcagagggucagggagcaauaggcccuggg

SEQ ID NO: 137998 - RNA, 77 nt, Homo sapiens
cccagaagccccgggacccaggagcccugggcaagccaccagaaaccuuguucuugcaacucucugcagugugccca

SEQ ID NO: 137999 - RNA, 63 nt, Homo sapiens
gugguccggggacccuggcuuccuugacaugccauccccagagccugguucaaggccucucug

SEQ ID NO: 138000 - RNA, 51 nt, Homo sapiens
gcugacaguccucccccagggccuccccgguucuguugagucuccuuucuc

SEQ ID NO: 138001 - RNA, 42 nt, Homo sapiens
acauggaauucaugugucaggagccaccuuccgagccuccag

SEQ ID NO: 138002 - RNA, 43 nt, Homo sapiens
gacguuggcugcuaggagagccugcucccaacaucuaggggcu

SEQ ID NO: 138003 - RNA, 47 nt, Homo sapiens
uuaagaguuuuguaucuguaauucaaagguucuuuaguucugggaug

SEQ ID NO: 138004 - RNA, 48 nt, Homo sapiens
uauagcacugagcacuguuugcccgugucagaaucccucacccacaug

SEQ ID NO: 138005 - RNA, 44 nt, Homo sapiens
ccccgugcuuuuggccuuuucuucuccugaaagcaaacccuuuc

SEQ ID NO: 138006 - RNA, 48 nt, Homo sapiens
ugugugucggugacaaggcgagaucccugagucaggucaggcuuguag

SEQ ID NO: 138007 - RNA, 47 nt, Homo sapiens
aaucagccaacuguguucccugggugcucagaaaucacagcccauau

SEQ ID NO: 138008 - RNA, 44 nt, Homo sapiens
aagaggaguuaaugcccagcucuguuuagagaaaauugggggag

SEQ ID NO: 138009 - RNA, 44 nt, Homo sapiens
caccccuccccccaacugacaacauuugggcucaaaugcagcag

SEQ ID NO: 138010 - RNA, 29 nt, Homo sapiens
uugcucuucauggaccuguuaacaaccac

SEQ ID NO: 138011 - RNA, 45 nt, Homo sapiens
aggugcagcuggccaucugcacuguggauguggagcaggcggcua

SEQ ID NO: 138012 - RNA, 44 nt, Homo sapiens
ccccccaggagggccaccucccugcccugcgucagaaccgcuac

SEQ ID NO: 138013 - RNA, 41 nt, Homo sapiens
gugauggcugucgugaugcugcugccugcgaugagggacga

SEQ ID NO: 138014 - RNA, 60 nt, Homo sapiens
aggcauugccucacgcgcaguagcacgaggauggcugccagggcuaggguguucuuccag

SEQ ID NO: 138015 - RNA, 46 nt, Homo sapiens
accagauccucaacagcuuccucgcccacuucagcauggcccagau

SEQ ID NO: 138016 - RNA, 57 nt, Homo sapiens
caggguuugccuggcggcaguguuccucuggaaggcucuccuccaccggagguuucu

SEQ ID NO: 138017 - RNA, 43 nt, Homo sapiens
caaaguugaagugggagaagaagaagacccaaugcccggggag

SEQ ID NO: 138018 - RNA, 41 nt, Homo sapiens
ucaucugcuuccuucggguuaaacacgucggccaggucuga

SEQ ID NO: 138019 - RNA, 42 nt, Homo sapiens
gcaaugcauggcgggggcgggcggaagcaguucuucaggcag

SEQ ID NO: 138020 - RNA, 45 nt, Homo sapiens
agucugauugugcucauccugcaaauagaagagaagcuggcagag

SEQ ID NO: 138021 - RNA, 46 nt, Homo sapiens
aaucgggaagggaggagacuccucaagagcaaaaccagaccgagca

SEQ ID NO: 138022 - RNA, 46 nt, Homo sapiens
cuuacgugggccacuggauggcuccuccaugucuuggaguagauca

SEQ ID NO: 138023 - RNA, 47 nt, Homo sapiens
gugugaaccguugcaugacuccuccaggucuuggaguaggucauugg

SEQ ID NO: 138024 - RNA, 24 nt, Homo sapiens
cuccccgcacuccacugcccgacg

SEQ ID NO: 138025 - RNA, 45 nt, Homo sapiens
guagcugggaccguggagaucagaaccuggugguggaaggggagu

SEQ ID NO: 138026 - RNA, 37 nt, Homo sapiens
ucaacaaugagcucaaugagcucaucccccaccccuu

SEQ ID NO: 138027 - RNA, 46 nt, Homo sapiens
agcugcuccugaggcugaucuugccuuucaaggcaagugggcaggg

SEQ ID NO: 138028 - RNA, 82 nt, Homo sapiens
gauggaugacuguggacauguggcuguaaaucauccuccccgucuuacauaggauggggaugcaacuuucaagaguugccuu

SEQ ID NO: 138029 - RNA, 49 nt, Homo sapiens
caagcucuucucauuuuuuggaauccaaagggaagguguggggagcagg

SEQ ID NO: 138030 - RNA, 42 nt, Homo sapiens
aaguaaagcacucccccgugggugcuggacagcuugggaggg

SEQ ID NO: 138031 - RNA, 59 nt, Homo sapiens
caaacacugcagauaaagccaucuuuaaugcuucccucgaucccuccccaucacccccc

SEQ ID NO: 138032 - RNA, 49 nt, Homo sapiens
ugcuuagagauaauaaagaucaacacuauuccuuauaacaacaccucag

SEQ ID NO: 138033 - RNA, 41 nt, Homo sapiens
ugcuuaaugcagaucagugaggaagcgugucacaaaucgag

SEQ ID NO: 138034 - RNA, 65 nt, Homo sapiens
ugccucgaauucuuucuugcaccgaugggcagaugggcagugucggaggaucgugucaucugucc

SEQ ID NO: 138035 - RNA, 50 nt, Homo sapiens
ucaggcuggcacccccccacugccccagccugcgcuauaccacguucccc

SEQ ID NO: 138036 - RNA, 31 nt, Homo sapiens
aguaacgaugaggggcucuggggaaggacag

SEQ ID NO: 138037 - RNA, 37 nt, Homo sapiens
uucaaaucaaccuuuuaauagguuaaaacaacagcac

SEQ ID NO: 138038 - RNA, 48 nt, Homo sapiens
acaaacaguuuuucccgaagggcuugcagugccuaacugagcugccag

SEQ ID NO: 138039 - RNA, 42 nt, Homo sapiens
uuucaguccucuccuuucugugcugaauggcaauacccccac

SEQ ID NO: 138040 - RNA, 40 nt, Homo sapiens
uuccaguugcuagggagaacgcucuguaugcagcccccug

SEQ ID NO: 138041 - RNA, 43 nt, Homo sapiens
gucucaugagccccauuagauugaugaggaaacugaggcacag

SEQ ID NO: 138042 - RNA, 44 nt, Homo sapiens
agagauggaaaccaaacgucauuucgagaaaagcccccauuccc

SEQ ID NO: 138043 - RNA, 44 nt, Homo sapiens
agaggguuagagcauuaaccccugaagccccagccgcaugucua

SEQ ID NO: 138044 - RNA, 44 nt, Homo sapiens
aacauaacuuugcuuggggaccccccacugcaacuaucuugcug

SEQ ID NO: 138045 - RNA, 45 nt, Homo sapiens
ucuguguuuguuguauuuaaaaaaauaaaugaaaacauugaaaag

SEQ ID NO: 138046 - RNA, 34 nt, Homo sapiens
acauauguuugugagagucaugauucuuguuuuu

SEQ ID NO: 138047 - RNA, 43 nt, Homo sapiens
gcuccagagugaaauuaaugacacuuugucgaugaagaucuug

SEQ ID NO: 138048 - RNA, 30 nt, Homo sapiens
aaacauaaauagaauuaaaaaaugcugaga

SEQ ID NO: 138049 - RNA, 46 nt, Homo sapiens
uucauuguacugcuauuaaguuaugaguaaauuaagcgaaagacga

SEQ ID NO: 138050 - RNA, 44 nt, Homo sapiens
uggacagaugcaucuaaguguccauguuggcauucuggauuggu

SEQ ID NO: 138051 - RNA, 44 nt, Homo sapiens
uugcagaaagugacuuccaucuauuagcucuuuggucaauggac

SEQ ID NO: 138052 - RNA, 48 nt, Homo sapiens
gauuauacuauuauuauuaaugaaucaaugaauaaagaaauaaacaau

SEQ ID NO: 138053 - RNA, 56 nt, Homo sapiens
ugccugugaacuguaugagaagugaaccaaugcaagaauaaagauguagaaauuaa

SEQ ID NO: 138054 - RNA, 61 nt, Homo sapiens
cuaaguugggcugaauuaaacuaaucauaaaccuugguucacuuccauuauugguucuugu

SEQ ID NO: 138055 - RNA, 48 nt, Homo sapiens
uuaguuuaauucagcccaacuuagguccauuacaaaugauggagggcu

SEQ ID NO: 138056 - RNA, 66 nt, Homo sapiens
ucuucuuguucuucuaggauaagucuacuuuucuuccacguaacaaccacaggauagaugacauuc

SEQ ID NO: 138057 - RNA, 51 nt, Homo sapiens
auuuucuaagaaacaaaaucuuggcaguuagauccgugggguaaagaauau

SEQ ID NO: 138058 - RNA, 52 nt, Homo sapiens
ggaaucaauaucuauaacaaauuaaaauaaccaggaauggaccagugaugga

SEQ ID NO: 138059 - RNA, 47 nt, Homo sapiens
gaauuuugugguuauauuauuauucaugaaccaaugaauaauaaaug

SEQ ID NO: 138060 - RNA, 33 nt, Homo sapiens
ggauugcauuuuuguuauaaaaucagcccauga

SEQ ID NO: 138061 - RNA, 66 nt, Homo sapiens
auaggccagcugauuuaauaauuuaagaaagaacuguuauccugaguaaggagcauagagacaaau

SEQ ID NO: 138062 - RNA, 42 nt, Homo sapiens
agaucuugcuguuaucucugugaaucaggagagaagagauug

SEQ ID NO: 138063 - RNA, 24 nt, Homo sapiens
acaggucuggaagucugaggucca

SEQ ID NO: 138064 - RNA, 57 nt, Homo sapiens
aauaagcaaauauauuuuaacugcauaaagauaaaaauaggcguuguccaauuaugg

SEQ ID NO: 138065 - RNA, 67 nt, Homo sapiens
aaaauaauaauaacguaugugaggucauuugggucaggaccauguucaugguuguuuguuuucucaa

SEQ ID NO: 138066 - RNA, 99 nt, Homo sapiens
uauacaguauuucuuguucuuaaguuuuuguaacauuauuuaauuacuauuagugaaaggaugaauuaauaaauaaacaaauguagaaguaauggagaa

SEQ ID NO: 138067 - RNA, 40 nt, Homo sapiens
uaugagucauacaugaugaauaugugucuggaacucugag

SEQ ID NO: 138068 - RNA, 87 nt, Homo sapiens
ggaaauauauggugaaauaagaaauacuauucacauuuauuaaaaacacugaggucuucuuucuauuaacaaauaaaugacucagag

SEQ ID NO: 138069 - RNA, 44 nt, Homo sapiens
ugguggcguaugagucauacaugaugaauaugugucuggaacuc

SEQ ID NO: 138070 - RNA, 42 nt, Homo sapiens
cguaugagucauaugugaugaauacgugucuggaacucugag

SEQ ID NO: 138071 - RNA, 47 nt, Homo sapiens
gugaaagaauaaauaaauaugucaguguauaaaaaugaauagaauga

SEQ ID NO: 138072 - RNA, 52 nt, Homo sapiens
uuuuauuguaauuaaucuauugaagaacuaauaaaucaacaaauauagaaau

SEQ ID NO: 138073 - RNA, 42 nt, Homo sapiens
cagcuaaggagagaggaucaaaggaauccucagaaggagaau

SEQ ID NO: 138074 - RNA, 36 nt, Homo sapiens
uccagcaaugggucacuggguccucucuggaaggcc

SEQ ID NO: 138075 - RNA, 42 nt, Homo sapiens
gucagccccucgcagaggguaugugcgcagaugguggaacag

SEQ ID NO: 138076 - RNA, 46 nt, Homo sapiens
gcugcuuugaaaaccucggaggacgugaagucgccauggaagagga

SEQ ID NO: 138077 - RNA, 40 nt, Homo sapiens
cucugggguguguguguguguguguguguguuugugugcg

SEQ ID NO: 138078 - RNA, 43 nt, Homo sapiens
ccuagggaucuuguuaaaaagcagauucugauucagggaccaa

SEQ ID NO: 138079 - RNA, 23 nt, Homo sapiens
uacgggaauggaaggucaaugcc

SEQ ID NO: 138080 - RNA, 46 nt, Homo sapiens
guccacucuguccacaggauggugguuggcagccacuccccuugga

SEQ ID NO: 138081 - RNA, 46 nt, Homo sapiens
ugugacugcuugguggacugcgaugacacgugcucuugggggugua

SEQ ID NO: 138082 - RNA, 34 nt, Homo sapiens
ggaaggacgaacugcauccuugcugcuggggaga

SEQ ID NO: 138083 - RNA, 28 nt, Homo sapiens
gcauuaaaucuagccuuaaagcacccuc

SEQ ID NO: 138084 - RNA, 48 nt, Homo sapiens
aaaugaugcugacguuuuaguugacaugguggucuucuagucgcaucc

SEQ ID NO: 138085 - RNA, 64 nt, Homo sapiens
auggaagacauccacauuacgcccucaaauaccuuaucuucugggugaccucugggaagcaagg

SEQ ID NO: 138086 - RNA, 99 nt, Homo sapiens
ccuggggaaauagcaagcugccgacguggcagccauggaaggaaauucacgguggcggcggugauaaacagugauauuugauguagacaagaacacauu

SEQ ID NO: 138087 - RNA, 114 nt, Homo sapiens
gaggaaucaaaucuucaugcagauuuuuaaauggaaaaaauugauccuaaugaaaaugauuuggggaaaauaacaagggaaauaagagaaaugaaaacagcucaacagcgcggu

SEQ ID NO: 138088 - RNA, 53 nt, Homo sapiens
guacaauucuugugaaggugguuacauuugugcguguuuacaguggaguuggu

SEQ ID NO: 138089 - RNA, 43 nt, Homo sapiens
ugaauaaauaaaagcauauuuugagggaauaaagaagcagaaa

SEQ ID NO: 138090 - RNA, 46 nt, Homo sapiens
uuuucaaugcucuuaacuuggcaaaauacgaacuuggcacccuacg

SEQ ID NO: 138091 - RNA, 83 nt, Homo sapiens
augggaucuuugccuaaaaguuacugagaaacgaaggcugcaaaaagccggaaaauaucccagcuuuuaaggcacacugacag

SEQ ID NO: 138092 - RNA, 46 nt, Homo sapiens
gguuucuugccuuaaggagcccauugccuuucccgcugaagucuag

SEQ ID NO: 138093 - RNA, 47 nt, Homo sapiens
caccccauuucgcugcagacuuaaccagaggagguugggugugucac

SEQ ID NO: 138094 - RNA, 45 nt, Homo sapiens
gcccaucauguuuccuuccuuguaccgcaacucaaagacccauug

SEQ ID NO: 138095 - RNA, 50 nt, Homo sapiens
gagaagugaagaugggcgcaaagcugcuucaggacguucgccaggaccuu

SEQ ID NO: 138096 - RNA, 32 nt, Homo sapiens
accuuggcuaagugaccgcacaggaccaacgg

SEQ ID NO: 138097 - RNA, 39 nt, Homo sapiens
cucaagauuuacgcuucacuauguuuuauuucaggcggg

SEQ ID NO: 138098 - RNA, 63 nt, Homo sapiens
aaaauaaggaagcuuauuuuauagaagccuuuaccaaaccuccuucuuugacuuguuguucca

SEQ ID NO: 138099 - RNA, 35 nt, Homo sapiens
uuuuggccacuuguuuuaguagcugaucuccauua

SEQ ID NO: 138100 - RNA, 43 nt, Homo sapiens
uuuaaaaucauuuaugugcucugcugaauauaaugagcccaug

SEQ ID NO: 138101 - RNA, 33 nt, Homo sapiens
gaggcugagcuaagcuggggaaacccaggcugg

SEQ ID NO: 138102 - RNA, 29 nt, Homo sapiens
aggccuggcacauaggaaguguugauuag

SEQ ID NO: 138103 - RNA, 44 nt, Homo sapiens
uguuacauauauuugaaggagaauaaguugugaaaguaacaguu

SEQ ID NO: 138104 - RNA, 49 nt, Homo sapiens
cugaguugacuggaaacaaaacuugccaucuggacugacagauuguaga

SEQ ID NO: 138105 - RNA, 49 nt, Homo sapiens
guuagcagaaauugugaauuuggaaucauuguggguuuuuauuguuuag

SEQ ID NO: 138106 - RNA, 44 nt, Homo sapiens
gugugguuuaaugccagcuuugcauuuacagcuugaggcugaaa

SEQ ID NO: 138107 - RNA, 74 nt, Homo sapiens
auuuuuaucagauuuuggucagaaugucuaagagcaagggucaccggagguuuguuccuuagagagugccagga

SEQ ID NO: 138108 - RNA, 62 nt, Homo sapiens
caaggcacuuuuaccuauggccucuacagggaggguggggaguuguucccauuuuacagaug

SEQ ID NO: 138109 - RNA, 58 nt, Homo sapiens
caugcaugguugccagaugagcucuugcccuuccgggagcucacaguuuaguaagaau

SEQ ID NO: 138110 - RNA, 55 nt, Homo sapiens
aaauguguuuuuuuagaacucuugucagcacuuguggaagguggauuggaaugaa

SEQ ID NO: 138111 - RNA, 39 nt, Homo sapiens
cugaaagaaggacgguuuaccuggggaagguggcaugaa

SEQ ID NO: 138112 - RNA, 30 nt, Homo sapiens
uacccuggcugcuuuuuggagacugaauug

SEQ ID NO: 138113 - RNA, 45 nt, Homo sapiens
ccuucuucauuuuggcagagaucgagcaaauaguacacaguccag

SEQ ID NO: 138114 - RNA, 46 nt, Homo sapiens
aggacucguggcauucaugacauuuguguguguccuugcucuugag

SEQ ID NO: 138115 - RNA, 47 nt, Homo sapiens
agcaggguugauugauauuauuuuuacauuguucuggcaauccacag

SEQ ID NO: 138116 - RNA, 39 nt, Homo sapiens
agaguaaucccggaaccacagcugccauccaagaacaag

SEQ ID NO: 138117 - RNA, 78 nt, Homo sapiens
cuugaauaguguuugcuuaaggcuuugugcuggcgugagguuguccugcuguagacaccaggcccgucgucggugcag

SEQ ID NO: 138118 - RNA, 55 nt, Homo sapiens
cagagacagcaccgugggaagcuucugggaguuccccacccgaugaacgugcugg

SEQ ID NO: 138119 - RNA, 54 nt, Homo sapiens
acauucagaccuacagcucucaaaagcggccuccuggggccuacgacugccaca

SEQ ID NO: 138120 - RNA, 45 nt, Homo sapiens
cgcccagcccacacucucauccacaucccacagcugucuccuuga

SEQ ID NO: 138121 - RNA, 58 nt, Homo sapiens
aggccugacagagcuucaggacauguccuuucucugacguggccuguggcccucacag

SEQ ID NO: 138122 - RNA, 57 nt, Homo sapiens
ucuuaacuuaguauuauaaauuagaaucaaacccaaaccaagagcuggaguauuuuu

SEQ ID NO: 138123 - RNA, 23 nt, Homo sapiens
cagcucuugguuuggguuugauu

SEQ ID NO: 138124 - RNA, 34 nt, Homo sapiens
uuaucacuuaauuuugaacugaagucucuagcgg

SEQ ID NO: 138125 - RNA, 73 nt, Homo sapiens
cuccacuucaucuauuuaauuccuauccagaucacugcguuccauuccuagagaauuggaacccugcugggug

SEQ ID NO: 138126 - RNA, 73 nt, Homo sapiens
uucccaggcuaguaguguuuaagccuccuugcuccccuguugagacaaaucugugacacccuuccuucacgug

SEQ ID NO: 138127 - RNA, 45 nt, Homo sapiens
ggaagggugggcaccugaagaggacucuuaccugggacugaaggc

SEQ ID NO: 138128 - RNA, 45 nt, Homo sapiens
gcuauccauuuuuaccuacacgauaguauugagcaagucaacaac

SEQ ID NO: 138129 - RNA, 52 nt, Homo sapiens
accaaacacagauccaaguuucagucaauaacggcaacuuaauauuaggggg

SEQ ID NO: 138130 - RNA, 103 nt, Homo sapiens
uaacauuuuauuuuuguaaucauuuuuauuuauagacuauaaagcaauuggcaaaauaggagagggaacguuuucugaaguuaugaagaugcaaagccugaga

SEQ ID NO: 138131 - RNA, 51 nt, Homo sapiens
auaggagaaacaauucucaguauauugcuguuuaaauuaucuuauagauua

SEQ ID NO: 138132 - RNA, 45 nt, Homo sapiens
uguguguaugaucauuaucauccuuuuuuucacuuaacaugaaau

SEQ ID NO: 138133 - RNA, 41 nt, Homo sapiens
accacggagauccuagugcgggaccccgccucagggaagug

SEQ ID NO: 138134 - RNA, 25 nt, Homo sapiens
cgcgcagcagcggaagccggcacug

SEQ ID NO: 138135 - RNA, 142 nt, Homo sapiens
aaggaagaggccacggugaggcgcggggaaacuggggaggcccggggacuccccucugccccucacacagccccuccgguccuggcccaccaggccuguaccuaccuccagccucggccaggcccuuccagucacccuacag

SEQ ID NO: 138136 - RNA, 44 nt, Homo sapiens
aggugggaacagaagcucuuccagugggucccuggguuggagag

SEQ ID NO: 138137 - RNA, 49 nt, Homo sapiens
gauauacccacauccccggaacuaggugaucgcggugcaggaaccaggu

SEQ ID NO: 138138 - RNA, 46 nt, Homo sapiens
aaaauccgaucagacaaaggaauucgucagauuuuaaugcaugaga

SEQ ID NO: 138139 - RNA, 61 nt, Homo sapiens
gaccuauuucuugaugcccaucuagaauauauaugcuaaguucugagagaucagugccaaa

SEQ ID NO: 138140 - RNA, 42 nt, Homo sapiens
aacuggaagaggcaaauggaaacaaucccauugacauugagg

SEQ ID NO: 138141 - RNA, 45 nt, Homo sapiens
agaaauguuuuucuguauuuguuguuacaugucggauuaauaguc

SEQ ID NO: 138142 - RNA, 36 nt, Homo sapiens
gagcaagaauuuuuaaaauuugaaggucgcucacaa

SEQ ID NO: 138143 - RNA, 46 nt, Homo sapiens; identical to SEQ ID NO: 42497

SEQ ID NO: 138144 - RNA, 45 nt, Homo sapiens
ccagaagccugugaaguccccagauaauuccauuaagaugcccga

SEQ ID NO: 138145 - RNA, 47 nt, Homo sapiens
aguaacagaauggucugucaguuauagauuauuuccuucagggcuua

SEQ ID NO: 138146 - RNA, 53 nt, Homo sapiens
agugauaauacgcuuuuuuggaaacuaauauauauugccagacugcaucauaa

SEQ ID NO: 138147 - RNA, 57 nt, Homo sapiens
uggcuuaaaucucccucuucucccuucccaaguguuacaaagaucauuuacugcaac

SEQ ID NO: 138148 - RNA, 99 nt, Homo sapiens
ggaauuguaaauuuuuuuuuaguauagucuggagagaaaggucauucaaaaggaaaguacaaugggacuugcugcccuucaucaucucguucccgugcc

SEQ ID NO: 138149 - RNA, 53 nt, Homo sapiens
gccuugaucuguauucugcacuaucccuuuacuugguuccuggcacugaaugg

SEQ ID NO: 138150 - RNA, 45 nt, Homo sapiens
auuuccaauauuugcugagguuaaauaaaaauuuucaagccauug

SEQ ID NO: 138151 - RNA, 72 nt, Homo sapiens
aaggcacccggccacuucugggugcugccuuugugacagccuaacuucugaggcaggaauucuccccauuuu

SEQ ID NO: 138152 - RNA, 60 nt, Homo sapiens
ccugcauauauaauuuaccucuucuuucuaauuugaaugccuuuuauuucuuuuucuugc

SEQ ID NO: 138153 - RNA, 30 nt, Homo sapiens
guucuuaaaaaaagcuucauugagaaaaua

SEQ ID NO: 138154 - RNA, 48 nt, Homo sapiens
gcaggggcaggacuucauuucccccugggcugugggugcugagggccu

SEQ ID NO: 138155 - RNA, 41 nt, Homo sapiens
gugcaauauagguccagcuggagccaugggcacugggccug

SEQ ID NO: 138156 - RNA, 22 nt, Homo sapiens
gggacaggguggagagggaggg

SEQ ID NO: 138157 - RNA, 62 nt, Homo sapiens
agggagacauggggacaggguggagagggagggaggagggagacaugggggcaggguggaga

SEQ ID NO: 138158 - RNA, 43 nt, Homo sapiens
gcccggugcccagguuggaugggcaggugaggauguagcccag

SEQ ID NO: 138159 - RNA, 56 nt, Homo sapiens
cuccccagugccggaaaucccccggggggacugaugcuggggcacccacaucccug

SEQ ID NO: 138160 - RNA, 46 nt, Homo sapiens
gcucgggggucagcaccuuggccaugugguuguugugggcgcucag

SEQ ID NO: 138161 - RNA, 41 nt, Homo sapiens
gcguuguggcuguuggagaagggcauggcggcggcgggcug

SEQ ID NO: 138162 - RNA, 42 nt, Homo sapiens
uccucggggcccaggccuaccuggaccacgugugggaugaag

SEQ ID NO: 138163 - RNA, 44 nt, Homo sapiens
cacagccuucaucccacacgugguccagguaggccugggccccg

SEQ ID NO: 138164 - RNA, 60 nt, Homo sapiens
aggccacggagccgcagccccagcaggugcgcacacacugcccgcacagggcucgcucac

SEQ ID NO: 138165 - RNA, 105 nt, Homo sapiens
cccucccgucgaccccacaguucagugugaacaccgagcgcucguccagggaaggcugccaugcacggcguggcucccggugaaggcagccggcuugagccagcc

SEQ ID NO: 138166 - RNA, 110 nt, Homo sapiens
cuggcucaagccggcugccuucaccgggagccacgccgugcauggcagccuucccuggacgagcgcucgguguucacacugaacuguggggucgacgggaggggugccuu

SEQ ID NO: 138167 - RNA, 42 nt, Homo sapiens
aaaauacuaaaguugaauguuguaaaaaaacgccguggugca

SEQ ID NO: 138168 - RNA, 41 nt, Homo sapiens
ucuccaucccuccaagcuaucguccagcgcaguccaccgcc

SEQ ID NO: 138169 - RNA, 36 nt, Homo sapiens
ucuccaaaaggaaccuuuuuaaauauuuagauuuua

SEQ ID NO: 138170 - RNA, 51 nt, Homo sapiens
aaaauaccuggugucagucuccgacgugaccuggggcuugaagggugggcu

SEQ ID NO: 138171 - RNA, 33 nt, Homo sapiens
cugaugucagagagcagcaagccaccagccccc

SEQ ID NO: 138172 - RNA, 46 nt, Homo sapiens
aaagaagcgaugcugcaugaucuccuuggcguccucggagcccccg

SEQ ID NO: 138173 - RNA, 42 nt, Homo sapiens
gcgaccgcacaucaucucguacaugaccacgcccagccccca

SEQ ID NO: 138174 - RNA, 108 nt, Homo sapiens
ucuuggacgugggggacacccaggcuuagccccccagcaggacucuguccccacaaccggacuccaacccccagcaggacuccgccccccagcaggacuccgcccccc

SEQ ID NO: 138175 - RNA, 44 nt, Homo sapiens
ugcggccgcuccuuguagccaaugaaggugccaucauucuugag

SEQ ID NO: 138176 - RNA, 54 nt, Homo sapiens
caccccuuuaccagcagcccucgaacccuguaaacaaccaggcugggguggggg

SEQ ID NO: 138177 - RNA, 50 nt, Homo sapiens
gugcgggccagccucugagacaagcacccugaccugcaggagcaaggcug

SEQ ID NO: 138178 - RNA, 44 nt, Homo sapiens
uguccuagcuucugcuggcccagcugccagccacuggccaucac

SEQ ID NO: 138179 - RNA, 84 nt, Homo sapiens
uuucuugguaggagaugaggagaacccuaauuugggaaaucggaaccagccugccuucuccuguuuuuuaggcaguucugccuc

SEQ ID NO: 138180 - RNA, 49 nt, Homo sapiens
uuuuuggaaucaacaccugucucaucaacagaagaggaaaacccaaugu

SEQ ID NO: 138181 - RNA, 45 nt, Homo sapiens
aaaguccuggguacugagagaucuacaaacucuggugucacuaug

SEQ ID NO: 138182 - RNA, 46 nt, Homo sapiens
uucuacaggauggcuggaggggaucuucaggugugggggcuauccc

SEQ ID NO: 138183 - RNA, 70 nt, Homo sapiens
ggaaaagauaccugaccaagagaaacaggaaucauggaauucagugggccagagugacucucagcuugag

SEQ ID NO: 138184 - RNA, 54 nt, Homo sapiens
gacagcaguggcccagaggaagcccagggcccagccaacuccuggaaugagccg

SEQ ID NO: 138185 - RNA, 136 nt, Homo sapiens
acagggcccuucaucgacaggacagccaggcaggggguuccagaguggggugggccgugcugggguccuggaagaguuggggcccuggggugauagccucgaggagacuggggcugccacaggcagcaggagagag

SEQ ID NO: 138186 - RNA, 51 nt, Homo sapiens
gaggcccagcucacgguggagcgccaagagcagaaggcagggccgggcagc

SEQ ID NO: 138187 - RNA, 50 nt, Homo sapiens
uauucagagccguacaagguucaguucaaaaucagacggcagcucccugc

SEQ ID NO: 138188 - RNA, 46 nt, Homo sapiens
gaaggacuccucagccgccaagcuuuuuaacuugagagaaggugcc

SEQ ID NO: 138189 - RNA, 51 nt, Homo sapiens
ucaccugucuacgaauacacgacugaggcugccgacuuuggacuccaggug

SEQ ID NO: 138190 - RNA, 68 nt, Homo sapiens
gagcccaggccauacaagguguguggcaggacaccaagcugugggcccugggcagguaggggacagug

SEQ ID NO: 138191 - RNA, 27 nt, Homo sapiens
gcaggcaaaggagccccucuguagccg

SEQ ID NO: 138192 - RNA, 46 nt, Homo sapiens
uuugggcacagcagcgggaggaugauggcuccggugggcuggaggc

SEQ ID NO: 138193 - RNA, 41 nt, Homo sapiens
cccccaucaucuccguauaaaagacugaggaggggcaggca

SEQ ID NO: 138194 - RNA, 42 nt, Homo sapiens
uagcagcguacagaguggccagcaccgugucggcuuccagau

SEQ ID NO: 138195 - RNA, 67 nt, Homo sapiens
ccucugcggggcgaggcccuuccucuuggucaggggaaaguccaggcggggcuuguugguggccgug

SEQ ID NO: 138196 - RNA, 55 nt, Homo sapiens
guagcaggaagauccaaccccucaaagcagguggcaugggugccacugggagggg

SEQ ID NO: 138197 - RNA, 38 nt, Homo sapiens
cagacuugugaguccugacacucagcugugggugagau

SEQ ID NO: 138198 - RNA, 45 nt, Homo sapiens
cuuguaguaguuuuagagggaaagugauauugggagcagacacag

SEQ ID NO: 138199 - RNA, 46 nt, Homo sapiens
gugacagcucaucucagcugaacaccagucuaccauuccuucaaag

SEQ ID NO: 138200 - RNA, 46 nt, Homo sapiens
gcagugaacaaagagauaccucugaugcuguaguuaugccaaagau

SEQ ID NO: 138201 - RNA, 49 nt, Homo sapiens
uccugaauaauguucugcaauauuagaacuuggggauggucugugaagg

SEQ ID NO: 138202 - RNA, 45 nt, Homo sapiens
acuuucucucucuuggaucuaccaccaguaaaugaauaugacaug

SEQ ID NO: 138203 - RNA, 46 nt, Homo sapiens
agccucuguuuguggaauuuuuguggauuuugccucagcuucacac

SEQ ID NO: 138204 - RNA, 97 nt, Homo sapiens
agcuauuaaugcagaaaaugaaaggauuggcgaguuaucuuugaaacuguuucagaagcgagguagaacagaauuugaaaaggagcccaggacaggu

SEQ ID NO: 138205 - RNA, 115 nt, Homo sapiens
augacuuugagguuugugauggugaugaugaugaaagcaguaaugaaccugagucaagagaaaaacuggaagaacuuccucuagcucaaaaaaaggaaauacaagaaauucaaag

SEQ ID NO: 138206 - RNA, 57 nt, Homo sapiens
aaacugauuuagaaaaugcuagagcugaugcauauacagccaguugugaagaugauu

SEQ ID NO: 138207 - RNA, 55 nt, Homo sapiens
guuuucauuuugaugaugagaggcaccaaagcaacguggauagaaaagagaaauc

SEQ ID NO: 138208 - RNA, 84 nt, Homo sapiens
ggagacagcaaggacaacccucucaaguacuggcuuuauaaagaagaaggcgagaggagacacaggaagcccagagagccagau

SEQ ID NO: 138209 - RNA, 40 nt, Homo sapiens
agagaaagaugaagacucugaaagaggagaugaagauaga

SEQ ID NO: 138210 - RNA, 105 nt, Homo sapiens
aaaaagacagaagggcccggaaggaagagcuccggcagaccguggcccaccacaaccugcugggccaggagacacgcgaccggcagcuccuggagcgggcggaga

SEQ ID NO: 138211 - RNA, 199 nt, Homo sapiens
agggaucccgaccaggaugccaggagcagagacaggguggccgaaguccacaccgcuaaggagaguccucguggggagagggacagagacagacagagggagaggagaagagacgcaaaagaccgggagaaagaaaagcugaaggagaaacaucgagaggcagaaaagucucacagcagaggaaaggacagggaaaaag

SEQ ID NO: 138212 - RNA, 49 nt, Homo sapiens
caggccauacagucaggugguuccaaggaagaaagaaagcacagagaga

SEQ ID NO: 138213 - RNA, 46 nt, Homo sapiens
agagaagaaccaaagaugauaccuggaaagcagaugaccucagaaa

SEQ ID NO: 138214 - RNA, 51 nt, Homo sapiens
guucuacacaugugcaccaggcuucccaugaacugugacauggauggggug

SEQ ID NO: 138215 - RNA, 61 nt, Homo sapiens
cgaggcucagguaaucugaagcaaguuaacagguuucaagucagggucagagacuuaagaa

SEQ ID NO: 138216 - RNA, 46 nt, Homo sapiens
cauuauuguaacaacuucagcuaacacauuuccagacucacaccag

SEQ ID NO: 138217 - RNA, 39 nt, Homo sapiens
aacauuuaaaaagcuuuuauuaugugccaggucuugagu

SEQ ID NO: 138218 - RNA, 45 nt, Homo sapiens
aaccaacuaccuucucugcuucggcaucggccucgcucucgccgg

SEQ ID NO: 138219 - RNA, 47 nt, Homo sapiens
cacgccucguugcgccugcgcaaccuuaagaacaagauugagaacaa

SEQ ID NO: 138220 - RNA, 64 nt, Homo sapiens
ccugggaucuguacccaggaccuggagaauaccaccccacccccagcccauaauugggacccag

SEQ ID NO: 138221 - RNA, 53 nt, Homo sapiens
gcccaaacaaaacaggacaucugugaccgcccuacccccacgccagccccaaa

SEQ ID NO: 138222 - RNA, 46 nt, Homo sapiens
agccaccuacauccagccccaaaacuggggcuucaggccagagcau

SEQ ID NO: 138223 - RNA, 124 nt, Homo sapiens
gccaaaucuugaacucagaacccaaguguuccaugccccuguguggauggagucggguauccugacuguuggaccccugguccaggugaucccgacccucaccagucccauuugccucccucca

SEQ ID NO: 138224 - RNA, 498 nt, Homo sapiens
uuauucuuuucgguauguuaucguucacacuuuuauuaccuuguuuucauuaauugagaugauuuugaugcccugagacguauuaugaguuugcgguuuggcacucugaugcuccguggcauccgccucguuuuaugguuugcuuucgguuugcgaauuuuauuuggucccguagauacguacgcaugguuuaucgcccugcaugcuuuucagaguuagaccugucgguggcauaugccaccguggccacccgcuggcagcuuaccuguccuggaugcuaugacuuugcugaacggagcugcuccuguuagcgcgcccuguggcugcgagacgcagcuccgcaguggccgauaaagcaaacccggccgggcugagccgggccuugugggggugcgcggggccggggcugacggggagaugggcggggcaggcagcaggagacucaggccccaucccugggcuuuugaaggcgucuacggugacgugcagcgcgugaag

SEQ ID NO: 138225 - RNA, 41 nt, Homo sapiens
aggccuuuccguuccgaacguccacggcgcccuggcccccc

SEQ ID NO: 138226 - RNA, 46 nt, Homo sapiens
gugacuacacacgcccagaccugccuuccggggacagccagcccuc

SEQ ID NO: 138227 - RNA, 139 nt, Homo sapiens
aggcggugcguggccccgcggcggaccccagcagcccggggaccucgggggugggcccagccgcaggggccggggacucacggcugugccucccacagcgggcccaggcggcccugcaggcggugaacucgguccaguc

SEQ ID NO: 138228 - RNA, 45 nt, Homo sapiens
aaguucaaaggugacagccgaagugcaggcguccccucuagagug

SEQ ID NO: 138229 - RNA, 46 nt, Homo sapiens
ugcuuuagaugcuucuugggaccacgagccauggcuacguuaggca

SEQ ID NO: 138230 - RNA, 46 nt, Homo sapiens
guagcagcuccaaagcauuggaugcuggauaaauugacuggugugu

SEQ ID NO: 138231 - RNA, 121 nt, Homo sapiens
ccauccaccaguccccacaaguugagagagugucucccccucaucauuuucauaaggaacagacuuaaguaugcccugacaggagaggaaguaaagaagauuugcaugcagcgguucauua

SEQ ID NO: 138232 - RNA, 44 nt, Homo sapiens
uaauacgauguacagcaaagugacccuuggugucacagaucaga

SEQ ID NO: 138233 - RNA, 71 nt, Homo sapiens
gugacaccaagggucacuuugcuguacaucguauuacaccugaggaggccaaguacaaguugugaaaagug

SEQ ID NO: 138234 - RNA, 85 nt, Homo sapiens
ugauccccucaucaaggugaaugacaccauucagauugauuuggagacuggcaagauuacugacuucaucagguucgacacuggu

SEQ ID NO: 138235 - RNA, 84 nt, Homo sapiens
acuggaggugccaaccugggaagaauuggugugaucaccaacagagagaggcacccuggaucucuugacgugguucacaugaaa

SEQ ID NO: 138236 - RNA, 74 nt, Homo sapiens
cccaaggaaaagguaucugccucaccauugcugaagagagagacaagagauuggcaaccaaucaaagcaguggg

SEQ ID NO: 138237 - RNA, 40 nt, Homo sapiens
uaaaauggucccuggauggcauguuagaucuuuguaugua

SEQ ID NO: 138238 - RNA, 46 nt, Homo sapiens
gacgaggcgcgauuaugcuauccccuuccugaaguuauucuuuaag

SEQ ID NO: 138239 - RNA, 78 nt, Homo sapiens
cucccgucuccuccuuuaggugcaaugauucuggacugagacgcgcuugggcagaggcuauguaaucgugucuguguu

SEQ ID NO: 138240 - RNA, 37 nt, Homo sapiens
gugccgcgcugaccagcaguacgaaugcguggcggag

SEQ ID NO: 138241 - RNA, 33 nt, Homo sapiens
aauaaauugaaggcaguguucacuuauucacca

SEQ ID NO: 138242 - RNA, 30 nt, Homo sapiens
cccgguucccccccguccccuucuaugccc

SEQ ID NO: 138243 - RNA, 37 nt, Homo sapiens
ccggucccgccaccccacgcccgucccggucaccaag

SEQ ID NO: 138244 - RNA, 46 nt, Homo sapiens
cuggccauccucggacccgagaacccgaaaauugccaaggacccau

SEQ ID NO: 138245 - RNA, 33 nt, Homo sapiens
ccgagacaauacaccuccgagcugaauaugaaa

SEQ ID NO: 138246 - RNA, 62 nt, Homo sapiens
gccaaagaugcaccauguagaauuuucacuuuguacuggcaggcucguuuuaccucauucua

SEQ ID NO: 138247 - RNA, 42 nt, Homo sapiens
ccgcuggcggacugcuugaugcggucgcaggucuggucacag

SEQ ID NO: 138248 - RNA, 41 nt, Homo sapiens
ggcgauccugcugcugagaaauuccccgaggagucccaugg

SEQ ID NO: 138249 - RNA, 33 nt, Homo sapiens
gguccugucccugcuacagcauggaacccgcag

SEQ ID NO: 138250 - RNA, 49 nt, Homo sapiens
gagauggccaggacacgccccucagcucgagugggaggcugaggcucgg

SEQ ID NO: 138251 - RNA, 47 nt, Homo sapiens
uccagagcaaugguaccugcggcuccccuagucuaggugggauagaa

SEQ ID NO: 138252 - RNA, 46 nt, Homo sapiens
acacacagggggaugcaaagcuccugguggcggccucgugccucgg

SEQ ID NO: 138253 - RNA, 32 nt, Homo sapiens
guuagucacgagugggacagcucagcucucgg

SEQ ID NO: 138254 - RNA, 44 nt, Homo sapiens
agggaagggggcaugcagcuggauuaccggugggccacacucag

SEQ ID NO: 138255 - RNA, 40 nt, Homo sapiens
aagccgugacacccaccaccaggagaacagaagcaacguc

SEQ ID NO: 138256 - RNA, 46 nt, Homo sapiens
uuacgucggugauaguguucagggcggugucugccccgaugcugaa

SEQ ID NO: 138257 - RNA, 28 nt, Homo sapiens
aauaugugauuuuaaacaaaauucuagg

SEQ ID NO: 138258 - RNA, 42 nt, Homo sapiens
ugaguguccccugagggccccaugagccaccagcagccuggg

SEQ ID NO: 138259 - RNA, 42 nt, Homo sapiens
gguguccgggguggccucuagcaaggcgaugacugccuccac

SEQ ID NO: 138260 - RNA, 46 nt, Homo sapiens
uuggguaucaauugcuccuucagccacaauaauaauauucagccuu

SEQ ID NO: 138261 - RNA, 45 nt, Homo sapiens
uccucccagccuuccucugguggagauucuggaaggaacacccag

SEQ ID NO: 138262 - RNA, 28 nt, Homo sapiens
gaaacagggcgaaaacccgcaggacaga

SEQ ID NO: 138263 - RNA, 32 nt, Homo sapiens
aggcucauucagcugaccacagugguggggag

SEQ ID NO: 138264 - RNA, 46 nt, Homo sapiens
gcauccccgccgcuggucagcacgccgauggccuugccggccccgg

SEQ ID NO: 138265 - RNA, 72 nt, Homo sapiens
ccugcugcugaaauuugggggcaaauaacuggaguaggccugcugggaacaggacuuguuaaaagaacuaug

SEQ ID NO: 138266 - RNA, 51 nt, Homo sapiens
caguguuuggaagugggaacaguuuuguccuguaugcugauguguccagaa

SEQ ID NO: 138267 - RNA, 46 nt, Homo sapiens
cuuucaauacguccaccuggaggcucaccacuuggagagacacagg

SEQ ID NO: 138268 - RNA, 94 nt, Homo sapiens
gugaacauaugcagggcacaguggaggaggacggguagagauauuuuacauucucauuuucuuacuaagucuuugcaugcuaaguuuuccuugg

SEQ ID NO: 138269 - RNA, 75 nt, Homo sapiens
cagacaugcagggcuucucuugacuucuugugaggauuggucuugugucugggugggucugguucuaccauugag

SEQ ID NO: 138270 - RNA, 65 nt, Homo sapiens
cuaacuuagccuaaaaccagguuggaucagugagauuugugagaaugagaaugacccguuugugg

SEQ ID NO: 138271 - RNA, 43 nt, Homo sapiens
gggaagaaaucaguuguccuuuucuugcacugguggagaggcu

SEQ ID NO: 138272 - RNA, 51 nt, Homo sapiens
cuguaaccucucuucguuccguugccuguagauguggaauagaguagaaug

SEQ ID NO: 138273 - RNA, 44 nt, Homo sapiens
ggcacugccccugcgucucaggaucugcccacucugcccugaag

SEQ ID NO: 138274 - RNA, 90 nt, Homo sapiens
ccgugugaugccgugguuuccaguugggcaguuuccccccaggagacaguguuuguugucaccccuggggaggggucugcucuaguuucu

SEQ ID NO: 138275 - RNA, 41 nt, Homo sapiens
uguucguguguuuuucacccggcaguguaauuccauaaguc

SEQ ID NO: 138276 - RNA, 44 nt, Homo sapiens
agguggaguguguaauucccgugugcccuuucucccacaugggu

SEQ ID NO: 138277 - RNA, 46 nt, Homo sapiens
guuuuguguaaaaagaaaaguuuuuguauuuauaucaccagaguug

SEQ ID NO: 138278 - RNA, 49 nt, Homo sapiens
cuuuuucuaaacauuuagcuccauuuuggcuauuucaaaggauguagga

SEQ ID NO: 138279 - RNA, 166 nt, Homo sapiens
uuuacaggcucugcccuaacugaagggaaggguguuaggcauguacgggguggggguggcuuggggccaucuugggaugcugccugcugaaguugcuucugcgaaucuaucucuaagugcauuuccugcaugagcguuaaagauuguauuugacugaggacccaua

SEQ ID NO: 138280 - RNA, 54 nt, Homo sapiens
cacccaggacaauauucccuuugaugaagucaaagucaacucauuuagggaccu

SEQ ID NO: 138281 - RNA, 38 nt, Homo sapiens
cugagguugagaugacuggccccuucaugcagguggag

SEQ ID NO: 138282 - RNA, 42 nt, Homo sapiens
ugaucucgaaggauguguguaggcuuucaguagaccagaggu

SEQ ID NO: 138283 - RNA, 47 nt, Homo sapiens
gauggagcagagcugaguaagggccaacucaaaacaaaagguaaggu

SEQ ID NO: 138284 - RNA, 45 nt, Homo sapiens
gccuuccucgguucgcaguacacuucuggaacuguuuggucaaau

SEQ ID NO: 138285 - RNA, 43 nt, Homo sapiens
gaacuaacagcucggagcaggagaggacgggacugccaagaga

SEQ ID NO: 138286 - RNA, 42 nt, Homo sapiens
ggagugaccaggacacuaccuccuagaaguaaugcccacaga

SEQ ID NO: 138287 - RNA, 50 nt, Homo sapiens
ggaggugcuugugugccuggugcgggagcuauggggcccagggauugugu

SEQ ID NO: 138288 - RNA, 36 nt, Homo sapiens
acacugggaaaaaauguggagggugugaauacagag

SEQ ID NO: 138289 - RNA, 40 nt, Homo sapiens
cuucgggucaguacggggggccgcgucguagggacucacu

SEQ ID NO: 138290 - RNA, 46 nt, Homo sapiens
gaaauaaacacuaaccaccucgacaagcaacagguucaacuccugg

SEQ ID NO: 138291 - RNA, 46 nt, Homo sapiens
gugucuucuuauucaacaccgaaaauaagcuucugcuacagcaaag

SEQ ID NO: 138292 - RNA, 73 nt, Homo sapiens
acuuugaauccagaucccaaugagauuaaaagcuauuguuaugugucaaaggaagaacuaaaagaacuucuga

SEQ ID NO: 138293 - RNA, 46 nt, Homo sapiens
caaauaaaacuuaauuuaaucuuugcagauacauacuuaugggaaa

SEQ ID NO: 138294 - RNA, 32 nt, Homo sapiens
aaugcacaggacggacccccaccacaaagauu

SEQ ID NO: 138295 - RNA, 74 nt, Homo sapiens
uaggauggugaacagcaucccuggacugcgcacuggaugcuguuagcaccccucucccaugacacccacaauua

SEQ ID NO: 138296 - RNA, 39 nt, Homo sapiens
aauauuuccugacucuguaggacagugguccucaguugg

SEQ ID NO: 138297 - RNA, 45 nt, Homo sapiens
agcgccuauauuaaggcacauuugaauaaauucuauuaccaguuc

SEQ ID NO: 138298 - RNA, 45 nt, Homo sapiens
ccaggucuaaauaaggcaggaaaguucccuucccugcucacacac

SEQ ID NO: 138299 - RNA, 46 nt, Homo sapiens
uucuuggccagcuucuugaccaguuuuuuauucuuuuugaguuuuu

SEQ ID NO: 138300 - RNA, 41 nt, Homo sapiens
agaagcacuuguccuucugggggucauaguucuucaagcug

SEQ ID NO: 138301 - RNA, 86 nt, Homo sapiens
gcgggaaguccugcaccggaaccagcgcaagcgccgcaaguuccuggagacgguggaguugcagaucagcuugaagaacuaugacc

SEQ ID NO: 138302 - RNA, 45 nt, Homo sapiens
ccccggaagugggagcuguguguucucaugcgaacgggaaggagc

SEQ ID NO: 138303 - RNA, 65 nt, Homo sapiens
gaggccggggcaggggaaggccggggccggggcuuaggaggacccguugaggcgaggcgggaguc

SEQ ID NO: 138304 - RNA, 33 nt, Homo sapiens
auguucgggaagauugccauuuuuaaaagugag

SEQ ID NO: 138305 - RNA, 40 nt, Homo sapiens
cacuucugugucuuccuucuugcccugccccaccuuuuaa

SEQ ID NO: 138306 - RNA, 33 nt, Homo sapiens
agaauuaccuguguagugccccaagugggaaag

SEQ ID NO: 138307 - RNA, 40 nt, Homo sapiens
agcagggaguggucacauguggguguuacugggcggcaag

SEQ ID NO: 138308 - RNA, 26 nt, Homo sapiens
uuacugggaaagguguagcacgggau

SEQ ID NO: 138309 - RNA, 26 nt, Homo sapiens
agacccagucacaggcuuuaacggug

SEQ ID NO: 138310 - RNA, 46 nt, Homo sapiens
gugaggugaaauaucauugugguuuuguucugcauuuccccaauaa

SEQ ID NO: 138311 - RNA, 45 nt, Homo sapiens
gaaguguaguaagguaacaaagcgaggggucaguugugaccuuag

SEQ ID NO: 138312 - RNA, 45 nt, Homo sapiens
uggccuguuacaaaaaucuguggaggaaaaggaaccagaaaacaa

SEQ ID NO: 138313 - RNA, 45 nt, Homo sapiens
cagggagugaugacccggaggugguaacaguuguugucgaccaga

SEQ ID NO: 138314 - RNA, 76 nt, Homo sapiens
uguggugguggugaaaacagacugggucuaauuaggaaaggugauguauggaaguauuagagugggaaagagaaua

SEQ ID NO: 138315 - RNA, 54 nt, Homo sapiens
aguacuuaaaacaaaaacuaaaaagaauuccagauagauacucauuuaaacacc

SEQ ID NO: 138316 - RNA, 29 nt, Homo sapiens
gacauuugacuuuucuuuaggcuuugggg

SEQ ID NO: 138317 - RNA, 42 nt, Homo sapiens
ccuaauuguaggaucggaugccaauggugauggugaccaggg

SEQ ID NO: 138318 - RNA, 45 nt, Homo sapiens
gcaggagucggacccagcagacaugaacgcucucgcucugggucc

SEQ ID NO: 138319 - RNA, 51 nt, Homo sapiens
ggcauuauacauugagggagugagaauccuaaugguaggaaguaaaauggu

SEQ ID NO: 138320 - RNA, 47 nt, Homo sapiens
ccauccaaugugcaauuccuaguagacccaguuuaguucuucuccaa

SEQ ID NO: 138321 - RNA, 45 nt, Homo sapiens
accagagagauauuuucaaaaugucagccuugaauugauuuucua

SEQ ID NO: 138322 - RNA, 43 nt, Homo sapiens
ggaggaaaugagucucaaccagacagccaggaagacccccgag

SEQ ID NO: 138323 - RNA, 46 nt, Homo sapiens
ucacagauggauagugaccaguaugugccaaucacaacgguggcua

SEQ ID NO: 138324 - RNA, 28 nt, Homo sapiens
uuugcccauuugcagguuucuuuagcuu

SEQ ID NO: 138325 - RNA, 46 nt, Homo sapiens
gaugaaaagggagaaaaaguaaggccaaaucaaaaucgcugcauag

SEQ ID NO: 138326 - RNA, 44 nt, Homo sapiens
ggcucauuuuccccacugcggaagcagugcccuucugagcacug

SEQ ID NO: 138327 - RNA, 53 nt, Homo sapiens
uuuuacuauuugcaaaguguuuggggggaaauuugaaccuaaucuucaucucc

SEQ ID NO: 138328 - RNA, 88 nt, Homo sapiens
uauuuuggaagaugcuuuuaaugguauugagaaguaagcucuguaaggaggcgugaggaguuaguaguuuuccugcuuuuaagggaag

SEQ ID NO: 138329 - RNA, 49 nt, Homo sapiens
guggaguggagugugagcucugccagcccguguggcgaauguggucgga

SEQ ID NO: 138330 - RNA, 44 nt, Homo sapiens
ucugguauuuccugaacugcauucuccuaaucugaaauugggau

SEQ ID NO: 138331 - RNA, 43 nt, Homo sapiens
ggguuucgcuguggacuaagggaaagacugagugguccucagg

SEQ ID NO: 138332 - RNA, 45 nt, Homo sapiens
ggaccuggguuauuagaaaguccuucaauauuuaacuucacugca

SEQ ID NO: 138333 - RNA, 51 nt, Homo sapiens
aaaauaacagucuuucacuuuccacuccucuaggaagaauuccuuuggcua

SEQ ID NO: 138334 - RNA, 46 nt, Homo sapiens
uaccaaaccugagauuuaauuaaauggauuaagguuaaggcacaag

SEQ ID NO: 138335 - RNA, 50 nt, Homo sapiens
ccuccgucgccaagcuucgagcuggggcuguccagcuucccuccauuacc

SEQ ID NO: 138336 - RNA, 62 nt, Homo sapiens
uggagcugccggcaauuugaagacagaggacuuguuugaaaacaggcuaucuagcuugauaa

SEQ ID NO: 138337 - RNA, 159 nt, Homo sapiens
caugaugugccguacacacccuuucucucacccagaaacuuagauugcauugucauuguuguaguucagaccugccuuuauuuuauaaaacaacagaaugaaauggaaacaucugaauuguauuggaaaugauuaaaauguguaguaaucuacaugaga

SEQ ID NO: 138338 - RNA, 70 nt, Homo sapiens
acacucagcccagcacucuggccucuaaugugcuuaggagguggaagugggacuuggccggcugccacac

SEQ ID NO: 138339 - RNA, 62 nt, Homo sapiens
gcaagcgugaacacccuuccuguaguggucuccagagagcccucggugccggcuucuugugc

SEQ ID NO: 138340 - RNA, 58 nt, Homo sapiens
aucccaagguggcggagaaacagagggaaacccacaguguggacagacuuccuuccgc

SEQ ID NO: 138341 - RNA, 49 nt, Homo sapiens
ccucacugcgaccgcguguaaaucggugcaggugaacggagccgccacg

SEQ ID NO: 138342 - RNA, 57 nt, Homo sapiens
gaacgaguaaagagccuccuucuuccccauugcaaccccaaaaagaacaaaagccaa

SEQ ID NO: 138343 - RNA, 55 nt, Homo sapiens
cagagcccgcagagagauaccgggagcccccagcccucaaguccacaccuggagc

SEQ ID NO: 138344 - RNA, 93 nt, Homo sapiens
cagagcgcuguguuaaccacaaacgagacacucucccacucagugcgagggcgagccgcugguuaggagcuugcagugucugaggccuguggg

SEQ ID NO: 138345 - RNA, 47 nt, Homo sapiens
auacuguaguacaagagcuaguaguaguuuuuguaauauaccuuaaa

SEQ ID NO: 138346 - RNA, 23 nt, Homo sapiens
auacuaaucauaucuaaugugaa

SEQ ID NO: 138347 - RNA, 49 nt, Homo sapiens
uuaaagcaguugccauuauucaaauacagagaaauagccacagggcuag

SEQ ID NO: 138348 - RNA, 46 nt, Homo sapiens
auuuuuuuuuguaguugucaguucacugaccaaaaaaaaaaaaaaa

SEQ ID NO: 138349 - RNA, 43 nt, Homo sapiens
augcuuaucauuuugaaauagaagaauaaaaaccuggucccgu

SEQ ID NO: 138350 - RNA, 40 nt, Homo sapiens
ucgaggcgagggcgcuggccgccagcagcucacagcgcgg

SEQ ID NO: 138351 - RNA, 45 nt, Homo sapiens
agggugagauggacagaaaauguaagcaaguaaaggaaaagugua

SEQ ID NO: 138352 - RNA, 56 nt, Homo sapiens
uuuucguccucccauaauuucauauuuccguaccccugaggaaacaaaaaggaaau

SEQ ID NO: 138353 - RNA, 46 nt, Homo sapiens
gaguuguugccuuccaagauauacccaaauucccaguuccagguaa

SEQ ID NO: 138354 - RNA, 75 nt, Homo sapiens
uuaaaacuccgcuggcgugaaagaugacguccuuagcccagcagcugcaacgacucgcccucccucaaagugaug

SEQ ID NO: 138355 - RNA, 46 nt, Homo sapiens
cuaaggaagcggccacaaucgacagggacaccgccuucgccauugg

SEQ ID NO: 138356 - RNA, 55 nt, Homo sapiens
uauuauaaauuauauguacuuaaagaauucagaaacuucuuagggguaaguaaaa

SEQ ID NO: 138357 - RNA, 46 nt, Homo sapiens
gaguugcuuggaauugauccuuccuuugagcaguuugaagcaccgu

SEQ ID NO: 138358 - RNA, 46 nt, Homo sapiens
aucuuuaccagauuacagagcugcaacauacaugauaauaugucag

SEQ ID NO: 138359 - RNA, 43 nt, Homo sapiens
gagaagaaacugaaggaauggauggucaaaucuacaagagaca

SEQ ID NO: 138360 - RNA, 45 nt, Homo sapiens
gccuucuauuugaagaguauauuucauauaguucacaggaagaaa

SEQ ID NO: 138361 - RNA, 41 nt, Homo sapiens
ccagaacauuagauguuguauuagaggaacacuuaaaggaa

SEQ ID NO: 138362 - RNA, 36 nt, Homo sapiens
aggaugugcuugguucauuuuuuuugagugccugag

SEQ ID NO: 138363 - RNA, 46 nt, Homo sapiens
guguagcaaaucagaagaugauugaguuguuggcugauaauauaaa

SEQ ID NO: 138364 - RNA, 60 nt, Homo sapiens
ccugggaagccccguaaaagaaguucguagggcugccauucagugucuccaggcccucag

SEQ ID NO: 138365 - RNA, 53 nt, Homo sapiens
uggaguggcauccccguuuuaucugauaauagaucauuugauuucuaaagcag

SEQ ID NO: 138366 - RNA, 48 nt, Homo sapiens
agagagaaaagaaacugaaaucucaucagaaguugucugaaacuuuga

SEQ ID NO: 138367 - RNA, 47 nt, Homo sapiens
aguugcccaucuuauauagcaaaagauuugaugaaaguacuucaggg

SEQ ID NO: 138368 - RNA, 57 nt, Homo sapiens
agacaauuguaagaguugcaugugugcgcucagaagagauaaauguaauauuaauuu

SEQ ID NO: 138369 - RNA, 45 nt, Homo sapiens
gugcuuucucagcuauugccuauggcugaacaacugcuagaaaag

SEQ ID NO: 138370 - RNA, 95 nt, Homo sapiens
aaaggaacuuuacgcgggaaugccaaccauucagaucacagcccuugaaaaggucagugauuucuuucagaaacuaaggcauagcauguucaagc

SEQ ID NO: 138371 - RNA, 51 nt, Homo sapiens
ucaauggcucaguauugaacuggguaacauuauucuacuuaauuuaaauag

SEQ ID NO: 138372 - RNA, 83 nt, Homo sapiens
gauuuccguuaaugcugaacaaguccgaauagaacuggagccaccagauaaagcuaaacccuugggcacaguucagcaaaaaa

SEQ ID NO: 138373 - RNA, 45 nt, Homo sapiens
auccuggaauuacugcagcacaaaaagaagcucagaaguccucag

SEQ ID NO: 138374 - RNA, 46 nt, Homo sapiens
gauaaaguuuuacacaauaucaugucuauuuuuacauuuaugggag

SEQ ID NO: 138375 - RNA, 45 nt, Homo sapiens
auguuuccuuuucuuuuucuacuuuuuauuuggaaaugacuucaa

SEQ ID NO: 138376 - RNA, 40 nt, Homo sapiens
cugugugacucaggacccccgagucugauuuccauuuaga

SEQ ID NO: 138377 - RNA, 46 nt, Homo sapiens
uguuugauugggcuaaaacagaagaugccccaaaggacagguuguu

SEQ ID NO: 138378 - RNA, 44 nt, Homo sapiens
aaaaucuuccuuuuugauacccagcauuuuauaaguaaagagag

SEQ ID NO: 138379 - RNA, 48 nt, Homo sapiens
ugcuggagagaaaggggcgaugauaaaggguaugagauuccauuugag

SEQ ID NO: 138380 - RNA, 46 nt, Homo sapiens
uggaaaacaggcuugggggagaagagaaauuccaggaacgggugac

SEQ ID NO: 138381 - RNA, 60 nt, Homo sapiens
uggccauggcggaugacucucuuuggaaaccacugaacuaccagauucugcuaaagacga

SEQ ID NO: 138382 - RNA, 94 nt, Homo sapiens
auuugcugcuuugauuacuguguuagcacuggcugaaaaacuaaaggagaauuauauugucuugcuaccagaauccauuccuuucuuagcagag

SEQ ID NO: 138383 - RNA, 27 nt, Homo sapiens
acaaaaguacauucuccuuuguuucuu

SEQ ID NO: 138384 - RNA, 55 nt, Homo sapiens
acuauucagcaacuggaaacuguccugggagagccacuccagagcuauuucuaag

SEQ ID NO: 138385 - RNA, 45 nt, Homo sapiens
cuccugccuaucguauagagcugcagaaagaguaaaugauacacg

SEQ ID NO: 138386 - RNA, 32 nt, Homo sapiens
aguggagucauuguuucccaaagggaaauuag

SEQ ID NO: 138387 - RNA, 42 nt, Homo sapiens
acauuugagcaaaguccuaccuaaugugaaagagccaugaga

SEQ ID NO: 138388 - RNA, 41 nt, Homo sapiens
gaauaggcagaaagcugguauagcuggagugaacgagaggg

SEQ ID NO: 138389 - RNA, 76 nt, Homo sapiens
acagcaucuaugaagagaacuguuucaaguaacuggagggggugggggaagaaggaacgacugauagagggucggg

SEQ ID NO: 138390 - RNA, 56 nt, Homo sapiens
aacacugcugaaaagaugaggaaaaggaaacuacuacauagaaaaagaggaaggga

SEQ ID NO: 138391 - RNA, 24 nt, Homo sapiens
ucugcugaggagcaguaauuuaaa

SEQ ID NO: 138392 - RNA, 45 nt, Homo sapiens
guaagacuauauagugguaguuuaaauuagauugauagaggccau

SEQ ID NO: 138393 - RNA, 58 nt, Homo sapiens
uuaauuauaauuccuuauuuucuuggaauauuuaaaaagcacuaugguuguuaugaaa

SEQ ID NO: 138394 - RNA, 49 nt, Homo sapiens
uuuuuucuaguuagaggccacgugcuucagaaucaucugugauaggaca

SEQ ID NO: 138395 - RNA, 49 nt, Homo sapiens
auguuucuccuguuuugauucuuagauuaugaggaggaucagacagaau

SEQ ID NO: 138396 - RNA, 50 nt, Homo sapiens
gaguugucggugggcauuucagcccuguguguagcaugguuuugugggaa

SEQ ID NO: 138397 - RNA, 46 nt, Homo sapiens
uacuaauauuacucccauucuaagaugaggaaauugaggcauagaa

SEQ ID NO: 138398 - RNA, 32 nt, Homo sapiens
cugggagaauacaugcuuucucagugaucggg

SEQ ID NO: 138399 - RNA, 30 nt, Homo sapiens
uaucuuuaaucacauguucuaaagcuagag

SEQ ID NO: 138400 - RNA, 46 nt, Homo sapiens
ccauggauucagucccagaucuuauuucuuugacaacccucgaaga

SEQ ID NO: 138401 - RNA, 100 nt, Homo sapiens
caccucucgggccugcuacaaccuguucauccugucauuuucucagaacaagagcguccauuccuuugauuaugacugguacaauguaucagaccagguc

SEQ ID NO: 138402 - RNA, 43 nt, Homo sapiens
uucccgaacugcggucccgcaaacccggucccgcggccaggac

SEQ ID NO: 138403 - RNA, 41 nt, Homo sapiens
cgacagauccgacaucgacgcagucuacgugagugagcccc

SEQ ID NO: 138404 - RNA, 79 nt, Homo sapiens
gagaauacaugcuuucucagugaucggggagcagagaaauccuggucagauaggauaaaagauugucgcugagaaaaaa

SEQ ID NO: 138405 - RNA, 30 nt, Homo sapiens
aucuuuaaucacauguucuaaagcuagaga

SEQ ID NO: 138406 - RNA, 37 nt, Homo sapiens
gucugaugacucucccugucuguuucuaacaggcaga

SEQ ID NO: 138407 - RNA, 106 nt, Homo sapiens
caccucucgggccugcuacaaccuguucauccugucauuuucucagaacaagagcguccauuccuuugauuaugacugguacaauguaucagaccaggucaguggg

SEQ ID NO: 138408 - RNA, 46 nt, Homo sapiens
cgcucuucgugcugugugccgucucucucuccaucugucucuacaa

SEQ ID NO: 138409 - RNA, 36 nt, Homo sapiens
ccuagcaguuucuaaauuugaucacgugacauuuau

SEQ ID NO: 138410 - RNA, 40 nt, Homo sapiens
acagacugaagcagcugacuaaugacuguugccuggggag

SEQ ID NO: 138411 - RNA, 36 nt, Homo sapiens
aagacuucguggcggccaauucgcucagccccuucg

SEQ ID NO: 138412 - RNA, 41 nt, Homo sapiens
uggaggacggggaugacuucgucucuccugcccuggagcug

SEQ ID NO: 138413 - RNA, 43 nt, Homo sapiens
agccuccuguauuuguguguggacuccggaugugucuuggcag

SEQ ID NO: 138414 - RNA, 44 nt, Homo sapiens
cgggaaacacagggcucccagugaucccauuuccuguggccagg

SEQ ID NO: 138415 - RNA, 45 nt, Homo sapiens
guugaaacaauuguacauaagugguuccagcuguuacccaugugg

SEQ ID NO: 138416 - RNA, 44 nt, Homo sapiens
uguuacuuccaggaaaaugaaguuuacaagggagaaguuuaaag

SEQ ID NO: 138417 - RNA, 48 nt, Homo sapiens
uucaguaaaauuagcugaaaaauaauuuuccaaugcaaauacuaauga

SEQ ID NO: 138418 - RNA, 44 nt, Homo sapiens
ggucaccacaaauggcaucauugcuacgagugaacccccggcca

SEQ ID NO: 138419 - RNA, 69 nt, Homo sapiens
acacgaccgauggccuggggaagguuuauuaucgagaagacuuaucccccuccaucacucagcgagcag

SEQ ID NO: 138420 - RNA, 47 nt, Homo sapiens
ugggaauccguggcccccuaccaagggcccagcagggacccagacca

SEQ ID NO: 138421 - RNA, 48 nt, Homo sapiens
uccuuuauccugaggauggucugcaguuccauacgacauucucaaaga

SEQ ID NO: 138422 - RNA, 101 nt, Homo sapiens
gaaaacaaccaaguuccugccgugguugcauucagucaagguucagugggauucuuauggaagagcaacggagcuuauaacauauuugcuaaugacaggga

SEQ ID NO: 138423 - RNA, 41 nt, Homo sapiens
uaggaguaguaacucugggcagcagggugucuggguguuug

SEQ ID NO: 138424 - RNA, 45 nt, Homo sapiens
ccauuggugguggcuggacucccaaucucaaacacccagacaccc

SEQ ID NO: 138425 - RNA, 49 nt, Homo sapiens
cguggugccugcagacgugauccucggaacugaagauggggcagaguau

SEQ ID NO: 138426 - RNA, 87 nt, Homo sapiens
ggccuuucgguagcugcccggcgcggggagaggacgcugggcacacuguaugugucagcaccuccccuucucagagccuuguaggag

SEQ ID NO: 138427 - RNA, 51 nt, Homo sapiens
gcccuucuccuacaaggcucugagaaggggaggugcugacacauacagugu

SEQ ID NO: 138428 - RNA, 46 nt, Homo sapiens
cuuuucaccagcagcacccucaggucauagauguggaugaaguuga

SEQ ID NO: 138429 - RNA, 70 nt, Homo sapiens
cagcuauaacacggauucccgccagacgugugcuaacaacagacaccagugcucggugcacgcagagugc

SEQ ID NO: 138430 - RNA, 34 nt, Homo sapiens
cagguuccccccagcgagucaauggcaaggugaa

SEQ ID NO: 138431 - RNA, 46 nt, Homo sapiens
ccaguggaagcagagaauauccaacggucucgggaauggugcugau

SEQ ID NO: 138432 - RNA, 46 nt, Homo sapiens
ggccccaguuggaggcaucauuggauggauguuugcaguggagcag

SEQ ID NO: 138433 - RNA, 67 nt, Homo sapiens
aaugaccagauugcccgggugccccacgaaggucaccucagccuggcgagugaacucacccccugaa

SEQ ID NO: 138434 - RNA, 67 nt, Homo sapiens
accuucguggggcacccgggcaaucuggucauuaagcagcgguucagcggcaucgaugagcaugggc

SEQ ID NO: 138435 - RNA, 24 nt, Homo sapiens
cggcuccuccgugcacauugagcc

SEQ ID NO: 138436 - RNA, 50 nt, Homo sapiens
cgcucgggcucagucaccguguacucccggguggaggaggaagugaucac

SEQ ID NO: 138437 - RNA, 51 nt, Homo sapiens
gugacugagcccgagcgagauggggcaucuccuucacgcaucuacacuuac

SEQ ID NO: 138438 - RNA, 51 nt, Homo sapiens
ggaaugcguccacgaugacucccggccagcccugcccagcacccagcagcu

SEQ ID NO: 138439 - RNA, 42 nt, Homo sapiens
ccucacaggcccaauggaguugcugagagcauagcgcaagau

SEQ ID NO: 138440 - RNA, 44 nt, Homo sapiens
acgcggccugucgcccuggucccaggacacaguucaccugcgag

SEQ ID NO: 138441 - RNA, 46 nt, Homo sapiens
gagccacacaaucugcaauaaucacccaggaaccuuccgcugcgag

SEQ ID NO: 138442 - RNA, 66 nt, Homo sapiens
gccgugauccccuugccuccugggacccauuuacucuuugcccagacugggaagauugagcgccug

SEQ ID NO: 138443 - RNA, 60 nt, Homo sapiens
ccccuggagggaaauaccaugaggaagacagaagcaaaggcguuccuucaugucccggug

SEQ ID NO: 138444 - RNA, 46 nt, Homo sapiens
ugacugcguggacaagaugguuuacuggacggacaucacugagccu

SEQ ID NO: 138445 - RNA, 47 nt, Homo sapiens
gaugguggcuuaaagugaacaggaugucauuguauguggcuggagac

SEQ ID NO: 138446 - RNA, 133 nt, Homo sapiens
caccuuggccgcaacaucuucuggacagacucuaaccuggaucgaauagaaguggcgaagcuggacggcacgcagcgccgggugcucuuugagacugacuuggugaaucccagaggcauuguaacggauuccg

SEQ ID NO: 138447 - RNA, 44 nt, Homo sapiens
ccucugggauucaccaagucagucucaaagagcacccggcgcug

SEQ ID NO: 138448 - RNA, 100 nt, Homo sapiens
ccaggaaccuuuacuggacagacuggaacagagauaaccccaagauugaaacuuccuacauggacggcacgaaccggaggauccuugugcaggaugaccu

SEQ ID NO: 138449 - RNA, 46 nt, Homo sapiens
agagcugagaugagaacgcaucgaaggucaguccauugggcaagcc

SEQ ID NO: 138450 - RNA, 44 nt, Homo sapiens
ggcugacugggguucaggcauuccgcccgauuggugccugugug

SEQ ID NO: 138451 - RNA, 57 nt, Homo sapiens
cgaagggcuccaguauccuuuugcugugacgagcuacgggaagaaucuguauuucac

SEQ ID NO: 138452 - RNA, 65 nt, Homo sapiens
aaguggacauggagcccaccggccacgugacccugggccaacuccuggggaaagaacagacgugc

SEQ ID NO: 138453 - RNA, 104 nt, Homo sapiens
ccgugguugcucucgaucuugcaauuuccaaggagacggaugcuuuccaaccccacaagcagacccggcuguauggcaucaccacggcccugucucaguguccg

SEQ ID NO: 138454 - RNA, 46 nt, Homo sapiens
uuggaaagcauccgucuccuuggaaauugcaagaucgagagcaacc

SEQ ID NO: 138455 - RNA, 79 nt, Homo sapiens
auuucuguucgauacagucaacucccaagguguugucagggcaacggcagguccugcucccugggguggccaagcauag

SEQ ID NO: 138456 - RNA, 48 nt, Homo sapiens
accugccguugcccugacaacaccuugggaguugacuguaucgaacag

SEQ ID NO: 138457 - RNA, 53 nt, Homo sapiens
gauugaaaaguguccucuggcugaguggccacuaggcccagacccagcccagc

SEQ ID NO: 138458 - RNA, 47 nt, Homo sapiens
uggggaacagugagggaaaaguuguuggggcucaggcugggcugggu

SEQ ID NO: 138459 - RNA, 58 nt, Homo sapiens
cuacacaaggacagaacccuccaccccuacccccaacccucagacagacuuauacacc

SEQ ID NO: 138460 - RNA, 113 nt, Homo sapiens
guaccucaaagcgaggcugagcucauaaggccacagggaagggugcaacucaaauuugggagguucuguucaccacuggggggcuaguauugggaaaagguccuaggacacug

SEQ ID NO: 138461 - RNA, 71 nt, Homo sapiens
uuugaguugcacccuucccuguggccuuaugagcucagccucgcuuugagguacccaccguccugucagcu

SEQ ID NO: 138462 - RNA, 71 nt, Homo sapiens
uuuacuccucaguuccucaccaucaucaucuugucuaagacccccauuauaauauucaugcgcugcuuuuu

SEQ ID NO: 138463 - RNA, 63 nt, Homo sapiens
caugaauauuauaaugggggucuuagacaagaugaugauggugaggaacugaggaguaaaacu

SEQ ID NO: 138464 - RNA, 62 nt, Homo sapiens
aaggcuuaaaucaaaagaauguccaaugguaggaauuucaagguguaggucagauauuugag

SEQ ID NO: 138465 - RNA, 60 nt, Homo sapiens
auaccaaagauuacuaauuauuccucuuugcccaaaauacuugcauccaagguucuaguc

SEQ ID NO: 138466 - RNA, 46 nt, Homo sapiens
gauuguguuguuagauaagaauacauccaaaaagggccacagaucg

SEQ ID NO: 138467 - RNA, 47 nt, Homo sapiens
uuucuaaacaaauuguagaaauauaaacaugaaauguggcaaugauc

SEQ ID NO: 138468 - RNA, 47 nt, Homo sapiens
ucauguuuauauuucuacaauuuguuuagaaaacaucuccugaccau

SEQ ID NO: 138469 - RNA, 48 nt, Homo sapiens
ccagaguccuaaaacaauagaaauuuuggauugaaaaguucagcauaa

SEQ ID NO: 138470 - RNA, 84 nt, Homo sapiens
aucaacaagagaaauaaaaaagcccaagaggaagugguaggggaaggaauuuaagaacagcaauaaguaaaacucuuaaguaac

SEQ ID NO: 138471 - RNA, 43 nt, Homo sapiens
ucucuccucuuuuccucaaaccccaguacacucagccucucug

SEQ ID NO: 138472 - RNA, 57 nt, Homo sapiens
ucaauucagguuccaauguacugcagaagcaagugaggacaaagucaggagaaggug

SEQ ID NO: 138473 - RNA, 43 nt, Homo sapiens
agcugaaaauaguuuuaguuuacucauuaucacaugcuagaag

SEQ ID NO: 138474 - RNA, 46 nt, Homo sapiens
acuguacuccucguagcccccguagccugugcuguaggcaccaggc

SEQ ID NO: 138475 - RNA, 46 nt, Homo sapiens
uguuucccuagagccuucucagcuaacuccugcgaggcaaacugca

SEQ ID NO: 138476 - RNA, 44 nt, Homo sapiens
ugaacaccucaauguaccggugucccaugcuuucccugucuuuu

SEQ ID NO: 138477 - RNA, 47 nt, Homo sapiens
guguagaugaaauggacaccugcggccccaucaugaaucgugcaguc

SEQ ID NO: 138478 - RNA, 58 nt, Homo sapiens
ccuuuuguuagucacaaauccuagcuauaacucucaucaccuguguaaaacaguggug

SEQ ID NO: 138479 - RNA, 87 nt, Homo sapiens
cauagagacuguggugcuguacacgggagagacaccgucugaacaagaucagggcaagaggaucauugaacgagacagaaagcgacc

SEQ ID NO: 138480 - RNA, 42 nt, Homo sapiens
acauguccuuugugccuacugcuaugaaaaggugugcaagga

SEQ ID NO: 138481 - RNA, 76 nt, Homo sapiens
auagucacauaaauaaggccauacagagaaauggugagcuggcucuuuucuuuagagagcagacaggaaucaagau

SEQ ID NO: 138482 - RNA, 39 nt, Homo sapiens
ccggccgggcuuucccaguccuccgugggguagguaaag

SEQ ID NO: 138483 - RNA, 46 nt, Homo sapiens
uuaccacaugauacaagagccggcugguggaagaguggggaccaga

SEQ ID NO: 138484 - RNA, 76 nt, Homo sapiens
gcugaagaggagaaggaaaaaaaaaacaccaaaaaaaaaaauaaaaaaauccacacacacaaaaaaaccugcgcgu

SEQ ID NO: 138485 - RNA, 66 nt, Homo sapiens; identical to SEQ ID NO: 42995

SEQ ID NO: 138486 - RNA, 48 nt, Homo sapiens
agaugguggaggccgucaagaagcacauuuuaaacaugcugcacuuga

SEQ ID NO: 138487 - RNA, 48 nt, Homo sapiens
ucagaaagcuucaugugggcaaagucggggagaacggguauguggaga

SEQ ID NO: 138488 - RNA, 51 nt, Homo sapiens
accuuuagaaaaugucuauaagugcacaggcaccacauucaagacagggaa

SEQ ID NO: 138489 - RNA, 43 nt, Homo sapiens
ggaaagaugggaaaagagauuaauaguggucugcggccugugc

SEQ ID NO: 138490 - RNA, 47 nt, Homo sapiens
caugcaauauacaaauagcaguuccagaaauggacaccaggagaagg

SEQ ID NO: 138491 - RNA, 45 nt, Homo sapiens
aagacgcugcacuucgagauuuccaaggaaggcagugaccuguca

SEQ ID NO: 138492 - RNA, 70 nt, Homo sapiens
aggggaagaggccgaggaagugggcuuaaagggggagaggagugaacuguugcucucugaaaaaguagua

SEQ ID NO: 138493 - RNA, 55 nt, Homo sapiens
gaguggcgccagcuugguucuccugggcaagaagaagaagaaagaagaggagggg

SEQ ID NO: 138494 - RNA, 55 nt, Homo sapiens
cugcaggcccggcagucugaagaccacccucaucgccggcgucggcggggcuugg

SEQ ID NO: 138495 - RNA, 46 nt, Homo sapiens
gccaacuacugcgagggugagugcccgagccauauagcaggcacgu

SEQ ID NO: 138496 - RNA, 60 nt, Homo sapiens
cauagaguugcccagcccagggggaaagggagcaagaguuguccagagaagacaguggca

SEQ ID NO: 138497 - RNA, 44 nt, Homo sapiens
aaaaaacaaaaguaaauuaaaaacaaaaccugaugaaacagaug

SEQ ID NO: 138498 - RNA, 50 nt, Homo sapiens
ggacuagaacaacccaaauagcaucuagaaagccaugaguuugaaagggc

SEQ ID NO: 138499 - RNA, 51 nt, Homo sapiens
cacuuuugcaacaaaacaaaacaaacaacauuaaaaaauugagaacaagua

SEQ ID NO: 138500 - RNA, 45 nt, Homo sapiens
guaucauucaccaucaaugagucagggguugggauucaagguuga

SEQ ID NO: 138501 - RNA, 48 nt, Homo sapiens
uguacacuguuggauaucaaguucaaucaaauucauggaacuacaugc

SEQ ID NO: 138502 - RNA, 81 nt, Homo sapiens
uuuuugcuuuuacucugaacuaggugggcgcauuucaaaaauucggaugggaaaaagccuggaaauuccagugaauauuca

SEQ ID NO: 138503 - RNA, 65 nt, Homo sapiens
ucaucacuaacuaaaagauaauuaauuugagagaaaguguuaagagagggagaguaaggaagaga

SEQ ID NO: 138504 - RNA, 45 nt, Homo sapiens
auauuuuguaaaauauugaagcuuuuagcccuaugucaauuugua

SEQ ID NO: 138505 - RNA, 43 nt, Homo sapiens
ugucacuacugggcaaauacacuuacuguguucuagaggcagc

SEQ ID NO: 138506 - RNA, 56 nt, Homo sapiens
agugugagaaauuaaguccugguucacugcgcaguagcaaagauggucaaggccau

SEQ ID NO: 138507 - RNA, 65 nt, Homo sapiens
aaccuuacuaucuccucacucuuucucuaagacuaaacucuaggcucuuaaaaaucugcccacac

SEQ ID NO: 138508 - RNA, 51 nt, Homo sapiens
ucccugcagucuccuuaaagguagaacaaauacuuucuauuuuuuuuucac

SEQ ID NO: 138509 - RNA, 41 nt, Homo sapiens
auuaaacccuguaucacugagaagcuguuguaugggucaga

SEQ ID NO: 138510 - RNA, 70 nt, Homo sapiens
ugaagccuguuuuauuuuaaaacuuuuuauguucugugguugauguuguuuguuuguuuguuucuauuuu

SEQ ID NO: 138511 - RNA, 47 nt, Homo sapiens
acugguaauuuuuuuauuuacaauauguuuaaagagauaacaguuug

SEQ ID NO: 138512 - RNA, 47 nt, Homo sapiens
aguggacaguauucagcaacgccugauagcuucuuuggccuuauguu

SEQ ID NO: 138513 - RNA, 45 nt, Homo sapiens
agcagauaccagagaagcaucuuucuugcagaaaacuugucaguu

SEQ ID NO: 138514 - RNA, 46 nt, Homo sapiens
aauagaaaucaacuuuccagcagaguacccauucaaaccaccgaag

SEQ ID NO: 138515 - RNA, 45 nt, Homo sapiens
augacccccagcccaagcacccgcuucgggcugaccuagcugaag

SEQ ID NO: 138516 - RNA, 45 nt, Homo sapiens
cuugugaaagugacucugacuccugaggaagaggccuguuugaag

SEQ ID NO: 138517 - RNA, 36 nt, Homo sapiens
ccaagucagugauuuagguaaucccgccgccccugg

SEQ ID NO: 138518 - RNA, 42 nt, Homo sapiens
caauucggcuacuccccagggcagcagcagacccacccccag

SEQ ID NO: 138519 - RNA, 55 nt, Homo sapiens
cccuuuacguggauuauuuugucuaauccucucugagguacuauuguuagcccaa

SEQ ID NO: 138520 - RNA, 43 nt, Homo sapiens
cccguacacagauuuuccuaauucuccauuuccuccuguuugc

SEQ ID NO: 138521 - RNA, 50 nt, Homo sapiens
aguggaaguuuuccauuccuuuagugagaguaaauacaaaagacagagag

SEQ ID NO: 138522 - RNA, 41 nt, Homo sapiens
acuacauuagacacaaaaguauuugagaugacaguggucau

SEQ ID NO: 138523 - RNA, 40 nt, Homo sapiens
uuuuucuaaaggguucuccaaggacaucuacaccauuugg

SEQ ID NO: 138524 - RNA, 41 nt, Homo sapiens
aaauuauuucaagccuucaaugcuugaagauccuugggcug

SEQ ID NO: 138525 - RNA, 59 nt, Homo sapiens
cacauuuuagagauuuaccguuuccauauauuuaacauuccugguuacauaauggacau

SEQ ID NO: 138526 - RNA, 48 nt, Homo sapiens
acccauuuaagcauaacuuuauacucauuuaacuggaaaaggcaagaa

SEQ ID NO: 138527 - RNA, 37 nt, Homo sapiens
cucuuagaucauuggguuauuaguaaagacgaaaaca

SEQ ID NO: 138528 - RNA, 44 nt, Homo sapiens
aauaaaagcuauuaauaauaagcugucaugggauccauuugaag

SEQ ID NO: 138529 - RNA, 47 nt, Homo sapiens
cuuuuauuugaauauugauuacuaacaacuuauaaacuacauugcag

SEQ ID NO: 138530 - RNA, 42 nt, Homo sapiens
uacuaauucuagaaaggaaccaaagguaaauaaccaguguuu

SEQ ID NO: 138531 - RNA, 45 nt, Homo sapiens
gagaaggugguagugaaaggcaacacagcccaaagacaggcagaa

SEQ ID NO: 138532 - RNA, 22 nt, Homo sapiens
agccccugaaacuucagaguuu

SEQ ID NO: 138533 - RNA, 43 nt, Homo sapiens
uuauguuagcaaugauggucuaggaagcaguucugcuccacca

SEQ ID NO: 138534 - RNA, 58 nt, Homo sapiens
ugaccccaaaagagaaggugggauugauuaucaagcaggagacacuuacguguccacu

SEQ ID NO: 138535 - RNA, 86 nt, Homo sapiens
cucgaauucugccuccugaccaacgaccucccgagccuccugaaccaccaccagucacugaggaagaucuagauuaucggacagaa

SEQ ID NO: 138536 - RNA, 49 nt, Homo sapiens
cagcaucaagauaugaggaucuuggagcuaacgccagaaccagaccggc

SEQ ID NO: 138537 - RNA, 76 nt, Homo sapiens
ggcagacucuauuauuagccuccuuuuacugagaagaagaaacugacaccgaaagagaccaagcaacuugcccaag

SEQ ID NO: 138538 - RNA, 41 nt, Homo sapiens
ucuucgcuuuuuacuccauaacucaugacaaucuugccaua

SEQ ID NO: 138539 - RNA, 40 nt, Homo sapiens
ucauacaaacacuuagaaaggaaauucuuuggcggguuua

SEQ ID NO: 138540 - RNA, 28 nt, Homo sapiens
auauuuauucaaaggaaaauucggauuu

SEQ ID NO: 138541 - RNA, 55 nt, Homo sapiens
ugaaaauaauucagcuauauagaauuuagggagaaggagcauuagcauagacaug

SEQ ID NO: 138542 - RNA, 47 nt, Homo sapiens
gagaccuagugucaguauaguacagauacauguaaaacugaucaaga

SEQ ID NO: 138543 - RNA, 40 nt, Homo sapiens
augguuauugaacauaauuagauaaugcgggagccaagga

SEQ ID NO: 138544 - RNA, 47 nt, Homo sapiens
aaagcagcaaaauaaacccaggaaauaaaaaugaauuauaauacaua

SEQ ID NO: 138545 - RNA, 56 nt, Homo sapiens
aagaacugauacucuuggaaaaaagaaauauaccuuucagugcuaauugggcauuu

SEQ ID NO: 138546 - RNA, 43 nt, Homo sapiens
gaaguacccgaagccagaaacuaguagugcuucaacuccaaag

SEQ ID NO: 138547 - RNA, 50 nt, Homo sapiens
ugcguuuuuuuaagucaaaggacuugaggcccaaaagauaagacuggcaa

SEQ ID NO: 138548 - RNA, 61 nt, Homo sapiens
agguaaaugggcuuggaauacagccuuucuggggaauuugcuauggcuuuugaguccuugu

SEQ ID NO: 138549 - RNA, 42 nt, Homo sapiens
auaaugcuagugcuuaaguuauuuggagaaauuuggcuggau

SEQ ID NO: 138550 - RNA, 40 nt, Homo sapiens
guucauuuuccagagaaaggggauaaagccagggagagaa

SEQ ID NO: 138551 - RNA, 49 nt, Homo sapiens
gugaucuaaacaagaucaucucuacgauguugacaguugguagccaaau

SEQ ID NO: 138552 - RNA, 46 nt, Homo sapiens
cauuuaugagacagcucauggagggucuggauuauugucauaagaa

SEQ ID NO: 138553 - RNA, 41 nt, Homo sapiens
auauugacuuuauucagcuucuaagagacaauuugacgucu

SEQ ID NO: 138554 - RNA, 40 nt, Homo sapiens
gacgucaaauugucucuuagaagcugaauaaagucaauau

SEQ ID NO: 138555 - RNA, 44 nt, Homo sapiens
agcccuuuugagucuguuaucccuucauccauaaaagggaaaca

SEQ ID NO: 138556 - RNA, 46 nt, Homo sapiens
gagaagguacuuacggacaaguuuacaaagccagggauaaagacac

SEQ ID NO: 138557 - RNA, 43 nt, Homo sapiens
cucuacuuucuuuucuuuuaacauauuguauuugucaguaucu

SEQ ID NO: 138558 - RNA, 39 nt, Homo sapiens
uuuauaaaauuuaaaaagguuaagucagaucugauagaa

SEQ ID NO: 138559 - RNA, 41 nt, Homo sapiens
gucuuuaaaauauguaauuaauuuugcauuuuucugauaau

SEQ ID NO: 138560 - RNA, 48 nt, Homo sapiens
aaagaucacuuuaaagaagagugaguaauggucugcauaaucucauug

SEQ ID NO: 138561 - RNA, 45 nt, Homo sapiens
uaacgaagguggaaaauaauuugauuguagauaaagccaccaaga

SEQ ID NO: 138562 - RNA, 53 nt, Homo sapiens
caaggggaacacggaaacuagugccagugcaucacaaacaaaccaugugaagg

SEQ ID NO: 138563 - RNA, 46 nt, Homo sapiens
guuagugugcuaggagaaauacuagaaugacgacuucuggaucuag

SEQ ID NO: 138564 - RNA, 89 nt, Homo sapiens
cccguauucaucuaggcauucaagaucucguagcaggcacagauugucuagauccagaagucgucauucuaguauuucuccuagcacac

SEQ ID NO: 138565 - RNA, 39 nt, Homo sapiens
cgguggagggaugcagcuucuuccagaaaauguggccau

SEQ ID NO: 138566 - RNA, 45 nt, Homo sapiens
ucacugagacugauuuuggacuucugacaugcagaacugcaagaa

SEQ ID NO: 138567 - RNA, 68 nt, Homo sapiens
uguguaaucacaaggauuuuuauaaaagagaggcuguagggucuagucagagaacucacgugaugaca

SEQ ID NO: 138568 - RNA, 31 nt, Homo sapiens
cguagauaugauuaaauuaaguauguugaua

SEQ ID NO: 138569 - RNA, 42 nt, Homo sapiens
ggauuaguuugguuauggugucuguagaaauggagcagacac

SEQ ID NO: 138570 - RNA, 67 nt, Homo sapiens
uauaggggaguuagccuuagauagaaagaggaacaccuccuuucuuaauugagguggaguguacggu

SEQ ID NO: 138571 - RNA, 155 nt, Homo sapiens
uauuccuucaggggaauuaacaaaugaacagcaaagguuaacaucacaauuaauagaguaagccagcuauugucauagaguagccuagcauagugcaucucagacuuuaauggauaucuuguuaaaaugcagauugugguucaguaggucugggc

SEQ ID NO: 138572 - RNA, 86 nt, Homo sapiens
uuugaaagguaggucauugguugcuucagaggugaccaguugcagaauggauguauguauaagccagauuguagugauuugaggau

SEQ ID NO: 138573 - RNA, 36 nt, Homo sapiens
agcauaaauuaaacuugugggagaaugaauauagga

SEQ ID NO: 138574 - RNA, 46 nt, Homo sapiens
uuuagcuguauuguguugaagauacaugucagaguuggaaguagag

SEQ ID NO: 138575 - RNA, 53 nt, Homo sapiens
aucugugagaagagauaaaagagaucauguggaauguagaauaauuuccaggu

SEQ ID NO: 138576 - RNA, 39 nt, Homo sapiens
cugaaagauuauucaagugcagaguuaauuggaaagggu

SEQ ID NO: 138577 - RNA, 58 nt, Homo sapiens
auauaaacagaauugugaugggaucguaggacaaguaccagcucuagcugacuggcgu

SEQ ID NO: 138578 - RNA, 73 nt, Homo sapiens
aagucaaggcuugaggauagaauaucucaguuuaguuggggaagauagauuaucugauuauuuuuauucugag

SEQ ID NO: 138579 - RNA, 67 nt, Homo sapiens
auccaaacaagcagcacggucuccauucuaugaacucccauagcauuuuaucugcacccuucuuaug

SEQ ID NO: 138580 - RNA, 84 nt, Homo sapiens
augugaaguuaagaguuaucauaagaagggugcagauaaaaugcuaugggaguucauagaauggagaccgugcugcuuguuugg

SEQ ID NO: 138581 - RNA, 26 nt, Homo sapiens
uauaugugaauauuaagcaacauuca

SEQ ID NO: 138582 - RNA, 54 nt, Homo sapiens
aucuguaaacuugcuugguauuuugguuuacauacacucucauacucuaggaua

SEQ ID NO: 138583 - RNA, 73 nt, Homo sapiens
ugacacuuuuuaaaagcauuuuaagaauuccauucaccuagggauuuucaugacuuauuucuauuaaguauau

SEQ ID NO: 138584 - RNA, 48 nt, Homo sapiens
cuuguucuuugucuucauuugaaucuucaguccucggcucaugcauuu

SEQ ID NO: 138585 - RNA, 56 nt, Homo sapiens
uaaugcuguaagaaacaguguaauauuuccccagccuaugcagaacuuacauauua

SEQ ID NO: 138586 - RNA, 44 nt, Homo sapiens
ugaauagguguaaaugaagggaugcuggaguuuacugaacauac

SEQ ID NO: 138587 - RNA, 38 nt, Homo sapiens
guuugucaaauguccagcuuaaaacauagggccuagaa

SEQ ID NO: 138588 - RNA, 42 nt, Homo sapiens
acaauuuaaagugcuugaugcaauuuuaagaauggauuuugu

SEQ ID NO: 138589 - RNA, 69 nt, Homo sapiens
acagaaaugggagaagcagccuuucuguaaaguuuauucuuuuaguauguuaaaaaagcuuagguggaa

SEQ ID NO: 138590 - RNA, 87 nt, Homo sapiens
cuuaagaucuaguauuguacaggggaauaagaaucagguacugaugucagaguuagauguggauugcagauguuucuuaugauuauu

SEQ ID NO: 138591 - RNA, 75 nt, Homo sapiens
cagucccuacagcccugugcucaggugaguucugccguucugccugugugugccuuggcugcgcuggccagaucc

SEQ ID NO: 138592 - RNA, 46 nt, Homo sapiens
uagggacugcgagagcggcgccagcugcugcugcuguagggacuag

SEQ ID NO: 138593 - RNA, 42 nt, Homo sapiens
gggggagcggcggcgacuguaggggcucggggagcgcggcag

SEQ ID NO: 138594 - RNA, 82 nt, Homo sapiens
uccgcucugaauacccccggccacgccacacgagcggccucaacccugagacgcccagggaacaugagcugacccucuagaa

SEQ ID NO: 138595 - RNA, 44 nt, Homo sapiens
ggcugcagcccgagcuuucuaugaggcccugauuggggaugaga

SEQ ID NO: 138596 - RNA, 114 nt, Homo sapiens
acucccagagaucucagacugaaccugccagagaaagaaagagaaagaaaagaagaauaaugaaggcaccagcagcagaagcaguggcagaaggagcaucaggaagacauggac

SEQ ID NO: 138597 - RNA, 41 nt, Homo sapiens
gcauggucagggagagccauggagagacaaggagcccggaa

SEQ ID NO: 138598 - RNA, 45 nt, Homo sapiens
agacagggcuugggagcgggaucuaaggacuuacaugaaccucga

SEQ ID NO: 138599 - RNA, 53 nt, Homo sapiens
auuguggaaucuuugauuuugcaucagaguaaaauaaaauaaacccaucacau

SEQ ID NO: 138600 - RNA, 47 nt, Homo sapiens
gcaagcuuaaugugguuugaggaaagcaucagauuugucccuggaag

SEQ ID NO: 138601 - RNA, 81 nt, Homo sapiens
uucgacccggagucaaauugacccuuuaucagcuuuaaucgauggaaacaacuucagugcaggaggucacaagguuggcuu

SEQ ID NO: 138602 - RNA, 84 nt, Homo sapiens
ugggcuguguuggucuuugaaggguggcuugccggcuaucagaugaguuuugacacagccaaauccaaauugucacagaauaau

SEQ ID NO: 138603 - RNA, 46 nt, Homo sapiens
aaggguugaaacugagucuugauaccauauugguaccaaacacagg

SEQ ID NO: 138604 - RNA, 45 nt, Homo sapiens
gaugucuucaacaaaggauauggcuuuggcauggggaagauagac

SEQ ID NO: 138605 - RNA, 45 nt, Homo sapiens
ugccggcagcgguuacauaaggccugcucaguucugagaucuaua

SEQ ID NO: 138606 - RNA, 24 nt, Homo sapiens
aaagcucccugcgaagagaaguua

SEQ ID NO: 138607 - RNA, 46 nt, Homo sapiens
gcuccaaaacgauuuauaguugaccuucauauucacagaugcccaa

SEQ ID NO: 138608 - RNA, 45 nt, Homo sapiens
aguaggauuugcgugaaauuauuuuaucuuacuugcaccuuuuuu

SEQ ID NO: 138609 - RNA, 43 nt, Homo sapiens
ucagaauagugauuguuaauguuaaaguggacuauguccacaa

SEQ ID NO: 138610 - RNA, 34 nt, Homo sapiens
uuuauaauaaauauguuuguuuuagaaaauuuag

SEQ ID NO: 138611 - RNA, 46 nt, Homo sapiens
ccuguguauuauucuaccuucacuuguccauuggauguauaauuag

SEQ ID NO: 138612 - RNA, 39 nt, Homo sapiens
gaauuggggacuugggggguaauuaaauuuagaugaggg

SEQ ID NO: 138613 - RNA, 51 nt, Homo sapiens
agcuauuaaauguuaacacuuuagcuuuuuuuaaguuuaauuuauagcaag

SEQ ID NO: 138614 - RNA, 25 nt, Homo sapiens
acugaacauguuuacuacacuuccu

SEQ ID NO: 138615 - RNA, 22 nt, Homo sapiens
uagucacugucuggugcugugu

SEQ ID NO: 138616 - RNA, 41 nt, Homo sapiens
augugcuacccuccugguauagaugugugcuaaccagagaa

SEQ ID NO: 138617 - RNA, 45 nt, Homo sapiens
uuuacagaauauuaggauaggccaugagcuuuucaauaccagagu

SEQ ID NO: 138618 - RNA, 48 nt, Homo sapiens
uuagcugugugaugucugcuaaguuauuuauaccucucucuaccucag

SEQ ID NO: 138619 - RNA, 59 nt, Homo sapiens
uuuaacuguacagguguguuugagaaccacuaagguaaagcauguugacacauuuaggg

SEQ ID NO: 138620 - RNA, 46 nt, Homo sapiens
aaugugaacaugcacauaaccuaugacucagcaauuccauuccaag

SEQ ID NO: 138621 - RNA, 45 nt, Homo sapiens
ugugauauauucauacaugaaauaauacccagcaguggcaaagaa

SEQ ID NO: 138622 - RNA, 52 nt, Homo sapiens
agaaggacugaugagagaagcuggcuuuccauguggaagaacaacauaauag

SEQ ID NO: 138623 - RNA, 46 nt, Homo sapiens
uuguguucaggaaauggcaaauuguccaauuuauuugguacauaaa

SEQ ID NO: 138624 - RNA, 46 nt, Homo sapiens
ggagagauagggucugauguauguuuuaaaaaguugaauuugccag

SEQ ID NO: 138625 - RNA, 72 nt, Homo sapiens
gacucuuuucagagcaggagggucacuauacaugaaggaauaaauuggagaugaggaaguagaaacaaucag

SEQ ID NO: 138626 - RNA, 46 nt, Homo sapiens
gaagguuuuugccgaccauguuuugguucauggcaaaaaccaguga

SEQ ID NO: 138627 - RNA, 49 nt, Homo sapiens
uagaaugugugaauccuucacuacugguauugaggauggauuaggaaag

SEQ ID NO: 138628 - RNA, 130 nt, Homo sapiens
auugaagguauauagaaguaaaauugugugagauuuuguguguguguuuaccuaaaaaaaauucucuauguuaaauuagaaaaacacaaaauuaguuaaguuggugauuucaugggugguuuggggauaa

SEQ ID NO: 138629 - RNA, 44 nt, Homo sapiens
acauuucgugagauccaguugcaagcaguuugugaccggaggga

SEQ ID NO: 138630 - RNA, 46 nt, Homo sapiens
uguagaguaggaaagcacuagauagauuuaucagcacaaaacagag

SEQ ID NO: 138631 - RNA, 129 nt, Homo sapiens
uacuacuaugguuaaugguuaaguaccauuuuuuccccucuuaagaguaaaccuuuaagaauauaagccauuuccacagcaggaggcaaaauaguuuggauaagaguccuuaaguaggauaacagaaag

SEQ ID NO: 138632 - RNA, 43 nt, Homo sapiens
ggugaaaauggcauuaagauuaaagaaauacguauggcuguac

SEQ ID NO: 138633 - RNA, 86 nt, Homo sapiens
ucacuugcaucucuuguauucucacaggacucccugagccucugguacuuuucaccaaagucuuccaugaucucugugguauggua

SEQ ID NO: 138634 - RNA, 36 nt, Homo sapiens
agaaaauguggugggucagaacaagaguuuacuccc

SEQ ID NO: 138635 - RNA, 37 nt, Homo sapiens
uauuuuuugaaaauaaaagcaguggcuccugggggag

SEQ ID NO: 138636 - RNA, 65 nt, Homo sapiens
ggacuuuuuccagaagaagaagcgaggguuuuggagaugacuggaacauguuuaugccaguguau

SEQ ID NO: 138637 - RNA, 47 nt, Homo sapiens
uauuccaucugcuugguacacuuuaauuuauuaagguguucuccuag

SEQ ID NO: 138638 - RNA, 40 nt, Homo sapiens
uagaaauugugcugggcacuggagauccaagaucaacaaa

SEQ ID NO: 138639 - RNA, 78 nt, Homo sapiens
aaaacaacauccacaacaaauagucuacguauuuguuguacuaaguuugucaccaucugaaaggauuuggaaaaaaau

SEQ ID NO: 138640 - RNA, 45 nt, Homo sapiens
uugauggcagcugaaauuagccaaaaaaauauuaaaagacauaag

SEQ ID NO: 138641 - RNA, 100 nt, Homo sapiens
caugaaagccugaauugucaaagagugcagaagcaaaauaauuuaggaauaacaggagaauagaaaaccagagcaucuuaaaaaaaaaaaaaauccagcc

SEQ ID NO: 138642 - RNA, 32 nt, Homo sapiens
ugcacguucagacagcugcauuguaagaguuc

SEQ ID NO: 138643 - RNA, 52 nt, Homo sapiens
uccuuuaguaugauagucauuauuucauuuuucuuauaacuucucuucagac

SEQ ID NO: 138644 - RNA, 42 nt, Homo sapiens
auuggcuuggcauauauaaaucaccugguggagagaggagac

SEQ ID NO: 138645 - RNA, 22 nt, Homo sapiens
acugaaggucagauuacaaaaa

SEQ ID NO: 138646 - RNA, 43 nt, Homo sapiens
uuugguuaggguuuugccacauugauccgagaauggccuggag

SEQ ID NO: 138647 - RNA, 45 nt, Homo sapiens
ugaagaaagauagucagaacaagacuuuacuuaaaacccuggcag

SEQ ID NO: 138648 - RNA, 50 nt, Homo sapiens
gacuacaauuugcaaguaaguauccuuucuuggacaaaugagcaucugaa

SEQ ID NO: 138649 - RNA, 101 nt, Homo sapiens
aaccauaaaauggacaacugagaauucucccagcugccugaaagcgucgccaacugugguuauccugcaagcugcuaccugcaacuuggacguuguuucca

SEQ ID NO: 138650 - RNA, 82 nt, Homo sapiens
auauuugggaugccccccgcgcuggaucaugggcuucccaacaccgcuggccuugaaugauucgggccuaauucguuauggu

SEQ ID NO: 138651 - RNA, 44 nt, Homo sapiens
ggccaggguucucauauuaucucaccuccaugccuacuuuccaa

SEQ ID NO: 138652 - RNA, 48 nt, Homo sapiens
agauccaccagggaaauauaccaggaaaauguugcagcauuagugcaa

SEQ ID NO: 138653 - RNA, 56 nt, Homo sapiens
ccagugcacguggucccagacuucacuuuucuuuucuuucaagaagcaucauccua

SEQ ID NO: 138654 - RNA, 52 nt, Homo sapiens
gaauacauuucuggcaguguaccaggguccuauuucaaagugacccagccuu

SEQ ID NO: 138655 - RNA, 40 nt, Homo sapiens
cuucauucauuaacucauucuuugggcacuugaggccagg

SEQ ID NO: 138656 - RNA, 70 nt, Homo sapiens
aaaaaaagagggagagagagagagagaacucuaaguuuagagaggcuggguaacuugcccagggccauag

SEQ ID NO: 138657 - RNA, 47 nt, Homo sapiens
auugcuaauauugacaaauucuugaggaguauauaugguuuguucag

SEQ ID NO: 138658 - RNA, 47 nt, Homo sapiens
cuggcugaucauugcaaaaugggugagcacugggagaucagaaaaua

SEQ ID NO: 138659 - RNA, 51 nt, Homo sapiens
guuccugcccagcguuuacuucuuuauuugcucuuguuuuauucccacagg

SEQ ID NO: 138660 - RNA, 36 nt, Homo sapiens
aauccugggagaaggagguuuaugccguguguggag

SEQ ID NO: 138661 - RNA, 41 nt, Homo sapiens
cuguccccuagccuucaugaugucaaugccagacacuggga

SEQ ID NO: 138662 - RNA, 67 nt, Homo sapiens
ugucagauguuguuucuugauugaaucagaaguuggcacaagaauuagaaguauguuuucacaugca

SEQ ID NO: 138663 - RNA, 71 nt, Homo sapiens
aucacauaaccugccucucucccauagcauguuagcuucauuuagaaagcucuuugcuucuuuuuagccug

SEQ ID NO: 138664 - RNA, 51 nt, Homo sapiens
gugguccucaaccuugacuguguacaagaagcauccagggagcuuguacaa

SEQ ID NO: 138665 - RNA, 51 nt, Homo sapiens
uucugcuggccaggggcagggcuuuucaucugcaucugugauaagcaccag

SEQ ID NO: 138666 - RNA, 39 nt, Homo sapiens
aucugggauuguuuccuuccugguuccucuucuuucuag

SEQ ID NO: 138667 - RNA, 23 nt, Homo sapiens
augcucaugcuguuggaccuaca

SEQ ID NO: 138668 - RNA, 36 nt, Homo sapiens
uggugauuugggcauccagagugagcuugagcagag

SEQ ID NO: 138669 - RNA, 41 nt, Homo sapiens
cucagcaggccagugucaaggcagaaaugugggcagcaaca

SEQ ID NO: 138670 - RNA, 52 nt, Homo sapiens
uaugagccaguuuugucuucuaaacugauaaucuugggggccagcagggagg

SEQ ID NO: 138671 - RNA, 46 nt, Homo sapiens
acuuccuccauacugagaccuacucuagcauguaugaaguauagug

SEQ ID NO: 138672 - RNA, 41 nt, Homo sapiens
aacaagaugauuacacaggcagcuaacuuuguagcuuaggc

SEQ ID NO: 138673 - RNA, 54 nt, Homo sapiens
gugggugggugaacugcagcucuuuacugucucugggaauggcguaagucaagg

SEQ ID NO: 138674 - RNA, 655 nt, Homo sapiens
gaaggucucuuuaaagaggugacacaagguggggcauguaauccucaugccuguaaucccagcacuuugggaggaugaggugggcggaucaccugagguggagaguucaagaccagccugaccaacauggagaaaccccaucucuacuaauaauacaaaaaugagccgggcaugguggcgcaugccuguaauuccagcuacuugggaggcugaggcaggagaaucgcuugaacccaggaggcagagauugcagugagccgagaucgugccauugcacuccagccuggggaacaagagugaaacuccaucucaaaaaaaaaaaagugacacuuugggaggccaaggcuggcagaucaccugaggucaggaguuugagacccaccuggccaacauggugaaacccugucucuaccaaaaauacaaaaauuagcugggugugguggugcacaccuguaauccaaacuacuugggagacugaggcagaagaauugcuugaccugggaggcagagguuucagugagcugagaucgcaccacugcacuccagccugggcaacagagugagacucugucucaaacaaacaaacaaauaaacaaaaaaaaggugacauuugagccaagacuggaggauaacagggagccagacccuagcauug

SEQ ID NO: 138675 - RNA, 48 nt, Homo sapiens
uagaauugagaaguuacucuauaagccagaaauuugggaucugugaac

SEQ ID NO: 138676 - RNA, 59 nt, Homo sapiens
uugcauaugaauaugcuaagcuaauaaaguacagugucaggauaggcauuuauuaugaa

SEQ ID NO: 138677 - RNA, 45 nt, Homo sapiens
uacauuaaauguaaauagacuaagcagcucaaugaaaagguuuag

SEQ ID NO: 138678 - RNA, 96 nt, Homo sapiens
ugcaccuaaaaauuuuaaauguguaugcacauuuaaaauuauuauacauguguauaauaaaguuuuaaaauacgugaagcaaacacugacuacuaa

SEQ ID NO: 138679 - RNA, 45 nt, Homo sapiens
uggaccuagggaaagaaggguggccuuagcaugguagauuuggug

SEQ ID NO: 138680 - RNA, 45 nt, Homo sapiens
cugagaaggacucuauuguacagugcuaccuuagaaauucaagua

SEQ ID NO: 138681 - RNA, 56 nt, Homo sapiens
agaaagacuguauauaauucagcagaaauuuaugaaguauuauaugacucauucau

SEQ ID NO: 138682 - RNA, 55 nt, Homo sapiens
uucauaaacuauaaacucuugaaauuaagaauguuguucaucaaaauaaagggag

SEQ ID NO: 138683 - RNA, 45 nt, Homo sapiens
uauuaacagcugagcuuguaugccuuagucugggcucuauguucu

SEQ ID NO: 138684 - RNA, 32 nt, Homo sapiens
ugcaucauuuccuuuaauaaaaucacccuuga

SEQ ID NO: 138685 - RNA, 49 nt, Homo sapiens
uguuuacauuaccaaacuggcuagacugcugagaaucuaucauuuuuag

SEQ ID NO: 138686 - RNA, 43 nt, Homo sapiens
gauguucauuaucucugcccuuggguugccauaaacuucccug

SEQ ID NO: 138687 - RNA, 65 nt, Homo sapiens
caguguuucucaaaaggauucauuucuucccugcucauguucacauuagaaucuccaucuguuga

SEQ ID NO: 138688 - RNA, 31 nt, Homo sapiens
aaccauacugcaccucucuaaguaaaagguu

SEQ ID NO: 138689 - RNA, 358 nt, Homo sapiens
uaaagugaucaugagucguuuguugguuuuguuuuguuuuguuuuuucuuugagacagaaucucacucugucgcccaggcuggagugcagugguacaaucucggcucacugcaaccuccgccuccuggguucaagugauucuggugccucagccucccgaguagcugggauuacaggcgugcaccaccacgcccagcuaauuuuuuguauguuuaguagagacaagguuucaccauguuucccaggcuggucucgaacuccugagcucaggcaaucugccugccuuggccucccaaagugcuaggauuacaggcaugagccacagugcccagccuguuggguuuugaguugggcaugg

SEQ ID NO: 138690 - RNA, 58 nt, Homo sapiens
auuugggagucuauaaaaucauuacaguauccaggggaacaaaacauuaaacauuuac

SEQ ID NO: 138691 - RNA, 29 nt, Homo sapiens
aaaaauguaaaagaaaaaacauuuuagac

SEQ ID NO: 138692 - RNA, 46 nt, Homo sapiens
auaauguaaucugcuuuuguaguaaguaaauuaauauuuuugagau

SEQ ID NO: 138693 - RNA, 41 nt, Homo sapiens
aggugaucugugaguacuuuaaaguuugagaaguacuggga

SEQ ID NO: 138694 - RNA, 52 nt, Homo sapiens
aagagaguuauguuuuauuuacaguguagaacugacuacagguacugcugaa

SEQ ID NO: 138695 - RNA, 38 nt, Homo sapiens
uuuuaaacuguagguaauaagacuuucuaucccugaag

SEQ ID NO: 138696 - RNA, 27 nt, Homo sapiens
uaaagggcuccuggggaauaggcaacc

SEQ ID NO: 138697 - RNA, 42 nt, Homo sapiens
ggcauggugaagaauaugagguuugaauguguagggguggag

SEQ ID NO: 138698 - RNA, 25 nt, Homo sapiens
gcagugucaagggcccaggugaugg

SEQ ID NO: 138699 - RNA, 45 nt, Homo sapiens
ugauucuagauuuacacacauacuugaaagucugaaguuugcaua

SEQ ID NO: 138700 - RNA, 65 nt, Homo sapiens
uguguguguguguguguguguguguguguguguuuuaacaaaugaaaaugcccugcaaaguugug

SEQ ID NO: 138701 - RNA, 48 nt, Homo sapiens
ugugguuaaauugucuccuuggauggucauuagccuugguuggagcag

SEQ ID NO: 138702 - RNA, 40 nt, Homo sapiens
cuccucugcuuucuggggcaccacuaauucuuaaaugcag

SEQ ID NO: 138703 - RNA, 43 nt, Homo sapiens
cggcuguuuuuguuccacuauaaacaaagccguacacugggga

SEQ ID NO: 138704 - RNA, 43 nt, Homo sapiens
gagaccauuucuccagacacagucacauucugagguacugggg

SEQ ID NO: 138705 - RNA, 42 nt, Homo sapiens
acugaggagcgaauugagaugaggaagggugauuaaggcaga

SEQ ID NO: 138706 - RNA, 41 nt, Homo sapiens
ggaagcagcagauggaauguuuuuuauuuauauaagagaag

SEQ ID NO: 138707 - RNA, 46 nt, Homo sapiens
auuaccaauauuuuagagcaugcauuauucauuuuuaugggcauua

SEQ ID NO: 138708 - RNA, 66 nt, Homo sapiens
gauucuaguccagcucugccugugaccuccugcgugacccggggcuuuucuccuauccugcacuca

SEQ ID NO: 138709 - RNA, 49 nt, Homo sapiens
ugguuuuggcauaaacugaggauuuggacagccuucaagaggaugggaa

SEQ ID NO: 138710 - RNA, 319 nt, Homo sapiens
aggauucauauucuugaagguacaaauccaacaucaagaccaaugggcggccaggcgucguggcucccgccuguaaucccagcacuuugggaggccaagguggauggaucaccugaggucaggaguuugagaccagccuguccaacauggugaaaccccaucuuuaauaaauauacaaaaauuagccaggcaugauggcacaugccuguaaucucagcuacucaggaggcugaggcaggagaaucgcuugaaccugggaggaagagguugcagugagccgagaucacaccauugcacuccagcaagacugucaaaacaa

SEQ ID NO: 138711 - RNA, 59 nt, Homo sapiens
ggggacgacucuaagucgcuuugugguggcagcagcuuagaaucaguauuugugguugg

SEQ ID NO: 138712 - RNA, 56 nt, Homo sapiens
uaaauguagcuuuguccuauugucugccgagaaaacugaauuggaacaagcacaug

SEQ ID NO: 138713 - RNA, 49 nt, Homo sapiens
aggagacucugaauucaaaagacugcaugcuuugcuugggucugauccg

SEQ ID NO: 138714 - RNA, 48 nt, Homo sapiens
uuaaagcuacauuaauaauaagagucaacccuguguauugcuaggaag

SEQ ID NO: 138715 - RNA, 30 nt, Homo sapiens
cugcuuggaaaauguguaacugagcuaggu

SEQ ID NO: 138716 - RNA, 45 nt, Homo sapiens
ugcaaagauaaagugaagugcaauuggaaagauuuuagcagucaa

SEQ ID NO: 138717 - RNA, 50 nt, Homo sapiens
cacuggugaugaaauuuucaauuucguuggguagaaacaggaagaacaag

SEQ ID NO: 138718 - RNA, 46 nt, Homo sapiens
ugguuuaugaagaaaugcacaugaaauagucaaacaagagaaaucu

SEQ ID NO: 138719 - RNA, 42 nt, Homo sapiens
cugccugcugcaccacacuccucaguacaccucgaugcucga

SEQ ID NO: 138720 - RNA, 66 nt, Homo sapiens
cuauuauuggaucauggaacucuuuaagaaugugaaagcuaugaaccuccucucugcuccccccac

SEQ ID NO: 138721 - RNA, 24 nt, Homo sapiens
acuuugaaaagaagcauacaggga

SEQ ID NO: 138722 - RNA, 43 nt, Homo sapiens
gcaacucaguucuaacuagagucaucuaggccacaggucccag

SEQ ID NO: 138723 - RNA, 46 nt, Homo sapiens
ugaaaguaggcaagauaauguaagacuugaaugggguugcauucug

SEQ ID NO: 138724 - RNA, 46 nt, Homo sapiens
gaugcauguuccacacugagcccaguggcugcccucaggaguagau

SEQ ID NO: 138725 - RNA, 41 nt, Homo sapiens
augugagggguauggagccacagcaagucaucucacugggg

SEQ ID NO: 138726 - RNA, 43 nt, Homo sapiens
cccugggagaacccccuaauugaggugaagcaguguggcccaa

SEQ ID NO: 138727 - RNA, 47 nt, Homo sapiens
gcuuccucggcuuagaccuuggggacaaccugggucauuggcuguaa

SEQ ID NO: 138728 - RNA, 57 nt, Homo sapiens
uaaaaauauuacccugcaguuguagccaagcuggguucuggggauggaagaaugaag

SEQ ID NO: 138729 - RNA, 15 nt, Homo sapiens
uguuacccauguauu

SEQ ID NO: 138730 - RNA, 48 nt, Homo sapiens
agcggauuggugguggcuacuugcagacagaguccagguucagcagaa

SEQ ID NO: 138731 - RNA, 67 nt, Homo sapiens
cuaucacagggauucgucccuggccuucaugaagacuugccagaauuuuuuuuuuuguuugcacaua

SEQ ID NO: 138732 - RNA, 42 nt, Homo sapiens
uuccuccuuccuaccuucuugugcugccuaauucggaccagu

SEQ ID NO: 138733 - RNA, 48 nt, Homo sapiens
ggcuugacaaaugagcaggggcuagaaggaagguaauagucauggaua

SEQ ID NO: 138734 - RNA, 45 nt, Homo sapiens
gagcuacacugagauccugaaaauccgccaguccgagaggaugaa

SEQ ID NO: 138735 - RNA, 44 nt, Homo sapiens
ccauucauuaaagcacuaugaaaaugaaaguagcaugaaucuaa

SEQ ID NO: 138736 - RNA, 66 nt, Homo sapiens
ccccugcagccuccuuagaguguagauucuggagauaugagucugaccccucuguuucugcucaug

SEQ ID NO: 138737 - RNA, 29 nt, Homo sapiens
ccgauuccuuuuacgucucuuacccuuau

SEQ ID NO: 138738 - RNA, 40 nt, Homo sapiens
guucucaaaucacaauggaauuaaacuagaaaucagcagc

SEQ ID NO: 138739 - RNA, 37 nt, Homo sapiens
ucacuuuccucugccuccacucucccuaggacucagg

SEQ ID NO: 138740 - RNA, 36 nt, Homo sapiens
uguguggaggcaaguaggcccugaggggggcacaga

SEQ ID NO: 138741 - RNA, 32 nt, Homo sapiens
acagagauaacagaaguaucgacuuuauauug

SEQ ID NO: 138742 - RNA, 42 nt, Homo sapiens
cuccucaccagcuagucugggguuuccucucccugccccagg

SEQ ID NO: 138743 - RNA, 41 nt, Homo sapiens
ggucuuacuccuuggaggccaugugggccaugagguccacc

SEQ ID NO: 138744 - RNA, 42 nt, Homo sapiens
uuugcagauggcaauguaaggauccaaagacgucacagcuaa

SEQ ID NO: 138745 - RNA, 41 nt, Homo sapiens
uagccuguauugaauguguccuucuuggcaucguggccuua

SEQ ID NO: 138746 - RNA, 46 nt, Homo sapiens
agauacauguaaaucgcagguagguagaagagggagacgaucauca

SEQ ID NO: 138747 - RNA, 91 nt, Homo sapiens
accgacauuucuggacaguggugggucacagacgcucgccggcguccuagggacccuuuccugggccuuccucacuucagauuauaaucac

SEQ ID NO: 138748 - RNA, 43 nt, Homo sapiens
aaccuuuggaaguaaagauagaggaagagaaauauaccaccag

SEQ ID NO: 138749 - RNA, 42 nt, Homo sapiens
cagagaguggggaggagguggugacugugcuggaggauuuag

SEQ ID NO: 138750 - RNA, 46 nt, Homo sapiens
uaacuauuucaggggaaugagaugugggaguacaauggaaaguuag

SEQ ID NO: 138751 - RNA, 109 nt, Homo sapiens
aggugacauuuacaggagaaaucugaaugaaaagagcaagccauaagcuaucagggauaacagcauucaggcagagggucuuaaagugagaauguacuuaucauggugg

SEQ ID NO: 138752 - RNA, 33 nt, Homo sapiens
agauuuuauuuaaaauaaggauuugacgggcag

SEQ ID NO: 138753 - RNA, 72 nt, Homo sapiens
cauaggaaagcaauauaaguuacaaaacaaauuauggacugauaaagggagaaaauaaggagguaugauauu

SEQ ID NO: 138754 - RNA, 27 nt, Homo sapiens
cacuauugagguugugguacuuuguua

SEQ ID NO: 138755 - RNA, 42 nt, Homo sapiens
guaaagauuagauccuggggaguuugaauuuacuucaacgag

SEQ ID NO: 138756 - RNA, 43 nt, Homo sapiens
uugccagggaagguuuuacaauagaacauuuacgcugggccuu

SEQ ID NO: 138757 - RNA, 46 nt, Homo sapiens
uugcuuguucuggaauacuucggaaguuaaacaauaaagucagcuu

SEQ ID NO: 138758 - RNA, 55 nt, Homo sapiens
gaacuugccuucaggguuagcuucauguaauuuuaccauuucccauccccauucc

SEQ ID NO: 138759 - RNA, 52 nt, Homo sapiens
ucccccaguggcuucaccucauuccucccacuggccuuaccccuuccuuccc

SEQ ID NO: 138760 - RNA, 46 nt, Homo sapiens
gugcugaugagaagagagcucuugcauccuuuaaccaagaagagag

SEQ ID NO: 138761 - RNA, 50 nt, Homo sapiens
acaaauucugacucugaugaugauaaaaagagaguuaaagccaagaagaa

SEQ ID NO: 138762 - RNA, 58 nt, Homo sapiens
ucaccgccauggauguggucuacgcgcucaagcgccagggccgcacccucuacgguuu

SEQ ID NO: 138763 - RNA, 48 nt, Homo sapiens
accaagccggccauccggcgccuugcucgccgcggcggcgugaagcgc

SEQ ID NO: 138764 - RNA, 43 nt, Homo sapiens
gcguugggugagacuccucuugcucgucaugucuggccgcggc

SEQ ID NO: 138765 - RNA, 61 nt, Homo sapiens
aagaagacuccgaagaaggcgaagaagcccgcggcggcuggcgucaaaaagguggcgaaga

SEQ ID NO: 138766 - RNA, 73 nt, Homo sapiens
gccaccccagcgccgguggagaaauccccggcuaagaagaaggcaacuaagaaggcugccggcgccggcgcug

SEQ ID NO: 138767 - RNA, 46 nt, Homo sapiens
ggccuugugguggcucucaguuuucuuaggcagcagcacggccugg

SEQ ID NO: 138768 - RNA, 45 nt, Homo sapiens
guagguggcucugaaaagaaccuuuuugguuuggaccgagguaug

SEQ ID NO: 138769 - RNA, 38 nt, Homo sapiens
auuguagguggcucugaaaagagccuuugguuccuuug

SEQ ID NO: 138770 - RNA, 46 nt, Homo sapiens
uucgccuugugguggcucucggucuucuugggcaguagcacggccu

SEQ ID NO: 138771 - RNA, 45 nt, Homo sapiens
ugcuaugaaaaaguuggauuguacagaggaagugaaaaccaugag

SEQ ID NO: 138772 - RNA, 58 nt, Homo sapiens
ggguccuugugaguuagagaucaaugcacuagaagacugagaccuuauuaccugugag

SEQ ID NO: 138773 - RNA, 58 nt, Homo sapiens
ugaggcucaagguggggcggggccacaauggaggacggggccugcagggaagacccga

SEQ ID NO: 138774 - RNA, 48 nt, Homo sapiens
agguuuuggaagaaggcgggagcugacgaagaggaggggcaccaggaa

SEQ ID NO: 138775 - RNA, 32 nt, Homo sapiens
cguugcagguuucgcccuucucuggccuccuc

SEQ ID NO: 138776 - RNA, 76 nt, Homo sapiens
cacgucaugagaaaacggcccugguuucuggccagauucacccauucaugucucuggauccggguuucccccagaa

SEQ ID NO: 138777 - RNA, 43 nt, Homo sapiens
cucaucagguuaggaccccuccuucuccucuuaguagcccucc

SEQ ID NO: 138778 - RNA, 68 nt, Homo sapiens
auacagagacggagaaaaugagacaggcaaacagacuguuacagacacagacagagauaccaaugagg

SEQ ID NO: 138779 - RNA, 49 nt, Homo sapiens
cccccacccauacacucuucacaggccaucccgcagccuuggccccagc

SEQ ID NO: 138780 - RNA, 37 nt, Homo sapiens
uccugacauuaucaaguggucagagaacaaaggucug

SEQ ID NO: 138781 - RNA, 46 nt, Homo sapiens
uucgccuugugguggcucucagucuuuuugggcaguagcacggccu

SEQ ID NO: 138782 - RNA, 40 nt, Homo sapiens
cauagcgagcgcaacucacuacgagcaaccacaaagugaa

SEQ ID NO: 138783 - RNA, 43 nt, Homo sapiens
agucugccaucagaagacugaaggaauugaaagaccaguagau

SEQ ID NO: 138784 - RNA, 94 nt, Homo sapiens
aggacccaccauggggccucccucuggaaaauggugaaggaaauugaaaucagccagcacaccaaguacacuugcucuuucuguggcaaaacca

SEQ ID NO: 138785 - RNA, 42 nt, Homo sapiens
uggagcuuaucagaacauuaaagauccaaaagaggaagagau

SEQ ID NO: 138786 - RNA, 46 nt, Homo sapiens
gcccaugagacucugaaagaugauaucccaaagagccauaagagug

SEQ ID NO: 138787 - RNA, 46 nt, Homo sapiens; identical to SEQ ID NO: 43498

SEQ ID NO: 138788 - RNA, 46 nt, Homo sapiens; identical to SEQ ID NO: 43499

SEQ ID NO: 138789 - RNA, 84 nt, Homo sapiens
gaacuggugcuuauaugguguacauuuugaugaccaaaggccugaagcagucaguuugugaccaggguuuuuacaauggaccug

SEQ ID NO: 138790 - RNA, 44 nt, Homo sapiens
ucaggccuuuggucaucaaaauguacaccauauaagcaccaguu

SEQ ID NO: 138791 - RNA, 42 nt, Homo sapiens
uugcuuagcacaaaugcauaagcccagaauuugcugacaggu

SEQ ID NO: 138792 - RNA, 46 nt, Homo sapiens
gcugaugggcugugugguuaacuaccuggucuucugcuggaugcag

SEQ ID NO: 138793 - RNA, 46 nt, Homo sapiens
uuuuccucauuuugccgauguaggccucaaagaagaaauggcagaa

SEQ ID NO: 138794 - RNA, 43 nt, Homo sapiens
caacucuaggacaagggagaacaaaagcaagccagaagcagag

SEQ ID NO: 138795 - RNA, 25 nt, Homo sapiens
uuacucuagaaacugugcgagcaca

SEQ ID NO: 138796 - RNA, 45 nt, Homo sapiens
uucuuaaaaaggcuuuaguuucugcaaaagcauuaucguucuaga

SEQ ID NO: 138797 - RNA, 43 nt, Homo sapiens
uuucuucauacaguguuuccuugaucuaaauauuuucugccca

SEQ ID NO: 138798 - RNA, 46 nt, Homo sapiens
cugaccucugggcuggaauuauuugcaaaccuggagcucugaaggu

SEQ ID NO: 138799 - RNA, 46 nt, Homo sapiens
aguuguuaagaauaaggccuacuuuaacagauaccaagugaaauuu

SEQ ID NO: 138800 - RNA, 46 nt, Homo sapiens
gaaacgcuuggugauacaggauaaaaauaaauacaacacacccaag

SEQ ID NO: 138801 - RNA, 72 nt, Homo sapiens
ucagccaggugccuucaccugcuguauggaugcaggucuugccagaacuaccacuggcaauaaaguuuuugg

SEQ ID NO: 138802 - RNA, 45 nt, Homo sapiens
uuaauggaagaagaugacgaugcuuacaagaaacaguucucucaa

SEQ ID NO: 138803 - RNA, 44 nt, Homo sapiens
ugggcuuccacuguccccacuccgaacuccuguaugugccuggc

SEQ ID NO: 138804 - RNA, 46 nt, Homo sapiens
uggccaggaucuuuggagccccgccacccucagagagcauggaggg

SEQ ID NO: 138805 - RNA, 45 nt, Homo sapiens
uaugggugcccgcaggcgcagccccuuccguuaugaucuuuggaa

SEQ ID NO: 138806 - RNA, 41 nt, Homo sapiens
cgguucgugagacgcaagaagaaggcagcagcagcugccgg

SEQ ID NO: 138807 - RNA, 70 nt, Homo sapiens
gaggcagaggaaucggagaaggccgcaacggagcaagagccgcuggaagggacagaacagacacuagaug

SEQ ID NO: 138808 - RNA, 94 nt, Homo sapiens
uagguuucuuaaguugguuuuagaaguugcuuagucaugucuggccgugguaaagguggaaaagguuuggguaagggaggagcuaagcgucauc

SEQ ID NO: 138809 - RNA, 85 nt, Homo sapiens
gcaagguuuugcgcgauaacauccagggcaucacuaagccagcuauccggcgccuugcucgucgcggcggugucaagcgaauuuc

SEQ ID NO: 138810 - RNA, 70 nt, Homo sapiens
ucuuuacggcuucgguggcuaaggcuccugcuugcugcacucuuauuuucauuuucaaccaaaggcccuu

SEQ ID NO: 138811 - RNA, 45 nt, Homo sapiens
ugccuggggaacuggccaagcacgccguguccgagggcacuaagg

SEQ ID NO: 138812 - RNA, 46 nt, Homo sapiens
cgccccgaagaagggcuccaagaaggcggugaccaaggcgcagaag

SEQ ID NO: 138813 - RNA, 41 nt, Homo sapiens
acagguguuuuuucugcgggugcaggaaugguaggagcaag

SEQ ID NO: 138814 - RNA, 47 nt, Homo sapiens
cuugcuccuaccauuccugcacccgcagaaaaaacaccugugaagaa

SEQ ID NO: 138815 - RNA, 43 nt, Homo sapiens
uuucuuguugaguuugaaggagccagaagcaccgguaccuuug

SEQ ID NO: 138816 - RNA, 41 nt, Homo sapiens
aacaagaaagcggcuuccggggaaggcaaacccaaggccaa

SEQ ID NO: 138817 - RNA, 50 nt, Homo sapiens
gaagccagcaaccgcugcugggaccaagaaaguggccaagagugcgaaaa

SEQ ID NO: 138818 - RNA, 50 nt, Homo sapiens
aaaagugaaacuggcgggacguuccccuuugaaaauuuuaaacggcucuu

SEQ ID NO: 138819 - RNA, 46 nt, Homo sapiens
uuggccuuaugguggcucuccgucuucuuaggcagcaauacggccu

SEQ ID NO: 138820 - RNA, 47 nt, Homo sapiens
agcuuugccgccuugcuuuccacguccagacauaguggcuuccuaac

SEQ ID NO: 138821 - RNA, 46 nt, Homo sapiens
ccgccccgaagaagggcuccaagaaggcagugaccaaagcgcagaa

SEQ ID NO: 138822 - RNA, 59 nt, Homo sapiens
caccaaggccgucaccaaguacaccagcuccaaguaaacauuccaaguaagcgucuuaa

SEQ ID NO: 138823 - RNA, 60 nt, Homo sapiens
aagaagauaaauggagguauuuugaacaaucaaagaaggacaaaugaacaccuggcugag

SEQ ID NO: 138824 - RNA, 30 nt, Homo sapiens
cucaagaaggcauuggccgcugcuggcuac

SEQ ID NO: 138825 - RNA, 45 nt, Homo sapiens
gagagccaagaagccgagagcgacaacuccuaaaacuguuaggag

SEQ ID NO: 138826 - RNA, 77 nt, Homo sapiens
ucaaaauugacccaacaucaugaaguuaauguuagaaaggccacaucuaagaaguaaagagcuuuccgggaggccaa

SEQ ID NO: 138827 - RNA, 42 nt, Homo sapiens
uucuuguugaguuuaaaggagccagaagcaccggugccuuuc

SEQ ID NO: 138828 - RNA, 46 nt, Homo sapiens
uucuugggcgccgccuucuuaggcuugacaaccuugggcuuagcgg

SEQ ID NO: 138829 - RNA, 48 nt, Homo sapiens
agaagaacaacagccgcauuaagcugggcauuaagagccugguaagca

SEQ ID NO: 138830 - RNA, 43 nt, Homo sapiens
gcuagcccccguggccuuuuugagcuuuuuagaugcacccguu

SEQ ID NO: 138831 - RNA, 45 nt, Homo sapiens
gcuaaaaagccugcggcaacaaggaaauccuccaagaauccaaaa

SEQ ID NO: 138832 - RNA, 46 nt, Homo sapiens
ggcuguaaaacccaaggcggccaaggcuagggugacgaagccaaag

SEQ ID NO: 138833 - RNA, 46 nt, Homo sapiens
ccgcccaaaagcuuauugaguuccucaucauugcggaucgcuagcu

SEQ ID NO: 138834 - RNA, 61 nt, Homo sapiens
ugagagucaccaccauaaagcccaaagcaaguaacuuaagguugucauugguaaaaagacu

SEQ ID NO: 138835 - RNA, 33 nt, Homo sapiens
aaaacaaaguacauguguaauagacaucccccc

SEQ ID NO: 138836 - RNA, 52 nt, Homo sapiens
acugagagaacagcagaaugaccuaaagaaacccaacaaugaauaucaagua

SEQ ID NO: 138837 - RNA, 46 nt, Homo sapiens
gaucugaccaacaaggccacaggaaaauuaauagcacaaggaagac

SEQ ID NO: 138838 - RNA, 46 nt, Homo sapiens
cacguuaguagauaacauaucaacaauggcucugcuaugcacggaa

SEQ ID NO: 138839 - RNA, 47 nt, Homo sapiens
uuagauuacucuugucucugcugcuccugggaaagugauuugugaaa

SEQ ID NO: 138840 - RNA, 45 nt, Homo sapiens
augguuucaggucggcguuccaaggcgcucuccuccaccggaggc

SEQ ID NO: 138841 - RNA, 53 nt, Homo sapiens
aagcagagaugauucuuauuuauugcuguauuauuaagggccuggcauacagg

SEQ ID NO: 138842 - RNA, 116 nt, Homo sapiens
cucagaaaaaggccacucugaucauccucugauugucaaugcccauuuuugaaacauaacaucugauuuaucuuuacacccagagcguucaaugcccccaagcucagguaugugcu

SEQ ID NO: 138843 - RNA, 39 nt, Homo sapiens
uuaagccucccaaaguagugugcauggaagauucuagag

SEQ ID NO: 138844 - RNA, 42 nt, Homo sapiens
uggugcuuguaaacugaagaugucaaauuggcagggagcaau

SEQ ID NO: 138845 - RNA, 47 nt, Homo sapiens
acguggacaguucaaaggcuguuauugagacagcagauagagccaag

SEQ ID NO: 138846 - RNA, 204 nt, Homo sapiens
uccagauuucccugaggaugcggauauagauuuaaaagaugugaguacuuucagauuagucaaacuuuaauuaauuuaguaagugaaaauauuuaguacuaaaaguuugagcuuuuguuucagucucucauaugauagaaucuagcauuaaaccacauuacuuacuaaaauccaacauauuuguauuuuuuuauacagguagau

SEQ ID NO: 138847 - RNA, 90 nt, Homo sapiens
uuccaacuccucauuuggaugggaaacaugugguguuuggccaaguaauuaaaggaauaggaguggcaaggauauuggaaaauguggaag

SEQ ID NO: 138848 - RNA, 2064 nt, Homo sapiens
uuauggugaaaaauuugaagaugaaaauuuccauuacaagguaaaguagagaaaaugcauguuauugcugauaaaaagauuguuauauaucuggaauacuuguuggauuaagacaccaaaaaauguuucaagugugcuuagauucuccauuucuuguaauaggaaucacuuuuguaaauaaugguucuuuaauauggaaaaguuuucauucaguaaugauuaauucagcauuauuucauugugauccaguuuuuauaugcuucaguuaagccagugaguuuuuaaaugcgaccagcaucuggcaaaauuguuuccaggaaaaauguuuccauuguuggaaggaugguaacuugugcauccuuauccuugaauuugaagagcaacaaaaccaucacuaauauccaggaugucaggggauuugcacacuagcagauauaguuaaauguccaagcuccuaaaggacuucaguggugccugugccuucuugucuucguugucccaagauguaauugggguauauugcaucauucaaguuauaagaauggacauguaaguacaaaaguaaagugauauuuuuggaaauaaggaauaugagcaaggguauuaggauaauuugaaaaaaugucgucagucuuccagucaguguuuauugagccacuaucacuggcaccaaaggguuuauaaaaaugaaaggccuugaugacaaggaauuuauaauccuaccucagagacaagauuaagauacaugggacuacuggagaauaauaguauauaaauaaaugcuaaauugauugaauauccuugcuuguauaacauugcuaauacugucuauauacugcaggagaaagaugugauuuaugcagucugaauuauuauggaagucauugaggaggaauggcuacuugggcugugcagacugggucuugcaaggcggcaacaugucugagauuugguuaggcaggaacuguaguauugaugcagaauuuaaaaagggacgucggugaggaaagacaaaggcaagagacguugaggaaauaaaguucuaguuacuguuguaccaaaggaagcuaccagaaggaugaaaacuaaaggugaugugaugaucacauugacauagagaaaaggggccuauagacaagacacaugauucuugcuuucuauaaacgugguggccuuaaaaucugaauuugauuuagacugaggggaguaaaaggcauuuuggugggguggggggugucaugaaacauuauauaacaugagaguuacggugcaugcaccaacaaggaauacauuuagaaagccuaggagauaaagugaaaagguuaagaaauuggguuucauagauccuuugacaggauuaugccaagguagaauuuugauuucaagauguaugcagcaguuucuuuugagcacucuccgaagaggugauucaucugggaugaaaaccuaauccaaauccuguaugauuuggauucuuuugagauuaggaaaguaccaaacugaaugucuuggguaaauucaguaucccauuauuguuccaguuuauugauguuuuguaaaggaagacuuauacuguaggcauauuuaugaauuuggaagaccguucaggucuucccagaaaaaaagagcauucaucauaaagagggcaaaauauauuacaagaguuucauaaugcugcaucuucauuuuaaaggugaaguguaaguauuuucucauggccaauuuagaaauaacccuccccccgacuauuguuucuguuaccuauuuacuuugauaagguuuuuuaaaguuuaaagugauuaagugccccauguuuugugaauuaaagguugcaguuuauaaaaaaauaaaaaguaauuaaaaaauuuuauaagugaaaaguaaaaaaaaguaguuugaucuaaaugguaguauagugcaccccaguuuuauguucaguaaaagaacaguucagacuaacacacaauucagaaaagaacacaucuaaccuugguuuucuuuuaauuuuuauuucuacagcaugaucgggaggguuuacugagcauggcaaaugcaggccgcaac

SEQ ID NO: 138849 - RNA, 46 nt, Homo sapiens
cguacccaaaacugcggaaaauuuucgugcacuguguacaggagaa

SEQ ID NO: 138850 - RNA, 64 nt, Homo sapiens
cgagcgaugggcaucucucgggacaacuggcaccagcgccgcaaaaccgggggcaagagaaagc

SEQ ID NO: 138851 - RNA, 54 nt, Homo sapiens
uuucucuugcccccgguuuugcggcgcuggugccaguugucccgagagaugccc

SEQ ID NO: 138852 - RNA, 63 nt, Homo sapiens
ccuaccacaagaagcggaaguaugaguuggagcgcccagcugccaacaccaagauuggccccc

SEQ ID NO: 138853 - RNA, 45 nt, Homo sapiens
ccacuacgugcugccccugggccgcaagaagggagccaagcugac

SEQ ID NO: 138854 - RNA, 45 nt, Homo sapiens
ugcuggaacugcucuuccaggagacugcugauuuuggcauucuuu

SEQ ID NO: 138855 - RNA, 46 nt, Homo sapiens
gcaagcuucuugcaugcaucgcuucaaggccgggacaguguggccg

SEQ ID NO: 138856 - RNA, 63 nt, Homo sapiens
aaucaaggcccggaaaggcaaauaaauccuuguuuugucuucacccauguaauaaagguguuu

SEQ ID NO: 138857 - RNA, 47 nt, Homo sapiens
gaaugucuuucaaaccaaaacaauaggaaaucacucuuggcugaaag

SEQ ID NO: 138858 - RNA, 57 nt, Homo sapiens
gucuuacauuugaguuucaaauuguccagauuugagagugagcaaaauacaccagau

SEQ ID NO: 138859 - RNA, 47 nt, Homo sapiens
aagaauucagugugugcaugacaacucguguguaugagaaggaggga

SEQ ID NO: 138860 - RNA, 40 nt, Homo sapiens
uuuuuuccaaagucuaaagacugagcucaccuggcuagau

SEQ ID NO: 138861 - RNA, 24 nt, Homo sapiens
acaccagcacuuuaaacucuuugu

SEQ ID NO: 138862 - RNA, 47 nt, Homo sapiens
uuguuuacuuugaagcgguuuuugcaaauucauauuacuuaagcaga

SEQ ID NO: 138863 - RNA, 45 nt, Homo sapiens
guuguggauuuuccugucuccaugaaccacucccauucccccguc

SEQ ID NO: 138864 - RNA, 45 nt, Homo sapiens
gccucggggaggaggaaggcaucagcgaucucuucgaugcuuacg

SEQ ID NO: 138865 - RNA, 46 nt, Homo sapiens
caaguacccaagggcccauugagguuuacuuauguccagaagagac

SEQ ID NO: 138866 - RNA, 95 nt, Homo sapiens
uugauggguuauguagugaccuaaaacccagaauccugcaagagcagccacuacaagcucaacacugaauuagccaucaucucaacuguaaagau

SEQ ID NO: 138867 - RNA, 49 nt, Homo sapiens
ugaggaugggggcaugcuggcccagugucaaggccugucaaaagaagug

SEQ ID NO: 138868 - RNA, 25 nt, Homo sapiens
agggcuuugaaaagauacuaauuca

SEQ ID NO: 138869 - RNA, 46 nt, Homo sapiens
caccaacguucuggaaggcauccaccucauuaagaagaagucuaaa

SEQ ID NO: 138870 - RNA, 44 nt, Homo sapiens
ggucaucaguaccucucagaugguuuaaaaacccccaagggcaa

SEQ ID NO: 138871 - RNA, 64 nt, Homo sapiens
gugggguggagcagaggggugagagcuggcaugagccugcagcauuuggcaggccagcccacaa

SEQ ID NO: 138872 - RNA, 61 nt, Homo sapiens
cuuagauaagggcuucucauuugcuaggcuugauaagaaaauggagaaaguaauagugguu

SEQ ID NO: 138873 - RNA, 49 nt, Homo sapiens
caggaaagggauggcuccccaaggaacaaacagggagcuucugccugau

SEQ ID NO: 138874 - RNA, 48 nt, Homo sapiens
aaagucugggaaagaccaacaguugcccccagggcaugaccagagcca

SEQ ID NO: 138875 - RNA, 33 nt, Homo sapiens
aacagcacaauucuagguucccgacucaaaaca

SEQ ID NO: 138876 - RNA, 47 nt, Homo sapiens
gaugaaguuucucucuaucuguaguaucuuccuggcggucacaagaa

SEQ ID NO: 138877 - RNA, 39 nt, Homo sapiens
uacagcucuaugucuccuuagauugcuuucuguagagaa

SEQ ID NO: 138878 - RNA, 50 nt, Homo sapiens
ucccuguucacucaacaggggaggaaaaauaacaggauaacccaacggga

SEQ ID NO: 138879 - RNA, 40 nt, Homo sapiens
gaugcucacgcugugaacuaacaaaaauugagaugaccaa

SEQ ID NO: 138880 - RNA, 46 nt, Homo sapiens
aauggaagaagugagauggguaucguaucauugaaggaugucagua

SEQ ID NO: 138881 - RNA, 48 nt, Homo sapiens
gugaauacuguuuauacagucaugauguauagcacugguuuuuuauuu

SEQ ID NO: 138882 - RNA, 53 nt, Homo sapiens
gccaugcagcagaccuggagaaccccuagcuagucucaggucuggauaucagg

SEQ ID NO: 138883 - RNA, 34 nt, Homo sapiens
aaauguuugcccacauuacuguaacagggaguca

SEQ ID NO: 138884 - RNA, 42 nt, Homo sapiens
acaugacuucauauguauucauuagcaaucacugccguaggc

SEQ ID NO: 138885 - RNA, 65 nt, Homo sapiens
cuacacgcacucgcgcacauauuuuagugagcaaugcaaugugcgaauacaaauagaaauagauu

SEQ ID NO: 138886 - RNA, 40 nt, Homo sapiens
aauagucuugcugauugauuuuguuggcugcaagcaaagu

SEQ ID NO: 138887 - RNA, 52 nt, Homo sapiens
ucaaguuccuccucagucgggcuggagagucgagagcgggucauggugaguu

SEQ ID NO: 138888 - RNA, 48 nt, Homo sapiens
gauugacgcggauccuuucuuugacccauccgcaugucacccaaccuu

SEQ ID NO: 138889 - RNA, 44 nt, Homo sapiens
guagcauguaucagaaucucauucuuuuuaucucugaauaauau

SEQ ID NO: 138890 - RNA, 42 nt, Homo sapiens
gcuuuagcaugggcugcugaagcgagcugcucuuuagggagg

SEQ ID NO: 138891 - RNA, 36 nt, Homo sapiens
acuaauuuuccuaacuaaauggaaacuccagcugua

SEQ ID NO: 138892 - RNA, 47 nt, Homo sapiens
uuagaaugguauuuuaauugagcuauuuuuguugcugauucagagau

SEQ ID NO: 138893 - RNA, 54 nt, Homo sapiens
gacccaccgaaagcucuaaauguaucaguggauuuuucauuauuuccaaaaaua

SEQ ID NO: 138894 - RNA, 51 nt, Homo sapiens
gauuuguggcauaauucgagguaguuuaaacuggaauaucaaggugucaga

SEQ ID NO: 138895 - RNA, 46 nt, Homo sapiens
ggaagauaaccaugagcaaauccacguugugguauaagaaaaggga

SEQ ID NO: 138896 - RNA, 50 nt, Homo sapiens
ucugauugagagauggauguggucuggaguaugugaaaaugggauagaug

SEQ ID NO: 138897 - RNA, 43 nt, Homo sapiens
aauacagccacauucugaggcacuggggguuaugacuucaaca

SEQ ID NO: 138898 - RNA, 49 nt, Homo sapiens
uagcagauagguguuaagcaccuagcauaugccagccaccauucuaggu

SEQ ID NO: 138899 - RNA, 41 nt, Homo sapiens
cagugaaguuucuuaggcauccaaacuugauggaggggaca

SEQ ID NO: 138900 - RNA, 51 nt, Homo sapiens
gcauucuaaaguuuaaacauaugagccuuugaauacuccugucuaggaaag

SEQ ID NO: 138901 - RNA, 91 nt, Homo sapiens
ugaugagucuggaagcaggauggcaacaaugauggugugaaaaggcagguggaagugaagggcagauuaagggagaaaagaaauacaagac

SEQ ID NO: 138902 - RNA, 42 nt, Homo sapiens
uacuuggaagaauggauucugagauuaauguuauacugugua

SEQ ID NO: 138903 - RNA, 52 nt, Homo sapiens
cucugaaacaaagcacccuuaaauauggcacugugggcugaagaacuccacc

SEQ ID NO: 138904 - RNA, 44 nt, Homo sapiens
aaagaaauugaaaacaauacauuaauauaccauaacacuaaaaa

SEQ ID NO: 138905 - RNA, 45 nt, Homo sapiens
auuacugcccuugccaugggucacacuaugaugcaucuggcagga

SEQ ID NO: 138906 - RNA, 25 nt, Homo sapiens
cugauguguuggcccuggcgaaaau

SEQ ID NO: 138907 - RNA, 49 nt, Homo sapiens
aaaggcgcccggaggucgccaggccgcgccugcgaugcccuccaaccga

SEQ ID NO: 138908 - RNA, 59 nt, Homo sapiens
gccucggauccccuccucccgcccgccuucccaggcuggggagaaagauggcuaggccg

SEQ ID NO: 138909 - RNA, 53 nt, Homo sapiens
ugcacgggugugccugcuggggagccuggggaguugcaggaggcaggagaaag

SEQ ID NO: 138910 - RNA, 27 nt, Homo sapiens
gacgacgacgaggaggaggaggugguc

SEQ ID NO: 138911 - RNA, 28 nt, Homo sapiens
cuggauggccaugacgaugagcgcgaug

SEQ ID NO: 138912 - RNA, 42 nt, Homo sapiens
ccuucagguccugccacccaggaccuguaucaucaauguggg

SEQ ID NO: 138913 - RNA, 78 nt, Homo sapiens
caccgaggggugugugugugugugugugugugugugugugugugugugugugauugacagccgguccaagggaauaca

SEQ ID NO: 138914 - RNA, 31 nt, Homo sapiens
uaucugcccccucugaggaggggagaggaga

SEQ ID NO: 138915 - RNA, 51 nt, Homo sapiens
acaacgucagcacagggucuggggcagcauaagaagauuacauuaacuaga

SEQ ID NO: 138916 - RNA, 42 nt, Homo sapiens
gggcgagggugaggagggcgacgacggcggcgagaccgagag

SEQ ID NO: 138917 - RNA, 57 nt, Homo sapiens
ccuuccucccggggcugcuggagcgggccaccgggaagucggggauaaggcgggcgc

SEQ ID NO: 138918 - RNA, 44 nt, Homo sapiens
gcuccagcagccccgggaggaaggggucggggaagaggccggcg

SEQ ID NO: 138919 - RNA, 46 nt, Homo sapiens
cauccuuuuuauugaugagauucaucgguucaauaaaucucagcag

SEQ ID NO: 138920 - RNA, 43 nt, Homo sapiens
gccccauuugcuccugucugagauggagggagaauucugcugu

SEQ ID NO: 138921 - RNA, 51 nt, Homo sapiens
ggucaacuuguuagcaauucuaacaagaaguuaaguuaggagauaucauag

SEQ ID NO: 138922 - RNA, 57 nt, Homo sapiens
ccauuccccaugacuccaaaccagaaguguggaaccacuuguacuuuggucaggagu

SEQ ID NO: 138923 - RNA, 47 nt, Homo sapiens
gacauggccucgguguuuguuuuuuuguuguucuggugaggucugcu

SEQ ID NO: 138924 - RNA, 45 nt, Homo sapiens
ucagaccagaacgccucccucuacuggcuggcucgcaugcucgag

SEQ ID NO: 138925 - RNA, 60 nt, Homo sapiens
cgaggacauaggugagugugaugggagggucccggaguccuauguccaugagggugggga

SEQ ID NO: 138926 - RNA, 45 nt, Homo sapiens
cugcgccgaccaccccuuccuuuucuucauccagcacagcaagac

SEQ ID NO: 138927 - RNA, 46 nt, Homo sapiens
ugugcaaaugauguuuaagcaaucuacuuuuaagaagaccuauaua

SEQ ID NO: 138928 - RNA, 46 nt, Homo sapiens
gugucauguggaagugcucuccuucccccucuccagggcugcugaa

SEQ ID NO: 138929 - RNA, 23 nt, Homo sapiens
cuauuucagaggaaacugggaug

SEQ ID NO: 138930 - RNA, 51 nt, Homo sapiens
ccguagagaaguccagaaaacacauaaacaccuggguagcugaaaagacag

SEQ ID NO: 138931 - RNA, 52 nt, Homo sapiens
uucucacccaugagcauguccugugcccuggccauggucuacaugggggcaa

SEQ ID NO: 138932 - RNA, 46 nt, Homo sapiens
uuuuuccuuuuuuguaauauugaugacaucaauguaacauuugaga

SEQ ID NO: 138933 - RNA, 44 nt, Homo sapiens
aagcgaggggguggggggcuucccgggacgauaaccuggcagug

SEQ ID NO: 138934 - RNA, 48 nt, Homo sapiens
accagcaguaccaggacgccacggccgacgaacaaggggaguucgagg

SEQ ID NO: 138935 - RNA, 45 nt, Homo sapiens
ugguacacgggcgagggcauggacgagauggaguucaccgaggcc

SEQ ID NO: 138936 - RNA, 45 nt, Homo sapiens
guacugcuggcugccccggcuggucaggggcgcgaagccgggcau

SEQ ID NO: 138937 - RNA, 45 nt, Homo sapiens
augacaucugcuuccgcacccugaagcugaccacccccaccuacg

SEQ ID NO: 138938 - RNA, 47 nt, Homo sapiens
ggucuggguacucuucccggaucuugcugaugagcagggugcccauc

SEQ ID NO: 138939 - RNA, 66 nt, Homo sapiens
gaaaagguaucugccucaccauugcugaagagagagacaagagauuggcaaccaaucaaagcagug

SEQ ID NO: 138940 - RNA, 58 nt, Homo sapiens
cuacccugauccccucaucaaggugaaugacaccauucagauugauuuggagacuggc

SEQ ID NO: 138941 - RNA, 93 nt, Homo sapiens
aucgauggcaagguccgcacugauauaaccuacccugcuggauucauggaugucaucagcauugacaagaugggagagaauuucugucugauc

SEQ ID NO: 138942 - RNA, 43 nt, Homo sapiens
ugagagagugucucccccucaucauuuucauaaggaacagacu

SEQ ID NO: 138943 - RNA, 47 nt, Homo sapiens
aagcuaaaucaucaaguuuaguucuuuuugcuggagacauacccucu

SEQ ID NO: 138944 - RNA, 48 nt, Homo sapiens
gccuuuucaugaauuucccccucuucuucagagccagacucauaaccu

SEQ ID NO: 138945 - RNA, 64 nt, Homo sapiens
uuuguaguaauuuuauuguccacaaguucaaguuuccccuuuguacuugaagaucuaguacuag

SEQ ID NO: 138946 - RNA, 27 nt, Homo sapiens
cuccuucgucuacgaccaccgcgugau

SEQ ID NO: 138947 - RNA, 46 nt, Homo sapiens
auacucuuuaacaucagcagcuacucgcuccagaaugucaucugga

SEQ ID NO: 138948 - RNA, 41 nt, Homo sapiens
auuauauauucacucccucuucugacccagcaaucccacuu

SEQ ID NO: 138949 - RNA, 45 nt, Homo sapiens
acaugaucaagacuccugucacaacuaccuucauuccaccugagg

SEQ ID NO: 138950 - RNA, 27 nt, Homo sapiens
cuguccuggagugagcaugugcccccg

SEQ ID NO: 138951 - RNA, 47 nt, Homo sapiens
uggugauggaugugacacuucauaaaagugagcuuuaaacuguagau

SEQ ID NO: 138952 - RNA, 47 nt, Homo sapiens
ucaauuuccuugugaaaacacucuuaacuuucucuuuacccuuagcu

SEQ ID NO: 138953 - RNA, 46 nt, Homo sapiens
cuugcucagcaguuugggcuuccauucuaguucuuuuaccaagauu

SEQ ID NO: 138954 - RNA, 55 nt, Homo sapiens
ugguaggauuuugacugguuuugcaacaacaggucuauuauuagagucaccuaug

SEQ ID NO: 138955 - RNA, 53 nt, Homo sapiens
caaauuaaaaagaagucccucauugacuuguuggguguaggugguaccccaug

SEQ ID NO: 138956 - RNA, 40 nt, Homo sapiens
ccuaaggcauccuaccagcagcaccaucaaggcauguagg

SEQ ID NO: 138957 - RNA, 106 nt, Homo sapiens
caccuagaagaccuuucagaaucuauuguuaaugauuuugccuacaugaagaagagagaagaggagauggugauaccagugagucaacaaacacuuggguccuaca

SEQ ID NO: 138958 - RNA, 60 nt, Homo sapiens
ccuagacaugaagcauggaguggaggugaaaaauuacagagagauugcaaaaguugagaa

SEQ ID NO: 138959 - RNA, 94 nt, Homo sapiens
ugguggccugugcagccaccucaagaucacagauucugcuggccauauuuucuacuccaaaaagaauacaaccaaggggaaauuugccuuuacc

SEQ ID NO: 138960 - RNA, 46 nt, Homo sapiens
uggcgaggaccaagcuggggcccagcaggaacaaaagcagcaacgc

SEQ ID NO: 138961 - RNA, 45 nt, Homo sapiens
uuucaaauacgcuucagaauuccuccuaaauguagauaaugauaa

SEQ ID NO: 138962 - RNA, 50 nt, Homo sapiens
auuaaguucugacaaaaguauguaucuuugcaauuuaaacuuucugucaa

SEQ ID NO: 138963 - RNA, 47 nt, Homo sapiens
agcuguuacacacacaguaauaccugaauauccaacgguauagauca

SEQ ID NO: 138964 - RNA, 45 nt, Homo sapiens
cuauauuaaucaugcuaguaacaugaaaaaugaugggcuccuccu

SEQ ID NO: 138965 - RNA, 44 nt, Homo sapiens
gacuaaagcugagguccgauuuuggcugugcuugcuugcucacu

SEQ ID NO: 138966 - RNA, 41 nt, Homo sapiens
cuugcgaggcuuagcacuguuuuccuagcuuuccccgagga

SEQ ID NO: 138967 - RNA, 46 nt, Homo sapiens
ggagagaaugagggcgaaggcgagaguaccgcggcguggagaagga

SEQ ID NO: 138968 - RNA, 82 nt, Homo sapiens
ccaggcagguugugggaaggaggaagaggaaguggggaacagaagagaggaaagcagacggaacggaaaaagaaagaaaggg

SEQ ID NO: 138969 - RNA, 37 nt, Homo sapiens
cuauuuuggguuuucagaagaaagggggacagucaaa

SEQ ID NO: 138970 - RNA, 48 nt, Homo sapiens
ggugccugugaccuggugcucaaggcccggggcagguggggaccagcc

SEQ ID NO: 138971 - RNA, 32 nt, Homo sapiens
cgaugcggauucgcgcuggcgcugaacgcuga

SEQ ID NO: 138972 - RNA, 45 nt, Homo sapiens
ugggagacgaaggagggagcgaggagaaagagaaauaaaagggau

SEQ ID NO: 138973 - RNA, 23 nt, Homo sapiens
ucauuauaaaaccgauugccuac

SEQ ID NO: 138974 - RNA, 78 nt, Homo sapiens
ucuggcgcccucccggcgcccgggcugcuuugggccgcuaggcacucagcuuccagccggguucgucggccucagggc

SEQ ID NO: 138975 - RNA, 105 nt, Homo sapiens
cauccucuucaaugguaagcauguuaaaauauguggucugaaguucccuaucacucucgauuugcccaccagccgggucugcggugcccgugcaaacgcugcagc

SEQ ID NO: 138976 - RNA, 46 nt, Homo sapiens; identical to SEQ ID NO: 43765

SEQ ID NO: 138977 - RNA, 42 nt, Homo sapiens; identical to SEQ ID NO: 43766

SEQ ID NO: 138978 - RNA, 98 nt, Homo sapiens
gagcgacagagacuuuaugcacugggaaggcagagggaggagagaaagagagggagcgaggaagagacagaaagagagagagagagagaaagagagag

SEQ ID NO: 138979 - RNA, 44 nt, Homo sapiens
auacucugagaguguccuaaugauacagauuuuggacccuaucc

SEQ ID NO: 138980 - RNA, 54 nt, Homo sapiens
agcacaacugucaagagucuuguacacacaacuucagcuuugcaucacgagucu

SEQ ID NO: 138981 - RNA, 48 nt, Homo sapiens
ucugaggcagaagauaacagcagcaucucgaccagccucugccuuaaa

SEQ ID NO: 138982 - RNA, 38 nt, Homo sapiens
gcuucaaggaggucgaccuucuaauguaugaagaaugg

SEQ ID NO: 138983 - RNA, 57 nt, Homo sapiens
agagguuagccgugaugaaagcagcguuacuucugaccgugccugaguaagagaaug

SEQ ID NO: 138984 - RNA, 44 nt, Homo sapiens
caccgcuuuguccugagccaagcgaaagacgaacuuuaggaaca

SEQ ID NO: 138985 - RNA, 42 nt, Homo sapiens
aagguacgaggcuaccccacguuauugcuuuuccgaggaggg

SEQ ID NO: 138986 - RNA, 83 nt, Homo sapiens
ucuaaaaaggaauucccuggucuggcgggggucaagaucgccgaaguagacugcacugcugaacggaauaucugcagcaagua

SEQ ID NO: 138987 - RNA, 40 nt, Homo sapiens
aaugccuuucaaaucauuugcaacauuuaaaaaccuaaag

SEQ ID NO: 138988 - RNA, 42 nt, Homo sapiens
cuucgaugacaccauugcagaaggaauaaccuucaucaaguu

SEQ ID NO: 138989 - RNA, 60 nt, Homo sapiens
gcuauuguaacuagguucuuucuguugcauagagaggaugucacaaagggugcuaggaga

SEQ ID NO: 138990 - RNA, 56 nt, Homo sapiens
cgcagcugcagcgcacagagacuggagcgacggagaccgucacgcccucagaggcc

SEQ ID NO: 138991 - RNA, 57 nt, Homo sapiens
agguggaucaguacaagggaaagcgggauuuggagucacugagggaguacguggagu

SEQ ID NO: 138992 - RNA, 49 nt, Homo sapiens
acaggguaacugugcucugguuguaaacacaaaccuucaggccuuugaa

SEQ ID NO: 138993 - RNA, 48 nt, Homo sapiens
ccagguucguggcuaucccacucuucucugguuccgagaugggaaaaa

SEQ ID NO: 138994 - RNA, 49 nt, Homo sapiens
uagcauggggcagaugcuugguaaauuguaaucacuuuuguugucaguu

SEQ ID NO: 138995 - RNA, 46 nt, Homo sapiens
accucuccacgccucggucucccccuuugcaaaacugagcuaagau

SEQ ID NO: 138996 - RNA, 45 nt, Homo sapiens
gagcagcuggcucugggccuugaacauuccgaaacugucaagauu

SEQ ID NO: 138997 - RNA, 46 nt, Homo sapiens
augauaaaauauaauacagaucgagaaaacaaauguagggcuuaau

SEQ ID NO: 138998 - RNA, 49 nt, Homo sapiens
uagcagcaucaguggcacugacaaagggucacucuagaggagcuguugg

SEQ ID NO: 138999 - RNA, 38 nt, Homo sapiens
cccuccaucacuucucccugcacaggaggguuggaaua

SEQ ID NO: 139000 - RNA, 23 nt, Homo sapiens
uuaaaaaucucaacuugaccaga

SEQ ID NO: 139001 - RNA, 44 nt, Homo sapiens
ggguccucgggacuuccagacacuggaaaacuggaugcugcaga

SEQ ID NO: 139002 - RNA, 46 nt, Homo sapiens
ucaccucauuuuaguuuuccuugaauaaaaccagaaacuucugaaa

SEQ ID NO: 139003 - RNA, 83 nt, Homo sapiens
caccgugucugcuccaguccuaauuugaacacagacaacaacugcugaagccgggaaagcauaacaguagcuugcagggaagg

SEQ ID NO: 139004 - RNA, 46 nt, Homo sapiens
acagccguugaacuaagacacuauucaaaccuucaugucagauuuu

SEQ ID NO: 139005 - RNA, 45 nt, Homo sapiens
uaaaguggacugcacggcccacuccgacgugugcuccgcccaggg

SEQ ID NO: 139006 - RNA, 96 nt, Homo sapiens
uucaugcugagaacagggcagugacucuggagggaugggagcaggggagagagguccuggaguacugguccaggagcugccaucugcaauggugua

SEQ ID NO: 139007 - RNA, 49 nt, Homo sapiens
cuauaguccuuugggaacacugcagaugcugcaguagggcucaggagua

SEQ ID NO: 139008 - RNA, 49 nt, Homo sapiens
ccgggaugccccgaggaagggaagugaccacaggccagagcagaaagcc

SEQ ID NO: 139009 - RNA, 75 nt, Homo sapiens
gguucucugggcgaggcuuuggugugggccucgcugcugaccugagagacccuacccuggcacucaucccacgga

SEQ ID NO: 139010 - RNA, 83 nt, Homo sapiens
ucggcugggacagacugcgggcacguccccuuccagaggcuuuaacugaaaaauagaacccaggaaggugugguuucccacuu

SEQ ID NO: 139011 - RNA, 23 nt, Homo sapiens
agagaggagagagagagagagag

SEQ ID NO: 139012 - RNA, 54 nt, Homo sapiens
uucucccucacacaaaacauccuagacauaggaaaccauuucacacauuggaag

SEQ ID NO: 139013 - RNA, 56 nt, Homo sapiens
gugugugugugugucacuuucgagaagggguugugaaaggaagguaagaaauggaa

SEQ ID NO: 139014 - RNA, 45 nt, Homo sapiens
cuuuguagccaggagcauguuuuuucuugucacuugcucauuggg

SEQ ID NO: 139015 - RNA, 43 nt, Homo sapiens
caaacuuggagaaugugcaguucuuaaacuugugcguuguuua

SEQ ID NO: 139016 - RNA, 47 nt, Homo sapiens
ucaccauuaacaauaucuuccucucgacgacaguaaacugucucaau

SEQ ID NO: 139017 - RNA, 41 nt, Homo sapiens
ccucgauggcgugagguaaggaguggaucgagaggucuccg

SEQ ID NO: 139018 - RNA, 45 nt, Homo sapiens; identical to SEQ ID NO: 43816

SEQ ID NO: 139019 - RNA, 31 nt, Homo sapiens
guagggggcacaccgcgcugcacuuuuccug

SEQ ID NO: 139020 - RNA, 42 nt, Homo sapiens
acucaaggaaaucaagaugaacguggggagaaacacgccuug

SEQ ID NO: 139021 - RNA, 42 nt, Homo sapiens
cggcgccuuuuguguggggcgcgcucgggcggcggggcagcc

SEQ ID NO: 139022 - RNA, 27 nt, Homo sapiens
ggaaaaaguaugugugagugugugggu

SEQ ID NO: 139023 - RNA, 42 nt, Homo sapiens
aaaagguugcagggcaugcaaaagugaaagagaaagaggcag

SEQ ID NO: 139024 - RNA, 41 nt, Homo sapiens
gaaugugucugcgugcgugugugagaaagaaagugugggcg

SEQ ID NO: 139025 - RNA, 42 nt, Homo sapiens
ccgagucugggacucgggacucggcugcccgcugcugcgcgg

SEQ ID NO: 139026 - RNA, 43 nt, Homo sapiens
agagccaguacccgugggaugucaccccguccccaucuaccgg

SEQ ID NO: 139027 - RNA, 80 nt, Homo sapiens
uagaaguggggguggggggaagaaagaaugaaugaaugaaugaaugaaugaauagaaagaagaaggaauauuaaagaucg

SEQ ID NO: 139028 - RNA, 45 nt, Homo sapiens
ugcgcuggggaaaguuugucccacccgcguuucgcagcugguugc

SEQ ID NO: 139029 - RNA, 45 nt, Homo sapiens
agugcuggcugccggcggugagcgcaggaggaggaggaggaggga

SEQ ID NO: 139030 - RNA, 44 nt, Homo sapiens
gaggaggaggaggaagaggagggcgaggaggaggaggagggcga

SEQ ID NO: 139031 - RNA, 48 nt, Homo sapiens
ucuaauaaaauugcacggggccaaaagggcagcucggaucgugguagc

SEQ ID NO: 139032 - RNA, 70 nt, Homo sapiens
uuucuuacuuaaaaaaaaaucccaaaaccgaaagggauaaaagccccagaggacccagcaggccccggug

SEQ ID NO: 139033 - RNA, 39 nt, Homo sapiens
agggaacuccaaguuucgcuuucuugcccucugcgggcu

SEQ ID NO: 139034 - RNA, 49 nt, Homo sapiens
ucccaaguuucuacuugaggugggaggggggugggggaaacggccacag

SEQ ID NO: 139035 - RNA, 42 nt, Homo sapiens
cgggcaugggcuggagggcucggucgggccagcucccuggaa

SEQ ID NO: 139036 - RNA, 53 nt, Homo sapiens
cuuuugucugucugucucuuucccucaggccuccagcugcugcuucugagaca

SEQ ID NO: 139037 - RNA, 45 nt, Homo sapiens
uagacugcuuuaucuuacuuaugauuuugcuugcauuuauccacu

SEQ ID NO: 139038 - RNA, 46 nt, Homo sapiens
uuuuuuuggcuuuacuuuuauuuucuuuaacuauuuuggcuuccau

SEQ ID NO: 139039 - RNA, 41 nt, Homo sapiens
cuaagaguuuagagaagaauuuuuauuuagaaaagggcagg

SEQ ID NO: 139040 - RNA, 36 nt, Homo sapiens
uaguagucccguuuauucaaaggcaauauguuccaa

SEQ ID NO: 139041 - RNA, 41 nt, Homo sapiens
acaggcagagauuauuuugcccuugcuuacggagugucuaa

SEQ ID NO: 139042 - RNA, 53 nt, Homo sapiens
aauuuaguagcuuaacacaagacacauuuauuuucucauacagucucugaugg

SEQ ID NO: 139043 - RNA, 60 nt, Homo sapiens
gaugcuggcuaagacagucuuaaagguggguauggggagaaaggaaugaggcuaagggaa

SEQ ID NO: 139044 - RNA, 38 nt, Homo sapiens
cuccuugcuuugcauccucaccucacuaaugagcuaag

SEQ ID NO: 139045 - RNA, 44 nt, Homo sapiens
aaaaggagauaugauucuauaacuucuuuauuuaaaguuuuuau

SEQ ID NO: 139046 - RNA, 62 nt, Homo sapiens
aguccccuaugugggacauguccccaaauucagaagucauugcuguuagaaaaugggugcaa

SEQ ID NO: 139047 - RNA, 50 nt, Homo sapiens
ugauuucuagaauguuuagugcauaguaaguuuucaguauugacuugcua

SEQ ID NO: 139048 - RNA, 69 nt, Homo sapiens
agugauuucugucucuacugcauacccaguaugcaguaauucucaugagcagcucaaguugagaaccau

SEQ ID NO: 139049 - RNA, 92 nt, Homo sapiens
auaucuuaucucuaaaagccauuguuaggucuucuuccauuugguuauauguuuucuauacagauaugaaaauguacuuuuuuaaacaaaua

SEQ ID NO: 139050 - RNA, 49 nt, Homo sapiens
agaagauaauuuuuuaguggcuuggcaaccagagcugaugaaaguuaca

SEQ ID NO: 139051 - RNA, 51 nt, Homo sapiens
ccaaaaaguaacacacugcaacaauccaggcaaaauuaaggugaggauuau

SEQ ID NO: 139052 - RNA, 39 nt, Homo sapiens
uggcuuccucccuucauuguuacccaauugcuagaagcu

SEQ ID NO: 139053 - RNA, 40 nt, Homo sapiens
uuuacaauugauagugacuaccuagcccaaaucacagaug

SEQ ID NO: 139054 - RNA, 56 nt, Homo sapiens
ucagguauaagugagagaauccuuaucugaauaguuuaaguaaaaagagggauuuu

SEQ ID NO: 139055 - RNA, 63 nt, Homo sapiens
uucaucaugcgacgaugaaguagcuucacaaaucuugagccuuucugcuucagcuacccaaag

SEQ ID NO: 139056 - RNA, 89 nt, Homo sapiens
auuggcccagcuuggaucgauugccuuucuuuccacccucacuacaguauggucagggagaaggagucagugcaaggacaucuguggga

SEQ ID NO: 139057 - RNA, 77 nt, Homo sapiens
acuauauggagugacugggaggcagucggguggccagaaggaaagggaaugaaugugagacagagaaugaagagugu

SEQ ID NO: 139058 - RNA, 47 nt, Homo sapiens
uaacuggagcgaugauuaccaguaaguugauuuucuuuugucugagg

SEQ ID NO: 139059 - RNA, 103 nt, Homo sapiens
acuagaguaauggccguagguugggaaggaaggaguuaauguaagaaccauacaaaggacaaaaaaucuaaauuaguuauucauugugguggcauacaaacag

SEQ ID NO: 139060 - RNA, 47 nt, Homo sapiens
ccucugucucaggcaaggugcauuaagacacuauguaaaguuacaag

SEQ ID NO: 139061 - RNA, 42 nt, Homo sapiens
uucuuuauauuccugauguuuuuacaaauuaaauuuaggcau

SEQ ID NO: 139062 - RNA, 47 nt, Homo sapiens
ucauuauauagguauauagagagcugcuauauaugaauacagucuac

SEQ ID NO: 139063 - RNA, 46 nt, Homo sapiens
acgaauuuagcaauuuccuaaaaaucuuccuccucuuuccauacag

SEQ ID NO: 139064 - RNA, 35 nt, Homo sapiens
uguuuaaaggaacguuaacucgagaguacuacuga

SEQ ID NO: 139065 - RNA, 73 nt, Homo sapiens
cuggaggugggaggaagacagaggaauuggacaaauucaaauuuccaauuaggcauaaguggcuucuuaguag

SEQ ID NO: 139066 - RNA, 46 nt, Homo sapiens
aaaguguuuugaaucauuuagugggguagcaggcacuuauccacag

SEQ ID NO: 139067 - RNA, 46 nt, Homo sapiens
augacuccaagaaaguuaaaguacaaaaaguacagucugucaggua

SEQ ID NO: 139068 - RNA, 45 nt, Homo sapiens
auaaaagcuacuuggccguaaggcuaaaagaccaagaucugagag

SEQ ID NO: 139069 - RNA, 45 nt, Homo sapiens
aaaaacaaaaugccaagagguuuaaaagacgguggauggucagaa

SEQ ID NO: 139070 - RNA, 38 nt, Homo sapiens
aauuuaucuaauaaaucauucauagaucauuuuaaagg

SEQ ID NO: 139071 - RNA, 46 nt, Homo sapiens
ugcauuuugcaaguuacacugauugaaugcuuauaugggagugggg

SEQ ID NO: 139072 - RNA, 42 nt, Homo sapiens; identical to SEQ ID NO: 43886

SEQ ID NO: 139073 - RNA, 35 nt, Homo sapiens
ucaagagauucaaagugcuuuacuuuuuucaauua

SEQ ID NO: 139074 - RNA, 44 nt, Homo sapiens
aaugcaaaauauccuggaggacaauggggaaggaaagcugcggg

SEQ ID NO: 139075 - RNA, 38 nt, Homo sapiens
augguggugaggacagcgacucuuaaauugggacaugg

SEQ ID NO: 139076 - RNA, 46 nt, Homo sapiens
cgaagugguugacauccagggacacgcgccagcgguccgcagugug

SEQ ID NO: 139077 - RNA, 42 nt, Homo sapiens; identical to SEQ ID NO: 43899

SEQ ID NO: 139078 - RNA, 23 nt, Homo sapiens
aaaaaaaaaaaagcagagaaggg

SEQ ID NO: 139079 - RNA, 72 nt, Homo sapiens
cucccucucuccaaagguugcaguagacaguggccacuccuccaucccaugagcaguagcaucacucagcau

SEQ ID NO: 139080 - RNA, 37 nt, Homo sapiens
gaugaugccccccaaaacccugauuuccacacacuaa

SEQ ID NO: 139081 - RNA, 62 nt, Homo sapiens
aauuggauaauccacugucucccaucccaggagguggugaguuggcuacaagagaaagggac

SEQ ID NO: 139082 - RNA, 44 nt, Homo sapiens
ggauaaaguuccucauuucaaacaguauacauacuucuuugcag

SEQ ID NO: 139083 - RNA, 79 nt, Homo sapiens
uuaaccuguaaacaguaucugauggcccaccuauaaauaaaauucagcauucuauuuuuaauaauuuguaugccaccaa

SEQ ID NO: 139084 - RNA, 45 nt, Homo sapiens
cgccggcgaucgcuccaucaaaguguuugauuuuuuuggccagau

SEQ ID NO: 139085 - RNA, 42 nt, Homo sapiens
aucuuggagcuucuaguuggaagucaccuccugcagaugagc

SEQ ID NO: 139086 - RNA, 34 nt, Homo sapiens
uucgaugccggaggaggcucggggcgcccccgcg

SEQ ID NO: 139087 - RNA, 38 nt, Homo sapiens
aaggcgcagguaaauguggggcagaggacccguaggga

SEQ ID NO: 139088 - RNA, 38 nt, Homo sapiens
gcucggccuucagcacggcugcgaagaaagagaaugag

SEQ ID NO: 139089 - RNA, 74 nt, Homo sapiens
caggguccauaugaggaaaugguggggaaaugucccgggaaauggcggccauuuguccaaaugccgccugggga

SEQ ID NO: 139090 - RNA, 25 nt, Homo sapiens
ccgccccuugggcuuggugggagac

SEQ ID NO: 139091 - RNA, 35 nt, Homo sapiens
gcagggggcgcccaggggccagcgggaaccucagc

SEQ ID NO: 139092 - RNA, 83 nt, Homo sapiens
aguggguagagagugagccgggagcuugugucaagcacaguguucgcccauagccagggcagccccuuggggguuaucaccaa

SEQ ID NO: 139093 - RNA, 61 nt, Homo sapiens
gagccugcagcuggggccaauuccauguccgguuucccuucuuguggcccgggguggcugg

SEQ ID NO: 139094 - RNA, 46 nt, Homo sapiens
gucggagaaugagcgccuggccucuguggcccaggagcugaaggag

SEQ ID NO: 139095 - RNA, 41 nt, Homo sapiens
uuugagggccucaagcaugagaucaagcgucuggaggagga

SEQ ID NO: 139096 - RNA, 46 nt, Homo sapiens
aucucagagcggcagcuggaggaggcgcuggagacccugaagacgg

SEQ ID NO: 139097 - RNA, 25 nt, Homo sapiens
auggggacuacuacgagguggacau

SEQ ID NO: 139098 - RNA, 35 nt, Homo sapiens
ggcauucgaguuaccuggugagagaccguguugcc

SEQ ID NO: 139099 - RNA, 51 nt, Homo sapiens
ugaccuuugcucugguuaaaacaguaauaggcacuugaaaaaaaaagauaa

SEQ ID NO: 139100 - RNA, 50 nt, Homo sapiens
cuugagugugcuuugggaaccaaauggaccuucugggacaagcugagcaa

SEQ ID NO: 139101 - RNA, 70 nt, Homo sapiens
ucauuaaaacuccuuagcaaaccaggucuacauccuguuuuguuugcugagugagguuagugggaguggu

SEQ ID NO: 139102 - RNA, 46 nt, Homo sapiens
gaaauauuguuacauuugagauaacuucaucuguaugggguauuua

SEQ ID NO: 139103 - RNA, 49 nt, Homo sapiens
uucuccugccaaggaaccuuuacacagacccaaacaaaaaaauaauaau

SEQ ID NO: 139104 - RNA, 45 nt, Homo sapiens
uacaauagagacaaagauccucaaaaugagaauaaaauuggaaua

SEQ ID NO: 139105 - RNA, 46 nt, Homo sapiens
aaagacacuuggaaucuucuuuuagacuucaguacagugauugcaa

SEQ ID NO: 139106 - RNA, 46 nt, Homo sapiens
auuucaucuuacaucuguggaccauccuacuuuauucucccauaag

SEQ ID NO: 139107 - RNA, 39 nt, Homo sapiens
auaauguaagauucuacuccugucuacauuaugcacuac

SEQ ID NO: 139108 - RNA, 72 nt, Homo sapiens
uggaauacgaaacaucaaccugccugccagcagggacaccccaugccugcuacagaacaguagucagccaca

SEQ ID NO: 139109 - RNA, 45 nt, Homo sapiens
ucuuuagcccuucacacaucgcacugaagaauaugaugcugaagg

SEQ ID NO: 139110 - RNA, 46 nt, Homo sapiens
caacaagcuaacgaagauucacccaaaagccuuucuaaccacaaag

SEQ ID NO: 139111 - RNA, 46 nt, Homo sapiens
acuuuauuggagcuucacuuagauuauaauaaaauuucaacagugg

SEQ ID NO: 139112 - RNA, 54 nt, Homo sapiens
cauucuaauucaauugcaagagugggaguaaaugacuucuguccaacagugcca

SEQ ID NO: 139113 - RNA, 45 nt, Homo sapiens
uaagauucaaaaaucccuacauuuggaauacuugaacucuauuaa

SEQ ID NO: 139114 - RNA, 57 nt, Homo sapiens
augacaagaaauuucaacggaauuuugccaaacuauugauacauaaggguugagaga

SEQ ID NO: 139115 - RNA, 48 nt, Homo sapiens
cucuucaaauacguauggacuggauaacucugagaaacacaucuagua

SEQ ID NO: 139116 - RNA, 24 nt, Homo sapiens
aacaaaucauugcauauaaugaaa

SEQ ID NO: 139117 - RNA, 42 nt, Homo sapiens
gaaauggaaauucuucuaaauuauuaugcucuagaugaaguu

SEQ ID NO: 139118 - RNA, 45 nt, Homo sapiens
agaaugcuugcuucaauuuguuguguccaacacugaguucuacaa

SEQ ID NO: 139119 - RNA, 44 nt, Homo sapiens
ggcucuuuugcagucguugagggggaggugacggaggcgucagg

SEQ ID NO: 139120 - RNA, 46 nt, Homo sapiens
ugggacacgugaccagaaguuaggggcugcagcggcgcuggcuuua

SEQ ID NO: 139121 - RNA, 30 nt, Homo sapiens
agcugagcgccugccgggugcuaaacgaaa

SEQ ID NO: 139122 - RNA, 47 nt, Homo sapiens
auaaauuuugcuuuacuuuuuacacauuuugccucauuccaaucuag

SEQ ID NO: 139123 - RNA, 41 nt, Homo sapiens
aggcuuugacaaagacagcugccauaguaccacaaagacag

SEQ ID NO: 139124 - RNA, 46 nt, Homo sapiens
uucgucagaugugagugcuaaagauaagcaugcugaagacaaugag

SEQ ID NO: 139125 - RNA, 41 nt, Homo sapiens
gagauccuucagaccaugaugaaaacaaaucgaacggcucc

SEQ ID NO: 139126 - RNA, 46 nt, Homo sapiens
gauuccgcauggacucucgauuucuagaaacugacagugaagagga

SEQ ID NO: 139127 - RNA, 1699 nt, Homo sapiens
ucugcauuuuaauccucaccauuccuacuuccuauuacuccuuucaucacuugcauuuucauucuucuccuucuagcuucuuccuuuuucuacagacauaguuaggucuuguggucccaaaaaagccauuccucuaaccaugccaguuuucaaguuuguacuccaucucucuuucaguucuaaauuugaagugaaaaaguaaauuacaucuaauucaguagcaguuggcuuuuuacugaaaacaaucugugauuugaucuucucaauucuuugaggugauuauuaacaguguuggacuguuucaggaaaccaagguucagagaguuuuaaaaugaauucucuaggguccucccaaauucuguuucagugcugagauuacaggcaugagccacuguagcuggcccuuuuccaacuuuugaaagcacaauguuugucuauccugcaagcagcagcacagccagccuccaucaccuugagcccuuuccagcauuguauucuacuugacuuucucacucaaaacuccauguugaaaacacaagaaugaacagaaccuggagacuaaccuucauuuagaagguacauagguuauuuucuuaacuucugccaauuuugucuguuucuuuacaacucuuuggguguguguucccucaaagccguaaacaacuuguccuccaagugcaguggcauugucuccaaugacauccucuucagcuaaccuagagcauaugucacuguugaucaucccuucuugaaauguucacuuugcuuccaauugcaucauaacuuccugguuuucuuaacucuuuauuccuaauuuuucuuuugccuccaaauauggguucuucccaggguucuguaagucccuauagcuuuagccuucacuugcacaugaguauuuuucaaauuuggaucuucuuucuuccuugcuguucugcugagcucccaacuggucuuaaacgccuguuggauauuuuccacaggcuuuccugaguuuguguuaaaacucagcaaguccaaaccagcucuucuuaaccuuucugcguugauggcguguccauucuuagaaucucuguuguuguuuuuuucuuuccuucucaacauuuuauuuuuauuuuuuuggagacaggaucucacuguguuccucaggcuggagugcaguggcacagucauagcuuacuguaaccucaaacucagucucucuaguagcuaggacuacaggcaugugccaccauguccagcuaauuuuuguauuuucauagagacagggucucgcuguguugccuaggcgggucucaaacuccuggccucaagugauccuccugccucagcuucccaaagugcugagauuauaggcauggaaccacugcaccagaccccuucccaaauuuugaggcacaacguuuugucucaaguaagcagcacagccagccuauaucaccuugagccuuuuucagcauuauaaucuacuucccuaaugcuuauuagauuaaaauuuaaauugauguuuuugauagucaaaaguuguugaaauuagcaguuucaaccuaaugcaguguaaacuuuuuguacuuuauuauuucaauauauguguucguuuuguuuccaacaccuagcaugcuuuccuaccaccucuagggauucaacucuaucuuuccuaccucauaacuuuaccuaguuuauaaagcaucuuuugauucag

SEQ ID NO: 139128 - RNA, 41 nt, Homo sapiens
uaccugaggugucuaaagaaauguauuauaauauugcuaug

SEQ ID NO: 139129 - RNA, 36 nt, Homo sapiens
gauguaaauaguaacgauaguuuuucuaacuuugag

SEQ ID NO: 139130 - RNA, 48 nt, Homo sapiens
cugacccagaaaacaguuuuagcugacaaagaagaaauuucagaguga

SEQ ID NO: 139131 - RNA, 47 nt, Homo sapiens
auaucaguggagaaaauggagacucagaagaggacaugccaguagaa

SEQ ID NO: 139132 - RNA, 55 nt, Homo sapiens
acugacugcugcaggcagcccugcucugugucagugccaucgccaugcugcacaa

SEQ ID NO: 139133 - RNA, 40 nt, Homo sapiens
caguacaagguaaaggccaugaccauccaagcucccguga

SEQ ID NO: 139134 - RNA, 87 nt, Homo sapiens
caucuggcauucgagcgcaggaccgggcgccccggcaccgccgcgcgccacccgcuaggaugccgguggccccagcgcccucagccg

SEQ ID NO: 139135 - RNA, 28 nt, Homo sapiens
gacguucagccugucucccacggucugg

SEQ ID NO: 139136 - RNA, 50 nt, Homo sapiens
ccugcacaaucucccugacugcucuaccauccugccccucuacuccaaga

SEQ ID NO: 139137 - RNA, 44 nt, Homo sapiens
aaguccagcagccguaagguggccaaccacaacaacucggagcg

SEQ ID NO: 139138 - RNA, 54 nt, Homo sapiens
aaauuacagaagagccagccaagaucacccaggagcuugugcccccagaugggc

SEQ ID NO: 139139 - RNA, 48 nt, Homo sapiens
aagcuggcacugaucgugacuaucagugaaagaaguuuaauuuucagg

SEQ ID NO: 139140 - RNA, 42 nt, Homo sapiens
uaggacaguaaaacguuaaaguacuggauuaagaaaacaaca

SEQ ID NO: 139141 - RNA, 43 nt, Homo sapiens
cgagagcgcgaagagcgggcgcagcagacaaaaccacguccag

SEQ ID NO: 139142 - RNA, 45 nt, Homo sapiens
ccgguacucguaguguucgucgaaguacuuguccgaguaguagau

SEQ ID NO: 139143 - RNA, 47 nt, Homo sapiens
aguuaagaaaaagggguugacuguuuucugaagccacgcccuaaaug

SEQ ID NO: 139144 - RNA, 46 nt, Homo sapiens
ucagggagccagagcaggaaucuaggaccauagaagcaacuguaaa

SEQ ID NO: 139145 - RNA, 45 nt, Homo sapiens
ucucuggguaacauaacaugccuguuacaagauacagccaagugu

SEQ ID NO: 139146 - RNA, 25 nt, Homo sapiens
uaggcuccaggguucuguugggguc

SEQ ID NO: 139147 - RNA, 99 nt, Homo sapiens
cugucuccucccacagguggggggcgggcgggggcauccuccacaucccuccacauguuccuuuaccuuccuuaucuguccuggcugcgucccucgggu

SEQ ID NO: 139148 - RNA, 39 nt, Homo sapiens
acucaccuuuuuucuuuuucuuuuuuuuuuuuuaacuuu

SEQ ID NO: 139149 - RNA, 26 nt, Homo sapiens
gucauuuuuuuuuaguuacagaagca

SEQ ID NO: 139150 - RNA, 44 nt, Homo sapiens
cuccccguagcagccacuaaaagauuauuuaauuccagauugga

SEQ ID NO: 139151 - RNA, 46 nt, Homo sapiens
uuuggaaguuccagaauggcguguugaaggccgagagccccaagua

SEQ ID NO: 139152 - RNA, 45 nt, Homo sapiens
ggcccuggaugggacugucuaugaugucauguuugucagcacagg

SEQ ID NO: 139153 - RNA, 47 nt, Homo sapiens
uugauggaugacucgguaaccccaauagacaacaggcccagguuaau

SEQ ID NO: 139154 - RNA, 73 nt, Homo sapiens
gcaucgacagcgaggcacgggccgccaacuacaccagcuccuugaauuugccagacaagacgcugcaguucgu

SEQ ID NO: 139155 - RNA, 22 nt, Homo sapiens
cugggggcgggccgugcuuucc

SEQ ID NO: 139156 - RNA, 109 nt, Homo sapiens
cugcagagccuaguuucguguuugcugacgugauccgaaaaagcccagacagccccgacggcgaggaugacagggucuacuucuucuucacggaggugucuguggagua

SEQ ID NO: 139157 - RNA, 41 nt, Homo sapiens
aacccaucaucucccgaaauucuucccacaguccucugagg

SEQ ID NO: 139158 - RNA, 62 nt, Homo sapiens
agcuuuagguuugccuaggggugggguuggggucucagugaaccuuccacuguacgagaaca

SEQ ID NO: 139159 - RNA, 42 nt, Homo sapiens
caaaaaagcaaaaugugcagaaaaggggaaaucaaaacaggu

SEQ ID NO: 139160 - RNA, 48 nt, Homo sapiens
uguuccuacucaggacuugucacagugugucaucacacacacgcaagc

SEQ ID NO: 139161 - RNA, 42 nt, Homo sapiens
uuugcagagagugaacaugugggcaaugcugucaugcccgcc

SEQ ID NO: 139162 - RNA, 124 nt, Homo sapiens
ucccugcuucuagguagguggcauuugagccagguggagacaggaaggaaggugccugccacacacaggggcagcccccaaggcuugcagggaggaugagggucagcccccuuugggacccagg

SEQ ID NO: 139163 - RNA, 30 nt, Homo sapiens
auuagcaggacaugugauggccccugugaa

SEQ ID NO: 139164 - RNA, 39 nt, Homo sapiens
cugcgauuuucagaugcacacacaugcgugcaugcauaa

SEQ ID NO: 139165 - RNA, 69 nt, Homo sapiens
ugaauguucaguuucuauuuugcuugagguauuuuguacauaugugccuugugauugcugcugcuuuaa

SEQ ID NO: 139166 - RNA, 45 nt, Homo sapiens
gggucucgcgagcaagaugucagacugcuucaggaaauuguagau

SEQ ID NO: 139167 - RNA, 46 nt, Homo sapiens
uucaucuagguauuuuugcaguguugaaggaaaagugcggacaaau

SEQ ID NO: 139168 - RNA, 32 nt, Homo sapiens
uuuugaugauguccaguuuauguguuuuguug

SEQ ID NO: 139169 - RNA, 58 nt, Homo sapiens
uguccucuuccagaauugguaagcaaccauguucagcuguaauuuuaauauuuggacu

SEQ ID NO: 139170 - RNA, 68 nt, Homo sapiens
ccugaaccauguacaguuucauacaugugggagauuuauuagugacuugcucugagcagaguguguga

SEQ ID NO: 139171 - RNA, 42 nt, Homo sapiens
uguauaaacuucgccucauuuaauuuucuuggauuguuggau

SEQ ID NO: 139172 - RNA, 45 nt, Homo sapiens
accaaagcauuuaagauuugccauucauucaucuuggaauucuag

SEQ ID NO: 139173 - RNA, 57 nt, Homo sapiens
ucuuuaguggcuuccuauacaugacauuucuuuuuaagccguuuaacuaugcaagau

SEQ ID NO: 139174 - RNA, 59 nt, Homo sapiens
cugucccagccgggcucauauccggcuccaguguagcugccacccacauucuccccgcu

SEQ ID NO: 139175 - RNA, 36 nt, Homo sapiens
gaaauuaagggagcuucgaaaguaaauuguuaagaa

SEQ ID NO: 139176 - RNA, 44 nt, Homo sapiens
aaaccagaguuuagacggacgauaaaacggaguggugaaaauga

SEQ ID NO: 139177 - RNA, 46 nt, Homo sapiens
cuuggacuuguuaaggaggcucaugauggucacuacgcucucgguu

SEQ ID NO: 139178 - RNA, 62 nt, Homo sapiens
cucuauuauucucaacaccaauggcagcggucuucauaggccagcggagugaguucugucga

SEQ ID NO: 139179 - RNA, 44 nt, Homo sapiens
guucuaugaaaccccauggggauggauacagaaaggcaccaacu

SEQ ID NO: 139180 - RNA, 29 nt, Homo sapiens
cuccaucagcaaaaaccagccagaaaaaa

SEQ ID NO: 139181 - RNA, 58 nt, Homo sapiens
agaaaucuauugggaugaggcuccaugaaacuauauuuacucaaaaccuuaguuaaaa

SEQ ID NO: 139182 - RNA, 22 nt, Homo sapiens
ugcccucagcgcaucucugccu

SEQ ID NO: 139183 - RNA, 53 nt, Homo sapiens
aaacauuaacaucaaggaaccucgaugggaucaaagcacuuucauuggacgag

SEQ ID NO: 139184 - RNA, 46 nt, Homo sapiens
guaacugaccccaggaacauucuguuaaccaacgaacaacucgaga

SEQ ID NO: 139185 - RNA, 44 nt, Homo sapiens
aggcaaggaauuguuccuccuggucuuacagaaaaugaauugug

SEQ ID NO: 139186 - RNA, 46 nt, Homo sapiens
ugauucagcuuuucauccugacacuggugagaagaugauuuugaua

SEQ ID NO: 139187 - RNA, 25 nt, Homo sapiens
cucaaaguauauuuuuguauguaaa

SEQ ID NO: 139188 - RNA, 73 nt, Homo sapiens
uuuuggggcuuaaaguacauuauucuauaucuuuggaaguauuguuguagaacuggcaaaaauuaaaggagaa

SEQ ID NO: 139189 - RNA, 42 nt, Homo sapiens
aucacgcaaguugucguguccaggauucucauggcagccccu

SEQ ID NO: 139190 - RNA, 51 nt, Homo sapiens
accagaaaacaaacacauauaucacaccucuuaguggaaauugccuuccac

SEQ ID NO: 139191 - RNA, 385 nt, Homo sapiens
aagaaagaauuuagagucacuaacuuuucaggggguuuuuugcuuuuuuuuuuuuuuuuuuuuuuuugagaccgagucuugcucugucaccaggcuggagugcaaugacauaaccuuggcucacugcaaacucugccucccggguucaagcaauucuccugccucagccuccugaguagcuggaacuacaggcauguaccaccaugccuagcuaauuuuuguauuuuuaguagagacgggauuucaccauguuagccaggauggucuugaucucuugaccuugugauccaccugccucagccucccaaaguguugggauuacaggcaugagccaccacacccagccugacuuuugaguuuuuuacuucauugaauauauauaugu

SEQ ID NO: 139192 - RNA, 42 nt, Homo sapiens
ugucccagcccagaugucaccuggcuaggaagcgcuggggag

SEQ ID NO: 139193 - RNA, 84 nt, Homo sapiens
uucucccaguuacggaaaccuuuuaaagauccacauuagccuuuuagaauaaagcugcuacuuuaacagagcaccuggcguggg

SEQ ID NO: 139194 - RNA, 57 nt, Homo sapiens
accuuuccuguagcuuuuauagucauuguuuuucaaagacgauauaccagcccucac

SEQ ID NO: 139195 - RNA, 52 nt, Homo sapiens
uuaaaauacugaauuuucaucucacucccauugcaaaucaaggagaucucag

SEQ ID NO: 139196 - RNA, 52 nt, Homo sapiens
aaaaacuuacccugaaauauuaagggcaguuugcuucuaguuuggggauugc

SEQ ID NO: 139197 - RNA, 44 nt, Homo sapiens
aacuauuuaguuuugguagauuuuuuuucugacaaugugaccag

SEQ ID NO: 139198 - RNA, 28 nt, Homo sapiens
cuggucaggcugcgcauuucauucuuuu

SEQ ID NO: 139199 - RNA, 46 nt, Homo sapiens
augugguuaguuuggucuguucucucggaguuggugggcacccuaa

SEQ ID NO: 139200 - RNA, 45 nt, Homo sapiens
ugugaggacuacaaaaugcauugccacugugaacacuaaagguga

SEQ ID NO: 139201 - RNA, 46 nt, Homo sapiens
uuggcauccaaguaauccugaccuauuuguuacggcguccggagau

SEQ ID NO: 139202 - RNA, 47 nt, Homo sapiens
ggugguggugguggugguacguugguggugguacguuggugguacgu

SEQ ID NO: 139203 - RNA, 56 nt, Homo sapiens
ggugagcugccggggcucggcucaggcuagggagaggggccguggugaagugaggu

SEQ ID NO: 139204 - RNA, 36 nt, Homo sapiens
aauuacagcuaaauuaaucucacuuuaaagugcaag

SEQ ID NO: 139205 - RNA, 74 nt, Homo sapiens
ucuuccacacaacaagggcaagcuuuauacuaauguuucucaaaaaccaauuacaucuccagcucuagccucaa

SEQ ID NO: 139206 - RNA, 46 nt, Homo sapiens
uuguccacacugucaauggcugaugacagggucauggcaggggagg

SEQ ID NO: 139207 - RNA, 17 nt, Homo sapiens
ucgggccucgccggaag

SEQ ID NO: 139208 - RNA, 46 nt, Homo sapiens
gguggaaggcgggccugggcccucuggugccuucggucuucccucg

SEQ ID NO: 139209 - RNA, 47 nt, Homo sapiens
ugagugccugcuaugugccaggcauugugcugagggcuuugugggga

SEQ ID NO: 139210 - RNA, 337 nt, Homo sapiens
cuauuucuagccgggcgugguggcucaugccuguaaucccagcacuuugggaggcugaggcagguggaucaccugaggucaggaguucgagaccagccuggccagcacggcgaaaccccgucucuacuaaaaauacaaaaauuagccaggcgugguggcucacaccuguagucccagcuacuagggaggcugaagcaggagaaucgcuucaggauuccaccacaggagguggagguugcagugagccaagaucgugccacugcacuccagccugggugacagagcaaaacuccgucucaaaacaguggcuaaugaugcaaugaaaagagguugguac

SEQ ID NO: 139211 - RNA, 105 nt, Homo sapiens
ggccugauauucccggggauagccuaagaacaguguguuuccugauauucccggggauagccuaagaacaguguguuuccugauauucccggggauagccuaaga

SEQ ID NO: 139212 - RNA, 68 nt, Homo sapiens
ugcucucguacuaacugugccagugcccauguuuacagaagucaggggaaggaaggagccuguguccc

SEQ ID NO: 139213 - RNA, 77 nt, Homo sapiens
aauagagauugugugccuucauuucauuugacauuuacccagcaugccucaguuccacaccgugaccaguguaagaa

SEQ ID NO: 139214 - RNA, 39 nt, Homo sapiens
gugcccuugggcgccauuugaagaaucacuguucuugaa

SEQ ID NO: 139215 - RNA, 29 nt, Homo sapiens
cccauagguaagugggugcgguaggaacu

SEQ ID NO: 139216 - RNA, 44 nt, Homo sapiens
ggcuuagggucgagacuucauagcagugacagccagacccagca

SEQ ID NO: 139217 - RNA, 49 nt, Homo sapiens
gccuugaaagcuccgcagaaaugauuccaaaacccagggagcaaccacu

SEQ ID NO: 139218 - RNA, 40 nt, Homo sapiens
aagggucacuuccuccccagcgacacaugggccucucaaa

SEQ ID NO: 139219 - RNA, 46 nt, Homo sapiens
uccuggcccucugguccagccccucacgccuccucucagucuacuc

SEQ ID NO: 139220 - RNA, 47 nt, Homo sapiens
ggggaaagcagacugcuauaaaagcccguccuaucuccacccgcagg

SEQ ID NO: 139221 - RNA, 336 nt, Homo sapiens
cccucugugaugucucuugguggguguguggggugaaggguuuuuuguuuuuugagauggaguuucgcucuugcugcucaggauggagugcagugcugcgaucucggcucacugcgaccuccaccuccuggguucaagcgauucuccugccucagccucccgaguagcugagauuauaggcacaugcaaccgugcccggcuaacuuuuguauuuuuaguagagacgggguuucaccaugucggccaggcuggucucgaacuccugaccucaggugauccacccaccucggccucccaaagugcugggauuacaggcaugagccaccacacccagcu

SEQ ID NO: 139222 - RNA, 36 nt, Homo sapiens
gggcaggagguaggggggcauucuagaccuggguac

SEQ ID NO: 139223 - RNA, 45 nt, Homo sapiens
ugacaggcugacccaggagccugagagcauccgcaaguggcgaga

SEQ ID NO: 139224 - RNA, 48 nt, Homo sapiens
ggcacagagagggugaguaacuugcccgcagucacacagguggcggag

SEQ ID NO: 139225 - RNA, 36 nt, Homo sapiens
caugugggucgauauauacauggguauacacagagu

SEQ ID NO: 139226 - RNA, 48 nt, Homo sapiens
ugcaagguggugagguccugggcuggggcugagcugcgggagagagug

SEQ ID NO: 139227 - RNA, 70 nt, Homo sapiens
ugccaaccuaaguuuugcaaugccagcuuuguucagagagaaagaauauugcaguuuuggcuggagacau

SEQ ID NO: 139228 - RNA, 47 nt, Homo sapiens
cuuuagaauucauuaucaguguacacaucugacuuccuucaauagac

SEQ ID NO: 139229 - RNA, 43 nt, Homo sapiens
guaguugaggaagaaaguucuaaggagugugaagcuaggagau

SEQ ID NO: 139230 - RNA, 46 nt, Homo sapiens
uuccagacuauuccaaagauacuccaacaaucucaaugaggcagaa

SEQ ID NO: 139231 - RNA, 46 nt, Homo sapiens
uuucuuucuuucuccuggucagcucugagagaggccagguaggccu

SEQ ID NO: 139232 - RNA, 32 nt, Homo sapiens
ucucuccucugccaacuuuugcuguugcaccu

SEQ ID NO: 139233 - RNA, 49 nt, Homo sapiens
uaguccuuuggaaaggcaccaggcuuggcaauucaggaaagcccagggc

SEQ ID NO: 139234 - RNA, 44 nt, Homo sapiens
gaaaauauucuuacaaaauacacucccauagaaggggaacaaac

SEQ ID NO: 139235 - RNA, 43 nt, Homo sapiens
gccuuauuaucugcauuuuacagauggggaaacugaaggaaua

SEQ ID NO: 139236 - RNA, 40 nt, Homo sapiens
auccccugggaacccccaucuccucccauccaguucuugc

SEQ ID NO: 139237 - RNA, 52 nt, Homo sapiens
gauucgagaccagcucaaccucuucaucaacaacaacgucaaggccuaccgg

SEQ ID NO: 139238 - RNA, 39 nt, Homo sapiens
agagcuggugccugcuucaagcagcucucaacccagggc

SEQ ID NO: 139239 - RNA, 42 nt, Homo sapiens
gaaccucaauaucuacuucaacugcacugacuugaaccccag

SEQ ID NO: 139240 - RNA, 55 nt, Homo sapiens
ugaacagccaugugacagucucagcugagagcuuggaagaaaauaagggagguga

SEQ ID NO: 139241 - RNA, 28 nt, Homo sapiens
gaaaaaaugaaaaaaauaaauaaauaag

SEQ ID NO: 139242 - RNA, 41 nt, Homo sapiens
gcgccgccugugggaagccguguccggugcccagccggugg

SEQ ID NO: 139243 - RNA, 65 nt, Homo sapiens
acaugccaacaaagugaagagauaccuagcaauccauggaauggagacauuaaagggggaaacga

SEQ ID NO: 139244 - RNA, 62 nt, Homo sapiens
agcaagacaagagaaaauggaaagaagccaggcugcuugcuuucuugagggccaaggaaaag

SEQ ID NO: 139245 - RNA, 28 nt, Homo sapiens
agagagaugcugggaucccuuuauguag

SEQ ID NO: 139246 - RNA, 48 nt, Homo sapiens
cagcaggaauggccaaagcaaagcaaggaagcaucagagaauaaagug

SEQ ID NO: 139247 - RNA, 27 nt, Homo sapiens
gugaaaguucuuugauguuuauuucau

SEQ ID NO: 139248 - RNA, 82 nt, Homo sapiens
aaacacagaaaacaggagaccaagcucaaacuaauggcacgcuaugggcggcuggcggacccugcugucacugacuuuccag

SEQ ID NO: 139249 - RNA, 40 nt, Homo sapiens
aguucucggcugaaauggaauccuggcagucuuuuuucag

SEQ ID NO: 139250 - RNA, 42 nt, Homo sapiens
ugcaaaggcaacccauucagaaagacucaaccaccuuggaag

SEQ ID NO: 139251 - RNA, 65 nt, Homo sapiens
ccagauauggccaguugcgcagguuucugccaacugugaaguauccuccuggagcagugacacaa

SEQ ID NO: 139252 - RNA, 32 nt, Homo sapiens
ggggguguguggcugucuggguggaucaaaga

SEQ ID NO: 139253 - RNA, 42 nt, Homo sapiens
cgucaagguggugaugcugggcaaggaguacgugggcaagac

SEQ ID NO: 139254 - RNA, 48 nt, Homo sapiens
gcccuuucuuccggccguguaggagugccugugcggggcuccucuggu

SEQ ID NO: 139255 - RNA, 48 nt, Homo sapiens
cauacuagaugguucucagccuuggcuguguauuggaguucccuggag

SEQ ID NO: 139256 - RNA, 61 nt, Homo sapiens
ggcaccacguggaggcuuggcugggcaggcggguacacugacggggaacuccggggggcuc

SEQ ID NO: 139257 - RNA, 48 nt, Homo sapiens
gucccugggcccaggagccaaugugaacuuuuuuuuuuaccgggauua

SEQ ID NO: 139258 - RNA, 79 nt, Homo sapiens
ucaugacaucaucuccaugaagcuguuccagcugaugguggagcacacgcccgacgaggagagcaucgacuggaccaag

SEQ ID NO: 139259 - RNA, 60 nt, Homo sapiens
gaucaucacuccucuacaugugcggaacaugagccucaaagagggcggcagaccccagga

SEQ ID NO: 139260 - RNA, 25 nt, Homo sapiens
acgugucggcuuugagccucagccu

SEQ ID NO: 139261 - RNA, 31 nt, Homo sapiens
ucggcucucacacugugugccuggccgagcu

SEQ ID NO: 139262 - RNA, 33 nt, Homo sapiens
cccuggccuuuuccucaucucggucacacccac

SEQ ID NO: 139263 - RNA, 43 nt, Homo sapiens
cgagccaguacguacgucugaccccugacgagcgcagcaaaga

SEQ ID NO: 139264 - RNA, 41 nt, Homo sapiens
ccacuacaccucucuuucuucuuuuguuguuggggucugug

SEQ ID NO: 139265 - RNA, 41 nt, Homo sapiens
agggcggaaguggccgagaggagaggagaauggcggcggaa

SEQ ID NO: 139266 - RNA, 50 nt, Homo sapiens
ggaaagggaaggggggacacgggagagggcagggcguggauggagcuuca

SEQ ID NO: 139267 - RNA, 45 nt, Homo sapiens
cuggguggucucgccauugguuagcagguggggcuccggcuccug

SEQ ID NO: 139268 - RNA, 46 nt, Homo sapiens
uggcccccggggaggcgccugugccugagggggcuccuccaugggg

SEQ ID NO: 139269 - RNA, 42 nt, Homo sapiens
cugugcuccucgaucugcugcucccgcucccgguagcgccgc

SEQ ID NO: 139270 - RNA, 42 nt, Homo sapiens
gcuccauccgcuccugcucgaaccugagccucucauccaggg

SEQ ID NO: 139271 - RNA, 66 nt, Homo sapiens
cauccucucgcagccgcagucggugcagcacagggcuggagagucgcgccagcccguuagagagcc

SEQ ID NO: 139272 - RNA, 46 nt, Homo sapiens
gagcacguauuuuggcagagcagcuugggaguccuugacacugcag

SEQ ID NO: 139273 - RNA, 36 nt, Homo sapiens
gcuccucccccaucagggaccgagugccccuugcug

SEQ ID NO: 139274 - RNA, 34 nt, Homo sapiens
ccagggggcugcuguauguguagacugguggcag

SEQ ID NO: 139275 - RNA, 44 nt, Homo sapiens
cugucggcucagaaguccauggagcugugggccagguaguccuu

SEQ ID NO: 139276 - RNA, 37 nt, Homo sapiens
gggaguggcaggccaaccaggcaggggaaggcauuag

SEQ ID NO: 139277 - RNA, 30 nt, Homo sapiens
caacaaggaaccuaaagaaacuccuccuca

SEQ ID NO: 139278 - RNA, 107 nt, Homo sapiens
cggacccuccugcuggugcuguggcuggcgacgcgcggaagcgcgcucuacuuucacaucggagagacggagaagaagugcuuuauugaggagaucccggacgagac

SEQ ID NO: 139279 - RNA, 45 nt, Homo sapiens
caaggaaacuaccggacgcagcuguaugacaagcagcgggaggag

SEQ ID NO: 139280 - RNA, 56 nt, Homo sapiens
ggcagguucacuuucacuucccauaccccuggugagcaccagaucugucuucacuc

SEQ ID NO: 139281 - RNA, 40 nt, Homo sapiens
ccagucuguuggcuaaaugaacagaugaaggaaagucggg

SEQ ID NO: 139282 - RNA, 83 nt, Homo sapiens
ugaguugcagcuacgagugcgacagcugguggaacaaguggagcagauccagaaagagcagaacuaccagcgggugagugacu

SEQ ID NO: 139283 - RNA, 46 nt, Homo sapiens
cagugagagcaccaaccagcgggugcuguggugguccauucugcag

SEQ ID NO: 139284 - RNA, 67 nt, Homo sapiens
caggcugggggagaaaggaccuccuggaacugacuucuucugucaggaggacugguuuccagccaua

SEQ ID NO: 139285 - RNA, 38 nt, Homo sapiens
ucuucugucuuccuuugcuaacuuaggguuuugagcag

SEQ ID NO: 139286 - RNA, 69 nt, Homo sapiens
uagaccugcugauccagggugugugugaguugaggguggguggagggguuugcagugugggaauguggc

SEQ ID NO: 139287 - RNA, 44 nt, Homo sapiens
auaaauguagguuuguuacaugaguuucccaauaaaaaaaaaaa

SEQ ID NO: 139288 - RNA, 61 nt, Homo sapiens
gcaaggcccaaacugucaguggcgguucacugaacgagccucaaaccuuuaguccaagagg

SEQ ID NO: 139289 - RNA, 46 nt, Homo sapiens
cgguccagagggguucccgccauggccuagagcaguaccuuuccag

SEQ ID NO: 139290 - RNA, 43 nt, Homo sapiens
ggaaacagcugauuagugaaaaacccagucaagaggauggaaa

SEQ ID NO: 139291 - RNA, 46 nt, Homo sapiens
gcucuuggagucagagcuuuuguuugcaaauacuugguaagaaaag

SEQ ID NO: 139292 - RNA, 54 nt, Homo sapiens
cgguaacccccaacuugccgguagggaaggcagccacucuagaggcauggcgag

SEQ ID NO: 139293 - RNA, 41 nt, Homo sapiens
gugaguucagagccuagcggcgucaccuguggugcuggagg

SEQ ID NO: 139294 - RNA, 46 nt, Homo sapiens
cuccaauaacacugaaagucugaaauccccaaaggugaacugugag

SEQ ID NO: 139295 - RNA, 28 nt, Homo sapiens
acaggugguggcagggacgguguacccu

SEQ ID NO: 139296 - RNA, 72 nt, Homo sapiens
uacuccugagggagcugguggugucacuuuauggaggccccuuaaagaaagugggcuguucucuguguggug

SEQ ID NO: 139297 - RNA, 46 nt, Homo sapiens
aaggagcuaaaccaauggccagauuuaaucauacagaucgaacacu

SEQ ID NO: 139298 - RNA, 78 nt, Homo sapiens
aguuugaaaugugaagauguauuccggcagaauagugaguagaaugacaugcuuacuauacagaaggcaaaaauagga

SEQ ID NO: 139299 - RNA, 44 nt, Homo sapiens
gagaauccguauucggagaagaaaacggauauaauuucgggaga

SEQ ID NO: 139300 - RNA, 72 nt, Homo sapiens
gcucaggaaacuccacucagaacuggaggaaaauccgagugggcagagggcaugcgguaggcagauagguaa

SEQ ID NO: 139301 - RNA, 52 nt, Homo sapiens
gacaguaggcgacagaaugaaagagaccaaagagaaggggcgggcgggaagg

SEQ ID NO: 139302 - RNA, 31 nt, Homo sapiens
gcaggcugcugucacucagccgggcugaguu

SEQ ID NO: 139303 - RNA, 45 nt, Homo sapiens
auugagagcauguccaggucccuuccccagccaacgcccaagauc

SEQ ID NO: 139304 - RNA, 42 nt, Homo sapiens
uaaaccauucuugggcacaggguguuuuuagugagccaggcu

SEQ ID NO: 139305 - RNA, 23 nt, Homo sapiens
aggggcgggcaggaggggcgcug

SEQ ID NO: 139306 - RNA, 43 nt, Homo sapiens
gggggaaaguaacagugucuacaaagggccuagugguaaggaa

SEQ ID NO: 139307 - RNA, 31 nt, Homo sapiens
aaggaaaggggcuaggccaugauucuguggg

SEQ ID NO: 139308 - RNA, 69 nt, Homo sapiens
gcagaacccagaagucucgggaaggagcagcauuugagcuggaacuaaaaagacaagcuaaguugugag

SEQ ID NO: 139309 - RNA, 40 nt, Homo sapiens
agguuugcucuggcaccucagacuccccucugagccuccu

SEQ ID NO: 139310 - RNA, 44 nt, Homo sapiens
augaucccccaaaggagcagaaauuugggcaagaaauggagaag

SEQ ID NO: 139311 - RNA, 36 nt, Homo sapiens
caucucuuucaaaggcacauuggcugugcaggggaa

SEQ ID NO: 139312 - RNA, 92 nt, Homo sapiens
cauugcagugggaggggcuggaagaggccagggagcuccuguggagauauggaggcgcauggcuccuaaagaggcuggagccauguggaggc

SEQ ID NO: 139313 - RNA, 42 nt, Homo sapiens
gacccgcucagauggaccaccaggagcugcaucucagccugc

SEQ ID NO: 139314 - RNA, 73 nt, Homo sapiens
guuacccaccaguccuugcacuguucugacacuuuccccaggaggaaaacaaguacaaagguuacgguggagg

SEQ ID NO: 139315 - RNA, 46 nt, Homo sapiens
ugguaguucuauuaagaaauaguuaaauauugugcuuuucagagcc

SEQ ID NO: 139316 - RNA, 50 nt, Homo sapiens
guaguuuaacaggcauuaaaauuuguaauugaaauguugcuuucacugaa

SEQ ID NO: 139317 - RNA, 57 nt, Homo sapiens
uuggaauucugugcuguuauaaacaaacccaauaugaugcauuuuaagguggaguac

SEQ ID NO: 139318 - RNA, 46 nt, Homo sapiens
aggaggaggucaaguaauaauuugcacacuagguuugcugucaaag

SEQ ID NO: 139319 - RNA, 43 nt, Homo sapiens
gaaauugaaacuuggggaaagaacuugggauuccaaaauggga

SEQ ID NO: 139320 - RNA, 48 nt, Homo sapiens
auuauggccaauccacaaaugcagcaguugauacagagaaauccagaa

SEQ ID NO: 139321 - RNA, 55 nt, Homo sapiens
augcagcgacaacuuuugucuaacccugaaaugaugguccagaucauggaaaauc

SEQ ID NO: 139322 - RNA, 23 nt, Homo sapiens
auauuaaggaaguaguuggggau

SEQ ID NO: 139323 - RNA, 46 nt, Homo sapiens
uugauauuugcuggaaaaauuuugaaagaucaagauaccuugaguc

SEQ ID NO: 139324 - RNA, 62 nt, Homo sapiens
gucagaggguaagccgaagaccuccagaggauaauauugaaggcuuaugcucuguaucagac

SEQ ID NO: 139325 - RNA, 44 nt, Homo sapiens
gcucuuucccuuuuaguauguuuaucaucucuuagaugccaauc

SEQ ID NO: 139326 - RNA, 68 nt, Homo sapiens
ccaggauagcgccgccggagccgaaggugcuggcgcccccgcggccgcugccuccgcggagcccaaaa

SEQ ID NO: 139327 - RNA, 43 nt, Homo sapiens
auaucccagaagaaacugaagaaacaaaaacuuauggcacggg

SEQ ID NO: 139328 - RNA, 48 nt, Homo sapiens
uuuucccuauuuuuuuuuuuuuuuacaggguggcagaaaagggaaaag

SEQ ID NO: 139329 - RNA, 36 nt, Homo sapiens
guauuguuucauuuuguuuuauaauguugauguuga

SEQ ID NO: 139330 - RNA, 14 nt, Homo sapiens
cagaagaguaggca

SEQ ID NO: 139331 - RNA, 87 nt, Homo sapiens
gggauaaggaaagaaaggcagcaugaaggaguaggcauuugggauugaccuugaaggagacagggagaguuuuacagcaagcaggga

SEQ ID NO: 139332 - RNA, 84 nt, Homo sapiens
gcaugagaauauauaugaaggcgaaucagugaaaguuguguuggggaaagagcaaagacuccaggguauguugagagguagaaa

SEQ ID NO: 139333 - RNA, 72 nt, Homo sapiens
ugauugauuaauuguggguaggaagagagaaaucaaagaaaguggagguuuugaguuuguagauaauugcaa

SEQ ID NO: 139334 - RNA, 42 nt, Homo sapiens
aauccuuguagcagauacguggaguguauuggaaggaaaagg

SEQ ID NO: 139335 - RNA, 46 nt, Homo sapiens
cgucguaacggucuccaggucucccucuucugucauaggccaugag

SEQ ID NO: 139336 - RNA, 46 nt, Homo sapiens
cucauaucaucauaaucucuucuagauggaggcaugggacgcccac

SEQ ID NO: 139337 - RNA, 46 nt, Homo sapiens; identical to SEQ ID NO: 44319

SEQ ID NO: 139338 - RNA, 45 nt, Homo sapiens
auaccuugcucugaagcagaaugcguaauucaaccaucucaucag

SEQ ID NO: 139339 - RNA, 58 nt, Homo sapiens
ucgaggucggugcagcagagaaacagaggauaauggcgucugcagugcugucgccugg

SEQ ID NO: 139340 - RNA, 63 nt, Homo sapiens
agcgcccuccuccuuucucguucgcgcacucacuagcuggggggaggggcggcuagggggcga

SEQ ID NO: 139341 - RNA, 32 nt, Homo sapiens
gcgggaagagguaaaaaaggaacugggagcgc

SEQ ID NO: 139342 - RNA, 42 nt, Homo sapiens
guauucuccacccuuugucuauuugucuguucuaauggccag

SEQ ID NO: 139343 - RNA, 46 nt, Homo sapiens
acuguagagacccuccggauuacuggacaauacauggacuauggca

SEQ ID NO: 139344 - RNA, 45 nt, Homo sapiens
gagggugaaaauaagucagcuaagguggugaucaggucaggugag

SEQ ID NO: 139345 - RNA, 21 nt, Homo sapiens
cuaauuaauagaaauauauuc

SEQ ID NO: 139346 - RNA, 41 nt, Homo sapiens
ggucaauaccauguagaacaaguacaguauaaacaacccca

SEQ ID NO: 139347 - RNA, 71 nt, Homo sapiens
gauuuuaauagaaagacaugauguauguauuuaagccacguuaaaagaaaaaauauaacuauggaccggua

SEQ ID NO: 139348 - RNA, 53 nt, Homo sapiens
aggacacagcaguguagaucaggcuucaacuuaacauuuaagggaaaugucag

SEQ ID NO: 139349 - RNA, 49 nt, Homo sapiens
aguaaauauaugacucagggaaaagccucagcgaagaggacccagcagg

SEQ ID NO: 139350 - RNA, 50 nt, Homo sapiens
aauuuuauggcuuuugucauaaagcgaggcuuguuucauuuauauugggu

SEQ ID NO: 139351 - RNA, 37 nt, Homo sapiens
agggaaacuaccuccuuucuuccccuccaaaauuacu

SEQ ID NO: 139352 - RNA, 43 nt, Homo sapiens
ggauaaguuugagcccuugaccuuaauuucauugcuaccacuc

SEQ ID NO: 139353 - RNA, 31 nt, Homo sapiens
ggugcugaccaguggggccuuagcaauuuga

SEQ ID NO: 139354 - RNA, 42 nt, Homo sapiens
guacgccgaggcgugcgcgccggugcuggcgcagcacggcgg

SEQ ID NO: 139355 - RNA, 45 nt, Homo sapiens
aaccaacagaaacuacuuccucaguuucuucuucacuuggacaag

SEQ ID NO: 139356 - RNA, 48 nt, Homo sapiens
ugacauggauaaguuaaaauccacgcugaaacaguuugugagagacug

SEQ ID NO: 139357 - RNA, 46 nt, Homo sapiens
aauauaaacuuuauccuuggauccaucaguuuagcaauaaccggag

SEQ ID NO: 139358 - RNA, 11477 nt, Homo sapiens
uaaaucuagguaaguuuuuuaguauuuacuaaaauuuuguauauuaaucugaguacuuacagcuguauuacauuuaacuucacagucucaaaugugcaugaacauuagaauuauguuguaaauguuuuaaaaccacuacaguuuccuuuagacugcauccugguggugaucccuccaaaggcaguggaagcucagaaguuguauauucacacuuaggucagucucacagucauuguaauuucaguguauacuaauuguugaucugaugguagguaaucauucccucauuaucaccaucccacaugcugagacagugguccguucuguuaggaagagaguguucucuuuuucuuucuauaaugaagcaugcggggagauuuuaccucuuccauggaaucuuccucccuaguacauccauauacugggaaggguguaggugugauaacuucugugauuaccuugaguuuaagaaagaauagaaacacaauuuuuuuuaugcaaaauuuuuuuuuacugcauucuacuuacuacucgauguuagaaauuaaauguugacuauaacauggucccuccaguccagaaucuaaaggaaauugccauuuuacuccuuuuuaaaauaaaggggguauaaugauaauauucagguagauauacauguauucuuucgugagauauauaaucuguguucagaaagacaucaugacuagaacauaaagguuuucaagauaaggauuauuauacuacauaaaaggacauaacguacauggucuugagcccuuggccuuccgggugggucuaguuuugugacugauuucugacaccuacucucuuuuuaauuuuaauuuaccagaaauuuugccauuugggacuaagcccuggagguaguaguaagucuuuugcaaacuucucuuaagaauuccuuaggaccagaugaaagcagcuguacaaugcaaucauaauaaaauaaauaucccaaacuguaagucuucuuuaaaaguaguuaccuugggaaauuuuucccaaggaaaaauggaaagauauuaccuacuggguauuugcuuacuguggguuagguacuguguuggucccuuauaaauaccuuguggaaucucaaagcagcccuauauugaaauggcacuauguuauaguugaagagacuuagagucuuggguuaaauaacuagcagaacaguccuguagcuuacauguggcaaagacaggcuugaagcccagagccaauuucuugauuacccucaguuaauuuguaaguuagcauuaacaugacccuguguuuauauaauuaaauuuuuugacccccauuacugaguuaugguaagguuuuauguauuuccagagcaugugacuuucauagaaacagcuuuuuuuuuaacauuuguuuuauugguuuaugaauauuuuauuaaguuauauaauacaauaauuguaacuaccugaagcacauaaaguuggcuccugauaaguauacuguuugauaagaguagauguacuauagugugacuuaugaucugucaugggcaucagaaguaauggagcauguugguuaacaggaagucaauuaggagagcuaauuccauuauggagucucaaaacaauuuugaaaauuguaauaauggagaaacacaguccuuaaaaauaguuauuuggaagguuaguacuuuauaaaguauuaacuuacacaucuuuugcauguauaaguuaaagaauguaaaaaaaaaagucucagaaucagcuuucuuuuaaauguuacuguguucugggcaucuaaucuguguuuuucauuuuuuaugccauguacucauuuuugacuccauauuccuccuaccuaaucucauggcuuuuccuacucuuuggauucccaaucuguaucucugguccaaacaucucucuugugcuccaagccaguauguccaacuuggguguaccacagauacuucaaaauccuugugucucaagaccagccugggcaacaugcccugagaccccaucucaaaaaaaagccaaaacaaaacagaaaaugauuccaugccucccaauaucuuuucuauuaaucaucuacucagguuacccugaagaaaaauacugggagccuuucguuaccccuuuuauuaggucacucaggcuaccauaacaauaccacagauuggguggcuuaaauaacaaguuuauuuucucacaguucugaugacuggaauuccaggugcucaccagguuggugucuagugagggcucuuccuuugauuugcagggguuacccucuugcuguguauucacauagccuuucuuugguugugcauagagggagaaggagugaaugagagcaugagugagcucuuuggugugucucuucuuauaaggacacuaauccuauuggaugaggaccccacccuuacgaccucauuuaccuuaauuacuuccuuagaaguccuacuuucaaauacagccacacuggggauuagggcuucaacaugugaauuuggaggcagggggacacaaacagucaauaggaccucucuuuuuccucgcuguuugucucuagucagucuaaaaguuguaucuccuaaagcuacuuaaucgcucuugaauauccuucuauuccaggguuucucgauugugguuuugacauuugggcuggaucauucuucagugggaguggugagggaagugggggucugaccuguauaguguaggaugguuaacagccuuccuggccucuaagacuccaguaguaccucccaguuuugacaaccaaaaugucuuuagauauugaaaaauguugcccuccggggguggaggguguuggcagagucauccccaguugagaaccauugcuccaauuucaugguuucuugccuggauuagcauuaggauuacuguaguaauuuccuuaaggacgccccugccuucaaguugucuucggcccuuuucauuucuccacauaaucaucagugaccuuccuaacaugcaaaucuguuccuguaagacucccugcaugaaauucuagcuuucuggaaaaccuaaacucuucaggauuauguuuuuuaccuucaggauuauuuuuuaccaccccuucucugaccucaagugccaguccuuugacuuagcccuuucuuucucuucuguuuucccuugguuaguccuuauguguucuuaaacacuuagcucaggugauccuuucggguuggguuaaguauucuguauuucuuauguucuaagagacucugcuguaacauauacuucaguuugguauuagcacccauaugcuuuuguuuccacugcuagucucuaagcuccauaagggcaaagaucuaaugcuuccuagucaccugguacaaagccuggcaaacaauggguauuaaugacuguuacauguauguaugaauguauuguuucaaaauuugaaaaagggaacauacuaagaugucucgaagagaugaugaagugccaucuauauugguaaauucauaacauucuuaugguuuuggcuuuaauuauauagaccuggaggcuuaauuuacccuguaaacugagagaucaaccucuuggggaugauuuuacccuaacccugcuuagguagacuagaacaucaauauauucauauauaaugggaaauguaauggccagccauucuggaacaaaugacauuggagguaaaauuauauaugaaaauguugcccaaacugcaugaaaucagauuugguggggaucauuaauuuacaaaugcuuuaauuaaggaggauuugauggacucuuuaacacuacccaguuuaaggaaagcuaguaagccuuuuaagggaacuauuaugcauauguccuuuggguaaggcuaugauuuuggcaaagaacaaaagaaugccugugaauucccuuuuucaguuuuucauccugaccagcacuccuuaaacacauuuauuuauaauuucuucuaaaaagaaaguguguguguauguauccacugauaaauuugggagucagguaguggagggcaggcauuuagcuacaucuggaagaauuaauaaaaugaaucuaacuacaucugaagaauuaaaauguaacuacaucugguaaaaguaccaaaggagaucuuuguaaaguguacugaaagauaggucuuaucagauuuuagagcauuaugaagcuacagaauuuuuuuuucuuuuuuuuuuuuagauggagucucacucugucacccaggcuggagugcagugguaccaucucggcucacugcaaccucugucuccuggguucaagcgauucuuaugccucagccucucaaguagcugggguuacaggcgugcgccaccacaccuggcuguuuuuuguauuuuaaguggagaugggguuucaccauguuggccaggcuggucuugaacugccgaccucaggugauccaccugccucagccucccaaagugcugggauuacaagcgugagccacugugccuggccuagaauuuuuuaaaacgagauucccuuuaaaagauagaugacugaacacauacagcccuuuccucauuauaguaguaguaaaaauauaaaaagauauaaaacacauggacaaagaauggcaggcauguuacugggggacaaaauaaugugccaguuuuuagaaguugggguagauagguaaguuuugcgaagaaaaacacaugugagagccaccuuacccgaauaacucuggaaaacgaggugcuguauggaaaaaccuaacuugaaaaucuguauauauugaacaguugacuccucuauaaucaagaugccuaccuuauaugcccauuuccacuccaugcucaggugagagaccauaaguuuaauucucuagaaaaaguaaauaggaaaggagcaggauuuaggaaagcguguccucauauagaaugggggcgaaauguagggcagaaaagaaggggauuaauuaaaaacuuuggaaaaugcucaagcagugaacgucagcccaagccaucuccaaccccuacccugccuauaaaacguaccaagguuuggccgggcaugguggcucacaccuguaaucccagcacuuugggaggugaggcaggcggaucacgaggucaagaaauugagaccauccuggccaacauggugaaaccccgucucuacuaaaaauacaaaaauuagcugagugugguggcgcacaccuguagucacagcuacucgggaggcugaggcaggagaauugcuugaacuugggaggcagagguugcagugaucugagauugugccacuucacuccagccuggcgacagagcgagacucccucuggaaaaaaaaaaagaaaaaaaaacuuaccaagguuugaauuccagauguuuugcacagaugcaagucacauuucuuggagugggcaugucaauaucacuauaugagcuuauuuuaaaauuaauaacuguuucuuguaucuuuuucugucucuuaaaucuuuaugccuaacuuuuuagauuuuucagccuuuuuguggcaaucuuuauguuuuaggugugucucuuacaaacagccuacaguacauuuuuacuauccagucaaacaaucuuucucucuuaaccagaacuuuuagagccuuacagguguaaaugguuuaaauccgccugucacagauuuggcaagugguuuggcaacccccuuuaagcuaguuccuguucuuucgacauaucccugucacuguuugguaccuccuuugugaaacaaccagauauuccaagcccaucuuguacuuugucugaccagccauuauuuccaaggauuccuaguuccuuuuaauggggaaugguuuguagaaauggaaaaucuaguuccuaccaccgaagugguauuuugucuaggccuuuuuggcaaacaggguaggaaauauauguauauguccgucuguaaaaaucauguauaugcguguauguaaaaaucaucaaaggagggccuuaagaaaaacuaaacacacacacauacauacacacaaacauacagacaaaaucguaaguucauacugauaacuuuaguuccaaugcaacacucaguauaaaauacuaagguggcagguagcuuucaacacuuagaauauaucacacccaguggccucuaguuuccgucuuugcuguugagaauucagcuuuuuaaaauguugcuccucugaagguauucuguuuuuuuaagauuuuuaccuuguaguuuuaucaggucuaauauuacaucuagguguggaguucucuuuuuaauacugugcacaguuuguuaggcuucuuaagucuaugaauugaccuuaucaguugugaaaaauucucagcuuugcggggggauccccucucaccaaucauagguuuagcauuaaaauauguaacaauagccauuauuucuucacauacuuccucugccucauucuuuuucucuguuucuucuggaaaugcaaucaaauauauuuuagaacuucucaugguagcuuucauauaucucaaccacuucucuugcuaucuuucucgccaugcugcacucuggauaguuucuucugaccgauagucuuuuauuugaaaauacugagcauauuauuucugauaauucugacaucucaagucuuugcaggucauuuucugcuuucucuugcuuuucuugguucuuguucaugauuccuuguuucucugugcuguugacuuugaguguuuauuggggauuguucaugagaaaucgcacuuuggauuucuuaaggccuggguugaaguguuuuuccccaaaggaauuugcauuugccacuuuuaaagcaucagaucuugcaagaacucaguauccugagaacagcauggggggagccaccccuaugauccagucaccucccaccaggucccucccuccaugugggauuauaauuugagaugagauuuggguggaggcacaaaggcaaaccauaucagcaguaaacuauauuuuuagauuaaaaaaauucuuuaaagggggaacaaagagaaaacuacccagcaaugaaauaggcuguacaacauaaauaugcaaguuauuuuaauaauaaaaaaacuggaugacguagcucaugccuguaauccugacaacuccugaggucaagccaggcagaucacuugaggccaggauuucuagaccagccugggcaacacagcaagacccuucaucucuaaaaaaaaaguuuaaaaauuagccagguguaguggccugugccuguagucccagcuacuugggaccugaggugggaggaucacuggagcccagaaauucaaggcugcagugaacuaugccuaugccauuguacuucaaccugggugacagagcaaaacuccaacacucaguaaaaaaaugaaaaaaagaauaaauguaaacaaccuauauacagaaaaaaauguucauucucacuguuaaguaaauaaacauaaaugugcuaccauuuuucaccuaucauauucacuaaguuuuuaaauuugcuuacuuaaagcuuagguaaguacagugagaugggauaugcucuuguucuguuaguggggauguaaaaugauaugacuuucuucuagaaaaacaguaacauguuauaaaauagugugugggaaaaccuuaaauauucauacauuuagucagggguuggcaaacuacagcccaauuuggccuguagccuauuuuuguauggcccuaccacuacaaguauuucuuacauucuuaaaggguaauggggaaaaacacaaauaagaauauaugcuagacacuguaagugggacacaaagccucaacuauuugccaucuguccuguuacauaauuaauccacuauuaccuauguuuauuagauuaauuauacuucuagaagucugucagaggcaaauaaucagauaugggcggacuaaagacugaugaaauggacagacauacucagcaagaacuuagagugaacuuauauuucuaacaguaauggaguggacagucauaagacauucauacaguaaaacuauuuucuagaaauaaugaaauagagaaauguuccuaaugaaguauaagauguaaaacuguauauggaauauacuguacaucaaggaaagacugcaaggagauaaauauucaagugcuuacucugaauguuagacuuauaggugauuuuuuaauuuuuuaaugcuuuuucauguuaucucagcuuccuaguuuugaucuuauaaucaaagaaaaaaacauaucuuugcuccuucuguuauggccacuaaaagaauaugaagaaagcugcgugugguguugcaugccuguagucccagcuauuugggagacugaggcaagaggauugcuugagcccaggaauucuaauccagcuuggguaauauaacaagacacugucucuaaaaaaaaaguuaaauaauuaaaaauuaaaaaagaaaaaaagaacgaagagacaugagaguugagaaaauaaagaacccuuugaggaaugugucucuguuauucaucuucauauauauccagugccagacauuagcuaggugcuugguaaacauuuguuuaaagaaugggcaacuaggucgugaauaugaaaaacugcucagccucaaagagaugcaaauucaaauuauauauaauuuuccccauaucaaauuagcaaauauuuuguuuaauaaaaauucuuguuguguuuuuuuuuuaaguuggauuuuuuuggagauauaauugacauauaauaaaauucacccuuuuuacaaauguacaguuugaugcauuuugaaaacuggauaauuguguaaccauggccacuaucaagacagggaaucuucccauuuccaucaccccaaaauguccccuuguacuccauucucuccucuuacuccuaauaccaugcugucacuacuuuggauucuguuacuauaguuuucccuuuucuagaaugucauauaaauagaaucauacaguaugcugcuuuuugucucuggcuuucuuagcauaacacuuuugagauucaucauuuuguugcauguacuguugugguggucuuuuuuuauuguugacuaguuuuccauuugauauauuacauuuuguuuauccauucacugguugguggacguuuggguuauucccaaauuauuaugauuaagaauaaaguugcauuaaauaugaguauaaaucuuuguguggcugcaaauuuccauuuauccugcguaaauacguaccuaacagaauugcugggucacauauggugaguguaucuauaacuuagaaacuggcaagguguuuuccaaagugacuguacuauugcauucccacaauuuaauauaagaugcugaaauaaguacuuauugcaauugugagugaaaacuuauaacucuuugggaaagcauuuuuggcauucugaaucaggucaguaaaaauguuuauucucuggccuucaagaaacaucuuuguaagggauaaucuaaaauaugcacaaggauauuugucaaaguaccauuguauuagaagacuaaaaauauacacuccagcuguugucuuugguaaaauuuauaaauucagcacuaaguuaggcauugugguggguucaaaagcaacuuaagauguguuccuugacuuacauaacuuguaaucuagugagaaaacugugcuaauugccugaaaaauuuucacugagcaaugcaacacagcauuaaaugaguguuaaaauaugccacauuaagaagaaugagcaguagggaugaagacuuggauggauuucagcaagguuuugaagcacggcuaaagcuugaguuggaggguuggagcuuucuagguggaacacaccaugacuagagguaaaaauggucuaaguauguaaaaaucauuggaauauauguauguauguagagauaauaaaacuauguuauuggaggcucuuaauggaacaggaacagcauaaucuuuaaaagcuggaaagacucugcugugaggcucugcauucuuauaaaagcuuuggguagucuaggaaacagcagugcucaggaaaugguagaaaacaaucauuuuuacugguacuaauauaacaaauuucagcuugauagaguaguuugauaaggaaccauuguuaucuuuuguaaguagcacuaacauauacauuauauucauggucauuuuuucuagucguuuauguaggauacagaaaggagagagaaagaaaaacuuuuuuacccugugauccacagaauguuaagccucuugguagcagaaccuuugucuuguuauuaaauacuucugucuuccaugauuagcacauuguauggggaguaggaguagagagcugguugcaggauuuauaauuaacccaaugaaagguaaagagaagauugucuagauuagccugagguauauauaacuguguuaagugauaaugguuccuggaugagguugauggauugggcaaaaugauagauugaaagauuugaaaaucaugcuuuaaaucauaugugcauuucuugaauguauagaaugagcaaauaguaaagggaggaugucauauaaacaguguaauaccugccauuuacuuagugccuuguuuaugacagguguaauacauauuaucucacauuaaagucauacuacagggcacacacgguggcucacgccuguaaucgcaacacuuugggaggccaaggcugguggaucacuugaggucaggaguucaagaccagccuggccaacauggugaaacgcugucucuacuaaaaauauaaaaauuagccuggcguggcgacagguuccuguaaucucagcuauucaggaggcugaggcaggaaaaucacuugaaccugggagguggagguugcaguaagcccagaucaugccacugcaccccacccuuccugggcaacagagugagauugucucaaaaaaaaaaaaagucauauuguagaugaaguggaguuauugaauugcccacagacacacaauuauuagauguuagagcugggauaugaacagugcacuuaaaaaaauaaaagccagcucuaauguuacuucuuccuuucaggaaaccuuccauauaacuccuguccaccuuuuacuaccuagguuaacuugaggcuccuccuuuguuuucauaugauauacaguugguaacugcaguuuugcauuugcuuauggaauuauaauugcagaauacauuuggaauuugaggacuuagcauucucugauucaucuacuccuucaguaacuugcaaguuaaaggugaaggcccauggugugaaucacagugcaaggcagguaugccagagggacucacuccucaugaguguaggcccaacucuugagauacuaggccaaauuuucagaggucugggcauuuucagcaaaugcccagacuuuuuauguuugucucauccaguaccuaacuuacucaacuuggaauucaguguaacacagcuaugaguguauguuuauauucaaguaauucauaguaucuuuaaaccauagguccucugcuguaccacuuugaaaaucuggca

SEQ ID NO: 139359 - RNA, 51 nt, Homo sapiens
cuaugugaauggggaaacuucccuugagaaaagauaaaaugaagaucugga

SEQ ID NO: 139360 - RNA, 30 nt, Homo sapiens
augagugcuuugcguacacccuugaaaggc

SEQ ID NO: 139361 - RNA, 4716 nt, Homo sapiens
cgcugagagcucccaauucgugcuuuaacccugaagaacagagaggggaggucauugacagaaugaggacuaaucaaagaaaucagggcuuaucccaggccauaaaugcagcaauagucacaaauaguuauuuguguccuaucuguccuauuuuguaaacuaguuacuaaaaccccaucuaguagcuuagaaauacaagaggcugagcgcgguggcucacgccuguaaucccagcacuuugggaggcccaggcagguggauuguuugaggucaggaguucgagaccagccuggccaacauggugaaacccugucucuacuaaaaauacaaaaauuagcugggagugguggcgggugccuguaaucccagcuacucgggaggcugaggcaagagaaucacuugaacccaggaggcagagguugcaagccaagauugcgccacugcacuucagccugggugacagagcaagacuccaucucaaaaaaaaaaaaaguagcagagaggcugggcauggucacuuauaccuguaaucccagcacuucaggaggcagaggccagagaucgcuugagcccaggggaguuugagaccagucugggaaacaaagugagacccuaucucugcaaaaaauuagccagguaugguggcaagcaccuguaguccugguuccucaggaggcugaggcaggaggaucgcuugaacccagaauucgaggcugcagugagccaugaaugugccacugcacuccagucugggcgacagacugagacccugucucucucucucacacacacccuaaaaaaguagcagcacuccagccugggugacagaauaaaggcccuguuuggguacccugacacacaccuacucauaccaaaaacaacuagcagcagagaaaccaauuucccagaguucuugccucuggcucaagcuuuuuuuucagagacagguauccccaauauagguaucaccuuguuuugcagauuaggaaacuaaggguccaauaauuagcuuguaugaggucacaaaacuaguuaagugacagaccugggauucaaaccuaaguuugucagauuucaaagccuauacucuucacuaaacccaaugaacauuccuagaaacuacaaaucaaacauaauuuuuuguuuuugagauggagucuuuuucucuguugcucaggcuggagugcaguggcacaaucuuggcucacugcaaccucugccuccuagguugaagcgaccugucucggccucccgaguagcuggggauugcaggugcauaccacaaugcccagccaauuuuucuauuuuuaguagagacaggguuucaccauguuggccaggcuggucuugaacuccugaccucaggugauccacccgccucagccucccaaagugcugggauuacagccgugagccaccaugccuggccuucagaaauaauuuuuaaaaagauugugguaaaauacauguaacauaaaauuuaccaucuuaagaauuuuuaaauguaugguucaguaguguuaaguauauucacaguguugugcaaccaaccuccacauuuucaucuugcaaaacugaaacuauacccagugaacaacucccuauuucccccacucuccagccccugcaaccaucauucuacuuucugucucugaguuugacuaccuagguaucucauauaacuggaaucaucuaguauuuaucuuucaaagaaagugaauuuugaacaggcuucugcugacuucuagaccaaaugcccuuuuccagccuuucuacauguucauuuucaucagugcucuaagcaguuuuuuuuuuuuuuuuuuuugagacagugucucacucuguugcccagguuagagggcaguggcaugaucuuggcucacugcaaccucugccucccaggcacaagugguacacgcaccucagcuccugaguagcugggacuacagguagguggucgccaccacucccagcuaauuuuuuuucgagauggagucuugcucuguugcccaggcuggagugcaguggcgcgaucuuggcucacugcaagcuccgccuccuggguucaugccauucuccugccccagccucccacguagcugggacuacaggcacccgccaccacgcccggcuaauuuuuuuuuuuuuguauuuuuaguagagacugguuuucacguuagccaggauguucccgcucuccugauuucaugaaccgcccgccucggccucuccaaguguugggauuacaggcgugagccaccacaccuggccuaauuuuuuuauuuuuaguagagacaggguuacacuaugaugcccagguuggucucaaucuccugggcucaaguaauccacccaucucagccucccaaaguguugggauuacaaguacgaaccacugcagcuggccuucuaagcaguuuuuacuaggaccuuucaucuuuucgagacagacucuugcucugucacccacgcuggaguggcacaaucucggcucacugcaaccucugcuuccuggguucaagcaauucuccugccucagccucuggaauagcugggauuacaggcaugugccaccacaccaggcuaauuuuuauauuuuuaguagagaugagguuuugucauguuggccaggcuggucuccaacuccuggccucaagugauccgcccaccuuggccucccaaagugcugggauuauagacgugagccacugcuccaggccuuggcccuuucaucuuuuaagacaacguagcucauuuuuagggacagagagaagacaggagagacauaccccuuaagcucuugaaaaagagcaauauucaacauagcagaaaacagauuauuuuuauggcugguaacuaacuguuuauuauuauuuugagauggagucucgcucugucgccuaggcuggaguggaauggcacgaucuuggcucacugcaaccuccaccucccagguucaagcgauucuccugccucaccuuccugaguggcuggcauuacaggugcgcacaucaucaugcccggcuaauuuuuguauuuuuguagagaugggguuucaccauguugguuaagcuggucuugaacuccugaccuuagaugauccaccugccucggccucccaguguugggauuacaggugugagccacugcgcccggccuaaguuuuuacucuagauuggcuuuccuuucucgccaagaacuuugauuuuaacauuugcaugaaaauacgagacuauguuuaguguguauuaaaaacauucccaaacaaaagccaugaauccucuccugugacacaaaugcucaacagcugacucuauagcgauggccuuuguuucagacaugguuacuaauacuuuaagugguaguaaaaauagauuuuuuuaauuuuuaauuuuuauuuuuuuuuugagacagucaugcucuugucaccccagcugaagugcaauggcaugauaucggcucauugcaaccuccaccucccggguucaagugauuucugccucagccucccgaguagcugguauuacaggagcccgccagcaugcccagcuaauuuuuguauuuucaguaaagacgagguuucaccauguuggccaggcuggucuugaacuccugaccuugugauccacccuccucggccucccaaagugcugggauuauaggcgugagccaccgcgcccggccaaaaauagauguuauuuaauucuuuuuuuuuuuuuuuuuuuuuuuuuuuuuuugagauggagucuugcucugucaccaggcuggagugcaguggcgugaucucagcucacugcaaccucugccuccuggggucaagcgauucuccugccucagccacccgaguagcugagauuacaggcacgcaccaccaugcccagcuaauuuuuguauuuuuaguagagacaggguuucaccuuguuggcuaggauggucuugaucucuugaccucaugauucgccugccucggccucccaaagugcugggauuacaggcgugagccaccgcgcccggcccaauguuauuuaauucuuacuuuuauugggccaagacacaaaagggacgcugagacucugaagagaaggaaucccugugugugcugaaaaacuauucccuuugcuaggcuacaccaauuuugacauuuuauugggcuaaacaaaagacaagaaaaaugcacacaagaaaaaugcuaguaaaaacuucuuuuacuagcuuguauaguugcaucugcuuucuuuucuucuuuuuuuuuuuugagacagaguuucacuuuuguugcccaggcuggaguauaauggcacgaucuuggcucaccgcaaccuccgccucccggguucaagagauucuccugccucagccuccccagaagcuaggauuacaggcaugcgccaccacgcccggcuaauuuuguauuuuuaguagagaacgggguuucuccauguuggucaggcuggucucggauucccaaccucagaugauccucccgccucggccucccaaagugcugggauuauaggcgugaaccacugugcccggccgcaucugcuuucuaauguaagagacugaucuaauagucuagaaccugacaacucuuaugguaucauggauuuuguuuauaugcuuuaugaaggucacugcacuguggcaacaguccaacacuacuguaccagcucccucugacacguuccccuccaaacucacgcaguggccagcuca

SEQ ID NO: 139362 - RNA, 42 nt, Homo sapiens
aacaccugaaugcaaauccagaaaaaagcgcuacugggggaa

SEQ ID NO: 139363 - RNA, 60 nt, Homo sapiens
ucucucauugagaauguuucuuguguacccauagaaaagccucuuugguagauuuuccgg

SEQ ID NO: 139364 - RNA, 51 nt, Homo sapiens
gcuuuuuacuugagaauuuaaaaguuguaaaguuguuaguuaaauguguau

SEQ ID NO: 139365 - RNA, 43 nt, Homo sapiens
cuuucgagcacauguaauaauacacacuggggcucgaccuuau

SEQ ID NO: 139366 - RNA, 44 nt, Homo sapiens
gauggaagagggccacugggaaacucuccccagagaauuggucg

SEQ ID NO: 139367 - RNA, 31 nt, Homo sapiens
cuaugaagcagacaacuggacaugcauauuc

SEQ ID NO: 139368 - RNA, 47 nt, Homo sapiens
ugaauggggaaacuucccuugagaaaagauaaaaugaagaucuggaa

SEQ ID NO: 139369 - RNA, 31 nt, Homo sapiens
cugugugcacaagcacuuuguuaucugggcc

SEQ ID NO: 139370 - RNA, 46 nt, Homo sapiens
ugguuauuuuguagcacugcucugcagaacauucugcuuugcuagu

SEQ ID NO: 139371 - RNA, 47 nt, Homo sapiens
gaaaauauuaucugugaucugccucaauccacacgccacaacaccaa

SEQ ID NO: 139372 - RNA, 47 nt, Homo sapiens
gaugucaucaauauuacaaaaaaggaaaaaaaaagugacaggcaaca

SEQ ID NO: 139373 - RNA, 42 nt, Homo sapiens
cugcuggcugccccggcuggucaggggcgcgaagccgggcau

SEQ ID NO: 139374 - RNA, 38 nt, Homo sapiens
ugauuaucucuccuuuucaaauugcuucaaccucagcc

SEQ ID NO: 139375 - RNA, 42 nt, Homo sapiens
uggcgccgacggauccauccggccagggggaggggccgagcc

SEQ ID NO: 139376 - RNA, 41 nt, Homo sapiens
gagaagcacuuguccuucugggggucauaguucuucaagcu

SEQ ID NO: 139377 - RNA, 47 nt, Homo sapiens
augugucauaguacacagauaguuuaaaauauguagccacggggaag

SEQ ID NO: 139378 - RNA, 42 nt, Homo sapiens
cagcaggacccucuggaauaccuucagucugaugaagaggac

SEQ ID NO: 139379 - RNA, 29 nt, Homo sapiens
aguuuguuuauucucucgaugggcauuug

SEQ ID NO: 139380 - RNA, 49 nt, Homo sapiens
caauuugauacauuuuugacauguauauacugugacaccaucuccacaa

SEQ ID NO: 139381 - RNA, 24 nt, Homo sapiens
uguauacuuuaaaauguauuaaac

SEQ ID NO: 139382 - RNA, 45 nt, Homo sapiens
augcaaaccgccacuguccgaagcaccccuacgccaggcugaaga

SEQ ID NO: 139383 - RNA, 44 nt, Homo sapiens
ggggaagcugagugggaaggcaggaguggguggaagacauagug

SEQ ID NO: 139384 - RNA, 45 nt, Homo sapiens
aggcccagagcagauacuguccgcgauuuaauaaaugaaggagag

SEQ ID NO: 139385 - RNA, 45 nt, Homo sapiens
ggaaaacgguucaccaguguuuaguuuuauauugaggugcucagg

SEQ ID NO: 139386 - RNA, 40 nt, Homo sapiens
uaauucugcauuaucauaaauguacaaguucuccuagcag

SEQ ID NO: 139387 - RNA, 48 nt, Homo sapiens
auuauuuuagguauuuucauuauaugaaagcuaccaugugucagagau

SEQ ID NO: 139388 - RNA, 46 nt, Homo sapiens
uacuguuacuaaaacagcuaauuauuucucucucccccuuugacag

SEQ ID NO: 139389 - RNA, 37 nt, Homo sapiens
gucaacagucuugacaagaucuguccuuagccuccag

SEQ ID NO: 139390 - RNA, 52 nt, Homo sapiens
aguuaucacaugacuaaacacuuucaaaaucacuaaucaaccuucuagaggu

SEQ ID NO: 139391 - RNA, 40 nt, Homo sapiens
auaaacuggaauuaaaacuugagaaguugugaagauaggu

SEQ ID NO: 139392 - RNA, 58 nt, Homo sapiens
uagguuuugaaguguucaggugacacagaaaggggaaguaggauacggcagccgguag

SEQ ID NO: 139393 - RNA, 45 nt, Homo sapiens
ugcagacuugucuccucucuuccccaaaaaugagcagacucagca

SEQ ID NO: 139394 - RNA, 50 nt, Homo sapiens
uauugaugaagcaauccacaugcagcuccaaaaauucauuuauuuagcuu

SEQ ID NO: 139395 - RNA, 1006 nt, Homo sapiens
gguuauaaaacuauagguuuuuauacacuucagcucuugaaacugcaccucaguaaacauuugaaagaacagaaccugggccgggugcgguggcucacgccuguaaucccagaacuuugcgaggcagaggcgggcggaucacgaggucaggagaucaagaccauccuggcuaacacggugaaaccccgucuuuacucaaaauacaaaaaauuagccgggcuugguggugggcgccuguagucccagcuacucgggaggcugagguaggagaauggcgugaagcgggaggcggagcuugcagggaacugaaaucaggccacugcgcuccagccugugcaaaagagcgagaauccgucucaaaaaaaaaaaaaaaaaacaacaaaaaaaaaaaccauaacagagccuggugagguggcucaugccugugaucccuucaggaggcugaggcuggggaaucacuugagaccaggaguucaagaccagccugggcaacauagaccgcaucuggcggccugcaccuauauacguagcuacaugggaggcugaggcaggaggaucacuugagaccaggaguuugaggcuacagugagacaugauagcaccacugcacuucagucugggugacaaagcaagaccucaacucuuuaacaaaaauugaagaaacuugccaggugcgguggcucacgccuguaaucccagcacuuugggaggcugaggcggguggaucaccugagguccaggaguucgagaccagccugaccaacauggugaaacccugucucuacuaaaaauauaaaaauucgccggacgugguggcgggcgcccguaaucccagcuacuugggaggcuaaggcaggagaauugguagaacucgggaggcggcgguugcagugagccgagauugcgccauugcacuccagccugggggacagagugagacuccgucucaaaaaaaaaaaaaaaaaaaaaaaaaaaaaaaaaaaaugaagaaacuaacgauagaagc

SEQ ID NO: 139396 - RNA, 99 nt, Homo sapiens
uuucuaucuagaagacuauaugacuuuacuaccuuacauucuguaaaugcucaauaaaggugcucaaaaaauauuuguguaaugaaugaauggugcuaa

SEQ ID NO: 139397 - RNA, 45 nt, Homo sapiens
uagucuucuagauagaaauacuccuggcucaccuggagcuuacag

SEQ ID NO: 139398 - RNA, 37 nt, Homo sapiens
uuuuacagaucaggcagcuggggcuuacagugauuag

SEQ ID NO: 139399 - RNA, 161 nt, Homo sapiens
aacaccuagcaaguaguaugcuggauaaaugaaaggcagcgaaggcacaacuucagccgcagaacaggcccagaaguccuuucuugcucuucggcugucucugcagggcaucuuuuaacagggcgagggcgaucugcaguaauggagcaaacacugugcgc

SEQ ID NO: 139400 - RNA, 59 nt, Homo sapiens
cccgcccgccgcaccguuaacgggccccggcugccccacgucccgcccgcccgcccgcc

SEQ ID NO: 139401 - RNA, 48 nt, Homo sapiens
ccgccgucccuccgcgugguuaguccgggccagggagacaagggcggc

SEQ ID NO: 139402 - RNA, 48 nt, Homo sapiens
ggcagugggaaacaaaugcccuccuaagccacaaggcgugcgccagau

SEQ ID NO: 139403 - RNA, 60 nt, Homo sapiens
guggccgaggggagcggaugagaacaguggcagcacgagugccccggccugggcuucaga

SEQ ID NO: 139404 - RNA, 91 nt, Homo sapiens
aggaagaaaauacaucugcugcacacugcucugcaaagccaugcuuggccuggguuggaaggcagaaggccgcgagugcccggguucccug

SEQ ID NO: 139405 - RNA, 63 nt, Homo sapiens
agaggcuuuauuucugcagaagaauguacaagaggcccacuuguggaacagcauguugaagac

SEQ ID NO: 139406 - RNA, 43 nt, Homo sapiens
auguuuuaauauuuuguugccugcuguucaaaagucaaguuga

SEQ ID NO: 139407 - RNA, 46 nt, Homo sapiens
uagccugcuacaucaugaagcauuacaggaugacagcagccgagac

SEQ ID NO: 139408 - RNA, 46 nt, Homo sapiens
ugaugccaaacgcuuuacggaugcuggcuucgaucaccaugaucuu

SEQ ID NO: 139409 - RNA, 45 nt, Homo sapiens
auaauaccagaccgauuuauugccuucuguggaccucauucaaga

SEQ ID NO: 139410 - RNA, 25 nt, Homo sapiens
aaugaaccccuuuuuucuggggaca

SEQ ID NO: 139411 - RNA, 22 nt, Homo sapiens
uuguuucugaaaaaagaagauc

SEQ ID NO: 139412 - RNA, 38 nt, Homo sapiens
agaagcauauagaauauuaaucuuuggagagacauccu

SEQ ID NO: 139413 - RNA, 40 nt, Homo sapiens
uaacacuuuucuauagaaaacuugggaaaauacaggaggg

SEQ ID NO: 139414 - RNA, 46 nt, Homo sapiens
uuugauccaucuggaauuguagaauaagauuaggagguaugcaggu

SEQ ID NO: 139415 - RNA, 56 nt, Homo sapiens
cugggcgccgcguugcccguccggcgcguaagcccgagccccucuccugggccucc

SEQ ID NO: 139416 - RNA, 26 nt, Homo sapiens
agaccauuauauucagugaagaaggc

SEQ ID NO: 139417 - RNA, 46 nt, Homo sapiens
gcuugaaccuguugaauugcaugcugggaagcaucaguugucaaaa

SEQ ID NO: 139418 - RNA, 80 nt, Homo sapiens
augcagacucaucaucuacucugggagacaggcacaaacagcuaauuacaauaccaucuaagggccagugauggagggag

SEQ ID NO: 139419 - RNA, 42 nt, Homo sapiens
guguuacaucugcaaggaauacguagaggaucuggccaaaau

SEQ ID NO: 139420 - RNA, 36 nt, Homo sapiens
aaagauguacaaaacaguuugaaauaaauuuuaauu

SEQ ID NO: 139421 - RNA, 60 nt, Homo sapiens
auugaggauccaaguugagauuuuaauucugugacauuuuuacaaggguaaaauguuacc

SEQ ID NO: 139422 - RNA, 59 nt, Homo sapiens
uguaaaaauagccaaagacaagaacaaccacuguggaaucgccacagcagccagcuacc

SEQ ID NO: 139423 - RNA, 90 nt, Homo sapiens
caaaaaccuggaucaugguguucuggugguuggcuacggcuuugaaggagcaaauucgaauaacagcaaguauuggcucgucaaaaacag

SEQ ID NO: 139424 - RNA, 45 nt, Homo sapiens
uauggaugcaggccauucguccuuccaguucuacaaaucagguaa

SEQ ID NO: 139425 - RNA, 103 nt, Homo sapiens
guaaguacagaccugagaauucuguugcuaaugacacuggcuucacaguggucgcaccuggaaaggagaaggcccugaugaaagcagucgcaacuguggggcc

SEQ ID NO: 139426 - RNA, 94 nt, Homo sapiens
ggcugcaaugguggcuucauggcuagggccuuccaguaugucaaggagaacggaggccuggacucugaggaauccuauccauauguagcagugg

SEQ ID NO: 139427 - RNA, 48 nt, Homo sapiens
aacagugugguucuuguugggcuuuuagugcgacuggugcucuugaag

SEQ ID NO: 139428 - RNA, 60 nt, Homo sapiens
ucuucccaaaucuguggauuggagaaagaaaggcuacgugacgccagugaagaaucaggu

SEQ ID NO: 139429 - RNA, 75 nt, Homo sapiens
caggcagaugauggguugcuuucgaaaccagaaauucaggaaggggaaaguguuccgugagccucuguuucuuga

SEQ ID NO: 139430 - RNA, 73 nt, Homo sapiens
ugggaaaagaauaugaaaaugauugaacugcacaauggggaauacagccaagggaaacauggcuucacaaugg

SEQ ID NO: 139431 - RNA, 46 nt, Homo sapiens
aauuuggauacaaagugguaccaguggaaggcaacacacagaagau

SEQ ID NO: 139432 - RNA, 45 nt, Homo sapiens
gacccaaagcgcuccauggccuccacaauauucaugccuucuuuc

SEQ ID NO: 139433 - RNA, 46 nt, Homo sapiens
uagauggacuugccaccagugccauuauggcgugugaagucaccac

SEQ ID NO: 139434 - RNA, 47 nt, Homo sapiens
gucuuugggaccuugucugcaaacagcucaaaggagacgcggcccaa

SEQ ID NO: 139435 - RNA, 45 nt, Homo sapiens
cuuaaaaggccuuuuaggaaaugcuggugaggaugugguagcagc

SEQ ID NO: 139436 - RNA, 42 nt, Homo sapiens
ccuuccggcggccgaagacacugcgacuccggagacagccca

SEQ ID NO: 139437 - RNA, 43 nt, Homo sapiens
auugauguggccaaggucaacauccugauucggccugauggag

SEQ ID NO: 139438 - RNA, 43 nt, Homo sapiens
cccuccugccacucuccuuguccucaggaguagacgugccuuc

SEQ ID NO: 139439 - RNA, 45 nt, Homo sapiens
ucagcugccauuuucuccauauccacuucuacuuucagagggcac

SEQ ID NO: 139440 - RNA, 75 nt, Homo sapiens
ucuucuucuccuggugucguuccucuauuugaaguucagcuucuaguuuucgcugaugaaccauuaaggacugga

SEQ ID NO: 139441 - RNA, 51 nt, Homo sapiens
uucaaaaguuucccaaaccacuucuuaugauccaguggauauucaaaagag

SEQ ID NO: 139442 - RNA, 56 nt, Homo sapiens
ccucucugaauuucaugaauuucuauuucacaaggguaacuguuuuauccacacug

SEQ ID NO: 139443 - RNA, 64 nt, Homo sapiens
ggaaagccugaugcagcaaaaaagggaguugucaaggcugaaaaaagcaagaaaaagaaggaag

SEQ ID NO: 139444 - RNA, 55 nt, Homo sapiens
uagcagacuugaugagauauuauucaccgccuccgaacugcuccgggucgcaggu

SEQ ID NO: 139445 - RNA, 45 nt, Homo sapiens
aucuguuuucuucuuugauuugcugucaucagauucacugucaga

SEQ ID NO: 139446 - RNA, 42 nt, Homo sapiens
aucccaguucuuuucgaaaucaugaaagaacucacucuggag

SEQ ID NO: 139447 - RNA, 43 nt, Homo sapiens
uauuaccaaacuuuucaaauacaugaaaggacucacacugggg

SEQ ID NO: 139448 - RNA, 46 nt, Homo sapiens
guaaacaaugugacaaagccuucaguugcucacguuccuuucgaau

SEQ ID NO: 139449 - RNA, 45 nt, Homo sapiens
ugucuucuacugcauuucaguaucaugaaaagacccacaccagag

SEQ ID NO: 139450 - RNA, 36 nt, Homo sapiens
cagucuuuaguaaacauaagaaaauucaugcuggag

SEQ ID NO: 139451 - RNA, 41 nt, Homo sapiens
uuuaaaugcagcaucugcgaugugaggaaaggcaccuccac

SEQ ID NO: 139452 - RNA, 46 nt, Homo sapiens
aagggcuccucccguuccuccacgccaaagggcgacaugucagcag

SEQ ID NO: 139453 - RNA, 46 nt, Homo sapiens; identical to SEQ ID NO: 44603

SEQ ID NO: 139454 - RNA, 46 nt, Homo sapiens
ccaugugggaacuugacucucucaucugucuaaagaguacuggacg

SEQ ID NO: 139455 - RNA, 48 nt, Homo sapiens
auaacugacaaaucacaagugguuuaguugggcagggcuuugaucauu

SEQ ID NO: 139456 - RNA, 41 nt, Homo sapiens
ucaugaaaauaugguauucuguaacuugaauuccauccauu

SEQ ID NO: 139457 - RNA, 46 nt, Homo sapiens
auuucucaauccccugcugugguaggaacuccaguggugaacggcu

SEQ ID NO: 139458 - RNA, 42 nt, Homo sapiens
gagguuaccucucuuuauuugaccuuuagggacucacgggag

SEQ ID NO: 139459 - RNA, 89 nt, Homo sapiens
aagacauuccuucuaaaguuuuaauauuccuuuuauuaagggucucagggaggguaaauuagucagccauauuuauuuuccagagguuu

SEQ ID NO: 139460 - RNA, 45 nt, Homo sapiens
caauguuuugguuuuucaguuuugccuccgugauaaauuaaagaa

SEQ ID NO: 139461 - RNA, 44 nt, Homo sapiens
ucuugacacccacacaauauucuaaucaaaaccuuucaguuuca

SEQ ID NO: 139462 - RNA, 47 nt, Homo sapiens
uauuccuguuacuggcaugugcacgacuauguuauuagaagccacuu

SEQ ID NO: 139463 - RNA, 46 nt, Homo sapiens
uccgcaggguuccucuggggcccuucacgauaacugugcgucccuu

SEQ ID NO: 139464 - RNA, 44 nt, Homo sapiens
aacaacguugauggggaagugagcauacacagaccucaucuugu

SEQ ID NO: 139465 - RNA, 65 nt, Homo sapiens
uuaugaagaugguuaaacuugaaacaaacaauuuuaagaauuauuuggucugaagauguuuuacu

SEQ ID NO: 139466 - RNA, 47 nt, Homo sapiens
uaccuugaaccguaucugaaagagguuauucgggaaagaaaagaaag

SEQ ID NO: 139467 - RNA, 89 nt, Homo sapiens
aaugacaggauguuucgcauuaagagggcacuggaccugaacuugaagcaucagaucuugccuaaagagcaguggaccaaauaugaaga

SEQ ID NO: 139468 - RNA, 47 nt, Homo sapiens
aagggauacgagcgacgcuucagguugaccuuggauuaucuagagcg

SEQ ID NO: 139469 - RNA, 23 nt, Homo sapiens
aagauaacugaggcaaagugacc

SEQ ID NO: 139470 - RNA, 72 nt, Homo sapiens
uggaaagaaaugaaaaacccugguuaaucaaagauguuccagagugccuagaacugagagggaaauggaacu

SEQ ID NO: 139471 - RNA, 68 nt, Homo sapiens
cauuuggaacuccccgugaggaggucgaggcgcacagggcaagcaggaagaggcgagggcacuugggg

SEQ ID NO: 139472 - RNA, 56 nt, Homo sapiens
uucaucugugccaugcucuagaaccuugaccuugauaguucaccaccucugaugga

SEQ ID NO: 139473 - RNA, 47 nt, Homo sapiens
gcucauuuucuugcaucuuacugguaucuucuauugauuguaagcag

SEQ ID NO: 139474 - RNA, 69 nt, Homo sapiens
ccaguacccaguugauuagcuuacagauaucaacucacugaaaguaaucuuuuguucccucauuucaca

SEQ ID NO: 139475 - RNA, 43 nt, Homo sapiens
uuuuuaaacacagguacaauuuaaacaugaucuuucuuugcaa

SEQ ID NO: 139476 - RNA, 45 nt, Homo sapiens
uggcuccauugcuagacuaauucccagggucuuggaagaugcaca

SEQ ID NO: 139477 - RNA, 46 nt, Homo sapiens
acugcuggaccagaggacuccccucacguugaguuacugaaagcca

SEQ ID NO: 139478 - RNA, 46 nt, Homo sapiens
uugggacauuugcauucaauuuacagguaccaguacguacauauuu

SEQ ID NO: 139479 - RNA, 88 nt, Homo sapiens
uuaagcuuuuuugacugaaaguacuaaaagucagcuuuacuagugccaaaccuuuaaauuuucaaaagaaaauuuucuuucaacauuu

SEQ ID NO: 139480 - RNA, 41 nt, Homo sapiens
uuuguaacaauaccacauuacguaguuauauaaaaaaauua

SEQ ID NO: 139481 - RNA, 52 nt, Homo sapiens
acaccaaaauguauauuguccuuuuuacucuugggccagcaagauccuuuuc

SEQ ID NO: 139482 - RNA, 46 nt, Homo sapiens
ucacauuuguuuuucaaggaggaaagccaaguaucugugacuucag

SEQ ID NO: 139483 - RNA, 45 nt, Homo sapiens
agagcugcuacacauugaaucucaagucgagcuucugagauucga

SEQ ID NO: 139484 - RNA, 53 nt, Homo sapiens
cucauccuugucaguauaugcuaacggcaagaguuagaaaaggugcuccagua

SEQ ID NO: 139485 - RNA, 42 nt, Homo sapiens
cagccaugaaacauuuucagaauagcaguggcugggccucau

SEQ ID NO: 139486 - RNA, 46 nt, Homo sapiens
gguacauggauuuucugcagaucuucacuguauuagugaauccgau

SEQ ID NO: 139487 - RNA, 46 nt, Homo sapiens
aaaagggguauuuuuccauucuuauuaccuuauuucaaaaaucaga

SEQ ID NO: 139488 - RNA, 48 nt, Homo sapiens
aggaauauucagcuggggaugugcaagauggagaaaaaagucagcaga

SEQ ID NO: 139489 - RNA, 45 nt, Homo sapiens
augaauggggaccagaaaucagauguuuaugcccaagaaaagcag

SEQ ID NO: 139490 - RNA, 46 nt, Homo sapiens
uuuuggcagauucacugaaaacagguacaaaucuauugucaaguac

SEQ ID NO: 139491 - RNA, 46 nt, Homo sapiens
cuuagaagauccuacuggagaucgagaguuuuuucaaauucaggau

SEQ ID NO: 139492 - RNA, 42 nt, Homo sapiens
cacucuggaacaguaccagauccugaaggaaaauuacggaca

SEQ ID NO: 139493 - RNA, 46 nt, Homo sapiens
cgccccugcucccagccauguuucuggggcuuguguacaaaaucua

SEQ ID NO: 139494 - RNA, 44 nt, Homo sapiens
ugcugugaggaacagcgucccagucuguaaaccacugcccaucu

SEQ ID NO: 139495 - RNA, 45 nt, Homo sapiens
gauaacaacguugauggggaagugagcauacacagaccucaucuu

SEQ ID NO: 139496 - RNA, 46 nt, Homo sapiens
ccuccgcaggguuccucuggggcccuucacgauaacugugcguccc

SEQ ID NO: 139497 - RNA, 50 nt, Homo sapiens
cuugauaggcugcacacggcugguguccaugauggcggcgcggcggcggu

SEQ ID NO: 139498 - RNA, 48 nt, Homo sapiens
gagagagaaaaaaaggaguuauagcuucuccugcacuuccaccugcuc

SEQ ID NO: 139499 - RNA, 46 nt, Homo sapiens
ugguucuucugucuuguuauugcugguaaaccccagcuuuaccugu

SEQ ID NO: 139500 - RNA, 30 nt, Homo sapiens
gaccgccggacugggcguccccaggguuga

SEQ ID NO: 139501 - RNA, 33 nt, Homo sapiens
agaggggcucucagaggcgucuggcuggcaugg

SEQ ID NO: 139502 - RNA, 24 nt, Homo sapiens
ugccaccaagcauuccugcucaag

SEQ ID NO: 139503 - RNA, 76 nt, Homo sapiens
ccgggcacgcggacggggguccugggcaccgggcgagguccuggccacgagggagggguucugggcacgcgggagg

SEQ ID NO: 139504 - RNA, 45 nt, Homo sapiens
agauuaugccgacaagccccuggagaagccucuaaagcuaguccu

SEQ ID NO: 139505 - RNA, 106 nt, Homo sapiens
ccaguuacuaugaugacaggucagaccaugagcgagagaggcacaaagaaaagaaaaagaagaagaagaagaaguccgagaaggagaagcaucuggacgaugagga

SEQ ID NO: 139506 - RNA, 66 nt, Homo sapiens
cugggaagaagguggagguggagccgcccccagaucggccaguccgagcgugccggacacagccag

SEQ ID NO: 139507 - RNA, 46 nt, Homo sapiens
uauucaaugauaauaaaacaucccauggauuuuggcaccaugaaag

SEQ ID NO: 139508 - RNA, 53 nt, Homo sapiens
ucuacuuggcuuacacuuacccuuuauuuuaauaaaagugucuuaauuuguca

SEQ ID NO: 139509 - RNA, 47 nt, Homo sapiens
guaugcucugccagcucugugucugagggcagggucgguagaagcug

SEQ ID NO: 139510 - RNA, 41 nt, Homo sapiens
gccuugcugggaaaggaaagggaacguugugugcucuguga

SEQ ID NO: 139511 - RNA, 38 nt, Homo sapiens
cuguugcauaaugucccuccccaauuucuuuagcccca

SEQ ID NO: 139512 - RNA, 42 nt, Homo sapiens
acgucacccacgaccccuaugaguuucuucagucuccagagc

SEQ ID NO: 139513 - RNA, 28 nt, Homo sapiens
gccugggaaaggaguguguucugccugc

SEQ ID NO: 139514 - RNA, 38 nt, Homo sapiens
uccccaagacucacccaagcagcgucgggaucuucccg

SEQ ID NO: 139515 - RNA, 47 nt, Homo sapiens
gguggggggugcaucaaaggccuuggugggcagggugagcgaggcca

SEQ ID NO: 139516 - RNA, 46 nt, Homo sapiens
uccacagcccuagauagggcuacggccccucagugggggcucugag

SEQ ID NO: 139517 - RNA, 46 nt, Homo sapiens
acuuucuugguagguuuggccaugucaccgcgaacuagguccgagc

SEQ ID NO: 139518 - RNA, 44 nt, Homo sapiens
ccagauccccgcagcucaucucuucaucuugguuuugccacaga

SEQ ID NO: 139519 - RNA, 39 nt, Homo sapiens
cuuuuucuugcucagucuugcaaggauaaaagauuagug

SEQ ID NO: 139520 - RNA, 40 nt, Homo sapiens
uuccuuaugucggggcguacgggauucugggagucccugg

SEQ ID NO: 139521 - RNA, 63 nt, Homo sapiens
uauacugcauaacaaauaucucauugauaagguguauucuuuauccuacaaugcgagggacgg

SEQ ID NO: 139522 - RNA, 43 nt, Homo sapiens
gucauaucugagaauugaugggaagaaaggucagaucaggcug

SEQ ID NO: 139523 - RNA, 44 nt, Homo sapiens
uugauuuucuggauuuuagagguaguacagugauguuaaaagag

SEQ ID NO: 139524 - RNA, 20 nt, Homo sapiens
caacacauaaaaauuaauag

SEQ ID NO: 139525 - RNA, 47 nt, Homo sapiens
ucagcugugauacaauccuguugcaugcucagccuccaccugggccu

SEQ ID NO: 139526 - RNA, 46 nt, Homo sapiens
cuuccucaagucucucaucaauaguuggaccacuuguugaaaugaa

SEQ ID NO: 139527 - RNA, 47 nt, Homo sapiens
acgagagaacucugugccugccuggacuuacguucuaguggagggag

SEQ ID NO: 139528 - RNA, 38 nt, Homo sapiens
gacaaguuaaaacuauaaauguggcuuaagaaagaaua

SEQ ID NO: 139529 - RNA, 47 nt, Homo sapiens
aucuuggaagaccucugccaugaauauuucgaaaagugaaggcuuuc

SEQ ID NO: 139530 - RNA, 61 nt, Homo sapiens
cacucagaucucagacacggauuaaaaagaacauuguaggagugugauuucuaugaaaugu

SEQ ID NO: 139531 - RNA, 42 nt, Homo sapiens; identical to SEQ ID NO: 44765

SEQ ID NO: 139532 - RNA, 62 nt, Homo sapiens
gucaucaucugauaguucagaugaaccagcagaaaaacgggaaagaaaagauaaaguuucua

SEQ ID NO: 139533 - RNA, 45 nt, Homo sapiens
uuauuuuauggugacagagcuuuuuagugcuaaccagaaagcuuu

SEQ ID NO: 139534 - RNA, 44 nt, Homo sapiens
cuugaauaacagaccccauucucuauccaaacaucuuugcuuca

SEQ ID NO: 139535 - RNA, 39 nt, Homo sapiens
uuugggguauaugcugaaauugcuaagcauugaacagaa

SEQ ID NO: 139536 - RNA, 36 nt, Homo sapiens
cuccuucgaagaauuuggcaguaaagguggcaacuc

SEQ ID NO: 139537 - RNA, 31 nt, Homo sapiens
uagaagcagauaaauuuugauuugggcauga

SEQ ID NO: 139538 - RNA, 46 nt, Homo sapiens
acaacuggaugccugagcuaggggcaugauggagggacaaauuaag

SEQ ID NO: 139539 - RNA, 64 nt, Homo sapiens
ugaugacacgugauacuauaauugacuguuacaggacuuuguuucccccaaagaguucauuuaa

SEQ ID NO: 139540 - RNA, 46 nt, Homo sapiens
uuuauuuuaauaguuauuuguuuauucuaauauguauuagaauaac

SEQ ID NO: 139541 - RNA, 50 nt, Homo sapiens
auguacauauaaguagaguacaauccucuuguuucacuuuuauagauagu

SEQ ID NO: 139542 - RNA, 65 nt, Homo sapiens
uugacuagaauguaagggucuaacaacaguguguaugauuagaauauaaaagucaccguugacua

SEQ ID NO: 139543 - RNA, 32 nt, Homo sapiens
acauuugucuggaaaccacauccuuaauuguu

SEQ ID NO: 139544 - RNA, 44 nt, Homo sapiens
ugaaauccaaacuucuguguccaucacacucuuguuccugcuaa

SEQ ID NO: 139545 - RNA, 3850 nt, Homo sapiens
uuuccuccaugaaauucaagguauauuuuguuucugcuguaacuuuuuuuauuuggaaaugcuucuuuuuuucuuuuuuuuuuagacagagucucacucuguugcgaggcuggagugcaguggcaugaucuugucucacugcaaccucugccuccuggguucaaacgauucuccugcaucagccuccugaauagcugggacgacaggugcgugccagcacgcccagcuaauuuuuggauuuuuuuaguagagaugggguuucaccauguuggccaggauggucucgaucucuucaccucgugaucugcccgccuuggccucacaaagugcaaugcuucuuuuuaauuuuucuagcuauuuugagucccaaaccugggcuguaaaacuugcaguuauuuucacacauguucagguuuuguaaaaucaguagagaccucaaaguuauguucaaauaggaauucuaaugauaaaaauuaguauaucagccaggcauagugguucucaugccuguaaucccagcacuuucaaaggcucaggcaggaggaugacuugagcccaggaguucaagaccagccugggcaacaugucgaaaucccgucucuacaaaaaauacaaaagauuagccagguguggggcacacaccuguagucucagcuaucugggaggcugaggucaaggcugcugcagugugccaugaucccaccacuacucuccagccugggcaacacagugagacccagucucaaaaaacaaaaaaaauuaguaugucacgucuaaaauaaaugcugauguguauucccuuuugucuuaguugccaggcaaauuagagcuuacuucauagcugagcaacaguugccuuacuccaagugccuauuaaccucuagcacauguguucuucugaaaugacaucuucucuguuuacuucuuuuaaauaucauguacugcaggucauuuuuuaacuuuuuuuuuuuuugagacagucuugcucugucauccaggguggaguacaguggcacaaucucggcucacugcaaccuccaccuccuggguucaagcgauucuccugccucagccucccaaguagcugggauuacaggugccugccaccacgcccagcuaauuuuuuguauuuuuaguagagacgggguuucaccauguuguccaggcuggucuugaacuccugaccucaugugaucuacccgccucggccucccgaagugcugggauuacaggcgugagccaccgcauccagccauuuuuuaacuuuuaaguggccucuuguucuuuuggaaguacacaagauaaaaauagauaauuaaaugaaauuauuaguaggaacucaaauguauaagauuguuuuuaaaauauuugaucaguugaauuguauuuauuucugucaugacauccaggcauauuuacuaaccaccuacugagaaugauucucugaguguauauguaauauaaaaauuuuuaaauuauauauauauuuuguguguguguucacacuauagauugaaaguaaaccuguacaaauagguaagcacuacauugagaguuuaaaaacauuuacaccuuuuuagucuugucauuucaccuugagauaaauaaacaaaggaaguaaucagaauuuugauacggauauacacggucguuuauuaaauucuuuuucuuuuuuuuucuuuuuuuuuuuuugagauggagucuugcucuguuguccaggcuggaguacaguggcacgauccuggcccacugcaaccucccccucccagguucaagcaguucuuccugccucagccucccaaguagcugggauuacaggugcauucaccacacccagcuaauuuuuguauuuuuaguagagacggggguuucucuauguuggccaggcuggucuugaacuccugaccucaggugaucugccugccucagccucccaaagcgcugggauuacagacaugagccacuacgcuaaaccaaauuucuuaaaugucacccaagaaugaacagagccaacaguacauuaugguguguccauaagauagauauuaugaaggcauuaccauuuuugucaaaaauauucaaagacauggagaaaugcuuauggcacagagugaaaaaacuuccauauguaacuugauccaaauauugucuuaaaaaacuauauauucauagaaagaggaugaagaagaaauauaccuguaguaaugaugauuucuauuuacaugcuuauugugucaaauuaacaucacagguauuuuuuaaugucauuacucuucuguagcauuguuuuguggcuggagaguaauauuuuucuauucuuagacacuuagaaaauuuccaguuguuggccgggcgcauuggcucacgucuguaaucccagcacuuuggcaggccgaggcggguggaucaccugaggucaguucuagaccagccugaccaacauggagaaaccccgucucuacuaaaaauacagaauuagcugggcgugauggugcaugccuguaaucccagcuacucaggaggcugaggcaggagaaucacuuaagcccgggagguggagguugcggugagcugagaucacaccauugcacuccagccuggacaacaagagcaaaacucugucugaaaaaaaaaaaaaacaaagaaaagaaaagaaaauuuccaguuauugguguggacaaccauguaguuguguguaguugguuuugugcauuuucuuaguauggagucccagaaguggaaugauuggguuagagaccuggaacauuuuaaagucugucucuuuuuuuuuuuuuuuuuuuuucugagacagagugucacucugucacuaggcuggagugcagugacgcgaucucagcucacugcaaccuccgccuccuggguucaagcgagucuccugccucagccucccaaguagcugggacuacaggugcacgccaccaugcccagcuaauuuuuuuguauuuuuaguagagacaggguuucaccauguuggccaggauggucucaaucucccgaccuugugacucgccugccucggccccccaaagugcugggauuacaggcgugagccaccaagccuagcuaaauuaucuuuuauacauauuacucaguaaguugccuaaauuuuacuuuuccaucccagugugauaauaccagauguugagcaaauucuguuuugauuaaauuaauuccuaauuaucaugcauuaagucauguucaucuaauauaugaagcggcauaauuucccacuauugugcacauuguugaggauaaaggcuuuggucacugaaugugguuaucaggcaaaaugcaaaauuaaaauuuuguuuucuuucuguuugguuggauuuguauccuuaagaaaaagggaaaaugaguauaguuuuaccuccugccugugguuuaccagugucccucacuaaaccuaguacucaaaauauauaaaauacgaguaaccugggccaggugcaguggcucacgccuguaaucccagcacuuugggaggccgaggcaaguggaucacuugagaucaggaguucaagaccagccuggccaacauggugaaaccugucucuacuaaaaauaugaaaaaaaaaauuagcugggcgugauggugggcgccuguaaucccaacuacuugggaggcugaggcaggagaaucacuugaagccaggagguggagguugcagugagccaagaucgugccacugcacuccagccugggugacagagcaagacucugccuccaaaaaaaaaaaaguaacuuaacauacguaaugaaaauuauuuuccaaaugcgaguugaauuuguaaugucuucuuucaggauccacugaaagauggugag

SEQ ID NO: 139546 - RNA, 44 nt, Homo sapiens
ccugguaaccgaauguguuguucuuugcaggcaccgaccgucac

SEQ ID NO: 139547 - RNA, 61 nt, Homo sapiens
cccauuuuuguuuccucaaacagguuuuuaggagaguggagauuuaaagucaggauguggc

SEQ ID NO: 139548 - RNA, 46 nt, Homo sapiens
ccaagagaauuaaugugcguauugagcacauuaagcacucuaagag

SEQ ID NO: 139549 - RNA, 46 nt, Homo sapiens
cuuacauuauauuuuuauagauuuuguuauaaacauggugcuggga

SEQ ID NO: 139550 - RNA, 41 nt, Homo sapiens
gauaccgucucaggaaggguaaauuuagaaguuacugggga

SEQ ID NO: 139551 - RNA, 45 nt, Homo sapiens
acugaaucuagaaacgccggcuccaauacugccuauacacagaau

SEQ ID NO: 139552 - RNA, 45 nt, Homo sapiens; identical to SEQ ID NO: 44842

SEQ ID NO: 139553 - RNA, 49 nt, Homo sapiens
augaaacggaugaaagaaaacagauuuuuccucaagggguuaagacuug

SEQ ID NO: 139554 - RNA, 65 nt, Homo sapiens
gcuaauuucccacccaaacacagcauuucucccacgacuuuauguuggcgugaaauauucgcuga

SEQ ID NO: 139555 - RNA, 34 nt, Homo sapiens
gacgauagcagggaaagaaaaacuugacgugugg

SEQ ID NO: 139556 - RNA, 56 nt, Homo sapiens
cccagauuuguaacacgauagucagcugccugcauuucauuauaaaggggagugga

SEQ ID NO: 139557 - RNA, 67 nt, Homo sapiens
acaauguauuaugcaaaucagaaaucuuggugugaugcuuaauuuacucccucucuucaugucugaa

SEQ ID NO: 139558 - RNA, 42 nt, Homo sapiens
gacuugacgacauuauaguauuaacaaaagauauacaagaag

SEQ ID NO: 139559 - RNA, 35 nt, Homo sapiens
ccuuuuugauggaagcauaagcaacaaaaaaaauu

SEQ ID NO: 139560 - RNA, 110 nt, Homo sapiens
cuggcuaaguaagaagcauuugcauacugauuccaucauuuaaucuuuaaaaguauguguuuuaaaaauguaaccagaaugauucuucaauagaaaugagauuuggugga

SEQ ID NO: 139561 - RNA, 54 nt, Homo sapiens
ccuauacuauuaaacucaaccuugaaccugagcuugguuguuucugugccuuag

SEQ ID NO: 139562 - RNA, 30 nt, Homo sapiens
ucuguuguuuuggacaaauaguuguuacca

SEQ ID NO: 139563 - RNA, 44 nt, Homo sapiens
uaggaaaaugacuacauuaauucauacuuugaagauggagauga

SEQ ID NO: 139564 - RNA, 71 nt, Homo sapiens
ggaaaaugaagagaaagaaggaagcaaagagaaaaguaaagaaggugaugaugacgaugacgaugaugccg

SEQ ID NO: 139565 - RNA, 345 nt, Homo sapiens
agguaagauagaccaccagguacuguggcucaugccuguaaucccagcacuuugggaggcuaaggugggcagaucucuugagaccagcaguuugagaccagcauagccaacauggagaaacccugucucuacuaaaaaaauuagccaggcuuggugguaugcaccuguagucccagcuacgcaggaagcucaagcaggagaaucacuugaacccaggagaaggagguugcugugagccgagaucguggcacugcacuccagccugggugacagagcgagacuuucucucaaaaaagaagguaggagauaaauuauaaaaaauaaagcauugugcauuagagcuga

SEQ ID NO: 139566 - RNA, 46 nt, Homo sapiens
cacaccacucacuaauacugaagauguguugaaaaaaauggaggua

SEQ ID NO: 139567 - RNA, 40 nt, Homo sapiens
agugggaauaauccuuguccucauggagcuuguagucaaa

SEQ ID NO: 139568 - RNA, 46 nt, Homo sapiens
auaguaaaagauacaugaagguauacaaggaagaauggauaccagg

SEQ ID NO: 139569 - RNA, 96 nt, Homo sapiens
acaggagaaggugaagaauauaugcuggcuuugaaacaggaguugagagaaacaaugaaaagaaugccuuauuuuauugaaacaccugaagaaaga

SEQ ID NO: 139570 - RNA, 51 nt, Homo sapiens
ccuggugaagaguagagcagcugugugaaguacuguggcuugcauaauuuu

SEQ ID NO: 139571 - RNA, 92 nt, Homo sapiens
uuuucguaacuguuggcacuuuauaucguagggaagggaguuguuaauaugguuugucuuuucuuauaaaaaauaaaauucuauauccaccc

SEQ ID NO: 139572 - RNA, 53 nt, Homo sapiens
cagugaguuagaaggguauuuaugcucuuacugauaguagguuauuuucaaaa

SEQ ID NO: 139573 - RNA, 44 nt, Homo sapiens
cuuguccugcucccuucagaauuuuuuaaguccaauuuccagau

SEQ ID NO: 139574 - RNA, 100 nt, Homo sapiens
cccuuuccuugccggccggcacuucggcugcagaguuuugcccacgcuucgagacuuagggagcagguaaccgaggaagcaaucgaagacuugggagggg

SEQ ID NO: 139575 - RNA, 46 nt, Homo sapiens
ucagguggcgaccguuucgccaccccgggcgugugacagcagaggc

SEQ ID NO: 139576 - RNA, 48 nt, Homo sapiens
auuuccaggagcuuucguagugagcagacuuuuaaggaaugaccccuc

SEQ ID NO: 139577 - RNA, 70 nt, Homo sapiens
guugaacggcugugggcgucuugcugccuuggguaggggguuaaaaucguucuugagaggaacgucucug

SEQ ID NO: 139578 - RNA, 41 nt, Homo sapiens
gaagaggaaagaagagacagaaaaagggagaggcgcuguaa

SEQ ID NO: 139579 - RNA, 45 nt, Homo sapiens
ggcuuaccccgagggccgguggcucggugacucgcuggcuaggug

SEQ ID NO: 139580 - RNA, 29 nt, Homo sapiens
uagugaccgggcaacugggcaaccguugg

SEQ ID NO: 139581 - RNA, 48 nt, Homo sapiens
guggucguauguggccgaaguugaguaccugugcaggaauggcugggg

SEQ ID NO: 139582 - RNA, 45 nt, Homo sapiens
uaccacaacagaucuuggcauugcuggcuuaaacaccgaacagaa

SEQ ID NO: 139583 - RNA, 43 nt, Homo sapiens
uuaagccagcaaugccaagaucuguugugguaaguuacagugg

SEQ ID NO: 139584 - RNA, 55 nt, Homo sapiens
agugguuauuucauugguuccagccaaaugauauaaugguuaaaaguacaggcag

SEQ ID NO: 139585 - RNA, 45 nt, Homo sapiens
acggcuuguauguauuucaaacguuuuuaucuuaauaacucagua

SEQ ID NO: 139586 - RNA, 46 nt, Homo sapiens
auuuuuggccugcaaaguagaugaauucaauguaucuaguccucag

SEQ ID NO: 139587 - RNA, 46 nt, Homo sapiens
auaagaaguaguucauauuccaguaucuguucaagugccuucuccu

SEQ ID NO: 139588 - RNA, 46 nt, Homo sapiens
uuauacagcaacuuaauuuccaccuuauuguccacaauccuuacag

SEQ ID NO: 139589 - RNA, 29 nt, Homo sapiens
ucaggaauugguucauucauguuagauca

SEQ ID NO: 139590 - RNA, 55 nt, Homo sapiens
ugucuccacagucuagacucugccuuccacucuggcagcagcugucugugaucuc

SEQ ID NO: 139591 - RNA, 45 nt, Homo sapiens
uaagguugccaacaugaucuuuuaaagcugcaaaucuaaucaugc

SEQ ID NO: 139592 - RNA, 48 nt, Homo sapiens
ccucaggauuugguguugacaggaaauagcgccuuucuuugguaagag

SEQ ID NO: 139593 - RNA, 46 nt, Homo sapiens
ggaugcuuaccuuuuauacacaccuucccaaauugcccugacugcc

SEQ ID NO: 139594 - RNA, 39 nt, Homo sapiens
uuaucugguguauauauuaugaaaugugaaauacccaag

SEQ ID NO: 139595 - RNA, 45 nt, Homo sapiens
uauuuaucagagagucugaugcugaaagagaacagaacuugccug

SEQ ID NO: 139596 - RNA, 54 nt, Homo sapiens
ugcguaaucaagacuuauccagcccaaaaagucauuagugcugguguugagaaa

SEQ ID NO: 139597 - RNA, 40 nt, Homo sapiens
cacuauaaucuagcauuaauuuuuggcaaauccuacuggg

SEQ ID NO: 139598 - RNA, 42 nt, Homo sapiens
uuacguuaagugcaagcucagcagaaugacaucgcuccaacu

SEQ ID NO: 139599 - RNA, 46 nt, Homo sapiens
ucugaggaacaaauaugcucuuccagacuucuguuagcuagaguag

SEQ ID NO: 139600 - RNA, 45 nt, Homo sapiens
auaaaauuuuucauggaauugucaaaucuaacacugaccuaggaa

SEQ ID NO: 139601 - RNA, 48 nt, Homo sapiens
gaaaggcuaugaagaugaugauuacgucucaaagaaauccaaacauga

SEQ ID NO: 139602 - RNA, 62 nt, Homo sapiens
acgaccugguagaaucucucuaaccauuugaaguugauuucucaaugcuaacuaaucaagag

SEQ ID NO: 139603 - RNA, 45 nt, Homo sapiens
uccacauuccagugaugugugagcuaugcaaacaaaauccaagau

SEQ ID NO: 139604 - RNA, 138 nt, Homo sapiens
auguguugcugcugcuacaccuaauuuauaagaaguauugcuacauguauggguuuugcuauauuaauuuggugcaauaguaauugcaguuuuugcuguuaacuguaauuacuuuugcaccaaccuaauagaucaaac

SEQ ID NO: 139605 - RNA, 42 nt, Homo sapiens
ccugccauccugaauccacggauguucaauaucaucucaggu

SEQ ID NO: 139606 - RNA, 46 nt, Homo sapiens
ggauucaggauggcaggacagaugagucgaagaaaaacaaaaccac

SEQ ID NO: 139607 - RNA, 73 nt, Homo sapiens
uguuaaaagcuugcauagauacuccuauucugccuccuuuagucacugguagggaggauauguugucauguag

SEQ ID NO: 139608 - RNA, 29 nt, Homo sapiens
gacaaaaaauaaaaugcacauagaaaaag

SEQ ID NO: 139609 - RNA, 45 nt, Homo sapiens
aagaugacuuugaauccuuauccacuuaauuuaauguuuaaagaa

SEQ ID NO: 139610 - RNA, 44 nt, Homo sapiens
uaaaguuuugaauguucauguaugaaugcugcagcugugaagca

SEQ ID NO: 139611 - RNA, 45 nt, Homo sapiens
auggaggacuuuucuguaaccaggaacauuuuuuaggggucaaag

SEQ ID NO: 139612 - RNA, 46 nt, Homo sapiens
uuuggaaauaacccaauuugcuuuccuuuagucgcuugcggccagc

SEQ ID NO: 139613 - RNA, 29 nt, Homo sapiens
uucuguuuguuauuuagugaaaagauggu

SEQ ID NO: 139614 - RNA, 60 nt, Homo sapiens
cacccucucuaucuccauuuuuuucuuugaaagauuuauuagagcuucuccgucuugggu

SEQ ID NO: 139615 - RNA, 51 nt, Homo sapiens
uuggugaucuccaaacaacacuuuaauaaacgcaaagcuuccagugcacau

SEQ ID NO: 139616 - RNA, 38 nt, Homo sapiens
uuaauguccaugguuaaggaaaguuaugccauuauaaa

SEQ ID NO: 139617 - RNA, 39 nt, Homo sapiens
aggagcugugcacacuacaaaucuggguuuguauuguaa

SEQ ID NO: 139618 - RNA, 42 nt, Homo sapiens
aucgcugcaaaaugaacccgugccuuaacggaggcaccuguu

SEQ ID NO: 139619 - RNA, 41 nt, Homo sapiens
auggucucagcauggugucuagugucagugguaggaauagu

SEQ ID NO: 139620 - RNA, 74 nt, Homo sapiens
agcaaguggcagcgagaauucuugauuccaaugaucaggcaacaguaaacccuguggaauuuaauacugagguu

SEQ ID NO: 139621 - RNA, 46 nt, Homo sapiens
ggucaaguuucuggagaagcaaucaagauguuucccaccauuaaaa

SEQ ID NO: 139622 - RNA, 49 nt, Homo sapiens
aauauugaagcgacuuucaaaccaucaagugaggaauaccuucacauaa

SEQ ID NO: 139623 - RNA, 42 nt, Homo sapiens
ccccagcccagugcucugccaggaauagacgucggcucaucu

SEQ ID NO: 139624 - RNA, 41 nt, Homo sapiens
ccuucuuuucagccagaauucucuucaggagcugaggaggc

SEQ ID NO: 139625 - RNA, 47 nt, Homo sapiens
agaccaaagugaaauaauaccaacauugggccaauuugaaaggacuc

SEQ ID NO: 139626 - RNA, 46 nt, Homo sapiens
caugggcuuucacuucacaacugggaucccugcuccuagcacagaa

SEQ ID NO: 139627 - RNA, 46 nt, Homo sapiens
uacagagaguaccauccuugaaauucuaccugagcugacaucggau

SEQ ID NO: 139628 - RNA, 55 nt, Homo sapiens
gcagaacaaaagcuccccugauccaacuagcacacugucaaauacagugucauau

SEQ ID NO: 139629 - RNA, 46 nt, Homo sapiens
aauuaacgaaacaacaaccucaucuacugauuuucuggcuagagcu

SEQ ID NO: 139630 - RNA, 95 nt, Homo sapiens
aguuggaccacucguaucucaaacagacaucuuugaagguagugggucaguaaccagcacaacauuaauagaaauuuuaagugacacuggagcag

SEQ ID NO: 139631 - RNA, 45 nt, Homo sapiens
cacacuucucaaguggaaaguaccucaagugacaaaauugaagac

SEQ ID NO: 139632 - RNA, 42 nt, Homo sapiens
uucaagagucagauacugagcucuuauucucuggacugggau

SEQ ID NO: 139633 - RNA, 46 nt, Homo sapiens
aucuauaccagcugaacauguagucacagauucaccaaucaaaaag

SEQ ID NO: 139634 - RNA, 46 nt, Homo sapiens
acuccagauccagaugcaaauggcuuggaaucuuacacaacucucc

SEQ ID NO: 139635 - RNA, 45 nt, Homo sapiens
gaagaaaagucauuugaauccccucaaaacucuccugcaacagaa

SEQ ID NO: 139636 - RNA, 46 nt, Homo sapiens
caaauuauggucuaggcaagaagucaacccuguaagacaagaaauu

SEQ ID NO: 139637 - RNA, 49 nt, Homo sapiens
uacagcuuccuccauuaucgacgaaggauugggagaaguggguacuguc

SEQ ID NO: 139638 - RNA, 46 nt, Homo sapiens
caccaucuacaguaccuacuucaguucacaucagucacauaucuga

SEQ ID NO: 139639 - RNA, 56 nt, Homo sapiens
cuuuagagaauacucaacagugucucaucccauagcaaaagaagaaacgguaauga

SEQ ID NO: 139640 - RNA, 46 nt, Homo sapiens
uggacagaguaguugcugaaaauauaacccaaacauccagggaaau

SEQ ID NO: 139641 - RNA, 46 nt, Homo sapiens
gauucagguaccaggaaaaguuuuauguccuugacaacaccaacac

SEQ ID NO: 139642 - RNA, 53 nt, Homo sapiens
ggagggaacuacagguacggcuucuacauuugagguauauucaucuacacaga

SEQ ID NO: 139643 - RNA, 61 nt, Homo sapiens
gauacaauguucaccaugguaacugauuuaucacagagaaauacuacugauacacucauua

SEQ ID NO: 139644 - RNA, 46 nt, Homo sapiens
gaaagcuggguagaagcaacuccuagacaaguuguagagcucucag

SEQ ID NO: 139645 - RNA, 46 nt, Homo sapiens
ucagucacagagagagauacugaaguuggucaucaggcacaugaac

SEQ ID NO: 139646 - RNA, 47 nt, Homo sapiens
uugucuacugcugugcaaccuaaugaaucuacagaaacaacugaguc

SEQ ID NO: 139647 - RNA, 56 nt, Homo sapiens
gaagaagagugugcaaaugcuacugaugugacaaccaccccaucugugcaguacau

SEQ ID NO: 139648 - RNA, 57 nt, Homo sapiens
gaauucccugacauaauugaaauagaccuauaccacagugaagaaaaugaagaagaa

SEQ ID NO: 139649 - RNA, 46 nt, Homo sapiens
ucgaaugagugauuugaguguaauuggucauccaauagauucagaa

SEQ ID NO: 139650 - RNA, 48 nt, Homo sapiens
guguagcuaauaaguugaguugaauaauauaaaacccaguaaaaaugu

SEQ ID NO: 139651 - RNA, 82 nt, Homo sapiens
gugaaagcuuuugcuugucagugaauaguagagaagagaacacacccacagaguauuaaaauuaaccuccacuucccaaugc

SEQ ID NO: 139652 - RNA, 77 nt, Homo sapiens
aagugguaacacuaacaccacgcauugggccaaaaguaucuuuaaguccagggccugaacaaaaauaugaaacagaa

SEQ ID NO: 139653 - RNA, 42 nt, Homo sapiens
agagggcgauggaucagcauauacagucucugaagaugaauu

SEQ ID NO: 139654 - RNA, 48 nt, Homo sapiens
caauuagauuucagccaacuacaucaacugguauugcagaaaagucaa

SEQ ID NO: 139655 - RNA, 45 nt, Homo sapiens
agugcuuuuggcccaugguacuuuaaguguugaagcagccacugu

SEQ ID NO: 139656 - RNA, 51 nt, Homo sapiens
ggaauuuccacaguuauuuauccuucucuacaaacagaaaugacacauaga

SEQ ID NO: 139657 - RNA, 60 nt, Homo sapiens
agucagucucagcauccacaacuguuuccccuuuaauuaugccugauaauaauggaucau

SEQ ID NO: 139658 - RNA, 46 nt, Homo sapiens
ugaccaaauuccugaagucauuacggugucaaagacuucagaagac

SEQ ID NO: 139659 - RNA, 36 nt, Homo sapiens
gaggcuacaaccaucgauuugaguauccucgcagaa

SEQ ID NO: 139660 - RNA, 31 nt, Homo sapiens
aauacugguaguuuuccagagccaaaacuuc

SEQ ID NO: 139661 - RNA, 44 nt, Homo sapiens
ccauaaguacagugaugugaaacaucugugggcagacagcugca

SEQ ID NO: 139662 - RNA, 50 nt, Homo sapiens
acgugacugauauaauuaaggagcaaaaucagauugguaugcugugggga

SEQ ID NO: 139663 - RNA, 45 nt, Homo sapiens
uggucuacuuggggugagaacccuguaucguuuugagaaccagac

SEQ ID NO: 139664 - RNA, 46 nt, Homo sapiens
aaaccaggaugccaggcuggcaacagugggggaacuccaggcggca

SEQ ID NO: 139665 - RNA, 46 nt, Homo sapiens
auguguuccaccucacuguccccaguaaauucaccuucgaggaggc

SEQ ID NO: 139666 - RNA, 46 nt, Homo sapiens
ccauccgggcucccagaguaggcuguuauggagauaagaugggaaa

SEQ ID NO: 139667 - RNA, 43 nt, Homo sapiens
uuuugaggcugcucagaaggcuuguuuggacguuggggcaguc

SEQ ID NO: 139668 - RNA, 51 nt, Homo sapiens
gugggcgaugccucccucacuguggucaagcugcuggcaagugaugcgggu

SEQ ID NO: 139669 - RNA, 45 nt, Homo sapiens
ccaguuacaacaccagugaauuucuccgcaucaaauggucuaaga

SEQ ID NO: 139670 - RNA, 56 nt, Homo sapiens
guucauaaauauaaagagcaucuuauggauguguucaaccuuaauaguaacccaug

SEQ ID NO: 139671 - RNA, 64 nt, Homo sapiens
uggugcuaaaaacaaagaaagaggcuucugaaagcuuuccauuuaauaugaucaaacauagaag

SEQ ID NO: 139672 - RNA, 48 nt, Homo sapiens
uuuuuaaauacauucaggucacucuaaagcccauucuuagucaauuaa

SEQ ID NO: 139673 - RNA, 41 nt, Homo sapiens
ggcgggugugggcgcccccugauggagaagucccgcacagg

SEQ ID NO: 139674 - RNA, 42 nt, Homo sapiens
ccgaacccagucgcgcagcgcugcagugaauuuuccccccaa

SEQ ID NO: 139675 - RNA, 47 nt, Homo sapiens
auccucccgcaucuuccagcaccgucccgcacccuccgcauccuucc

SEQ ID NO: 139676 - RNA, 76 nt, Homo sapiens
caugguaacagucuccaggucucccucuucugucauaggccaugaggucucccccucuagguggugguggaggagg

SEQ ID NO: 139677 - RNA, 46 nt, Homo sapiens; identical to SEQ ID NO: 139336

SEQ ID NO: 139678 - RNA, 32 nt, Homo sapiens
gccaguauuccuggaggauauaacacugacau

SEQ ID NO: 139679 - RNA, 46 nt, Homo sapiens
ccucuucagauuuaugauauagaugccaucacuuuuccuuuuauag

SEQ ID NO: 139680 - RNA, 42 nt, Homo sapiens
uggguuccugcuacaaggaacuuaaggacauccuccuccuuc

SEQ ID NO: 139681 - RNA, 27 nt, Homo sapiens
aauauauugaguuagaugacuuuggug

SEQ ID NO: 139682 - RNA, 52 nt, Homo sapiens
gaggacugguaaaucauauagucaguccaagaaggauuguuuauauagauaa

SEQ ID NO: 139683 - RNA, 41 nt, Homo sapiens
ugucaguuguaaagguagcuagaccaggaucauagggaggu

SEQ ID NO: 139684 - RNA, 56 nt, Homo sapiens
guaagcagaugcacuuuccugaauagcaugucagauucucaaacagucaauggccc

SEQ ID NO: 139685 - RNA, 42 nt, Homo sapiens
acuuaccaucagcauagaguccuuugggauuaucaggacaag

SEQ ID NO: 139686 - RNA, 45 nt, Homo sapiens
ggucuacuuuagccuuacacuugguuauuucgugcucuguggacc

SEQ ID NO: 139687 - RNA, 45 nt, Homo sapiens
accuuuuuucuaaaagugcuuaucacaucaauuccuuuggccaga

SEQ ID NO: 139688 - RNA, 50 nt, Homo sapiens
agcgugcacggccccacacacacagccccagcguacacggccccccgcac

SEQ ID NO: 139689 - RNA, 48 nt, Homo sapiens
agcguacacggccccacacacacacagguccagcguacacggccccca

SEQ ID NO: 139690 - RNA, 109 nt, Homo sapiens
agcgugcacagccccacccccaacacacagagccccagcauacacggccccccgcacucagccccagcgugcaaggccccacacacagccccagcauacacggccccca

SEQ ID NO: 139691 - RNA, 95 nt, Homo sapiens
ccacacacacacagccccagcgugcacggcccccacacacacagccccagugugcacggccccacacacacacagccccagcgugcacggcccca

SEQ ID NO: 139692 - RNA, 51 nt, Homo sapiens
agcgugcccggccccacacaaacacagccccagcgugcacggcccccacac

SEQ ID NO: 139693 - RNA, 60 nt, Homo sapiens
aggcuuugacucaagagucucuuaccauaaccugcuguugauugacauuuucgaggaaua

SEQ ID NO: 139694 - RNA, 67 nt, Homo sapiens
aaugugcuguuuuucugguugauggcaagaucuuauguauggcuauggaagguggguagcagaaggg

SEQ ID NO: 139695 - RNA, 34 nt, Homo sapiens
guguuuaaauucuuauuaaaauuugucaugaggu

SEQ ID NO: 139696 - RNA, 31 nt, Homo sapiens
agcaaugacauucagaaugucuuacccauuu

SEQ ID NO: 139697 - RNA, 50 nt, Homo sapiens
ucaugucuuauuuauaccauugacaucagaaagagcauuguuguucauau

SEQ ID NO: 139698 - RNA, 50 nt, Homo sapiens
ggauuucaguuccuuggauaaaaacuaucuaaaaauccucucuguucaga

SEQ ID NO: 139699 - RNA, 29 nt, Homo sapiens
gucccaggagaagaauaugagagauugcu

SEQ ID NO: 139700 - RNA, 45 nt, Homo sapiens
aauucaagguguuauugacgagauccgaaugcauuugcaagaaau

SEQ ID NO: 139701 - RNA, 60 nt, Homo sapiens
guggaacgugcccuggaauauguaccaauagguguuuuuauggugauaaugauagaggau

SEQ ID NO: 139702 - RNA, 35 nt, Homo sapiens
auuuugucacacacaauauccuguuuagggguuca

SEQ ID NO: 139703 - RNA, 42 nt, Homo sapiens
uuguuuucuggucuuucuuagacugauaugaaaaccaaagga

SEQ ID NO: 139704 - RNA, 59 nt, Homo sapiens
acagacauuucuggagcuuugugauucaaagggaaaaauauaaacccaaccugguuuuc

SEQ ID NO: 139705 - RNA, 55 nt, Homo sapiens
agccuuucucuugggcauggugguggcggcgacggcagcaggacguaggugcugg

SEQ ID NO: 139706 - RNA, 49 nt, Homo sapiens
gccaugugugucaaagucagggaaucccuccuccugggagccaagagga

SEQ ID NO: 139707 - RNA, 45 nt, Homo sapiens
auaugaaguuagaaacaugugaaaucguacucuguacugcuuaag

SEQ ID NO: 139708 - RNA, 66 nt, Homo sapiens
aucucagcaaaaugacagaauagaaauuaacuaggaaacaaggagguggugcugguucaagguugc

SEQ ID NO: 139709 - RNA, 64 nt, Homo sapiens
acuucuaacacauugauacaccaucuuugucauguuuucuggggaagaaagcuagaaaguuaaa

SEQ ID NO: 139710 - RNA, 57 nt, Homo sapiens
ccgaagguaagugaaccuaaaauucacaaagaaaaucaaagggccaggaguagccaa

SEQ ID NO: 139711 - RNA, 49 nt, Homo sapiens
guuguaaccucaaaaguggaaugcauuuccugguuggugcugcuugccc

SEQ ID NO: 139712 - RNA, 39 nt, Homo sapiens
ucuuauagucuagaggggagguagucauggaaauaauug

SEQ ID NO: 139713 - RNA, 60 nt, Homo sapiens
ugagcacuggcauagccaaggaaggcuguaugaaggaggugggguaggcugguacauuug

SEQ ID NO: 139714 - RNA, 34 nt, Homo sapiens
guauuaagugcuaaacgugaaggugccuuguugg

SEQ ID NO: 139715 - RNA, 42 nt, Homo sapiens
uguccgagcaaacagaggcgcucauccacagagccacaucug

SEQ ID NO: 139716 - RNA, 36 nt, Homo sapiens
uguaugugagauuuauuuacaugugucgcuguaguu

SEQ ID NO: 139717 - RNA, 46 nt, Homo sapiens
uccagccuugccaccuuaaacguuauauacaaauguaaauauagug

SEQ ID NO: 139718 - RNA, 50 nt, Homo sapiens
agccguuugcccuucaagcauuuucuuuggggcuguccuuuacuucagca

SEQ ID NO: 139719 - RNA, 47 nt, Homo sapiens
uuggaccuauauacaaauaguaaaguuauuuacuuuuaagcuuuaac

SEQ ID NO: 139720 - RNA, 47 nt, Homo sapiens
acaugaaugacuaugguauuauaucuagauuuggaggaggggauagu

SEQ ID NO: 139721 - RNA, 47 nt, Homo sapiens
uccagagagugcaaacguguuuuguaaggugguagguaggcuucaau

SEQ ID NO: 139722 - RNA, 46 nt, Homo sapiens
aagaauucugcugcgauucugcccuuccucaaaguagaguccagac

SEQ ID NO: 139723 - RNA, 67 nt, Homo sapiens
cagaagaaagaagagaccauuggaaaaugaugggccuguuaaaaagaaaguaaagaaaguccaacaa

SEQ ID NO: 139724 - RNA, 44 nt, Homo sapiens
cgggaagccugaaauccaccuccuccuccacaggugcagccgac

SEQ ID NO: 139725 - RNA, 46 nt, Homo sapiens
accuguggaggaggagguggauuucaggcuucccguagacuggaag

SEQ ID NO: 139726 - RNA, 46 nt, Homo sapiens
acuccgaaaggaaaacagaguaggccuuuggaacagcugcuggaag

SEQ ID NO: 139727 - RNA, 46 nt, Homo sapiens
ggaugaacuucuugguucucuuuuugacgaucuugggcuucacaag

SEQ ID NO: 139728 - RNA, 49 nt, Homo sapiens
auguauuacccacuuauuuugugugguaagaacacuuaaagucuacucu

SEQ ID NO: 139729 - RNA, 45 nt, Homo sapiens
uuuguuauuaacuaaaauaauagauguuguacaauagaucucuug

SEQ ID NO: 139730 - RNA, 41 nt, Homo sapiens
gagaauuguacuugcauugcacugguuucuacucccugaau

SEQ ID NO: 139731 - RNA, 51 nt, Homo sapiens
aauuaucaaccauauuuuaggcaguaguuagaaaagucauguacaauauaa

SEQ ID NO: 139732 - RNA, 40 nt, Homo sapiens
cucauuccagagagacuaaaauuauaauagaaaaugguua

SEQ ID NO: 139733 - RNA, 41 nt, Homo sapiens
gagcuggagagaacacaggcuuaagugagaguuagggaaca

SEQ ID NO: 139734 - RNA, 66 nt, Homo sapiens
uuaaagucagcgagcagguucucauugauaacaagcuccauacugcugagauacagggaaauggag

SEQ ID NO: 139735 - RNA, 57 nt, Homo sapiens
ugaggaaacgcgccugguuccaggggucggcggggaccguggagacgcugccagcau

SEQ ID NO: 139736 - RNA, 48 nt, Homo sapiens
gacagaaaacuuauccagggagagaagagacaaaagugaagugugaaa

SEQ ID NO: 139737 - RNA, 21 nt, Homo sapiens
agcccugauacucauugccau

SEQ ID NO: 139738 - RNA, 42 nt, Homo sapiens
cugauuacagaaagaaccugaacauguauuguacauuuggag

SEQ ID NO: 139739 - RNA, 55 nt, Homo sapiens
cauauaugcuaugcucuuuucugcacacacauucuauuuuacaauaaguaaauaa

SEQ ID NO: 139740 - RNA, 58 nt, Homo sapiens
uauauuugaucccuaaguaaaauaauuauuuauuuuuuaaaaacuuaguagcagguac

SEQ ID NO: 139741 - RNA, 42 nt, Homo sapiens
guauggaaauuucaagugaaggaaauuccuugaucaaagcag

SEQ ID NO: 139742 - RNA, 46 nt, Homo sapiens
cguggggaaaccccuuuaaugaucgcuuguaagaccaaacaugucg

SEQ ID NO: 139743 - RNA, 42 nt, Homo sapiens
auucuaguuacucagcucuuguuuaugcuauaaauucagaag

SEQ ID NO: 139744 - RNA, 25 nt, Homo sapiens
cucaccaucuccuucccaauuguca

SEQ ID NO: 139745 - RNA, 34 nt, Homo sapiens
gcaaauguacauagucuguuuagaaaaaaaccaa

SEQ ID NO: 139746 - RNA, 48 nt, Homo sapiens
auucuccugaccagaggacagccuccccucuaccaccuccgagaagug

SEQ ID NO: 139747 - RNA, 46 nt, Homo sapiens
uucuaucaaacagauugggaacaucucaguuuuucuuuggagauac

SEQ ID NO: 139748 - RNA, 44 nt, Homo sapiens
cccacaggcgagcuuucucucaaauacacauucaaaaugguguu

SEQ ID NO: 139749 - RNA, 50 nt, Homo sapiens
uuuuuaugcauuuaacuuaaaagcuugaauacacgacuccuccuagagag

SEQ ID NO: 139750 - RNA, 46 nt, Homo sapiens
aaugccacaucugcauuggagcacacaguucccucuuauucaagua

SEQ ID NO: 139751 - RNA, 46 nt, Homo sapiens
aauagugguucuaauacaguguccaaaacacgcaaauuaguagccc

SEQ ID NO: 139752 - RNA, 42 nt, Homo sapiens
uuaaagaagaauuaauuccucuacaauuuuauggaacauugc

SEQ ID NO: 139753 - RNA, 32 nt, Homo sapiens
uguugagaggcugcauuauggcaguagcggug

SEQ ID NO: 139754 - RNA, 25 nt, Homo sapiens
ggacaaccagaugaauaaucucauu

SEQ ID NO: 139755 - RNA, 46 nt, Homo sapiens
aaauugagcauguucgacgguccaggaagaaaaaaggagcgaucag

SEQ ID NO: 139756 - RNA, 26 nt, Homo sapiens
uguugccuuuugcucuuuagugcagc

SEQ ID NO: 139757 - RNA, 46 nt, Homo sapiens
auaugucuuuccaagugugcaaacuauaauauguaguuaaugaaaa

SEQ ID NO: 139758 - RNA, 42 nt, Homo sapiens
uuauauugguuuuaaaaagucugcauaaucacuagguggcau

SEQ ID NO: 139759 - RNA, 48 nt, Homo sapiens
uguuuuuaauuaggcacacuaagaguggcuaaauuugggggaauuggu

SEQ ID NO: 139760 - RNA, 41 nt, Homo sapiens
auguuauguaagcaaaggguuuggaaaggcgggagggaguc

SEQ ID NO: 139761 - RNA, 57 nt, Homo sapiens
gcuguaagacauuucaaaaccauugcagacacauuguuaaaaugcagccauuugaua

SEQ ID NO: 139762 - RNA, 63 nt, Homo sapiens
aagaauuaaaacucuuaaaucagugaaacaaaaacuaaugggcagcauucucucuguuuggaa

SEQ ID NO: 139763 - RNA, 49 nt, Homo sapiens
uuuaaaaucauuguguauauuacagcaguaugaggaaugccuggcuaaa

SEQ ID NO: 139764 - RNA, 28 nt, Homo sapiens
auguguauauuuaguuaugaugguacuu

SEQ ID NO: 139765 - RNA, 37 nt, Homo sapiens
cuacaaagauagaaaguagagacaagucuccguggcu

SEQ ID NO: 139766 - RNA, 36 nt, Homo sapiens
uugguuccucaguuggauaacauuagauccaaaguu

SEQ ID NO: 139767 - RNA, 54 nt, Homo sapiens
aaaucaaacuagaucagucacacuagacacauaucaagugcucauuagccacau

SEQ ID NO: 139768 - RNA, 48 nt, Homo sapiens
gucuagacucucagguaugucuaacugggaaucuuuuccauaguggau

SEQ ID NO: 139769 - RNA, 45 nt, Homo sapiens
caugaagcucuuagaagaauuaaagaagcauccccagagucagag

SEQ ID NO: 139770 - RNA, 46 nt, Homo sapiens
cuccuuuuccugaugaagaugauaguaauaauaucuuggcacaaau

SEQ ID NO: 139771 - RNA, 43 nt, Homo sapiens
cucccacuauaucucuuccacuuuugaauaacaaccucgaacc

SEQ ID NO: 139772 - RNA, 47 nt, Homo sapiens
cggccaccauguuccugccuuaggugcgagauggcccuccaccaaga

SEQ ID NO: 139773 - RNA, 49 nt, Homo sapiens
gaaauagauuaauuaauguacuuuuauuuuucauuacuguuucuguggg

SEQ ID NO: 139774 - RNA, 47 nt, Homo sapiens
guauacuaugacacuuacgaaagcauggaggccaugcuggagaagga

SEQ ID NO: 139775 - RNA, 46 nt, Homo sapiens
ggggggugauuucuagcauuuauugagcacuuacuguuugccagau

SEQ ID NO: 139776 - RNA, 73 nt, Homo sapiens
uacaguuugaaaucuugaagugugaagaguuacuauugacagcgcaacuagaaagcaucaaaagacuuauauc

SEQ ID NO: 139777 - RNA, 45 nt, Homo sapiens
aagagauaugcuuggaacagcggaaacaugcacuaaaggaagagg

SEQ ID NO: 139778 - RNA, 40 nt, Homo sapiens
ugggcguguucucuuuuuacaacauauuuaugauucagaa

SEQ ID NO: 139779 - RNA, 45 nt, Homo sapiens
gcuaaaugugauuugcacucucaaaccuagcaucacaagacagaa

SEQ ID NO: 139780 - RNA, 40 nt, Homo sapiens
gagacaugagagaacuugccaugcuacgaagacagcagau

SEQ ID NO: 139781 - RNA, 35 nt, Homo sapiens
guggcauuugaucacuuguaaaugacucaggggga

SEQ ID NO: 139782 - RNA, 61 nt, Homo sapiens
aagauuguguuguuaucugcuuauguauauauaauaguugaaccuuguuguuagauuaggg

SEQ ID NO: 139783 - RNA, 43 nt, Homo sapiens
cgcgagaaacacaaauucgucuuuauuguggccuggaacgaga

SEQ ID NO: 139784 - RNA, 43 nt, Homo sapiens
ccgccgacgucagcagucgaauggcaacauuguggcgaugcug

SEQ ID NO: 139785 - RNA, 39 nt, Homo sapiens
aggaauauaugcuuuguaucuuauacguaauauuccaga

SEQ ID NO: 139786 - RNA, 47 nt, Homo sapiens
cuggccgccagggcuuuggguguuaaugccuuccuuggacgggaggc

SEQ ID NO: 139787 - RNA, 48 nt, Homo sapiens
acaaauuacaccacacuuagaaaaggaggagagaagaagauggugggg

SEQ ID NO: 139788 - RNA, 59 nt, Homo sapiens
gcugcggcaccugcgcuucggcagccugacgaacuguaccuccggcccucagccgauuc

SEQ ID NO: 139789 - RNA, 43 nt, Homo sapiens
cauuuacauaucacuguuaauugacacauuaauauuugaaaag

SEQ ID NO: 139790 - RNA, 120 nt, Homo sapiens
uaacgauggaguggagacugacuuucuaagugguuaauaaaugaguggauauauauacuuauuuguguguagguacauauacaguuguuauggugacuuuuauuuucuucuaugaccuua

SEQ ID NO: 139791 - RNA, 50 nt, Homo sapiens
uaaauacugcaguuaauaguaaguugcagugcagaggugggggcuuacau

SEQ ID NO: 139792 - RNA, 40 nt, Homo sapiens
uucuaugaaucucuauacuuuuccuucucuaaauccccag

SEQ ID NO: 139793 - RNA, 28 nt, Homo sapiens
auuugccacuuaguauuuuaaaaaauaa

SEQ ID NO: 139794 - RNA, 47 nt, Homo sapiens
uuucuuuauuaacccucugaguuuuuguauguauuauuauuaaagaa

SEQ ID NO: 139795 - RNA, 342 nt, Homo sapiens
uccagugagugagguucuuguaccacuucaucaaaaucauggaucuuggcugggugcggugccucaugccuguaauccuagcacuuugggaggcugaggcaggcaaucacuugaggucaggaguucgagaccagccuggccaucauggcgaaaccucaucucuacuaaaaauacaaaaguuaaccagguguguggugcacguuuguaaucccaguuacucaggaggcugaggcacaagaauugaguaucacuuuaacucaggaggcagagguugcagugagccgagauugcaccacugcacuccagcuugggugauaaaauaaaauaaaauagucgugaauc

SEQ ID NO: 139796 - RNA, 37 nt, Homo sapiens
gguuuccucauuuguaaggucguucaguuggacugau

SEQ ID NO: 139797 - RNA, 39 nt, Homo sapiens
ccucagagaugaucaguccaacugaacgaccuuacaaau

SEQ ID NO: 139798 - RNA, 39 nt, Homo sapiens
gucucaccacauaccauguggaugcagcaccucucagga

SEQ ID NO: 139799 - RNA, 90 nt, Homo sapiens
ccaggaaauccagcucuuacucuucaaguucaaccacuguuaagaccuccuauugaguuuuccagguccucagaugggaauugcacagua

SEQ ID NO: 139800 - RNA, 36 nt, Homo sapiens
uuguggugcauuauuuucugauuaagagccagggcc

SEQ ID NO: 139801 - RNA, 42 nt, Homo sapiens
cagaagguuacuaggagugaagcagaucagguacauggccag

SEQ ID NO: 139802 - RNA, 58 nt, Homo sapiens
uuggggucuuucuguucccagccuuccucacagccucugccuaugugcugaugaucag

SEQ ID NO: 139803 - RNA, 49 nt, Homo sapiens
aggcagaggcugugaggaaggcugggaacagaaagaccccaauggccag

SEQ ID NO: 139804 - RNA, 42 nt, Homo sapiens
acgacauacaaaggaauggugaccagcagaaucagcagccau

SEQ ID NO: 139805 - RNA, 45 nt, Homo sapiens
ccccaugggguucacgaugacccaauaccucugcacacugaggca

SEQ ID NO: 139806 - RNA, 46 nt, Homo sapiens
ccaguuguugccauguaugugauaggcaaucuucaaggggaaccag

SEQ ID NO: 139807 - RNA, 46 nt, Homo sapiens
uggccuuggcugaccuccucucugucaucugguuccccuugaagau

SEQ ID NO: 139808 - RNA, 42 nt, Homo sapiens
auugucuacacaauuguguuugugguggguuugccaaguaac

SEQ ID NO: 139809 - RNA, 49 nt, Homo sapiens
guagauccucuaaaggaagaagccuuauugguaagguugauggcacauc

SEQ ID NO: 139810 - RNA, 48 nt, Homo sapiens
uuaaauuauaaaaacaauaugugaucacucgagggaaaaaugagccaa

SEQ ID NO: 139811 - RNA, 46 nt, Homo sapiens
acuaacccuuugggaaaguuacuuugcaagggaauaaaaguauggu

SEQ ID NO: 139812 - RNA, 52 nt, Homo sapiens
ccgcauccuccuggaagccccgacgccgggcgcgcggggaauccgccgccgc

SEQ ID NO: 139813 - RNA, 46 nt, Homo sapiens
agauugcucaaaucagguuuucuuuuaagaaucaaucaugucaguc

SEQ ID NO: 139814 - RNA, 36 nt, Homo sapiens
gaauaagacagagaccugcccucaagagcaaaguag

SEQ ID NO: 139815 - RNA, 51 nt, Homo sapiens
cuaggagguaaugaccaugaaagacuucucuacccaucuuaaaaacaacga

SEQ ID NO: 139816 - RNA, 55 nt, Homo sapiens
uauuccugagagcugcauguguccgcccccgauggaggacuccaggcagcagaca

SEQ ID NO: 139817 - RNA, 32 nt, Homo sapiens
uuacauuuuacacacuguacacauaagccaaa

SEQ ID NO: 139818 - RNA, 50 nt, Homo sapiens
caaauaaguguauuuugaaauuguuugacggcaagguuuaaguuauuaag

SEQ ID NO: 139819 - RNA, 77 nt, Homo sapiens
aaaauaaucucugauucccugauuuaauaugcaaagucuagguugguagaguuuagcccugaacauuucaugguguu

SEQ ID NO: 139820 - RNA, 46 nt, Homo sapiens
gcugucaagcauguauuuuugucaauuaccagaaagauaacaggac

SEQ ID NO: 139821 - RNA, 52 nt, Homo sapiens
ggauaccugcucuaguaaccugaauaacagcauauacaaaaagcuguuaacu

SEQ ID NO: 139822 - RNA, 93 nt, Homo sapiens
uuacuugccaucaacugcccacugcuguuauaacugcugggaucggaacuuucuuugcagcauaagauacuguagacguaccucuggcacuca

SEQ ID NO: 139823 - RNA, 59 nt, Homo sapiens
agaggagguaggcaaaguaggcagccucugugguggaagugugagaaaggaaugaguaa

SEQ ID NO: 139824 - RNA, 24 nt, Homo sapiens
gggaggcugacuacaaacacuccg

SEQ ID NO: 139825 - RNA, 62 nt, Homo sapiens
ugggagcccuuugagauugacuccagcgucuuuuugaccuaacccugauauucuuugaagau

SEQ ID NO: 139826 - RNA, 67 nt, Homo sapiens
aacgccacagcaggcaugaagacuacauaaggaaagugugugggcucuugcuuggagcagccuggag

SEQ ID NO: 139827 - RNA, 64 nt, Homo sapiens
ucaaauauuuucuguaucccuuuccccaagagcagcacagaugaguuguuuuuagccuguaaag

SEQ ID NO: 139828 - RNA, 42 nt, Homo sapiens
ggcccgcuguugucugcccgcacccgggcccgcaggccaggu

SEQ ID NO: 139829 - RNA, 45 nt, Homo sapiens
acagacugaagcaggcggccaccagcagcagccgccgcggcccca

SEQ ID NO: 139830 - RNA, 64 nt, Homo sapiens
gagagagggugaagcggagcagcccgaggcggggcagccucccggagcagcgccgcgcagagcc

SEQ ID NO: 139831 - RNA, 65 nt, Homo sapiens
uggugguauuuauaccauggaaagcaacaaagccauggaaagcaacaaagccaugcaaaucagac

SEQ ID NO: 139832 - RNA, 44 nt, Homo sapiens
ucaacauuuagagcaaaagaacaucacacggagaacuguuacgc

SEQ ID NO: 139833 - RNA, 46 nt, Homo sapiens
cagcucugauuauccgacauggaggcucgacaaccgagcaggagac

SEQ ID NO: 139834 - RNA, 45 nt, Homo sapiens
uuugauuuaaguuucacaauuuguucuuugauggauuauaccuuu

SEQ ID NO: 139835 - RNA, 26 nt, Homo sapiens
uuagcuuucucagggggucagcagag

SEQ ID NO: 139836 - RNA, 43 nt, Homo sapiens
ccgagccuaaugaaagggaaagucagcuuucagagccagugaa

SEQ ID NO: 139837 - RNA, 77 nt, Homo sapiens
aaauuaauacuucauuuggugcuggucuauuuugauuuugggggguaaucagcauuauucuucagaaggggaccugu

SEQ ID NO: 139838 - RNA, 47 nt, Homo sapiens
acauaaaaucugugaauuaaaaaagcucaaugcauugucuuguggag

SEQ ID NO: 139839 - RNA, 46 nt, Homo sapiens
ggaaaaucuguuguuugugaagcugucauuccagccaagguuguca

SEQ ID NO: 139840 - RNA, 45 nt, Homo sapiens
cuagccguuagugguaacuauuguacugacaagaaaccugcugcu

SEQ ID NO: 139841 - RNA, 68 nt, Homo sapiens
auuugcacgucuacagaaacuucauacaaguauagcuggacgcaaccuuuauauccguuuccagucca

SEQ ID NO: 139842 - RNA, 45 nt, Homo sapiens
uugguggaggugccagcagccgaguccuugcagaugggaugacuc

SEQ ID NO: 139843 - RNA, 50 nt, Homo sapiens
ggcaaugagaagaguuuuaaggacaauuagugauaccuuuugggucaagc

SEQ ID NO: 139844 - RNA, 53 nt, Homo sapiens
gcaggaccccuuugcuuagaugaaaaagaauuucagguuccaauggcaacaac

SEQ ID NO: 139845 - RNA, 84 nt, Homo sapiens
augagcgugguguaucuauucgccgacaguuacuuuccaagaagcuuucagaaccuucuucucuccaguaccuaccuuacaggg

SEQ ID NO: 139846 - RNA, 77 nt, Homo sapiens
uagugaugcugagaucauccaguuagucaaugcuaagcauaucccagccuacaaguuggaaacucugauggaaacuc

SEQ ID NO: 139847 - RNA, 65 nt, Homo sapiens
uggugacacaggaaccugaaauugaacuucccagggaaccucggccuaaugaagaaugucuacag

SEQ ID NO: 139848 - RNA, 49 nt, Homo sapiens
aaauaaccagaaaugugauucaguagaggaagagacagggauaaaccga

SEQ ID NO: 139849 - RNA, 69 nt, Homo sapiens
auagcugauccuucuccucaaaacaguacagcagauacuucuaagguuucauuaggacuggaugaaaau

SEQ ID NO: 139850 - RNA, 44 nt, Homo sapiens
cgcgagggucguccaauuuggcagcucagccauuuugcccgagu

SEQ ID NO: 139851 - RNA, 46 nt, Homo sapiens
gguacgucagcuugaaauuaugugcugcuuuggcugcaugucaguu

SEQ ID NO: 139852 - RNA, 41 nt, Homo sapiens
uccuugguuaauuggcaaauugcuuuucuccuaacaagugg

SEQ ID NO: 139853 - RNA, 48 nt, Homo sapiens
guguuuuaauuaucauguagggagaaaagagucaggaauuggacagau

SEQ ID NO: 139854 - RNA, 43 nt, Homo sapiens
cauccuguauauuuacuuccaguuccagaauuuacgucaacuu

SEQ ID NO: 139855 - RNA, 61 nt, Homo sapiens
uccaugaacauguuuacugguaacaauaagaucugugguuggaauuaugaauguccaaagu

SEQ ID NO: 139856 - RNA, 95 nt, Homo sapiens
uaaacauccuuuugcuagugacauuaugccauauguucuauggaaugaaaaaguacaagaggucccugcccuugaggaucuuaucaacuaacaug

SEQ ID NO: 139857 - RNA, 53 nt, Homo sapiens
augcuuuuccauuggucuucuagcacuauuguugaugaaucugcuagaagaaa

SEQ ID NO: 139858 - RNA, 26 nt, Homo sapiens
guaaaucaaaaucuucuauauguucu

SEQ ID NO: 139859 - RNA, 19 nt, Homo sapiens
uagugaaagaaguaagacu

SEQ ID NO: 139860 - RNA, 35 nt, Homo sapiens
uuuuuccuugaauauugcaaagaugacuuuacacc

SEQ ID NO: 139861 - RNA, 46 nt, Homo sapiens
ucuggaauaccagcuugagcagcagaaugcuagaucuuguugggau

SEQ ID NO: 139862 - RNA, 93 nt, Homo sapiens
uaacacuuaucuuugucagagaacuuuggagcucuagcuucauaagugaaugaagagaauagauaugacuuaaaaaacaacauguaauagaau

SEQ ID NO: 139863 - RNA, 50 nt, Homo sapiens
auuccuuuauggucuaguuucuagacuauagauagccacauuauggaauu

SEQ ID NO: 139864 - RNA, 86 nt, Homo sapiens
acuuaugaauuuauuuuccucuccaugcagugaaaggcauuuugcaauuuagagauaaucuagcaaagaccuggacaguacuuugg

SEQ ID NO: 139865 - RNA, 49 nt, Homo sapiens
uaauuucugcaguaggaggaggucgauguacuccauucuuaaguagucg

SEQ ID NO: 139866 - RNA, 145 nt, Homo sapiens
agcggggcggagaugggugggagcgggguuugggcuguguugguggcaauucuggagcuucccucggcccugggaaguggcuaccggcagcuccugcggaccuggagggggcugcgguugcgcuuugucgguguggcagcucgga

SEQ ID NO: 139867 - RNA, 99 nt, Homo sapiens
cccaccuaagucacaaaaugagggaaguggggaguuagauuucagaguccaggcccuagguugggacccacuccaaauaaucuccucgguguggguggu

SEQ ID NO: 139868 - RNA, 42 nt, Homo sapiens
auaugugugugccuagguccuccuucugcacgauccaauagg

SEQ ID NO: 139869 - RNA, 896 nt, Homo sapiens
caucauagccaaagaggcacguagcgauuaggcccaguaccugggggacaggauaggagugaggggguuuagauuagcuggucagguuacucagucucuuaucuucuuguauccaccaccuccagcaccugccccacgcaggaugggacucaagcaccggguugguaagccagggaaaggccaagagagugcauccuaccccacucucccuccuccuauaccucucaacacagggaggccacacuguggcccuacccguagggggcacaauucaagucauacuuuuuuuuuuuuugagacacaguaucacucugucacccaucugucacuggggcuggagugaguggcaugaucuuggcucacugcaaccuuugucuucuggguucaagugauucuccugccucagccuccugaguagcugggacuauaggcgcccaccaccaugcccggcugauuuuuguauuuuuaguggagaugggguuucgccauguuggccaggcuggucuugaacuccugaccucaagugaucugccugccucggccucagccucccaaagugcugggaauacaggcaugagccacugcgcccggccccaauuucuacuacauuugggacaaaguucuugcagaugguagucuagugcguugacaaaggggccgccuguuuguaccucucaccaagguccuugugucugacaagggacuucccuucacagcaaaugaagaccuugggaggcaaaaccaaguccugggccagacuuuccuccaugucugaggacaagugugacuugcugugggucacacgauuucugccagaagcaaaggcagaaauggucccuggcuccucaaacccuucgcucugugcuucagagcugcucccauggccuuuaccccug

SEQ ID NO: 139870 - RNA, 152 nt, Homo sapiens
ccuggagugugagaagggguccacaauggcaagaccagggaggggucugggcaguuaggauugucggggaacugugguugcugacuucccucuucuccucccuacaccucacaggauuucuuccgaacccucauagcggcaauccucuaccu

SEQ ID NO: 139871 - RNA, 152 nt, Homo sapiens
agaaauccugugagguguagggaggagaagagggaagucagcaaccacaguuccccgacaauccuaacugcccagaccccucccuggucuugccauuguggaccccuucucacacuccagggccaguugaugaaugguaucuuggugugcag

SEQ ID NO: 139872 - RNA, 87 nt, Homo sapiens
gagguguggcugcccgaggcgguagagcggagaaagccuauuuucuuuucguuuagauacauugccuuuugccuaggcuggcgucga

SEQ ID NO: 139873 - RNA, 47 nt, Homo sapiens
cagaauaggcuaaacuuuuggccaagacaaugaaggaagccaaagaa

SEQ ID NO: 139874 - RNA, 30 nt, Homo sapiens
uuggccuugcuuccacuucuacagucacaa

SEQ ID NO: 139875 - RNA, 46 nt, Homo sapiens
uacauccugaauuggggauccaagcaaugguccuagacaagggaaa

SEQ ID NO: 139876 - RNA, 49 nt, Homo sapiens
uggcccaaaauggacuguaaucuaaagaacacugaagauccaauauugg

SEQ ID NO: 139877 - RNA, 64 nt, Homo sapiens
gauauggcuaagccacaaaaguggcaacaucacuuuucccuaauagucaaaagauaaucagcag

SEQ ID NO: 139878 - RNA, 69 nt, Homo sapiens
uaaauccagccacuccacugcuuuugcugacugauacucaaguucuuuuguagaaacuugaaauuccac

SEQ ID NO: 139879 - RNA, 52 nt, Homo sapiens
aagaguugcccuuucugaccgugacaaaucucaucccauaaaugucagauaa

SEQ ID NO: 139880 - RNA, 44 nt, Homo sapiens
aauacuuggaagagugaaaaggcaagucuauuuucauaugguug

SEQ ID NO: 139881 - RNA, 24 nt, Homo sapiens
uugcaugcaggugaggcuggagca

SEQ ID NO: 139882 - RNA, 61 nt, Homo sapiens
gcuucaagaacuuuauuaguucuuucuccuuuugucugagucugagggagaauacuguuag

SEQ ID NO: 139883 - RNA, 47 nt, Homo sapiens
ucacacguuccaccucaucaucagugaguucucccgcccucuuggug

SEQ ID NO: 139884 - RNA, 57 nt, Homo sapiens
cucgcaaaauaugcuggaacuuuucagggaucacuagcgacauggcggcagcacaag

SEQ ID NO: 139885 - RNA, 47 nt, Homo sapiens
gcauuuacuuucugugcuuuaaugcagugaagucugucaucaugcuc

SEQ ID NO: 139886 - RNA, 39 nt, Homo sapiens
cuugacuccagagugaaaggauaauuaggauugauacag

SEQ ID NO: 139887 - RNA, 47 nt, Homo sapiens
aacuccugacauauacuuuuaacuuugggaaaaguccacaaauuccu

SEQ ID NO: 139888 - RNA, 54 nt, Homo sapiens
uguuuacaaaaugauauuauaaauaaauaaaauacuucuucugucaguuugcau

SEQ ID NO: 139889 - RNA, 39 nt, Homo sapiens
aacuuggucuagcuaauauaaacagaauggaagggaaag

SEQ ID NO: 139890 - RNA, 46 nt, Homo sapiens
uucaguuugccucauucuuggaagccucaucaaaauucuccacaag

SEQ ID NO: 139891 - RNA, 46 nt, Homo sapiens
ucaucaucauccucuccaguagcaaguggugcuuuuccauccacag

SEQ ID NO: 139892 - RNA, 116 nt, Homo sapiens
uuaaacuagucagacuauccgcaccaagcugguuuaagaugcuggguagcauuucugucagcugcuuugucucagcauggccuguaauggugaaaguguucgcugccagagaugcc

SEQ ID NO: 139893 - RNA, 46 nt, Homo sapiens
uuaaaguggaucacuguuccuugguuuguaaacauauucaccuauu

SEQ ID NO: 139894 - RNA, 52 nt, Homo sapiens
cccuaaagucagggagaagaggaaagaaaacagcacauuuauaccacaacag

SEQ ID NO: 139895 - RNA, 46 nt, Homo sapiens
aaugcgcacuugugccugcaguuuggcgaguuuuuccugguucaug

SEQ ID NO: 139896 - RNA, 30 nt, Homo sapiens
aggaaauccucagcaaggauagguuuagcu

SEQ ID NO: 139897 - RNA, 64 nt, Homo sapiens
guggaccaccugagauuaggcgcacacacgcggggacgcaagauggcagcuaaagggaggccgg

SEQ ID NO: 139898 - RNA, 46 nt, Homo sapiens
gccuuuuuguggucuuaaccaugaaaugucuuugcauauucaaaag

SEQ ID NO: 139899 - RNA, 45 nt, Homo sapiens
cuuuuuacauauaaguuuguugcaacugaugucucaagaacauaa

SEQ ID NO: 139900 - RNA, 74 nt, Homo sapiens
ucguuuguagauucaguuacauccaucugucaucugaagaaggaggaaaaaacccaucauuucuuggaccaaaa

SEQ ID NO: 139901 - RNA, 48 nt, Homo sapiens
uacacugguggaacugaguggaaaaugcuguuugagaccaugccagaa

SEQ ID NO: 139902 - RNA, 51 nt, Homo sapiens
ugaacacauucuaagucuaauauauuuugcagaaagggaugagcugagcag

SEQ ID NO: 139903 - RNA, 42 nt, Homo sapiens
gcuugcuguuucuugaauauaccaaauaugcuuuuaccuugg

SEQ ID NO: 139904 - RNA, 56 nt, Homo sapiens
cauacagcuguuucuuugauauuuaguuuucccucacuauaaugcaagcucaggag

SEQ ID NO: 139905 - RNA, 28 nt, Homo sapiens
uccagucaaagacuuguugacuggacaa

SEQ ID NO: 139906 - RNA, 29 nt, Homo sapiens
gaagggaggauauuugaggaaucccaaag

SEQ ID NO: 139907 - RNA, 49 nt, Homo sapiens
auuuuuuugaacuccauggaaaaugguguuuaaagaggggaggagggga

SEQ ID NO: 139908 - RNA, 42 nt, Homo sapiens
cucuguagaauuuuguuuaagaauacuaccaaaaaggucaug

SEQ ID NO: 139909 - RNA, 19 nt, Homo sapiens
gaucagcuucuaguacccc

SEQ ID NO: 139910 - RNA, 50 nt, Homo sapiens
gacucagaguggacuaaguggguggacaaaugcugggagcaugccuuaga

SEQ ID NO: 139911 - RNA, 46 nt, Homo sapiens
gcggucuugcacgggagcuggagguggguccauguguuuguacgug

SEQ ID NO: 139912 - RNA, 48 nt, Homo sapiens
ucaucacacugucggcccuguugcuuuccuccuggaggcgguggggcu

SEQ ID NO: 139913 - RNA, 45 nt, Homo sapiens
acauccugacgggcuucugagggggacuucuuuucugcaguguag

SEQ ID NO: 139914 - RNA, 67 nt, Homo sapiens
cuauucaaggcuagaugguguugcauuguaucgaauaacacugaggcacggaagccauagggcucug

SEQ ID NO: 139915 - RNA, 45 nt, Homo sapiens
cuucaguuggcccauuuucagugaugugaagcacgccugcaccca

SEQ ID NO: 139916 - RNA, 42 nt, Homo sapiens
agaucugugaucuugaacggguguccuggacuuugcaguuuu

SEQ ID NO: 139917 - RNA, 46 nt, Homo sapiens
agucaucuacuucuguggaauguggggagccaaccucagcaugcag

SEQ ID NO: 139918 - RNA, 42 nt, Homo sapiens
cuuuucccuuccuguuugucuugguaaagacuaguagaaguc

SEQ ID NO: 139919 - RNA, 55 nt, Homo sapiens
augacuucuguagggagaugacuggauuucucgucaguaggagauugauaguaag

SEQ ID NO: 139920 - RNA, 44 nt, Homo sapiens
ugaauuugucuuccuccauggaagaggguggugauaugguagag

SEQ ID NO: 139921 - RNA, 95 nt, Homo sapiens
uggccacagacucccucuucucccugauguaugcaucagccuccgccuuggcacuuuccucauccucaguggggcugugcuuggaggcgcucaca

SEQ ID NO: 139922 - RNA, 46 nt, Homo sapiens
uucuugacagacucuuccuucuuggguacuuuugguuuuaaagcag

SEQ ID NO: 139923 - RNA, 45 nt, Homo sapiens
uggcuuuuccacgugauucacuuuugugaccucagggguuucuuc

SEQ ID NO: 139924 - RNA, 45 nt, Homo sapiens
cccucuguuucaguuuuguuuguuucaccacaggagugggcaccu

SEQ ID NO: 139925 - RNA, 45 nt, Homo sapiens
uggauuuuugagauuuucagguacauugagaaauacaacuccuaa

SEQ ID NO: 139926 - RNA, 44 nt, Homo sapiens
ucauccccaaugugggugagcaggauggaguccacucggucuaa

SEQ ID NO: 139927 - RNA, 46 nt, Homo sapiens
agggcuuggagagcuucagaaauccacccgaugugggagguuccaa

SEQ ID NO: 139928 - RNA, 46 nt, Homo sapiens
ugagagauacucgguaaacucagaaaguccuuccauuucuggcaag

SEQ ID NO: 139929 - RNA, 47 nt, Homo sapiens
aggauggcauucuaaagggauaaauguaagguucaauaaaccagcag

SEQ ID NO: 139930 - RNA, 42 nt, Homo sapiens
cuacaaauaaaccuacaaggauuaggaacugggaagguuuaa

SEQ ID NO: 139931 - RNA, 40 nt, Homo sapiens
gaaacaaaagacaaaucugugcaaaaagaagcagcaaaca

SEQ ID NO: 139932 - RNA, 373 nt, Homo sapiens
gauggugcaacagagaaggcaauugucuauuuaaaaaauuacguuuucagccaaaugcaguggcucacacuguaaucccagcacuuugggaggccaaggcaggaggacugcuugaggccaggagauugagaccagccugggcaacuuagcaaggcccugucucuacaaaaauuuaaaaaugaaaauauaaaauuaguuguuugccuuggcaugugccuacagcccuagcuacuuaggaagcugaggugggaagauuacuggagcccagaaauucaaggcugcagugaaccaugacggugccacugcacuccagccugggcgcagagugagacccuuucucaaaaaauaaaauaaaauaaaaauuauguuuuca

SEQ ID NO: 139933 - RNA, 46 nt, Homo sapiens
ugaguucuugguccaaguugcauucaaucagguuugugucccauga

SEQ ID NO: 139934 - RNA, 44 nt, Homo sapiens
acaucaacaacaaaaaauugcacuacaagccugccccuaacagu

SEQ ID NO: 139935 - RNA, 45 nt, Homo sapiens
ugaagcauuuuauaaaucgcuuuugauaaucaacugggcugaaca

SEQ ID NO: 139936 - RNA, 65 nt, Homo sapiens
aagaagaugguuggagacuaugauagacagaaaacauagaaggcugaugccaaguuguuugagaa

SEQ ID NO: 139937 - RNA, 64 nt, Homo sapiens
gucugcagauuacaaaaguaagaagaaucauugcaagcaguuaaagagcaaauugucacacauc

SEQ ID NO: 139938 - RNA, 41 nt, Homo sapiens
uaggcugcugcugaugaauacaauagacugaagcaagugaa

SEQ ID NO: 139939 - RNA, 42 nt, Homo sapiens
acaacuguacaagaggaauuuugacacuggccuacaggaaua

SEQ ID NO: 139940 - RNA, 46 nt, Homo sapiens
aaagggacuaaaccuggaagagcucaguaugauaguuuauguaaau

SEQ ID NO: 139941 - RNA, 45 nt, Homo sapiens
uuaaggaaaucuaggaagauagaugaaauuuuuuucugguuaauu

SEQ ID NO: 139942 - RNA, 42 nt, Homo sapiens
ccauugccauuguacugggguucaugauuauuguggcuuuug

SEQ ID NO: 139943 - RNA, 45 nt, Homo sapiens
guccaccucucccucccugcuuccucuggcggaggcggcaggaac

SEQ ID NO: 139944 - RNA, 67 nt, Homo sapiens
aauacucaaauacaaaagguaucuuuuuuaaaaaguuaguuuacugcuuccuuaggcucuuucuaaa

SEQ ID NO: 139945 - RNA, 42 nt, Homo sapiens
auacugaagaaucucuucuuccaguuaugcagcaccuggcua

SEQ ID NO: 139946 - RNA, 46 nt, Homo sapiens
gccucuaccuuugcacuuccuucggagagcaucuaagauuggagag

SEQ ID NO: 139947 - RNA, 58 nt, Homo sapiens
acauaaagcucagguucuaaguuuagaggcuuaagugaaaagaucugagaugauaaug

SEQ ID NO: 139948 - RNA, 54 nt, Homo sapiens
gaccugugucaggcuuucucugauguaauucuugcaguaaaugauguggaugca

SEQ ID NO: 139949 - RNA, 46 nt, Homo sapiens
gauaucucuuuguuucaagguugauacugccucuccaagcccaaug

SEQ ID NO: 139950 - RNA, 46 nt, Homo sapiens
gcaaaaccuucagcuacuggaaaagucauugauaaaaaacuaccaa

SEQ ID NO: 139951 - RNA, 39 nt, Homo sapiens
guagaggucggcggaaacugacuugucacggccgcagag

SEQ ID NO: 139952 - RNA, 73 nt, Homo sapiens
ggauggagggaggaaggugagaaagagaacuggacggauauuggauaaauguuuuggggagguggagagucga

SEQ ID NO: 139953 - RNA, 55 nt, Homo sapiens
uugguuucugcuggguguagguccuuggcuggucgggccuccgguguucugcuuc

SEQ ID NO: 139954 - RNA, 54 nt, Homo sapiens
agaccccgcgacaggggcagcggcggcggcucgugagccccgggauggaggaga

SEQ ID NO: 139955 - RNA, 66 nt, Homo sapiens
gggccuggaguacugguaaccguuguugcuagaggcccuggaauccaacugugugaggacagaaca

SEQ ID NO: 139956 - RNA, 49 nt, Homo sapiens
aggaagaagaugacacaaaugaugaagacuuuaauguggaaauaaggca

SEQ ID NO: 139957 - RNA, 44 nt, Homo sapiens
acuugccaacguagcaccaccaauuaguggcaaacagagccuaa

SEQ ID NO: 139958 - RNA, 881 nt, Homo sapiens
uuaugaccagcaagugccuuacauggucaccaaugugagugaucaguuugaaaguugcuguuuauaaacuugacuccgucggggguggggagagggagaaaaugagaagggagggggcacggggguugggauugcagauacuuaucugcuuuguugccacuguagggcgacucugcuucuagaagcccagucuucaaaaugagcuuaccuuucagugauuuggauaaggcauaguuuuguuuuuaagaccccuuuuucugauuaaagugcccaacaugaguggaagaggagauggagggcagcagcagcugcugcacucaaaguuuuuggcuggguuugucugccacauugaaaagaaugaaguugagacaaaugcugacacuuuuuguuuauaugggguguuuuuguuucuuuuuuuuuucucauuuucucuuuuuuuuuuuuuucauuucucuacucuuuuugcuuuuuuuuuuugugggggugggguggggaggaggggcuguccaagagagaauaaaacccacuguuuuaaucuagcauugaaccagccuaaaaacaacuuuaaguguaaaugcuucagguuguuuugaugcugagauaccaugaauauaugauugauaaauaguaaugugcuaagaucggcacugggaagcaacucucccugccugcuuaacauaagcuuucacugucaaauaagugagaaaaugaauauuagaguugauacuauggacuucuauuuuucuauucagagaagauccauuagacuuauguaugcaugucugugugugugugugugcgcgcgcgugugcgugugugugaucugagguuuacauucuuuuaaaggauuuuaucuuucccuuuguagagucagcguggga

SEQ ID NO: 139959 - RNA, 4012 nt, Homo sapiens
gcggcgaaaucuagggaauaagagaguguguuucagaugaaacgguaacauggaacauucuuuaaaauacggauacgguuuuccauuucuuagugaacgaacaugauaccagcugaccugaagcguaaaucuuuaacaagcauuacguuuuucuuuccuggauuaguagcucuauguuuuuuaaucauaugacuuauauucccuuucuaaucagucuuuugcagcacuguugcaguauaugaguuaaagauguacuuugaguaaggauuggagagcaaugaaaaacuuugaggauuuuacacacccacacacacacacacacacacacacaacgauuaauggcuaaaaugccuaguucuaaaucaauuggaucacggauaauuuccacacaagauucuuaaaucauuauauaccagaaaaagaucucaaacugcauccucuaucuuuuaauucuguuaccaaacugaucaauaaacaaaaaaccaaccaaccaaaaaccugcugagaaagcaagagaggaaugacuuuuuucucaaaucaggacuuucaauuccucaacaauguccuaauuaacauugcguucuaguaagaaacaaaacuagguauuauaaggacucaaacccaagccgguuguaaaaagacuaccucuuuacugucaaacagcaaugcagaccauauuggcuuccaauagauucaaauacaguaucagguugauaaaaauaagcauaaaugcacagcugaucuccaaaggugaaaauaacauauaguguuguauagguuuggggcaagucccgcuguuaggacaugaggaaguucugaggccucagcagaaggcuagaaaugaguccuaugccucuuuguucuugguuauacuuuauaacaauuggcuaaucacauaaucguucuguucuguguuucucauccauaauaucauugacccaccacaaagauguggauuaauuaaagauuuaaaagugcucuaaaaaugccccaggagugcuuaaaaauaaccuauaaaacauuucuaugagcaaauauaagccuaauaacccccccacuaaaagcauuccugagacuuuaauuuggaaaguuagcauuuaauuucgguaauguuaaauaaaaauaagguaaaagcuaaagaauggcaaagcgauugcuuuagcauuucuaagaacacuccauccugugauuuaacucuaggcucacugguggucauggaaagcacugaaauuccaccuacaccugcagaaaauaaacuuagaaacucggauauugcagagcaguuaggcugacuggcacugcauucauuucccuucucuugcuuauuucauuagccaaaaaaagaaacagaaauuaucauuaagaacugucaaggagugaaucagaaaauuguaacuugaaguuaaaauaagaaacuggcucacuugugaagccuuaaaaggaaguuaauaauacuuguaacugaaagcuuuguaaggaaucaagccauuuguuuuuacgagucgaccugauuccaguuggaaguugcuggggaacauguauauaucaaacacgcaugcuucucaggaauuugcaagguuuuggugcaauucuuaggagccacugaccaaugguaaagagaaagugauucaagaagcuucuggaaaggaguuaacagauaaggagaacaugcugaugaacucccagauaaagaaaaacaggguguaagugguggaaacacugagaaagagagacagggcuccugcacaguggguucaggaaaaagugccaaagggcuggccccaggagcagagugaggcugaggaaaggaagcagggugcaggccaguuggccguaaagcauucccagagugaaguggggugccuggcuggaggggguguuuuggggaaaggaucuguucccagagcaaauuugccauuuauaacugagggacugucauuuguuggccagagcccucuaagaaauccuccucagaaacauacggcuuuagagauuuuccugggacuggccagcugguacuguccucaaaacucagucaggggucagugggaaaagaccccgagcuucccucuuggaguuccgggccggcuguucucagucucaaauaucugacuucaaguagagaaacuaaaaugaauuuggcuaaagcauuucaaguuaggucaccuaaaaccaggcacacugcuuauucagcaggcaccuucccuaagaaauaaccaguuugcacaaaaagcgaauuauacaaucuauaauucuggcacugaucagaagagugagauucaguuaucaagaacucagaagucaccaguaguggagaaaauaaaacuugguuuguucauauuuuuuuguucccuuucagcucugcacaauguccaucuguuuaauggcccacccugcaauaagaauucuuucaucuguauuuacaaaacuguuuacacagaugcacauaccauugcacucugacaaagucucaaggcuacagggugagaagaaaaagauaauaggaagcauuuaauaacuaccccacaagaggacuuagugauggaaccaaggguggaaaagacaaggcuuuguaucacauuguaaagaacgcuuucaucuuacgcccuuuauagcaaaaugaguuucugaauuugagauugagucccaugaaaaaaccuauaaaaagcacauuugagugcucccuuauuuucagaaaguugccaguggcacaucuucugcuuuccucugcugaucuagaagauuccuuuggcugaguuauuuuuacaacggugucucagggccaguuugcacugacuuauugucaaacuugcaggaauuuuuugagccaguucuuaaacacagccacuauuaacaguuaaauuauauaacuucacaaucaaaaaauauguuaaaaacagaagauaaaaaugcaaaacucaucacuuucuaauuaucuuacuacauuucauuaccaauuauacaccugagguuacuuaugucucugguauccguaugcuagaaauacuacauuacgcugugcuauugcaucuuugcaacucggcauucaggguucucacagugauggcucguagugggccaugaaagcaauauguacaucacagacccagcaaaagcuacugaugagggcguuuuguuuuucucucaugcaggcuguugcuaaacauuuaccagcacgccacugcauacagaagcacagggcagaagagauaaagaaggagagaugcuguauauaagcaaccugauuuuaagcuguauauuaagguaguacaucucagaaccucuacagguuuuauuuaguauuuuacuuaaauaugaauuucuuaaucucaaggagucaugaauuaccuaacgcaguauucuccuuagaucuaugcuaugcuucuugccuugcuccuuucuaaguaauacuaauugagucucuaucucuuuaauuguauauucgcaguguccagagucaugcgucuacugauauuaaauauuaaucaccuggaaaagauggucaacaguuuuaaucaaauaaguuauauucugcaaaacuauguacagcugaaccauucaauauaagguagaaaaccuaauuccauaagcuaccuacuaaaauuagucuccuaacuuuacagaacaaguacacacauaugcucauaaaaaugggaugaucugauuuaaaguuuaagugaagcaauuuaauucaagcaaagcgaaagggaaaugcucaaaugucaguagauagauuaauuuuccauuuuagcaaccaauuuaaauguuuauaaaaggaauguuuauaaaugacuuucuccacaaauuauaaguauagauagagugagcucuuucuaaaaauauuuugcacagaugugcaaaauuaauaggcucaccuuaaaucuacucuaggccuucagaauuguuaauagaaauuuuuuccaagaacgcaaaaaacaguuucuagaaaacugguaucugcagguuaccugugguccaugggguagcugcuaucugguauggacugcgaugg

SEQ ID NO: 139960 - RNA, 72 nt, Homo sapiens
uugguacauaggacguccuucccuuggcaucgucggcaaaggaggaaaggaguuacaggguucagaaagcug

SEQ ID NO: 139961 - RNA, 46 nt, Homo sapiens
gguacuguucaaaaaggaaugccccacaaguguuaccauggcaaaa

SEQ ID NO: 139962 - RNA, 46 nt, Homo sapiens
uaagagccgagauagcuuccugaaacgugugaaggaaaaugaucag

SEQ ID NO: 139963 - RNA, 48 nt, Homo sapiens
auaauggaacuugugguuagagggaaagaaccacuguacagaauauaa

SEQ ID NO: 139964 - RNA, 45 nt, Homo sapiens
uuccucauaagcacuguggacaaaaaaagcggggaagacagcaag

SEQ ID NO: 139965 - RNA, 54 nt, Homo sapiens
caaaaagggagaaggaaaauaaaguauucauugcauaaauacacaaaauuagau

SEQ ID NO: 139966 - RNA, 46 nt, Homo sapiens
uccucgugacuggagagaacaaguacuucgacauauugaagccaaa

SEQ ID NO: 139967 - RNA, 70 nt, Homo sapiens
ucuuggugauccaggcucuacaaggcgggcucagauuccugaaggagauuauuuaucauacagagaguuc

SEQ ID NO: 139968 - RNA, 43 nt, Homo sapiens
aacaaaggcaauuuucaaguuugauucaaaucauaaucccgaa

SEQ ID NO: 139969 - RNA, 45 nt, Homo sapiens
gaaucuuaauaaacuuauaacuaaugauacauuucaaccagagau

SEQ ID NO: 139970 - RNA, 98 nt, Homo sapiens
uuaagaauauggucaaaacuguucaaaccauuguacauagauuaaaagaugaagagaccaaugaagacucaggaagagauuugaaaccacaugaagau

SEQ ID NO: 139971 - RNA, 67 nt, Homo sapiens
gaggaaacagcgggcucaaguugcauuugaaugugaugaagacaaagaugaaagggaggcaccuccc

SEQ ID NO: 139972 - RNA, 74 nt, Homo sapiens
gcacagauguuuuuauagauuaugguaugacgaccuuuuagacuaacgagcaaauuguuuuuaguauauguugu

SEQ ID NO: 139973 - RNA, 47 nt, Homo sapiens
cuauaaauacuacucuuaaauucuuuucuuuauuuugcccgacaagg

SEQ ID NO: 139974 - RNA, 41 nt, Homo sapiens
aauggugcuuaccaacuacauguucccucaacagccaagga

SEQ ID NO: 139975 - RNA, 56 nt, Homo sapiens
uuuuguacccuuugaccaauauaucccaauccauguuccagcccaccccgccagcc

SEQ ID NO: 139976 - RNA, 45 nt, Homo sapiens
ucaucuauugggcagcuuacuaacuuaagaacuuuugcugcugau

SEQ ID NO: 139977 - RNA, 42 nt, Homo sapiens
aaugguugaagaaggaauuucaacaugugaaaaccuucaaga

SEQ ID NO: 139978 - RNA, 46 nt, Homo sapiens
gcagauuaacuaaacuccaaauauuagagcuuagagaaaaccaguu

SEQ ID NO: 139979 - RNA, 46 nt, Homo sapiens
cugaaugaugcuuuucuugaguucuugccagcaaauuuuggcaggu

SEQ ID NO: 139980 - RNA, 66 nt, Homo sapiens
cuuuuuaacugucagucuuuacacaaacugaguuugccagacaaugauuuaacaacguuaccagca

SEQ ID NO: 139981 - RNA, 55 nt, Homo sapiens
uucaugaaauauuuaaagauguauauaauugacauucuuuccucccuuuuuucaa

SEQ ID NO: 139982 - RNA, 29 nt, Homo sapiens
acuuuuauauaaauuagguauuuaaagag

SEQ ID NO: 139983 - RNA, 47 nt, Homo sapiens
cacacaaccuagaauaaguugguuugacuuuccucuuccuuauagau

SEQ ID NO: 139984 - RNA, 43 nt, Homo sapiens
ucuguagguauaccccucccagguuuucagcacugcuauagau

SEQ ID NO: 139985 - RNA, 46 nt, Homo sapiens
uacaggugcuuacuguuccucaggaggcagucuccuuuuuucauaa

SEQ ID NO: 139986 - RNA, 45 nt, Homo sapiens
gaccugugguguuacagugaagcaauagaaaaauggaaagaugac

SEQ ID NO: 139987 - RNA, 47 nt, Homo sapiens
ugaaacuauaaguauuuucgaagcuuuguuuaaacugugacaaaggu

SEQ ID NO: 139988 - RNA, 47 nt, Homo sapiens
auaacucaucuacuuuaugauuuuggaacguaucauuaggcugcaaa

SEQ ID NO: 139989 - RNA, 52 nt, Homo sapiens
guguuuuacguuaacuuuaauauuggauucgguaaucuguaaaguugaacag

SEQ ID NO: 139990 - RNA, 71 nt, Homo sapiens
uuccaggauaccucauacuuucuuggcuuucuuaucucauuguuugcuucuuuucuguccccuuuucuggu

SEQ ID NO: 139991 - RNA, 44 nt, Homo sapiens
aauaccccuuauuuauaugcuauuucccaaauuuaugcccucag

SEQ ID NO: 139992 - RNA, 42 nt, Homo sapiens
ggaaagaguggaagaccagguccagauugagauggugauuag

SEQ ID NO: 139993 - RNA, 57 nt, Homo sapiens
ucggauuugaaggaccaguagaacuuggauaggcagaggagaggggaaggcauuuca

SEQ ID NO: 139994 - RNA, 21 nt, Homo sapiens
uggcuaugaguggaaagaaua

SEQ ID NO: 139995 - RNA, 16 nt, Homo sapiens
ccccaagaaaccuucc

SEQ ID NO: 139996 - RNA, 35 nt, Homo sapiens
guaccuuaaauucuccuacuguguccuuuacaaac

SEQ ID NO: 139997 - RNA, 46 nt, Homo sapiens
cagacauuaauuagcuuaguauuauaaauugagucaucaucaucgu

SEQ ID NO: 139998 - RNA, 42 nt, Homo sapiens
accuaaaauauguaugcuuuuaaaauuguuuaaagagcacau

SEQ ID NO: 139999 - RNA, 32 nt, Homo sapiens
caguuuucuguauacuuuuaaaacuuuucuuu

SEQ ID NO: 140000 - RNA, 46 nt, Homo sapiens
cauaauucaguucuaccaagaauaaagugaaaagaggaagaagauu

SEQ ID NO: 140001 - RNA, 51 nt, Homo sapiens
guugucaaacuagcccacucaugugcugugucugcaaagaauauggaaaac

SEQ ID NO: 140002 - RNA, 45 nt, Homo sapiens
uggaauugugcagcacauugaaggaggagaacaaaucguggaaga

SEQ ID NO: 140003 - RNA, 66 nt, Homo sapiens
uggaggucagagaaguccuuauagaagaaaugguguuuaaacugagauuugaagaauuucagucag

SEQ ID NO: 140004 - RNA, 46 nt, Homo sapiens
agguuguuuuaaauguagaaaaugaauuggaggagcaacaaaauug

SEQ ID NO: 140005 - RNA, 56 nt, Homo sapiens
guuaaaguuuucuaguuaaaauacuagagauguuuauggccuauaauacacuaggg

SEQ ID NO: 140006 - RNA, 47 nt, Homo sapiens
gucaugguggugggcucuuuucuggcucuaagauaucagcaucucag

SEQ ID NO: 140007 - RNA, 46 nt, Homo sapiens
uagcugguauauucagggcugugaugcucgaagugguaugggacug

SEQ ID NO: 140008 - RNA, 47 nt, Homo sapiens
ucgcaauauuucuaauccugggaggugauaaauugaaauggacuaaa

SEQ ID NO: 140009 - RNA, 45 nt, Homo sapiens
uggaaguuguacagaggaucuccaacgucaaagucaaucccaaaa

SEQ ID NO: 140010 - RNA, 47 nt, Homo sapiens
auggguaaauacuuuuaagaugagaauuucauuuacaccuuucaaaa

SEQ ID NO: 140011 - RNA, 45 nt, Homo sapiens
uugcccaggggaugcaauuucuucaguugcugcuuccgaaaagag

SEQ ID NO: 140012 - RNA, 47 nt, Homo sapiens
ugcccuuugagaauacuuggaagaguauauuucagacuuugauagaa

SEQ ID NO: 140013 - RNA, 42 nt, Homo sapiens
ggaagcugguauagaaaucuggaugagauaugguggcuugga

SEQ ID NO: 140014 - RNA, 122 nt, Homo sapiens
gaauuucgaacucuuauuuagguaugcaaaaggguaccaguucucuuuaaggcuuuaguucaggagugguguuaauguauuaauguguuggggcgcgagaggaaggcggugcuuauuucgaa

SEQ ID NO: 140015 - RNA, 46 nt, Homo sapiens
agccagauccgaagagggaugauguguggaguuuugugcccucaga

SEQ ID NO: 140016 - RNA, 44 nt, Homo sapiens
gcuggcaguagcaguggcggugucccaggagaacgaugaggaga

SEQ ID NO: 140017 - RNA, 46 nt, Homo sapiens
aagauucaagggccagaucuugaugcccaacauugguuaugggagc

SEQ ID NO: 140018 - RNA, 40 nt, Homo sapiens
gcaucauggccgcccucagaccccuugugaagcccaagau

SEQ ID NO: 140019 - RNA, 41 nt, Homo sapiens
ucaguccuggcgugacguuucguggcccugguuggcgcaga

SEQ ID NO: 140020 - RNA, 46 nt, Homo sapiens
aaugcuguuucguauuuucuuacaggacucauguucaacacgggga

SEQ ID NO: 140021 - RNA, 364 nt, Homo sapiens
uuucagccaggcgcgguggcucacgccuguaaucccagcacuuugggaggccgaggcagguggaucaugaggucaagagauugagaccauccugggcaauauggugaaaccccaucucaacuaaaaauacaaaaauuagccgagugugguggcaggugccuguagucccagcuacuugggaggcuggggcaggagaaucacuugaacccggaaggcagagguugcagugagccaggauugcaccacugcacuccagccuggugacagagugagacucugucucaaaaaaaaaaaaaaaaaaaaaggaaaauaugagauauuucagugaggaaaacagaaaccacauuagguauuucaacaggga

SEQ ID NO: 140022 - RNA, 36 nt, Homo sapiens
caagucaaaaacuagugguuauaaaauuaaugaguc

SEQ ID NO: 140023 - RNA, 48 nt, Homo sapiens
gcgaugugauguuugcuaucuuuuuagcuuccaguuuaauuagaacag

SEQ ID NO: 140024 - RNA, 95 nt, Homo sapiens
uucccaguauuccuaugauuucuggacaauuaaaauuuccaguuccuuuuucauauaccuggugcuuaguuuuaagcuauuuuaaaacugucaga

SEQ ID NO: 140025 - RNA, 45 nt, Homo sapiens
uccacagaguaaaucaguauuucuacagaaaaaugucagagaagu

SEQ ID NO: 140026 - RNA, 37 nt, Homo sapiens
aagauuuguggaaggagaacuuucaaaagccaggaaa

SEQ ID NO: 140027 - RNA, 42 nt, Homo sapiens
gccagccggagcuuguucaccuucagagucugugcagcaccg

SEQ ID NO: 140028 - RNA, 52 nt, Homo sapiens
uacuccaugucucagccagucauuggcugauguuugcccccaagucccaagu

SEQ ID NO: 140029 - RNA, 22 nt, Homo sapiens
ggcugccaugacagauugguua

SEQ ID NO: 140030 - RNA, 58 nt, Homo sapiens
aauuuagcuuauucuaaugccuuuauauuuccuacuuuuauucuccuuuugacaauga

SEQ ID NO: 140031 - RNA, 43 nt, Homo sapiens
uguucuaacugucccaguuuugaccaaugggaaccccaggaug

SEQ ID NO: 140032 - RNA, 46 nt, Homo sapiens
agaagacuaguuacuuaaugauuuccaacuucguaaaaguauuuac

SEQ ID NO: 140033 - RNA, 72 nt, Homo sapiens
auuuaaauccuggauauuugugaagcucauaguaaagugccaaacuguugaaguauguuuugaaagugguga

SEQ ID NO: 140034 - RNA, 63 nt, Homo sapiens
gaaauaaggucugcuuuauuuacuuuuaagaaauaaaauauuauucauguaaguuuagccaaa

SEQ ID NO: 140035 - RNA, 57 nt, Homo sapiens
cuccuuaguaaagagaccagugaggaacuccugccuccaccaguucaaacucaaauu

SEQ ID NO: 140036 - RNA, 64 nt, Homo sapiens
aaagaaugaaaaacacagagaagaaaucaaaauaaaaagccaagauuuuuaugaaaaagaaaaa

SEQ ID NO: 140037 - RNA, 58 nt, Homo sapiens
auacagcucaugccuuuuuuuaauuugucaguaugguuucuuucucuucuucccugag

SEQ ID NO: 140038 - RNA, 74 nt, Homo sapiens
uagccacauaauuggccauuggagcuuacccagcucuucccuaugguaccuccuuugaccauccucuuuguucc

SEQ ID NO: 140039 - RNA, 47 nt, Homo sapiens
cucauuuaaguuuuaaaacuggguuuagauccagagugaaaaggggu

SEQ ID NO: 140040 - RNA, 66 nt, Homo sapiens
auagaaguaauagauuaccugaaauccuaugucuggcugcuaccugaaauccuaugucuggcugca

SEQ ID NO: 140041 - RNA, 49 nt, Homo sapiens
gaaaaugauagaugagaaaccggguaguuauuaucucuggggaaggaaa

SEQ ID NO: 140042 - RNA, 53 nt, Homo sapiens
uuaaaagacauaaacccacaaggucauagaaacgugaguaugcaaaccaucaa

SEQ ID NO: 140043 - RNA, 44 nt, Homo sapiens
ugcucuggcuuaugauguguugaucuuauaguuuaacauucaga

SEQ ID NO: 140044 - RNA, 42 nt, Homo sapiens
gauuagaagaacaagaaagacuccaccuacuauggagguaag

SEQ ID NO: 140045 - RNA, 47 nt, Homo sapiens
aagcuuauuucaguaguuauguuuauguaucuguguaaaaccaagau

SEQ ID NO: 140046 - RNA, 47 nt, Homo sapiens
aauucauuucaaacaauguuuacauuauaaugaggacugauacagau

SEQ ID NO: 140047 - RNA, 47 nt, Homo sapiens
caugcugaugagaaugcaaaugaauauugacgaaagaaugcuaggau

SEQ ID NO: 140048 - RNA, 24 nt, Homo sapiens
gaagaguguaugcuucaugaagua

SEQ ID NO: 140049 - RNA, 43 nt, Homo sapiens
aauacaggaacuauuuugucugacaaaaauaguucuguagagu

SEQ ID NO: 140050 - RNA, 53 nt, Homo sapiens
guuuaguuagagacaauggagaccaaaaaggagcugccagaaacauaggagaa

SEQ ID NO: 140051 - RNA, 46 nt, Homo sapiens
ugcaaaauuuaagcaggcacucacuuucauguagugacccagcacu

SEQ ID NO: 140052 - RNA, 85 nt, Homo sapiens
ugcugaauuuuaguaagcagaugcauguauagcaaaaagaacuauuaagcauuaucagagcugagacuaaggugaggcaagccaa

SEQ ID NO: 140053 - RNA, 34 nt, Homo sapiens
guaaguuauauaacaguauacaaauucaauaaga

SEQ ID NO: 140054 - RNA, 58 nt, Homo sapiens
acuauucgagagaaaagaauuguagaagcagcaaauaaaaaagaaguagacuaugaag

SEQ ID NO: 140055 - RNA, 50 nt, Homo sapiens
gaauuuauuuaauaagcuaauagcuuuauuuuauauuacuaaagauguau

SEQ ID NO: 140056 - RNA, 56 nt, Homo sapiens
ucucaauguaaacauauucuccauuuacuaguauaauuuuuaucucucuuuaaaua

SEQ ID NO: 140057 - RNA, 35 nt, Homo sapiens
auucuucccuagagccuucagaggacccucccucc

SEQ ID NO: 140058 - RNA, 56 nt, Homo sapiens
augagacggggggugggagggagggaggcgggggaagagagagagagagagagaga

SEQ ID NO: 140059 - RNA, 29 nt, Homo sapiens
aucagauuguugccagcuacucugcauuu

SEQ ID NO: 140060 - RNA, 25 nt, Homo sapiens
aauaauugagucucaguuuaaagga

SEQ ID NO: 140061 - RNA, 45 nt, Homo sapiens
aucuuuauguuccuccagauuucuuucuucagcucacccaucccu

SEQ ID NO: 140062 - RNA, 46 nt, Homo sapiens
cuaaaacauugugcagauguacaguuggauacaaugaugccaauau

SEQ ID NO: 140063 - RNA, 45 nt, Homo sapiens
guggcugcuuaauaguuauagguuuuucuguugggguggugagaa

SEQ ID NO: 140064 - RNA, 45 nt, Homo sapiens
aaaggggacguauuguaugauuccauuuauaugaaauauccagau

SEQ ID NO: 140065 - RNA, 71 nt, Homo sapiens
uauauacauacaauggaacauuguucagccauaaaaaggaugaaguacuaauuuauacuugcugccacaug

SEQ ID NO: 140066 - RNA, 71 nt, Homo sapiens
aaauguucguagcuucacuauuuacaauagccaaaaggcaaaaaacaacccaaucaucuaucaauggauga

SEQ ID NO: 140067 - RNA, 48 nt, Homo sapiens
aacauugacaggagcaguuuguggaauuaaauuauaaucagcguugca

SEQ ID NO: 140068 - RNA, 69 nt, Homo sapiens
agcaaaacuuguucauccaucugacugauauuuauuguauaccuuguaggccaggcacaguucuaggca

SEQ ID NO: 140069 - RNA, 655 nt, Homo sapiens
ugcuacauucauaaacauuagaaaauugcgugguggcucacgccuguaaucccaacacuuugggaggccgaggugggcagaucacgaggucaggagaucgagaccauccuggcuaacacggugaaaccccaucucuacuaaaaaauacaaaaaauuagccaggccugguggcacgcgccuguagucccagcuacuuuggagucugaggcaggagaauugcuugaacccgggaggcggagguugcagugagccaagaucacaccgcugcacuccagccaagugacagagugagacugcaucuuaaaaaaaaaaaaauggagagacugacuuauaaacaaagagauugucauuuauuuauuuauuuauuuauuuuugagacagaguccugcucuauagcccaggcuggagugcaguggcgcgaucucggcucacugcaaccugcgccuuccagguucaagucauucuccugccucagcuucccgaguaguuggaacuacaggcacgugccaccaugccuggcuaauuuuuguauuuuuaguagaggcaggguuucaccauguuggugaagcugggcucaaacuccugaccucgugauccaccugcccuggccucccaaagugcugagauuacaggugugagccacugcacccagcca

SEQ ID NO: 140070 - RNA, 46 nt, Homo sapiens
uuuguuuugaggguuuuguaauugcuuuauauuaagaauaguagug

SEQ ID NO: 140071 - RNA, 49 nt, Homo sapiens
uuuauuaggugcuaacucugauuacuuaacauuuuuauaacaaccaugu

SEQ ID NO: 140072 - RNA, 60 nt, Homo sapiens
caauucgggaacaaauacuacuacaucccgcaguacaagaacuggagaggugagguggcg

SEQ ID NO: 140073 - RNA, 42 nt, Homo sapiens
uuuguuccgcgccuuguggagaucgcugucaagggaagugaa

SEQ ID NO: 140074 - RNA, 48 nt, Homo sapiens
uggggaaaauauuugcaaaccacauaugugacaguggagugcuaucaa

SEQ ID NO: 140075 - RNA, 72 nt, Homo sapiens
guuaagugaauauuuauagauugccaguaacuggaaauaaccuaaacauucuuccaugggugaauggauaac

SEQ ID NO: 140076 - RNA, 62 nt, Homo sapiens
uauuguacauccauacaauguagcaccgcuggguggcagaagggugcgacuguaaagggaga

SEQ ID NO: 140077 - RNA, 43 nt, Homo sapiens
ugauagggcuauacaccaaaaaaaaaaauuuuauuuuaccaua

SEQ ID NO: 140078 - RNA, 31 nt, Homo sapiens
uuuuucaaaaugagcauuauuaugaagccaa

SEQ ID NO: 140079 - RNA, 53 nt, Homo sapiens
gaagagagggcuaaguggaucacagcguguccuccgugucugagcuuucagag

SEQ ID NO: 140080 - RNA, 45 nt, Homo sapiens
uauguugucaguaacaguucaauucauuaaaguucuugccuagaa

SEQ ID NO: 140081 - RNA, 44 nt, Homo sapiens
uaggauccaggcauccacaagagaagaccaagccuuauccaagg

SEQ ID NO: 140082 - RNA, 49 nt, Homo sapiens
gcacaaguggaccgggguguugggugcuagucggcaccagaggcaaggg

SEQ ID NO: 140083 - RNA, 46 nt, Homo sapiens
ugcggggcggcaaggcgaccauggagcuuuugcggacuaucaccua

SEQ ID NO: 140084 - RNA, 44 nt, Homo sapiens
auuauuccucacagcagaguagcuaaaccucaucaaagggaaaa

SEQ ID NO: 140085 - RNA, 45 nt, Homo sapiens
agugucaacuccuauuugagaacauuugcuuaccccgaauuaaca

SEQ ID NO: 140086 - RNA, 46 nt, Homo sapiens
gugucuggacugaaauaccuucaugaacaagaaaucuugcacagag

SEQ ID NO: 140087 - RNA, 41 nt, Homo sapiens
ggaacuuuuuuauuaaugaagccauggaacuaaaaguuggg

SEQ ID NO: 140088 - RNA, 29 nt, Homo sapiens
cuuggcuuaaaauguauaaaaugccacga

SEQ ID NO: 140089 - RNA, 61 nt, Homo sapiens
guugucauacaguuccagauuuccacuuaucaagcccagcuaagaauuucuuuaagaaagc

SEQ ID NO: 140090 - RNA, 51 nt, Homo sapiens
uaggcaugauuugaaaaagacuucaauaacucagcaacccagcaaacacag

SEQ ID NO: 140091 - RNA, 46 nt, Homo sapiens
cuccagccaccuaccaccacaguugccaggucuggaacacccgcag

SEQ ID NO: 140092 - RNA, 46 nt, Homo sapiens
aagugcauuccuuguuaauaaacuuuuuauuuauuacagcccaaag

SEQ ID NO: 140093 - RNA, 29 nt, Homo sapiens
auccaggcguagaauggcaugaggcaggg

SEQ ID NO: 140094 - RNA, 1855 nt, Homo sapiens
uaacaggugccaaaguggugguaucuggugguaagugaaauauuaaucuuaaaagauguaaauugaaaauacuuugauuuuuuuuuuuauuuuuaguauuuauuuuagaaguacacagaucuuuuucaaauguaagaaguugggaaguuugggauauuauucccauuuaaccaauuaggaaaaugaaauuaugagcauaauacacaguuugggguuucuguugcacaccuagucacuggcaccagggggagcaugguauaaaucuuaucugcauaacuuugccacuuggugccaucuuauugauggacuuccaugaauucugcagaguaugguuggcuucucaauuauagauagaacuggcuugaauuucagggccaucuuguguauaauuccuacccuucuuuccacuuggaaagauuuccagaguuguccaugucuuuguguauaacucuuuaaaaaguuucuuaacauuuaauaucaaaacuguuaauauugcauaagacaugcuuauuuuuauacaucaugcuccuugucuuuaaaaacaaugauuuuuuuauggcccacugacuaacuuuuugaaaaaauaaggacuguuaugcuuuuuaaauccuugcaauuaaacauccaacaaaauaagcuuucagacagccuucuauugcaaguaucauugagaaaaaaaaauuaauauuuugaagugauauaucugacuuguuuuucguuuucuuuuuuucuuuuugagauggaguuucgcucuuguugccuaggcuggagugcaauggcacaaucucugcucaccgccaccuccaccucccagguucaagcgauucuccugccucagccucccgaguagcugggauuacaggcaugugccacuacgcccagcgcggugacucacaccuguaauuccagcacuuugggaagccgaggcggguggaucacccgaggucaaguguucgagaccagccuggccaacauagugaaaccccgucucuauuaaaaauacaaaaaauuagcugggcauggugguggaugccaguagucccagcuacucaggagggugaggcaggagaauugcuugaaccugggaggcagagguugcagugagccgagaucgcaccauugcauuucagccugggcaacaagagugaaacuccuccuaaaaaauaaauaaauaaauaaauaaaaauaauaauuuuguauuuuuaguagagacggagguucugcauguuggucaggcuggucucgaaauccugaccucaggugauccgcccacuucagccucccaaaguguugggauuacaggugugagccaccgagcugggcccugacuuguuuauucacuuauuuauucaagaaauguauauugguuaucuguucuaugacaggcuuauugccaagugcuggagaaacagaugaaaaggcagaauguucuuccucucgaggaguuuaaaguccuugagaugacucccauucaaauaauaacuuuauucagucauucagagaaauuuauugagcaucuauuauauguagaguuuugcuaaauauugcagauauggcagugaccaagauagauauagauccugaaauuaaagaguuuuuauucuagugggaaaaaaacucauauuaauuacacaauuaguuaacuagguaaucauaguaguguugaaugcuuuauagaaguauaggagugucagaggccagaaaagguuuauagaggaggugacaugcuuaauauggcaguuacauaauaugaaaauuuacuccaguauauaaaauagcaaaauuguuccagaauguauuugauguuugccuaauuuuuuuuuuucaucuuuuuaaaugaggucgaggcuugaag

SEQ ID NO: 140095 - RNA, 45 nt, Homo sapiens
caucaaguacuucaccaguggaaauaucagaguggcuugaccaga

SEQ ID NO: 140096 - RNA, 1410 nt, Homo sapiens
ugcaaucaagucaccugacacauuugugagaacuauuuaugcaggugaguacucaaggaagauaauuaaucaacauguuaaauuuuagugaaaagcauaaauuaaucuugaagauagaauuuuaaaucaaaccauacaauugcuuuaaguggaccaucuuaaagguuucugaggaaaauuuuagucuagaauugcugguggcccuugacauggcauucucucugauggaucgcaaacacagagauuuccugccuguuuauucaguuugcagggugauauuuuccuagugaucaauaaaaauuagauucacaauuuaauauauuuuguaagugguaccuggaaaagcaaaacuuaaaaaaaaauaguauucucaaucuuugcugcuucuacuucauuuccauaggcauuaagaaauucauuuuagccagcugcaguggcucgugccuauaaucccagcacuuuggcaggcugaggugggaggauuacuugaacucaggaguuugaggcuauccugggcaacauaauaagacccuaucucaaaaauaaauaaauaaaauaaauuagcuaggcauguuggcauaugccuguagucacagauacuugggaggcugaggugggaggauugcuugagccagaaggucgaggcuauggugaguugugaucaugccacagcacuccagccugggcaacagagcaagacccugucucaagaaaaagaaaagaaauucauuucagugucucuucaguugauuuuuugcuuagcacacuggucucuaguggggucggagaaggcagugaacucuucguuuuuugccugauuaaaguuguguauuccaguaugaauggcuaauucugaaauuagacuuuucaucuuccauaauguuugagggaaaauauuuugucaugguuuagguuacuguuaaugugauagcuaauccagagugucucaaauccucuuaaaaucuuagcacauucauaccuguucuuuaugaccuauuguguuuucaagauauuccuccuuuagcaugcacaguagcuacauucuuccuaaguuguugcagcucauaguuuugaguuacugauuguauuguuuuuggagaaggaagcuuuguucauauuccuuuuagagguguaguguaccuucuuaguguggaugccuguucgaguuucuuccuucuaggugugguaguaccuguccugcuuuuaaagacauccaggguuauacagauaucugcugauauguuucuucaccguuaugguucauuuuuuccuauacuuaauagaguuagaagacaacuggucaauaguuauuucuugccuugucugugaaguaaauuccaagcaucaaaggagugcuaguuuuguugccuuuugcuguugcuuuuaagaaauagauuguauguuucagga

SEQ ID NO: 140097 - RNA, 30 nt, Homo sapiens
uauuucaggaacuuuauauugcuguuggaa

SEQ ID NO: 140098 - RNA, 45 nt, Homo sapiens
auuuaaaauguacaacacaaauuggaaauaaaauaaguuacaaga

SEQ ID NO: 140099 - RNA, 45 nt, Homo sapiens
aggccuggcagaucauuuuuuaaaaagauuauucaacuaccaauc

SEQ ID NO: 140100 - RNA, 51 nt, Homo sapiens
cauuuaagucuuacucuguauguaacaauccaucauucaccuucacuacug

SEQ ID NO: 140101 - RNA, 45 nt, Homo sapiens
aaaaugaacuagauaugaaguagaguucauuaaauaucuugcuau

SEQ ID NO: 140102 - RNA, 30 nt, Homo sapiens
ucaacuacaguagaaacaggaugcucaaca

SEQ ID NO: 140103 - RNA, 46 nt, Homo sapiens
acaguuacuccguggccuuucguaucuccaugaaaaccaaaucauu

SEQ ID NO: 140104 - RNA, 45 nt, Homo sapiens
agccaucugaaucauccaaacaucauuaggauguugggagccacg

SEQ ID NO: 140105 - RNA, 46 nt, Homo sapiens
cagguugaaaauggagaagauaucaucauuauucaacaggauguaa

SEQ ID NO: 140106 - RNA, 46 nt, Homo sapiens
ugauaccuacaaagaugaugugaaucauaaucaaaagugcaaagag

SEQ ID NO: 140107 - RNA, 67 nt, Homo sapiens
gcuguagcagcaauaguaguaaugcuguuauacccagugacgagacaguguucaccccaguagagga

SEQ ID NO: 140108 - RNA, 47 nt, Homo sapiens
auuaucuuagguauuaagcuuacuuuuagcuaauuggcccauaaugu

SEQ ID NO: 140109 - RNA, 47 nt, Homo sapiens
guugguucauucucccauaauaucccuuuauaacaaaacauauguaa

SEQ ID NO: 140110 - RNA, 53 nt, Homo sapiens
cgaaggaaucaagagagcaauuuuaaccuuacucauuauggaacucagcaaau

SEQ ID NO: 140111 - RNA, 51 nt, Homo sapiens
cucagagcugcacagcagcaaaccguacagcagcagccuuuggcuggauca

SEQ ID NO: 140112 - RNA, 46 nt, Homo sapiens
gaagaaauagagaaccuuuaauauguccccuuuguagaucuaagug

SEQ ID NO: 140113 - RNA, 33 nt, Homo sapiens
ggcauuacagaaaggcuagcaucaaaguaaggu

SEQ ID NO: 140114 - RNA, 39 nt, Homo sapiens
caucaggucgcacagugaaaucagaaucuccaggaguaa

SEQ ID NO: 140115 - RNA, 46 nt, Homo sapiens
gccuggaagcacgaaugguuggaaaggagaaauaggcgagggccug

SEQ ID NO: 140116 - RNA, 46 nt, Homo sapiens
cgugagauggagaauaaagaaacucucaaaggguugcacaagaugg

SEQ ID NO: 140117 - RNA, 60 nt, Homo sapiens
augaaaauaaaaauuuaaucauguaggcuaugaaaaauuguuuuggggucauagaugaug

SEQ ID NO: 140118 - RNA, 42 nt, Homo sapiens
uggaagagcucacaauguggagagggaagcagauacuuaaac

SEQ ID NO: 140119 - RNA, 49 nt, Homo sapiens
aagccaacuaacuuguuuuuaucaaguguucccugauuugcagaaucau

SEQ ID NO: 140120 - RNA, 51 nt, Homo sapiens
gguucuuagcuucuuuacugaccaucucuuagucuuuuccugggguugaaa

SEQ ID NO: 140121 - RNA, 43 nt, Homo sapiens
cuucugccccaacccaugcuaguucuuacuguugugaucaguu

SEQ ID NO: 140122 - RNA, 108 nt, Homo sapiens
cagacagggucccagcaagcugacagguuguaggugagcaagcacguuagaugugcaggucacucacaucccuuuuugugggaucaauggauguucuuuccugagaaa

SEQ ID NO: 140123 - RNA, 47 nt, Homo sapiens
uuucuuuuuucaaauuaauaaucaaauuaauugauuauuuuuaagga

SEQ ID NO: 140124 - RNA, 47 nt, Homo sapiens
ccagucaucuucuuggguugagggcugucuguuacacagaaggcgau

SEQ ID NO: 140125 - RNA, 61 nt, Homo sapiens
gaaaugaggggguggcaagguaguuaauggggaauggauuaccaugaggaaaaauaugggg

SEQ ID NO: 140126 - RNA, 30 nt, Homo sapiens
ucuuugggaaaggcagucccguacagaacc

SEQ ID NO: 140127 - RNA, 33 nt, Homo sapiens
gucuccucgagugccagauagcccguccgaaac

SEQ ID NO: 140128 - RNA, 50 nt, Homo sapiens
ggugacaaaguuguggaaguagaauucggagguccgggagcaggaagggg

SEQ ID NO: 140129 - RNA, 47 nt, Homo sapiens
aaaaagggggguuuguucuugaagggcguucugcggggcgggcguua

SEQ ID NO: 140130 - RNA, 72 nt, Homo sapiens
ucuucauucucgagguggauuucccuuccccaaagccguuuuuucaucuugaaaucguaacguuucagcuuu

SEQ ID NO: 140131 - RNA, 41 nt, Homo sapiens
auuuaauagcaaguugguucuauaaauguaauauuucaguu

SEQ ID NO: 140132 - RNA, 75 nt, Homo sapiens
aacuauuucucuuuagggauaaucuugaacguuuguuuuuaaucuugagugaaagaaaaaaauuacaggaaggag

SEQ ID NO: 140133 - RNA, 103 nt, Homo sapiens
aaagugucaaaaaggacagacuguagugggauuuuuuucuuauuuuaaguauguauugacaauaccaguuuaauuuucucacaggcaauuuagauuauuauaa

SEQ ID NO: 140134 - RNA, 45 nt, Homo sapiens
uugugaauugcaguauuuucaauuuauuuaaauuuguuuccaagg

SEQ ID NO: 140135 - RNA, 54 nt, Homo sapiens
aagaggauaaaggaaagaauucaacuacauuaucugguuacauagaaaccagga

SEQ ID NO: 140136 - RNA, 44 nt, Homo sapiens
agcaggagauucauuccuuucagcacuguaaaucuguugcccug

SEQ ID NO: 140137 - RNA, 78 nt, Homo sapiens
uugcuuaagaaauaaaagcucaagcuuuuauucaauuuuuauuccguuacaaacauaauugaagccauauaaauaguu

SEQ ID NO: 140138 - RNA, 45 nt, Homo sapiens
uucaucaaagugcucuguaaaccuuuucauuuggcuaaaauaguc

SEQ ID NO: 140139 - RNA, 58 nt, Homo sapiens
aauggggaaggaaagaaguguguggguuuuuuuuuuuuucuucaguaaaugaauagga

SEQ ID NO: 140140 - RNA, 70 nt, Homo sapiens
uaucuuuauaauuuguauauuucuuuacaaauucaggcauuaaauucuaaccauauuaauuuucaguugu

SEQ ID NO: 140141 - RNA, 46 nt, Homo sapiens
uucauuaaauauucagcucacuugcaacauucuuacauucggacag

SEQ ID NO: 140142 - RNA, 42 nt, Homo sapiens
gaaaaaccuaaaaauuugaguugcauugugaacgaggggaag

SEQ ID NO: 140143 - RNA, 39 nt, Homo sapiens
uaaaaaaaauuauacauauaggcauauucaugagacaua

SEQ ID NO: 140144 - RNA, 54 nt, Homo sapiens
ugaguuacacaggugucuguacuugucaaaacucacugaaugauacacuaagau

SEQ ID NO: 140145 - RNA, 48 nt, Homo sapiens
caaaacgugacacccccaccucaugcacuguugauuauucuacugugu

SEQ ID NO: 140146 - RNA, 32 nt, Homo sapiens
uuaucacaaacaguaugucuuugcuuuuguug

SEQ ID NO: 140147 - RNA, 41 nt, Homo sapiens
ggauacuggagugacuggagugaagaagcaagugggaucac

SEQ ID NO: 140148 - RNA, 42 nt, Homo sapiens
aauugauacagaaccaaaagcuaacggaaugaugcuacuuac

SEQ ID NO: 140149 - RNA, 44 nt, Homo sapiens
ugguguguguuaucagauaaagcacccuguaucacagacuggca

SEQ ID NO: 140150 - RNA, 21 nt, Homo sapiens
aagcugccuaaagaguuagaa

SEQ ID NO: 140151 - RNA, 44 nt, Homo sapiens
uuuucccuacuuuuuuuguccgaacaguagguccuuuggaaggu

SEQ ID NO: 140152 - RNA, 46 nt, Homo sapiens
guguaugcugccauucguaccauguacaaugugucacuagucaaag

SEQ ID NO: 140153 - RNA, 50 nt, Homo sapiens
uacaugguacgaauggcagcauacacagaugaaggugggaaggauggucc

SEQ ID NO: 140154 - RNA, 28 nt, Homo sapiens
aacagcacucccagaagaguugucaaua

SEQ ID NO: 140155 - RNA, 41 nt, Homo sapiens
aagagucauauugcccaguggucaccucacacuccuccaag

SEQ ID NO: 140156 - RNA, 44 nt, Homo sapiens
gucaguccaagucuucucaagauccgagucuacccagcccuugu

SEQ ID NO: 140157 - RNA, 46 nt, Homo sapiens
ggaaguuucugcagcagaugcuuuugguccagguacugagggacaa

SEQ ID NO: 140158 - RNA, 82 nt, Homo sapiens
guuucaggauguuugcacugaagaaaaacagaaagcuuaucugaaauuuauaaaacuuuuuguuuugcuacauagaaaacag

SEQ ID NO: 140159 - RNA, 38 nt, Homo sapiens
gaauaccguguacacugauauacacgaagcugcuccuc

SEQ ID NO: 140160 - RNA, 78 nt, Homo sapiens
uguacacgguauuccuuaggucccuuccauugguagugaugcugcgaguuauuacuggagaaaaggaauucuagagcu

SEQ ID NO: 140161 - RNA, 70 nt, Homo sapiens
uuaacuuggcagauuaaaaguacucauuuuuuauucaucaauaauuaguaaucucacuaguuuucaaaaa

SEQ ID NO: 140162 - RNA, 73 nt, Homo sapiens
uuuagugcuaaagccgcuaguguacuuaugcuguccccuaaccaccacgugcgauauggaagcagaugcuaaa

SEQ ID NO: 140163 - RNA, 53 nt, Homo sapiens
guagucaaucacuaauaacgcuugcuaauuuccucuuacuuucuaagaaaacc

SEQ ID NO: 140164 - RNA, 64 nt, Homo sapiens
agugauugacuacugcuaucaagugaauucaaaggaaacagguuuuuaugccauauuuaaguua

SEQ ID NO: 140165 - RNA, 36 nt, Homo sapiens
cccacuuuaggcaaaaguagauuaauagaaugacga

SEQ ID NO: 140166 - RNA, 77 nt, Homo sapiens
ggcugggcuggauuugucuugcuguaugugucaggaaauuuauaccuauuacauuuuccauuuucucaaaauuuaag

SEQ ID NO: 140167 - RNA, 46 nt, Homo sapiens
uuuugagaaaauggaaaauguaauagguauaaauuuccugacacau

SEQ ID NO: 140168 - RNA, 40 nt, Homo sapiens
cacuauuuguuaugaggaaaguugcagcuaaauauuaguc

SEQ ID NO: 140169 - RNA, 56 nt, Homo sapiens
ggucagauauacaauaugaacucuuaaucuacaggaaugagaauggaggaucauug

SEQ ID NO: 140170 - RNA, 38 nt, Homo sapiens
auaacaaaguuauaagcugcauaagacaaaaguucaau

SEQ ID NO: 140171 - RNA, 50 nt, Homo sapiens
guuuuaagugcuguuacauuaauaccauaaugugauguguuagaaacaaa

SEQ ID NO: 140172 - RNA, 49 nt, Homo sapiens
aaauaaagccgcuauaaacuuuggcaugcagguuuuugugugaacauaa

SEQ ID NO: 140173 - RNA, 42 nt, Homo sapiens
ucgagccccgccgcccgagcggggaggcgggacaacgaccag

SEQ ID NO: 140174 - RNA, 16 nt, Homo sapiens
cucccaggcucucucc

SEQ ID NO: 140175 - RNA, 49 nt, Homo sapiens
caccggccucauuuuacagauggagaaaaguggggcguagacggcuuga

SEQ ID NO: 140176 - RNA, 57 nt, Homo sapiens
agagaggaauucguuuccggguugagucuggacuccuaccgaacucgggcaaguuau

SEQ ID NO: 140177 - RNA, 50 nt, Homo sapiens
ccuggcccggcugcuggaccucucccguagccucagaagagugcaguacu

SEQ ID NO: 140178 - RNA, 46 nt, Homo sapiens
gaacaccuugcagcggcggugggaggagugggggaccuggagggag

SEQ ID NO: 140179 - RNA, 44 nt, Homo sapiens
cagccggagauggaguggaaacuggagcgcaccgcgccucggag

SEQ ID NO: 140180 - RNA, 27 nt, Homo sapiens
uuuuuaauguuaucuugcuauuaagug

SEQ ID NO: 140181 - RNA, 56 nt, Homo sapiens
ccaaacccucauggagacauuucucuguucuauuagaaacgcaauggcauucucau

SEQ ID NO: 140182 - RNA, 46 nt, Homo sapiens
gcagcucugguuagacaagugaucauaaaaaagaaagaggaucuau

SEQ ID NO: 140183 - RNA, 42 nt, Homo sapiens
accaagguggaauuuuuggaaguaucuugucaacccugaggg

SEQ ID NO: 140184 - RNA, 49 nt, Homo sapiens
gaguaacuuuccccaucuuccacaagauuaagauucuaggaucugaagg

SEQ ID NO: 140185 - RNA, 49 nt, Homo sapiens
uuggaccaucccacuucagcguguuggcuuuucccugcaaucaguuugg

SEQ ID NO: 140186 - RNA, 46 nt, Homo sapiens
gacuucccucuagaauccuccaacauggagccucuugcagcuuacc

SEQ ID NO: 140187 - RNA, 44 nt, Homo sapiens
uaugaggugucacuaggaugcaaugacgaguuuuuuuugcaggg

SEQ ID NO: 140188 - RNA, 45 nt, Homo sapiens
ucacaggggaguaucuggaccuaacaguagaugaaaaaaagguaa

SEQ ID NO: 140189 - RNA, 55 nt, Homo sapiens
ccacugccgucccugaggucaucaagccuuuucuucaagaugagaguagcgauuu

SEQ ID NO: 140190 - RNA, 46 nt, Homo sapiens
aaguaauggagacagcuuuuaccauguuagacuuauggcaaggaaa

SEQ ID NO: 140191 - RNA, 50 nt, Homo sapiens
caacuuuaaagcagauaagacauacuuuauuuuaacuaacagaggauuau

SEQ ID NO: 140192 - RNA, 46 nt, Homo sapiens
ggaacuccaccaaugcauggauaccuccaaaaauuuauaccagaag

SEQ ID NO: 140193 - RNA, 88 nt, Homo sapiens
guggaggauggcaauauccuuuaugugcagacaucccccaaccaagaacaggacuguuuuucccuggaugugaugaaugguuuccaag

SEQ ID NO: 140194 - RNA, 47 nt, Homo sapiens
uauaaggugcacucuucuugccucucacguggcauuuucacaguggu

SEQ ID NO: 140195 - RNA, 40 nt, Homo sapiens
caagagguuaagcgauuugcccaaaauaacaaaguuagug

SEQ ID NO: 140196 - RNA, 43 nt, Homo sapiens
ggauaugaacguuaggcugucugcauaggaaucuugccuggug

SEQ ID NO: 140197 - RNA, 42 nt, Homo sapiens
cugccauugauuuuguuuguuuaucuuugguggugguguguu

SEQ ID NO: 140198 - RNA, 42 nt, Homo sapiens
uuuaaguuagaugccuccaaccucuuauuuaaauugccugaa

SEQ ID NO: 140199 - RNA, 46 nt, Homo sapiens
gaaaauggaagaucuggacaguccuccagaugaaaucagauauaug

SEQ ID NO: 140200 - RNA, 49 nt, Homo sapiens
auugugaaccuuacugaccuacuucucccacaaggccagacaaccaucc

SEQ ID NO: 140201 - RNA, 112 nt, Homo sapiens
uucaggaagacucuuuuaucacaugacaaaucucacugccacacaggaccagcuacaguucucacuguuuacaucagaaagcaaccugacaggacaaacacugaacaucaga

SEQ ID NO: 140202 - RNA, 49 nt, Homo sapiens
cugaaaauugccgacagaguggcucaucagcugagaagaagggaccuag

SEQ ID NO: 140203 - RNA, 65 nt, Homo sapiens
gcuaauaugacugacagugaucccaaauuugaagugacagagcccccuguacauagaaggcuggg

SEQ ID NO: 140204 - RNA, 46 nt, Homo sapiens
uacagccagugauauguuaucuccccuucaccauagugccgccuga

SEQ ID NO: 140205 - RNA, 45 nt, Homo sapiens
cauguuagccccacugagaaugcuaguauuaaccuggggcauaga

SEQ ID NO: 140206 - RNA, 46 nt, Homo sapiens
uaaguuugagucuguauuggacaaauaagcaccaugcuuuucaaau

SEQ ID NO: 140207 - RNA, 19 nt, Homo sapiens
uacucagaaaagguuauug

SEQ ID NO: 140208 - RNA, 45 nt, Homo sapiens
uuuuauaguugcugagcuaacuaaugugauuauugaguuuacaga

SEQ ID NO: 140209 - RNA, 68 nt, Homo sapiens
ggaaaaagauaauugauuuauacuauguuuuaaaaaaaaaaaagguauugaugagcccccccccccca

SEQ ID NO: 140210 - RNA, 83 nt, Homo sapiens
cuuaaaaacuuuucagggaugucuguaaauuucaguguuaauaugucaugaaaagugguguggauugaucuaaggagggacca

SEQ ID NO: 140211 - RNA, 86 nt, Homo sapiens
agauuuucuuuuaauauucaguuuuuugaaaaaaaauggaucuacacuguuaacugauugagacuccacugugauucacuuguuua

SEQ ID NO: 140212 - RNA, 51 nt, Homo sapiens
agcuuggcgugaagauuucagcaaacaugucuuacaacaugaggaggagga

SEQ ID NO: 140213 - RNA, 48 nt, Homo sapiens
aauuugcacagcaaguauuaucuccugauaagaugcuggugaaugcag

SEQ ID NO: 140214 - RNA, 46 nt, Homo sapiens
uggcuggauacaagccugcuguggaugccuuuuuacucucauagau

SEQ ID NO: 140215 - RNA, 49 nt, Homo sapiens
aaaacugcugucaaagagcuauugccagcuaucaguggugguacaagga

SEQ ID NO: 140216 - RNA, 33 nt, Homo sapiens
auaguguuuaaugacuggacguuggauuaugga

SEQ ID NO: 140217 - RNA, 53 nt, Homo sapiens
agaguaggcgacacguggaggaagggaagauggaggugcagaaggcugacggc

SEQ ID NO: 140218 - RNA, 48 nt, Homo sapiens
aacuuguuuuauugcuaaucaucuuuuaacuuucuuuugaagguggau

SEQ ID NO: 140219 - RNA, 44 nt, Homo sapiens
aacuagucaauugacuuccauaauuagcuuaccguuuucauagg

SEQ ID NO: 140220 - RNA, 89 nt, Homo sapiens
aauauguuuccacuuucuuuucuagugaacucagagcuuaggagcucagugggcagaggcggguagagggaagcuuccugggaacccca

SEQ ID NO: 140221 - RNA, 41 nt, Homo sapiens
uagauuuauuuuggcuugggucucccuuuaucuuucuagaa

SEQ ID NO: 140222 - RNA, 30 nt, Homo sapiens
gaagggaugugaagcagcacucaggauaac

SEQ ID NO: 140223 - RNA, 67 nt, Homo sapiens
gucuuuaguugguuauuuaugauuucauacaaggauguccggauguggucagaguaaagacucacag

SEQ ID NO: 140224 - RNA, 59 nt, Homo sapiens
guuuuaaguuugggugguagaaaguagugaagccagugauagaagagguaggcagacug

SEQ ID NO: 140225 - RNA, 46 nt, Homo sapiens
gcuauuguauuaguuuccuguggcugcuguaacaaauuccuacaaa

SEQ ID NO: 140226 - RNA, 54 nt, Homo sapiens
ugggaggagaacacagaaggggcugcuugccugcagaguaggguaagggauagg

SEQ ID NO: 140227 - RNA, 45 nt, Homo sapiens
ugauuucacuuuauauugauucuugguguuuaaacuuacgcaugc

SEQ ID NO: 140228 - RNA, 60 nt, Homo sapiens
gguagaucaggcucaugcauucugcuccaugucuccccaccccaacacaagcacuuucua

SEQ ID NO: 140229 - RNA, 46 nt, Homo sapiens
gcuuugcaggucacuguuaggacuuggaaugaaagcccgagucaga

SEQ ID NO: 140230 - RNA, 48 nt, Homo sapiens
uccuaugggggaaggggcuugcugggagaaugaucaaacguuuucagu

SEQ ID NO: 140231 - RNA, 41 nt, Homo sapiens
uguucccugggaccgccuucagacauuuggagacagcaguc

SEQ ID NO: 140232 - RNA, 45 nt, Homo sapiens
ucuuacuaaugugcauucucauauaaugccuugauugagagaaug

SEQ ID NO: 140233 - RNA, 120 nt, Homo sapiens
aaauugagaacguuguuuaggaaaauuguuuagggaaacuacauagaaugaauauaaucugaguauuggaucugagagcagcguugcugguaucccagugaguuagcuguccaacuauca

SEQ ID NO: 140234 - RNA, 52 nt, Homo sapiens
uaauuucaggaaaagcguacucauuuugaguuugaaaucuauuaauguacug

SEQ ID NO: 140235 - RNA, 63 nt, Homo sapiens
aaccauguuagguaucuguuugaacacugcacugucacuuaguggugaguuucaaaaagugag

SEQ ID NO: 140236 - RNA, 62 nt, Homo sapiens
ugacagugcuaucauuuuagaguuugaauaguugaguaaugagcugcucaaaucuguaaucu

SEQ ID NO: 140237 - RNA, 81 nt, Homo sapiens
caggaccuggaucccgucauggaccuauuagcgcuguaucaggggcaucuggcuaacuucccggacaucauccacguucag

SEQ ID NO: 140238 - RNA, 45 nt, Homo sapiens
agccgcggcgaccgcggccucuucccggccuccuaugugcaggug

SEQ ID NO: 140239 - RNA, 41 nt, Homo sapiens
ccgggcgcuguacgacuucaggucggagaacccaggagaga

SEQ ID NO: 140240 - RNA, 2922 nt, Homo sapiens
gacuucucagagaauagagacugugacaagcuggaagauguaagagcauccgccuuuucuggggguagccuaggaauuuuccuuugauacauacgugauuucuucuucuuaaaggauaaagauguggcaagauuuuuaaauguacagagauacugucuguagguguaacugccuucuagaccacauaguaaagugaguuuaauccuuuuuucagcaaaaauguuaaauucggguuuauuuuaguaaucacucaccuauugaaguacaucuugguugcuuccaaguguuggcaacuaugaauaaaacugcaguaaacauccaugugcagguuuuugugcuggcauaaguucaacuccuuuggguaaauaccaaggagcgcaauugcuggaucauaugguaagagcauguuuagcuugucaggaaaccaccaaacugucuuccaaagugguugugccauuuugcauucccaccagcaauaaaugagaauuucuguugcuacaccuccucaccaguauucgauauuaucaguguucuggauuuuggcccuccugauagguguguaguuuuaauuugcacuuccaugaugacauaucauguggagcauccaucuauguaucuucuuuguugauguguuuguucaggucccuuacccauuuuuuaaugagguugucuguuuucuuauugcuaaguuuuaagaguucuuagaguucuuuguauaucuuaguuaauaguccuuuauuagaugugucuuugacuacaguuucuccaagucugugauuugacucuucauucuuucuuauuuauuuauuuugagacagagucuggcucuuaucacccagacuggagugcaguggcacgaucugggcucauugcaaccuccgcuucccggguucaagcgauucuccugccucagcuuccugaguagcugggauuacaggcacccgccaccacgcccagcuaauuuuuguauucuuaguagagauggaguuucgucauguuggccaggcuggucuugaacuccuggccucaaguguucugccugucucagccucccaaagugcuaggauuaaaggcauaagccaccacauguggccauauuuauuuauuuguauuacuuuauuuuuugagauggaguuucacucuguugcccaggcuggagugcaauggagcaaucucagcuuacugcaaccaccgccuuccagguucaagcaguucuccugccucagccucccaaguagcugggauuacaggcaugugccaccacaugacacacguuauuuagcuucuuagcucuggccagaggaccaggaaacuacagugcagaacaagaggcagaggaaggccaaccugcuuccuugaagaccaagagcucagaccauaacucuggaacacagccuugugguucugauaaggaauuagaccugugaggaugaaagaguauacuauuuucuggaauuuuuuuuguauguaguagagacaagguuucaccauguuggucaggcuggucucggauuccagaccucagguaauccacccaccucagccucccaaaaugcugggauuacaggcaugagcugccaugcccagccggccauauuuguuuuugagacagugucucacucugucgcccaggcugaaugcaguggcauuaaugaucacaguucacugcagccucgaccuccccuccucaagcuaugccucagccucagccucccgaguagcugggacuauaggcuugugccaccaugccuggcuaauauuuuguuugguacagagauagcuucuugcuauguugcucaggcugguguuaaacuccuagacucaagcaguccucccaccuuuggccuccgaaagugcuaggauuacaggugugagcaacuacacugucuuuuaauucucuugacagaguguuuugcaaagcagaaauuuuuuuuauuuuaaugaaauccagccuaauuaauuguaggccagucacgguggcucaaaccuauaaucccaacacuuugguuggcugaggugggcggaucaccugaggucaggaguuugagaccagccuggccaaccuggcgaaaccccguuccuacuaaaaacagaaaaauuagccgggcaugguagcaugcacccauagucacagcuacaugggaggcugaggcaugagaaucacuugaacaugggaggcggggguugcagugagccgagaucgcgccacugcacuccagccugagcaacagagugagacuugaucuccaaaaauaaguaaguaaauaaacaaauaaauaaauaaauaaaugucauacccaagguaaucuaaguuuucuuuuauguuauccuuauaggaguuuuauaguuuuguguuuuacauuuaggucugugacccauuuugacuuuauuuuugugacggcuguaaggucuuuguuuagauugauuuuuuuuuuuuuaguguggcuguccaauuguucccucaccauuuguugaaaagacuaucuuuucuccauuguauuuccuuugucaaagaucaguugucuauuugugggcucucuguucugucccauuggacuauuugugucaucuucugccaguaccacacuuuuuccccccacaccucuuaugagcacuguuaccauacuguuuuaauuacuccagcuuuugugguaagucuugaugucagguaauaucaguacucugguuuuauucuucaguauuguguuggcuguucuggaucuuuugccuuuucauuaaaacuuuagaaucaguuuuguugaugcagcagguccucauuuguaaauggggaaaaaaaucugugggcugaggcugucuuuuggaaaacacuuccugggucgugaguccuugauuucauagguugcuuauauuacuacaaaggaaccuuaaaccaacuguguccuuccuuuuccuuauugcagu

SEQ ID NO: 140241 - RNA, 62 nt, Homo sapiens
uauaauuuauacauaaaaugucugguugacuguauaccuuguuuuugaagaaauuuauucgu

SEQ ID NO: 140242 - RNA, 41 nt, Homo sapiens
uuaaaaaaauuuuuuuaacuuauugcauaacagcagaugcc

SEQ ID NO: 140243 - RNA, 46 nt, Homo sapiens
gcacuggaguaggugacuccaucauucccacagagauauugcucag

SEQ ID NO: 140244 - RNA, 70 nt, Homo sapiens
gcagcuccacaugugugguggaccagaccaauaaugccuacugugugaccuguaaucggauuugcccaga

SEQ ID NO: 140245 - RNA, 49 nt, Homo sapiens
agccgugcagacucuaauucugccuguuacaggcuguagggaauacacg

SEQ ID NO: 140246 - RNA, 42 nt, Homo sapiens
gggcagggagagcgagguggcuagcgaaggagacccggcggg

SEQ ID NO: 140247 - RNA, 42 nt, Homo sapiens
aaagggguggagggguggaaaaagaaggcaguggagggggaa

SEQ ID NO: 140248 - RNA, 61 nt, Homo sapiens
caggaauuauuugugacagggguuaagaaaguaagagaacgagagagaggagagaggagag

SEQ ID NO: 140249 - RNA, 42 nt, Homo sapiens
acuucugaaaaaugaaagcaaaaaagcaacccggcccagccc

SEQ ID NO: 140250 - RNA, 46 nt, Homo sapiens
uucuguggucuccacuuggucuguucugagcaacgcugcucucgga

SEQ ID NO: 140251 - RNA, 44 nt, Homo sapiens
ggugacauuucccaccuucuggaaacccuucccaauuaucuuuc

SEQ ID NO: 140252 - RNA, 24 nt, Homo sapiens
uuuuucugguucuugaaaaaccua

SEQ ID NO: 140253 - RNA, 47 nt, Homo sapiens
gccaacagauuuaugaauaucuagcaccauuucugcaucaagucuau

SEQ ID NO: 140254 - RNA, 72 nt, Homo sapiens
auuguuauggcuguguugcagguggcucuuugacccaugcuaccuugucaucuuucuaaacaacuuagucca

SEQ ID NO: 140255 - RNA, 46 nt, Homo sapiens
guagaugaagucucacaguuggugauuucuccgcucuguggugcaa

SEQ ID NO: 140256 - RNA, 48 nt, Homo sapiens
aaaagucauuagcuuagaauaugaagcauaucuacccauggcggaaaa

SEQ ID NO: 140257 - RNA, 40 nt, Homo sapiens
ugucaaagaacagcucauaccagagggcagcucaaacuug

SEQ ID NO: 140258 - RNA, 49 nt, Homo sapiens
aagauaaauggguauguaggaugaaggguuauuuaaaauggaacuaaag

SEQ ID NO: 140259 - RNA, 48 nt, Homo sapiens
uucugggagagcauuguuauuaaggaugcaugacaggaauguuggcag

SEQ ID NO: 140260 - RNA, 50 nt, Homo sapiens
cacuugcaugaauuacuguauauaaacuccuuaacuucagggagcuauuu

SEQ ID NO: 140261 - RNA, 70 nt, Homo sapiens
uuuguugacucuuguaauuuauuauaugcuucauuuaaacccauuuuguaaagaaaucagguaacaguca

SEQ ID NO: 140262 - RNA, 28 nt, Homo sapiens
ucagugcuaugagacugggcaguaggag

SEQ ID NO: 140263 - RNA, 36 nt, Homo sapiens
aacauuugcucugaguaccagcuucagugacucaau

SEQ ID NO: 140264 - RNA, 98 nt, Homo sapiens
ccgaaccaaaacuaggcugucccgaaccccugguaauagaauuguuuaucuuuauaccaagaaguuugggaaagcaccaaaaucugcauguggcaugu

SEQ ID NO: 140265 - RNA, 74 nt, Homo sapiens
ugacaggaucaagcaugcuuuccuuacugaggagcagaaaaucguugugaaaguguugaaggcacaagcacaaa

SEQ ID NO: 140266 - RNA, 45 nt, Homo sapiens
auaaauugggaggguggccauaaaauuuaucauccaaccacugaa

SEQ ID NO: 140267 - RNA, 46 nt, Homo sapiens
gcgccuagggcgcagcugggaaaggggcucgggccuuuccugaaga

SEQ ID NO: 140268 - RNA, 30 nt, Homo sapiens
cagaacaaagaaacagguaauauaacucca

SEQ ID NO: 140269 - RNA, 25 nt, Homo sapiens
ggcuggggggaggggccgggugcgc

SEQ ID NO: 140270 - RNA, 52 nt, Homo sapiens
cgagacccuagcgaguaaccaccucuuuuccaccgaccccuuuaaaacgaca

SEQ ID NO: 140271 - RNA, 45 nt, Homo sapiens
uguagcuccuguauuaaugucuaagcugucugugaaugccccuga

SEQ ID NO: 140272 - RNA, 45 nt, Homo sapiens
gaauauguagaaaggaauuuguuguacuggauaaacccagaugag

SEQ ID NO: 140273 - RNA, 56 nt, Homo sapiens
ggugacguucuuucuuccauuuuauuaccuccuuugcuaaucccgccuauuccaua

SEQ ID NO: 140274 - RNA, 45 nt, Homo sapiens
agacauuaucucuucgcuuucugguagccucagguaacugauggg

SEQ ID NO: 140275 - RNA, 53 nt, Homo sapiens
ucgaaaacgauuucaugcauuuguacucuuucugggagaacuuuaucuuaacc

SEQ ID NO: 140276 - RNA, 47 nt, Homo sapiens
uuuaguugacaggaucaguuuuggaagaugcuuggaaggaaaaagga

SEQ ID NO: 140277 - RNA, 42 nt, Homo sapiens
uccggucaaguaacuggggcagaguccaugcaacuucaacau

SEQ ID NO: 140278 - RNA, 45 nt, Homo sapiens
caacauuuuauacaucugaugguguuccuuucacugcagcugauc

SEQ ID NO: 140279 - RNA, 72 nt, Homo sapiens
gaugacuuggauuuucuuuuuugugaacuuauccauacauuuaaaagaaugccugucuuuuuguagcaggaa

SEQ ID NO: 140280 - RNA, 59 nt, Homo sapiens
gaaauaccaagaauuacuugaaagagaggacuuuuuuccagauuaugaagaaaauggaa

SEQ ID NO: 140281 - RNA, 41 nt, Homo sapiens
aaauugucaucaugggaauaacccagcagaaaucauagcag

SEQ ID NO: 140282 - RNA, 59 nt, Homo sapiens
uggacccagagauagaagaagcuuaugaaaaguuuuguuuggaaucagagcguaagcga

SEQ ID NO: 140283 - RNA, 71 nt, Homo sapiens
ucacucuaggcugggucuugccagaaagcaagcuuaauucuauaauuagguauuucauuaaaucuuuagag

SEQ ID NO: 140284 - RNA, 45 nt, Homo sapiens
cuaggguugugauuuuuuucuuucaccaagaaauaucacucgcug

SEQ ID NO: 140285 - RNA, 89 nt, Homo sapiens
gucuauggccugaaaaagagaaagagguagagagagucagguuccaaagacagaaaaucaacaggacuuguuacaggggcauggagugg

SEQ ID NO: 140286 - RNA, 58 nt, Homo sapiens
uaugaagaaaaaacuugaagagggaugacaaaugauugggagauguuugggaguaacu

SEQ ID NO: 140287 - RNA, 51 nt, Homo sapiens
uaucuaaagugcccuguagaaguaggagagaguugagaaaugacauuggga

SEQ ID NO: 140288 - RNA, 127 nt, Homo sapiens
uggguuuuaagccacgaagugauagaugugauuuucauuuuaaaagaucccucugggcacuacuguaugcagacuggauuugagggaagagaugagagugaaagugcaauuaggggguauuacagaa

SEQ ID NO: 140289 - RNA, 67 nt, Homo sapiens
ccagguauuuggauuucuucuucaggguccuuuucccauaggccuaauaguuacuuucugccugucu

SEQ ID NO: 140290 - RNA, 47 nt, Homo sapiens
cuauuaaaauuauaaagacaguuaucacuugugguugucucuucuug

SEQ ID NO: 140291 - RNA, 42 nt, Homo sapiens
cuuucucccuguggcacugaauuuuuauuugaaaagucacca

SEQ ID NO: 140292 - RNA, 48 nt, Homo sapiens
auaaagccccaaaagauaaacuaguugaaaaaacuggcaaaaucugua

SEQ ID NO: 140293 - RNA, 46 nt, Homo sapiens
auaaaaucagcaauaugucuaaaauugaugcacauauaacucagag

SEQ ID NO: 140294 - RNA, 50 nt, Homo sapiens
agaaggcugacucuacacuagauacugugcuaaguccaguaacugcagag

SEQ ID NO: 140295 - RNA, 53 nt, Homo sapiens
ucuagugaaggucacuguaccuaaaaagauuauuaaaguaugcuaaaugaugg

SEQ ID NO: 140296 - RNA, 40 nt, Homo sapiens
ggaucugacacaguucuuuuguccauaccuagcuucagag

SEQ ID NO: 140297 - RNA, 54 nt, Homo sapiens
auccaggcuaaauuuuaaauguuauuaaaacuguuaauuuauguaauugugcug

SEQ ID NO: 140298 - RNA, 67 nt, Homo sapiens
cuuacccaucaaaauaugaacucaauagagauuuauucuggggauggaucuguuuucaaaucagaag

SEQ ID NO: 140299 - RNA, 42 nt, Homo sapiens
agagagaagagaaaacuuacucaguaaauaaccuuccuccag

SEQ ID NO: 140300 - RNA, 46 nt, Homo sapiens
acccuaaauuggaauuucagcucuccuauugagaagagacaggugg

SEQ ID NO: 140301 - RNA, 45 nt, Homo sapiens
aaucaaaucauaucaguaagcguuauuugaauaucucagguagcu

SEQ ID NO: 140302 - RNA, 39 nt, Homo sapiens
acauuuuuaaaauauguauuuauaucuuaauaauaaaua

SEQ ID NO: 140303 - RNA, 3257 nt, Homo sapiens
ucccaagguagucuuguuucaguggcaugucuugaacaagcuguguggcauugcguuucuaaagaguugcuuagauuggguaguacaaaugaugcuggggauaguucacaccugcuaagagcuauuuaauagggacuuacuggggcuuaugacguaaauaaagaauggauuggcaacuggaaaacuaaagacaugaagauuuuaaaaaucauuuucauauaauuuugaauguuagauaacauuuuauuucuuaggagucagcaaucauagauguaagcuuauuaaaauacaugauggggaaaaaugaaguucaaguuaaauauuguaaaauucuaauuggagaaaaaaaaauuggcauugcccuauugucuuuaagcagcauguucuugccuauccuggucccucaaacacacagacacagaaggauauaaagaaagcuuuaguguuuuccugaacuuuuuggcaggauugggguugaaauuuacauuucugggccaggugcaauggcucaugcuuguaauuccagcacuuugggaggccgagaggacugcuugaggccaggagacuagccugggcaauauaaggagaccucaucucuacaaaaaauuuaaaaauuagccagguguggugguuugcaccuguagucccagcuacuugggagacaggugggagaacugcuucagcccaggaauucaacguuacagugaaccauuaaucacaccacugcacuccagccugggcugcagaguaugagacuuugucucuuaaaaaaaaaaauuuuacuuuuggcugagugcaguggcucaugccuguaaucccagcacuuugggaggccgaggagugcggaucaugaggucaggagaucgagaccacccuggcuaacacgguggaaccccgucucuacuaaaaauacaagaaauuugcugggcgugguggcacacauuuguagucccagcuacucgggaggcugaggcaggagaaucacuugaaccugggaggaggagguugcagugagccgagauugcaccacugcacuccagccugggucacagagcaagacuccaucucaaaaaaaacaauuuuuuuuuuuuuuuuuuacuuuuuuggaacauagcuggcaaaggaauaguaagauucaaugugauggugcuuuuuuuuuucccuccugaccgagucuugcuguuaccuaggcugaagugcaguguuauaucaugucucacuguguauucauuuuuuugagacggaaucuugcucuguugcccaggcuggagugcaguggcgcaauuucaacuccaccucucggguucaagcgauucuccugccucagccuccacaggcgccugccaccacacuugguuaauuuucguauuuucaguagagaugggguuuuaccauauuggccaggcuggucucgcacugcugaucucgugauccgucugucucugccucccacagugcugggauuacaggggugagccaccacgcccaaccaucauggcucacuguagucuuaacuccuggccucaagcaauccuccuaccucaaccuccugaguagcugggaccagcggugcaugccgccacaccuggcuaaacuuuuaaauuuuuauagagaugggagucucccuaugucgcccaggcuggucuugaacuccuggccucaaguaguccucccaaaguacugugauuacaagcgugagccacugugcccagcggauagugauuuuuuugagaccgaguuucacucuaguccaggcuggaguacaauggugcaaucuuggcucaccgcaaccuccgccucccagguucaagcgauucuccugccucagccucccaaguagcuggaauuacaggcaugcgccaccaugccugggcuaauuuuuuuguauuuuuaguacagaugguguuucuccauguuggucaggcuggucucgaacuccugacuuugggugaucugccugccucggccucccaaagugcugggauuacaggugugagccaccgcacccggcccggauagugcuuuuuaauuuuuuaauuuuuuuaaacauauuuguucauuuuguaggaucucaguugauuuuuuauuuauuuauuuauuuuugagacggagucucccucugucaccaggcuggagugcaguggcacgauuuuggcucacugcaaccuccgccucauggguucaagugauucuccugccucagccucccgaguagcugggauuacaggugucuaccaccacgccuggcuaguuuuuuguauuuuuaguggagacaggguuucacccuguuggccaggcuggucuugaacuucugaucucaggugaucugccugccucagccucccaaagugcugggauuacagcgugaaccacugugcccggcuuuuuuuuuuuuuuuuuuuuuuuuuuuuuaagguggagucuugcucuguugaccagacuggaguugcaguggcaugaucuaggcucauugcaaccaucgccucccagguucaagcaauucuucugccucagccgcuggaguagcugggacucaaggcauaagccaccaugacuggcuaauuuuugguauuuuuaguagagaugagguuucaucauguuggccagccugaucucaggcucuugaguucaagugauuugccacacccagcagcguuuguuuuuuuuuuuuuuggaggugaagucucgcuguguugcccaugcuggagugcaguggcacgaucucggcucacugcaagcucugccucccggguucaggcgauccuccucccucagcccccuaauagcuaggauuacaggcacaggccaccacgcccggcuaauuuuugcauuuuuaguagagacgggguuucaccauguuggccaagcuggucucgaacugcugaccucaggugauccacccaccuuggccucccaaaaugcuaggauuauaggugugagccaccgcucccagccccuagcuguuuuuuuguucuguuuuguuguuuuuuuuaaauagagacgaggucucacuguguugcccaggccauuuuuaaauuccugagcuuaagugaucuuggcaugaccucccaaaaugcuaggauuacaggcaugagccaccaugccuggugaucuguaauauuuaaaauaauacuaaucucauaguuugguuaaucuucaggcuaauguggaaaugugaguggcaugugggcaugugcuagaauaaucuuucuccuguagacaccuucgacaaccuggcauucaucccaagaccccua

SEQ ID NO: 140304 - RNA, 44 nt, Homo sapiens
cuggcacacccaccaaggugagacacauggacagucaaguggag

SEQ ID NO: 140305 - RNA, 35 nt, Homo sapiens
cuaguuagacucuuuagaauacuccaagaguuagg

SEQ ID NO: 140306 - RNA, 76 nt, Homo sapiens
gcucgaggugcucagccagaagcgcauguaccgcaaguaccaucagcggcccaccuuucgccagaugcagcucgag

SEQ ID NO: 140307 - RNA, 98 nt, Homo sapiens
ucucugcucccagcucagcucuggccgcgcgccgcagguugaacccacuccuugcugccgaaguuauaauuuagagaugguggugguaacaguaauug

SEQ ID NO: 140308 - RNA, 93 nt, Homo sapiens
agaacugaaggaagugggcaacaguuagaaggaggcuuuguuuuccucuccucucccaaaccuacaccagggucuuccugaaaggagggaggg

SEQ ID NO: 140309 - RNA, 62 nt, Homo sapiens
cuuguggucugagauaguuggaggcuucccagagggccacaaggcuacugauagugugggcu

SEQ ID NO: 140310 - RNA, 56 nt, Homo sapiens
guuugcauguacacggaauguaugcagagaauguguauccaccuacacguguguau

SEQ ID NO: 140311 - RNA, 36 nt, Homo sapiens
uaaaccagaaguauccaaauacgacaugaaaucucu

SEQ ID NO: 140312 - RNA, 37 nt, Homo sapiens
aaaacaacaacaaaaccaaaccaaaccgcagcacuag

SEQ ID NO: 140313 - RNA, 371 nt, Homo sapiens
gguucuccugauucccugcucccccuccccaccaccgccccgccuggagauggagccuugcucugucuccaggcuggaguacaauggugccaucucugcucacugcaaccuccaccucccggguucaagcgauucuucugccucagccuccugaguagcuagaauuacaggcacaugccaccacgcccggcuaauuuuuguauucuuaguagagaugggguuucaccauguuggccaggcuggucucgaacucuugaccucaugauaugcccgccucggccucccaagugcggggguuacagcccugagccaccgcgcccagcccgguccuccuuuuauuuucgaauccacucaggcccuagcuacuccca

SEQ ID NO: 140314 - RNA, 31 nt, Homo sapiens
uuaccauaucuuuucccacaccguggagcuc

SEQ ID NO: 140315 - RNA, 30 nt, Homo sapiens
caagaaugguuuggcaucuacagccuauug

SEQ ID NO: 140316 - RNA, 33 nt, Homo sapiens
aaaggguggcugugccagcugcucccauccccc

SEQ ID NO: 140317 - RNA, 67 nt, Homo sapiens
cagugguuagugcuuggaaacuggacuucuggguuaugcccuguacaaacagcaucaaagucgcugg

SEQ ID NO: 140318 - RNA, 84 nt, Homo sapiens
aucuuuauguuuuaaugaugggaagaaauucgucagccuggguacuuuuuccaugugauggggcaaaaauuuaaaacacuugca

SEQ ID NO: 140319 - RNA, 48 nt, Homo sapiens
aauggugguuuagggaacgcaacauguaccccacccccaacuuuuuua

SEQ ID NO: 140320 - RNA, 59 nt, Homo sapiens
aauuguuuuggacccauacauuuaaacuccuuaauuaauugacucaagacuuaggacag

SEQ ID NO: 140321 - RNA, 67 nt, Homo sapiens
ccauucacuuuauugccucuuuucauuguugcccagaauaucaccaugauuuauucauggguggugg

SEQ ID NO: 140322 - RNA, 31 nt, Homo sapiens
gugcugugacggcaaaucccccagcgcuggc

SEQ ID NO: 140323 - RNA, 38 nt, Homo sapiens
cgagccaaagcaaacaggacaguaacugaaacugcagg

SEQ ID NO: 140324 - RNA, 33 nt, Homo sapiens
uugucugguugggaagcauucucuuaaguccaa

SEQ ID NO: 140325 - RNA, 48 nt, Homo sapiens
aggugcagacuguuuagaugagcuggucauaaagagcccugacugugg

SEQ ID NO: 140326 - RNA, 46 nt, Homo sapiens
uacugccacgaccguuuaucacgggccagaguucaggggcacacug

SEQ ID NO: 140327 - RNA, 46 nt, Homo sapiens
cuuauaauagcagaaggaagguaucauuuaucccaaugagaccaua

SEQ ID NO: 140328 - RNA, 22 nt, Homo sapiens
agagcaagccgauuucauguua

SEQ ID NO: 140329 - RNA, 40 nt, Homo sapiens
gagaaaguugcagggggugcgggagauggauagcugcaga

SEQ ID NO: 140330 - RNA, 45 nt, Homo sapiens
gucugugcccagacugggaauccugggacccgcagaagccugugg

SEQ ID NO: 140331 - RNA, 45 nt, Homo sapiens
ggcaugggugaaguuguugaaggagcugcugggaagaaaugccaa

SEQ ID NO: 140332 - RNA, 60 nt, Homo sapiens
uucacuuaauugagaagcugacucaguuucuuaauauuuguagugcuugguuuaagaggc

SEQ ID NO: 140333 - RNA, 33 nt, Homo sapiens
acauuccaagggguuuaggaacucuggaaccag

SEQ ID NO: 140334 - RNA, 54 nt, Homo sapiens
uggcaggaaucgagcccacuggaaacauggugaagcagccagccaaguucacug

SEQ ID NO: 140335 - RNA, 57 nt, Homo sapiens
uggacaccaucagcgccgggcaaggagacgugaugguguuuguugaggacccagaag

SEQ ID NO: 140336 - RNA, 40 nt, Homo sapiens
cuuauucuagacaccuugugugugccaucaugggagggua

SEQ ID NO: 140337 - RNA, 48 nt, Homo sapiens
agcacaucuccaagagcccauuugaagugaguguugacaaggcccagg

SEQ ID NO: 140338 - RNA, 52 nt, Homo sapiens
gggugacauugguguggagguggaagauccccaggggaagaacaccguggag

SEQ ID NO: 140339 - RNA, 59 nt, Homo sapiens
gaccuuccuguauagagauuugucaaauuuucaguguuagauuuggaaaggaaaagcca

SEQ ID NO: 140340 - RNA, 47 nt, Homo sapiens
gaaaugaaaucagcaaugguguuuacugcuaauuauugccuuuauag

SEQ ID NO: 140341 - RNA, 45 nt, Homo sapiens
uucaagguugacaccaaagcugcaggaaguggggagcucggugua

SEQ ID NO: 140342 - RNA, 44 nt, Homo sapiens
gucaggcugugcccugaggguagccgagguucuagacugcccag

SEQ ID NO: 140343 - RNA, 48 nt, Homo sapiens
gggucuacgcauucgaguauuaccccagcaccccggggagauacagca

SEQ ID NO: 140344 - RNA, 45 nt, Homo sapiens
cuuggggcccugggcuccauggugggauugucgggcggucagcgg

SEQ ID NO: 140345 - RNA, 62 nt, Homo sapiens
gauggaucgugugaugucaaauacuggcccaaggagccuggcgaauaugcuguucacaucau

SEQ ID NO: 140346 - RNA, 55 nt, Homo sapiens
uggucugaaggcaaaugaaccuacacacuucacgguggacuguacugaggcuggg

SEQ ID NO: 140347 - RNA, 46 nt, Homo sapiens
guuggcauuaagugugaugcccggguguuaagugaagaugaggaag

SEQ ID NO: 140348 - RNA, 45 nt, Homo sapiens
cauuuuaucagagaaaugcucaguucuugauauucaggcccuaau

SEQ ID NO: 140349 - RNA, 47 nt, Homo sapiens
cccuuuacaaaaugcaggauuucacaugugaucuuaccaucuaggcu

SEQ ID NO: 140350 - RNA, 44 nt, Homo sapiens
agucuccccuguccgugagaagaaugagggaucuugaggggauu

SEQ ID NO: 140351 - RNA, 45 nt, Homo sapiens
uaaaagcccuuucacuguggguguugcugcaccgcuggaucugag

SEQ ID NO: 140352 - RNA, 44 nt, Homo sapiens
ggauaucaaguuaacaccaaaaguaaguaaauaagagacgacag

SEQ ID NO: 140353 - RNA, 44 nt, Homo sapiens
gugaugggaccugcuccgucucuuaccuucccacaaaacccggg

SEQ ID NO: 140354 - RNA, 46 nt, Homo sapiens
cguggacaccagcaggaucaaagucuuuggaccaggaauagaaggg

SEQ ID NO: 140355 - RNA, 50 nt, Homo sapiens
aucuucugggagcggugcaccuagcuaagaguuaugguccuguuaauaaa

SEQ ID NO: 140356 - RNA, 49 nt, Homo sapiens
cugccgggaaggguaaagugaccugcacgguucugaccccagauggcac

SEQ ID NO: 140357 - RNA, 45 nt, Homo sapiens
ucagaaucuguuuuuagcccauaguggguuuuaucugguugguua

SEQ ID NO: 140358 - RNA, 46 nt, Homo sapiens; identical to SEQ ID NO: 46009

SEQ ID NO: 140359 - RNA, 45 nt, Homo sapiens
ccugggauuuaagccuuuugaccuggucauuccguuugcugucag

SEQ ID NO: 140360 - RNA, 61 nt, Homo sapiens
uaagcugagucagcaggcccagcagggcuccaccauucaggggcauccgggcagccugcag

SEQ ID NO: 140361 - RNA, 51 nt, Homo sapiens
caaaaauguauuaucugcuucuauuuaaauauucuaaagcggcagauggag

SEQ ID NO: 140362 - RNA, 50 nt, Homo sapiens
cuuuucagauguuucucucuguaucuacaaacauacauauaauuuuauuc

SEQ ID NO: 140363 - RNA, 42 nt, Homo sapiens
ugaacuaccccaacaguggaaguguuucugcauacgguccag

SEQ ID NO: 140364 - RNA, 44 nt, Homo sapiens
cucaccuugcuguguucagguuaugcuuucaguggguuauaagg

SEQ ID NO: 140365 - RNA, 42 nt, Homo sapiens
aucccccgggaagugggcgaacaucuggucagcaucaagaaa

SEQ ID NO: 140366 - RNA, 147 nt, Homo sapiens
gcaaacgaggccgccauugcuuucuuucugcuauguagaaauagauugaggcguaagggucggauguccuuucuccauucaucaggcucccucuuccugaggagcugcugucagaacagccuggggcugcuguguugcagguuaugg

SEQ ID NO: 140367 - RNA, 35 nt, Homo sapiens
uuugcucacgcaugguuuccccucugccauuggga

SEQ ID NO: 140368 - RNA, 41 nt, Homo sapiens
auauguucaccuuuuucucuaacuuugucuuguugccuaaa

SEQ ID NO: 140369 - RNA, 42 nt, Homo sapiens
accauaaaaaugggucgugcgguguaucuuauauugcccaag

SEQ ID NO: 140370 - RNA, 46 nt, Homo sapiens
agguguccaucaaguucaaugaugagcacaucccggaaagccccua

SEQ ID NO: 140371 - RNA, 42 nt, Homo sapiens
gauagaucguuauuaugcccauuuuacagaugaggaaacuga

SEQ ID NO: 140372 - RNA, 55 nt, Homo sapiens
cagcauaacauaaaacuguguucguguucgugagugcaugacuuuguuagcugca

SEQ ID NO: 140373 - RNA, 64 nt, Homo sapiens
aaccagccagcauccuuugcuauaagguugaauggcgcaaaaggcaagauugaugcaaaggugc

SEQ ID NO: 140374 - RNA, 37 nt, Homo sapiens
uucagugccaaaggacguagggugcacagcuucaugg

SEQ ID NO: 140375 - RNA, 63 nt, Homo sapiens
guucgcuucaucccucaugagaaugguguccacaccaucgaugucaaguucaaugggagccac

SEQ ID NO: 140376 - RNA, 41 nt, Homo sapiens
cauuacuguuaguugugauucagauuccuuccucugccaag

SEQ ID NO: 140377 - RNA, 43 nt, Homo sapiens
aacagguggcaucggguggugcgcagugagugcgucacuguua

SEQ ID NO: 140378 - RNA, 45 nt, Homo sapiens
gugaggggugaguggcugcaugguugccuggcauccagcccuagg

SEQ ID NO: 140379 - RNA, 74 nt, Homo sapiens
ccggcuccacgcugaacucugggccugcggcuugccuuuugugaaaggcaugguaucauuuuaccguaagugau

SEQ ID NO: 140380 - RNA, 45 nt, Homo sapiens
gcuggggcagugucuagggcucuggcagaagcauagcccugcaug

SEQ ID NO: 140381 - RNA, 46 nt, Homo sapiens
uacggugggcccaaccacaucgugggcagucccuucaaggccaagg

SEQ ID NO: 140382 - RNA, 44 nt, Homo sapiens
ucucaaauccuggagagaguucuugugguugcuuuuguugcuug

SEQ ID NO: 140383 - RNA, 55 nt, Homo sapiens
aguacacuaggugcaaaccagaacucuugguggaacagaccagccacugcagcag

SEQ ID NO: 140384 - RNA, 66 nt, Homo sapiens
augagacugacauuucaaaaaaacaaaacuggcuagccugagcugcugguucacucuucagcauuu

SEQ ID NO: 140385 - RNA, 61 nt, Homo sapiens
aguggaacagcccggagccugaugugaaaggaccacggguguuguaagcugggacacggaa

SEQ ID NO: 140386 - RNA, 40 nt, Homo sapiens
ugaaaaauauugaaagccacccaagugcucagcaguaagg

SEQ ID NO: 140387 - RNA, 56 nt, Homo sapiens
aggcaaaugcuacgaagaagaaagcagggacggggcauggggguggggugcggugu

SEQ ID NO: 140388 - RNA, 71 nt, Homo sapiens
cccucuugacuuacuguaggugugaucagcacuggaaaagaugccugccccugcugccacauaugaaagag

SEQ ID NO: 140389 - RNA, 83 nt, Homo sapiens
aauuucaagauuguggaguuggacugaaugcugcacaguucaaacagcugcuuauuucggcugugaaggaccuguuuggggag

SEQ ID NO: 140390 - RNA, 45 nt, Homo sapiens
cuaauaugccuucuguuugacaaggaacacguuagacaaaugauu

SEQ ID NO: 140391 - RNA, 48 nt, Homo sapiens
uuuguaaaccacguauccaacaaaggacuauagugucuagaauauaua

SEQ ID NO: 140392 - RNA, 76 nt, Homo sapiens
ugaagagaagaccuugucagccaucuugagaauauguagcagguaugacagagagugggaaauuucuaguauaaca

SEQ ID NO: 140393 - RNA, 46 nt, Homo sapiens
gguucauugcuauuauugcagugucauguucuguaauagaaaguaa

SEQ ID NO: 140394 - RNA, 25 nt, Homo sapiens
aaaaagucuuucaugccccugucua

SEQ ID NO: 140395 - RNA, 41 nt, Homo sapiens
cuccacuccauaggugacccacaauaauuguuggcugaaug

SEQ ID NO: 140396 - RNA, 74 nt, Homo sapiens
guuuauugcugguaguaaagucauuuugcauuagaggauuacuaaauacauuauagccugaaagaaucuugggc

SEQ ID NO: 140397 - RNA, 46 nt, Homo sapiens
auguuugggggggacuuccccacagcucgagacccucaaggcaauu

SEQ ID NO: 140398 - RNA, 34 nt, Homo sapiens
aauaguuguauuuauuugaaggcagugaggacca

SEQ ID NO: 140399 - RNA, 50 nt, Homo sapiens
aaaacaucauguagggugaccuaguuuccaaaccaauaaauaaguaguau
